United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 12

SEQ ID NO: 451107 - RNA, 21 nt, Brucella suis 1330
agaaauagggccagacauaga

SEQ ID NO: 451108 - RNA, 20 nt, Brucella suis 1330
acuuuuggcucgaaaaugcu

SEQ ID NO: 451109 - RNA, 16 nt, Brucella suis 1330
agaaaagcaaaagccc

SEQ ID NO: 451110 - RNA, 20 nt, Brucella suis 1330
acuucuuuauggcucagaga

SEQ ID NO: 451111 - RNA, 15 nt, Brucella suis 1330
acuucgggcgccuuc

SEQ ID NO: 451112 - RNA, 22 nt, Brucella suis 1330
acuucgccaaagauacgguuca

SEQ ID NO: 451113 - RNA, 15 nt, Brucella suis 1330
acuucgccaagcccu

SEQ ID NO: 451114 - RNA, 11 nt, Brucella suis 1330
acuuccagugg

SEQ ID NO: 451115 - RNA, 21 nt, Brucella suis 1330
acuucccgcgccucacccucc

SEQ ID NO: 451116 - RNA, 14 nt, Brucella suis 1330
acuuccgacaagcg

SEQ ID NO: 451117 - RNA, 13 nt, Brucella suis 1330
acuggcagcauga

SEQ ID NO: 451118 - RNA, 17 nt, Brucella suis 1330
acuggaucaccuguucc

SEQ ID NO: 451119 - RNA, 16 nt, Brucella suis 1330
acugcggcaacggcgc

SEQ ID NO: 451120 - RNA, 22 nt, Brucella suis 1330
acugauuuucaaaagcuggaug

SEQ ID NO: 451121 - RNA, 19 nt, Brucella suis 1330
acucggccgcguugcccau

SEQ ID NO: 451122 - RNA, 14 nt, Brucella suis 1330
acucgaagauggaa

SEQ ID NO: 451123 - RNA, 16 nt, Brucella suis 1330
acuccccuacucccuu

SEQ ID NO: 451124 - RNA, 14 nt, Brucella suis 1330
acgugacaucaagc

SEQ ID NO: 451125 - RNA, 23 nt, Brucella suis 1330
acguaggcgcggcguggaaagcu

SEQ ID NO: 451126 - RNA, 13 nt, Brucella suis 1330
acuaaucgcaaaa

SEQ ID NO: 451127 - RNA, 16 nt, Brucella suis 1330
acuaauucguucuugu

SEQ ID NO: 451128 - RNA, 22 nt, Brucella suis 1330
acuacagccuggcggcuauucc

SEQ ID NO: 451129 - RNA, 19 nt, Brucella suis 1330
acuauucaaacggcaucau

SEQ ID NO: 451130 - RNA, 14 nt, Brucella suis 1330
acgggugcgcugcc

SEQ ID NO: 451131 - RNA, 17 nt, Brucella suis 1330
acgguuuucggaaaaga

SEQ ID NO: 451132 - RNA, 20 nt, Brucella suis 1330
acgguuuucggaaaagaugc

SEQ ID NO: 451133 - RNA, 16 nt, Brucella suis 1330
acggcuggaaaugcgc

SEQ ID NO: 451134 - RNA, 15 nt, Brucella suis 1330
acggaucaggcgcca

SEQ ID NO: 451135 - RNA, 15 nt, Brucella suis 1330
acggacgccugccau

SEQ ID NO: 451136 - RNA, 22 nt, Brucella suis 1330
acgcuugcgcccgcgguuucuc

SEQ ID NO: 451137 - RNA, 15 nt, Brucella suis 1330
acgcuuggccucuuc

SEQ ID NO: 451138 - RNA, 17 nt, Brucella suis 1330
acgcuuggccucuucca

SEQ ID NO: 451139 - RNA, 20 nt, Brucella suis 1330
acgcuuggccucuuccagga

SEQ ID NO: 451140 - RNA, 18 nt, Brucella suis 1330
acgcuuuccaccggcuca

SEQ ID NO: 451141 - RNA, 20 nt, Brucella suis 1330
acgcuuuccggcaaaaaacu

SEQ ID NO: 451142 - RNA, 23 nt, Brucella suis 1330
acgcugaaugcggcaaucgcuuc

SEQ ID NO: 451143 - RNA, 20 nt, Brucella suis 1330
acgccauaagccggcaugaa

SEQ ID NO: 451144 - RNA, 17 nt, Brucella suis 1330
acgccauagacgcccca

SEQ ID NO: 451145 - RNA, 22 nt, Brucella suis 1330
acgccauccauguggaaggcga

SEQ ID NO: 451146 - RNA, 18 nt, Brucella suis 1330
acgcuacccauucauuuc

SEQ ID NO: 451147 - RNA, 16 nt, Brucella suis 1330
acgccaaccaaagaaa

SEQ ID NO: 451148 - RNA, 19 nt, Brucella suis 1330
acgccaaccaaagaaaaaa

SEQ ID NO: 451149 - RNA, 21 nt, Brucella suis 1330
acgcacugcaagauaggccca

SEQ ID NO: 451150 - RNA, 15 nt, Brucella suis 1330
acgcaauggagcagg

SEQ ID NO: 451151 - RNA, 16 nt, Brucella suis 1330
acgcaauggagcagga

SEQ ID NO: 451152 - RNA, 23 nt, Brucella suis 1330
acgcaaugugcgggcuucuucca

SEQ ID NO: 451153 - RNA, 15 nt, Brucella suis 1330
acgauggugcggcgc

SEQ ID NO: 451154 - RNA, 13 nt, Brucella suis 1330
acgauggaaggaa

SEQ ID NO: 451155 - RNA, 17 nt, Brucella suis 1330
acgauggaaggaaagcc

SEQ ID NO: 451156 - RNA, 20 nt, Brucella suis 1330
acgaugauggccgggaaugc

SEQ ID NO: 451157 - RNA, 13 nt, Brucella suis 1330
acgaugacccagc

SEQ ID NO: 451158 - RNA, 14 nt, Brucella suis 1330
acgaucuccaguaa

SEQ ID NO: 451159 - RNA, 13 nt, Brucella suis 1330
acgauacagccca

SEQ ID NO: 451160 - RNA, 16 nt, Brucella suis 1330
acgaggccgaccagaa

SEQ ID NO: 451161 - RNA, 17 nt, Brucella suis 1330
acgaggccgaccagaac

SEQ ID NO: 451162 - RNA, 14 nt, Brucella suis 1330
acgaaggaucaggu

SEQ ID NO: 451163 - RNA, 20 nt, Brucella suis 1330
acgaaccgaaaccgugacau

SEQ ID NO: 451164 - RNA, 22 nt, Brucella suis 1330
acgaaaugaacaucggcgcgcu

SEQ ID NO: 451165 - RNA, 20 nt, Brucella suis 1330
acgaaaugggggccacgggc

SEQ ID NO: 451166 - RNA, 13 nt, Brucella suis 1330
accuugccgggcg

SEQ ID NO: 451167 - RNA, 11 nt, Brucella suis 1330
accuucgaguu

SEQ ID NO: 451168 - RNA, 22 nt, Brucella suis 1330
accuucgaguucgccagcaccu

SEQ ID NO: 451169 - RNA, 14 nt, Brucella suis 1330
accugacuugaagu

SEQ ID NO: 451170 - RNA, 15 nt, Brucella suis 1330
accgggcuucuuguu

SEQ ID NO: 451171 - RNA, 14 nt, Brucella suis 1330
accggggcagggca

SEQ ID NO: 451172 - RNA, 14 nt, Brucella suis 1330
accucgacggcggc

SEQ ID NO: 451173 - RNA, 15 nt, Brucella suis 1330
accggcuggcacaaa

SEQ ID NO: 451174 - RNA, 19 nt, Brucella suis 1330
accggcugggccuuguuuu

SEQ ID NO: 451175 - RNA, 12 nt, Brucella suis 1330
accggcgggagc

SEQ ID NO: 451176 - RNA, 23 nt, Brucella suis 1330
accggccuugauguccggcgcgc

SEQ ID NO: 451177 - RNA, 16 nt, Brucella suis 1330
accggcccaaaggccg

SEQ ID NO: 451178 - RNA, 18 nt, Brucella suis 1330
accggcccaaaggccgcg

SEQ ID NO: 451179 - RNA, 19 nt, Brucella suis 1330
accggcccacccaccgccu

SEQ ID NO: 451180 - RNA, 21 nt, Brucella suis 1330
accgcggguucccuguggaga

SEQ ID NO: 451181 - RNA, 12 nt, Brucella suis 1330
accgcgcggcgu

SEQ ID NO: 451182 - RNA, 16 nt, Brucella suis 1330
accgcgccggaaggcg

SEQ ID NO: 451183 - RNA, 19 nt, Brucella suis 1330
accgcgcaauaaugcagcg

SEQ ID NO: 451184 - RNA, 20 nt, Brucella suis 1330
accgcgacguauauccggua

SEQ ID NO: 451185 - RNA, 21 nt, Brucella suis 1330
accgcgaggaagccugcaccg

SEQ ID NO: 451186 - RNA, 18 nt, Brucella suis 1330
accgcgaaagccagaacc

SEQ ID NO: 451187 - RNA, 15 nt, Brucella suis 1330
accgccugccagccc

SEQ ID NO: 451188 - RNA, 12 nt, Brucella suis 1330
accgccuguccg

SEQ ID NO: 451189 - RNA, 21 nt, Brucella suis 1330
accgccuguccggccugcgcc

SEQ ID NO: 451190 - RNA, 19 nt, Brucella suis 1330
accgccaaggaacgcggcc

SEQ ID NO: 451191 - RNA, 17 nt, Brucella suis 1330
accgcacgcaaggcggc

SEQ ID NO: 451192 - RNA, 12 nt, Brucella suis 1330
accgauccgcaa

SEQ ID NO: 451193 - RNA, 22 nt, Brucella suis 1330
accgauccgcaacucauggaag

SEQ ID NO: 451194 - RNA, 14 nt, Brucella suis 1330
accgauaccggauc

SEQ ID NO: 451195 - RNA, 14 nt, Brucella suis 1330
accgauauagagca

SEQ ID NO: 451196 - RNA, 13 nt, Brucella suis 1330
acccguuccuugc

SEQ ID NO: 451197 - RNA, 22 nt, Brucella suis 1330
acccggcgucacgucauaggca

SEQ ID NO: 451198 - RNA, 22 nt, Brucella suis 1330
acccgcuccccccauucaugca

SEQ ID NO: 451199 - RNA, 19 nt, Brucella suis 1330
accccuuccuugccgggaa

SEQ ID NO: 451200 - RNA, 19 nt, Brucella suis 1330
acccaugucgaaagcccug

SEQ ID NO: 451201 - RNA, 15 nt, Brucella suis 1330
acccaugccuuucag

SEQ ID NO: 451202 - RNA, 16 nt, Brucella suis 1330
acccaccgccugcagc

SEQ ID NO: 451203 - RNA, 20 nt, Brucella suis 1330
accauuucccgguuuuucca

SEQ ID NO: 451204 - RNA, 16 nt, Brucella suis 1330
accauucugcccagaa

SEQ ID NO: 451205 - RNA, 10 nt, Brucella suis 1330
accauucaca

SEQ ID NO: 451206 - RNA, 23 nt, Brucella suis 1330
acccaauagccgagauagacaug

SEQ ID NO: 451207 - RNA, 19 nt, Brucella suis 1330
accaucacgacauugauau

SEQ ID NO: 451208 - RNA, 22 nt, Brucella suis 1330
accaucaucuucaccuguucgg

SEQ ID NO: 451209 - RNA, 15 nt, Brucella suis 1330
accaccuuccugccu

SEQ ID NO: 451210 - RNA, 11 nt, Brucella suis 1330
accaccggccu

SEQ ID NO: 451211 - RNA, 14 nt, Brucella suis 1330
accacauugcccca

SEQ ID NO: 451212 - RNA, 15 nt, Brucella suis 1330
accacauugccccac

SEQ ID NO: 451213 - RNA, 12 nt, Brucella suis 1330
acauugccuucg

SEQ ID NO: 451214 - RNA, 16 nt, Brucella suis 1330
acaugcuuuaugcaag

SEQ ID NO: 451215 - RNA, 14 nt, Brucella suis 1330
acaugcaugacacc

SEQ ID NO: 451216 - RNA, 16 nt, Brucella suis 1330
acaugaugaucgccag

SEQ ID NO: 451217 - RNA, 22 nt, Brucella suis 1330
acaucuuauaaaaaggccgcuc

SEQ ID NO: 451218 - RNA, 17 nt, Brucella suis 1330
acauaggcgaucaccuc

SEQ ID NO: 451219 - RNA, 17 nt, Brucella suis 1330
acauagaaaucaaccuc

SEQ ID NO: 451220 - RNA, 14 nt, Brucella suis 1330
acauauuugccaua

SEQ ID NO: 451221 - RNA, 19 nt, Brucella suis 1330
acauccauaugcagcggca

SEQ ID NO: 451222 - RNA, 20 nt, Brucella suis 1330
acauccaucggcucauccuc

SEQ ID NO: 451223 - RNA, 18 nt, Brucella suis 1330
acagcggucgaaaccuug

SEQ ID NO: 451224 - RNA, 14 nt, Brucella suis 1330
acagcggcgcgccu

SEQ ID NO: 451225 - RNA, 17 nt, Brucella suis 1330
acagcgcgaacaugccu

SEQ ID NO: 451226 - RNA, 20 nt, Brucella suis 1330
acagcgcgaacaugccugcc

SEQ ID NO: 451227 - RNA, 15 nt, Brucella suis 1330
acagccccgcaauaa

SEQ ID NO: 451228 - RNA, 19 nt, Brucella suis 1330
acagccccgcaauaacgaa

SEQ ID NO: 451229 - RNA, 20 nt, Brucella suis 1330
acagaucaugaggacauuca

SEQ ID NO: 451230 - RNA, 12 nt, Brucella suis 1330
acagaucggcaa

SEQ ID NO: 451231 - RNA, 16 nt, Brucella suis 1330
acacucugccugcccu

SEQ ID NO: 451232 - RNA, 18 nt, Brucella suis 1330
acacucugccugcccucg

SEQ ID NO: 451233 - RNA, 18 nt, Brucella suis 1330
acaccgaacugggcggcc

SEQ ID NO: 451234 - RNA, 14 nt, Brucella suis 1330
acacaucgcccuga

SEQ ID NO: 451235 - RNA, 13 nt, Brucella suis 1330
acaaucuugccaa

SEQ ID NO: 451236 - RNA, 20 nt, Brucella suis 1330
acaaugguuauacucggcgu

SEQ ID NO: 451237 - RNA, 19 nt, Brucella suis 1330
acacaaucgccggaaccgc

SEQ ID NO: 451238 - RNA, 17 nt, Brucella suis 1330
acaacgcgcagcaaagc

SEQ ID NO: 451239 - RNA, 17 nt, Brucella suis 1330
acaagaauaggagccgg

SEQ ID NO: 451240 - RNA, 22 nt, Brucella suis 1330
acaagagggauuuucguugcuu

SEQ ID NO: 451241 - RNA, 15 nt, Brucella suis 1330
aauggggggcaggca

SEQ ID NO: 451242 - RNA, 20 nt, Brucella suis 1330
aauggucugguugaguuccg

SEQ ID NO: 451243 - RNA, 13 nt, Brucella suis 1330
aauugcuccagcc

SEQ ID NO: 451244 - RNA, 21 nt, Brucella suis 1330
aauuugcagaacgucucgggc

SEQ ID NO: 451245 - RNA, 16 nt, Brucella suis 1330
aauuuguaguucaggc

SEQ ID NO: 451246 - RNA, 19 nt, Brucella suis 1330
aauggcugucaaugcagcg

SEQ ID NO: 451247 - RNA, 14 nt, Brucella suis 1330
aaugcuggccacca

SEQ ID NO: 451248 - RNA, 19 nt, Brucella suis 1330
aaugccguucuuggccaug

SEQ ID NO: 451249 - RNA, 21 nt, Brucella suis 1330
aaugcguaaaaauaaagaaau

SEQ ID NO: 451250 - RNA, 16 nt, Brucella suis 1330
aaugccgaagccaggu

SEQ ID NO: 451251 - RNA, 23 nt, Brucella suis 1330
aaugccccgcaccgacaaaaaca

SEQ ID NO: 451252 - RNA, 17 nt, Brucella suis 1330
aaugcauggaggcaagc

SEQ ID NO: 451253 - RNA, 18 nt, Brucella suis 1330
aaugaaagcaacgcccuu

SEQ ID NO: 451254 - RNA, 12 nt, Brucella suis 1330
aaugaaucagac

SEQ ID NO: 451255 - RNA, 14 nt, Brucella suis 1330
aaucguaucgccaa

SEQ ID NO: 451256 - RNA, 22 nt, Brucella suis 1330
aaucggcacuucgccaaagaua

SEQ ID NO: 451257 - RNA, 15 nt, Brucella suis 1330
aaucagccagaagac

SEQ ID NO: 451258 - RNA, 23 nt, Brucella suis 1330
aaucaggauaucgccguccuuug

SEQ ID NO: 451259 - RNA, 19 nt, Brucella suis 1330
aaucaggcaggcgaaucuc

SEQ ID NO: 451260 - RNA, 16 nt, Brucella suis 1330
aaucagggauagaaug

SEQ ID NO: 451261 - RNA, 17 nt, Brucella suis 1330
aauagaugagcugguuu

SEQ ID NO: 451262 - RNA, 11 nt, Brucella suis 1330
aauagccgaga

SEQ ID NO: 451263 - RNA, 20 nt, Brucella suis 1330
aauagcgcuuggaacguaca

SEQ ID NO: 451264 - RNA, 20 nt, Brucella suis 1330
aauagcggcgaguugccacg

SEQ ID NO: 451265 - RNA, 12 nt, Brucella suis 1330
aauaguuagagc

SEQ ID NO: 451266 - RNA, 14 nt, Brucella suis 1330
aauaagcugauaaa

SEQ ID NO: 451267 - RNA, 16 nt, Brucella suis 1330
aauaagcuuuucauuu

SEQ ID NO: 451268 - RNA, 13 nt, Brucella suis 1330
aauaaugccaagu

SEQ ID NO: 451269 - RNA, 18 nt, Brucella suis 1330
aauacccaugccuuucag

SEQ ID NO: 451270 - RNA, 20 nt, Brucella suis 1330
aauacccaugccuuucaggu

SEQ ID NO: 451271 - RNA, 15 nt, Brucella suis 1330
aagugcauaugauga

SEQ ID NO: 451272 - RNA, 18 nt, Brucella suis 1330
aagugcggucugcuugcc

SEQ ID NO: 451273 - RNA, 21 nt, Brucella suis 1330
aagucguccugugcggcugca

SEQ ID NO: 451274 - RNA, 23 nt, Brucella suis 1330
aagucacgauggcccagcgguuu

SEQ ID NO: 451275 - RNA, 13 nt, Brucella suis 1330
aagggcgccagcg

SEQ ID NO: 451276 - RNA, 22 nt, Brucella suis 1330
aagggccgcaucggaagggcaa

SEQ ID NO: 451277 - RNA, 18 nt, Brucella suis 1330
aagggccggucgugccag

SEQ ID NO: 451278 - RNA, 16 nt, Brucella suis 1330
aaggcuccggcauuau

SEQ ID NO: 451279 - RNA, 23 nt, Brucella suis 1330
aaggcucggcaaagggaauacca

SEQ ID NO: 451280 - RNA, 15 nt, Brucella suis 1330
aaggccgggaaaacc

SEQ ID NO: 451281 - RNA, 16 nt, Brucella suis 1330
aaggccgggucaggcu

SEQ ID NO: 451282 - RNA, 15 nt, Brucella suis 1330
aaggccggguuuuuc

SEQ ID NO: 451283 - RNA, 20 nt, Brucella suis 1330
aaggcccucgccgacccugu

SEQ ID NO: 451284 - RNA, 22 nt, Brucella suis 1330
aaggccgaggcaaccgccucgg

SEQ ID NO: 451285 - RNA, 16 nt, Brucella suis 1330
aaggccauuucauuau

SEQ ID NO: 451286 - RNA, 16 nt, Brucella suis 1330
aaggaaggucagaaga

SEQ ID NO: 451287 - RNA, 18 nt, Brucella suis 1330
aaggaaggucagaagacc

SEQ ID NO: 451288 - RNA, 22 nt, Brucella suis 1330
aaggaaugggcggggagcaggc

SEQ ID NO: 451289 - RNA, 18 nt, Brucella suis 1330
aagcgguuccuguuuuaa

SEQ ID NO: 451290 - RNA, 21 nt, Brucella suis 1330
aagcgguucgugaagccgcuu

SEQ ID NO: 451291 - RNA, 19 nt, Brucella suis 1330
aagcggcgucagcagguug

SEQ ID NO: 451292 - RNA, 20 nt, Brucella suis 1330
aagcggcgucagcagguuga

SEQ ID NO: 451293 - RNA, 22 nt, Brucella suis 1330
aagcgccuacgcagggaaauca

SEQ ID NO: 451294 - RNA, 16 nt, Brucella suis 1330
aagcgcaucccgaaaa

SEQ ID NO: 451295 - RNA, 12 nt, Brucella suis 1330
aagcgccagaga

SEQ ID NO: 451296 - RNA, 13 nt, Brucella suis 1330
aagcgcaaaacag

SEQ ID NO: 451297 - RNA, 21 nt, Brucella suis 1330
aagcgcaaagcccgccgaaga

SEQ ID NO: 451298 - RNA, 16 nt, Brucella suis 1330
aagccuguccuuguuc

SEQ ID NO: 451299 - RNA, 21 nt, Brucella suis 1330
aagccuucauugcgggaaggc

SEQ ID NO: 451300 - RNA, 13 nt, Brucella suis 1330
aagcgaaaugccg

SEQ ID NO: 451301 - RNA, 14 nt, Brucella suis 1330
aagauccucgccuu

SEQ ID NO: 451302 - RNA, 11 nt, Brucella suis 1330
aagaucagcca

SEQ ID NO: 451303 - RNA, 14 nt, Brucella suis 1330
aagaucaucgccgu

SEQ ID NO: 451304 - RNA, 13 nt, Brucella suis 1330
aagaggacaaggc

SEQ ID NO: 451305 - RNA, 12 nt, Brucella suis 1330
aagagccgcagg

SEQ ID NO: 451306 - RNA, 12 nt, Brucella suis 1330
aagagcgcucgc

SEQ ID NO: 451307 - RNA, 16 nt, Brucella suis 1330
aagagcguugcugccg

SEQ ID NO: 451308 - RNA, 17 nt, Brucella suis 1330
aagaggaacgacuuugg

SEQ ID NO: 451309 - RNA, 14 nt, Brucella suis 1330
aagauaaucagcag

SEQ ID NO: 451310 - RNA, 17 nt, Brucella suis 1330
aagauaaucagcagaag

SEQ ID NO: 451311 - RNA, 15 nt, Brucella suis 1330
aagaccuggaacggg

SEQ ID NO: 451312 - RNA, 13 nt, Brucella suis 1330
aagaccagcagga

SEQ ID NO: 451313 - RNA, 18 nt, Brucella suis 1330
aagaccagcaggaagaag

SEQ ID NO: 451314 - RNA, 14 nt, Brucella suis 1330
aagaauggcaagca

SEQ ID NO: 451315 - RNA, 12 nt, Brucella suis 1330
aacucgucgggu

SEQ ID NO: 451316 - RNA, 14 nt, Brucella suis 1330
aacggcugcaacaa

SEQ ID NO: 451317 - RNA, 17 nt, Brucella suis 1330
aacugcccccgaaaguu

SEQ ID NO: 451318 - RNA, 19 nt, Brucella suis 1330
aacugccuuuuacagcgua

SEQ ID NO: 451319 - RNA, 18 nt, Brucella suis 1330
aacuguguugccagcagc

SEQ ID NO: 451320 - RNA, 20 nt, Brucella suis 1330
aacuucgggcgccuucauuc

SEQ ID NO: 451321 - RNA, 22 nt, Brucella suis 1330
aacuuugugccgccgcugaaag

SEQ ID NO: 451322 - RNA, 23 nt, Brucella suis 1330
aagaaaccccggcagcgaaggcu

SEQ ID NO: 451323 - RNA, 19 nt, Brucella suis 1330
aacggcccaugagcuucaa

SEQ ID NO: 451324 - RNA, 14 nt, Brucella suis 1330
aacggccaagcagg

SEQ ID NO: 451325 - RNA, 15 nt, Brucella suis 1330
aacggccaagcagga

SEQ ID NO: 451326 - RNA, 16 nt, Brucella suis 1330
aacgcggguggaugga

SEQ ID NO: 451327 - RNA, 19 nt, Brucella suis 1330
aacgacuuuggccgucucu

SEQ ID NO: 451328 - RNA, 21 nt, Brucella suis 1330
aacgacuuuggccgucucuga

SEQ ID NO: 451329 - RNA, 14 nt, Brucella suis 1330
aacgcagcaucaca

SEQ ID NO: 451330 - RNA, 19 nt, Brucella suis 1330
aaccuugccgcguccuuuu

SEQ ID NO: 451331 - RNA, 14 nt, Brucella suis 1330
aaccuuugaaauaa

SEQ ID NO: 451332 - RNA, 14 nt, Brucella suis 1330
aaccuuuuuccuga

SEQ ID NO: 451333 - RNA, 19 nt, Brucella suis 1330
aaccugcucauaaacgcug

SEQ ID NO: 451334 - RNA, 15 nt, Brucella suis 1330
aaccugcccgucuuc

SEQ ID NO: 451335 - RNA, 19 nt, Brucella suis 1330
aaccguccgguugcaggcg

SEQ ID NO: 451336 - RNA, 13 nt, Brucella suis 1330
aaccgucuugaac

SEQ ID NO: 451337 - RNA, 18 nt, Brucella suis 1330
aaccgucuugaacagacc

SEQ ID NO: 451338 - RNA, 16 nt, Brucella suis 1330
aaccgugccagauggc

SEQ ID NO: 451339 - RNA, 22 nt, Brucella suis 1330
aaccguguucgcacaagaagca

SEQ ID NO: 451340 - RNA, 23 nt, Brucella suis 1330
aaccccaguucguugugccagaa

SEQ ID NO: 451341 - RNA, 14 nt, Brucella suis 1330
aaccaguugaagcu

SEQ ID NO: 451342 - RNA, 13 nt, Brucella suis 1330
aaccauauaaagc

SEQ ID NO: 451343 - RNA, 19 nt, Brucella suis 1330
aaccagcggccaucuucca

SEQ ID NO: 451344 - RNA, 15 nt, Brucella suis 1330
aaccagcgacagggu

SEQ ID NO: 451345 - RNA, 23 nt, Brucella suis 1330
aaccaccuuccugccuuugaaga

SEQ ID NO: 451346 - RNA, 14 nt, Brucella suis 1330
aaccaccuuguugc

SEQ ID NO: 451347 - RNA, 20 nt, Brucella suis 1330
aacaguuugagcaugaugcc

SEQ ID NO: 451348 - RNA, 14 nt, Brucella suis 1330
aacaguuuuuugaa

SEQ ID NO: 451349 - RNA, 14 nt, Brucella suis 1330
cggcgguugugcgc

SEQ ID NO: 451350 - RNA, 16 nt, Brucella suis 1330
cggcgguugugcgccc

SEQ ID NO: 451351 - RNA, 19 nt, Brucella suis 1330
cggcgguucggcugccuug

SEQ ID NO: 451352 - RNA, 23 nt, Brucella suis 1330
cggcggugcauucucgcccaagg

SEQ ID NO: 451353 - RNA, 13 nt, Brucella suis 1330
cggcgggcgggcg

SEQ ID NO: 451354 - RNA, 14 nt, Brucella suis 1330
cggcgggagcggca

SEQ ID NO: 451355 - RNA, 16 nt, Brucella suis 1330
cggcgggagcggcaca

SEQ ID NO: 451356 - RNA, 21 nt, Brucella suis 1330
cggcggcuuccucggcggcgc

SEQ ID NO: 451357 - RNA, 19 nt, Brucella suis 1330
cggcggcauccuugccggu

SEQ ID NO: 451358 - RNA, 11 nt, Brucella suis 1330
cggcgcgggcu

SEQ ID NO: 451359 - RNA, 16 nt, Brucella suis 1330
cggcgcggcaggaucg

SEQ ID NO: 451360 - RNA, 12 nt, Brucella suis 1330
cggcgcgcugca

SEQ ID NO: 451361 - RNA, 16 nt, Brucella suis 1330
cggcgcaucauccuga

SEQ ID NO: 451362 - RNA, 15 nt, Brucella suis 1330
cggcgcagcgcgacc

SEQ ID NO: 451363 - RNA, 19 nt, Brucella suis 1330
cggcgauaccagacgcgca

SEQ ID NO: 451364 - RNA, 21 nt, Brucella suis 1330
cggcgaguugccacgcgccgc

SEQ ID NO: 451365 - RNA, 17 nt, Brucella suis 1330
cggcgagacagacugga

SEQ ID NO: 451366 - RNA, 17 nt, Brucella suis 1330
cggcgaccgccuuuucc

SEQ ID NO: 451367 - RNA, 17 nt, Brucella suis 1330
cggcgaacgagcggcca

SEQ ID NO: 451368 - RNA, 15 nt, Brucella suis 1330
cggcgaaacgccugu

SEQ ID NO: 451369 - RNA, 20 nt, Brucella suis 1330
cggccugaaacagcauauug

SEQ ID NO: 451370 - RNA, 17 nt, Brucella suis 1330
cggccugaugcaaugcg

SEQ ID NO: 451371 - RNA, 14 nt, Brucella suis 1330
cggccugaugccuu

SEQ ID NO: 451372 - RNA, 14 nt, Brucella suis 1330
cggccugacggugc

SEQ ID NO: 451373 - RNA, 17 nt, Brucella suis 1330
cggccucggcaucgcuc

SEQ ID NO: 451374 - RNA, 15 nt, Brucella suis 1330
cggccucgccugcaa

SEQ ID NO: 451375 - RNA, 17 nt, Brucella suis 1330
cggccggagcgcagauc

SEQ ID NO: 451376 - RNA, 17 nt, Brucella suis 1330
cggccaugcguugcugg

SEQ ID NO: 451377 - RNA, 13 nt, Brucella suis 1330
cggccaugcccau

SEQ ID NO: 451378 - RNA, 20 nt, Brucella suis 1330
cggccaugaagaucaauucc

SEQ ID NO: 451379 - RNA, 11 nt, Brucella suis 1330
cggccagggcu

SEQ ID NO: 451380 - RNA, 16 nt, Brucella suis 1330
cggccacccagcccga

SEQ ID NO: 451381 - RNA, 18 nt, Brucella suis 1330
cggcaucggaaccccaau

SEQ ID NO: 451382 - RNA, 20 nt, Brucella suis 1330
cggcauccgaggcgcgcagc

SEQ ID NO: 451383 - RNA, 21 nt, Brucella suis 1330
cggcauccgaggcgcgcagca

SEQ ID NO: 451384 - RNA, 14 nt, Brucella suis 1330
cggcauccuugccg

SEQ ID NO: 451385 - RNA, 16 nt, Brucella suis 1330
cggcaguccggcagca

SEQ ID NO: 451386 - RNA, 16 nt, Brucella suis 1330
cggcagguaagagcag

SEQ ID NO: 451387 - RNA, 17 nt, Brucella suis 1330
cggcagguaagagcaga

SEQ ID NO: 451388 - RNA, 12 nt, Brucella suis 1330
cggcagggccag

SEQ ID NO: 451389 - RNA, 15 nt, Brucella suis 1330
cggcaggcauucaga

SEQ ID NO: 451390 - RNA, 14 nt, Brucella suis 1330
cggcaggaucgcca

SEQ ID NO: 451391 - RNA, 18 nt, Brucella suis 1330
cggcagcgacccgcgccc

SEQ ID NO: 451392 - RNA, 20 nt, Brucella suis 1330
cggcagccuugagcuggucc

SEQ ID NO: 451393 - RNA, 17 nt, Brucella suis 1330
cggcagcgaaggcugcc

SEQ ID NO: 451394 - RNA, 19 nt, Brucella suis 1330
cggcagccucgacacgccg

SEQ ID NO: 451395 - RNA, 18 nt, Brucella suis 1330
cggcagacgugaccgccu

SEQ ID NO: 451396 - RNA, 19 nt, Brucella suis 1330
cggcagacgugaccgccug

SEQ ID NO: 451397 - RNA, 17 nt, Brucella suis 1330
cggcacgaugcgcagcc

SEQ ID NO: 451398 - RNA, 14 nt, Brucella suis 1330
cggcacgaucaggg

SEQ ID NO: 451399 - RNA, 20 nt, Brucella suis 1330
cgcuugcccgcauauugcuu

SEQ ID NO: 451400 - RNA, 15 nt, Brucella suis 1330
cgcuugcgcccgcgg

SEQ ID NO: 451401 - RNA, 12 nt, Brucella suis 1330
cgcuugaugacg

SEQ ID NO: 451402 - RNA, 18 nt, Brucella suis 1330
cgcuugaugacgccaucu

SEQ ID NO: 451403 - RNA, 20 nt, Brucella suis 1330
cgcuugccagcaccagcggc

SEQ ID NO: 451404 - RNA, 19 nt, Brucella suis 1330
cgcuucaucgcauccggcc

SEQ ID NO: 451405 - RNA, 21 nt, Brucella suis 1330
cgcuucaugauaaggccgcuu

SEQ ID NO: 451406 - RNA, 14 nt, Brucella suis 1330
cgcuggcgcggcgg

SEQ ID NO: 451407 - RNA, 15 nt, Brucella suis 1330
cgcuggccuugccau

SEQ ID NO: 451408 - RNA, 16 nt, Brucella suis 1330
cgcugccauugccgcg

SEQ ID NO: 451409 - RNA, 13 nt, Brucella suis 1330
cgcugcaacaaau

SEQ ID NO: 451410 - RNA, 21 nt, Brucella suis 1330
cgcugaggcggccggagcgca

SEQ ID NO: 451411 - RNA, 21 nt, Brucella suis 1330
cgcucucgucgagaagcauca

SEQ ID NO: 451412 - RNA, 13 nt, Brucella suis 1330
cgcucgccgccca

SEQ ID NO: 451413 - RNA, 19 nt, Brucella suis 1330
cgcucgaccgcaccucugg

SEQ ID NO: 451414 - RNA, 13 nt, Brucella suis 1330
cgcuccuauuucu

SEQ ID NO: 451415 - RNA, 14 nt, Brucella suis 1330
cgcuccauucccau

SEQ ID NO: 451416 - RNA, 21 nt, Brucella suis 1330
cgcucauauggaugccgccgc

SEQ ID NO: 451417 - RNA, 21 nt, Brucella suis 1330
cgcucaccuuuuccaccggcc

SEQ ID NO: 451418 - RNA, 13 nt, Brucella suis 1330
cgcucaacacucu

SEQ ID NO: 451419 - RNA, 18 nt, Brucella suis 1330
cgcucaaggccuguucca

SEQ ID NO: 451420 - RNA, 16 nt, Brucella suis 1330
cgcguugccuugcugg

SEQ ID NO: 451421 - RNA, 21 nt, Brucella suis 1330
cgcguugcggccgggccaacg

SEQ ID NO: 451422 - RNA, 15 nt, Brucella suis 1330
cgcgugcacgcgcag

SEQ ID NO: 451423 - RNA, 14 nt, Brucella suis 1330
cgcgugcacgcggg

SEQ ID NO: 451424 - RNA, 18 nt, Brucella suis 1330
cgcggcucucacgcgcag

SEQ ID NO: 451425 - RNA, 18 nt, Brucella suis 1330
cgcggcucaagcuccagc

SEQ ID NO: 451426 - RNA, 21 nt, Brucella suis 1330
cgcggcguggaaagcuggacc

SEQ ID NO: 451427 - RNA, 13 nt, Brucella suis 1330
cgcggaucggcag

SEQ ID NO: 451428 - RNA, 18 nt, Brucella suis 1330
cgcggauaucggcgcgga

SEQ ID NO: 451429 - RNA, 19 nt, Brucella suis 1330
cgcgcuuuccccgggcagc

SEQ ID NO: 451430 - RNA, 20 nt, Brucella suis 1330
cgcggaaaagcucgcguccc

SEQ ID NO: 451431 - RNA, 23 nt, Brucella suis 1330
cgcggaaaauguuccgcaccgca

SEQ ID NO: 451432 - RNA, 14 nt, Brucella suis 1330
cgcggaaugacaug

SEQ ID NO: 451433 - RNA, 16 nt, Brucella suis 1330
cgcggacaagcucgcg

SEQ ID NO: 451434 - RNA, 21 nt, Brucella suis 1330
cgcgcugcgacgagaugcgcu

SEQ ID NO: 451435 - RNA, 19 nt, Brucella suis 1330
cgcgcuccacauccacccg

SEQ ID NO: 451436 - RNA, 12 nt, Brucella suis 1330
cgcgcuccagau

SEQ ID NO: 451437 - RNA, 19 nt, Brucella suis 1330
cgcgcuaaaaagcgcgcgc

SEQ ID NO: 451438 - RNA, 20 nt, Brucella suis 1330
cgcgcuaaaaagcgcgcgca

SEQ ID NO: 451439 - RNA, 22 nt, Brucella suis 1330
cgcgcgguugauaucgcggauc

SEQ ID NO: 451440 - RNA, 18 nt, Brucella suis 1330
cgcgcggcuuccagcgcc

SEQ ID NO: 451441 - RNA, 14 nt, Brucella suis 1330
cgcgcggcuucugu

SEQ ID NO: 451442 - RNA, 18 nt, Brucella suis 1330
cgcgcggcaugaaagcgc

SEQ ID NO: 451443 - RNA, 22 nt, Brucella suis 1330
cgcgcgaccagguugcgccgau

SEQ ID NO: 451444 - RNA, 16 nt, Brucella suis 1330
cgcgcgaaaccaugga

SEQ ID NO: 451445 - RNA, 23 nt, Brucella suis 1330
cgcgccgcuggugcgauccacca

SEQ ID NO: 451446 - RNA, 14 nt, Brucella suis 1330
cgcgccgaaccggg

SEQ ID NO: 451447 - RNA, 16 nt, Brucella suis 1330
cgcgccgaaccgggcc

SEQ ID NO: 451448 - RNA, 17 nt, Brucella suis 1330
cgcgccgaaaaucggca

SEQ ID NO: 451449 - RNA, 18 nt, Brucella suis 1330
cgcgccagugcgccaccg

SEQ ID NO: 451450 - RNA, 15 nt, Brucella suis 1330
cgcgccaugcacccg

SEQ ID NO: 451451 - RNA, 13 nt, Brucella suis 1330
cgcgccaucggca

SEQ ID NO: 451452 - RNA, 18 nt, Brucella suis 1330
cgcgccagcacucugcca

SEQ ID NO: 451453 - RNA, 14 nt, Brucella suis 1330
cgcgcaucgcgcgc

SEQ ID NO: 451454 - RNA, 14 nt, Brucella suis 1330
cgcgcagcaaagcc

SEQ ID NO: 451455 - RNA, 19 nt, Brucella suis 1330
cgcgcagauauggcgccug

SEQ ID NO: 451456 - RNA, 21 nt, Brucella suis 1330
cgcgcaauaaugcagcgccgc

SEQ ID NO: 451457 - RNA, 18 nt, Brucella suis 1330
cgcgaaccgucgccagcu

SEQ ID NO: 451458 - RNA, 19 nt, Brucella suis 1330
cgcgaaccagauccaccgc

SEQ ID NO: 451459 - RNA, 13 nt, Brucella suis 1330
cgccuggccggcg

SEQ ID NO: 451460 - RNA, 14 nt, Brucella suis 1330
cgccuggcccggcu

SEQ ID NO: 451461 - RNA, 15 nt, Brucella suis 1330
cgccugccgcgcggg

SEQ ID NO: 451462 - RNA, 13 nt, Brucella suis 1330
cgccugccagccc

SEQ ID NO: 451463 - RNA, 13 nt, Brucella suis 1330
cgccugcagccgg

SEQ ID NO: 451464 - RNA, 17 nt, Brucella suis 1330
cgccugccauccgcccc

SEQ ID NO: 451465 - RNA, 18 nt, Brucella suis 1330
cgccugccauccgccccg

SEQ ID NO: 451466 - RNA, 19 nt, Brucella suis 1330
cgccugccauccgccccga

SEQ ID NO: 451467 - RNA, 14 nt, Brucella suis 1330
cgccugcaccaugg

SEQ ID NO: 451468 - RNA, 23 nt, Brucella suis 1330
cgccugcaauggaaaaggccugu

SEQ ID NO: 451469 - RNA, 18 nt, Brucella suis 1330
cgccucuucauccggcag

SEQ ID NO: 451470 - RNA, 16 nt, Brucella suis 1330
cgccucgacacccgga

SEQ ID NO: 451471 - RNA, 15 nt, Brucella suis 1330
cgccucgaauuccac

SEQ ID NO: 451472 - RNA, 18 nt, Brucella suis 1330
cgccucauaaucagccuc

SEQ ID NO: 451473 - RNA, 13 nt, Brucella suis 1330
cgccgucagcccc

SEQ ID NO: 451474 - RNA, 13 nt, Brucella suis 1330
cgccggguuuugc

SEQ ID NO: 451475 - RNA, 20 nt, Brucella suis 1330
cgccggguucgcucuggcuu

SEQ ID NO: 451476 - RNA, 23 nt, Brucella suis 1330
cgccggggggaauggcgcgcgcg

SEQ ID NO: 451477 - RNA, 15 nt, Brucella suis 1330
cgccggggccggaug

SEQ ID NO: 451478 - RNA, 16 nt, Brucella suis 1330
cgccggggcaggcucc

SEQ ID NO: 451479 - RNA, 15 nt, Brucella suis 1330
cgccgccgcgcggca

SEQ ID NO: 451480 - RNA, 12 nt, Brucella suis 1330
cgccgccgcgac

SEQ ID NO: 451481 - RNA, 15 nt, Brucella suis 1330
cgccgaacccgccga

SEQ ID NO: 451482 - RNA, 19 nt, Brucella suis 1330
cgccgaaaaucggcacuuc

SEQ ID NO: 451483 - RNA, 15 nt, Brucella suis 1330
cgccgaaacgcccga

SEQ ID NO: 451484 - RNA, 14 nt, Brucella suis 1330
cgcccgucucgcag

SEQ ID NO: 451485 - RNA, 16 nt, Brucella suis 1330
cgcccguuguucugga

SEQ ID NO: 451486 - RNA, 14 nt, Brucella suis 1330
cgcccgugccgcgu

SEQ ID NO: 451487 - RNA, 21 nt, Brucella suis 1330
cgcccgugccgcguucagcca

SEQ ID NO: 451488 - RNA, 17 nt, Brucella suis 1330
cgcccgucgaccagcgc

SEQ ID NO: 451489 - RNA, 18 nt, Brucella suis 1330
cgcccgguuccggcguca

SEQ ID NO: 451490 - RNA, 23 nt, Brucella suis 1330
cgcccgcggccacaagcgccggu

SEQ ID NO: 451491 - RNA, 12 nt, Brucella suis 1330
cgccccgugauc

SEQ ID NO: 451492 - RNA, 13 nt, Brucella suis 1330
cgccccauucgau

SEQ ID NO: 451493 - RNA, 17 nt, Brucella suis 1330
cgcccaugaucgcgcca

SEQ ID NO: 451494 - RNA, 18 nt, Brucella suis 1330
cgccauugaccgccucga

SEQ ID NO: 451495 - RNA, 22 nt, Brucella suis 1330
cgccauugcgcguugcgucggc

SEQ ID NO: 451496 - RNA, 17 nt, Brucella suis 1330
cgccauauugggagcgc

SEQ ID NO: 451497 - RNA, 18 nt, Brucella suis 1330
cgccaguuuucgcggcag

SEQ ID NO: 451498 - RNA, 20 nt, Brucella suis 1330
cgccauaaagcaccaugagc

SEQ ID NO: 451499 - RNA, 21 nt, Brucella suis 1330
cgccagucauugacggcagcc

SEQ ID NO: 451500 - RNA, 15 nt, Brucella suis 1330
cgccagcucgccggc

SEQ ID NO: 451501 - RNA, 17 nt, Brucella suis 1330
cgccagcucgccggcuu

SEQ ID NO: 451502 - RNA, 17 nt, Brucella suis 1330
cgccagcggugcccuuu

SEQ ID NO: 451503 - RNA, 11 nt, Brucella suis 1330
cgccagcgccg

SEQ ID NO: 451504 - RNA, 15 nt, Brucella suis 1330
cgccagcccauucaa

SEQ ID NO: 451505 - RNA, 17 nt, Brucella suis 1330
cgccagcccauucaacc

SEQ ID NO: 451506 - RNA, 16 nt, Brucella suis 1330
cgccagcacucugcca

SEQ ID NO: 451507 - RNA, 19 nt, Brucella suis 1330
cgccagcacucugccaggc

SEQ ID NO: 451508 - RNA, 17 nt, Brucella suis 1330
cgccacuucccgcgccu

SEQ ID NO: 451509 - RNA, 22 nt, Brucella suis 1330
cgccagagcggcauauugcggc

SEQ ID NO: 451510 - RNA, 11 nt, Brucella suis 1330
cgccacuuccc

SEQ ID NO: 451511 - RNA, 18 nt, Brucella suis 1330
cgcauccgaaaugcgcgg

SEQ ID NO: 451512 - RNA, 13 nt, Brucella suis 1330
cgcauaagccccg

SEQ ID NO: 451513 - RNA, 18 nt, Brucella suis 1330
cgcaguugcaccgcccgg

SEQ ID NO: 451514 - RNA, 14 nt, Brucella suis 1330
aaacgguuuucgga

SEQ ID NO: 451515 - RNA, 22 nt, Brucella suis 1330
cgcagccuuucaaugucgccgg

SEQ ID NO: 451516 - RNA, 12 nt, Brucella suis 1330
cgcagccgucgu

SEQ ID NO: 451517 - RNA, 22 nt, Brucella suis 1330
cgcagccgccaacgaccagcug

SEQ ID NO: 451518 - RNA, 17 nt, Brucella suis 1330
cgcagcccggacaggcg

SEQ ID NO: 451519 - RNA, 20 nt, Brucella suis 1330
cgcagaccacccggccgccc

SEQ ID NO: 451520 - RNA, 21 nt, Brucella suis 1330
cgcacggucuugccggccuga

SEQ ID NO: 451521 - RNA, 18 nt, Brucella suis 1330
cgcaccgauggagcgccc

SEQ ID NO: 451522 - RNA, 20 nt, Brucella suis 1330
cgcaccgauggagcgcccga

SEQ ID NO: 451523 - RNA, 23 nt, Brucella suis 1330
cgcaccgauauagagcagcaccg

SEQ ID NO: 451524 - RNA, 16 nt, Brucella suis 1330
cgcacccuauuccccu

SEQ ID NO: 451525 - RNA, 13 nt, Brucella suis 1330
cgcaauggcgaca

SEQ ID NO: 451526 - RNA, 19 nt, Brucella suis 1330
cgcaauggcugucaaugca

SEQ ID NO: 451527 - RNA, 14 nt, Brucella suis 1330
cgcaauggccuugc

SEQ ID NO: 451528 - RNA, 19 nt, Brucella suis 1330
cgcaauaauuaugcaggaa

SEQ ID NO: 451529 - RNA, 21 nt, Brucella suis 1330
cgcaaguuccgcauugaugaa

SEQ ID NO: 451530 - RNA, 20 nt, Brucella suis 1330
cgcaaggaaagaucugcauc

SEQ ID NO: 451531 - RNA, 13 nt, Brucella suis 1330
cgcaagccaaagc

SEQ ID NO: 451532 - RNA, 17 nt, Brucella suis 1330
cgcaagccaaagcccgu

SEQ ID NO: 451533 - RNA, 18 nt, Brucella suis 1330
cgcaagccaaagcccgug

SEQ ID NO: 451534 - RNA, 13 nt, Brucella suis 1330
cgauuuccuugcc

SEQ ID NO: 451535 - RNA, 12 nt, Brucella suis 1330
cgauuaaaaaag

SEQ ID NO: 451536 - RNA, 16 nt, Brucella suis 1330
cgauggcgagcgcgcu

SEQ ID NO: 451537 - RNA, 16 nt, Brucella suis 1330
cgaugacggcgcggcg

SEQ ID NO: 451538 - RNA, 19 nt, Brucella suis 1330
cgaugacggcgcggcgcau

SEQ ID NO: 451539 - RNA, 18 nt, Brucella suis 1330
cgaugagccuucaucuuc

SEQ ID NO: 451540 - RNA, 12 nt, Brucella suis 1330
cgaugaccaccg

SEQ ID NO: 451541 - RNA, 18 nt, Brucella suis 1330
cgaugaagaccuggaacg

SEQ ID NO: 451542 - RNA, 20 nt, Brucella suis 1330
cgaucgccaguuucauuucc

SEQ ID NO: 451543 - RNA, 18 nt, Brucella suis 1330
cgauccuuguucuuggcg

SEQ ID NO: 451544 - RNA, 21 nt, Brucella suis 1330
cgauccgauucauuauucguc

SEQ ID NO: 451545 - RNA, 21 nt, Brucella suis 1330
cgaucauugccccaaggcgca

SEQ ID NO: 451546 - RNA, 18 nt, Brucella suis 1330
cgauccaauauugccuuc

SEQ ID NO: 451547 - RNA, 18 nt, Brucella suis 1330
cgaucagugccaccagau

SEQ ID NO: 451548 - RNA, 11 nt, Brucella suis 1330
cgaucaucaau

SEQ ID NO: 451549 - RNA, 17 nt, Brucella suis 1330
cgaucaucagcggcggg

SEQ ID NO: 451550 - RNA, 18 nt, Brucella suis 1330
cgaucacgaaagucugga

SEQ ID NO: 451551 - RNA, 15 nt, Brucella suis 1330
cgauauagagcagca

SEQ ID NO: 451552 - RNA, 24 nt, Brucella suis 1330
cgauaucaccaauauugcaggcga

SEQ ID NO: 451553 - RNA, 13 nt, Brucella suis 1330
cgauauccuggcc

SEQ ID NO: 451554 - RNA, 21 nt, Brucella suis 1330
cgauauccuggccuuccuuga

SEQ ID NO: 451555 - RNA, 16 nt, Brucella suis 1330
cgauaucgagauuggg

SEQ ID NO: 451556 - RNA, 13 nt, Brucella suis 1330
cgacgggagccgc

SEQ ID NO: 451557 - RNA, 13 nt, Brucella suis 1330
cgacgggcgagcg

SEQ ID NO: 451558 - RNA, 22 nt, Brucella suis 1330
cgacggcgugaugcgcaggcgc

SEQ ID NO: 451559 - RNA, 22 nt, Brucella suis 1330
cgacgcgcuaaaaagcgcgcgc

SEQ ID NO: 451560 - RNA, 14 nt, Brucella suis 1330
cgacgcccgccccc

SEQ ID NO: 451561 - RNA, 20 nt, Brucella suis 1330
cgaccuucgaguucgccagc

SEQ ID NO: 451562 - RNA, 15 nt, Brucella suis 1330
cgaccgggcuugcau

SEQ ID NO: 451563 - RNA, 23 nt, Brucella suis 1330
cgaccgcguucagaucgacgcag

SEQ ID NO: 451564 - RNA, 15 nt, Brucella suis 1330
cgaccgccuuuucca

SEQ ID NO: 451565 - RNA, 17 nt, Brucella suis 1330
cgaccgccuuuuccagu

SEQ ID NO: 451566 - RNA, 14 nt, Brucella suis 1330
cgacccguuugaag

SEQ ID NO: 451567 - RNA, 13 nt, Brucella suis 1330
cgaccauggcgca

SEQ ID NO: 451568 - RNA, 17 nt, Brucella suis 1330
cgaccauggcggaaccc

SEQ ID NO: 451569 - RNA, 22 nt, Brucella suis 1330
cgaccauuucccgguuuuucca

SEQ ID NO: 451570 - RNA, 14 nt, Brucella suis 1330
cgaccaccaccggg

SEQ ID NO: 451571 - RNA, 17 nt, Brucella suis 1330
cgacaggguaagcgccu

SEQ ID NO: 451572 - RNA, 18 nt, Brucella suis 1330
cgacaggguaagcgccuu

SEQ ID NO: 451573 - RNA, 21 nt, Brucella suis 1330
cgacagcggcgcgccugggcu

SEQ ID NO: 451574 - RNA, 19 nt, Brucella suis 1330
cgacagauugagauagccu

SEQ ID NO: 451575 - RNA, 21 nt, Brucella suis 1330
cgacagauugagauagccuug

SEQ ID NO: 451576 - RNA, 14 nt, Brucella suis 1330
cgacagcacugcca

SEQ ID NO: 451577 - RNA, 14 nt, Brucella suis 1330
cgacacguccggga

SEQ ID NO: 451578 - RNA, 20 nt, Brucella suis 1330
cgacaaucggaacaaacugg

SEQ ID NO: 451579 - RNA, 20 nt, Brucella suis 1330
cgacaaccacgcuugcgccc

SEQ ID NO: 451580 - RNA, 18 nt, Brucella suis 1330
cgaauuccacgaugagaa

SEQ ID NO: 451581 - RNA, 14 nt, Brucella suis 1330
cgaaugacuucauc

SEQ ID NO: 451582 - RNA, 15 nt, Brucella suis 1330
cgaaugacuucaucg

SEQ ID NO: 451583 - RNA, 21 nt, Brucella suis 1330
cgaauccacguuuggagcggc

SEQ ID NO: 451584 - RNA, 14 nt, Brucella suis 1330
cgaauaucuugaag

SEQ ID NO: 451585 - RNA, 18 nt, Brucella suis 1330
cgaaggcagccgugagca

SEQ ID NO: 451586 - RNA, 16 nt, Brucella suis 1330
cgaaggacuggaucac

SEQ ID NO: 451587 - RNA, 14 nt, Brucella suis 1330
cgaagcgguuuugc

SEQ ID NO: 451588 - RNA, 16 nt, Brucella suis 1330
cgaagaacaguccuga

SEQ ID NO: 451589 - RNA, 19 nt, Brucella suis 1330
cgaacugguucagccgcuc

SEQ ID NO: 451590 - RNA, 18 nt, Brucella suis 1330
cgaacugggcggccagcu

SEQ ID NO: 451591 - RNA, 15 nt, Brucella suis 1330
cgaaccgggccgcau

SEQ ID NO: 451592 - RNA, 16 nt, Brucella suis 1330
ccuuuuucaguuucau

SEQ ID NO: 451593 - RNA, 22 nt, Brucella suis 1330
ccuuuccaguuccauugcaacg

SEQ ID NO: 451594 - RNA, 13 nt, Brucella suis 1330
ccuuugccgcgcg

SEQ ID NO: 451595 - RNA, 22 nt, Brucella suis 1330
ccuuugcuucggccgacagaug

SEQ ID NO: 451596 - RNA, 12 nt, Brucella suis 1330
ccuuguggccac

SEQ ID NO: 451597 - RNA, 22 nt, Brucella suis 1330
ccuuggcaucaaccuuuucggc

SEQ ID NO: 451598 - RNA, 22 nt, Brucella suis 1330
ccuugcuggucguuugccucgg

SEQ ID NO: 451599 - RNA, 22 nt, Brucella suis 1330
ccuugacggagagagggccgcu

SEQ ID NO: 451600 - RNA, 19 nt, Brucella suis 1330
ccuugcgguccggccagag

SEQ ID NO: 451601 - RNA, 17 nt, Brucella suis 1330
ccuugcgguugcaacga

SEQ ID NO: 451602 - RNA, 19 nt, Brucella suis 1330
ccuucgccgucgagcagca

SEQ ID NO: 451603 - RNA, 16 nt, Brucella suis 1330
ccuucgcgccgccuuc

SEQ ID NO: 451604 - RNA, 13 nt, Brucella suis 1330
ccuuccugauuua

SEQ ID NO: 451605 - RNA, 15 nt, Brucella suis 1330
ccuuccugcggcagc

SEQ ID NO: 451606 - RNA, 21 nt, Brucella suis 1330
ccuuccugcggcagcgacccg

SEQ ID NO: 451607 - RNA, 19 nt, Brucella suis 1330
ccuuccguugcagcccaac

SEQ ID NO: 451608 - RNA, 23 nt, Brucella suis 1330
ccuuccguugcagcccaacccau

SEQ ID NO: 451609 - RNA, 18 nt, Brucella suis 1330
ccuucagcacauccugca

SEQ ID NO: 451610 - RNA, 15 nt, Brucella suis 1330
ccuucaggccgucga

SEQ ID NO: 451611 - RNA, 19 nt, Brucella suis 1330
ccuucacuucauugcgcuu

SEQ ID NO: 451612 - RNA, 16 nt, Brucella suis 1330
ccuucacauauugugc

SEQ ID NO: 451613 - RNA, 15 nt, Brucella suis 1330
ccuucaaagcgcgga

SEQ ID NO: 451614 - RNA, 15 nt, Brucella suis 1330
ccuucaacagcccga

SEQ ID NO: 451615 - RNA, 14 nt, Brucella suis 1330
ccuuauccugaugg

SEQ ID NO: 451616 - RNA, 13 nt, Brucella suis 1330
ccuuaaucccuua

SEQ ID NO: 451617 - RNA, 23 nt, Brucella suis 1330
ccugggccacggcgaaagcugcc

SEQ ID NO: 451618 - RNA, 12 nt, Brucella suis 1330
ccuggcuuuucu

SEQ ID NO: 451619 - RNA, 18 nt, Brucella suis 1330
ccuggcggcgugcaggcu

SEQ ID NO: 451620 - RNA, 21 nt, Brucella suis 1330
ccuggcgcacgucgaaaagcu

SEQ ID NO: 451621 - RNA, 15 nt, Brucella suis 1330
ccuggccgccgccga

SEQ ID NO: 451622 - RNA, 16 nt, Brucella suis 1330
ccuggccgccgccgaa

SEQ ID NO: 451623 - RNA, 14 nt, Brucella suis 1330
ccuggauauccaca

SEQ ID NO: 451624 - RNA, 14 nt, Brucella suis 1330
ccuggaugcggaac

SEQ ID NO: 451625 - RNA, 21 nt, Brucella suis 1330
ccugcuucaucgcggcagccg

SEQ ID NO: 451626 - RNA, 12 nt, Brucella suis 1330
ccugcuuccuuu

SEQ ID NO: 451627 - RNA, 19 nt, Brucella suis 1330
ccugcugguuuaagccuug

SEQ ID NO: 451628 - RNA, 17 nt, Brucella suis 1330
ccugcugcgcggcauug

SEQ ID NO: 451629 - RNA, 17 nt, Brucella suis 1330
ccugcugcuucgcaaaa

SEQ ID NO: 451630 - RNA, 16 nt, Brucella suis 1330
ccugcggcaguucguu

SEQ ID NO: 451631 - RNA, 13 nt, Brucella suis 1330
ccugccuucuuca

SEQ ID NO: 451632 - RNA, 14 nt, Brucella suis 1330
ccugcgaaaaccug

SEQ ID NO: 451633 - RNA, 16 nt, Brucella suis 1330
ccugcgaaaaccugcu

SEQ ID NO: 451634 - RNA, 16 nt, Brucella suis 1330
ccugcccgucuuccuc

SEQ ID NO: 451635 - RNA, 15 nt, Brucella suis 1330
ccugccagcggcaga

SEQ ID NO: 451636 - RNA, 20 nt, Brucella suis 1330
ccucggaaaaguccuuuccg

SEQ ID NO: 451637 - RNA, 19 nt, Brucella suis 1330
ccucgcgauugcgcuccug

SEQ ID NO: 451638 - RNA, 17 nt, Brucella suis 1330
ccucgaucacccgauca

SEQ ID NO: 451639 - RNA, 22 nt, Brucella suis 1330
ccucgaucacccgaucaccgca

SEQ ID NO: 451640 - RNA, 16 nt, Brucella suis 1330
ccucgacacgccggaa

SEQ ID NO: 451641 - RNA, 16 nt, Brucella suis 1330
ccucgacagcacugcc

SEQ ID NO: 451642 - RNA, 22 nt, Brucella suis 1330
ccucgacagcacugccaccauc

SEQ ID NO: 451643 - RNA, 20 nt, Brucella suis 1330
ccucgaagucgccagcggug

SEQ ID NO: 451644 - RNA, 23 nt, Brucella suis 1330
ccuccauucaagcggcaugucau

SEQ ID NO: 451645 - RNA, 22 nt, Brucella suis 1330
ccuccacgacgggagccgcagc

SEQ ID NO: 451646 - RNA, 19 nt, Brucella suis 1330
ccucaucgaucacggcgcc

SEQ ID NO: 451647 - RNA, 15 nt, Brucella suis 1330
ccucaaucgcgccgu

SEQ ID NO: 451648 - RNA, 18 nt, Brucella suis 1330
ccuauugccuuaaucccu

SEQ ID NO: 451649 - RNA, 17 nt, Brucella suis 1330
ccuaccggaggcauccu

SEQ ID NO: 451650 - RNA, 17 nt, Brucella suis 1330
ccguuuugcgcccagcu

SEQ ID NO: 451651 - RNA, 19 nt, Brucella suis 1330
ccguuuggaugugcagcgu

SEQ ID NO: 451652 - RNA, 21 nt, Brucella suis 1330
ccguucacacuuuucgggaug

SEQ ID NO: 451653 - RNA, 17 nt, Brucella suis 1330
ccgugucggagccggcc

SEQ ID NO: 451654 - RNA, 16 nt, Brucella suis 1330
ccguggcggccggcaa

SEQ ID NO: 451655 - RNA, 22 nt, Brucella suis 1330
aaacgauccagaucuuccuguc

SEQ ID NO: 451656 - RNA, 21 nt, Brucella suis 1330
ccgucgaggaaaaagcccgcc

SEQ ID NO: 451657 - RNA, 18 nt, Brucella suis 1330
ccgucgagggcaccggcc

SEQ ID NO: 451658 - RNA, 14 nt, Brucella suis 1330
ccgucgagcagcau

SEQ ID NO: 451659 - RNA, 12 nt, Brucella suis 1330
ccgguugcgcca

SEQ ID NO: 451660 - RNA, 16 nt, Brucella suis 1330
ccgguggacugauuuc

SEQ ID NO: 451661 - RNA, 23 nt, Brucella suis 1330
ccggucggguuugaugaggcgga

SEQ ID NO: 451662 - RNA, 15 nt, Brucella suis 1330
ccggucaaaacgccc

SEQ ID NO: 451663 - RNA, 17 nt, Brucella suis 1330
ccggucaaaacgccccg

SEQ ID NO: 451664 - RNA, 19 nt, Brucella suis 1330
ccggguucaauacccaugc

SEQ ID NO: 451665 - RNA, 18 nt, Brucella suis 1330
ccgggucuucgcccggca

SEQ ID NO: 451666 - RNA, 16 nt, Brucella suis 1330
aaaccguggaaauucc

SEQ ID NO: 451667 - RNA, 14 nt, Brucella suis 1330
aaaccguuucacac

SEQ ID NO: 451668 - RNA, 17 nt, Brucella suis 1330
aaaccguuucacacuuu

SEQ ID NO: 451669 - RNA, 13 nt, Brucella suis 1330
ccggcugccgcaa

SEQ ID NO: 451670 - RNA, 13 nt, Brucella suis 1330
ccggcugcggcgc

SEQ ID NO: 451671 - RNA, 16 nt, Brucella suis 1330
ccggcuggaauuguuc

SEQ ID NO: 451672 - RNA, 21 nt, Brucella suis 1330
ccggcucauucggguugccuu

SEQ ID NO: 451673 - RNA, 22 nt, Brucella suis 1330
ccggcggugaagaagcgccagc

SEQ ID NO: 451674 - RNA, 16 nt, Brucella suis 1330
ccggcgggagcggcac

SEQ ID NO: 451675 - RNA, 23 nt, Brucella suis 1330
ccggccuugauguccggcgcgcu

SEQ ID NO: 451676 - RNA, 16 nt, Brucella suis 1330
ccggcauugagccgcg

SEQ ID NO: 451677 - RNA, 21 nt, Brucella suis 1330
ccggcauccgaggcgcgcagc

SEQ ID NO: 451678 - RNA, 13 nt, Brucella suis 1330
ccggcagcuuucg

SEQ ID NO: 451679 - RNA, 17 nt, Brucella suis 1330
ccggcacuucgcccaga

SEQ ID NO: 451680 - RNA, 18 nt, Brucella suis 1330
ccggcacccacugcccgc

SEQ ID NO: 451681 - RNA, 16 nt, Brucella suis 1330
ccggauuuugccuuca

SEQ ID NO: 451682 - RNA, 14 nt, Brucella suis 1330
ccggauuuccaaug

SEQ ID NO: 451683 - RNA, 14 nt, Brucella suis 1330
ccggauuugccaag

SEQ ID NO: 451684 - RNA, 15 nt, Brucella suis 1330
ccggaucgcgcggca

SEQ ID NO: 451685 - RNA, 17 nt, Brucella suis 1330
ccgccggcgccgccaag

SEQ ID NO: 451686 - RNA, 19 nt, Brucella suis 1330
ccgccgcagaccacccggc

SEQ ID NO: 451687 - RNA, 20 nt, Brucella suis 1330
ccgccgcagaccacccggcc

SEQ ID NO: 451688 - RNA, 14 nt, Brucella suis 1330
ccgccgcacuuaca

SEQ ID NO: 451689 - RNA, 23 nt, Brucella suis 1330
ccgccgcacuuacaaaugcaagu

SEQ ID NO: 451690 - RNA, 15 nt, Brucella suis 1330
aaacccggccuuugc

SEQ ID NO: 451691 - RNA, 15 nt, Brucella suis 1330
ccgccgaagcugcgc

SEQ ID NO: 451692 - RNA, 21 nt, Brucella suis 1330
ccgcccuugcgcaccgcacgc

SEQ ID NO: 451693 - RNA, 17 nt, Brucella suis 1330
ccgcccgucuucggcgc

SEQ ID NO: 451694 - RNA, 12 nt, Brucella suis 1330
ccgcccgcggcc

SEQ ID NO: 451695 - RNA, 13 nt, Brucella suis 1330
ccgcccgccgcaa

SEQ ID NO: 451696 - RNA, 14 nt, Brucella suis 1330
ccgcccagggcaga

SEQ ID NO: 451697 - RNA, 19 nt, Brucella suis 1330
ccgccaugcggccagccua

SEQ ID NO: 451698 - RNA, 16 nt, Brucella suis 1330
aaaccauggagcgcau

SEQ ID NO: 451699 - RNA, 19 nt, Brucella suis 1330
aaaccauccccgccaugau

SEQ ID NO: 451700 - RNA, 16 nt, Brucella suis 1330
aaaccaucgagcauuu

SEQ ID NO: 451701 - RNA, 14 nt, Brucella suis 1330
ccgccagcaggccg

SEQ ID NO: 451702 - RNA, 15 nt, Brucella suis 1330
ccgccacgaggaaga

SEQ ID NO: 451703 - RNA, 13 nt, Brucella suis 1330
ccgccaccgccgg

SEQ ID NO: 451704 - RNA, 16 nt, Brucella suis 1330
ccgccaauaccgugau

SEQ ID NO: 451705 - RNA, 13 nt, Brucella suis 1330
ccgcaucggccug

SEQ ID NO: 451706 - RNA, 15 nt, Brucella suis 1330
ccgcauaggcuuuca

SEQ ID NO: 451707 - RNA, 20 nt, Brucella suis 1330
ccgcauaauccucacggcca

SEQ ID NO: 451708 - RNA, 19 nt, Brucella suis 1330
ccgcauaaagcacagccag

SEQ ID NO: 451709 - RNA, 17 nt, Brucella suis 1330
ccgcauaaaugcuccug

SEQ ID NO: 451710 - RNA, 11 nt, Brucella suis 1330
ccgcaggcacu

SEQ ID NO: 451711 - RNA, 20 nt, Brucella suis 1330
ccgcaggaacgcaucgagcu

SEQ ID NO: 451712 - RNA, 11 nt, Brucella suis 1330
ccgcacagcau

SEQ ID NO: 451713 - RNA, 17 nt, Brucella suis 1330
ccgcaauccuggugcgc

SEQ ID NO: 451714 - RNA, 15 nt, Brucella suis 1330
ccgauuuucugcugc

SEQ ID NO: 451715 - RNA, 21 nt, Brucella suis 1330
ccgagcggucgacagugaaau

SEQ ID NO: 451716 - RNA, 15 nt, Brucella suis 1330
ccgagaacggcggcg

SEQ ID NO: 451717 - RNA, 20 nt, Brucella suis 1330
ccgagaacggcggcggcgau

SEQ ID NO: 451718 - RNA, 15 nt, Brucella suis 1330
ccgaccuccccccgc

SEQ ID NO: 451719 - RNA, 20 nt, Brucella suis 1330
ccgaccaguaaggcgggcgg

SEQ ID NO: 451720 - RNA, 12 nt, Brucella suis 1330
ccgaccagaacg

SEQ ID NO: 451721 - RNA, 13 nt, Brucella suis 1330
ccgacauccaucg

SEQ ID NO: 451722 - RNA, 21 nt, Brucella suis 1330
ccgacaugcuuguagacgauc

SEQ ID NO: 451723 - RNA, 19 nt, Brucella suis 1330
aaaccaccuuguugccauu

SEQ ID NO: 451724 - RNA, 21 nt, Brucella suis 1330
ccgaauagcgcaucgccaccg

SEQ ID NO: 451725 - RNA, 14 nt, Brucella suis 1330
ccgaauacaagccc

SEQ ID NO: 451726 - RNA, 16 nt, Brucella suis 1330
ccgaauacaagcccaa

SEQ ID NO: 451727 - RNA, 17 nt, Brucella suis 1330
ccgaaucgcuguuggca

SEQ ID NO: 451728 - RNA, 19 nt, Brucella suis 1330
ccgaagaaugcgcagccgu

SEQ ID NO: 451729 - RNA, 12 nt, Brucella suis 1330
ccgaagccaggu

SEQ ID NO: 451730 - RNA, 18 nt, Brucella suis 1330
ccgaacggaucaggcgcc

SEQ ID NO: 451731 - RNA, 21 nt, Brucella suis 1330
ccgaaacgguggccuuccuuc

SEQ ID NO: 451732 - RNA, 19 nt, Brucella suis 1330
aaacagcauauugccgagc

SEQ ID NO: 451733 - RNA, 15 nt, Brucella suis 1330
ccgaaaaccgcuuca

SEQ ID NO: 451734 - RNA, 13 nt, Brucella suis 1330
cccugcugcuucg

SEQ ID NO: 451735 - RNA, 15 nt, Brucella suis 1330
cccucggggcggucu

SEQ ID NO: 451736 - RNA, 12 nt, Brucella suis 1330
cccucgccgccg

SEQ ID NO: 451737 - RNA, 17 nt, Brucella suis 1330
cccucgaucagcaccau

SEQ ID NO: 451738 - RNA, 19 nt, Brucella suis 1330
cccuauuccccuaaaucac

SEQ ID NO: 451739 - RNA, 20 nt, Brucella suis 1330
cccuauuccccuauuccccu

SEQ ID NO: 451740 - RNA, 19 nt, Brucella suis 1330
cccucaaaacgcugccagc

SEQ ID NO: 451741 - RNA, 22 nt, Brucella suis 1330
cccucaaaacgcugccagccgc

SEQ ID NO: 451742 - RNA, 20 nt, Brucella suis 1330
cccucaaccgagcagccgcg

SEQ ID NO: 451743 - RNA, 15 nt, Brucella suis 1330
cccuaucaagaaugu

SEQ ID NO: 451744 - RNA, 23 nt, Brucella suis 1330
cccguugccgaucagcaucgccc

SEQ ID NO: 451745 - RNA, 12 nt, Brucella suis 1330
cccgucuucauu

SEQ ID NO: 451746 - RNA, 22 nt, Brucella suis 1330
aaacaccgcgcaauaaugcagc

SEQ ID NO: 451747 - RNA, 22 nt, Brucella suis 1330
cccggugcauuuuuccagaccu

SEQ ID NO: 451748 - RNA, 19 nt, Brucella suis 1330
cccggucacccgcacgccg

SEQ ID NO: 451749 - RNA, 16 nt, Brucella suis 1330
cccgccggggccggau

SEQ ID NO: 451750 - RNA, 17 nt, Brucella suis 1330
cccgccaugcggccagc

SEQ ID NO: 451751 - RNA, 22 nt, Brucella suis 1330
cccgccauucggcgggcuuuuu

SEQ ID NO: 451752 - RNA, 20 nt, Brucella suis 1330
cccgccaaaaagcaaagagc

SEQ ID NO: 451753 - RNA, 18 nt, Brucella suis 1330
cccgcacccuauuccccu

SEQ ID NO: 451754 - RNA, 19 nt, Brucella suis 1330
ccccuugauaggcgcgccc

SEQ ID NO: 451755 - RNA, 11 nt, Brucella suis 1330
ccccgcacggu

SEQ ID NO: 451756 - RNA, 22 nt, Brucella suis 1330
cccccuguuucugcuggagcuu

SEQ ID NO: 451757 - RNA, 20 nt, Brucella suis 1330
cccccuugauaggcgcgccc

SEQ ID NO: 451758 - RNA, 16 nt, Brucella suis 1330
cccccagaaggcgcgg

SEQ ID NO: 451759 - RNA, 20 nt, Brucella suis 1330
cccccagaaggcgcggcagc

SEQ ID NO: 451760 - RNA, 21 nt, Brucella suis 1330
cccccagaaggcgcggcagcu

SEQ ID NO: 451761 - RNA, 15 nt, Brucella suis 1330
ccccagcccgcccca

SEQ ID NO: 451762 - RNA, 15 nt, Brucella suis 1330
ccccagccagaaccg

SEQ ID NO: 451763 - RNA, 17 nt, Brucella suis 1330
ccccagaucagcgucca

SEQ ID NO: 451764 - RNA, 22 nt, Brucella suis 1330
ccccaccgucaaucgcaucugc

SEQ ID NO: 451765 - RNA, 18 nt, Brucella suis 1330
cccaugguuugcagcaau

SEQ ID NO: 451766 - RNA, 23 nt, Brucella suis 1330
cccaugguuugcagcaauuccug

SEQ ID NO: 451767 - RNA, 22 nt, Brucella suis 1330
cccauguuuaugaaaacauggg

SEQ ID NO: 451768 - RNA, 17 nt, Brucella suis 1330
cccauggccugcugcau

SEQ ID NO: 451769 - RNA, 16 nt, Brucella suis 1330
cccauggacuuuucag

SEQ ID NO: 451770 - RNA, 22 nt, Brucella suis 1330
cccauggacuuuucagccucgg

SEQ ID NO: 451771 - RNA, 14 nt, Brucella suis 1330
cccaugccuuucag

SEQ ID NO: 451772 - RNA, 23 nt, Brucella suis 1330
cccaugagaaggcaagccccagc

SEQ ID NO: 451773 - RNA, 22 nt, Brucella suis 1330
cccaucgcauugcugaugauuu

SEQ ID NO: 451774 - RNA, 19 nt, Brucella suis 1330
cccagcgcggcaaugcgcu

SEQ ID NO: 451775 - RNA, 18 nt, Brucella suis 1330
cccagcccuuuucagcgg

SEQ ID NO: 451776 - RNA, 13 nt, Brucella suis 1330
cccagaaccugcc

SEQ ID NO: 451777 - RNA, 14 nt, Brucella suis 1330
cccagaaccugccc

SEQ ID NO: 451778 - RNA, 17 nt, Brucella suis 1330
cccagaaccugcccguc

SEQ ID NO: 451779 - RNA, 14 nt, Brucella suis 1330
cccagaaggcgcgg

SEQ ID NO: 451780 - RNA, 16 nt, Brucella suis 1330
cccagaaggcgcggca

SEQ ID NO: 451781 - RNA, 23 nt, Brucella suis 1330
ccauugccgguugcuuccaugcc

SEQ ID NO: 451782 - RNA, 18 nt, Brucella suis 1330
ccauuucgggcgcgaucu

SEQ ID NO: 451783 - RNA, 22 nt, Brucella suis 1330
ccauuuucauggguaccuucca

SEQ ID NO: 451784 - RNA, 21 nt, Brucella suis 1330
ccauucccgccucagccggau

SEQ ID NO: 451785 - RNA, 21 nt, Brucella suis 1330
ccauuaguaucggcagccuug

SEQ ID NO: 451786 - RNA, 15 nt, Brucella suis 1330
ccauguuuaugaaaa

SEQ ID NO: 451787 - RNA, 17 nt, Brucella suis 1330
ccauguuuaugaaaaca

SEQ ID NO: 451788 - RNA, 18 nt, Brucella suis 1330
ccauuaaucaaaaacaau

SEQ ID NO: 451789 - RNA, 21 nt, Brucella suis 1330
ccauuaaucaaaaacaaucuc

SEQ ID NO: 451790 - RNA, 17 nt, Brucella suis 1330
ccaugucgaaagcccug

SEQ ID NO: 451791 - RNA, 20 nt, Brucella suis 1330
ccauggugucauagaccaug

SEQ ID NO: 451792 - RNA, 13 nt, Brucella suis 1330
ccauggcuucaag

SEQ ID NO: 451793 - RNA, 18 nt, Brucella suis 1330
ccauggcguccccaucga

SEQ ID NO: 451794 - RNA, 16 nt, Brucella suis 1330
ccauggagcgcauccg

SEQ ID NO: 451795 - RNA, 13 nt, Brucella suis 1330
ccaugccgcagga

SEQ ID NO: 451796 - RNA, 19 nt, Brucella suis 1330
ccaugccgccaaggccgga

SEQ ID NO: 451797 - RNA, 12 nt, Brucella suis 1330
ccaugccgccag

SEQ ID NO: 451798 - RNA, 19 nt, Brucella suis 1330
ccaugcccaugcaguucca

SEQ ID NO: 451799 - RNA, 21 nt, Brucella suis 1330
ccaugcaguuccauccauuga

SEQ ID NO: 451800 - RNA, 14 nt, Brucella suis 1330
ccaugacgccgcuc

SEQ ID NO: 451801 - RNA, 17 nt, Brucella suis 1330
ccaugacgccgcuccag

SEQ ID NO: 451802 - RNA, 14 nt, Brucella suis 1330
ccaugacggcccgg

SEQ ID NO: 451803 - RNA, 19 nt, Brucella suis 1330
ccaucggcucauccuccac

SEQ ID NO: 451804 - RNA, 23 nt, Brucella suis 1330
ccaucgucauugcgauccagcgc

SEQ ID NO: 451805 - RNA, 18 nt, Brucella suis 1330
ccaucuuccucacccuuc

SEQ ID NO: 451806 - RNA, 14 nt, Brucella suis 1330
ccaucgcccgccgc

SEQ ID NO: 451807 - RNA, 20 nt, Brucella suis 1330
ccaucgccgacgcgcgugac

SEQ ID NO: 451808 - RNA, 14 nt, Brucella suis 1330
ccauaucuuuccau

SEQ ID NO: 451809 - RNA, 15 nt, Brucella suis 1330
ccauacguccagcca

SEQ ID NO: 451810 - RNA, 23 nt, Brucella suis 1330
ccauagccccccuggauauccac

SEQ ID NO: 451811 - RNA, 19 nt, Brucella suis 1330
ccauacgaauaccgcaccg

SEQ ID NO: 451812 - RNA, 23 nt, Brucella suis 1330
ccaguugucgccgggcugcuucu

SEQ ID NO: 451813 - RNA, 16 nt, Brucella suis 1330
ccagucgcugccccau

SEQ ID NO: 451814 - RNA, 23 nt, Brucella suis 1330
ccagucgaucagugggucccagu

SEQ ID NO: 451815 - RNA, 12 nt, Brucella suis 1330
ccaguccuugcc

SEQ ID NO: 451816 - RNA, 19 nt, Brucella suis 1330
ccagucauugacggcagcc

SEQ ID NO: 451817 - RNA, 13 nt, Brucella suis 1330
ccagucauggcgc

SEQ ID NO: 451818 - RNA, 13 nt, Brucella suis 1330
ccaguaaggcggg

SEQ ID NO: 451819 - RNA, 18 nt, Brucella suis 1330
ccagguggcugcccgccg

SEQ ID NO: 451820 - RNA, 14 nt, Brucella suis 1330
ccagccggacaaga

SEQ ID NO: 451821 - RNA, 17 nt, Brucella suis 1330
ccagccgccagcaggcc

SEQ ID NO: 451822 - RNA, 17 nt, Brucella suis 1330
ccagcccuucaucaagc

SEQ ID NO: 451823 - RNA, 20 nt, Brucella suis 1330
ccagccgcaaugagcccgcg

SEQ ID NO: 451824 - RNA, 23 nt, Brucella suis 1330
ccagcccgugacguccaccaccu

SEQ ID NO: 451825 - RNA, 13 nt, Brucella suis 1330
ccagccagcgcau

SEQ ID NO: 451826 - RNA, 19 nt, Brucella suis 1330
ccagccagcgcauaaaggc

SEQ ID NO: 451827 - RNA, 14 nt, Brucella suis 1330
ccagcacucugcca

SEQ ID NO: 451828 - RNA, 13 nt, Brucella suis 1330
ccagcacuuccag

SEQ ID NO: 451829 - RNA, 14 nt, Brucella suis 1330
ccagcacacagcca

SEQ ID NO: 451830 - RNA, 18 nt, Brucella suis 1330
ccagcaaaagugcgaagc

SEQ ID NO: 451831 - RNA, 14 nt, Brucella suis 1330
ccagauugcgaaug

SEQ ID NO: 451832 - RNA, 12 nt, Brucella suis 1330
ccagauugcgcc

SEQ ID NO: 451833 - RNA, 12 nt, Brucella suis 1330
ccagauugcggg

SEQ ID NO: 451834 - RNA, 17 nt, Brucella suis 1330
ccagauugcgggcaagc

SEQ ID NO: 451835 - RNA, 20 nt, Brucella suis 1330
ccagaucguccucguggauc

SEQ ID NO: 451836 - RNA, 12 nt, Brucella suis 1330
ccagaucuuccu

SEQ ID NO: 451837 - RNA, 14 nt, Brucella suis 1330
ccagaucggccuug

SEQ ID NO: 451838 - RNA, 21 nt, Brucella suis 1330
ccagaucauugaaauucuuuu

SEQ ID NO: 451839 - RNA, 20 nt, Brucella suis 1330
ccagaucaugggcggccacg

SEQ ID NO: 451840 - RNA, 21 nt, Brucella suis 1330
ccagauaccgguacuggccaa

SEQ ID NO: 451841 - RNA, 20 nt, Brucella suis 1330
ccagacaugcgauaaugcuu

SEQ ID NO: 451842 - RNA, 19 nt, Brucella suis 1330
ccagacagccuugucgccc

SEQ ID NO: 451843 - RNA, 24 nt, Brucella suis 1330
ccagaccaucggcaacaagagggc

SEQ ID NO: 451844 - RNA, 19 nt, Brucella suis 1330
ccagagacaucagauugag

SEQ ID NO: 451845 - RNA, 21 nt, Brucella suis 1330
ccagagagcggcgcauaaaac

SEQ ID NO: 451846 - RNA, 13 nt, Brucella suis 1330
ccagagcaaaaaa

SEQ ID NO: 451847 - RNA, 22 nt, Brucella suis 1330
ccagagccuguuccaaaagucg

SEQ ID NO: 451848 - RNA, 15 nt, Brucella suis 1330
ccagagccucggcgc

SEQ ID NO: 451849 - RNA, 21 nt, Brucella suis 1330
ccagaaccugcccgucuuccu

SEQ ID NO: 451850 - RNA, 19 nt, Brucella suis 1330
ccagaaagacauuuucgcc

SEQ ID NO: 451851 - RNA, 19 nt, Brucella suis 1330
ccagaaagagcaucccucc

SEQ ID NO: 451852 - RNA, 16 nt, Brucella suis 1330
ccagaaaaugcagcgg

SEQ ID NO: 451853 - RNA, 12 nt, Brucella suis 1330
ccacuuugccgu

SEQ ID NO: 451854 - RNA, 14 nt, Brucella suis 1330
ccacuuugccgucu

SEQ ID NO: 451855 - RNA, 14 nt, Brucella suis 1330
ccagaagcccgcgc

SEQ ID NO: 451856 - RNA, 19 nt, Brucella suis 1330
ccagaagcccgcgcuccuc

SEQ ID NO: 451857 - RNA, 22 nt, Brucella suis 1330
ccagaagguuucagccuccugu

SEQ ID NO: 451858 - RNA, 21 nt, Brucella suis 1330
ccacugcccgccuuugccgca

SEQ ID NO: 451859 - RNA, 13 nt, Brucella suis 1330
ccacugcccugga

SEQ ID NO: 451860 - RNA, 14 nt, Brucella suis 1330
ccacugcccuggau

SEQ ID NO: 451861 - RNA, 22 nt, Brucella suis 1330
ccaccuucgccgucgagcagca

SEQ ID NO: 451862 - RNA, 14 nt, Brucella suis 1330
ccaccuggccgccg

SEQ ID NO: 451863 - RNA, 15 nt, Brucella suis 1330
ccaccuggccgccgc

SEQ ID NO: 451864 - RNA, 21 nt, Brucella suis 1330
ccaccggacugauuucugauc

SEQ ID NO: 451865 - RNA, 18 nt, Brucella suis 1330
ccaccgcguuccgugccg

SEQ ID NO: 451866 - RNA, 15 nt, Brucella suis 1330
ccacccggccgcccu

SEQ ID NO: 451867 - RNA, 21 nt, Brucella suis 1330
ccacccggccgcccuugcgca

SEQ ID NO: 451868 - RNA, 15 nt, Brucella suis 1330
ccacccaccgccugc

SEQ ID NO: 451869 - RNA, 18 nt, Brucella suis 1330
ccaccacaugcuccaggg

SEQ ID NO: 451870 - RNA, 13 nt, Brucella suis 1330
ccacauccgccac

SEQ ID NO: 451871 - RNA, 16 nt, Brucella suis 1330
ccacauguggcgugau

SEQ ID NO: 451872 - RNA, 15 nt, Brucella suis 1330
ccacagugaccagcg

SEQ ID NO: 451873 - RNA, 11 nt, Brucella suis 1330
ccacacuuccg

SEQ ID NO: 451874 - RNA, 13 nt, Brucella suis 1330
ccacacgaacagc

SEQ ID NO: 451875 - RNA, 15 nt, Brucella suis 1330
ccacacgaacagcag

SEQ ID NO: 451876 - RNA, 13 nt, Brucella suis 1330
ccacaagguccug

SEQ ID NO: 451877 - RNA, 16 nt, Brucella suis 1330
ccacaagcaucugcuc

SEQ ID NO: 451878 - RNA, 15 nt, Brucella suis 1330
ccaagccggcgcagc

SEQ ID NO: 451879 - RNA, 20 nt, Brucella suis 1330
ccaagcccguaccaacccuu

SEQ ID NO: 451880 - RNA, 15 nt, Brucella suis 1330
ccaagaccgccgcga

SEQ ID NO: 451881 - RNA, 21 nt, Brucella suis 1330
ccaagaagaacacagccccuu

SEQ ID NO: 451882 - RNA, 20 nt, Brucella suis 1330
ccaacgugcggugcucccau

SEQ ID NO: 451883 - RNA, 13 nt, Brucella suis 1330
ccaacccuuuucc

SEQ ID NO: 451884 - RNA, 23 nt, Brucella suis 1330
ccaacccuuuuccgcaccgccga

SEQ ID NO: 451885 - RNA, 23 nt, Brucella suis 1330
ccaacuucuuuguucugcagcaa

SEQ ID NO: 451886 - RNA, 17 nt, Brucella suis 1330
ccaaacguacauuguuc

SEQ ID NO: 451887 - RNA, 13 nt, Brucella suis 1330
cauugaguuucau

SEQ ID NO: 451888 - RNA, 22 nt, Brucella suis 1330
cauugaucaacccgucuucauu

SEQ ID NO: 451889 - RNA, 15 nt, Brucella suis 1330
cauugaugagaaccg

SEQ ID NO: 451890 - RNA, 12 nt, Brucella suis 1330
cauuuucuccac

SEQ ID NO: 451891 - RNA, 14 nt, Brucella suis 1330
cauuuucugcauca

SEQ ID NO: 451892 - RNA, 15 nt, Brucella suis 1330
cauuuuuccagaccu

SEQ ID NO: 451893 - RNA, 12 nt, Brucella suis 1330
cauucugaauga

SEQ ID NO: 451894 - RNA, 17 nt, Brucella suis 1330
cauucugcacgucauca

SEQ ID NO: 451895 - RNA, 20 nt, Brucella suis 1330
cauucccuucgcgccgccuu

SEQ ID NO: 451896 - RNA, 15 nt, Brucella suis 1330
cauucuugcgcccuc

SEQ ID NO: 451897 - RNA, 21 nt, Brucella suis 1330
cauucuugcgcccuccaccgc

SEQ ID NO: 451898 - RNA, 24 nt, Brucella suis 1330
cauugaaauauuccggcacgacag

SEQ ID NO: 451899 - RNA, 22 nt, Brucella suis 1330
cauugaacccgccaccagaccg

SEQ ID NO: 451900 - RNA, 15 nt, Brucella suis 1330
cauugacgauacagc

SEQ ID NO: 451901 - RNA, 14 nt, Brucella suis 1330
cauugacgcgcacc

SEQ ID NO: 451902 - RNA, 15 nt, Brucella suis 1330
cauucagauggacau

SEQ ID NO: 451903 - RNA, 14 nt, Brucella suis 1330
cauuaauggcaucg

SEQ ID NO: 451904 - RNA, 21 nt, Brucella suis 1330
cauuauccgcaucgaucacau

SEQ ID NO: 451905 - RNA, 22 nt, Brucella suis 1330
cauuauccuacgcaaaaccgcu

SEQ ID NO: 451906 - RNA, 19 nt, Brucella suis 1330
cauuauccugaaaauacuc

SEQ ID NO: 451907 - RNA, 15 nt, Brucella suis 1330
cauguuucaaaaguu

SEQ ID NO: 451908 - RNA, 16 nt, Brucella suis 1330
caugguuugcagcaau

SEQ ID NO: 451909 - RNA, 18 nt, Brucella suis 1330
caugggcgugaucggccg

SEQ ID NO: 451910 - RNA, 19 nt, Brucella suis 1330
caugggcgcgugugcauag

SEQ ID NO: 451911 - RNA, 18 nt, Brucella suis 1330
cauggcgcacggcauuca

SEQ ID NO: 451912 - RNA, 21 nt, Brucella suis 1330
cauggccugcgcgcgcauggc

SEQ ID NO: 451913 - RNA, 17 nt, Brucella suis 1330
caugcguugcuggaaca

SEQ ID NO: 451914 - RNA, 18 nt, Brucella suis 1330
caugcguugcuggaacau

SEQ ID NO: 451915 - RNA, 16 nt, Brucella suis 1330
caugcgcggcaugggc

SEQ ID NO: 451916 - RNA, 14 nt, Brucella suis 1330
caugcgcucccggu

SEQ ID NO: 451917 - RNA, 22 nt, Brucella suis 1330
caugcgcaaccaaaacauacuc

SEQ ID NO: 451918 - RNA, 15 nt, Brucella suis 1330
caugcgccacuuccc

SEQ ID NO: 451919 - RNA, 21 nt, Brucella suis 1330
caugcgauagcggcgcggcag

SEQ ID NO: 451920 - RNA, 20 nt, Brucella suis 1330
caugccugccgcagccaggg

SEQ ID NO: 451921 - RNA, 12 nt, Brucella suis 1330
caugccggaggu

SEQ ID NO: 451922 - RNA, 17 nt, Brucella suis 1330
caugcccgucagcgcgc

SEQ ID NO: 451923 - RNA, 16 nt, Brucella suis 1330
caugccaagagccgcu

SEQ ID NO: 451924 - RNA, 22 nt, Brucella suis 1330
caugcagacgggacgcaggcgg

SEQ ID NO: 451925 - RNA, 19 nt, Brucella suis 1330
caugcaggccgugaagauu

SEQ ID NO: 451926 - RNA, 20 nt, Brucella suis 1330
caugcaggccgugaagauug

SEQ ID NO: 451927 - RNA, 23 nt, Brucella suis 1330
caugcaggccgugaagauugcuu

SEQ ID NO: 451928 - RNA, 18 nt, Brucella suis 1330
caugaugccgacaagcag

SEQ ID NO: 451929 - RNA, 14 nt, Brucella suis 1330
caugagcuucaaca

SEQ ID NO: 451930 - RNA, 18 nt, Brucella suis 1330
caugagaaggcaagcccc

SEQ ID NO: 451931 - RNA, 20 nt, Brucella suis 1330
caugagaaggcaagccccag

SEQ ID NO: 451932 - RNA, 15 nt, Brucella suis 1330
caugacauccaugaa

SEQ ID NO: 451933 - RNA, 15 nt, Brucella suis 1330
caucuuucuugaagu

SEQ ID NO: 451934 - RNA, 15 nt, Brucella suis 1330
caucuuugcggcgcg

SEQ ID NO: 451935 - RNA, 23 nt, Brucella suis 1330
caugaaaaugccauggaacagac

SEQ ID NO: 451936 - RNA, 21 nt, Brucella suis 1330
caucuucuucguugucuucaa

SEQ ID NO: 451937 - RNA, 16 nt, Brucella suis 1330
caucggcgcgcuuggc

SEQ ID NO: 451938 - RNA, 12 nt, Brucella suis 1330
caucggcgcgcu

SEQ ID NO: 451939 - RNA, 16 nt, Brucella suis 1330
caucggugcgcggcgc

SEQ ID NO: 451940 - RNA, 17 nt, Brucella suis 1330
caucggugcgcggcgcu

SEQ ID NO: 451941 - RNA, 16 nt, Brucella suis 1330
caucgguggcauugcc

SEQ ID NO: 451942 - RNA, 18 nt, Brucella suis 1330
caucggcgaggaagagaa

SEQ ID NO: 451943 - RNA, 13 nt, Brucella suis 1330
caucggccucggc

SEQ ID NO: 451944 - RNA, 23 nt, Brucella suis 1330
caucgcccgagaagcucaacgcc

SEQ ID NO: 451945 - RNA, 23 nt, Brucella suis 1330
caucgcccugaagaagcuucaca

SEQ ID NO: 451946 - RNA, 15 nt, Brucella suis 1330
caucgcauucuggac

SEQ ID NO: 451947 - RNA, 21 nt, Brucella suis 1330
caucgccaccauggccgcccc

SEQ ID NO: 451948 - RNA, 19 nt, Brucella suis 1330
caucgaggaauaggcgcca

SEQ ID NO: 451949 - RNA, 19 nt, Brucella suis 1330
caucgagcguaacggcgga

SEQ ID NO: 451950 - RNA, 19 nt, Brucella suis 1330
caucgagacggcgcuccau

SEQ ID NO: 451951 - RNA, 16 nt, Brucella suis 1330
caucgaaccgcccaga

SEQ ID NO: 451952 - RNA, 19 nt, Brucella suis 1330
caucgaaccgcccagaccg

SEQ ID NO: 451953 - RNA, 15 nt, Brucella suis 1330
cauccuugaugccca

SEQ ID NO: 451954 - RNA, 14 nt, Brucella suis 1330
cauccgccaccgcg

SEQ ID NO: 451955 - RNA, 15 nt, Brucella suis 1330
cauccgccccgaucg

SEQ ID NO: 451956 - RNA, 20 nt, Brucella suis 1330
caucccggaaggaaugggcg

SEQ ID NO: 451957 - RNA, 22 nt, Brucella suis 1330
cauccgaggcgcgcagcagcgg

SEQ ID NO: 451958 - RNA, 14 nt, Brucella suis 1330
cauccgcacccggc

SEQ ID NO: 451959 - RNA, 20 nt, Brucella suis 1330
caucccgaaaagugcgaagc

SEQ ID NO: 451960 - RNA, 12 nt, Brucella suis 1330
cauccauuccuc

SEQ ID NO: 451961 - RNA, 14 nt, Brucella suis 1330
cauccauuccucaa

SEQ ID NO: 451962 - RNA, 22 nt, Brucella suis 1330
cauccagucgaucagugggucc

SEQ ID NO: 451963 - RNA, 22 nt, Brucella suis 1330
cauccagcggugacggcggcag

SEQ ID NO: 451964 - RNA, 15 nt, Brucella suis 1330
cauccagcacuucca

SEQ ID NO: 451965 - RNA, 19 nt, Brucella suis 1330
cauccacucggcggcaucg

SEQ ID NO: 451966 - RNA, 21 nt, Brucella suis 1330
cauccacaaaaaccggggcgg

SEQ ID NO: 451967 - RNA, 19 nt, Brucella suis 1330
caucagcauugaacgccuu

SEQ ID NO: 451968 - RNA, 22 nt, Brucella suis 1330
caucacuucgucgcugacuuca

SEQ ID NO: 451969 - RNA, 12 nt, Brucella suis 1330
cauauuccacau

SEQ ID NO: 451970 - RNA, 18 nt, Brucella suis 1330
caucaaaggagcauggcu

SEQ ID NO: 451971 - RNA, 12 nt, Brucella suis 1330
cauaggcuuuca

SEQ ID NO: 451972 - RNA, 17 nt, Brucella suis 1330
cauaggcgcgcgcaagg

SEQ ID NO: 451973 - RNA, 19 nt, Brucella suis 1330
cauagacgcgcagacgcag

SEQ ID NO: 451974 - RNA, 16 nt, Brucella suis 1330
cauagaccaugacgcc

SEQ ID NO: 451975 - RNA, 20 nt, Brucella suis 1330
cauagaacagcaagcccaga

SEQ ID NO: 451976 - RNA, 20 nt, Brucella suis 1330
cagugcauuggaaacgccgu

SEQ ID NO: 451977 - RNA, 15 nt, Brucella suis 1330
cagugccaccagaug

SEQ ID NO: 451978 - RNA, 23 nt, Brucella suis 1330
caguccuugaccgcuaugucgau

SEQ ID NO: 451979 - RNA, 21 nt, Brucella suis 1330
cagucugaucgacgaggaagg

SEQ ID NO: 451980 - RNA, 11 nt, Brucella suis 1330
cagucuggauu

SEQ ID NO: 451981 - RNA, 14 nt, Brucella suis 1330
caguccacuggacu

SEQ ID NO: 451982 - RNA, 16 nt, Brucella suis 1330
caguaucggcaguuuc

SEQ ID NO: 451983 - RNA, 20 nt, Brucella suis 1330
caguaucggcaguuucaucu

SEQ ID NO: 451984 - RNA, 23 nt, Brucella suis 1330
cagucaaaaacgagggguuuuga

SEQ ID NO: 451985 - RNA, 13 nt, Brucella suis 1330
caguagggcagua

SEQ ID NO: 451986 - RNA, 18 nt, Brucella suis 1330
caguagggcaguagggca

SEQ ID NO: 451987 - RNA, 17 nt, Brucella suis 1330
cagguuuccggcugccu

SEQ ID NO: 451988 - RNA, 20 nt, Brucella suis 1330
cagguuuccggacgcgcaga

SEQ ID NO: 451989 - RNA, 12 nt, Brucella suis 1330
cagguugacgau

SEQ ID NO: 451990 - RNA, 16 nt, Brucella suis 1330
cagguggcugcccgcc

SEQ ID NO: 451991 - RNA, 19 nt, Brucella suis 1330
caggucuuucugcuucugu

SEQ ID NO: 451992 - RNA, 15 nt, Brucella suis 1330
caggucggcauugau

SEQ ID NO: 451993 - RNA, 22 nt, Brucella suis 1330
caggucgagcgccuguccgccu

SEQ ID NO: 451994 - RNA, 19 nt, Brucella suis 1330
cagggcggaucgugacccg

SEQ ID NO: 451995 - RNA, 14 nt, Brucella suis 1330
cagggccagaucgc

SEQ ID NO: 451996 - RNA, 18 nt, Brucella suis 1330
cagggcaagcgccugcug

SEQ ID NO: 451997 - RNA, 15 nt, Brucella suis 1330
cagggcaauccuuuc

SEQ ID NO: 451998 - RNA, 16 nt, Brucella suis 1330
cagggcaaucugcgcu

SEQ ID NO: 451999 - RNA, 15 nt, Brucella suis 1330
cagggacgagcggca

SEQ ID NO: 452000 - RNA, 17 nt, Brucella suis 1330
cagggacgagcggcagg

SEQ ID NO: 452001 - RNA, 22 nt, Brucella suis 1330
cagggaaucgcgcaauucaugc

SEQ ID NO: 452002 - RNA, 15 nt, Brucella suis 1330
caggcucccgccugc

SEQ ID NO: 452003 - RNA, 20 nt, Brucella suis 1330
caggcgaucaacgcuuugac

SEQ ID NO: 452004 - RNA, 19 nt, Brucella suis 1330
caggccgggcuuuggagga

SEQ ID NO: 452005 - RNA, 17 nt, Brucella suis 1330
caggccucugccuccau

SEQ ID NO: 452006 - RNA, 17 nt, Brucella suis 1330
caggccgguaagcccug

SEQ ID NO: 452007 - RNA, 14 nt, Brucella suis 1330
caggccggccuuga

SEQ ID NO: 452008 - RNA, 16 nt, Brucella suis 1330
caggccgcaaagcgaa

SEQ ID NO: 452009 - RNA, 13 nt, Brucella suis 1330
caggcccaccgug

SEQ ID NO: 452010 - RNA, 15 nt, Brucella suis 1330
caggcccaccgugcc

SEQ ID NO: 452011 - RNA, 22 nt, Brucella suis 1330
caggccagucgcugccccauau

SEQ ID NO: 452012 - RNA, 17 nt, Brucella suis 1330
caggccauucccgccuc

SEQ ID NO: 452013 - RNA, 20 nt, Brucella suis 1330
caggccauucccgccucagc

SEQ ID NO: 452014 - RNA, 14 nt, Brucella suis 1330
caggaucuuuccaa

SEQ ID NO: 452015 - RNA, 20 nt, Brucella suis 1330
caggauagauauuucuucca

SEQ ID NO: 452016 - RNA, 15 nt, Brucella suis 1330
caggaagggaaagcg

SEQ ID NO: 452017 - RNA, 21 nt, Brucella suis 1330
cagcuugccgccaauccccuc

SEQ ID NO: 452018 - RNA, 21 nt, Brucella suis 1330
cagcuucccggauugggucaa

SEQ ID NO: 452019 - RNA, 15 nt, Brucella suis 1330
cagcuuuggcgccgu

SEQ ID NO: 452020 - RNA, 21 nt, Brucella suis 1330
cagcuuuuuucgauugaaaaa

SEQ ID NO: 452021 - RNA, 17 nt, Brucella suis 1330
cagcucuauugcccggc

SEQ ID NO: 452022 - RNA, 20 nt, Brucella suis 1330
cagcuccggguucucgucga

SEQ ID NO: 452023 - RNA, 14 nt, Brucella suis 1330
cagcucgaaaucca

SEQ ID NO: 452024 - RNA, 14 nt, Brucella suis 1330
cagcgccucauaau

SEQ ID NO: 452025 - RNA, 21 nt, Brucella suis 1330
cagcgccucauaaucagccuc

SEQ ID NO: 452026 - RNA, 19 nt, Brucella suis 1330
cagcgcaaugcccucuucg

SEQ ID NO: 452027 - RNA, 21 nt, Brucella suis 1330
cagcgacuuccaguggaagca

SEQ ID NO: 452028 - RNA, 22 nt, Brucella suis 1330
cagcgacuuccaguggaagcac

SEQ ID NO: 452029 - RNA, 15 nt, Brucella suis 1330
cagcgaauagaccau

SEQ ID NO: 452030 - RNA, 17 nt, Brucella suis 1330
cagcgaauagaccaugc

SEQ ID NO: 452031 - RNA, 21 nt, Brucella suis 1330
cagcgaauagggaaacggcca

SEQ ID NO: 452032 - RNA, 22 nt, Brucella suis 1330
cagccuggcggcuauuccacuu

SEQ ID NO: 452033 - RNA, 14 nt, Brucella suis 1330
cagccuccugugca

SEQ ID NO: 452034 - RNA, 18 nt, Brucella suis 1330
cagccggaaugccucccg

SEQ ID NO: 452035 - RNA, 22 nt, Brucella suis 1330
cagccgcgaucacagccgcgcc

SEQ ID NO: 452036 - RNA, 15 nt, Brucella suis 1330
cagccgcagccgcca

SEQ ID NO: 452037 - RNA, 15 nt, Brucella suis 1330
cagccgcaaucagcc

SEQ ID NO: 452038 - RNA, 17 nt, Brucella suis 1330
cagccgacccgguaagc

SEQ ID NO: 452039 - RNA, 20 nt, Brucella suis 1330
cagccgaaaugagaucaacc

SEQ ID NO: 452040 - RNA, 16 nt, Brucella suis 1330
cagcccugccggcuca

SEQ ID NO: 452041 - RNA, 14 nt, Brucella suis 1330
cagcccuucaucaa

SEQ ID NO: 452042 - RNA, 21 nt, Brucella suis 1330
cagcccuucaucaagcugucg

SEQ ID NO: 452043 - RNA, 15 nt, Brucella suis 1330
cagccauucauggcu

SEQ ID NO: 452044 - RNA, 16 nt, Brucella suis 1330
cagccauucauggcug

SEQ ID NO: 452045 - RNA, 19 nt, Brucella suis 1330
cagccaucaggauuuggga

SEQ ID NO: 452046 - RNA, 12 nt, Brucella suis 1330
cagccacggcag

SEQ ID NO: 452047 - RNA, 16 nt, Brucella suis 1330
cagccacggcagagug

SEQ ID NO: 452048 - RNA, 17 nt, Brucella suis 1330
cagccacggcagagugg

SEQ ID NO: 452049 - RNA, 23 nt, Brucella suis 1330
cagccacauucccgaagacgauc

SEQ ID NO: 452050 - RNA, 18 nt, Brucella suis 1330
cagcauuucagggcugcc

SEQ ID NO: 452051 - RNA, 20 nt, Brucella suis 1330
cagcaugucauccgaaacca

SEQ ID NO: 452052 - RNA, 18 nt, Brucella suis 1330
cagcaugaucgccaccgg

SEQ ID NO: 452053 - RNA, 13 nt, Brucella suis 1330
cagcaucuugcca

SEQ ID NO: 452054 - RNA, 12 nt, Brucella suis 1330
cagcaugaacca

SEQ ID NO: 452055 - RNA, 22 nt, Brucella suis 1330
cagcaucugcgcgaggaaauca

SEQ ID NO: 452056 - RNA, 15 nt, Brucella suis 1330
cagcagucaaaaacg

SEQ ID NO: 452057 - RNA, 13 nt, Brucella suis 1330
cagcaggcgcgca

SEQ ID NO: 452058 - RNA, 22 nt, Brucella suis 1330
cagcaggcgcgcagcaaccauc

SEQ ID NO: 452059 - RNA, 14 nt, Brucella suis 1330
cagcagaaggauga

SEQ ID NO: 452060 - RNA, 21 nt, Brucella suis 1330
cagcagaauuucagcuucccg

SEQ ID NO: 452061 - RNA, 20 nt, Brucella suis 1330
cagcacauccugcaccggcu

SEQ ID NO: 452062 - RNA, 15 nt, Brucella suis 1330
cagcacaagccaucc

SEQ ID NO: 452063 - RNA, 15 nt, Brucella suis 1330
aaaauggaaaaaccc

SEQ ID NO: 452064 - RNA, 16 nt, Brucella suis 1330
aaaauggaaaaacccg

SEQ ID NO: 452065 - RNA, 11 nt, Brucella suis 1330
aaaauggaauc

SEQ ID NO: 452066 - RNA, 17 nt, Brucella suis 1330
aaaauggcccugucagc

SEQ ID NO: 452067 - RNA, 18 nt, Brucella suis 1330
aaaauggccucagauuca

SEQ ID NO: 452068 - RNA, 20 nt, Brucella suis 1330
aaaaugcucuaggaaaacuu

SEQ ID NO: 452069 - RNA, 14 nt, Brucella suis 1330
cagauggggcuggc

SEQ ID NO: 452070 - RNA, 15 nt, Brucella suis 1330
cagaugcggcgcgca

SEQ ID NO: 452071 - RNA, 17 nt, Brucella suis 1330
cagauguuccugcggug

SEQ ID NO: 452072 - RNA, 19 nt, Brucella suis 1330
aaaaucucgguuaucauuu

SEQ ID NO: 452073 - RNA, 19 nt, Brucella suis 1330
cagaugagcggcagcagcc

SEQ ID NO: 452074 - RNA, 14 nt, Brucella suis 1330
cagaugcaccauca

SEQ ID NO: 452075 - RNA, 23 nt, Brucella suis 1330
cagaucggccauuucggcuucca

SEQ ID NO: 452076 - RNA, 16 nt, Brucella suis 1330
cagaucgcgcgcggcc

SEQ ID NO: 452077 - RNA, 15 nt, Brucella suis 1330
cagaucgcgcggcga

SEQ ID NO: 452078 - RNA, 17 nt, Brucella suis 1330
cagaucggcaagauggc

SEQ ID NO: 452079 - RNA, 10 nt, Brucella suis 1330
cagauaagau

SEQ ID NO: 452080 - RNA, 14 nt, Brucella suis 1330
cagaucgacgcaga

SEQ ID NO: 452081 - RNA, 15 nt, Brucella suis 1330
cagaucgacgcagaa

SEQ ID NO: 452082 - RNA, 16 nt, Brucella suis 1330
cagagcuucgccgcca

SEQ ID NO: 452083 - RNA, 16 nt, Brucella suis 1330
cagacuagacaaagcg

SEQ ID NO: 452084 - RNA, 19 nt, Brucella suis 1330
cagaccacccggccgcccu

SEQ ID NO: 452085 - RNA, 19 nt, Brucella suis 1330
cagaccaucggcaacaaga

SEQ ID NO: 452086 - RNA, 15 nt, Brucella suis 1330
cagacgcagcgcauu

SEQ ID NO: 452087 - RNA, 13 nt, Brucella suis 1330
cagacacgcuuuu

SEQ ID NO: 452088 - RNA, 23 nt, Brucella suis 1330
cagaagcgcguccuucaggccgu

SEQ ID NO: 452089 - RNA, 15 nt, Brucella suis 1330
cagaagcaccagcgc

SEQ ID NO: 452090 - RNA, 23 nt, Brucella suis 1330
cagaacaaugccuugagaugagc

SEQ ID NO: 452091 - RNA, 18 nt, Brucella suis 1330
cagaaauugcacaugagc

SEQ ID NO: 452092 - RNA, 18 nt, Brucella suis 1330
cagaaauccauagcgaau

SEQ ID NO: 452093 - RNA, 18 nt, Brucella suis 1330
cacgucguggccagccgc

SEQ ID NO: 452094 - RNA, 22 nt, Brucella suis 1330
uuuuugguuugaaaauguucua

SEQ ID NO: 452095 - RNA, 22 nt, Brucella suis 1330
uuuuugacugcugccaaaaauc

SEQ ID NO: 452096 - RNA, 15 nt, Brucella suis 1330
uuugugauuccaaca

SEQ ID NO: 452097 - RNA, 12 nt, Brucella suis 1330
uuuguugcacuc

SEQ ID NO: 452098 - RNA, 16 nt, Brucella suis 1330
uuuuaacuguucuucc

SEQ ID NO: 452099 - RNA, 21 nt, Brucella suis 1330
uuuuauugcccggaucaucca

SEQ ID NO: 452100 - RNA, 12 nt, Brucella suis 1330
uuuuccagugca

SEQ ID NO: 452101 - RNA, 12 nt, Brucella suis 1330
uuuucuucaucc

SEQ ID NO: 452102 - RNA, 13 nt, Brucella suis 1330
uuuucuucaucca

SEQ ID NO: 452103 - RNA, 20 nt, Brucella suis 1330
uuugcgccgggucagauuga

SEQ ID NO: 452104 - RNA, 21 nt, Brucella suis 1330
uuugcagcaauuccugcgcca

SEQ ID NO: 452105 - RNA, 18 nt, Brucella suis 1330
uuugcaggucugauugca

SEQ ID NO: 452106 - RNA, 12 nt, Brucella suis 1330
uuugagcugcug

SEQ ID NO: 452107 - RNA, 15 nt, Brucella suis 1330
uuugaguuuuucuuc

SEQ ID NO: 452108 - RNA, 12 nt, Brucella suis 1330
uuucuucaucca

SEQ ID NO: 452109 - RNA, 15 nt, Brucella suis 1330
uuucuucauccaguu

SEQ ID NO: 452110 - RNA, 23 nt, Brucella suis 1330
uuucuuguaucuugcggguugaa

SEQ ID NO: 452111 - RNA, 17 nt, Brucella suis 1330
uuugaaaauguucuaaa

SEQ ID NO: 452112 - RNA, 21 nt, Brucella suis 1330
uuugaaucccggcuguuacau

SEQ ID NO: 452113 - RNA, 17 nt, Brucella suis 1330
uuugacgcgcaucuuuu

SEQ ID NO: 452114 - RNA, 19 nt, Brucella suis 1330
uuugacggacgccugccau

SEQ ID NO: 452115 - RNA, 18 nt, Brucella suis 1330
uuugacugcugccaaaaa

SEQ ID NO: 452116 - RNA, 14 nt, Brucella suis 1330
uuucucaaugcgaa

SEQ ID NO: 452117 - RNA, 22 nt, Brucella suis 1330
uuucguccagaucggccuugau

SEQ ID NO: 452118 - RNA, 15 nt, Brucella suis 1330
uuucggaaaagaugc

SEQ ID NO: 452119 - RNA, 18 nt, Brucella suis 1330
uuucgccgcgcacuggca

SEQ ID NO: 452120 - RNA, 13 nt, Brucella suis 1330
uuuccggcugccu

SEQ ID NO: 452121 - RNA, 13 nt, Brucella suis 1330
uuuccggcuucca

SEQ ID NO: 452122 - RNA, 20 nt, Brucella suis 1330
uuuccgcuccugguucauca

SEQ ID NO: 452123 - RNA, 17 nt, Brucella suis 1330
uuuccguggugcugcau

SEQ ID NO: 452124 - RNA, 17 nt, Brucella suis 1330
uuuccugucccuucuug

SEQ ID NO: 452125 - RNA, 22 nt, Brucella suis 1330
uuucccgugcggccuugcgguc

SEQ ID NO: 452126 - RNA, 21 nt, Brucella suis 1330
uuuccccgcauaaaugcuccu

SEQ ID NO: 452127 - RNA, 17 nt, Brucella suis 1330
uuucccggcgcacggcg

SEQ ID NO: 452128 - RNA, 12 nt, Brucella suis 1330
uuuccaucacuu

SEQ ID NO: 452129 - RNA, 17 nt, Brucella suis 1330
uuuccaguuccauugca

SEQ ID NO: 452130 - RNA, 21 nt, Brucella suis 1330
uuuccagcaaaagugagaaac

SEQ ID NO: 452131 - RNA, 13 nt, Brucella suis 1330
uuuccagcccccu

SEQ ID NO: 452132 - RNA, 21 nt, Brucella suis 1330
uuucauuaucggcggcuuccu

SEQ ID NO: 452133 - RNA, 13 nt, Brucella suis 1330
uuucauucugaau

SEQ ID NO: 452134 - RNA, 14 nt, Brucella suis 1330
uuucaugaaaaugc

SEQ ID NO: 452135 - RNA, 16 nt, Brucella suis 1330
uuucaugaaaaugcca

SEQ ID NO: 452136 - RNA, 23 nt, Brucella suis 1330
uuucagguggcggauugcagcgg

SEQ ID NO: 452137 - RNA, 17 nt, Brucella suis 1330
uuucagcaggcguugca

SEQ ID NO: 452138 - RNA, 20 nt, Brucella suis 1330
uuuauugcccggaucaucca

SEQ ID NO: 452139 - RNA, 13 nt, Brucella suis 1330
uuucaacgcuguc

SEQ ID NO: 452140 - RNA, 17 nt, Brucella suis 1330
uuucacauagccugcaa

SEQ ID NO: 452141 - RNA, 17 nt, Brucella suis 1330
uuucaccauggccgcau

SEQ ID NO: 452142 - RNA, 16 nt, Brucella suis 1330
uuucacugcauuggcg

SEQ ID NO: 452143 - RNA, 14 nt, Brucella suis 1330
uugugauuccaaca

SEQ ID NO: 452144 - RNA, 22 nt, Brucella suis 1330
uuguuccagccgggcuuuccug

SEQ ID NO: 452145 - RNA, 22 nt, Brucella suis 1330
uuguucgacuugaagagccgca

SEQ ID NO: 452146 - RNA, 13 nt, Brucella suis 1330
uugucaggaaaaa

SEQ ID NO: 452147 - RNA, 21 nt, Brucella suis 1330
uuuaaccggaaccgcucugga

SEQ ID NO: 452148 - RNA, 19 nt, Brucella suis 1330
uugcuccagcccuuuccug

SEQ ID NO: 452149 - RNA, 23 nt, Brucella suis 1330
uugcugccugcggugcugaaggc

SEQ ID NO: 452150 - RNA, 13 nt, Brucella suis 1330
uugcguuggaaaa

SEQ ID NO: 452151 - RNA, 17 nt, Brucella suis 1330
uugcguuggaaaaugcg

SEQ ID NO: 452152 - RNA, 14 nt, Brucella suis 1330
uugcgaggaaaaga

SEQ ID NO: 452153 - RNA, 12 nt, Brucella suis 1330
uugccuugucca

SEQ ID NO: 452154 - RNA, 20 nt, Brucella suis 1330
uugccgcauaaagcacagcc

SEQ ID NO: 452155 - RNA, 17 nt, Brucella suis 1330
uugcccauguccgccug

SEQ ID NO: 452156 - RNA, 19 nt, Brucella suis 1330
uugccaagcguugcaagau

SEQ ID NO: 452157 - RNA, 14 nt, Brucella suis 1330
uugcauuccagaag

SEQ ID NO: 452158 - RNA, 14 nt, Brucella suis 1330
uugcacuuuggcaa

SEQ ID NO: 452159 - RNA, 16 nt, Brucella suis 1330
uugcagaugagcggca

SEQ ID NO: 452160 - RNA, 20 nt, Brucella suis 1330
uugcaccguuucaaacccca

SEQ ID NO: 452161 - RNA, 22 nt, Brucella suis 1330
uugcacagcggucgaaaccuug

SEQ ID NO: 452162 - RNA, 19 nt, Brucella suis 1330
uugcaacgacauagauucc

SEQ ID NO: 452163 - RNA, 15 nt, Brucella suis 1330
uugacguuugaaucc

SEQ ID NO: 452164 - RNA, 16 nt, Brucella suis 1330
uugaccacauugcccc

SEQ ID NO: 452165 - RNA, 19 nt, Brucella suis 1330
uugaagcugucgccagcgc

SEQ ID NO: 452166 - RNA, 18 nt, Brucella suis 1330
uugaagccaucuuucuug

SEQ ID NO: 452167 - RNA, 18 nt, Brucella suis 1330
uugaaaaggauauccuug

SEQ ID NO: 452168 - RNA, 20 nt, Brucella suis 1330
uucugcccgccggggccgga

SEQ ID NO: 452169 - RNA, 18 nt, Brucella suis 1330
uucugccggugccggcag

SEQ ID NO: 452170 - RNA, 23 nt, Brucella suis 1330
uucuccaucugcggcgucagggc

SEQ ID NO: 452171 - RNA, 23 nt, Brucella suis 1330
uucugcgcccgcgccgcuugcca

SEQ ID NO: 452172 - RNA, 14 nt, Brucella suis 1330
uucuguuaucccuc

SEQ ID NO: 452173 - RNA, 19 nt, Brucella suis 1330
uucuguuucguuugcaaua

SEQ ID NO: 452174 - RNA, 13 nt, Brucella suis 1330
uucuuaugccaga

SEQ ID NO: 452175 - RNA, 22 nt, Brucella suis 1330
uucggugacgaauucaaccaua

SEQ ID NO: 452176 - RNA, 21 nt, Brucella suis 1330
uucguuuuaucagcuuauucu

SEQ ID NO: 452177 - RNA, 23 nt, Brucella suis 1330
uucgggaugcgcucuaugcagca

SEQ ID NO: 452178 - RNA, 22 nt, Brucella suis 1330
uucggcuuccuugcgcuugcga

SEQ ID NO: 452179 - RNA, 15 nt, Brucella suis 1330
uucggcggcuuucca

SEQ ID NO: 452180 - RNA, 14 nt, Brucella suis 1330
uucggcgggcuuuu

SEQ ID NO: 452181 - RNA, 21 nt, Brucella suis 1330
uucggccuugacggagagagg

SEQ ID NO: 452182 - RNA, 14 nt, Brucella suis 1330
uucuaaagcaaaac

SEQ ID NO: 452183 - RNA, 13 nt, Brucella suis 1330
uucuauugaacac

SEQ ID NO: 452184 - RNA, 20 nt, Brucella suis 1330
uuaccgcccuuuuugaagcc

SEQ ID NO: 452185 - RNA, 15 nt, Brucella suis 1330
uuacaaaaaaaucuc

SEQ ID NO: 452186 - RNA, 16 nt, Brucella suis 1330
uuacuugcgcuuugca

SEQ ID NO: 452187 - RNA, 19 nt, Brucella suis 1330
uuaggcggauuucaggcgc

SEQ ID NO: 452188 - RNA, 21 nt, Brucella suis 1330
uguuucgauucgcccggccca

SEQ ID NO: 452189 - RNA, 18 nt, Brucella suis 1330
uguuucgcgcaauggcug

SEQ ID NO: 452190 - RNA, 17 nt, Brucella suis 1330
uguuuuaacacaaucgc

SEQ ID NO: 452191 - RNA, 18 nt, Brucella suis 1330
uguuuugccgcauuaucc

SEQ ID NO: 452192 - RNA, 15 nt, Brucella suis 1330
uuaaacuaccaucug

SEQ ID NO: 452193 - RNA, 17 nt, Brucella suis 1330
uuaaagagccauuauuc

SEQ ID NO: 452194 - RNA, 14 nt, Brucella suis 1330
uguuguuucaggcc

SEQ ID NO: 452195 - RNA, 19 nt, Brucella suis 1330
uguuggcccauaucaucag

SEQ ID NO: 452196 - RNA, 17 nt, Brucella suis 1330
uguugggguuggccuga

SEQ ID NO: 452197 - RNA, 13 nt, Brucella suis 1330
uguuccgggccgg

SEQ ID NO: 452198 - RNA, 20 nt, Brucella suis 1330
uguucagccgcagccgccau

SEQ ID NO: 452199 - RNA, 17 nt, Brucella suis 1330
ugugcgggcuucuucca

SEQ ID NO: 452200 - RNA, 12 nt, Brucella suis 1330
ugugcgcgcgcc

SEQ ID NO: 452201 - RNA, 20 nt, Brucella suis 1330
ugugcgcgcgccaucggcaa

SEQ ID NO: 452202 - RNA, 18 nt, Brucella suis 1330
ugugccugaaacaaggcc

SEQ ID NO: 452203 - RNA, 14 nt, Brucella suis 1330
ugugacgacaacca

SEQ ID NO: 452204 - RNA, 14 nt, Brucella suis 1330
ugugagcacaaaag

SEQ ID NO: 452205 - RNA, 17 nt, Brucella suis 1330
ugucagccgguagccuu

SEQ ID NO: 452206 - RNA, 16 nt, Brucella suis 1330
ugucagcgccgcccag

SEQ ID NO: 452207 - RNA, 15 nt, Brucella suis 1330
ugucaccacaucggc

SEQ ID NO: 452208 - RNA, 16 nt, Brucella suis 1330
ugucacgaucuugccg

SEQ ID NO: 452209 - RNA, 19 nt, Brucella suis 1330
ugucacgccggcaucaaac

SEQ ID NO: 452210 - RNA, 15 nt, Brucella suis 1330
uguaucaccagaccg

SEQ ID NO: 452211 - RNA, 20 nt, Brucella suis 1330
uguagccgcgaaccgucgcc

SEQ ID NO: 452212 - RNA, 23 nt, Brucella suis 1330
uguacccaaacguacauuguucc

SEQ ID NO: 452213 - RNA, 22 nt, Brucella suis 1330
uguaccuuaaaguacacuccgc

SEQ ID NO: 452214 - RNA, 21 nt, Brucella suis 1330
uggugucauagaccaugacgc

SEQ ID NO: 452215 - RNA, 16 nt, Brucella suis 1330
uggugagcauggucac

SEQ ID NO: 452216 - RNA, 16 nt, Brucella suis 1330
uggugaguugaagaua

SEQ ID NO: 452217 - RNA, 17 nt, Brucella suis 1330
ugggcucuuguggucau

SEQ ID NO: 452218 - RNA, 15 nt, Brucella suis 1330
ugggcugauuuaggc

SEQ ID NO: 452219 - RNA, 14 nt, Brucella suis 1330
ugggccuuguuuuc

SEQ ID NO: 452220 - RNA, 17 nt, Brucella suis 1330
ugggcauggaaacgaac

SEQ ID NO: 452221 - RNA, 12 nt, Brucella suis 1330
ugggcagcagau

SEQ ID NO: 452222 - RNA, 16 nt, Brucella suis 1330
ugggcaagaucauccg

SEQ ID NO: 452223 - RNA, 17 nt, Brucella suis 1330
uggcggauugcagcggu

SEQ ID NO: 452224 - RNA, 20 nt, Brucella suis 1330
uggcgcgaaaccggaacgcc

SEQ ID NO: 452225 - RNA, 19 nt, Brucella suis 1330
uggcgcacccgaaaggauu

SEQ ID NO: 452226 - RNA, 22 nt, Brucella suis 1330
uggcgagcgcgcuuaugaucug

SEQ ID NO: 452227 - RNA, 21 nt, Brucella suis 1330
uggcgaaaacggccaugcgca

SEQ ID NO: 452228 - RNA, 21 nt, Brucella suis 1330
uggccuugugcagaugcacca

SEQ ID NO: 452229 - RNA, 22 nt, Brucella suis 1330
uggccuugccgaucuggugcgg

SEQ ID NO: 452230 - RNA, 16 nt, Brucella suis 1330
uggccuuugcccuggg

SEQ ID NO: 452231 - RNA, 13 nt, Brucella suis 1330
uggccgcucgcug

SEQ ID NO: 452232 - RNA, 18 nt, Brucella suis 1330
uggccgccccggcgcagc

SEQ ID NO: 452233 - RNA, 22 nt, Brucella suis 1330
uggccgccccggcgcagcgcgu

SEQ ID NO: 452234 - RNA, 20 nt, Brucella suis 1330
uggccgcauugucgaaggac

SEQ ID NO: 452235 - RNA, 18 nt, Brucella suis 1330
uggccccauaaagcuggu

SEQ ID NO: 452236 - RNA, 22 nt, Brucella suis 1330
uggccagccgcaaugagcccgc

SEQ ID NO: 452237 - RNA, 21 nt, Brucella suis 1330
uggcaucaauccuucaugccg

SEQ ID NO: 452238 - RNA, 22 nt, Brucella suis 1330
uggcauaggagacuguuccgcc

SEQ ID NO: 452239 - RNA, 13 nt, Brucella suis 1330
uggcagcgccggg

SEQ ID NO: 452240 - RNA, 14 nt, Brucella suis 1330
uggcagcagucaaa

SEQ ID NO: 452241 - RNA, 15 nt, Brucella suis 1330
uggcaauuuccagau

SEQ ID NO: 452242 - RNA, 22 nt, Brucella suis 1330
uggaguuugacaagaucgucac

SEQ ID NO: 452243 - RNA, 18 nt, Brucella suis 1330
uggauauccacaagcauc

SEQ ID NO: 452244 - RNA, 20 nt, Brucella suis 1330
uggagcguacaccgaccagc

SEQ ID NO: 452245 - RNA, 12 nt, Brucella suis 1330
uggagcaggcca

SEQ ID NO: 452246 - RNA, 16 nt, Brucella suis 1330
uggagcauuuccagca

SEQ ID NO: 452247 - RNA, 19 nt, Brucella suis 1330
uggagcauuuccagcaaaa

SEQ ID NO: 452248 - RNA, 19 nt, Brucella suis 1330
uggagagaggaagcaagaa

SEQ ID NO: 452249 - RNA, 16 nt, Brucella suis 1330
uggacaugaacacggc

SEQ ID NO: 452250 - RNA, 20 nt, Brucella suis 1330
uggaccacgcauagcgcgcc

SEQ ID NO: 452251 - RNA, 23 nt, Brucella suis 1330
uggacauagccgguauccagcag

SEQ ID NO: 452252 - RNA, 13 nt, Brucella suis 1330
uggaauuucuaaa

SEQ ID NO: 452253 - RNA, 20 nt, Brucella suis 1330
uggaagcacauggcggccuu

SEQ ID NO: 452254 - RNA, 17 nt, Brucella suis 1330
uggaagacauugccaag

SEQ ID NO: 452255 - RNA, 19 nt, Brucella suis 1330
uggaacggaaaaugcccgg

SEQ ID NO: 452256 - RNA, 18 nt, Brucella suis 1330
uggaacgggcccuucgcu

SEQ ID NO: 452257 - RNA, 22 nt, Brucella suis 1330
uggaaauugacauuugaagcga

SEQ ID NO: 452258 - RNA, 23 nt, Brucella suis 1330
uggaaauugacauuugaagcgac

SEQ ID NO: 452259 - RNA, 22 nt, Brucella suis 1330
uggaaacggcgcaucauccuga

SEQ ID NO: 452260 - RNA, 21 nt, Brucella suis 1330
ugcuuugaugcguugaaugca

SEQ ID NO: 452261 - RNA, 12 nt, Brucella suis 1330
ugcuuuccugca

SEQ ID NO: 452262 - RNA, 20 nt, Brucella suis 1330
ugcuuucggcggcaguuuca

SEQ ID NO: 452263 - RNA, 20 nt, Brucella suis 1330
ugcuuguagacgaucuugcc

SEQ ID NO: 452264 - RNA, 12 nt, Brucella suis 1330
ugcuucuugccu

SEQ ID NO: 452265 - RNA, 22 nt, Brucella suis 1330
ugcuucggccgacagaugcgca

SEQ ID NO: 452266 - RNA, 17 nt, Brucella suis 1330
ugcuggugccgcuggcu

SEQ ID NO: 452267 - RNA, 16 nt, Brucella suis 1330
ugcuggugaaagaccg

SEQ ID NO: 452268 - RNA, 13 nt, Brucella suis 1330
ugcuggccguggc

SEQ ID NO: 452269 - RNA, 18 nt, Brucella suis 1330
ugcuggccguggcaucaa

SEQ ID NO: 452270 - RNA, 16 nt, Brucella suis 1330
ugcucugcgcccaggc

SEQ ID NO: 452271 - RNA, 19 nt, Brucella suis 1330
ugcucgcgguugaggauuu

SEQ ID NO: 452272 - RNA, 22 nt, Brucella suis 1330
ugcucgcgguugaggauuucca

SEQ ID NO: 452273 - RNA, 14 nt, Brucella suis 1330
ugcucccaugccac

SEQ ID NO: 452274 - RNA, 20 nt, Brucella suis 1330
ugcuccagcccuuuccugac

SEQ ID NO: 452275 - RNA, 20 nt, Brucella suis 1330
ugcguuuucgagccaaaagu

SEQ ID NO: 452276 - RNA, 16 nt, Brucella suis 1330
ugcuauaagcaacagg

SEQ ID NO: 452277 - RNA, 16 nt, Brucella suis 1330
ugcuaucaacgcugca

SEQ ID NO: 452278 - RNA, 16 nt, Brucella suis 1330
ugcuauggcacaagaa

SEQ ID NO: 452279 - RNA, 20 nt, Brucella suis 1330
ugcgucaggcccagaugcag

SEQ ID NO: 452280 - RNA, 15 nt, Brucella suis 1330
ugcgggcaagcauuc

SEQ ID NO: 452281 - RNA, 22 nt, Brucella suis 1330
ugcgggcaagcauuccgggccg

SEQ ID NO: 452282 - RNA, 16 nt, Brucella suis 1330
ugcgcucuaaccauuu

SEQ ID NO: 452283 - RNA, 14 nt, Brucella suis 1330
ugcgcucuaugcag

SEQ ID NO: 452284 - RNA, 21 nt, Brucella suis 1330
ugcgcugauucuggauuucau

SEQ ID NO: 452285 - RNA, 20 nt, Brucella suis 1330
ugcgcaugaagcgcggcggc

SEQ ID NO: 452286 - RNA, 17 nt, Brucella suis 1330
ugcgcaucgucaaucac

SEQ ID NO: 452287 - RNA, 15 nt, Brucella suis 1330
ugcgcuccaccagca

SEQ ID NO: 452288 - RNA, 20 nt, Brucella suis 1330
ugcgcacgccugccgcgcgg

SEQ ID NO: 452289 - RNA, 16 nt, Brucella suis 1330
ugcgcaccgguauugc

SEQ ID NO: 452290 - RNA, 18 nt, Brucella suis 1330
ugcgauuucgccaaguuc

SEQ ID NO: 452291 - RNA, 20 nt, Brucella suis 1330
ugcgaugagccuucaucuuc

SEQ ID NO: 452292 - RNA, 18 nt, Brucella suis 1330
ugcgagaagggcugaggc

SEQ ID NO: 452293 - RNA, 22 nt, Brucella suis 1330
ugcgaccauggcgcauucagag

SEQ ID NO: 452294 - RNA, 23 nt, Brucella suis 1330
ugcgacauguuuuggaaagaaau

SEQ ID NO: 452295 - RNA, 17 nt, Brucella suis 1330
ugcgaaggcccuucagg

SEQ ID NO: 452296 - RNA, 16 nt, Brucella suis 1330
ugcgaaacggagaaaa

SEQ ID NO: 452297 - RNA, 13 nt, Brucella suis 1330
ugcgaaagcaccg

SEQ ID NO: 452298 - RNA, 19 nt, Brucella suis 1330
ugcgaaaaugauagcugca

SEQ ID NO: 452299 - RNA, 18 nt, Brucella suis 1330
ugccuugucgaggcugcg

SEQ ID NO: 452300 - RNA, 12 nt, Brucella suis 1330
ugccuugaucca

SEQ ID NO: 452301 - RNA, 18 nt, Brucella suis 1330
ugccuuuagccaagccau

SEQ ID NO: 452302 - RNA, 22 nt, Brucella suis 1330
ugccuuucaggucgucuuucag

SEQ ID NO: 452303 - RNA, 15 nt, Brucella suis 1330
ugccugccgcagcca

SEQ ID NO: 452304 - RNA, 17 nt, Brucella suis 1330
ugccuuaaucccuuacu

SEQ ID NO: 452305 - RNA, 16 nt, Brucella suis 1330
ugccuuaugucaugga

SEQ ID NO: 452306 - RNA, 21 nt, Brucella suis 1330
ugccgucuuugcgggcaaaau

SEQ ID NO: 452307 - RNA, 19 nt, Brucella suis 1330
ugccgucaacagccuuggc

SEQ ID NO: 452308 - RNA, 18 nt, Brucella suis 1330
ugccguaucacgccgcga

SEQ ID NO: 452309 - RNA, 17 nt, Brucella suis 1330
ugccggaucgaggccga

SEQ ID NO: 452310 - RNA, 14 nt, Brucella suis 1330
ugccgccgcuucca

SEQ ID NO: 452311 - RNA, 14 nt, Brucella suis 1330
ugccgcaauccugg

SEQ ID NO: 452312 - RNA, 13 nt, Brucella suis 1330
ugccgagaaugcg

SEQ ID NO: 452313 - RNA, 14 nt, Brucella suis 1330
ugccgaaucaaaca

SEQ ID NO: 452314 - RNA, 17 nt, Brucella suis 1330
ugccgaagcccauggca

SEQ ID NO: 452315 - RNA, 13 nt, Brucella suis 1330
ugcccgccggggc

SEQ ID NO: 452316 - RNA, 19 nt, Brucella suis 1330
ugcccgccggggccggaug

SEQ ID NO: 452317 - RNA, 16 nt, Brucella suis 1330
ugcccaugcaguucca

SEQ ID NO: 452318 - RNA, 19 nt, Brucella suis 1330
ugcccauguccgccugauc

SEQ ID NO: 452319 - RNA, 20 nt, Brucella suis 1330
ugcccagaaauccacuacaa

SEQ ID NO: 452320 - RNA, 18 nt, Brucella suis 1330
ugcccacaucgccuugca

SEQ ID NO: 452321 - RNA, 16 nt, Brucella suis 1330
ugccauauaggauucu

SEQ ID NO: 452322 - RNA, 14 nt, Brucella suis 1330
ugccauaauucagc

SEQ ID NO: 452323 - RNA, 16 nt, Brucella suis 1330
ugccauaauucagcuu

SEQ ID NO: 452324 - RNA, 15 nt, Brucella suis 1330
ugccagcaccagcgg

SEQ ID NO: 452325 - RNA, 17 nt, Brucella suis 1330
ugcagucuucggccggg

SEQ ID NO: 452326 - RNA, 19 nt, Brucella suis 1330
ugcagucuucggccgggca

SEQ ID NO: 452327 - RNA, 18 nt, Brucella suis 1330
ugcaggucugauugcagg

SEQ ID NO: 452328 - RNA, 22 nt, Brucella suis 1330
ugcaggcugcccaugcccgcca

SEQ ID NO: 452329 - RNA, 21 nt, Brucella suis 1330
ugcaggcgcggcaacgcuggc

SEQ ID NO: 452330 - RNA, 23 nt, Brucella suis 1330
ugcaggccgucagaaccggaaua

SEQ ID NO: 452331 - RNA, 15 nt, Brucella suis 1330
ugcaggacuggacau

SEQ ID NO: 452332 - RNA, 15 nt, Brucella suis 1330
ugcagccugaacagc

SEQ ID NO: 452333 - RNA, 18 nt, Brucella suis 1330
ugcagccugaacagcguu

SEQ ID NO: 452334 - RNA, 15 nt, Brucella suis 1330
ugcagaucgcaucca

SEQ ID NO: 452335 - RNA, 17 nt, Brucella suis 1330
ugcagagcgcauccagc

SEQ ID NO: 452336 - RNA, 20 nt, Brucella suis 1330
ugcagauaaagggugauggc

SEQ ID NO: 452337 - RNA, 18 nt, Brucella suis 1330
ugcagacgggacgcaggc

SEQ ID NO: 452338 - RNA, 23 nt, Brucella suis 1330
ugcagacaaguccuaaaacaccg

SEQ ID NO: 452339 - RNA, 13 nt, Brucella suis 1330
ugcagacacgcuu

SEQ ID NO: 452340 - RNA, 14 nt, Brucella suis 1330
ugcagacaggccag

SEQ ID NO: 452341 - RNA, 20 nt, Brucella suis 1330
ugcacguucauauguucaag

SEQ ID NO: 452342 - RNA, 15 nt, Brucella suis 1330
ugcagaaauucauag

SEQ ID NO: 452343 - RNA, 16 nt, Brucella suis 1330
ugcagaacgucucggg

SEQ ID NO: 452344 - RNA, 23 nt, Brucella suis 1330
ugcacagcggucgaaaccuuguu

SEQ ID NO: 452345 - RNA, 17 nt, Brucella suis 1330
ugcaaugcgucgauggc

SEQ ID NO: 452346 - RNA, 14 nt, Brucella suis 1330
ugcaagccgcggcg

SEQ ID NO: 452347 - RNA, 15 nt, Brucella suis 1330
ugcaagcgcaaagcu

SEQ ID NO: 452348 - RNA, 20 nt, Brucella suis 1330
ugauggcgagaacuucccgc

SEQ ID NO: 452349 - RNA, 21 nt, Brucella suis 1330
ugauggcccuuguggccacga

SEQ ID NO: 452350 - RNA, 15 nt, Brucella suis 1330
ugauuugauccaugc

SEQ ID NO: 452351 - RNA, 20 nt, Brucella suis 1330
ugcaaaccuccgacaccagc

SEQ ID NO: 452352 - RNA, 18 nt, Brucella suis 1330
ugaugauuucccgugcgg

SEQ ID NO: 452353 - RNA, 18 nt, Brucella suis 1330
ugaucgauucggcuucac

SEQ ID NO: 452354 - RNA, 13 nt, Brucella suis 1330
ugaucggcgugcc

SEQ ID NO: 452355 - RNA, 18 nt, Brucella suis 1330
ugaucggcgugccauugu

SEQ ID NO: 452356 - RNA, 17 nt, Brucella suis 1330
ugauccgcuccagauug

SEQ ID NO: 452357 - RNA, 20 nt, Brucella suis 1330
ugagugcgcacgccugccgc

SEQ ID NO: 452358 - RNA, 13 nt, Brucella suis 1330
ugagggccagaag

SEQ ID NO: 452359 - RNA, 15 nt, Brucella suis 1330
ugaggccgguaaaau

SEQ ID NO: 452360 - RNA, 16 nt, Brucella suis 1330
ugagcugcucggcaag

SEQ ID NO: 452361 - RNA, 15 nt, Brucella suis 1330
ugagcggcagcagcc

SEQ ID NO: 452362 - RNA, 16 nt, Brucella suis 1330
ugagcggcagcagcca

SEQ ID NO: 452363 - RNA, 16 nt, Brucella suis 1330
ugagcggcaggccgca

SEQ ID NO: 452364 - RNA, 14 nt, Brucella suis 1330
ugagcgaaaucggg

SEQ ID NO: 452365 - RNA, 15 nt, Brucella suis 1330
ugagcgacaggaaca

SEQ ID NO: 452366 - RNA, 23 nt, Brucella suis 1330
ugagcaccggaagcgcaaaacag

SEQ ID NO: 452367 - RNA, 14 nt, Brucella suis 1330
ugagauagccuugg

SEQ ID NO: 452368 - RNA, 22 nt, Brucella suis 1330
ugagaucaaccccgcacgguca

SEQ ID NO: 452369 - RNA, 16 nt, Brucella suis 1330
ugagaaggcaagcccc

SEQ ID NO: 452370 - RNA, 14 nt, Brucella suis 1330
ugagaucgcgcgca

SEQ ID NO: 452371 - RNA, 21 nt, Brucella suis 1330
ugacggaugaggccugauagc

SEQ ID NO: 452372 - RNA, 15 nt, Brucella suis 1330
ugacggcgcggcgca

SEQ ID NO: 452373 - RNA, 22 nt, Brucella suis 1330
ugacggcgcagcgacuuccagu

SEQ ID NO: 452374 - RNA, 22 nt, Brucella suis 1330
ugacugcgccauccguugcgac

SEQ ID NO: 452375 - RNA, 21 nt, Brucella suis 1330
ugacgauggggauugccauga

SEQ ID NO: 452376 - RNA, 18 nt, Brucella suis 1330
ugacgcugaagaaaacaa

SEQ ID NO: 452377 - RNA, 18 nt, Brucella suis 1330
ugacgagcgcacgcaggc

SEQ ID NO: 452378 - RNA, 18 nt, Brucella suis 1330
ugacgaucaccuguggcu

SEQ ID NO: 452379 - RNA, 20 nt, Brucella suis 1330
ugaccggaugcaaaaccggu

SEQ ID NO: 452380 - RNA, 23 nt, Brucella suis 1330
ugacccgcccuucaucaccuuca

SEQ ID NO: 452381 - RNA, 19 nt, Brucella suis 1330
ugaccgcuaucgcugcuuu

SEQ ID NO: 452382 - RNA, 14 nt, Brucella suis 1330
ugaccacgggcuuu

SEQ ID NO: 452383 - RNA, 16 nt, Brucella suis 1330
ugaccauagcggugcu

SEQ ID NO: 452384 - RNA, 20 nt, Brucella suis 1330
ugacagaauuuggaaguuuu

SEQ ID NO: 452385 - RNA, 12 nt, Brucella suis 1330
ugacagccuggg

SEQ ID NO: 452386 - RNA, 11 nt, Brucella suis 1330
ugaaugcaauc

SEQ ID NO: 452387 - RNA, 15 nt, Brucella suis 1330
ucuugcgcccuccac

SEQ ID NO: 452388 - RNA, 22 nt, Brucella suis 1330
ucuugcgcccuccaccgcucac

SEQ ID NO: 452389 - RNA, 21 nt, Brucella suis 1330
ucuugccggccugaaacagca

SEQ ID NO: 452390 - RNA, 17 nt, Brucella suis 1330
ucuugcccagaacaucg

SEQ ID NO: 452391 - RNA, 12 nt, Brucella suis 1330
ucuugccgccgc

SEQ ID NO: 452392 - RNA, 15 nt, Brucella suis 1330
ucuugccaacauggc

SEQ ID NO: 452393 - RNA, 18 nt, Brucella suis 1330
ucuugacguuauuuccga

SEQ ID NO: 452394 - RNA, 17 nt, Brucella suis 1330
ucuugagguugagcugc

SEQ ID NO: 452395 - RNA, 14 nt, Brucella suis 1330
ucuucuugcauucg

SEQ ID NO: 452396 - RNA, 13 nt, Brucella suis 1330
ucuucgcccgacu

SEQ ID NO: 452397 - RNA, 20 nt, Brucella suis 1330
ucuucauuuuaucaauaagu

SEQ ID NO: 452398 - RNA, 18 nt, Brucella suis 1330
ucuggcgauaaagaugcg

SEQ ID NO: 452399 - RNA, 18 nt, Brucella suis 1330
ucuggauuucauccagcg

SEQ ID NO: 452400 - RNA, 18 nt, Brucella suis 1330
ucugcgccgguuuuccgu

SEQ ID NO: 452401 - RNA, 22 nt, Brucella suis 1330
ucugcgccguaguagcuaaugu

SEQ ID NO: 452402 - RNA, 20 nt, Brucella suis 1330
ucugccggugccggcaggcu

SEQ ID NO: 452403 - RNA, 17 nt, Brucella suis 1330
ucugccgguucugcaug

SEQ ID NO: 452404 - RNA, 22 nt, Brucella suis 1330
ucugccgguuuccagccugcug

SEQ ID NO: 452405 - RNA, 15 nt, Brucella suis 1330
ucugccgucagcaaa

SEQ ID NO: 452406 - RNA, 17 nt, Brucella suis 1330
ucugccugcccucgucc

SEQ ID NO: 452407 - RNA, 21 nt, Brucella suis 1330
ucugcccgccggggccggaug

SEQ ID NO: 452408 - RNA, 12 nt, Brucella suis 1330
ucugccaaccau

SEQ ID NO: 452409 - RNA, 21 nt, Brucella suis 1330
ucucgcgguucuugcggcguu

SEQ ID NO: 452410 - RNA, 20 nt, Brucella suis 1330
ucugacccggcgcaaaggcc

SEQ ID NO: 452411 - RNA, 21 nt, Brucella suis 1330
ucuccuaaacucaucaaaagc

SEQ ID NO: 452412 - RNA, 16 nt, Brucella suis 1330
ucucacacugcaaaac

SEQ ID NO: 452413 - RNA, 14 nt, Brucella suis 1330
ucucacagccauca

SEQ ID NO: 452414 - RNA, 12 nt, Brucella suis 1330
ucguugcuuccg

SEQ ID NO: 452415 - RNA, 22 nt, Brucella suis 1330
ucguuugccucggagccuucau

SEQ ID NO: 452416 - RNA, 11 nt, Brucella suis 1330
ucguuuucaug

SEQ ID NO: 452417 - RNA, 17 nt, Brucella suis 1330
ucgugucauagccgaug

SEQ ID NO: 452418 - RNA, 20 nt, Brucella suis 1330
ucguggucgccucuucaucc

SEQ ID NO: 452419 - RNA, 14 nt, Brucella suis 1330
ucguggccagccgc

SEQ ID NO: 452420 - RNA, 21 nt, Brucella suis 1330
ucguggcggcaaaaagcggcg

SEQ ID NO: 452421 - RNA, 14 nt, Brucella suis 1330
ucgucaugcagacg

SEQ ID NO: 452422 - RNA, 15 nt, Brucella suis 1330
ucgucaaugcgcgcc

SEQ ID NO: 452423 - RNA, 23 nt, Brucella suis 1330
ucgucaaaaccgucgaguugugc

SEQ ID NO: 452424 - RNA, 16 nt, Brucella suis 1330
ucguagcugcuuugcu

SEQ ID NO: 452425 - RNA, 20 nt, Brucella suis 1330
ucgguucgcuggccaugaug

SEQ ID NO: 452426 - RNA, 18 nt, Brucella suis 1330
ucgguuaaacccgagcgu

SEQ ID NO: 452427 - RNA, 15 nt, Brucella suis 1330
ucggcauggcagccg

SEQ ID NO: 452428 - RNA, 22 nt, Brucella suis 1330
ucggcaucgcucaccuuuucca

SEQ ID NO: 452429 - RNA, 12 nt, Brucella suis 1330
ucggcagcgaac

SEQ ID NO: 452430 - RNA, 17 nt, Brucella suis 1330
ucggcagcgaaccgucc

SEQ ID NO: 452431 - RNA, 21 nt, Brucella suis 1330
ucggcaggagcgcgaucaucg

SEQ ID NO: 452432 - RNA, 14 nt, Brucella suis 1330
ucggcaaugaucug

SEQ ID NO: 452433 - RNA, 17 nt, Brucella suis 1330
ucggcacuucgccaaag

SEQ ID NO: 452434 - RNA, 19 nt, Brucella suis 1330
ucggcaagcgcaauggccu

SEQ ID NO: 452435 - RNA, 18 nt, Brucella suis 1330
ucggcaaggccgcgcucc

SEQ ID NO: 452436 - RNA, 17 nt, Brucella suis 1330
ucggcaagggcaagcag

SEQ ID NO: 452437 - RNA, 22 nt, Brucella suis 1330
ucggcaagggcaagcagaacac

SEQ ID NO: 452438 - RNA, 15 nt, Brucella suis 1330
ucggcaacgccgaag

SEQ ID NO: 452439 - RNA, 17 nt, Brucella suis 1330
ucggcaagauggcugcc

SEQ ID NO: 452440 - RNA, 22 nt, Brucella suis 1330
ucggaaauaucgauaucugcaa

SEQ ID NO: 452441 - RNA, 18 nt, Brucella suis 1330
ucgcuuauuggcuuucaa

SEQ ID NO: 452442 - RNA, 19 nt, Brucella suis 1330
ucgcuuauuggcuuucaaa

SEQ ID NO: 452443 - RNA, 20 nt, Brucella suis 1330
ucgcugaucggcgcaggggc

SEQ ID NO: 452444 - RNA, 14 nt, Brucella suis 1330
ucgcugacuucaaa

SEQ ID NO: 452445 - RNA, 21 nt, Brucella suis 1330
ucgcucguaacgggagcagcu

SEQ ID NO: 452446 - RNA, 17 nt, Brucella suis 1330
ucgcucaccuuuuccac

SEQ ID NO: 452447 - RNA, 16 nt, Brucella suis 1330
ucgcuaccaugcggcc

SEQ ID NO: 452448 - RNA, 23 nt, Brucella suis 1330
ucgcgcuuggauacgucacccgc

SEQ ID NO: 452449 - RNA, 14 nt, Brucella suis 1330
ucgcgccaggcuuc

SEQ ID NO: 452450 - RNA, 17 nt, Brucella suis 1330
ucgcgcaauucaugccc

SEQ ID NO: 452451 - RNA, 15 nt, Brucella suis 1330
ucgcgaccuucuugc

SEQ ID NO: 452452 - RNA, 11 nt, Brucella suis 1330
ucgccugcaau

SEQ ID NO: 452453 - RNA, 13 nt, Brucella suis 1330
ucgccugcaaugg

SEQ ID NO: 452454 - RNA, 14 nt, Brucella suis 1330
ucgccugcaaugga

SEQ ID NO: 452455 - RNA, 18 nt, Brucella suis 1330
ucgccgggguuucuucau

SEQ ID NO: 452456 - RNA, 15 nt, Brucella suis 1330
ucgccgcgcacuggc

SEQ ID NO: 452457 - RNA, 18 nt, Brucella suis 1330
ucgccagcucgccggcuu

SEQ ID NO: 452458 - RNA, 14 nt, Brucella suis 1330
ucgccaccauggcc

SEQ ID NO: 452459 - RNA, 18 nt, Brucella suis 1330
ucgccaccauggccgccc

SEQ ID NO: 452460 - RNA, 17 nt, Brucella suis 1330
ucgccaccggcggcgcg

SEQ ID NO: 452461 - RNA, 20 nt, Brucella suis 1330
ucgccaccggcggcgcggcc

SEQ ID NO: 452462 - RNA, 21 nt, Brucella suis 1330
ucgcaaaauaguccaguagcu

SEQ ID NO: 452463 - RNA, 23 nt, Brucella suis 1330
ucgcaaagcguuccgcgcaaaau

SEQ ID NO: 452464 - RNA, 20 nt, Brucella suis 1330
ucgauggugcggaacaaugc

SEQ ID NO: 452465 - RNA, 14 nt, Brucella suis 1330
ucgauggccugcac

SEQ ID NO: 452466 - RNA, 16 nt, Brucella suis 1330
ucgauggccgaauagc

SEQ ID NO: 452467 - RNA, 14 nt, Brucella suis 1330
ucgaucgacccgcc

SEQ ID NO: 452468 - RNA, 19 nt, Brucella suis 1330
ucgaucauauaggccucgg

SEQ ID NO: 452469 - RNA, 16 nt, Brucella suis 1330
ucgaucagcuugucgu

SEQ ID NO: 452470 - RNA, 22 nt, Brucella suis 1330
ucgagcggaagaggacaaggcc

SEQ ID NO: 452471 - RNA, 22 nt, Brucella suis 1330
ucgagcggcacgaugcgcagcc

SEQ ID NO: 452472 - RNA, 14 nt, Brucella suis 1330
ucgagcgccugucc

SEQ ID NO: 452473 - RNA, 16 nt, Brucella suis 1330
ucgagcgugaccagcc

SEQ ID NO: 452474 - RNA, 23 nt, Brucella suis 1330
ucgagcaggcggucgcuugccuu

SEQ ID NO: 452475 - RNA, 21 nt, Brucella suis 1330
ucgagaagcgguguggcccgg

SEQ ID NO: 452476 - RNA, 13 nt, Brucella suis 1330
ucgagaauuucuc

SEQ ID NO: 452477 - RNA, 17 nt, Brucella suis 1330
ucgagacggcgcuccau

SEQ ID NO: 452478 - RNA, 20 nt, Brucella suis 1330
ucgagauggccuugugcaga

SEQ ID NO: 452479 - RNA, 18 nt, Brucella suis 1330
ucgacauggacaggaugc

SEQ ID NO: 452480 - RNA, 19 nt, Brucella suis 1330
ucgacaaagccugaacccc

SEQ ID NO: 452481 - RNA, 13 nt, Brucella suis 1330
ucgacauauuugu

SEQ ID NO: 452482 - RNA, 15 nt, Brucella suis 1330
ucgaauuccaccgcc

SEQ ID NO: 452483 - RNA, 17 nt, Brucella suis 1330
ucgaagcggccuuugau

SEQ ID NO: 452484 - RNA, 21 nt, Brucella suis 1330
uccuuaaccuuuuuccugauc

SEQ ID NO: 452485 - RNA, 23 nt, Brucella suis 1330
uccugcgcccauucaaugccacc

SEQ ID NO: 452486 - RNA, 21 nt, Brucella suis 1330
uccugcgcccugucagaaagu

SEQ ID NO: 452487 - RNA, 16 nt, Brucella suis 1330
uccugccuuugaagac

SEQ ID NO: 452488 - RNA, 19 nt, Brucella suis 1330
uccugcaaaccggcugccg

SEQ ID NO: 452489 - RNA, 14 nt, Brucella suis 1330
uccugaucuugcgu

SEQ ID NO: 452490 - RNA, 18 nt, Brucella suis 1330
uccugaucguguugacca

SEQ ID NO: 452491 - RNA, 16 nt, Brucella suis 1330
uccucugccugcugau

SEQ ID NO: 452492 - RNA, 22 nt, Brucella suis 1330
uccugaaaauacucuacaaucu

SEQ ID NO: 452493 - RNA, 14 nt, Brucella suis 1330
uccucggcccugga

SEQ ID NO: 452494 - RNA, 14 nt, Brucella suis 1330
uccucggcggcgcg

SEQ ID NO: 452495 - RNA, 17 nt, Brucella suis 1330
uccuccugcgcccauuc

SEQ ID NO: 452496 - RNA, 20 nt, Brucella suis 1330
uccuccagcccuucaucaag

SEQ ID NO: 452497 - RNA, 15 nt, Brucella suis 1330
uccuauugccagacg

SEQ ID NO: 452498 - RNA, 12 nt, Brucella suis 1330
uccgugaaucug

SEQ ID NO: 452499 - RNA, 18 nt, Brucella suis 1330
uccgucugcaucgagcgg

SEQ ID NO: 452500 - RNA, 15 nt, Brucella suis 1330
uccguuacacgcccc

SEQ ID NO: 452501 - RNA, 19 nt, Brucella suis 1330
uccgguauaugcaccagcg

SEQ ID NO: 452502 - RNA, 20 nt, Brucella suis 1330
uccgggucuucgcccggcau

SEQ ID NO: 452503 - RNA, 15 nt, Brucella suis 1330
uccgggcugcuucca

SEQ ID NO: 452504 - RNA, 17 nt, Brucella suis 1330
uccgggaagcaguuccu

SEQ ID NO: 452505 - RNA, 15 nt, Brucella suis 1330
uccggcuagaaagga

SEQ ID NO: 452506 - RNA, 17 nt, Brucella suis 1330
uccggcguggccaagau

SEQ ID NO: 452507 - RNA, 22 nt, Brucella suis 1330
uccggccaguggccgaagccgc

SEQ ID NO: 452508 - RNA, 19 nt, Brucella suis 1330
uccggcaaaacggcaggca

SEQ ID NO: 452509 - RNA, 20 nt, Brucella suis 1330
uccggcaaaacggcaggcau

SEQ ID NO: 452510 - RNA, 15 nt, Brucella suis 1330
uccgcgacgccgccc

SEQ ID NO: 452511 - RNA, 15 nt, Brucella suis 1330
uccgcgacaucauca

SEQ ID NO: 452512 - RNA, 17 nt, Brucella suis 1330
uccgccugcgcauggga

SEQ ID NO: 452513 - RNA, 23 nt, Brucella suis 1330
uccgccuucgagaaccagcggcc

SEQ ID NO: 452514 - RNA, 16 nt, Brucella suis 1330
uccgccgaucugcacg

SEQ ID NO: 452515 - RNA, 17 nt, Brucella suis 1330
uccgccagcauuucagg

SEQ ID NO: 452516 - RNA, 21 nt, Brucella suis 1330
uccgcauucccuugaaaucau

SEQ ID NO: 452517 - RNA, 22 nt, Brucella suis 1330
uccgccaccgccggcgccgcca

SEQ ID NO: 452518 - RNA, 15 nt, Brucella suis 1330
uccgccaccgcgccg

SEQ ID NO: 452519 - RNA, 17 nt, Brucella suis 1330
uccgcaccggcauggau

SEQ ID NO: 452520 - RNA, 18 nt, Brucella suis 1330
uccgcaccauucugccca

SEQ ID NO: 452521 - RNA, 17 nt, Brucella suis 1330
uccgcaccucaggauga

SEQ ID NO: 452522 - RNA, 15 nt, Brucella suis 1330
uccgcaagccagucc

SEQ ID NO: 452523 - RNA, 21 nt, Brucella suis 1330
uccgcaagccaguccuugccc

SEQ ID NO: 452524 - RNA, 17 nt, Brucella suis 1330
uccgauggaacugcucc

SEQ ID NO: 452525 - RNA, 17 nt, Brucella suis 1330
uccgagcggcagcggcg

SEQ ID NO: 452526 - RNA, 21 nt, Brucella suis 1330
ucccuguggagagaggaagca

SEQ ID NO: 452527 - RNA, 14 nt, Brucella suis 1330
ucccuuacuccauu

SEQ ID NO: 452528 - RNA, 17 nt, Brucella suis 1330
ucccuugccgccuuuca

SEQ ID NO: 452529 - RNA, 23 nt, Brucella suis 1330
ucccugcgggccaugguuucggc

SEQ ID NO: 452530 - RNA, 18 nt, Brucella suis 1330
ucccucaaaacgcugcca

SEQ ID NO: 452531 - RNA, 19 nt, Brucella suis 1330
ucccuaucgaggcggcauc

SEQ ID NO: 452532 - RNA, 17 nt, Brucella suis 1330
ucccgcgccucacccuc

SEQ ID NO: 452533 - RNA, 15 nt, Brucella suis 1330
ucccggaagccgccu

SEQ ID NO: 452534 - RNA, 16 nt, Brucella suis 1330
ucccgccaugugcccg

SEQ ID NO: 452535 - RNA, 23 nt, Brucella suis 1330
ucccgauaaugcgaacaguuuca

SEQ ID NO: 452536 - RNA, 20 nt, Brucella suis 1330
uccccuaaaucacucccgca

SEQ ID NO: 452537 - RNA, 16 nt, Brucella suis 1330
uccccuauuccccuau

SEQ ID NO: 452538 - RNA, 21 nt, Brucella suis 1330
uccccuauuccccuauucccc

SEQ ID NO: 452539 - RNA, 17 nt, Brucella suis 1330
uccccuauucccuuaac

SEQ ID NO: 452540 - RNA, 18 nt, Brucella suis 1330
uccccgggcagcggcgcg

SEQ ID NO: 452541 - RNA, 18 nt, Brucella suis 1330
uccccggcaaagaccggc

SEQ ID NO: 452542 - RNA, 16 nt, Brucella suis 1330
uccccgcccgcggcca

SEQ ID NO: 452543 - RNA, 18 nt, Brucella suis 1330
uccccgcccgcggccaca

SEQ ID NO: 452544 - RNA, 15 nt, Brucella suis 1330
uccccccauucaugc

SEQ ID NO: 452545 - RNA, 19 nt, Brucella suis 1330
uccccauugcaucgccaag

SEQ ID NO: 452546 - RNA, 18 nt, Brucella suis 1330
ucccccaauaucgcgccg

SEQ ID NO: 452547 - RNA, 22 nt, Brucella suis 1330
ucccccaauaucgcgccggggc

SEQ ID NO: 452548 - RNA, 19 nt, Brucella suis 1330
uccccaucgaaaccggcau

SEQ ID NO: 452549 - RNA, 11 nt, Brucella suis 1330
ucccaugcagg

SEQ ID NO: 452550 - RNA, 13 nt, Brucella suis 1330
uccauggucaggc

SEQ ID NO: 452551 - RNA, 15 nt, Brucella suis 1330
uccauguggaaggcg

SEQ ID NO: 452552 - RNA, 12 nt, Brucella suis 1330
uccauuccucaa

SEQ ID NO: 452553 - RNA, 20 nt, Brucella suis 1330
uccauuccucaagauacaaa

SEQ ID NO: 452554 - RNA, 16 nt, Brucella suis 1330
uccaugcccggcgcga

SEQ ID NO: 452555 - RNA, 21 nt, Brucella suis 1330
uccaugagcagcggcaaaaaa

SEQ ID NO: 452556 - RNA, 12 nt, Brucella suis 1330
uccaugaaagcc

SEQ ID NO: 452557 - RNA, 18 nt, Brucella suis 1330
uccaugaaagccacaacg

SEQ ID NO: 452558 - RNA, 21 nt, Brucella suis 1330
uccaugaaagccacaacgcug

SEQ ID NO: 452559 - RNA, 20 nt, Brucella suis 1330
uccagucgaggcagccacgg

SEQ ID NO: 452560 - RNA, 13 nt, Brucella suis 1330
uccagucuucauc

SEQ ID NO: 452561 - RNA, 16 nt, Brucella suis 1330
uccagugcaaagcggc

SEQ ID NO: 452562 - RNA, 22 nt, Brucella suis 1330
uccaguggaagcacauggcggc

SEQ ID NO: 452563 - RNA, 15 nt, Brucella suis 1330
uccaguaaagucuga

SEQ ID NO: 452564 - RNA, 23 nt, Brucella suis 1330
uccaguacggcgcgcugaagccg

SEQ ID NO: 452565 - RNA, 23 nt, Brucella suis 1330
uccaggagagccuuugcuucacg

SEQ ID NO: 452566 - RNA, 13 nt, Brucella suis 1330
uccagcuugcagu

SEQ ID NO: 452567 - RNA, 15 nt, Brucella suis 1330
uccagcuuuccgcau

SEQ ID NO: 452568 - RNA, 16 nt, Brucella suis 1330
uccagcgcguugccuu

SEQ ID NO: 452569 - RNA, 22 nt, Brucella suis 1330
uccagcgaaacggcagccgagg

SEQ ID NO: 452570 - RNA, 14 nt, Brucella suis 1330
uccagcccuucauc

SEQ ID NO: 452571 - RNA, 18 nt, Brucella suis 1330
uccagcccauaaggcgga

SEQ ID NO: 452572 - RNA, 18 nt, Brucella suis 1330
uccagcaggcgcgcagca

SEQ ID NO: 452573 - RNA, 23 nt, Brucella suis 1330
uccagauugcgggcaagcauucc

SEQ ID NO: 452574 - RNA, 12 nt, Brucella suis 1330
uccagcaaaagu

SEQ ID NO: 452575 - RNA, 23 nt, Brucella suis 1330
uccagaagaucgucggcaagcug

SEQ ID NO: 452576 - RNA, 13 nt, Brucella suis 1330
uccagaagcgcgu

SEQ ID NO: 452577 - RNA, 21 nt, Brucella suis 1330
uccacuggacugauuucugau

SEQ ID NO: 452578 - RNA, 14 nt, Brucella suis 1330
uccacgcgccgaca

SEQ ID NO: 452579 - RNA, 20 nt, Brucella suis 1330
uccacgcccuuggcgagaau

SEQ ID NO: 452580 - RNA, 15 nt, Brucella suis 1330
uccacgacgggagcc

SEQ ID NO: 452581 - RNA, 14 nt, Brucella suis 1330
uccacgaaagccuu

SEQ ID NO: 452582 - RNA, 15 nt, Brucella suis 1330
uccaccgcgcugaag

SEQ ID NO: 452583 - RNA, 20 nt, Brucella suis 1330
uccaccgcgcugaagcggcc

SEQ ID NO: 452584 - RNA, 19 nt, Brucella suis 1330
uccaccaccucgccaauga

SEQ ID NO: 452585 - RNA, 22 nt, Brucella suis 1330
uccaccaccucgccaaugaaga

SEQ ID NO: 452586 - RNA, 16 nt, Brucella suis 1330
uccaccaccugcccgc

SEQ ID NO: 452587 - RNA, 21 nt, Brucella suis 1330
uccacaccugcaccaaucagu

SEQ ID NO: 452588 - RNA, 19 nt, Brucella suis 1330
uccacacgaacagcagcag

SEQ ID NO: 452589 - RNA, 16 nt, Brucella suis 1330
ucauugcgauccagcg

SEQ ID NO: 452590 - RNA, 15 nt, Brucella suis 1330
ucauugucccaauau

SEQ ID NO: 452591 - RNA, 23 nt, Brucella suis 1330
ucauuucaagguuugcauagggc

SEQ ID NO: 452592 - RNA, 19 nt, Brucella suis 1330
ucauuuccuuccacugggc

SEQ ID NO: 452593 - RNA, 22 nt, Brucella suis 1330
ucauuacagccuaaucaaaaga

SEQ ID NO: 452594 - RNA, 18 nt, Brucella suis 1330
ucauuccggcgcugcuca

SEQ ID NO: 452595 - RNA, 18 nt, Brucella suis 1330
ucauucggguugccuucg

SEQ ID NO: 452596 - RNA, 20 nt, Brucella suis 1330
ucauugaacagguuuccggc

SEQ ID NO: 452597 - RNA, 19 nt, Brucella suis 1330
ucauggaaaacgccgccuu

SEQ ID NO: 452598 - RNA, 13 nt, Brucella suis 1330
ucaugcugauugg

SEQ ID NO: 452599 - RNA, 23 nt, Brucella suis 1330
ucaugcccuauaccgccaaggaa

SEQ ID NO: 452600 - RNA, 14 nt, Brucella suis 1330
ucaugcccugacuc

SEQ ID NO: 452601 - RNA, 18 nt, Brucella suis 1330
ucaucguggcggcaaaaa

SEQ ID NO: 452602 - RNA, 16 nt, Brucella suis 1330
ucaucggcaagcggcu

SEQ ID NO: 452603 - RNA, 15 nt, Brucella suis 1330
ucaucucguucacaa

SEQ ID NO: 452604 - RNA, 16 nt, Brucella suis 1330
ucauccagucauggcg

SEQ ID NO: 452605 - RNA, 13 nt, Brucella suis 1330
ucaucccgccccu

SEQ ID NO: 452606 - RNA, 20 nt, Brucella suis 1330
ucaucagcccauagaucaga

SEQ ID NO: 452607 - RNA, 16 nt, Brucella suis 1330
ucaucaaucugacccg

SEQ ID NO: 452608 - RNA, 22 nt, Brucella suis 1330
ucaucaaaagcgucgcaaugcc

SEQ ID NO: 452609 - RNA, 21 nt, Brucella suis 1330
ucauaucguugccgaucaugg

SEQ ID NO: 452610 - RNA, 14 nt, Brucella suis 1330
ucauagauuccaga

SEQ ID NO: 452611 - RNA, 14 nt, Brucella suis 1330
ucagugccaccaga

SEQ ID NO: 452612 - RNA, 20 nt, Brucella suis 1330
ucaguggaucgacauauuug

SEQ ID NO: 452613 - RNA, 14 nt, Brucella suis 1330
ucaguaacugccuu

SEQ ID NO: 452614 - RNA, 17 nt, Brucella suis 1330
ucaggucgucuuucagu

SEQ ID NO: 452615 - RNA, 19 nt, Brucella suis 1330
ucaggucggcauugaucaa

SEQ ID NO: 452616 - RNA, 20 nt, Brucella suis 1330
ucaggucggcauugaucaac

SEQ ID NO: 452617 - RNA, 17 nt, Brucella suis 1330
ucagggcgaggaaaauc

SEQ ID NO: 452618 - RNA, 18 nt, Brucella suis 1330
ucagggcaauccuuucca

SEQ ID NO: 452619 - RNA, 19 nt, Brucella suis 1330
ucagggcaaucugcgcugc

SEQ ID NO: 452620 - RNA, 23 nt, Brucella suis 1330
ucagggauaaagccuguccuugu

SEQ ID NO: 452621 - RNA, 19 nt, Brucella suis 1330
ucaggcuuuccgacagggc

SEQ ID NO: 452622 - RNA, 18 nt, Brucella suis 1330
ucaggcgcgaggcggcug

SEQ ID NO: 452623 - RNA, 21 nt, Brucella suis 1330
ucaggcccagaugcagcggcg

SEQ ID NO: 452624 - RNA, 19 nt, Brucella suis 1330
ucaggccaagugcggucug

SEQ ID NO: 452625 - RNA, 21 nt, Brucella suis 1330
ucaggcacucuccucugccug

SEQ ID NO: 452626 - RNA, 20 nt, Brucella suis 1330
ucaggaugagggagagaaca

SEQ ID NO: 452627 - RNA, 20 nt, Brucella suis 1330
ucagcuugccgccaaucccc

SEQ ID NO: 452628 - RNA, 15 nt, Brucella suis 1330
ucagcuuauucuaaa

SEQ ID NO: 452629 - RNA, 17 nt, Brucella suis 1330
ucagcuuuacugccggg

SEQ ID NO: 452630 - RNA, 14 nt, Brucella suis 1330
ucagcuuggaaagc

SEQ ID NO: 452631 - RNA, 20 nt, Brucella suis 1330
ucagcuuuuccaucacuucg

SEQ ID NO: 452632 - RNA, 18 nt, Brucella suis 1330
ucagcggcgggugccgcg

SEQ ID NO: 452633 - RNA, 14 nt, Brucella suis 1330
ucagcgccacgccu

SEQ ID NO: 452634 - RNA, 15 nt, Brucella suis 1330
ucagcgccacgccuu

SEQ ID NO: 452635 - RNA, 23 nt, Brucella suis 1330
uaucuuccgacccgucaaugcca

SEQ ID NO: 452636 - RNA, 12 nt, Brucella suis 1330
uaucuuccugaa

SEQ ID NO: 452637 - RNA, 16 nt, Brucella suis 1330
ucagcgcaaagccugc

SEQ ID NO: 452638 - RNA, 16 nt, Brucella suis 1330
uauccagccgccgggg

SEQ ID NO: 452639 - RNA, 19 nt, Brucella suis 1330
uauccaguuuauucauugg

SEQ ID NO: 452640 - RNA, 20 nt, Brucella suis 1330
uauccgccaccgguuuucau

SEQ ID NO: 452641 - RNA, 18 nt, Brucella suis 1330
uaucagcuuauucuaaag

SEQ ID NO: 452642 - RNA, 19 nt, Brucella suis 1330
uauacucggcguuuacuuu

SEQ ID NO: 452643 - RNA, 13 nt, Brucella suis 1330
uauagagcagcac

SEQ ID NO: 452644 - RNA, 20 nt, Brucella suis 1330
uaggucagcaggcgccgugc

SEQ ID NO: 452645 - RNA, 15 nt, Brucella suis 1330
uaguuagcgacugcu

SEQ ID NO: 452646 - RNA, 14 nt, Brucella suis 1330
uaggggccaaggcc

SEQ ID NO: 452647 - RNA, 19 nt, Brucella suis 1330
uaggggccaaggccccaga

SEQ ID NO: 452648 - RNA, 21 nt, Brucella suis 1330
uagggcguaaucagcgucagc

SEQ ID NO: 452649 - RNA, 16 nt, Brucella suis 1330
uaggcgcggcguggaa

SEQ ID NO: 452650 - RNA, 19 nt, Brucella suis 1330
uaggagcgugucuugccca

SEQ ID NO: 452651 - RNA, 17 nt, Brucella suis 1330
uagcucgacgcuuucca

SEQ ID NO: 452652 - RNA, 14 nt, Brucella suis 1330
uagcugcuuugcug

SEQ ID NO: 452653 - RNA, 14 nt, Brucella suis 1330
uagcuucuggguga

SEQ ID NO: 452654 - RNA, 16 nt, Brucella suis 1330
uagccuccauucaagc

SEQ ID NO: 452655 - RNA, 16 nt, Brucella suis 1330
uagccugacccggccu

SEQ ID NO: 452656 - RNA, 23 nt, Brucella suis 1330
uagccguuaacggcguccuucag

SEQ ID NO: 452657 - RNA, 13 nt, Brucella suis 1330
uagccuuggcccu

SEQ ID NO: 452658 - RNA, 13 nt, Brucella suis 1330
uagccgccaagcc

SEQ ID NO: 452659 - RNA, 19 nt, Brucella suis 1330
uagccgccaagccagcccg

SEQ ID NO: 452660 - RNA, 15 nt, Brucella suis 1330
uagagcauuuccagc

SEQ ID NO: 452661 - RNA, 20 nt, Brucella suis 1330
uagagcauuuccagcaaaag

SEQ ID NO: 452662 - RNA, 15 nt, Brucella suis 1330
uagauaaacgcacca

SEQ ID NO: 452663 - RNA, 20 nt, Brucella suis 1330
uagaccgucuggccugaagc

SEQ ID NO: 452664 - RNA, 14 nt, Brucella suis 1330
uagacuucagccag

SEQ ID NO: 452665 - RNA, 14 nt, Brucella suis 1330
uacuaguggucuuu

SEQ ID NO: 452666 - RNA, 13 nt, Brucella suis 1330
uacgugcaagagc

SEQ ID NO: 452667 - RNA, 15 nt, Brucella suis 1330
uacgggugcuugccu

SEQ ID NO: 452668 - RNA, 12 nt, Brucella suis 1330
uacgcuccgccc

SEQ ID NO: 452669 - RNA, 17 nt, Brucella suis 1330
uacgcucgcacaucggg

SEQ ID NO: 452670 - RNA, 18 nt, Brucella suis 1330
uaccucguucaacgagaa

SEQ ID NO: 452671 - RNA, 17 nt, Brucella suis 1330
uaccggcaucagccuuc

SEQ ID NO: 452672 - RNA, 15 nt, Brucella suis 1330
uaccggcgugaucuc

SEQ ID NO: 452673 - RNA, 17 nt, Brucella suis 1330
uacauuuuugaaaacau

SEQ ID NO: 452674 - RNA, 18 nt, Brucella suis 1330
uacagccuaaucaaaaga

SEQ ID NO: 452675 - RNA, 16 nt, Brucella suis 1330
uaauugucaggaaaaa

SEQ ID NO: 452676 - RNA, 22 nt, Brucella suis 1330
uacaaaugcaagugugcgcgcg

SEQ ID NO: 452677 - RNA, 12 nt, Brucella suis 1330
uaaggcggaugc

SEQ ID NO: 452678 - RNA, 17 nt, Brucella suis 1330
uaaucaaaagaaaccuu

SEQ ID NO: 452679 - RNA, 23 nt, Brucella suis 1330
uaaucgcaaaaaauaucuuuuuu

SEQ ID NO: 452680 - RNA, 11 nt, Brucella suis 1330
uaagcuuugca

SEQ ID NO: 452681 - RNA, 21 nt, Brucella suis 1330
uaagaugcgcgcaaggaaaga

SEQ ID NO: 452682 - RNA, 21 nt, Brucella suis 1330
uaacuuccgguauaugcacca

SEQ ID NO: 452683 - RNA, 17 nt, Brucella suis 1330
uaacagcguucaacucc

SEQ ID NO: 452684 - RNA, 18 nt, Brucella suis 1330
uaacauacugccuuacug

SEQ ID NO: 452685 - RNA, 17 nt, Brucella suis 1330
uaaaggcgaguuuucaa

SEQ ID NO: 452686 - RNA, 22 nt, Brucella suis 1330
uaaaguaucucucgccugcaua

SEQ ID NO: 452687 - RNA, 21 nt, Brucella suis 1330
uaaauauucaggaucuuucca

SEQ ID NO: 452688 - RNA, 13 nt, Brucella suis 1330
uaaagcaaaggcc

SEQ ID NO: 452689 - RNA, 21 nt, Brucella suis 1330
uaaagcugguugcgcggccag

SEQ ID NO: 452690 - RNA, 16 nt, Brucella suis 1330
uaaacagcguuuccau

SEQ ID NO: 452691 - RNA, 15 nt, Brucella suis 1330
uaaacgcaccaagac

SEQ ID NO: 452692 - RNA, 22 nt, Brucella suis 1330
uaaacugaauccgcgacgccgc

SEQ ID NO: 452693 - RNA, 15 nt, Brucella suis 1330
uaaaaggcaaagccg

SEQ ID NO: 452694 - RNA, 20 nt, Brucella suis 1330
guuucucugcucgccugcac

SEQ ID NO: 452695 - RNA, 22 nt, Brucella suis 1330
guuucgcgcaauggcugucaau

SEQ ID NO: 452696 - RNA, 18 nt, Brucella suis 1330
guuucgaucugauugaau

SEQ ID NO: 452697 - RNA, 18 nt, Brucella suis 1330
guuugacgcccauuucac

SEQ ID NO: 452698 - RNA, 18 nt, Brucella suis 1330
guuuccggcugccuuggc

SEQ ID NO: 452699 - RNA, 23 nt, Brucella suis 1330
guuucgauauccuggccuuccuu

SEQ ID NO: 452700 - RNA, 22 nt, Brucella suis 1330
guuuaucgggccuuauuggaac

SEQ ID NO: 452701 - RNA, 17 nt, Brucella suis 1330
guugcuggaacaucugc

SEQ ID NO: 452702 - RNA, 13 nt, Brucella suis 1330
guuggagccgcuc

SEQ ID NO: 452703 - RNA, 20 nt, Brucella suis 1330
guugcgccuggcgcugcugg

SEQ ID NO: 452704 - RNA, 13 nt, Brucella suis 1330
guugccuugcugg

SEQ ID NO: 452705 - RNA, 20 nt, Brucella suis 1330
guugaugucgucaaucgugc

SEQ ID NO: 452706 - RNA, 15 nt, Brucella suis 1330
guugaggauuuccac

SEQ ID NO: 452707 - RNA, 16 nt, Brucella suis 1330
guugaccacauugccc

SEQ ID NO: 452708 - RNA, 22 nt, Brucella suis 1330
guugaacuugcccgcauagcca

SEQ ID NO: 452709 - RNA, 13 nt, Brucella suis 1330
guucuuccgccag

SEQ ID NO: 452710 - RNA, 19 nt, Brucella suis 1330
guucuuccgccagauaaga

SEQ ID NO: 452711 - RNA, 22 nt, Brucella suis 1330
guucuucggccaugcguugcug

SEQ ID NO: 452712 - RNA, 20 nt, Brucella suis 1330
guucggauccuccugcgccc

SEQ ID NO: 452713 - RNA, 16 nt, Brucella suis 1330
guucgcgcaucgggcg

SEQ ID NO: 452714 - RNA, 17 nt, Brucella suis 1330
guuccugcuucaucgcg

SEQ ID NO: 452715 - RNA, 21 nt, Brucella suis 1330
guucccucuaaucgcgagcag

SEQ ID NO: 452716 - RNA, 16 nt, Brucella suis 1330
guuccguguugaaaag

SEQ ID NO: 452717 - RNA, 20 nt, Brucella suis 1330
guuccacgauuuccgcgaca

SEQ ID NO: 452718 - RNA, 18 nt, Brucella suis 1330
guguuucgguccacacuu

SEQ ID NO: 452719 - RNA, 21 nt, Brucella suis 1330
guguuucgguccacacuuccg

SEQ ID NO: 452720 - RNA, 21 nt, Brucella suis 1330
guuaaaauggaaucgcuggaa

SEQ ID NO: 452721 - RNA, 12 nt, Brucella suis 1330
guguuucaccag

SEQ ID NO: 452722 - RNA, 15 nt, Brucella suis 1330
guguugagaucgcgc

SEQ ID NO: 452723 - RNA, 17 nt, Brucella suis 1330
gugugacggaugaggcc

SEQ ID NO: 452724 - RNA, 13 nt, Brucella suis 1330
guuacgccauauu

SEQ ID NO: 452725 - RNA, 15 nt, Brucella suis 1330
guggcugcccgccgc

SEQ ID NO: 452726 - RNA, 16 nt, Brucella suis 1330
guggcugcccgccgca

SEQ ID NO: 452727 - RNA, 13 nt, Brucella suis 1330
guggcugggcccc

SEQ ID NO: 452728 - RNA, 17 nt, Brucella suis 1330
guggcggauugcagcgg

SEQ ID NO: 452729 - RNA, 21 nt, Brucella suis 1330
guggcgcccgcccgccgcaag

SEQ ID NO: 452730 - RNA, 23 nt, Brucella suis 1330
guggcgauggucgcaagacccaa

SEQ ID NO: 452731 - RNA, 22 nt, Brucella suis 1330
guggcaagcccgcugcgccgca

SEQ ID NO: 452732 - RNA, 14 nt, Brucella suis 1330
gugcuggugaaaga

SEQ ID NO: 452733 - RNA, 12 nt, Brucella suis 1330
gugcugccaugg

SEQ ID NO: 452734 - RNA, 13 nt, Brucella suis 1330
gugcggucgccgc

SEQ ID NO: 452735 - RNA, 16 nt, Brucella suis 1330
gugcgggcuucuucca

SEQ ID NO: 452736 - RNA, 16 nt, Brucella suis 1330
gugcggcugcaaaugg

SEQ ID NO: 452737 - RNA, 17 nt, Brucella suis 1330
gugcgaagcgccuacgc

SEQ ID NO: 452738 - RNA, 20 nt, Brucella suis 1330
gugcgaauguauagcgauga

SEQ ID NO: 452739 - RNA, 17 nt, Brucella suis 1330
gugccuuaugucaugga

SEQ ID NO: 452740 - RNA, 19 nt, Brucella suis 1330
gugccgccgugaaaauaag

SEQ ID NO: 452741 - RNA, 12 nt, Brucella suis 1330
gugcccugcugc

SEQ ID NO: 452742 - RNA, 18 nt, Brucella suis 1330
gugcauuuuuccagaccu

SEQ ID NO: 452743 - RNA, 17 nt, Brucella suis 1330
gugccaagaagaagagc

SEQ ID NO: 452744 - RNA, 15 nt, Brucella suis 1330
gugccagaucggcaa

SEQ ID NO: 452745 - RNA, 22 nt, Brucella suis 1330
gucgccugauagcauauaggug

SEQ ID NO: 452746 - RNA, 17 nt, Brucella suis 1330
gucgcccauuuucucca

SEQ ID NO: 452747 - RNA, 14 nt, Brucella suis 1330
gucgcacgcuuggc

SEQ ID NO: 452748 - RNA, 23 nt, Brucella suis 1330
gucgcacgcuuggccucuuccag

SEQ ID NO: 452749 - RNA, 20 nt, Brucella suis 1330
gucgagggcaccggccuuga

SEQ ID NO: 452750 - RNA, 15 nt, Brucella suis 1330
guccuggcgcacguc

SEQ ID NO: 452751 - RNA, 17 nt, Brucella suis 1330
guccgggaagcaguucc

SEQ ID NO: 452752 - RNA, 22 nt, Brucella suis 1330
guccgcaaggaugugagcgaau

SEQ ID NO: 452753 - RNA, 23 nt, Brucella suis 1330
guccgcaaucgccaccggcggcg

SEQ ID NO: 452754 - RNA, 20 nt, Brucella suis 1330
guccgcaccauucugcccag

SEQ ID NO: 452755 - RNA, 21 nt, Brucella suis 1330
guccgcaccauucugcccaga

SEQ ID NO: 452756 - RNA, 21 nt, Brucella suis 1330
gucccgcccgucgaccagcgc

SEQ ID NO: 452757 - RNA, 23 nt, Brucella suis 1330
gucccgcccgucgaccagcgcau

SEQ ID NO: 452758 - RNA, 15 nt, Brucella suis 1330
guccauccggcggcg

SEQ ID NO: 452759 - RNA, 18 nt, Brucella suis 1330
gucauuugcgaccauggc

SEQ ID NO: 452760 - RNA, 18 nt, Brucella suis 1330
gucauaaugcauggaggc

SEQ ID NO: 452761 - RNA, 22 nt, Brucella suis 1330
gucaggcuuuccgacagggcaa

SEQ ID NO: 452762 - RNA, 20 nt, Brucella suis 1330
gucaggccaagugcggucug

SEQ ID NO: 452763 - RNA, 13 nt, Brucella suis 1330
gucaggccgauga

SEQ ID NO: 452764 - RNA, 19 nt, Brucella suis 1330
gucagcuuuccggcuucca

SEQ ID NO: 452765 - RNA, 20 nt, Brucella suis 1330
gucaggauaaccuucuggaa

SEQ ID NO: 452766 - RNA, 21 nt, Brucella suis 1330
gucaggauaaccuucuggaaa

SEQ ID NO: 452767 - RNA, 13 nt, Brucella suis 1330
gucagcuuggaaa

SEQ ID NO: 452768 - RNA, 17 nt, Brucella suis 1330
gucagcgccgcccaggg

SEQ ID NO: 452769 - RNA, 22 nt, Brucella suis 1330
gucagccacgauaccgagaacg

SEQ ID NO: 452770 - RNA, 21 nt, Brucella suis 1330
gucagaagcaaucgacaauug

SEQ ID NO: 452771 - RNA, 14 nt, Brucella suis 1330
gucacgcuccgcca

SEQ ID NO: 452772 - RNA, 16 nt, Brucella suis 1330
gucacgcuccgccacu

SEQ ID NO: 452773 - RNA, 23 nt, Brucella suis 1330
gucacgcgcccacgugagagguc

SEQ ID NO: 452774 - RNA, 20 nt, Brucella suis 1330
gucacgccacggcuuucggu

SEQ ID NO: 452775 - RNA, 14 nt, Brucella suis 1330
gucacgcccaugau

SEQ ID NO: 452776 - RNA, 17 nt, Brucella suis 1330
gucacccgcgucgucug

SEQ ID NO: 452777 - RNA, 13 nt, Brucella suis 1330
gucaaaacaaagg

SEQ ID NO: 452778 - RNA, 16 nt, Brucella suis 1330
guagggcaguagggca

SEQ ID NO: 452779 - RNA, 13 nt, Brucella suis 1330
guacggaaagggc

SEQ ID NO: 452780 - RNA, 19 nt, Brucella suis 1330
guaccgacaugccaagagc

SEQ ID NO: 452781 - RNA, 23 nt, Brucella suis 1330
guaaucgccggugccauaacggc

SEQ ID NO: 452782 - RNA, 18 nt, Brucella suis 1330
guaaugcuggccaccaga

SEQ ID NO: 452783 - RNA, 17 nt, Brucella suis 1330
guaacaauuggccgaga

SEQ ID NO: 452784 - RNA, 17 nt, Brucella suis 1330
gguguuugcgacgggcg

SEQ ID NO: 452785 - RNA, 14 nt, Brucella suis 1330
guaaagaucgaugu

SEQ ID NO: 452786 - RNA, 23 nt, Brucella suis 1330
guaaccgccaccuucggguuuuu

SEQ ID NO: 452787 - RNA, 11 nt, Brucella suis 1330
guaagagcaga

SEQ ID NO: 452788 - RNA, 17 nt, Brucella suis 1330
guaagcgaccaccaccg

SEQ ID NO: 452789 - RNA, 20 nt, Brucella suis 1330
guaagcgccuuugccgcgcg

SEQ ID NO: 452790 - RNA, 15 nt, Brucella suis 1330
guaagcggcaauccu

SEQ ID NO: 452791 - RNA, 18 nt, Brucella suis 1330
guaaggcuucagucugga

SEQ ID NO: 452792 - RNA, 19 nt, Brucella suis 1330
guaaguucauaaggcaauu

SEQ ID NO: 452793 - RNA, 18 nt, Brucella suis 1330
guaauauugaagccgaga

SEQ ID NO: 452794 - RNA, 13 nt, Brucella suis 1330
ggugugagugcgc

SEQ ID NO: 452795 - RNA, 13 nt, Brucella suis 1330
gguguccugccgg

SEQ ID NO: 452796 - RNA, 17 nt, Brucella suis 1330
ggugucauagaccauga

SEQ ID NO: 452797 - RNA, 21 nt, Brucella suis 1330
ggugucauagaccaugacgcc

SEQ ID NO: 452798 - RNA, 19 nt, Brucella suis 1330
gguggugcgcagggucugc

SEQ ID NO: 452799 - RNA, 12 nt, Brucella suis 1330
gguggcugggcc

SEQ ID NO: 452800 - RNA, 15 nt, Brucella suis 1330
gguggcugggcccca

SEQ ID NO: 452801 - RNA, 14 nt, Brucella suis 1330
ggugccggcaggcu

SEQ ID NO: 452802 - RNA, 15 nt, Brucella suis 1330
ggugcccugcugcuu

SEQ ID NO: 452803 - RNA, 15 nt, Brucella suis 1330
ggugcccuuucgcuu

SEQ ID NO: 452804 - RNA, 22 nt, Brucella suis 1330
ggugaaaauaucugccgugucg

SEQ ID NO: 452805 - RNA, 14 nt, Brucella suis 1330
ggucuuccgggaca

SEQ ID NO: 452806 - RNA, 14 nt, Brucella suis 1330
ggucuugccggccu

SEQ ID NO: 452807 - RNA, 19 nt, Brucella suis 1330
ggucgugauguugcgggug

SEQ ID NO: 452808 - RNA, 21 nt, Brucella suis 1330
ggucgucuuucaguuuuugca

SEQ ID NO: 452809 - RNA, 22 nt, Brucella suis 1330
ggucgagcgccuguccgccugc

SEQ ID NO: 452810 - RNA, 18 nt, Brucella suis 1330
ggucaggccaagugcggu

SEQ ID NO: 452811 - RNA, 20 nt, Brucella suis 1330
ggucacgcgcguugcggccg

SEQ ID NO: 452812 - RNA, 15 nt, Brucella suis 1330
ggucacgcuccgcca

SEQ ID NO: 452813 - RNA, 23 nt, Brucella suis 1330
gguagauuguggugugagugcgc

SEQ ID NO: 452814 - RNA, 15 nt, Brucella suis 1330
gguacggaaagggcu

SEQ ID NO: 452815 - RNA, 21 nt, Brucella suis 1330
gguaacgaugauauaggcgca

SEQ ID NO: 452816 - RNA, 18 nt, Brucella suis 1330
ggguucccuguggagaga

SEQ ID NO: 452817 - RNA, 15 nt, Brucella suis 1330
ggguguuugcgacgg

SEQ ID NO: 452818 - RNA, 18 nt, Brucella suis 1330
gggugagguuugcgacgg

SEQ ID NO: 452819 - RNA, 20 nt, Brucella suis 1330
ggguccagucaaugccguga

SEQ ID NO: 452820 - RNA, 15 nt, Brucella suis 1330
ggggagcaggcaggc

SEQ ID NO: 452821 - RNA, 13 nt, Brucella suis 1330
ggggacgggcggu

SEQ ID NO: 452822 - RNA, 21 nt, Brucella suis 1330
gggcugcuuccacaggcgcca

SEQ ID NO: 452823 - RNA, 13 nt, Brucella suis 1330
gggcgucgcgcau

SEQ ID NO: 452824 - RNA, 22 nt, Brucella suis 1330
gggcgccgggaaauuucagcca

SEQ ID NO: 452825 - RNA, 16 nt, Brucella suis 1330
gggcgagggcgggcgg

SEQ ID NO: 452826 - RNA, 14 nt, Brucella suis 1330
gggcgagcgcgcca

SEQ ID NO: 452827 - RNA, 18 nt, Brucella suis 1330
gggccuugccaaaaugau

SEQ ID NO: 452828 - RNA, 14 nt, Brucella suis 1330
gggccacgggccag

SEQ ID NO: 452829 - RNA, 17 nt, Brucella suis 1330
gggcauugucguccagg

SEQ ID NO: 452830 - RNA, 20 nt, Brucella suis 1330
gggccaacgccggcaccgcc

SEQ ID NO: 452831 - RNA, 15 nt, Brucella suis 1330
gggccaaggccccag

SEQ ID NO: 452832 - RNA, 16 nt, Brucella suis 1330
gggcaguagggcagua

SEQ ID NO: 452833 - RNA, 16 nt, Brucella suis 1330
gggcagcuugucgaaa

SEQ ID NO: 452834 - RNA, 15 nt, Brucella suis 1330
gggagcgcagugccu

SEQ ID NO: 452835 - RNA, 18 nt, Brucella suis 1330
ggcuucggccgcuugcga

SEQ ID NO: 452836 - RNA, 19 nt, Brucella suis 1330
ggcuuccuugcgcuugcga

SEQ ID NO: 452837 - RNA, 20 nt, Brucella suis 1330
ggcuguguaaaaguggaacc

SEQ ID NO: 452838 - RNA, 18 nt, Brucella suis 1330
ggcuguuggccggcagcg

SEQ ID NO: 452839 - RNA, 18 nt, Brucella suis 1330
ggcuguuuucgaggccau

SEQ ID NO: 452840 - RNA, 22 nt, Brucella suis 1330
ggcuggucaauaucgcgcaggc

SEQ ID NO: 452841 - RNA, 24 nt, Brucella suis 1330
ggcuggcucgcgugauaggcgaca

SEQ ID NO: 452842 - RNA, 18 nt, Brucella suis 1330
ggcuggcacaaagcggcc

SEQ ID NO: 452843 - RNA, 22 nt, Brucella suis 1330
ggcugcugcgugcugcuugccg

SEQ ID NO: 452844 - RNA, 20 nt, Brucella suis 1330
ggcugcccgccgcaagcucu

SEQ ID NO: 452845 - RNA, 20 nt, Brucella suis 1330
ggcugccaugugcagccggg

SEQ ID NO: 452846 - RNA, 21 nt, Brucella suis 1330
ggcugccaugugcagccgggu

SEQ ID NO: 452847 - RNA, 18 nt, Brucella suis 1330
ggcugcaucggcuuggga

SEQ ID NO: 452848 - RNA, 15 nt, Brucella suis 1330
ggcugcaaauggcaa

SEQ ID NO: 452849 - RNA, 22 nt, Brucella suis 1330
ggcucuugggagcggcgccaac

SEQ ID NO: 452850 - RNA, 22 nt, Brucella suis 1330
ggcucugcggaaagcccggccu

SEQ ID NO: 452851 - RNA, 19 nt, Brucella suis 1330
ggcucgcgugauaggcgac

SEQ ID NO: 452852 - RNA, 13 nt, Brucella suis 1330
ggcucauccucca

SEQ ID NO: 452853 - RNA, 16 nt, Brucella suis 1330
ggcucauccuccacga

SEQ ID NO: 452854 - RNA, 14 nt, Brucella suis 1330
ggcguucgcgggcg

SEQ ID NO: 452855 - RNA, 16 nt, Brucella suis 1330
ggcguucccagacaug

SEQ ID NO: 452856 - RNA, 15 nt, Brucella suis 1330
ggcguggaaagcugg

SEQ ID NO: 452857 - RNA, 21 nt, Brucella suis 1330
ggcguccccaucgaaaccggc

SEQ ID NO: 452858 - RNA, 13 nt, Brucella suis 1330
ggcgucagcaggu

SEQ ID NO: 452859 - RNA, 18 nt, Brucella suis 1330
ggcgguuuugagcugcug

SEQ ID NO: 452860 - RNA, 17 nt, Brucella suis 1330
ggcgguuauagcgcagc

SEQ ID NO: 452861 - RNA, 19 nt, Brucella suis 1330
ggcgguuauagcgcagcga

SEQ ID NO: 452862 - RNA, 22 nt, Brucella suis 1330
ggcggugaagaagcgccagcuu

SEQ ID NO: 452863 - RNA, 17 nt, Brucella suis 1330
ggcggucacguccagaa

SEQ ID NO: 452864 - RNA, 14 nt, Brucella suis 1330
ggcggggcuguagc

SEQ ID NO: 452865 - RNA, 13 nt, Brucella suis 1330
ggcggggcagggg

SEQ ID NO: 452866 - RNA, 11 nt, Brucella suis 1330
ggcggcuuccu

SEQ ID NO: 452867 - RNA, 14 nt, Brucella suis 1330
ggcggcgugggcug

SEQ ID NO: 452868 - RNA, 13 nt, Brucella suis 1330
ggcggcggccggg

SEQ ID NO: 452869 - RNA, 15 nt, Brucella suis 1330
ggcggcggccgggcg

SEQ ID NO: 452870 - RNA, 14 nt, Brucella suis 1330
ggcggcgcucggcg

SEQ ID NO: 452871 - RNA, 19 nt, Brucella suis 1330
ggcggccuuggaggcggca

SEQ ID NO: 452872 - RNA, 19 nt, Brucella suis 1330
ggcggccugaccggccacc

SEQ ID NO: 452873 - RNA, 16 nt, Brucella suis 1330
ggcggcaggcagacau

SEQ ID NO: 452874 - RNA, 18 nt, Brucella suis 1330
ggcggaucgugacccgcc

SEQ ID NO: 452875 - RNA, 15 nt, Brucella suis 1330
ggcggaugcgcggcg

SEQ ID NO: 452876 - RNA, 16 nt, Brucella suis 1330
ggcggaucggcaggau

SEQ ID NO: 452877 - RNA, 18 nt, Brucella suis 1330
ggcggauaaugcucgccc

SEQ ID NO: 452878 - RNA, 20 nt, Brucella suis 1330
ggcggaauucauccgccuug

SEQ ID NO: 452879 - RNA, 17 nt, Brucella suis 1330
ggcggaacaggcagcau

SEQ ID NO: 452880 - RNA, 14 nt, Brucella suis 1330
ggcggaagcgacga

SEQ ID NO: 452881 - RNA, 20 nt, Brucella suis 1330
ggcggaaggcugagugagcc

SEQ ID NO: 452882 - RNA, 15 nt, Brucella suis 1330
ggcgcuuuauuccuu

SEQ ID NO: 452883 - RNA, 16 nt, Brucella suis 1330
ggcgcugcgaaggccc

SEQ ID NO: 452884 - RNA, 19 nt, Brucella suis 1330
ggcgcucuuuccgcgcauc

SEQ ID NO: 452885 - RNA, 17 nt, Brucella suis 1330
ggcgcucggcggaacug

SEQ ID NO: 452886 - RNA, 23 nt, Brucella suis 1330
ggcgcucgaccgcaccucuggau

SEQ ID NO: 452887 - RNA, 22 nt, Brucella suis 1330
ggcgcuagcgaugaugauccag

SEQ ID NO: 452888 - RNA, 21 nt, Brucella suis 1330
ggcgcgggcuuuccagccccc

SEQ ID NO: 452889 - RNA, 20 nt, Brucella suis 1330
ggcgcggcaggaucgccaga

SEQ ID NO: 452890 - RNA, 11 nt, Brucella suis 1330
ggcgcgcgccu

SEQ ID NO: 452891 - RNA, 17 nt, Brucella suis 1330
ggcgcgccaguaggccc

SEQ ID NO: 452892 - RNA, 22 nt, Brucella suis 1330
ggcgcgacuguuucgaggccca

SEQ ID NO: 452893 - RNA, 23 nt, Brucella suis 1330
ggcgccgucgggaccaccggccu

SEQ ID NO: 452894 - RNA, 13 nt, Brucella suis 1330
ggcgccagcgcgg

SEQ ID NO: 452895 - RNA, 12 nt, Brucella suis 1330
ggcgccagccca

SEQ ID NO: 452896 - RNA, 21 nt, Brucella suis 1330
ggcgccaccgucaccggcugg

SEQ ID NO: 452897 - RNA, 15 nt, Brucella suis 1330
ggcgcaguuucgcag

SEQ ID NO: 452898 - RNA, 21 nt, Brucella suis 1330
ggcgcagucaggccgaccgca

SEQ ID NO: 452899 - RNA, 20 nt, Brucella suis 1330
ggcgcaaccuggcugcacca

SEQ ID NO: 452900 - RNA, 23 nt, Brucella suis 1330
ggcgcaaggucucgacaguccag

SEQ ID NO: 452901 - RNA, 15 nt, Brucella suis 1330
ggcgcaaaggccggg

SEQ ID NO: 452902 - RNA, 16 nt, Brucella suis 1330
ggcgcaaaggccgggu

SEQ ID NO: 452903 - RNA, 17 nt, Brucella suis 1330
ggcgaggucucccggca

SEQ ID NO: 452904 - RNA, 18 nt, Brucella suis 1330
ggcgauaaagaugcgcgc

SEQ ID NO: 452905 - RNA, 15 nt, Brucella suis 1330
ggcgaggaagagaau

SEQ ID NO: 452906 - RNA, 14 nt, Brucella suis 1330
ggcgagcgcgcuua

SEQ ID NO: 452907 - RNA, 21 nt, Brucella suis 1330
ggcgagcgacauauucuuccg

SEQ ID NO: 452908 - RNA, 14 nt, Brucella suis 1330
ggcgacggccagcg

SEQ ID NO: 452909 - RNA, 11 nt, Brucella suis 1330
ggcgacccagc

SEQ ID NO: 452910 - RNA, 12 nt, Brucella suis 1330
ggcgaagcucau

SEQ ID NO: 452911 - RNA, 18 nt, Brucella suis 1330
ggcgaaaugucgaucccg

SEQ ID NO: 452912 - RNA, 23 nt, Brucella suis 1330
ggccuuugcggcggaugaacccg

SEQ ID NO: 452913 - RNA, 15 nt, Brucella suis 1330
ggccuuuccggcggc

SEQ ID NO: 452914 - RNA, 16 nt, Brucella suis 1330
ggccuuugcgccgggu

SEQ ID NO: 452915 - RNA, 14 nt, Brucella suis 1330
ggccuugcggcggc

SEQ ID NO: 452916 - RNA, 11 nt, Brucella suis 1330
ggccugugcuu

SEQ ID NO: 452917 - RNA, 19 nt, Brucella suis 1330
ggccuguuccacaccugca

SEQ ID NO: 452918 - RNA, 16 nt, Brucella suis 1330
ggccuguuccugcaug

SEQ ID NO: 452919 - RNA, 13 nt, Brucella suis 1330
ggccugaaacagc

SEQ ID NO: 452920 - RNA, 15 nt, Brucella suis 1330
ggccugaaacagcau

SEQ ID NO: 452921 - RNA, 21 nt, Brucella suis 1330
ggccugaaagcugcuggcggg

SEQ ID NO: 452922 - RNA, 12 nt, Brucella suis 1330
ggccucuuccag

SEQ ID NO: 452923 - RNA, 16 nt, Brucella suis 1330
ggccguuacucggccg

SEQ ID NO: 452924 - RNA, 20 nt, Brucella suis 1330
ggccgucccggaagccgccu

SEQ ID NO: 452925 - RNA, 15 nt, Brucella suis 1330
ggccgguuucccggc

SEQ ID NO: 452926 - RNA, 17 nt, Brucella suis 1330
ggccgguaagcccuguc

SEQ ID NO: 452927 - RNA, 18 nt, Brucella suis 1330
ggccgggccaacgccggc

SEQ ID NO: 452928 - RNA, 14 nt, Brucella suis 1330
ggccggcugcggcg

SEQ ID NO: 452929 - RNA, 12 nt, Brucella suis 1330
ggccggcagcgg

SEQ ID NO: 452930 - RNA, 18 nt, Brucella suis 1330
ggccggaagcgcgcguga

SEQ ID NO: 452931 - RNA, 22 nt, Brucella suis 1330
ggccgcucaaggccuguuccac

SEQ ID NO: 452932 - RNA, 19 nt, Brucella suis 1330
ggccgcgugaaaagcacac

SEQ ID NO: 452933 - RNA, 14 nt, Brucella suis 1330
ggccgcgcuccaga

SEQ ID NO: 452934 - RNA, 21 nt, Brucella suis 1330
ggccgcaugauccgcuccaga

SEQ ID NO: 452935 - RNA, 19 nt, Brucella suis 1330
ggccgaaauagcggcccga

SEQ ID NO: 452936 - RNA, 17 nt, Brucella suis 1330
ggcccuugucgcgcaac

SEQ ID NO: 452937 - RNA, 18 nt, Brucella suis 1330
ggcccuggaaagaagcga

SEQ ID NO: 452938 - RNA, 18 nt, Brucella suis 1330
ggcccgguccgcgcucgu

SEQ ID NO: 452939 - RNA, 20 nt, Brucella suis 1330
ggcccgguccgcgcucgucg

SEQ ID NO: 452940 - RNA, 20 nt, Brucella suis 1330
ggcccgcgcaagcgggccuu

SEQ ID NO: 452941 - RNA, 15 nt, Brucella suis 1330
ggcccacccaccgcc

SEQ ID NO: 452942 - RNA, 21 nt, Brucella suis 1330
ggccaugaugccgacaagcag

SEQ ID NO: 452943 - RNA, 20 nt, Brucella suis 1330
ggccacgcacggucuugccg

SEQ ID NO: 452944 - RNA, 17 nt, Brucella suis 1330
ggccacgauagacgcgg

SEQ ID NO: 452945 - RNA, 21 nt, Brucella suis 1330
ggccaccguuucggguggccu

SEQ ID NO: 452946 - RNA, 22 nt, Brucella suis 1330
ggccaagcggaucgcgucccuu

SEQ ID NO: 452947 - RNA, 21 nt, Brucella suis 1330
ggccaagaucgacaaagccug

SEQ ID NO: 452948 - RNA, 22 nt, Brucella suis 1330
ggccaaaggcggcuaugcgcaa

SEQ ID NO: 452949 - RNA, 14 nt, Brucella suis 1330
ggcauugcgcggca

SEQ ID NO: 452950 - RNA, 14 nt, Brucella suis 1330
ggcauuauccgcau

SEQ ID NO: 452951 - RNA, 15 nt, Brucella suis 1330
ggcauccgaggcgcg

SEQ ID NO: 452952 - RNA, 19 nt, Brucella suis 1330
ggcagguuccaguccagcg

SEQ ID NO: 452953 - RNA, 20 nt, Brucella suis 1330
ggcagguaagagcagauccu

SEQ ID NO: 452954 - RNA, 19 nt, Brucella suis 1330
ggcacccacugcccgccuu

SEQ ID NO: 452955 - RNA, 19 nt, Brucella suis 1330
ggcacaagaacagccgccc

SEQ ID NO: 452956 - RNA, 15 nt, Brucella suis 1330
ggcacaaagcggccc

SEQ ID NO: 452957 - RNA, 17 nt, Brucella suis 1330
ggcaauccuguucaagc

SEQ ID NO: 452958 - RNA, 18 nt, Brucella suis 1330
ggcaagugugcagacagg

SEQ ID NO: 452959 - RNA, 18 nt, Brucella suis 1330
ggcaaggccgcgcuccag

SEQ ID NO: 452960 - RNA, 14 nt, Brucella suis 1330
ggcaagggcaagca

SEQ ID NO: 452961 - RNA, 15 nt, Brucella suis 1330
ggcaagggcaagcag

SEQ ID NO: 452962 - RNA, 13 nt, Brucella suis 1330
ggcaagcaggcgc

SEQ ID NO: 452963 - RNA, 14 nt, Brucella suis 1330
ggcaagcaggcgca

SEQ ID NO: 452964 - RNA, 14 nt, Brucella suis 1330
ggcaagcagcaaaa

SEQ ID NO: 452965 - RNA, 20 nt, Brucella suis 1330
ggcaagaucauccggcucau

SEQ ID NO: 452966 - RNA, 18 nt, Brucella suis 1330
ggcaagauggcugcccgc

SEQ ID NO: 452967 - RNA, 21 nt, Brucella suis 1330
ggcaagauagccccagcccgc

SEQ ID NO: 452968 - RNA, 15 nt, Brucella suis 1330
ggcaaaucaggcagg

SEQ ID NO: 452969 - RNA, 18 nt, Brucella suis 1330
ggcaacaagagggcgcag

SEQ ID NO: 452970 - RNA, 14 nt, Brucella suis 1330
ggcaaaacggcagg

SEQ ID NO: 452971 - RNA, 17 nt, Brucella suis 1330
ggcaaaacggcaggcau

SEQ ID NO: 452972 - RNA, 12 nt, Brucella suis 1330
ggcaaaaagcgg

SEQ ID NO: 452973 - RNA, 10 nt, Brucella suis 1330
ggauuuccac

SEQ ID NO: 452974 - RNA, 20 nt, Brucella suis 1330
ggauggaauaucgcucauau

SEQ ID NO: 452975 - RNA, 22 nt, Brucella suis 1330
ggaugaucgguacggaaagggc

SEQ ID NO: 452976 - RNA, 18 nt, Brucella suis 1330
ggauagagaacauauccu

SEQ ID NO: 452977 - RNA, 22 nt, Brucella suis 1330
ggaggagagcaugaucgcccgc

SEQ ID NO: 452978 - RNA, 13 nt, Brucella suis 1330
ggagcggaaaggc

SEQ ID NO: 452979 - RNA, 22 nt, Brucella suis 1330
ggagcgcagaucggcgagcgcc

SEQ ID NO: 452980 - RNA, 20 nt, Brucella suis 1330
ggacuucuucaccagccuug

SEQ ID NO: 452981 - RNA, 16 nt, Brucella suis 1330
ggacgguugcugaggg

SEQ ID NO: 452982 - RNA, 14 nt, Brucella suis 1330
ggacgaccauggcg

SEQ ID NO: 452983 - RNA, 19 nt, Brucella suis 1330
ggaccgcgaggaagccugc

SEQ ID NO: 452984 - RNA, 17 nt, Brucella suis 1330
ggaccauuucgggcgcg

SEQ ID NO: 452985 - RNA, 19 nt, Brucella suis 1330
ggaccaccggccugagcca

SEQ ID NO: 452986 - RNA, 17 nt, Brucella suis 1330
ggaccacgaacgacacc

SEQ ID NO: 452987 - RNA, 21 nt, Brucella suis 1330
ggaauagaccaucgaaagccc

SEQ ID NO: 452988 - RNA, 24 nt, Brucella suis 1330
ggaaugacauggaaaugcagguga

SEQ ID NO: 452989 - RNA, 23 nt, Brucella suis 1330
gcucgaaaaugcucuaggaaaac

SEQ ID NO: 452990 - RNA, 20 nt, Brucella suis 1330
gcuccucgaaauaggucagc

SEQ ID NO: 452991 - RNA, 14 nt, Brucella suis 1330
gcuccgccacuucg

SEQ ID NO: 452992 - RNA, 18 nt, Brucella suis 1330
gcuccagcccuuuccuga

SEQ ID NO: 452993 - RNA, 19 nt, Brucella suis 1330
gcuccagauugcgggcaag

SEQ ID NO: 452994 - RNA, 12 nt, Brucella suis 1330
gcucauccucca

SEQ ID NO: 452995 - RNA, 16 nt, Brucella suis 1330
gcucaucgcgcugcuc

SEQ ID NO: 452996 - RNA, 18 nt, Brucella suis 1330
gcucauucggguugccuu

SEQ ID NO: 452997 - RNA, 22 nt, Brucella suis 1330
gcucaccacauaggugcgcgga

SEQ ID NO: 452998 - RNA, 17 nt, Brucella suis 1330
gcucaauacuggguuga

SEQ ID NO: 452999 - RNA, 21 nt, Brucella suis 1330
gcuacugacaaaccucgggca

SEQ ID NO: 453000 - RNA, 18 nt, Brucella suis 1330
gcuacccauucauuucaa

SEQ ID NO: 453001 - RNA, 15 nt, Brucella suis 1330
gcuacgauuuucgug

SEQ ID NO: 453002 - RNA, 14 nt, Brucella suis 1330
gcguguauggcacg

SEQ ID NO: 453003 - RNA, 22 nt, Brucella suis 1330
gcguggugagcuugcgcagcgc

SEQ ID NO: 453004 - RNA, 15 nt, Brucella suis 1330
gcguggucauggcca

SEQ ID NO: 453005 - RNA, 21 nt, Brucella suis 1330
gcguggggagcguuuccgggu

SEQ ID NO: 453006 - RNA, 13 nt, Brucella suis 1330
gcgugggcugcug

SEQ ID NO: 453007 - RNA, 22 nt, Brucella suis 1330
gcgugccagcauugcgccguug

SEQ ID NO: 453008 - RNA, 15 nt, Brucella suis 1330
gcgugaugcgcaggc

SEQ ID NO: 453009 - RNA, 18 nt, Brucella suis 1330
gcgugaugcgcaggcgcu

SEQ ID NO: 453010 - RNA, 23 nt, Brucella suis 1330
gcgucuucugagaaaaaaaugcg

SEQ ID NO: 453011 - RNA, 21 nt, Brucella suis 1330
gcgucuguacauacaugauga

SEQ ID NO: 453012 - RNA, 15 nt, Brucella suis 1330
gcguauccaggugca

SEQ ID NO: 453013 - RNA, 16 nt, Brucella suis 1330
gcguagagugcuuccu

SEQ ID NO: 453014 - RNA, 19 nt, Brucella suis 1330
gcguaccauaggcgcgcgc

SEQ ID NO: 453015 - RNA, 18 nt, Brucella suis 1330
gcguacaacaucgccuga

SEQ ID NO: 453016 - RNA, 20 nt, Brucella suis 1330
gcguaaguucauaaggcaau

SEQ ID NO: 453017 - RNA, 14 nt, Brucella suis 1330
gcgguuuugagcug

SEQ ID NO: 453018 - RNA, 18 nt, Brucella suis 1330
gcgguuccugauugaaga

SEQ ID NO: 453019 - RNA, 19 nt, Brucella suis 1330
gcgguuccuguuuuaacac

SEQ ID NO: 453020 - RNA, 15 nt, Brucella suis 1330
gcggugcugcaccgu

SEQ ID NO: 453021 - RNA, 15 nt, Brucella suis 1330
gcggucggccucgcc

SEQ ID NO: 453022 - RNA, 13 nt, Brucella suis 1330
gcggucggcggcg

SEQ ID NO: 453023 - RNA, 13 nt, Brucella suis 1330
gcgggggcccaga

SEQ ID NO: 453024 - RNA, 17 nt, Brucella suis 1330
gcggggccugaaugcaa

SEQ ID NO: 453025 - RNA, 23 nt, Brucella suis 1330
gcgggcuguuggccggcagcggu

SEQ ID NO: 453026 - RNA, 14 nt, Brucella suis 1330
gcgggcuucuucca

SEQ ID NO: 453027 - RNA, 21 nt, Brucella suis 1330
gcgggcaugaaaacgccgcgg

SEQ ID NO: 453028 - RNA, 22 nt, Brucella suis 1330
gcgggcaugaaaacgccgcggc

SEQ ID NO: 453029 - RNA, 20 nt, Brucella suis 1330
gcgggcagcacugaaacggg

SEQ ID NO: 453030 - RNA, 21 nt, Brucella suis 1330
gcgggcagcacugaaacggga

SEQ ID NO: 453031 - RNA, 18 nt, Brucella suis 1330
gcgggcaauggccgcaug

SEQ ID NO: 453032 - RNA, 11 nt, Brucella suis 1330
gcgggcaagca

SEQ ID NO: 453033 - RNA, 20 nt, Brucella suis 1330
gcgggcaagcauuccgggcc

SEQ ID NO: 453034 - RNA, 13 nt, Brucella suis 1330
gcggcuucugggc

SEQ ID NO: 453035 - RNA, 14 nt, Brucella suis 1330
gcggcuucugggcc

SEQ ID NO: 453036 - RNA, 16 nt, Brucella suis 1330
gcggcuuccagcgccu

SEQ ID NO: 453037 - RNA, 18 nt, Brucella suis 1330
gcggcuucagaucgcgcg

SEQ ID NO: 453038 - RNA, 19 nt, Brucella suis 1330
gcgggaugacgccgggcau

SEQ ID NO: 453039 - RNA, 19 nt, Brucella suis 1330
gcggcucucacgcgcagca

SEQ ID NO: 453040 - RNA, 20 nt, Brucella suis 1330
gcggcugaaaucugcgccgg

SEQ ID NO: 453041 - RNA, 22 nt, Brucella suis 1330
gcggcugaaaucugcgccgguu

SEQ ID NO: 453042 - RNA, 14 nt, Brucella suis 1330
gcggcggcuccagc

SEQ ID NO: 453043 - RNA, 17 nt, Brucella suis 1330
gcggcggcuccagccgg

SEQ ID NO: 453044 - RNA, 14 nt, Brucella suis 1330
gcggcggccgggcg

SEQ ID NO: 453045 - RNA, 13 nt, Brucella suis 1330
gcggcgcggcggc

SEQ ID NO: 453046 - RNA, 16 nt, Brucella suis 1330
gcggcgcgcaaguucg

SEQ ID NO: 453047 - RNA, 16 nt, Brucella suis 1330
gcggcgaacgagcggc

SEQ ID NO: 453048 - RNA, 19 nt, Brucella suis 1330
gcggccuugaugcggcggc

SEQ ID NO: 453049 - RNA, 17 nt, Brucella suis 1330
gcggccacggcauccgc

SEQ ID NO: 453050 - RNA, 16 nt, Brucella suis 1330
gcggccaacgccacga

SEQ ID NO: 453051 - RNA, 15 nt, Brucella suis 1330
gcggccaagcgccag

SEQ ID NO: 453052 - RNA, 21 nt, Brucella suis 1330
gcggcauauccggaccgaagg

SEQ ID NO: 453053 - RNA, 13 nt, Brucella suis 1330
gcggcaguuucac

SEQ ID NO: 453054 - RNA, 19 nt, Brucella suis 1330
gcggcaggugccaucaagc

SEQ ID NO: 453055 - RNA, 20 nt, Brucella suis 1330
gcggcaggaucgccagaagc

SEQ ID NO: 453056 - RNA, 12 nt, Brucella suis 1330
gcggcagccgcc

SEQ ID NO: 453057 - RNA, 15 nt, Brucella suis 1330
gcggcagccgccgcc

SEQ ID NO: 453058 - RNA, 19 nt, Brucella suis 1330
gcggcagauaaagcgcaag

SEQ ID NO: 453059 - RNA, 15 nt, Brucella suis 1330
gcgcugucgccuguu

SEQ ID NO: 453060 - RNA, 16 nt, Brucella suis 1330
gcgcugauugggcggc

SEQ ID NO: 453061 - RNA, 17 nt, Brucella suis 1330
gcgcugauugggcggcg

SEQ ID NO: 453062 - RNA, 18 nt, Brucella suis 1330
gcgcucuaaccauuuguu

SEQ ID NO: 453063 - RNA, 20 nt, Brucella suis 1330
gcgcucgaccgcaccucugg

SEQ ID NO: 453064 - RNA, 16 nt, Brucella suis 1330
gcgcuagcgaugauga

SEQ ID NO: 453065 - RNA, 16 nt, Brucella suis 1330
gcgcuaaaaagcgcgc

SEQ ID NO: 453066 - RNA, 14 nt, Brucella suis 1330
gcgcgugagcgcgc

SEQ ID NO: 453067 - RNA, 21 nt, Brucella suis 1330
gcgcggagaugauggcggagc

SEQ ID NO: 453068 - RNA, 23 nt, Brucella suis 1330
gcgcgcuuuccccgggcagcggc

SEQ ID NO: 453069 - RNA, 16 nt, Brucella suis 1330
gcgcgccaguaggccc

SEQ ID NO: 453070 - RNA, 14 nt, Brucella suis 1330
gcgcgacgaucagg

SEQ ID NO: 453071 - RNA, 17 nt, Brucella suis 1330
gcgcgaacaugccugcc

SEQ ID NO: 453072 - RNA, 23 nt, Brucella suis 1330
gcgcgaacaugccugccgcagcc

SEQ ID NO: 453073 - RNA, 20 nt, Brucella suis 1330
gcgccuacgcggggaaauca

SEQ ID NO: 453074 - RNA, 23 nt, Brucella suis 1330
gcgccguuuucgugugcuugccg

SEQ ID NO: 453075 - RNA, 15 nt, Brucella suis 1330
gcgccgucgccgacc

SEQ ID NO: 453076 - RNA, 17 nt, Brucella suis 1330
gcgccgucgccgaccgc

SEQ ID NO: 453077 - RNA, 19 nt, Brucella suis 1330
gcgccguaauggcgcggcu

SEQ ID NO: 453078 - RNA, 20 nt, Brucella suis 1330
gcgccgguguagagcuggcg

SEQ ID NO: 453079 - RNA, 13 nt, Brucella suis 1330
gcgccgccauggc

SEQ ID NO: 453080 - RNA, 15 nt, Brucella suis 1330
gcgccgcacgcgcga

SEQ ID NO: 453081 - RNA, 20 nt, Brucella suis 1330
gcgccgcacgcgcgaaacca

SEQ ID NO: 453082 - RNA, 22 nt, Brucella suis 1330
gcgccgauaccaaggccgaugg

SEQ ID NO: 453083 - RNA, 17 nt, Brucella suis 1330
gcgccgaucacgaccuu

SEQ ID NO: 453084 - RNA, 15 nt, Brucella suis 1330
gcgccgaggcgcagg

SEQ ID NO: 453085 - RNA, 14 nt, Brucella suis 1330
gcgccgaacagcgc

SEQ ID NO: 453086 - RNA, 16 nt, Brucella suis 1330
gcgccgaaccgggccg

SEQ ID NO: 453087 - RNA, 15 nt, Brucella suis 1330
gcgccgaaaaucggc

SEQ ID NO: 453088 - RNA, 22 nt, Brucella suis 1330
gcgcccucaaccgagcagccgc

SEQ ID NO: 453089 - RNA, 15 nt, Brucella suis 1330
gcgcccgucaccggc

SEQ ID NO: 453090 - RNA, 20 nt, Brucella suis 1330
gcgcccgucaccggcuggca

SEQ ID NO: 453091 - RNA, 15 nt, Brucella suis 1330
gcgcccgcccgccgc

SEQ ID NO: 453092 - RNA, 20 nt, Brucella suis 1330
gcgcccgccacaugggcggc

SEQ ID NO: 453093 - RNA, 14 nt, Brucella suis 1330
gcgcccaggcgccc

SEQ ID NO: 453094 - RNA, 17 nt, Brucella suis 1330
gcgccauuugcaggccg

SEQ ID NO: 453095 - RNA, 19 nt, Brucella suis 1330
gcgccagaucaugggcggc

SEQ ID NO: 453096 - RNA, 24 nt, Brucella suis 1330
gcgccagagcauuuucgccgcagc

SEQ ID NO: 453097 - RNA, 19 nt, Brucella suis 1330
gcgccacuucccgcgccuc

SEQ ID NO: 453098 - RNA, 18 nt, Brucella suis 1330
gcgccagacaaggcgcgg

SEQ ID NO: 453099 - RNA, 14 nt, Brucella suis 1330
gcgcaggccgcggc

SEQ ID NO: 453100 - RNA, 19 nt, Brucella suis 1330
gcgcaggacuucacccgcc

SEQ ID NO: 453101 - RNA, 20 nt, Brucella suis 1330
gcgcaggacuucacccgcca

SEQ ID NO: 453102 - RNA, 14 nt, Brucella suis 1330
gcgcagcagcacca

SEQ ID NO: 453103 - RNA, 16 nt, Brucella suis 1330
gcgcacucaucaaaag

SEQ ID NO: 453104 - RNA, 14 nt, Brucella suis 1330
gcgcagcaaagccc

SEQ ID NO: 453105 - RNA, 17 nt, Brucella suis 1330
gcgcaauugcgcgccug

SEQ ID NO: 453106 - RNA, 19 nt, Brucella suis 1330
gcgcaauaauuaugcagga

SEQ ID NO: 453107 - RNA, 23 nt, Brucella suis 1330
gcgcaacgcaauggagcaggaag

SEQ ID NO: 453108 - RNA, 14 nt, Brucella suis 1330
gcgcaaaggccggg

SEQ ID NO: 453109 - RNA, 15 nt, Brucella suis 1330
gcgcaaagcccgccg

SEQ ID NO: 453110 - RNA, 13 nt, Brucella suis 1330
gcgcaaagccugc

SEQ ID NO: 453111 - RNA, 17 nt, Brucella suis 1330
gcgcaaaaucugcucgu

SEQ ID NO: 453112 - RNA, 20 nt, Brucella suis 1330
gcgcaaaaucugcucguccg

SEQ ID NO: 453113 - RNA, 13 nt, Brucella suis 1330
gcgcaaacaagcu

SEQ ID NO: 453114 - RNA, 17 nt, Brucella suis 1330
gcgauugcgcauugaca

SEQ ID NO: 453115 - RNA, 16 nt, Brucella suis 1330
gcgauuucgccgggcu

SEQ ID NO: 453116 - RNA, 16 nt, Brucella suis 1330
gcgauuucguccagag

SEQ ID NO: 453117 - RNA, 23 nt, Brucella suis 1330
gcgauugaugucauacauggcgu

SEQ ID NO: 453118 - RNA, 18 nt, Brucella suis 1330
gcgauggcgccgcauggc

SEQ ID NO: 453119 - RNA, 15 nt, Brucella suis 1330
gcgauggcgacgcgc

SEQ ID NO: 453120 - RNA, 22 nt, Brucella suis 1330
gcgauggaccauauccaucugc

SEQ ID NO: 453121 - RNA, 19 nt, Brucella suis 1330
gcgaugauagcgcccgccu

SEQ ID NO: 453122 - RNA, 12 nt, Brucella suis 1330
gcgaucuuuucg

SEQ ID NO: 453123 - RNA, 22 nt, Brucella suis 1330
gcgaucuuuucgcuuguuacau

SEQ ID NO: 453124 - RNA, 17 nt, Brucella suis 1330
gcgagguccggggugaa

SEQ ID NO: 453125 - RNA, 17 nt, Brucella suis 1330
gcgaggucucccggcac

SEQ ID NO: 453126 - RNA, 23 nt, Brucella suis 1330
gcgagggcgggcaugggcaccug

SEQ ID NO: 453127 - RNA, 13 nt, Brucella suis 1330
gcgagggcgggcg

SEQ ID NO: 453128 - RNA, 16 nt, Brucella suis 1330
gcgagggcgggcggcc

SEQ ID NO: 453129 - RNA, 17 nt, Brucella suis 1330
gcgagggcgggcggcca

SEQ ID NO: 453130 - RNA, 20 nt, Brucella suis 1330
gcgaggggaaacugcgggcg

SEQ ID NO: 453131 - RNA, 15 nt, Brucella suis 1330
gcgaggaagccugca

SEQ ID NO: 453132 - RNA, 20 nt, Brucella suis 1330
gcgagcgacauauucuuccg

SEQ ID NO: 453133 - RNA, 17 nt, Brucella suis 1330
gcgacuucgggucggug

SEQ ID NO: 453134 - RNA, 19 nt, Brucella suis 1330
gcgacuucgggucggugaa

SEQ ID NO: 453135 - RNA, 17 nt, Brucella suis 1330
gcgacugucaccgccag

SEQ ID NO: 453136 - RNA, 22 nt, Brucella suis 1330
gcgacugucaccgccagcagaa

SEQ ID NO: 453137 - RNA, 22 nt, Brucella suis 1330
gcgacucuacgcugaucgcaag

SEQ ID NO: 453138 - RNA, 20 nt, Brucella suis 1330
gcgacgaucaggaauacgcc

SEQ ID NO: 453139 - RNA, 19 nt, Brucella suis 1330
gcgaacgauugggcgauga

SEQ ID NO: 453140 - RNA, 17 nt, Brucella suis 1330
gcgaaaugcgcgcggca

SEQ ID NO: 453141 - RNA, 21 nt, Brucella suis 1330
gcgaaauaaucguaucgccaa

SEQ ID NO: 453142 - RNA, 22 nt, Brucella suis 1330
gcgaaauauuggcuaaaaaugg

SEQ ID NO: 453143 - RNA, 12 nt, Brucella suis 1330
gccuuugccgcg

SEQ ID NO: 453144 - RNA, 14 nt, Brucella suis 1330
gccuuuguuuucau

SEQ ID NO: 453145 - RNA, 12 nt, Brucella suis 1330
gccuuuuccagu

SEQ ID NO: 453146 - RNA, 12 nt, Brucella suis 1330
gccuuuucuuca

SEQ ID NO: 453147 - RNA, 20 nt, Brucella suis 1330
gccuuuuggccgcucgcugc

SEQ ID NO: 453148 - RNA, 22 nt, Brucella suis 1330
gccuugucgcccauuuucucca

SEQ ID NO: 453149 - RNA, 12 nt, Brucella suis 1330
gccuugcuugaa

SEQ ID NO: 453150 - RNA, 19 nt, Brucella suis 1330
gccuugcggcggcguucca

SEQ ID NO: 453151 - RNA, 23 nt, Brucella suis 1330
gccuuggaggcggcauaaggccc

SEQ ID NO: 453152 - RNA, 17 nt, Brucella suis 1330
gccuugcgauuuccuug

SEQ ID NO: 453153 - RNA, 15 nt, Brucella suis 1330
gccuugcggcggcgu

SEQ ID NO: 453154 - RNA, 19 nt, Brucella suis 1330
gccuugccugccggucccg

SEQ ID NO: 453155 - RNA, 18 nt, Brucella suis 1330
gccuugacggagagaggg

SEQ ID NO: 453156 - RNA, 22 nt, Brucella suis 1330
gccuugagaucguaggcuuucc

SEQ ID NO: 453157 - RNA, 14 nt, Brucella suis 1330
gccuugagaugagc

SEQ ID NO: 453158 - RNA, 14 nt, Brucella suis 1330
gccuugaaaccaaa

SEQ ID NO: 453159 - RNA, 19 nt, Brucella suis 1330
gccuugcagaugagcggca

SEQ ID NO: 453160 - RNA, 19 nt, Brucella suis 1330
gccuucggcugcuuccggc

SEQ ID NO: 453161 - RNA, 16 nt, Brucella suis 1330
gccuucgacaaccgcg

SEQ ID NO: 453162 - RNA, 18 nt, Brucella suis 1330
gccuucccgccagccguc

SEQ ID NO: 453163 - RNA, 22 nt, Brucella suis 1330
gccuucagcacauccugcaccg

SEQ ID NO: 453164 - RNA, 17 nt, Brucella suis 1330
gccuuaucggggcggcg

SEQ ID NO: 453165 - RNA, 13 nt, Brucella suis 1330
gccuguuccugca

SEQ ID NO: 453166 - RNA, 20 nt, Brucella suis 1330
gccuguuccuugaggccgcg

SEQ ID NO: 453167 - RNA, 18 nt, Brucella suis 1330
gccuguucuucggccaug

SEQ ID NO: 453168 - RNA, 18 nt, Brucella suis 1330
gccuguccuuguuccagu

SEQ ID NO: 453169 - RNA, 15 nt, Brucella suis 1330
gccugguuucacagg

SEQ ID NO: 453170 - RNA, 23 nt, Brucella suis 1330
gccugguagcgcaccucguucgg

SEQ ID NO: 453171 - RNA, 17 nt, Brucella suis 1330
gccuggucuagccgcgc

SEQ ID NO: 453172 - RNA, 23 nt, Brucella suis 1330
gccuggcgaaaacggccaugcgc

SEQ ID NO: 453173 - RNA, 15 nt, Brucella suis 1330
gccuggcccggcugu

SEQ ID NO: 453174 - RNA, 23 nt, Brucella suis 1330
gccugcuuccuuuucggcuuccu

SEQ ID NO: 453175 - RNA, 16 nt, Brucella suis 1330
gccugcugccaugucu

SEQ ID NO: 453176 - RNA, 16 nt, Brucella suis 1330
gccugcugcauccugc

SEQ ID NO: 453177 - RNA, 17 nt, Brucella suis 1330
gccugcugcauuuucug

SEQ ID NO: 453178 - RNA, 19 nt, Brucella suis 1330
gccugcugcauuuucugca

SEQ ID NO: 453179 - RNA, 13 nt, Brucella suis 1330
gccugccuucuuc

SEQ ID NO: 453180 - RNA, 20 nt, Brucella suis 1330
gccugcagccggaagaacag

SEQ ID NO: 453181 - RNA, 23 nt, Brucella suis 1330
gccugcagccggaagaacagcgc

SEQ ID NO: 453182 - RNA, 14 nt, Brucella suis 1330
gccugcaccaugga

SEQ ID NO: 453183 - RNA, 20 nt, Brucella suis 1330
gccugcaccggcccaaaggc

SEQ ID NO: 453184 - RNA, 21 nt, Brucella suis 1330
gccugcaccggcccaaaggcc

SEQ ID NO: 453185 - RNA, 13 nt, Brucella suis 1330
gccugagaucgau

SEQ ID NO: 453186 - RNA, 14 nt, Brucella suis 1330
gccugacuggcggc

SEQ ID NO: 453187 - RNA, 14 nt, Brucella suis 1330
gccugaaacaaggc

SEQ ID NO: 453188 - RNA, 19 nt, Brucella suis 1330
gccugaaacaaggccgagc

SEQ ID NO: 453189 - RNA, 14 nt, Brucella suis 1330
gccugaaacagcau

SEQ ID NO: 453190 - RNA, 16 nt, Brucella suis 1330
gccugaaccggcgagc

SEQ ID NO: 453191 - RNA, 14 nt, Brucella suis 1330
gccugaaugaaaac

SEQ ID NO: 453192 - RNA, 13 nt, Brucella suis 1330
gccugaaugcaau

SEQ ID NO: 453193 - RNA, 15 nt, Brucella suis 1330
gccucuucauccggc

SEQ ID NO: 453194 - RNA, 22 nt, Brucella suis 1330
gccucguuugcacuuucaagcg

SEQ ID NO: 453195 - RNA, 14 nt, Brucella suis 1330
gccucgauggccug

SEQ ID NO: 453196 - RNA, 17 nt, Brucella suis 1330
gccucccugcgcgcgcc

SEQ ID NO: 453197 - RNA, 13 nt, Brucella suis 1330
gccuccauggcgu

SEQ ID NO: 453198 - RNA, 18 nt, Brucella suis 1330
gccuccauggcgucccca

SEQ ID NO: 453199 - RNA, 15 nt, Brucella suis 1330
gccucauggcggcgc

SEQ ID NO: 453200 - RNA, 16 nt, Brucella suis 1330
gccucacccuccaccg

SEQ ID NO: 453201 - RNA, 19 nt, Brucella suis 1330
gccucacccuccaccgaau

SEQ ID NO: 453202 - RNA, 21 nt, Brucella suis 1330
gccucaauggucacggccaca

SEQ ID NO: 453203 - RNA, 22 nt, Brucella suis 1330
gccuaccaaggcccgccucgac

SEQ ID NO: 453204 - RNA, 18 nt, Brucella suis 1330
gccguugcgaucuucugc

SEQ ID NO: 453205 - RNA, 21 nt, Brucella suis 1330
gccuaacaggaacgccgccgg

SEQ ID NO: 453206 - RNA, 21 nt, Brucella suis 1330
gccuaaggcgcgcacuguuga

SEQ ID NO: 453207 - RNA, 20 nt, Brucella suis 1330
gccuaaucaaaagaaaccuu

SEQ ID NO: 453208 - RNA, 13 nt, Brucella suis 1330
gccgugggcaaga

SEQ ID NO: 453209 - RNA, 22 nt, Brucella suis 1330
gccgugggcaagaucauccggc

SEQ ID NO: 453210 - RNA, 18 nt, Brucella suis 1330
gccgucgggaccaccggc

SEQ ID NO: 453211 - RNA, 17 nt, Brucella suis 1330
gccggggggaauggcgc

SEQ ID NO: 453212 - RNA, 21 nt, Brucella suis 1330
gccggggggaauggcgcgcgc

SEQ ID NO: 453213 - RNA, 13 nt, Brucella suis 1330
gccggggccggau

SEQ ID NO: 453214 - RNA, 14 nt, Brucella suis 1330
gccgggcuuuccug

SEQ ID NO: 453215 - RNA, 16 nt, Brucella suis 1330
gccgggcuuuccugca

SEQ ID NO: 453216 - RNA, 22 nt, Brucella suis 1330
gccgggcauggaagccgacaga

SEQ ID NO: 453217 - RNA, 20 nt, Brucella suis 1330
gccgggauuuucggccagcg

SEQ ID NO: 453218 - RNA, 13 nt, Brucella suis 1330
gccggcgcagcgc

SEQ ID NO: 453219 - RNA, 22 nt, Brucella suis 1330
gccggccuuugcgcgccuguuu

SEQ ID NO: 453220 - RNA, 13 nt, Brucella suis 1330
gccggcaggcugu

SEQ ID NO: 453221 - RNA, 22 nt, Brucella suis 1330
gccggcagcgguuccugauuga

SEQ ID NO: 453222 - RNA, 15 nt, Brucella suis 1330
gccggauaucgccag

SEQ ID NO: 453223 - RNA, 17 nt, Brucella suis 1330
gccggaccgugccgcuu

SEQ ID NO: 453224 - RNA, 22 nt, Brucella suis 1330
gccggaccgugccgcuuccagc

SEQ ID NO: 453225 - RNA, 22 nt, Brucella suis 1330
gccggaaagcgauuucaggaaa

SEQ ID NO: 453226 - RNA, 15 nt, Brucella suis 1330
gccgcuuugcggagg

SEQ ID NO: 453227 - RNA, 14 nt, Brucella suis 1330
gccgcuuucuucca

SEQ ID NO: 453228 - RNA, 18 nt, Brucella suis 1330
gccgcuggugcgauccac

SEQ ID NO: 453229 - RNA, 19 nt, Brucella suis 1330
gccgcgccaugccauccuc

SEQ ID NO: 453230 - RNA, 15 nt, Brucella suis 1330
gccgcgccaauccag

SEQ ID NO: 453231 - RNA, 17 nt, Brucella suis 1330
gccgcgccaauccaggu

SEQ ID NO: 453232 - RNA, 17 nt, Brucella suis 1330
gccgccugccuucuuca

SEQ ID NO: 453233 - RNA, 18 nt, Brucella suis 1330
gccgcgaaccgucgccag

SEQ ID NO: 453234 - RNA, 11 nt, Brucella suis 1330
gccgccgcaga

SEQ ID NO: 453235 - RNA, 15 nt, Brucella suis 1330
gccgcccgacagaau

SEQ ID NO: 453236 - RNA, 18 nt, Brucella suis 1330
gccgccauggucgcgcac

SEQ ID NO: 453237 - RNA, 13 nt, Brucella suis 1330
gccgccagccgca

SEQ ID NO: 453238 - RNA, 13 nt, Brucella suis 1330
gccgccacccaug

SEQ ID NO: 453239 - RNA, 14 nt, Brucella suis 1330
gccgccacccaugu

SEQ ID NO: 453240 - RNA, 17 nt, Brucella suis 1330
gccgccaagccagcccg

SEQ ID NO: 453241 - RNA, 18 nt, Brucella suis 1330
gccgccaacgaccagcug

SEQ ID NO: 453242 - RNA, 23 nt, Brucella suis 1330
gccgcauggcggcacccgcaacc

SEQ ID NO: 453243 - RNA, 19 nt, Brucella suis 1330
gccgcaugauaggcaacau

SEQ ID NO: 453244 - RNA, 19 nt, Brucella suis 1330
gccgcaugauccgcuccag

SEQ ID NO: 453245 - RNA, 21 nt, Brucella suis 1330
gccgcaugauccgcuccagau

SEQ ID NO: 453246 - RNA, 22 nt, Brucella suis 1330
gccgcauaggcuuucagcgcag

SEQ ID NO: 453247 - RNA, 21 nt, Brucella suis 1330
gccgcagaccacccggccgcc

SEQ ID NO: 453248 - RNA, 18 nt, Brucella suis 1330
gccgauaauggcauagga

SEQ ID NO: 453249 - RNA, 15 nt, Brucella suis 1330
gcccugcgucgggug

SEQ ID NO: 453250 - RNA, 13 nt, Brucella suis 1330
gcccugaaauguc

SEQ ID NO: 453251 - RNA, 16 nt, Brucella suis 1330
gcccugaaaaggcuca

SEQ ID NO: 453252 - RNA, 13 nt, Brucella suis 1330
gcccugaaacacu

SEQ ID NO: 453253 - RNA, 23 nt, Brucella suis 1330
gcccucugaaccggcgggcuuga

SEQ ID NO: 453254 - RNA, 13 nt, Brucella suis 1330
gcccgucgcaggc

SEQ ID NO: 453255 - RNA, 14 nt, Brucella suis 1330
gcccguccucaucg

SEQ ID NO: 453256 - RNA, 22 nt, Brucella suis 1330
gcccgucccccaacgugcggug

SEQ ID NO: 453257 - RNA, 11 nt, Brucella suis 1330
gcccgcgugca

SEQ ID NO: 453258 - RNA, 20 nt, Brucella suis 1330
gcccgcgugugacggaugag

SEQ ID NO: 453259 - RNA, 16 nt, Brucella suis 1330
gcccgccgauccggcg

SEQ ID NO: 453260 - RNA, 22 nt, Brucella suis 1330
gcccgccgaagagacuguucuu

SEQ ID NO: 453261 - RNA, 11 nt, Brucella suis 1330
gcccgccgaaa

SEQ ID NO: 453262 - RNA, 17 nt, Brucella suis 1330
gcccgccacgaggaaga

SEQ ID NO: 453263 - RNA, 19 nt, Brucella suis 1330
gcccgccagauugcaaacg

SEQ ID NO: 453264 - RNA, 22 nt, Brucella suis 1330
gcccgcauggucgaugccgccg

SEQ ID NO: 453265 - RNA, 23 nt, Brucella suis 1330
gcccgcauggucgaugccgccga

SEQ ID NO: 453266 - RNA, 20 nt, Brucella suis 1330
gcccgcacccuauuccccua

SEQ ID NO: 453267 - RNA, 16 nt, Brucella suis 1330
gcccgacaaagaucau

SEQ ID NO: 453268 - RNA, 16 nt, Brucella suis 1330
gccccggcaucacugg

SEQ ID NO: 453269 - RNA, 19 nt, Brucella suis 1330
gcccccuguuucugcugga

SEQ ID NO: 453270 - RNA, 18 nt, Brucella suis 1330
gcccccagaaggcgcggc

SEQ ID NO: 453271 - RNA, 13 nt, Brucella suis 1330
gcccccacaacug

SEQ ID NO: 453272 - RNA, 20 nt, Brucella suis 1330
gccccauguuuaugaaaaca

SEQ ID NO: 453273 - RNA, 16 nt, Brucella suis 1330
gcccauugcccgcccg

SEQ ID NO: 453274 - RNA, 23 nt, Brucella suis 1330
gcccauguccgccugaucgucag

SEQ ID NO: 453275 - RNA, 20 nt, Brucella suis 1330
gcccauggacuuuucagccu

SEQ ID NO: 453276 - RNA, 17 nt, Brucella suis 1330
gcccaucccggaaggaa

SEQ ID NO: 453277 - RNA, 18 nt, Brucella suis 1330
gcccaucccggaaggaau

SEQ ID NO: 453278 - RNA, 17 nt, Brucella suis 1330
gcccaucgcauugcuga

SEQ ID NO: 453279 - RNA, 22 nt, Brucella suis 1330
gcccauauguauggcaaaaggc

SEQ ID NO: 453280 - RNA, 13 nt, Brucella suis 1330
gcccauaccgcgc

SEQ ID NO: 453281 - RNA, 16 nt, Brucella suis 1330
gcccauacgcgcggca

SEQ ID NO: 453282 - RNA, 19 nt, Brucella suis 1330
gcccaguucguggcggggc

SEQ ID NO: 453283 - RNA, 22 nt, Brucella suis 1330
gcccagcccuuuucagcggaga

SEQ ID NO: 453284 - RNA, 15 nt, Brucella suis 1330
gcccacgguuuuugu

SEQ ID NO: 453285 - RNA, 15 nt, Brucella suis 1330
gccaugcggccagcc

SEQ ID NO: 453286 - RNA, 16 nt, Brucella suis 1330
gccaugcggccagccu

SEQ ID NO: 453287 - RNA, 13 nt, Brucella suis 1330
gccaugcgcauga

SEQ ID NO: 453288 - RNA, 20 nt, Brucella suis 1330
gccaugccuucccgccagcc

SEQ ID NO: 453289 - RNA, 22 nt, Brucella suis 1330
gccaugcgcaaccaaaacauac

SEQ ID NO: 453290 - RNA, 19 nt, Brucella suis 1330
gccaugaugccgacaagca

SEQ ID NO: 453291 - RNA, 21 nt, Brucella suis 1330
gccaugaugccgacaagcagc

SEQ ID NO: 453292 - RNA, 23 nt, Brucella suis 1330
gccauaccgucgaggaaaaagcc

SEQ ID NO: 453293 - RNA, 14 nt, Brucella suis 1330
gccauacacgcggc

SEQ ID NO: 453294 - RNA, 22 nt, Brucella suis 1330
gccauaagccggcaugaaugug

SEQ ID NO: 453295 - RNA, 18 nt, Brucella suis 1330
gccaguuuggcugugcug

SEQ ID NO: 453296 - RNA, 23 nt, Brucella suis 1330
gccagugcgccaccgcgaaagcc

SEQ ID NO: 453297 - RNA, 15 nt, Brucella suis 1330
gccaguccuugcccu

SEQ ID NO: 453298 - RNA, 17 nt, Brucella suis 1330
gccagcuugaaaagccg

SEQ ID NO: 453299 - RNA, 21 nt, Brucella suis 1330
gccagcggugacgaucuggaa

SEQ ID NO: 453300 - RNA, 22 nt, Brucella suis 1330
gccagcggugacgaucuggaac

SEQ ID NO: 453301 - RNA, 17 nt, Brucella suis 1330
gccagcggugcccuuuc

SEQ ID NO: 453302 - RNA, 16 nt, Brucella suis 1330
gccagcgcaaagcgcg

SEQ ID NO: 453303 - RNA, 16 nt, Brucella suis 1330
gccagaugugccacca

SEQ ID NO: 453304 - RNA, 23 nt, Brucella suis 1330
gccagauccgcugacugcgccau

SEQ ID NO: 453305 - RNA, 21 nt, Brucella suis 1330
gccagaucaugggcggccacg

SEQ ID NO: 453306 - RNA, 23 nt, Brucella suis 1330
gccagaucccguuuugagaugac

SEQ ID NO: 453307 - RNA, 14 nt, Brucella suis 1330
gccagaucgcgcgc

SEQ ID NO: 453308 - RNA, 17 nt, Brucella suis 1330
gccagauaaagcaggau

SEQ ID NO: 453309 - RNA, 22 nt, Brucella suis 1330
gccagaagguuucagccuccug

SEQ ID NO: 453310 - RNA, 14 nt, Brucella suis 1330
gccacugcccugga

SEQ ID NO: 453311 - RNA, 18 nt, Brucella suis 1330
gccagaaccaccagagca

SEQ ID NO: 453312 - RNA, 21 nt, Brucella suis 1330
gccagaaccaccagagcaaaa

SEQ ID NO: 453313 - RNA, 16 nt, Brucella suis 1330
gccagaaccgcaucga

SEQ ID NO: 453314 - RNA, 16 nt, Brucella suis 1330
gccacgggccagaaug

SEQ ID NO: 453315 - RNA, 22 nt, Brucella suis 1330
gccacggcgaaagcugccgcga

SEQ ID NO: 453316 - RNA, 14 nt, Brucella suis 1330
gccacggauuucca

SEQ ID NO: 453317 - RNA, 13 nt, Brucella suis 1330
gccacgcgccgcc

SEQ ID NO: 453318 - RNA, 16 nt, Brucella suis 1330
gccacgcgccgccauc

SEQ ID NO: 453319 - RNA, 16 nt, Brucella suis 1330
gccacgccagccgcga

SEQ ID NO: 453320 - RNA, 21 nt, Brucella suis 1330
gccacgaugccugccggugca

SEQ ID NO: 453321 - RNA, 22 nt, Brucella suis 1330
gccacgagaaaauggcgcuagc

SEQ ID NO: 453322 - RNA, 21 nt, Brucella suis 1330
gccacgauagacgcggcggca

SEQ ID NO: 453323 - RNA, 18 nt, Brucella suis 1330
gccacgacagggcgcugc

SEQ ID NO: 453324 - RNA, 19 nt, Brucella suis 1330
gcauaggcuucggccgcuu

SEQ ID NO: 453325 - RNA, 17 nt, Brucella suis 1330
gcaguucaaugggcggg

SEQ ID NO: 453326 - RNA, 12 nt, Brucella suis 1330
gcauaaaggccg

SEQ ID NO: 453327 - RNA, 17 nt, Brucella suis 1330
gcagugaagaauauggu

SEQ ID NO: 453328 - RNA, 21 nt, Brucella suis 1330
gcagggcuucaugauggaaga

SEQ ID NO: 453329 - RNA, 20 nt, Brucella suis 1330
gcaggcggaagggccggucg

SEQ ID NO: 453330 - RNA, 20 nt, Brucella suis 1330
gcaggcggauauucgccgcc

SEQ ID NO: 453331 - RNA, 21 nt, Brucella suis 1330
gcaggcggauauucgccgccu

SEQ ID NO: 453332 - RNA, 12 nt, Brucella suis 1330
gcaggcgcggca

SEQ ID NO: 453333 - RNA, 14 nt, Brucella suis 1330
gcaggcgccgugcc

SEQ ID NO: 453334 - RNA, 18 nt, Brucella suis 1330
gcaggcgcaggcccugca

SEQ ID NO: 453335 - RNA, 20 nt, Brucella suis 1330
gcaggccggcgagggcgggc

SEQ ID NO: 453336 - RNA, 19 nt, Brucella suis 1330
gcaggccgaaggaugcaag

SEQ ID NO: 453337 - RNA, 17 nt, Brucella suis 1330
gcaggauugccgccaug

SEQ ID NO: 453338 - RNA, 14 nt, Brucella suis 1330
gcaggaucgccaga

SEQ ID NO: 453339 - RNA, 16 nt, Brucella suis 1330
gcaggaucggcagcag

SEQ ID NO: 453340 - RNA, 19 nt, Brucella suis 1330
gcaggaucuuccaucuggc

SEQ ID NO: 453341 - RNA, 13 nt, Brucella suis 1330
gcaggaggccaaa

SEQ ID NO: 453342 - RNA, 15 nt, Brucella suis 1330
gcaggaucagggcca

SEQ ID NO: 453343 - RNA, 17 nt, Brucella suis 1330
gcagcuucgagcgccuu

SEQ ID NO: 453344 - RNA, 14 nt, Brucella suis 1330
gcaggaaagcccgg

SEQ ID NO: 453345 - RNA, 14 nt, Brucella suis 1330
gcagcucggcuuca

SEQ ID NO: 453346 - RNA, 23 nt, Brucella suis 1330
gcagcgacagcggcgcgccuggg

SEQ ID NO: 453347 - RNA, 15 nt, Brucella suis 1330
gcagccugaacagcg

SEQ ID NO: 453348 - RNA, 19 nt, Brucella suis 1330
gcagcccaaccgagcagaa

SEQ ID NO: 453349 - RNA, 12 nt, Brucella suis 1330
gcagccagggau

SEQ ID NO: 453350 - RNA, 21 nt, Brucella suis 1330
gcagcaggggcagcgcgcggu

SEQ ID NO: 453351 - RNA, 20 nt, Brucella suis 1330
gcagaugagcggcagcagcc

SEQ ID NO: 453352 - RNA, 18 nt, Brucella suis 1330
gcagaucaucgucaugca

SEQ ID NO: 453353 - RNA, 15 nt, Brucella suis 1330
gcagauauuccuucu

SEQ ID NO: 453354 - RNA, 13 nt, Brucella suis 1330
gcagauaaagggu

SEQ ID NO: 453355 - RNA, 13 nt, Brucella suis 1330
gcagacaggccag

SEQ ID NO: 453356 - RNA, 14 nt, Brucella suis 1330
gcagaaggaugauc

SEQ ID NO: 453357 - RNA, 19 nt, Brucella suis 1330
gcagaagaaagggcgcggu

SEQ ID NO: 453358 - RNA, 18 nt, Brucella suis 1330
gcacuuucaagcggguag

SEQ ID NO: 453359 - RNA, 15 nt, Brucella suis 1330
gcacgcgcagauaac

SEQ ID NO: 453360 - RNA, 17 nt, Brucella suis 1330
gcacuucgcccagaaua

SEQ ID NO: 453361 - RNA, 21 nt, Brucella suis 1330
gcacgcgcaccugacggcgca

SEQ ID NO: 453362 - RNA, 19 nt, Brucella suis 1330
gcacgcaggcaucaaugaa

SEQ ID NO: 453363 - RNA, 18 nt, Brucella suis 1330
gcacgcaaggcggcugga

SEQ ID NO: 453364 - RNA, 16 nt, Brucella suis 1330
gcaccggauuugccaa

SEQ ID NO: 453365 - RNA, 17 nt, Brucella suis 1330
gcaccggauuugccaag

SEQ ID NO: 453366 - RNA, 14 nt, Brucella suis 1330
gcaccgugcuccag

SEQ ID NO: 453367 - RNA, 20 nt, Brucella suis 1330
gcaccguuucaaaccccagu

SEQ ID NO: 453368 - RNA, 13 nt, Brucella suis 1330
gcaccguuucucu

SEQ ID NO: 453369 - RNA, 13 nt, Brucella suis 1330
gcaccccaugaga

SEQ ID NO: 453370 - RNA, 18 nt, Brucella suis 1330
gcacccacugcccgccuu

SEQ ID NO: 453371 - RNA, 20 nt, Brucella suis 1330
gcaccauucuugcgcccucc

SEQ ID NO: 453372 - RNA, 14 nt, Brucella suis 1330
gcacaugagcgcgg

SEQ ID NO: 453373 - RNA, 17 nt, Brucella suis 1330
gcacaggcucgggcagc

SEQ ID NO: 453374 - RNA, 21 nt, Brucella suis 1330
gcacagccagaaagaagauga

SEQ ID NO: 453375 - RNA, 14 nt, Brucella suis 1330
gcaaugccggaugc

SEQ ID NO: 453376 - RNA, 18 nt, Brucella suis 1330
gcaauccuguucaagcag

SEQ ID NO: 453377 - RNA, 21 nt, Brucella suis 1330
gcaauccuucacccucggugc

SEQ ID NO: 453378 - RNA, 16 nt, Brucella suis 1330
gcaauccacaggagau

SEQ ID NO: 453379 - RNA, 19 nt, Brucella suis 1330
gcaaucccgaaaaguugac

SEQ ID NO: 453380 - RNA, 22 nt, Brucella suis 1330
gcaauacgccuggccggcgccu

SEQ ID NO: 453381 - RNA, 22 nt, Brucella suis 1330
gcaaucacgcggcgcaaagccc

SEQ ID NO: 453382 - RNA, 19 nt, Brucella suis 1330
gcaaguugcuccagcccuu

SEQ ID NO: 453383 - RNA, 16 nt, Brucella suis 1330
gcaagggcaagcagaa

SEQ ID NO: 453384 - RNA, 15 nt, Brucella suis 1330
gcaaggcgcgcccgu

SEQ ID NO: 453385 - RNA, 18 nt, Brucella suis 1330
gcaauaauuaugcaggaa

SEQ ID NO: 453386 - RNA, 19 nt, Brucella suis 1330
gcaagcugcucgcgguuga

SEQ ID NO: 453387 - RNA, 23 nt, Brucella suis 1330
gcaaggagcgagcuugcaaugag

SEQ ID NO: 453388 - RNA, 20 nt, Brucella suis 1330
gcaagcuggaaggccaggcc

SEQ ID NO: 453389 - RNA, 14 nt, Brucella suis 1330
gcaagcgucuucug

SEQ ID NO: 453390 - RNA, 12 nt, Brucella suis 1330
gcaagacagauc

SEQ ID NO: 453391 - RNA, 15 nt, Brucella suis 1330
gcaacucauggaagu

SEQ ID NO: 453392 - RNA, 14 nt, Brucella suis 1330
gcaacgacauagau

SEQ ID NO: 453393 - RNA, 17 nt, Brucella suis 1330
gcaaccuggcugcacca

SEQ ID NO: 453394 - RNA, 16 nt, Brucella suis 1330
gcaacccauuuucaug

SEQ ID NO: 453395 - RNA, 19 nt, Brucella suis 1330
gcaaccaugcguuuuacuc

SEQ ID NO: 453396 - RNA, 17 nt, Brucella suis 1330
gcaacauugaguuucau

SEQ ID NO: 453397 - RNA, 21 nt, Brucella suis 1330
gcaacagggcgaaaagccgcc

SEQ ID NO: 453398 - RNA, 22 nt, Brucella suis 1330
gcaacagggcgaaaagccgccu

SEQ ID NO: 453399 - RNA, 20 nt, Brucella suis 1330
gauuuccgcgacaucaucaa

SEQ ID NO: 453400 - RNA, 14 nt, Brucella suis 1330
gauuucgagcugac

SEQ ID NO: 453401 - RNA, 14 nt, Brucella suis 1330
gauuuuugccagau

SEQ ID NO: 453402 - RNA, 21 nt, Brucella suis 1330
gcaaaaaacuugcauuauuua

SEQ ID NO: 453403 - RNA, 17 nt, Brucella suis 1330
gauugcaggucuuucug

SEQ ID NO: 453404 - RNA, 15 nt, Brucella suis 1330
gauucuaucgccugg

SEQ ID NO: 453405 - RNA, 18 nt, Brucella suis 1330
gauugccauuuucauccu

SEQ ID NO: 453406 - RNA, 14 nt, Brucella suis 1330
gauugggcgcgcua

SEQ ID NO: 453407 - RNA, 13 nt, Brucella suis 1330
gauugggcggcgg

SEQ ID NO: 453408 - RNA, 22 nt, Brucella suis 1330
gauucgaaccucugacccccag

SEQ ID NO: 453409 - RNA, 17 nt, Brucella suis 1330
gauuccagcguaaaugg

SEQ ID NO: 453410 - RNA, 23 nt, Brucella suis 1330
gauucacccgaaaccauccaugc

SEQ ID NO: 453411 - RNA, 14 nt, Brucella suis 1330
gauguugauggaag

SEQ ID NO: 453412 - RNA, 17 nt, Brucella suis 1330
gauguugauggaaggcg

SEQ ID NO: 453413 - RNA, 19 nt, Brucella suis 1330
gaugugcagcgugccgugu

SEQ ID NO: 453414 - RNA, 21 nt, Brucella suis 1330
gaugugagcgaauaugcgggg

SEQ ID NO: 453415 - RNA, 18 nt, Brucella suis 1330
gauggcgguaaugcuggc

SEQ ID NO: 453416 - RNA, 19 nt, Brucella suis 1330
gauggccgaauagcgcauc

SEQ ID NO: 453417 - RNA, 14 nt, Brucella suis 1330
gaugcggcggcgcg

SEQ ID NO: 453418 - RNA, 13 nt, Brucella suis 1330
gaugcggcgguga

SEQ ID NO: 453419 - RNA, 13 nt, Brucella suis 1330
gaugcucuuucug

SEQ ID NO: 453420 - RNA, 14 nt, Brucella suis 1330
gaugcugccagcag

SEQ ID NO: 453421 - RNA, 22 nt, Brucella suis 1330
gaugcgcucuaauuuuaugcug

SEQ ID NO: 453422 - RNA, 17 nt, Brucella suis 1330
gaugccgggcacgaaaa

SEQ ID NO: 453423 - RNA, 23 nt, Brucella suis 1330
gaugccggaugcgcacauauuug

SEQ ID NO: 453424 - RNA, 15 nt, Brucella suis 1330
gaugcaccaucaucg

SEQ ID NO: 453425 - RNA, 22 nt, Brucella suis 1330
gaugcaaugcaccgauggccag

SEQ ID NO: 453426 - RNA, 14 nt, Brucella suis 1330
gaugauaggcugcu

SEQ ID NO: 453427 - RNA, 21 nt, Brucella suis 1330
gaugauuucccgugcggccuu

SEQ ID NO: 453428 - RNA, 21 nt, Brucella suis 1330
gaugaagaagauaaucagcag

SEQ ID NO: 453429 - RNA, 12 nt, Brucella suis 1330
gaucuucugcuc

SEQ ID NO: 453430 - RNA, 22 nt, Brucella suis 1330
gaucuuccuguccgacauccau

SEQ ID NO: 453431 - RNA, 18 nt, Brucella suis 1330
gaucuuccaucuggccgc

SEQ ID NO: 453432 - RNA, 20 nt, Brucella suis 1330
gaucuguaucccgaaaagug

SEQ ID NO: 453433 - RNA, 21 nt, Brucella suis 1330
gaucuguaucccgaaaagugc

SEQ ID NO: 453434 - RNA, 18 nt, Brucella suis 1330
gaucuggcugagauaaac

SEQ ID NO: 453435 - RNA, 17 nt, Brucella suis 1330
gaucuggaacaguucca

SEQ ID NO: 453436 - RNA, 16 nt, Brucella suis 1330
gaucuugucgccgaaa

SEQ ID NO: 453437 - RNA, 12 nt, Brucella suis 1330
gaugaaauagcu

SEQ ID NO: 453438 - RNA, 16 nt, Brucella suis 1330
gaucugcaucccgaaa

SEQ ID NO: 453439 - RNA, 16 nt, Brucella suis 1330
gaucucauuucggcug

SEQ ID NO: 453440 - RNA, 22 nt, Brucella suis 1330
gaucucauuucggcuggcugga

SEQ ID NO: 453441 - RNA, 14 nt, Brucella suis 1330
gaucaucagcggcg

SEQ ID NO: 453442 - RNA, 20 nt, Brucella suis 1330
gaucagauagccggugcugu

SEQ ID NO: 453443 - RNA, 17 nt, Brucella suis 1330
gaucauauuugcgggcg

SEQ ID NO: 453444 - RNA, 11 nt, Brucella suis 1330
gaucaauuccu

SEQ ID NO: 453445 - RNA, 23 nt, Brucella suis 1330
gaucacaacgccgucagccccgu

SEQ ID NO: 453446 - RNA, 14 nt, Brucella suis 1330
gauauagagcagca

SEQ ID NO: 453447 - RNA, 17 nt, Brucella suis 1330
gauaggcugcuucuguu

SEQ ID NO: 453448 - RNA, 14 nt, Brucella suis 1330
gauagagaacauau

SEQ ID NO: 453449 - RNA, 13 nt, Brucella suis 1330
gauacgucacccg

SEQ ID NO: 453450 - RNA, 20 nt, Brucella suis 1330
gauaaggcggcguuuuccau

SEQ ID NO: 453451 - RNA, 20 nt, Brucella suis 1330
gaguugucaauacaccugca

SEQ ID NO: 453452 - RNA, 14 nt, Brucella suis 1330
gaguuuuucuucca

SEQ ID NO: 453453 - RNA, 15 nt, Brucella suis 1330
gagguugagcugcuc

SEQ ID NO: 453454 - RNA, 18 nt, Brucella suis 1330
gaggugcgggccggugga

SEQ ID NO: 453455 - RNA, 15 nt, Brucella suis 1330
gagguaggacugugg

SEQ ID NO: 453456 - RNA, 13 nt, Brucella suis 1330
gaggucgagaucg

SEQ ID NO: 453457 - RNA, 14 nt, Brucella suis 1330
gagggcgggcggcc

SEQ ID NO: 453458 - RNA, 15 nt, Brucella suis 1330
gaggcuuucgccggu

SEQ ID NO: 453459 - RNA, 14 nt, Brucella suis 1330
gagggacggcucgg

SEQ ID NO: 453460 - RNA, 14 nt, Brucella suis 1330
gagggagagaacac

SEQ ID NO: 453461 - RNA, 19 nt, Brucella suis 1330
gagggccagaagauugaac

SEQ ID NO: 453462 - RNA, 15 nt, Brucella suis 1330
gaggcggcugccuuu

SEQ ID NO: 453463 - RNA, 15 nt, Brucella suis 1330
gaggcggccggagcg

SEQ ID NO: 453464 - RNA, 21 nt, Brucella suis 1330
gaggccgcgcgcgcgcaggau

SEQ ID NO: 453465 - RNA, 20 nt, Brucella suis 1330
gaggccgccaccggaaagau

SEQ ID NO: 453466 - RNA, 14 nt, Brucella suis 1330
gaggccgaacgagg

SEQ ID NO: 453467 - RNA, 22 nt, Brucella suis 1330
gaggcauugaggaucgaccagg

SEQ ID NO: 453468 - RNA, 15 nt, Brucella suis 1330
gaggcaucagccucc

SEQ ID NO: 453469 - RNA, 20 nt, Brucella suis 1330
gaggcaucagccucccuuca

SEQ ID NO: 453470 - RNA, 11 nt, Brucella suis 1330
gaggcaaugaa

SEQ ID NO: 453471 - RNA, 15 nt, Brucella suis 1330
gaggauagcguaaaa

SEQ ID NO: 453472 - RNA, 13 nt, Brucella suis 1330
gagcugguuuuuc

SEQ ID NO: 453473 - RNA, 21 nt, Brucella suis 1330
gagcuucggauuuuucucaau

SEQ ID NO: 453474 - RNA, 14 nt, Brucella suis 1330
gagcuugcaaugag

SEQ ID NO: 453475 - RNA, 16 nt, Brucella suis 1330
gagcugcaucgcaggc

SEQ ID NO: 453476 - RNA, 19 nt, Brucella suis 1330
gagcuacgggugcuugccu

SEQ ID NO: 453477 - RNA, 14 nt, Brucella suis 1330
gagcuaucagccgc

SEQ ID NO: 453478 - RNA, 18 nt, Brucella suis 1330
gagcggggcccgaaagca

SEQ ID NO: 453479 - RNA, 14 nt, Brucella suis 1330
gagcggcagcagcc

SEQ ID NO: 453480 - RNA, 15 nt, Brucella suis 1330
gagcggcagcggcgu

SEQ ID NO: 453481 - RNA, 12 nt, Brucella suis 1330
gagcggcaggcc

SEQ ID NO: 453482 - RNA, 13 nt, Brucella suis 1330
gagcggaagagga

SEQ ID NO: 453483 - RNA, 17 nt, Brucella suis 1330
gagcggcacaugaaaua

SEQ ID NO: 453484 - RNA, 15 nt, Brucella suis 1330
gagcggguucccacu

SEQ ID NO: 453485 - RNA, 12 nt, Brucella suis 1330
gagcguccgagc

SEQ ID NO: 453486 - RNA, 16 nt, Brucella suis 1330
gagcgugaucucaucc

SEQ ID NO: 453487 - RNA, 19 nt, Brucella suis 1330
gagcguuacuucggcggcg

SEQ ID NO: 453488 - RNA, 21 nt, Brucella suis 1330
gagcgcgccacggauuuccac

SEQ ID NO: 453489 - RNA, 22 nt, Brucella suis 1330
gagcgccguuuucgugugcuug

SEQ ID NO: 453490 - RNA, 20 nt, Brucella suis 1330
gagcgcaaggcuucgccagu

SEQ ID NO: 453491 - RNA, 12 nt, Brucella suis 1330
gagcgcacauaa

SEQ ID NO: 453492 - RNA, 21 nt, Brucella suis 1330
gagcgccagauaaagcaggau

SEQ ID NO: 453493 - RNA, 20 nt, Brucella suis 1330
gagcgauuucuggagccgcu

SEQ ID NO: 453494 - RNA, 13 nt, Brucella suis 1330
gagcgauccgcca

SEQ ID NO: 453495 - RNA, 18 nt, Brucella suis 1330
gagcgacauauucuuccg

SEQ ID NO: 453496 - RNA, 21 nt, Brucella suis 1330
gagccuucauugcggccaagc

SEQ ID NO: 453497 - RNA, 22 nt, Brucella suis 1330
gagccuucauugcggccaagcg

SEQ ID NO: 453498 - RNA, 20 nt, Brucella suis 1330
gagccuuccguugcagccca

SEQ ID NO: 453499 - RNA, 18 nt, Brucella suis 1330
gagccgggcugugacuuu

SEQ ID NO: 453500 - RNA, 13 nt, Brucella suis 1330
gagccgcugcgca

SEQ ID NO: 453501 - RNA, 21 nt, Brucella suis 1330
gagccgcgccaugccauccuc

SEQ ID NO: 453502 - RNA, 18 nt, Brucella suis 1330
gagccauuauucucccag

SEQ ID NO: 453503 - RNA, 20 nt, Brucella suis 1330
gagccauuauucucccagag

SEQ ID NO: 453504 - RNA, 16 nt, Brucella suis 1330
gagccacgagaaaaug

SEQ ID NO: 453505 - RNA, 13 nt, Brucella suis 1330
gagccaaaagugc

SEQ ID NO: 453506 - RNA, 16 nt, Brucella suis 1330
gagcauggucacgucg

SEQ ID NO: 453507 - RNA, 13 nt, Brucella suis 1330
gagcaucccuccc

SEQ ID NO: 453508 - RNA, 21 nt, Brucella suis 1330
gagcaugaucgcccgcccggc

SEQ ID NO: 453509 - RNA, 21 nt, Brucella suis 1330
gagcaggccgguaagcccugu

SEQ ID NO: 453510 - RNA, 17 nt, Brucella suis 1330
gagcaggcucccgccug

SEQ ID NO: 453511 - RNA, 22 nt, Brucella suis 1330
gagcaggcucccgccugcaaug

SEQ ID NO: 453512 - RNA, 16 nt, Brucella suis 1330
gagcaggcaggccgcc

SEQ ID NO: 453513 - RNA, 20 nt, Brucella suis 1330
gagcaaguggaucuuugaaa

SEQ ID NO: 453514 - RNA, 13 nt, Brucella suis 1330
gagauguguaggc

SEQ ID NO: 453515 - RNA, 15 nt, Brucella suis 1330
gagauugggcagcag

SEQ ID NO: 453516 - RNA, 16 nt, Brucella suis 1330
gagauugggcagcaga

SEQ ID NO: 453517 - RNA, 14 nt, Brucella suis 1330
gagagugaugcaga

SEQ ID NO: 453518 - RNA, 18 nt, Brucella suis 1330
gagagcaugaucgcccgc

SEQ ID NO: 453519 - RNA, 15 nt, Brucella suis 1330
gagaccugccaucac

SEQ ID NO: 453520 - RNA, 18 nt, Brucella suis 1330
gagaccugccaucaccag

SEQ ID NO: 453521 - RNA, 19 nt, Brucella suis 1330
gagaccugccaucaccagc

SEQ ID NO: 453522 - RNA, 19 nt, Brucella suis 1330
gagaccagcgcauucugcu

SEQ ID NO: 453523 - RNA, 20 nt, Brucella suis 1330
gagaaugaccacgccgagga

SEQ ID NO: 453524 - RNA, 20 nt, Brucella suis 1330
gagaauggagcauuuccagc

SEQ ID NO: 453525 - RNA, 17 nt, Brucella suis 1330
gagaacuucggcauggc

SEQ ID NO: 453526 - RNA, 15 nt, Brucella suis 1330
gagaacggcggcggc

SEQ ID NO: 453527 - RNA, 23 nt, Brucella suis 1330
gagaaagcuugucgcggccuuga

SEQ ID NO: 453528 - RNA, 19 nt, Brucella suis 1330
gagaaccaccuuccugccu

SEQ ID NO: 453529 - RNA, 15 nt, Brucella suis 1330
gacuuuauagaggaa

SEQ ID NO: 453530 - RNA, 15 nt, Brucella suis 1330
gacuuuccauccagu

SEQ ID NO: 453531 - RNA, 18 nt, Brucella suis 1330
gacuuccgggaauuccug

SEQ ID NO: 453532 - RNA, 18 nt, Brucella suis 1330
gacuuccaguggaagcac

SEQ ID NO: 453533 - RNA, 17 nt, Brucella suis 1330
gacugauuuccccgcgu

SEQ ID NO: 453534 - RNA, 13 nt, Brucella suis 1330
gacucgaacaggc

SEQ ID NO: 453535 - RNA, 12 nt, Brucella suis 1330
gacuagacaaag

SEQ ID NO: 453536 - RNA, 22 nt, Brucella suis 1330
gacggggauugcuauugaaugc

SEQ ID NO: 453537 - RNA, 14 nt, Brucella suis 1330
gacgggacgcaggc

SEQ ID NO: 453538 - RNA, 12 nt, Brucella suis 1330
gacggcgcggcg

SEQ ID NO: 453539 - RNA, 18 nt, Brucella suis 1330
gacggcgcggcgcauggc

SEQ ID NO: 453540 - RNA, 23 nt, Brucella suis 1330
gacggacuucuucaccagccuug

SEQ ID NO: 453541 - RNA, 17 nt, Brucella suis 1330
gacggagcguccgagcg

SEQ ID NO: 453542 - RNA, 21 nt, Brucella suis 1330
gacggacgccugccauccgcc

SEQ ID NO: 453543 - RNA, 20 nt, Brucella suis 1330
gacgcugcaacacgccgccg

SEQ ID NO: 453544 - RNA, 20 nt, Brucella suis 1330
gacgcgcuaaaaagcgcgcg

SEQ ID NO: 453545 - RNA, 19 nt, Brucella suis 1330
gacgcgcagacgcagcgca

SEQ ID NO: 453546 - RNA, 20 nt, Brucella suis 1330
gacgcgcagacgcagcgcau

SEQ ID NO: 453547 - RNA, 14 nt, Brucella suis 1330
gacgcgagcggacg

SEQ ID NO: 453548 - RNA, 23 nt, Brucella suis 1330
gacgcccagcgaauagaccaugc

SEQ ID NO: 453549 - RNA, 22 nt, Brucella suis 1330
gacgauuuucgccaagccggcg

SEQ ID NO: 453550 - RNA, 20 nt, Brucella suis 1330
gacgaucuggaacaguucca

SEQ ID NO: 453551 - RNA, 20 nt, Brucella suis 1330
gacgagaccugccaucacca

SEQ ID NO: 453552 - RNA, 19 nt, Brucella suis 1330
gacgaaaaaggcgaucagg

SEQ ID NO: 453553 - RNA, 14 nt, Brucella suis 1330
gacgaaagccacgc

SEQ ID NO: 453554 - RNA, 17 nt, Brucella suis 1330
gaccuucuuggagccga

SEQ ID NO: 453555 - RNA, 21 nt, Brucella suis 1330
gaccuuggcaaucuugaccug

SEQ ID NO: 453556 - RNA, 23 nt, Brucella suis 1330
gaccuucgaguucgccagcaccu

SEQ ID NO: 453557 - RNA, 21 nt, Brucella suis 1330
gaccugcaccgcgugaagaau

SEQ ID NO: 453558 - RNA, 18 nt, Brucella suis 1330
gaccugccaucaccagcc

SEQ ID NO: 453559 - RNA, 17 nt, Brucella suis 1330
gaccggcgaaaaggcga

SEQ ID NO: 453560 - RNA, 15 nt, Brucella suis 1330
gaccggcggcaggca

SEQ ID NO: 453561 - RNA, 19 nt, Brucella suis 1330
gaccgcggguucccugugg

SEQ ID NO: 453562 - RNA, 16 nt, Brucella suis 1330
gaccgccuggcccggc

SEQ ID NO: 453563 - RNA, 15 nt, Brucella suis 1330
gaccgccuuuuccag

SEQ ID NO: 453564 - RNA, 17 nt, Brucella suis 1330
gaccgcccccucgcaac

SEQ ID NO: 453565 - RNA, 12 nt, Brucella suis 1330
gaccgcaacagg

SEQ ID NO: 453566 - RNA, 15 nt, Brucella suis 1330
gaccgagggccuguu

SEQ ID NO: 453567 - RNA, 16 nt, Brucella suis 1330
gaccgaauugaucuug

SEQ ID NO: 453568 - RNA, 20 nt, Brucella suis 1330
gacccgcccuucaucaccuu

SEQ ID NO: 453569 - RNA, 20 nt, Brucella suis 1330
gaccauggcgcauucagagc

SEQ ID NO: 453570 - RNA, 16 nt, Brucella suis 1330
gaccauauugcugggc

SEQ ID NO: 453571 - RNA, 17 nt, Brucella suis 1330
gaccaguaaggcgggcg

SEQ ID NO: 453572 - RNA, 21 nt, Brucella suis 1330
gaccaguuccguguugaaaag

SEQ ID NO: 453573 - RNA, 18 nt, Brucella suis 1330
gaccaggcccauuggaaa

SEQ ID NO: 453574 - RNA, 13 nt, Brucella suis 1330
gaccagcaggaag

SEQ ID NO: 453575 - RNA, 14 nt, Brucella suis 1330
gaccaccgcacggu

SEQ ID NO: 453576 - RNA, 20 nt, Brucella suis 1330
gacauggcuuccggcguggu

SEQ ID NO: 453577 - RNA, 21 nt, Brucella suis 1330
gacauggguggcgcccgcccg

SEQ ID NO: 453578 - RNA, 19 nt, Brucella suis 1330
gacaugaaggagaggccga

SEQ ID NO: 453579 - RNA, 12 nt, Brucella suis 1330
gacaugccaaga

SEQ ID NO: 453580 - RNA, 16 nt, Brucella suis 1330
gacaugccaagagccg

SEQ ID NO: 453581 - RNA, 18 nt, Brucella suis 1330
gacaugccaagagccgcu

SEQ ID NO: 453582 - RNA, 21 nt, Brucella suis 1330
gacaucgguggugccgaaggc

SEQ ID NO: 453583 - RNA, 18 nt, Brucella suis 1330
gacaucaucaaggaaaaa

SEQ ID NO: 453584 - RNA, 14 nt, Brucella suis 1330
gacauauucuuccg

SEQ ID NO: 453585 - RNA, 19 nt, Brucella suis 1330
gacauauugcccugcuggu

SEQ ID NO: 453586 - RNA, 19 nt, Brucella suis 1330
gacaguuggauagaccacc

SEQ ID NO: 453587 - RNA, 13 nt, Brucella suis 1330
gacagggcggauc

SEQ ID NO: 453588 - RNA, 14 nt, Brucella suis 1330
gacacgccggaaca

SEQ ID NO: 453589 - RNA, 17 nt, Brucella suis 1330
gacaccuucggccagcg

SEQ ID NO: 453590 - RNA, 18 nt, Brucella suis 1330
gacaaccgcgccgcuggu

SEQ ID NO: 453591 - RNA, 15 nt, Brucella suis 1330
gacaagcgugagcuu

SEQ ID NO: 453592 - RNA, 22 nt, Brucella suis 1330
gacaagcguccgucgcgugagg

SEQ ID NO: 453593 - RNA, 21 nt, Brucella suis 1330
gacaaucuugcgcagcgcagg

SEQ ID NO: 453594 - RNA, 21 nt, Brucella suis 1330
gacaaugaagcaaaggucggg

SEQ ID NO: 453595 - RNA, 20 nt, Brucella suis 1330
cuuuggccgucucugaagua

SEQ ID NO: 453596 - RNA, 17 nt, Brucella suis 1330
cuuugcuucacgcucgg

SEQ ID NO: 453597 - RNA, 22 nt, Brucella suis 1330
cuuugcuucggccgacagaugc

SEQ ID NO: 453598 - RNA, 20 nt, Brucella suis 1330
cuuugcggggccugaaugca

SEQ ID NO: 453599 - RNA, 22 nt, Brucella suis 1330
cuuugcggaggcggcugccuuu

SEQ ID NO: 453600 - RNA, 19 nt, Brucella suis 1330
cuuugcggcggaugaaccc

SEQ ID NO: 453601 - RNA, 22 nt, Brucella suis 1330
cuuugcccuggggcaugacauc

SEQ ID NO: 453602 - RNA, 23 nt, Brucella suis 1330
cuuugauccgcuucuggauuugc

SEQ ID NO: 453603 - RNA, 19 nt, Brucella suis 1330
cuuugcagaaccaggccgc

SEQ ID NO: 453604 - RNA, 19 nt, Brucella suis 1330
cuuucggcggcaguuucac

SEQ ID NO: 453605 - RNA, 21 nt, Brucella suis 1330
cuuuccagcccccuugccgcu

SEQ ID NO: 453606 - RNA, 14 nt, Brucella suis 1330
cuuucggucaggaa

SEQ ID NO: 453607 - RNA, 17 nt, Brucella suis 1330
cuuucugcuucuguugc

SEQ ID NO: 453608 - RNA, 18 nt, Brucella suis 1330
cuuucuguccggccagcu

SEQ ID NO: 453609 - RNA, 16 nt, Brucella suis 1330
cuuuauggcucagaga

SEQ ID NO: 453610 - RNA, 19 nt, Brucella suis 1330
cuuucagaaagaaagcugu

SEQ ID NO: 453611 - RNA, 13 nt, Brucella suis 1330
cuugucagaagca

SEQ ID NO: 453612 - RNA, 16 nt, Brucella suis 1330
cuugucgucgugcagc

SEQ ID NO: 453613 - RNA, 18 nt, Brucella suis 1330
cuugucgucgugcagcgg

SEQ ID NO: 453614 - RNA, 19 nt, Brucella suis 1330
cuuuaauugucggcgucca

SEQ ID NO: 453615 - RNA, 22 nt, Brucella suis 1330
cuugguaaaggcgaguuuucaa

SEQ ID NO: 453616 - RNA, 18 nt, Brucella suis 1330
cuugggcgcgucaacagg

SEQ ID NO: 453617 - RNA, 14 nt, Brucella suis 1330
cuuggcuuccagcg

SEQ ID NO: 453618 - RNA, 23 nt, Brucella suis 1330
cuuggcuuccagcgucaggacaa

SEQ ID NO: 453619 - RNA, 17 nt, Brucella suis 1330
cuuggcgacggccacau

SEQ ID NO: 453620 - RNA, 15 nt, Brucella suis 1330
cuuggccaugaugcc

SEQ ID NO: 453621 - RNA, 19 nt, Brucella suis 1330
cuuggcacguugcgccugg

SEQ ID NO: 453622 - RNA, 19 nt, Brucella suis 1330
cuugcuucgcaccuuccac

SEQ ID NO: 453623 - RNA, 14 nt, Brucella suis 1330
cuugcgcagcgccg

SEQ ID NO: 453624 - RNA, 19 nt, Brucella suis 1330
cuugcgauuuccuugccgc

SEQ ID NO: 453625 - RNA, 14 nt, Brucella suis 1330
cuugcgauuugaca

SEQ ID NO: 453626 - RNA, 19 nt, Brucella suis 1330
cuugccuucuugcacaguu

SEQ ID NO: 453627 - RNA, 18 nt, Brucella suis 1330
cuugccuuuuggccgcuc

SEQ ID NO: 453628 - RNA, 14 nt, Brucella suis 1330
cuugccgcguccuu

SEQ ID NO: 453629 - RNA, 14 nt, Brucella suis 1330
cuugccgccgcuuc

SEQ ID NO: 453630 - RNA, 16 nt, Brucella suis 1330
cuugccgaccuccccc

SEQ ID NO: 453631 - RNA, 15 nt, Brucella suis 1330
cuugcccagaacauc

SEQ ID NO: 453632 - RNA, 23 nt, Brucella suis 1330
cuugccauggccgaacggguggc

SEQ ID NO: 453633 - RNA, 16 nt, Brucella suis 1330
cuugcaaugagcgcgc

SEQ ID NO: 453634 - RNA, 24 nt, Brucella suis 1330
cuugcagugcaggacuggacauaa

SEQ ID NO: 453635 - RNA, 12 nt, Brucella suis 1330
cuugaucgagcc

SEQ ID NO: 453636 - RNA, 17 nt, Brucella suis 1330
cuugaucugcuccaucg

SEQ ID NO: 453637 - RNA, 23 nt, Brucella suis 1330
cuugagauauccauaucuuucca

SEQ ID NO: 453638 - RNA, 20 nt, Brucella suis 1330
cuugagauccgcaucggccu

SEQ ID NO: 453639 - RNA, 23 nt, Brucella suis 1330
cuugaauagcggcgaguugccac

SEQ ID NO: 453640 - RNA, 19 nt, Brucella suis 1330
cuucuuuguucugcagcaa

SEQ ID NO: 453641 - RNA, 17 nt, Brucella suis 1330
cuucguguccggcguca

SEQ ID NO: 453642 - RNA, 15 nt, Brucella suis 1330
cuucgugcaaaccuc

SEQ ID NO: 453643 - RNA, 17 nt, Brucella suis 1330
cuucguaaagcgcgcca

SEQ ID NO: 453644 - RNA, 20 nt, Brucella suis 1330
cuucggcaagggcaagcaga

SEQ ID NO: 453645 - RNA, 14 nt, Brucella suis 1330
cuucggaagaaaga

SEQ ID NO: 453646 - RNA, 16 nt, Brucella suis 1330
cuucgaguucgccagc

SEQ ID NO: 453647 - RNA, 17 nt, Brucella suis 1330
cuucgacaaccgcgccg

SEQ ID NO: 453648 - RNA, 18 nt, Brucella suis 1330
cuucgacaaccgcgccgc

SEQ ID NO: 453649 - RNA, 19 nt, Brucella suis 1330
cuuccugccuuugaagaca

SEQ ID NO: 453650 - RNA, 13 nt, Brucella suis 1330
cuuccugcgaugc

SEQ ID NO: 453651 - RNA, 21 nt, Brucella suis 1330
cuuccguugcagcccaaccca

SEQ ID NO: 453652 - RNA, 21 nt, Brucella suis 1330
cuuccgucgcacgcuuggccu

SEQ ID NO: 453653 - RNA, 14 nt, Brucella suis 1330
cuuccucacccuuc

SEQ ID NO: 453654 - RNA, 23 nt, Brucella suis 1330
cuuccccgucagcuuggaaagcu

SEQ ID NO: 453655 - RNA, 23 nt, Brucella suis 1330
cuucccgcccguccucaucgccg

SEQ ID NO: 453656 - RNA, 22 nt, Brucella suis 1330
cuuccaggagagccuuugcuuc

SEQ ID NO: 453657 - RNA, 13 nt, Brucella suis 1330
cuuccagagccuc

SEQ ID NO: 453658 - RNA, 13 nt, Brucella suis 1330
cuuccagaaugcg

SEQ ID NO: 453659 - RNA, 20 nt, Brucella suis 1330
cuucaucgcggcagccgccg

SEQ ID NO: 453660 - RNA, 17 nt, Brucella suis 1330
cuucaugauggaagaca

SEQ ID NO: 453661 - RNA, 18 nt, Brucella suis 1330
cuucaccugagcaagagc

SEQ ID NO: 453662 - RNA, 22 nt, Brucella suis 1330
cuucaagcucgacccagcuaag

SEQ ID NO: 453663 - RNA, 22 nt, Brucella suis 1330
cuuaugaucgccgcccuuguga

SEQ ID NO: 453664 - RNA, 11 nt, Brucella suis 1330
cuuaugccaga

SEQ ID NO: 453665 - RNA, 12 nt, Brucella suis 1330
cuuauuccccua

SEQ ID NO: 453666 - RNA, 20 nt, Brucella suis 1330
cuuauuccccuauucccuua

SEQ ID NO: 453667 - RNA, 16 nt, Brucella suis 1330
cuguuccacaccugca

SEQ ID NO: 453668 - RNA, 12 nt, Brucella suis 1330
cuuaacauacug

SEQ ID NO: 453669 - RNA, 22 nt, Brucella suis 1330
cuguucaagcaguaugauuugu

SEQ ID NO: 453670 - RNA, 23 nt, Brucella suis 1330
cuguucaauaagcuuuucauuuu

SEQ ID NO: 453671 - RNA, 18 nt, Brucella suis 1330
cuguucauaggcuuucau

SEQ ID NO: 453672 - RNA, 13 nt, Brucella suis 1330
cugugcggcggcg

SEQ ID NO: 453673 - RNA, 18 nt, Brucella suis 1330
cugugcguaccgaaucca

SEQ ID NO: 453674 - RNA, 16 nt, Brucella suis 1330
cugucgaaugucuucg

SEQ ID NO: 453675 - RNA, 14 nt, Brucella suis 1330
cuguccuuguucca

SEQ ID NO: 453676 - RNA, 20 nt, Brucella suis 1330
cuguccuuguuccagucgcc

SEQ ID NO: 453677 - RNA, 12 nt, Brucella suis 1330
cuguccugccag

SEQ ID NO: 453678 - RNA, 14 nt, Brucella suis 1330
cuguccgccugcca

SEQ ID NO: 453679 - RNA, 20 nt, Brucella suis 1330
cugucauuugcggcaguucc

SEQ ID NO: 453680 - RNA, 19 nt, Brucella suis 1330
cuguaucccgaaaagugcg

SEQ ID NO: 453681 - RNA, 19 nt, Brucella suis 1330
cuguagcagcaacaggcau

SEQ ID NO: 453682 - RNA, 22 nt, Brucella suis 1330
cuguagaaaauauagccgccug

SEQ ID NO: 453683 - RNA, 16 nt, Brucella suis 1330
cugguuuaagccuugg

SEQ ID NO: 453684 - RNA, 20 nt, Brucella suis 1330
cugguuuaagccuugguccu

SEQ ID NO: 453685 - RNA, 15 nt, Brucella suis 1330
cugguuuccgccauc

SEQ ID NO: 453686 - RNA, 20 nt, Brucella suis 1330
cugguugcgcggccagccag

SEQ ID NO: 453687 - RNA, 15 nt, Brucella suis 1330
cuggcuuucgcgggc

SEQ ID NO: 453688 - RNA, 21 nt, Brucella suis 1330
cuggcugagauaaaccggccc

SEQ ID NO: 453689 - RNA, 13 nt, Brucella suis 1330
cuggcgcacgucg

SEQ ID NO: 453690 - RNA, 17 nt, Brucella suis 1330
cuggcgaaaacggccau

SEQ ID NO: 453691 - RNA, 18 nt, Brucella suis 1330
cuggccgucgcguucagc

SEQ ID NO: 453692 - RNA, 13 nt, Brucella suis 1330
cuggccuugccau

SEQ ID NO: 453693 - RNA, 16 nt, Brucella suis 1330
cuggccggcgccuugu

SEQ ID NO: 453694 - RNA, 18 nt, Brucella suis 1330
cuggccggcgccuuguuc

SEQ ID NO: 453695 - RNA, 14 nt, Brucella suis 1330
cuggaugucgauuu

SEQ ID NO: 453696 - RNA, 14 nt, Brucella suis 1330
cuggaugcggaaca

SEQ ID NO: 453697 - RNA, 15 nt, Brucella suis 1330
cuggaugcggaacac

SEQ ID NO: 453698 - RNA, 14 nt, Brucella suis 1330
cuggauccggcgaa

SEQ ID NO: 453699 - RNA, 14 nt, Brucella suis 1330
cugcuuccuuuucg

SEQ ID NO: 453700 - RNA, 14 nt, Brucella suis 1330
cugcuggccgucgc

SEQ ID NO: 453701 - RNA, 13 nt, Brucella suis 1330
cugcugcgcggca

SEQ ID NO: 453702 - RNA, 15 nt, Brucella suis 1330
cugcugcauccugcu

SEQ ID NO: 453703 - RNA, 16 nt, Brucella suis 1330
cugcugcauuuucugc

SEQ ID NO: 453704 - RNA, 14 nt, Brucella suis 1330
cugcugcaauccac

SEQ ID NO: 453705 - RNA, 16 nt, Brucella suis 1330
cugcugcaauccacag

SEQ ID NO: 453706 - RNA, 20 nt, Brucella suis 1330
cugcugauagcagccgcuuc

SEQ ID NO: 453707 - RNA, 18 nt, Brucella suis 1330
cugcucguccggccagcc

SEQ ID NO: 453708 - RNA, 21 nt, Brucella suis 1330
cugcucgacaugcaugacacc

SEQ ID NO: 453709 - RNA, 14 nt, Brucella suis 1330
cugcggcgccagau

SEQ ID NO: 453710 - RNA, 20 nt, Brucella suis 1330
cugcggcaacggcgcuggcc

SEQ ID NO: 453711 - RNA, 19 nt, Brucella suis 1330
cugcgcguuugauagccuc

SEQ ID NO: 453712 - RNA, 22 nt, Brucella suis 1330
cugcgccguaguagcuaaugua

SEQ ID NO: 453713 - RNA, 16 nt, Brucella suis 1330
cugcgccggaaacacc

SEQ ID NO: 453714 - RNA, 17 nt, Brucella suis 1330
cugcgccagccuugcga

SEQ ID NO: 453715 - RNA, 22 nt, Brucella suis 1330
cugcgccaguuuucgcggcaga

SEQ ID NO: 453716 - RNA, 19 nt, Brucella suis 1330
cugcgcaccgguauugccc

SEQ ID NO: 453717 - RNA, 15 nt, Brucella suis 1330
cugcgaucugcuucu

SEQ ID NO: 453718 - RNA, 18 nt, Brucella suis 1330
cugcgacgagaugcgcuu

SEQ ID NO: 453719 - RNA, 23 nt, Brucella suis 1330
cugcgaggauuucagguggcgga

SEQ ID NO: 453720 - RNA, 21 nt, Brucella suis 1330
cugcgauagugcaucgaucuc

SEQ ID NO: 453721 - RNA, 15 nt, Brucella suis 1330
cugcgaaaaccugcu

SEQ ID NO: 453722 - RNA, 22 nt, Brucella suis 1330
cugccgcgccgaaccgggccgc

SEQ ID NO: 453723 - RNA, 15 nt, Brucella suis 1330
cugccuuacugcccu

SEQ ID NO: 453724 - RNA, 16 nt, Brucella suis 1330
cugccgcgaaaaagcc

SEQ ID NO: 453725 - RNA, 13 nt, Brucella suis 1330
cugccgcacagca

SEQ ID NO: 453726 - RNA, 16 nt, Brucella suis 1330
cugcccuggauaucuu

SEQ ID NO: 453727 - RNA, 13 nt, Brucella suis 1330
cugcccgucuucc

SEQ ID NO: 453728 - RNA, 21 nt, Brucella suis 1330
cugcaucggcaaaucaggcag

SEQ ID NO: 453729 - RNA, 12 nt, Brucella suis 1330
cugcauuggcga

SEQ ID NO: 453730 - RNA, 19 nt, Brucella suis 1330
cugcauuggcgauuuucug

SEQ ID NO: 453731 - RNA, 20 nt, Brucella suis 1330
cugcaucacagucacgccau

SEQ ID NO: 453732 - RNA, 18 nt, Brucella suis 1330
cugcaucauaggcccagg

SEQ ID NO: 453733 - RNA, 21 nt, Brucella suis 1330
cugcaucaugucauggccgcc

SEQ ID NO: 453734 - RNA, 13 nt, Brucella suis 1330
cugcauccagcgg

SEQ ID NO: 453735 - RNA, 14 nt, Brucella suis 1330
cugcauccagcggu

SEQ ID NO: 453736 - RNA, 15 nt, Brucella suis 1330
cugcauccagcggug

SEQ ID NO: 453737 - RNA, 14 nt, Brucella suis 1330
cugcaccggcuucc

SEQ ID NO: 453738 - RNA, 15 nt, Brucella suis 1330
cugcaccggccuugu

SEQ ID NO: 453739 - RNA, 13 nt, Brucella suis 1330
cugcacacccuug

SEQ ID NO: 453740 - RNA, 14 nt, Brucella suis 1330
cugcacagccugga

SEQ ID NO: 453741 - RNA, 16 nt, Brucella suis 1330
cugcacaucaccauug

SEQ ID NO: 453742 - RNA, 15 nt, Brucella suis 1330
cugcaacaaaagaag

SEQ ID NO: 453743 - RNA, 14 nt, Brucella suis 1330
cugcaacaaaaugc

SEQ ID NO: 453744 - RNA, 22 nt, Brucella suis 1330
cugauucuaucgccuggcauug

SEQ ID NO: 453745 - RNA, 15 nt, Brucella suis 1330
cugaugcggauuugg

SEQ ID NO: 453746 - RNA, 13 nt, Brucella suis 1330
cugaugauuuccc

SEQ ID NO: 453747 - RNA, 12 nt, Brucella suis 1330
cugaugcaaugc

SEQ ID NO: 453748 - RNA, 18 nt, Brucella suis 1330
cugacuggcggccaagcg

SEQ ID NO: 453749 - RNA, 13 nt, Brucella suis 1330
cugagaaaaaaau

SEQ ID NO: 453750 - RNA, 20 nt, Brucella suis 1330
cugacgggaugauugcgcca

SEQ ID NO: 453751 - RNA, 17 nt, Brucella suis 1330
cugacgaauaaugaauc

SEQ ID NO: 453752 - RNA, 21 nt, Brucella suis 1330
cugaccguuucgauauccugg

SEQ ID NO: 453753 - RNA, 18 nt, Brucella suis 1330
cugacgcgcaucuuaucc

SEQ ID NO: 453754 - RNA, 22 nt, Brucella suis 1330
cugacccggccuuugcgccggg

SEQ ID NO: 453755 - RNA, 13 nt, Brucella suis 1330
cugacccauggcc

SEQ ID NO: 453756 - RNA, 16 nt, Brucella suis 1330
cugacccauggccugc

SEQ ID NO: 453757 - RNA, 16 nt, Brucella suis 1330
cugacccccagauucg

SEQ ID NO: 453758 - RNA, 22 nt, Brucella suis 1330
cugaccagccuugcccuggcuc

SEQ ID NO: 453759 - RNA, 18 nt, Brucella suis 1330
cugaauccgcgacgccgc

SEQ ID NO: 453760 - RNA, 16 nt, Brucella suis 1330
cugaaggcucggcaaa

SEQ ID NO: 453761 - RNA, 13 nt, Brucella suis 1330
cugaaaucucuca

SEQ ID NO: 453762 - RNA, 18 nt, Brucella suis 1330
cugaaacgagacaaggca

SEQ ID NO: 453763 - RNA, 16 nt, Brucella suis 1330
cugaaacugaugaugc

SEQ ID NO: 453764 - RNA, 15 nt, Brucella suis 1330
cugaaacuugugcgu

SEQ ID NO: 453765 - RNA, 18 nt, Brucella suis 1330
cugaaacuugugcgugcc

SEQ ID NO: 453766 - RNA, 12 nt, Brucella suis 1330
cugaaagcugcu

SEQ ID NO: 453767 - RNA, 20 nt, Brucella suis 1330
cugaaauaauagucgaaaaa

SEQ ID NO: 453768 - RNA, 15 nt, Brucella suis 1330
cugaaaaaggccggg

SEQ ID NO: 453769 - RNA, 18 nt, Brucella suis 1330
cucuugggagcggcgcca

SEQ ID NO: 453770 - RNA, 22 nt, Brucella suis 1330
cucuuguggugcuugcccaucu

SEQ ID NO: 453771 - RNA, 15 nt, Brucella suis 1330
cucuuccaggagagc

SEQ ID NO: 453772 - RNA, 16 nt, Brucella suis 1330
cucuuccaggagagcc

SEQ ID NO: 453773 - RNA, 18 nt, Brucella suis 1330
cucugcggaaagcccggc

SEQ ID NO: 453774 - RNA, 19 nt, Brucella suis 1330
cucugcggaaagcccggcc

SEQ ID NO: 453775 - RNA, 16 nt, Brucella suis 1330
cucugccuccauggcg

SEQ ID NO: 453776 - RNA, 22 nt, Brucella suis 1330
cucugaucuaguggagcaccgc

SEQ ID NO: 453777 - RNA, 18 nt, Brucella suis 1330
cucugaaccggcgggcuu

SEQ ID NO: 453778 - RNA, 15 nt, Brucella suis 1330
cucucaaaaagguua

SEQ ID NO: 453779 - RNA, 15 nt, Brucella suis 1330
cucucacgcgcagca

SEQ ID NO: 453780 - RNA, 17 nt, Brucella suis 1330
cucucacgcgcagcagc

SEQ ID NO: 453781 - RNA, 24 nt, Brucella suis 1330
cucgucggaaauaucgccgacgau

SEQ ID NO: 453782 - RNA, 15 nt, Brucella suis 1330
cucggcgaugaagcg

SEQ ID NO: 453783 - RNA, 11 nt, Brucella suis 1330
cucgccugcaa

SEQ ID NO: 453784 - RNA, 12 nt, Brucella suis 1330
cucgccugcaau

SEQ ID NO: 453785 - RNA, 17 nt, Brucella suis 1330
cucgccguucgccacgu

SEQ ID NO: 453786 - RNA, 18 nt, Brucella suis 1330
cucgaucucgcgguucuu

SEQ ID NO: 453787 - RNA, 22 nt, Brucella suis 1330
cucgaucuggccgauaagcucg

SEQ ID NO: 453788 - RNA, 15 nt, Brucella suis 1330
cucgaccgcaacagg

SEQ ID NO: 453789 - RNA, 19 nt, Brucella suis 1330
cucgaaaaucaccauuuuc

SEQ ID NO: 453790 - RNA, 17 nt, Brucella suis 1330
cuccugcgucgcaucca

SEQ ID NO: 453791 - RNA, 21 nt, Brucella suis 1330
cuccugcgugcggaagcgauu

SEQ ID NO: 453792 - RNA, 17 nt, Brucella suis 1330
cuccugcgcccauucaa

SEQ ID NO: 453793 - RNA, 22 nt, Brucella suis 1330
cuccucagcuauagccugcgcc

SEQ ID NO: 453794 - RNA, 14 nt, Brucella suis 1330
cuccgguucauuuu

SEQ ID NO: 453795 - RNA, 21 nt, Brucella suis 1330
cuccgguucauuuuuagaaga

SEQ ID NO: 453796 - RNA, 14 nt, Brucella suis 1330
cuccccuacucccu

SEQ ID NO: 453797 - RNA, 15 nt, Brucella suis 1330
cuccaccagugcggc

SEQ ID NO: 453798 - RNA, 22 nt, Brucella suis 1330
cuccaccaccccuuccuugccg

SEQ ID NO: 453799 - RNA, 16 nt, Brucella suis 1330
cuccacacgaacagca

SEQ ID NO: 453800 - RNA, 17 nt, Brucella suis 1330
cucaugauggcccuugu

SEQ ID NO: 453801 - RNA, 19 nt, Brucella suis 1330
cucaugauggcccuugugg

SEQ ID NO: 453802 - RNA, 14 nt, Brucella suis 1330
cucacggccauagc

SEQ ID NO: 453803 - RNA, 12 nt, Brucella suis 1330
cucaccuuuucc

SEQ ID NO: 453804 - RNA, 13 nt, Brucella suis 1330
cucaccuuuucca

SEQ ID NO: 453805 - RNA, 21 nt, Brucella suis 1330
cucacccugaggagccguugg

SEQ ID NO: 453806 - RNA, 19 nt, Brucella suis 1330
cucacacugcaaaacugaa

SEQ ID NO: 453807 - RNA, 14 nt, Brucella suis 1330
cucaagcaucuuga

SEQ ID NO: 453808 - RNA, 14 nt, Brucella suis 1330
cuauugccagacga

SEQ ID NO: 453809 - RNA, 11 nt, Brucella suis 1330
cuauuccccua

SEQ ID NO: 453810 - RNA, 14 nt, Brucella suis 1330
cuauuccccuauuc

SEQ ID NO: 453811 - RNA, 19 nt, Brucella suis 1330
cuauuccccuauuccccua

SEQ ID NO: 453812 - RNA, 22 nt, Brucella suis 1330
cuauucccuuaacauacugccu

SEQ ID NO: 453813 - RNA, 15 nt, Brucella suis 1330
cuauuauucaccgcg

SEQ ID NO: 453814 - RNA, 14 nt, Brucella suis 1330
cuaugcgccacgag

SEQ ID NO: 453815 - RNA, 19 nt, Brucella suis 1330
cuaucguuguugaagagcc

SEQ ID NO: 453816 - RNA, 17 nt, Brucella suis 1330
cuaucaacgcugcaaca

SEQ ID NO: 453817 - RNA, 21 nt, Brucella suis 1330
cuaguggauuggauuugacgu

SEQ ID NO: 453818 - RNA, 18 nt, Brucella suis 1330
cuaguggucuuugugauu

SEQ ID NO: 453819 - RNA, 13 nt, Brucella suis 1330
cuagacagcagug

SEQ ID NO: 453820 - RNA, 15 nt, Brucella suis 1330
cuacccauucauuuc

SEQ ID NO: 453821 - RNA, 20 nt, Brucella suis 1330
cuacagccuagacagcagug

SEQ ID NO: 453822 - RNA, 11 nt, Brucella suis 1330
cuaccaucugc

SEQ ID NO: 453823 - RNA, 15 nt, Brucella suis 1330
cuaaacucaucaaaa

SEQ ID NO: 453824 - RNA, 18 nt, Brucella suis 1330
cguugcgaucuucugcuc

SEQ ID NO: 453825 - RNA, 12 nt, Brucella suis 1330
cguugcgccugg

SEQ ID NO: 453826 - RNA, 13 nt, Brucella suis 1330
cguugcgcggcgg

SEQ ID NO: 453827 - RNA, 15 nt, Brucella suis 1330
cguugcaagauccuc

SEQ ID NO: 453828 - RNA, 23 nt, Brucella suis 1330
cguugaggcgggggcgcuuuauu

SEQ ID NO: 453829 - RNA, 19 nt, Brucella suis 1330
cguugaggcguuccgccuc

SEQ ID NO: 453830 - RNA, 22 nt, Brucella suis 1330
cguugagccgcgccaugccauc

SEQ ID NO: 453831 - RNA, 18 nt, Brucella suis 1330
cguuccuucggagcgcgu

SEQ ID NO: 453832 - RNA, 15 nt, Brucella suis 1330
cguuccgccucccug

SEQ ID NO: 453833 - RNA, 16 nt, Brucella suis 1330
cguccaccaccucgcc

SEQ ID NO: 453834 - RNA, 14 nt, Brucella suis 1330
cguuaugagcugca

SEQ ID NO: 453835 - RNA, 17 nt, Brucella suis 1330
cguuaugcucuauuucg

SEQ ID NO: 453836 - RNA, 20 nt, Brucella suis 1330
cguuaugugccgguuuaucc

SEQ ID NO: 453837 - RNA, 20 nt, Brucella suis 1330
cgucauuuccgugacgccgu

SEQ ID NO: 453838 - RNA, 18 nt, Brucella suis 1330
cgucauaggcaauaccaa

SEQ ID NO: 453839 - RNA, 15 nt, Brucella suis 1330
cgucagcgcaaagcc

SEQ ID NO: 453840 - RNA, 13 nt, Brucella suis 1330
cgucagaaccgga

SEQ ID NO: 453841 - RNA, 15 nt, Brucella suis 1330
cgucacggcgagaca

SEQ ID NO: 453842 - RNA, 19 nt, Brucella suis 1330
cgucacgccacggcuuucg

SEQ ID NO: 453843 - RNA, 19 nt, Brucella suis 1330
cgucacggucagaucaucu

SEQ ID NO: 453844 - RNA, 14 nt, Brucella suis 1330
cgucaacaggcugu

SEQ ID NO: 453845 - RNA, 20 nt, Brucella suis 1330
cgucaaaggaaaagcuggca

SEQ ID NO: 453846 - RNA, 21 nt, Brucella suis 1330
cguaucgccaaagaccagcag

SEQ ID NO: 453847 - RNA, 14 nt, Brucella suis 1330
cguaucuucaagcu

SEQ ID NO: 453848 - RNA, 22 nt, Brucella suis 1330
cguauugccguugagaaucgca

SEQ ID NO: 453849 - RNA, 15 nt, Brucella suis 1330
cgucaaaacaaaaga

SEQ ID NO: 453850 - RNA, 19 nt, Brucella suis 1330
cguagggcgcgagcacgcc

SEQ ID NO: 453851 - RNA, 17 nt, Brucella suis 1330
cguagaaauagggccag

SEQ ID NO: 453852 - RNA, 18 nt, Brucella suis 1330
cgguuuuccgucugcauc

SEQ ID NO: 453853 - RNA, 23 nt, Brucella suis 1330
cguaaagaucgauguucuuuauc

SEQ ID NO: 453854 - RNA, 16 nt, Brucella suis 1330
cguaaccgucuugaac

SEQ ID NO: 453855 - RNA, 22 nt, Brucella suis 1330
cgguuuccacauccgccaccgc

SEQ ID NO: 453856 - RNA, 23 nt, Brucella suis 1330
cgguuauggcgugccgaaaaugg

SEQ ID NO: 453857 - RNA, 21 nt, Brucella suis 1330
cgguugcgccaaaacgcagcc

SEQ ID NO: 453858 - RNA, 13 nt, Brucella suis 1330
cgguuggaacgcc

SEQ ID NO: 453859 - RNA, 21 nt, Brucella suis 1330
cgguggcauugcccauggacu

SEQ ID NO: 453860 - RNA, 19 nt, Brucella suis 1330
cggugcauuuuuccagacc

SEQ ID NO: 453861 - RNA, 20 nt, Brucella suis 1330
cggugcacgaauugcacggu

SEQ ID NO: 453862 - RNA, 24 nt, Brucella suis 1330
cggugcaaugccauccagaucggc

SEQ ID NO: 453863 - RNA, 16 nt, Brucella suis 1330
cggugacggcggcaga

SEQ ID NO: 453864 - RNA, 17 nt, Brucella suis 1330
cggucggcuugccgacc

SEQ ID NO: 453865 - RNA, 12 nt, Brucella suis 1330
cggucgggaagc

SEQ ID NO: 453866 - RNA, 16 nt, Brucella suis 1330
cggucggccgcgcggc

SEQ ID NO: 453867 - RNA, 15 nt, Brucella suis 1330
cgguccaccacaugc

SEQ ID NO: 453868 - RNA, 17 nt, Brucella suis 1330
cggucagucgcccacgg

SEQ ID NO: 453869 - RNA, 18 nt, Brucella suis 1330
cggggcguccgccaccgc

SEQ ID NO: 453870 - RNA, 19 nt, Brucella suis 1330
cggggcguccgccaccgcc

SEQ ID NO: 453871 - RNA, 19 nt, Brucella suis 1330
cggggggaauggcgcgcgc

SEQ ID NO: 453872 - RNA, 12 nt, Brucella suis 1330
cggggcggacgg

SEQ ID NO: 453873 - RNA, 16 nt, Brucella suis 1330
cgggcuuugccgcaua

SEQ ID NO: 453874 - RNA, 22 nt, Brucella suis 1330
cgggcuuuuuuauucaggauag

SEQ ID NO: 453875 - RNA, 19 nt, Brucella suis 1330
cgggcgugccucaggaucg

SEQ ID NO: 453876 - RNA, 15 nt, Brucella suis 1330
cgggcggcuugccag

SEQ ID NO: 453877 - RNA, 13 nt, Brucella suis 1330
cgggcggccagga

SEQ ID NO: 453878 - RNA, 15 nt, Brucella suis 1330
cgggcggccaggaca

SEQ ID NO: 453879 - RNA, 16 nt, Brucella suis 1330
cgggcggccaggacaa

SEQ ID NO: 453880 - RNA, 20 nt, Brucella suis 1330
cgggcggaucggcaggauag

SEQ ID NO: 453881 - RNA, 14 nt, Brucella suis 1330
cgggcggcaaauag

SEQ ID NO: 453882 - RNA, 15 nt, Brucella suis 1330
cgggcgcagcgacag

SEQ ID NO: 453883 - RNA, 20 nt, Brucella suis 1330
cgggcgcagcgacagcggcg

SEQ ID NO: 453884 - RNA, 19 nt, Brucella suis 1330
cgggcgcaaccuggcugca

SEQ ID NO: 453885 - RNA, 20 nt, Brucella suis 1330
cgggcgaucaucaucaccgg

SEQ ID NO: 453886 - RNA, 15 nt, Brucella suis 1330
cgggcgagcgccagc

SEQ ID NO: 453887 - RNA, 18 nt, Brucella suis 1330
cgggccuuuuucaugcug

SEQ ID NO: 453888 - RNA, 17 nt, Brucella suis 1330
cgggccucgcgcccggu

SEQ ID NO: 453889 - RNA, 15 nt, Brucella suis 1330
cgggccauuuccaau

SEQ ID NO: 453890 - RNA, 21 nt, Brucella suis 1330
cgggccauuuccaaugccuca

SEQ ID NO: 453891 - RNA, 20 nt, Brucella suis 1330
cgggcagugaaagccgcguc

SEQ ID NO: 453892 - RNA, 16 nt, Brucella suis 1330
cgggcagcggcgcgcc

SEQ ID NO: 453893 - RNA, 17 nt, Brucella suis 1330
cggcugucccugcgggc

SEQ ID NO: 453894 - RNA, 16 nt, Brucella suis 1330
cggcuggucuggcgag

SEQ ID NO: 453895 - RNA, 23 nt, Brucella suis 1330
cggcguuaugagcugcaucgcag

SEQ ID NO: 453896 - RNA, 22 nt, Brucella suis 1330
cggcguggugagcuugcgcagc

SEQ ID NO: 453897 - RNA, 18 nt, Brucella suis 1330
cggcgugcaggcugccca

SEQ ID NO: 453898 - RNA, 15 nt, Brucella suis 1330
cggcgggcgggcgau

SEQ ID NO: 453899 - RNA, 15 nt, Brucella suis 1330
cggcgggagcggcac

SEQ ID NO: 453900 - RNA, 14 nt, Brucella suis 1330
cggcggcuccagcc

SEQ ID NO: 453901 - RNA, 22 nt, Brucella suis 1330
cggcggcugaaaucugcgccgg

SEQ ID NO: 453902 - RNA, 21 nt, Brucella suis 1330
cggcggcgccaccgucaccgg

SEQ ID NO: 453903 - RNA, 23 nt, Brucella suis 1330
cggcggccuugaugcggcggcgc

SEQ ID NO: 453904 - RNA, 18 nt, Brucella suis 1330
cggcggauaaugcucgcc

SEQ ID NO: 453905 - RNA, 17 nt, Brucella suis 1330
cggcggaacugcauggg

SEQ ID NO: 453906 - RNA, 13 nt, Brucella suis 1330
cggcgcggcggca

SEQ ID NO: 453907 - RNA, 17 nt, Brucella suis 1330
cggccugaccggccacc

SEQ ID NO: 453908 - RNA, 13 nt, Brucella suis 1330
cggccgggcaucg

SEQ ID NO: 453909 - RNA, 18 nt, Brucella suis 1330
cggccgggcggcuugcca

SEQ ID NO: 453910 - RNA, 16 nt, Brucella suis 1330
cggccggagcgcagau

SEQ ID NO: 453911 - RNA, 18 nt, Brucella suis 1330
cggccgcuugcgacaccu

SEQ ID NO: 453912 - RNA, 15 nt, Brucella suis 1330
cggcccggugcagcg

SEQ ID NO: 453913 - RNA, 17 nt, Brucella suis 1330
cggcccgauuccuccgg

SEQ ID NO: 453914 - RNA, 20 nt, Brucella suis 1330
cggcccaaaggccgcgccga

SEQ ID NO: 453915 - RNA, 19 nt, Brucella suis 1330
cggccagcgcaaagcgcgc

SEQ ID NO: 453916 - RNA, 21 nt, Brucella suis 1330
cggccagcgcaaagcgcgcgc

SEQ ID NO: 453917 - RNA, 16 nt, Brucella suis 1330
cggcaucggaacccca

SEQ ID NO: 453918 - RNA, 17 nt, Brucella suis 1330
cggcaucgagaaaagcg

SEQ ID NO: 453919 - RNA, 17 nt, Brucella suis 1330
cggcaguuucaccaugg

SEQ ID NO: 453920 - RNA, 18 nt, Brucella suis 1330
cggcaguuucaccauggc

SEQ ID NO: 453921 - RNA, 20 nt, Brucella suis 1330
cggcaguuucugccgcgcau

SEQ ID NO: 453922 - RNA, 22 nt, Brucella suis 1330
cggcauaaaaaaagcgcggagc

SEQ ID NO: 453923 - RNA, 19 nt, Brucella suis 1330
cggcaggugccaucaagcg

SEQ ID NO: 453924 - RNA, 14 nt, Brucella suis 1330
cggcagggccagau

SEQ ID NO: 453925 - RNA, 19 nt, Brucella suis 1330
cggcaggccgaaggaugca

SEQ ID NO: 453926 - RNA, 19 nt, Brucella suis 1330
cggcaggaucgccagaagc

SEQ ID NO: 453927 - RNA, 20 nt, Brucella suis 1330
cggcaggaucuuccaucugg

SEQ ID NO: 453928 - RNA, 21 nt, Brucella suis 1330
cggcagcgaaccguccacgau

SEQ ID NO: 453929 - RNA, 12 nt, Brucella suis 1330
cggcagaccgga

SEQ ID NO: 453930 - RNA, 13 nt, Brucella suis 1330
cggcacgccgccc

SEQ ID NO: 453931 - RNA, 23 nt, Brucella suis 1330
cggcaccgcaaagagaaccaccu

SEQ ID NO: 453932 - RNA, 16 nt, Brucella suis 1330
cggcacaugaaauaag

SEQ ID NO: 453933 - RNA, 22 nt, Brucella suis 1330
cggauuugaggauugccgccgc

SEQ ID NO: 453934 - RNA, 20 nt, Brucella suis 1330
cggauucuuaugccagauau

SEQ ID NO: 453935 - RNA, 16 nt, Brucella suis 1330
cggauggaccggcugg

SEQ ID NO: 453936 - RNA, 16 nt, Brucella suis 1330
cggaugauugcauuug

SEQ ID NO: 453937 - RNA, 12 nt, Brucella suis 1330
cggaugaacccg

SEQ ID NO: 453938 - RNA, 21 nt, Brucella suis 1330
cggaucggcagcgaaccgucc

SEQ ID NO: 453939 - RNA, 16 nt, Brucella suis 1330
cggaucggcaggauag

SEQ ID NO: 453940 - RNA, 16 nt, Brucella suis 1330
cggaucguacggcccu

SEQ ID NO: 453941 - RNA, 21 nt, Brucella suis 1330
cggaucgugagguucuugagg

SEQ ID NO: 453942 - RNA, 18 nt, Brucella suis 1330
cggaguuuuucggccagu

SEQ ID NO: 453943 - RNA, 21 nt, Brucella suis 1330
cggagccggccuuugcgcgcc

SEQ ID NO: 453944 - RNA, 22 nt, Brucella suis 1330
cggagccggccuuugcgcgccu

SEQ ID NO: 453945 - RNA, 21 nt, Brucella suis 1330
cggaacgcugaucgccuuuca

SEQ ID NO: 453946 - RNA, 19 nt, Brucella suis 1330
cggaaaccaguggccuuca

SEQ ID NO: 453947 - RNA, 13 nt, Brucella suis 1330
cgcuuuugcgcuc

SEQ ID NO: 453948 - RNA, 12 nt, Brucella suis 1330
cgcuugaugccu

SEQ ID NO: 453949 - RNA, 20 nt, Brucella suis 1330
cgcuggaugucgauuucacc

SEQ ID NO: 453950 - RNA, 14 nt, Brucella suis 1330
cgcugcucgcgcaa

SEQ ID NO: 453951 - RNA, 13 nt, Brucella suis 1330
cgcugcgggcagc

SEQ ID NO: 453952 - RNA, 14 nt, Brucella suis 1330
cgcugcgaaggccc

SEQ ID NO: 453953 - RNA, 19 nt, Brucella suis 1330
cgcugcgacgagaugcgcu

SEQ ID NO: 453954 - RNA, 13 nt, Brucella suis 1330
cgcugaucgccuu

SEQ ID NO: 453955 - RNA, 15 nt, Brucella suis 1330
cgcugaggcggccgg

SEQ ID NO: 453956 - RNA, 17 nt, Brucella suis 1330
cgcgugcacgcgcagau

SEQ ID NO: 453957 - RNA, 14 nt, Brucella suis 1330
cgcgugagcgcgca

SEQ ID NO: 453958 - RNA, 16 nt, Brucella suis 1330
cgcgucgagcaaugcg

SEQ ID NO: 453959 - RNA, 17 nt, Brucella suis 1330
cgcgucgagcaaugcgc

SEQ ID NO: 453960 - RNA, 17 nt, Brucella suis 1330
cgcgguuugcaagccgc

SEQ ID NO: 453961 - RNA, 18 nt, Brucella suis 1330
cgcgguuugcaagccgcg

SEQ ID NO: 453962 - RNA, 15 nt, Brucella suis 1330
cgcggaugacgccgc

SEQ ID NO: 453963 - RNA, 15 nt, Brucella suis 1330
cgcggaucggcagcg

SEQ ID NO: 453964 - RNA, 19 nt, Brucella suis 1330
cgcgccgcuugccagcacc

SEQ ID NO: 453965 - RNA, 13 nt, Brucella suis 1330
cgcgcccuggcug

SEQ ID NO: 453966 - RNA, 14 nt, Brucella suis 1330
cgcgcccucgcgcu

SEQ ID NO: 453967 - RNA, 14 nt, Brucella suis 1330
cgcgcccggcggcu

SEQ ID NO: 453968 - RNA, 15 nt, Brucella suis 1330
cgcgcccgucaccgg

SEQ ID NO: 453969 - RNA, 19 nt, Brucella suis 1330
cgcgccagacaaggcgcgg

SEQ ID NO: 453970 - RNA, 18 nt, Brucella suis 1330
cgcgccaauccaggucag

SEQ ID NO: 453971 - RNA, 20 nt, Brucella suis 1330
cgcgcaggacuucacccgcc

SEQ ID NO: 453972 - RNA, 19 nt, Brucella suis 1330
cgcgcacguccggcacuuc

SEQ ID NO: 453973 - RNA, 20 nt, Brucella suis 1330
cgcgcacaggcucgggcagc

SEQ ID NO: 453974 - RNA, 19 nt, Brucella suis 1330
cgcgcaauaaugcagcgcc

SEQ ID NO: 453975 - RNA, 20 nt, Brucella suis 1330
cgcgcaaaagagaaaccccg

SEQ ID NO: 453976 - RNA, 20 nt, Brucella suis 1330
cgcgauccugcugcgcggca

SEQ ID NO: 453977 - RNA, 23 nt, Brucella suis 1330
cgcgaucaugcccacaucgccuu

SEQ ID NO: 453978 - RNA, 12 nt, Brucella suis 1330
cgcgaucaccag

SEQ ID NO: 453979 - RNA, 14 nt, Brucella suis 1330
cgcgacuccuugua

SEQ ID NO: 453980 - RNA, 22 nt, Brucella suis 1330
cgcgacguaaagcgugagccgg

SEQ ID NO: 453981 - RNA, 13 nt, Brucella suis 1330
cgcgacgccgccc

SEQ ID NO: 453982 - RNA, 22 nt, Brucella suis 1330
cgcgaccucauuugccaccugc

SEQ ID NO: 453983 - RNA, 19 nt, Brucella suis 1330
cgcgaccagguugcgccga

SEQ ID NO: 453984 - RNA, 14 nt, Brucella suis 1330
cgcgacaucaucaa

SEQ ID NO: 453985 - RNA, 13 nt, Brucella suis 1330
cgcgaaacgccuu

SEQ ID NO: 453986 - RNA, 13 nt, Brucella suis 1330
cgccuuugccgcg

SEQ ID NO: 453987 - RNA, 15 nt, Brucella suis 1330
cgccuuuugcggggc

SEQ ID NO: 453988 - RNA, 22 nt, Brucella suis 1330
cgccuugagaucguaggcuuuc

SEQ ID NO: 453989 - RNA, 13 nt, Brucella suis 1330
cgccuucgcgcac

SEQ ID NO: 453990 - RNA, 20 nt, Brucella suis 1330
cgccuuauaggcgcgcgccu

SEQ ID NO: 453991 - RNA, 19 nt, Brucella suis 1330
cgccuucagcgugaugccc

SEQ ID NO: 453992 - RNA, 19 nt, Brucella suis 1330
cgccugggcuuucaaagga

SEQ ID NO: 453993 - RNA, 14 nt, Brucella suis 1330
cgccuguccgccug

SEQ ID NO: 453994 - RNA, 15 nt, Brucella suis 1330
cgccuguccgccugc

SEQ ID NO: 453995 - RNA, 16 nt, Brucella suis 1330
cgccuggccggcgccu

SEQ ID NO: 453996 - RNA, 17 nt, Brucella suis 1330
cgccugccaugccgcca

SEQ ID NO: 453997 - RNA, 16 nt, Brucella suis 1330
cgccugccagcccgcu

SEQ ID NO: 453998 - RNA, 15 nt, Brucella suis 1330
cgccugcaccaugga

SEQ ID NO: 453999 - RNA, 21 nt, Brucella suis 1330
cgccucauggcggcgcucggc

SEQ ID NO: 454000 - RNA, 21 nt, Brucella suis 1330
cgccucaauggucacggccac

SEQ ID NO: 454001 - RNA, 23 nt, Brucella suis 1330
cgccucaauggucacggccacau

SEQ ID NO: 454002 - RNA, 23 nt, Brucella suis 1330
cgccgugggcguguuugcggccu

SEQ ID NO: 454003 - RNA, 17 nt, Brucella suis 1330
cgccgucgggaccaccg

SEQ ID NO: 454004 - RNA, 19 nt, Brucella suis 1330
cgccgucgagcagcaucuu

SEQ ID NO: 454005 - RNA, 18 nt, Brucella suis 1330
cgccguaauggcgcggcu

SEQ ID NO: 454006 - RNA, 12 nt, Brucella suis 1330
cgccggguuuug

SEQ ID NO: 454007 - RNA, 19 nt, Brucella suis 1330
cgccgggccuugccaaaau

SEQ ID NO: 454008 - RNA, 23 nt, Brucella suis 1330
cgccgggcugcuucucccaaagc

SEQ ID NO: 454009 - RNA, 22 nt, Brucella suis 1330
cgccgggcuuucucguuuucau

SEQ ID NO: 454010 - RNA, 20 nt, Brucella suis 1330
cgccggaagauggagcggcu

SEQ ID NO: 454011 - RNA, 23 nt, Brucella suis 1330
cgccgcuuccagcgaaacggcag

SEQ ID NO: 454012 - RNA, 21 nt, Brucella suis 1330
cgccgcuugccagcaccagcg

SEQ ID NO: 454013 - RNA, 13 nt, Brucella suis 1330
cgccgcuccagcc

SEQ ID NO: 454014 - RNA, 20 nt, Brucella suis 1330
cgccgcuccagccgagcgcc

SEQ ID NO: 454015 - RNA, 21 nt, Brucella suis 1330
cgccgcgauugcaucggcagc

SEQ ID NO: 454016 - RNA, 19 nt, Brucella suis 1330
cgccgcgaaaaccggcugg

SEQ ID NO: 454017 - RNA, 22 nt, Brucella suis 1330
cgccgccuccucgauugccucg

SEQ ID NO: 454018 - RNA, 22 nt, Brucella suis 1330
cgccgccggugcucugcgccca

SEQ ID NO: 454019 - RNA, 24 nt, Brucella suis 1330
cgccgccauggucgcgcaccagcu

SEQ ID NO: 454020 - RNA, 19 nt, Brucella suis 1330
cgccgccaagggccgccga

SEQ ID NO: 454021 - RNA, 18 nt, Brucella suis 1330
cgccgcagaccacccggc

SEQ ID NO: 454022 - RNA, 20 nt, Brucella suis 1330
cgccgaugcggggaaaucag

SEQ ID NO: 454023 - RNA, 19 nt, Brucella suis 1330
cgccgaucaggaccggcga

SEQ ID NO: 454024 - RNA, 21 nt, Brucella suis 1330
cgccgagauugggcagcagau

SEQ ID NO: 454025 - RNA, 18 nt, Brucella suis 1330
cgccgacgauuucuucca

SEQ ID NO: 454026 - RNA, 21 nt, Brucella suis 1330
cgccgacaaaaaacaccgcgc

SEQ ID NO: 454027 - RNA, 16 nt, Brucella suis 1330
cgcccuggcggcgugc

SEQ ID NO: 454028 - RNA, 22 nt, Brucella suis 1330
cgcccugcacaucaucggucag

SEQ ID NO: 454029 - RNA, 15 nt, Brucella suis 1330
cgcccgugccgcguu

SEQ ID NO: 454030 - RNA, 17 nt, Brucella suis 1330
cgcccgucuucggcgca

SEQ ID NO: 454031 - RNA, 17 nt, Brucella suis 1330
cgcccgucaccgcggcu

SEQ ID NO: 454032 - RNA, 18 nt, Brucella suis 1330
cgcccgucaccgcggcuu

SEQ ID NO: 454033 - RNA, 14 nt, Brucella suis 1330
cgcccgguuccggc

SEQ ID NO: 454034 - RNA, 21 nt, Brucella suis 1330
cgcccgccucgcaggcaaagc

SEQ ID NO: 454035 - RNA, 17 nt, Brucella suis 1330
cgcccgcccccgcgcuu

SEQ ID NO: 454036 - RNA, 18 nt, Brucella suis 1330
cgcccgauauccggcugg

SEQ ID NO: 454037 - RNA, 18 nt, Brucella suis 1330
cgcccgaauugcggcuga

SEQ ID NO: 454038 - RNA, 14 nt, Brucella suis 1330
cgccccgugaucuu

SEQ ID NO: 454039 - RNA, 20 nt, Brucella suis 1330
cgcccauuucacccgccaga

SEQ ID NO: 454040 - RNA, 20 nt, Brucella suis 1330
cgcccauuuucuccaccagu

SEQ ID NO: 454041 - RNA, 16 nt, Brucella suis 1330
cgcccauacgcgcggc

SEQ ID NO: 454042 - RNA, 13 nt, Brucella suis 1330
cgcccagcgcggc

SEQ ID NO: 454043 - RNA, 19 nt, Brucella suis 1330
cgcccagcgaauagaccau

SEQ ID NO: 454044 - RNA, 23 nt, Brucella suis 1330
cgcccaccauauuugccgccaga

SEQ ID NO: 454045 - RNA, 15 nt, Brucella suis 1330
cgccauuucccccaa

SEQ ID NO: 454046 - RNA, 22 nt, Brucella suis 1330
cgccauggucgcgcaccagcuu

SEQ ID NO: 454047 - RNA, 22 nt, Brucella suis 1330
cgccauguugggguuggccuga

SEQ ID NO: 454048 - RNA, 15 nt, Brucella suis 1330
cgccauugaccgccu

SEQ ID NO: 454049 - RNA, 14 nt, Brucella suis 1330
cgccauauugggag

SEQ ID NO: 454050 - RNA, 16 nt, Brucella suis 1330
cgccauagaacagcaa

SEQ ID NO: 454051 - RNA, 18 nt, Brucella suis 1330
cgccaguuucauuuccuc

SEQ ID NO: 454052 - RNA, 19 nt, Brucella suis 1330
cgccaguuuucgcggcaga

SEQ ID NO: 454053 - RNA, 14 nt, Brucella suis 1330
cgccaguuccugaa

SEQ ID NO: 454054 - RNA, 20 nt, Brucella suis 1330
cgccaggcaaaugcuccuuc

SEQ ID NO: 454055 - RNA, 20 nt, Brucella suis 1330
cgccagcucgccggcuucca

SEQ ID NO: 454056 - RNA, 23 nt, Brucella suis 1330
cgccagcucgccggcuuccacgc

SEQ ID NO: 454057 - RNA, 20 nt, Brucella suis 1330
cgccagcggugacgaucugg

SEQ ID NO: 454058 - RNA, 14 nt, Brucella suis 1330
cgccagccgccagc

SEQ ID NO: 454059 - RNA, 13 nt, Brucella suis 1330
cgccagccgcgau

SEQ ID NO: 454060 - RNA, 15 nt, Brucella suis 1330
cgccagcauggcguc

SEQ ID NO: 454061 - RNA, 18 nt, Brucella suis 1330
cgccagcauuucagggcu

SEQ ID NO: 454062 - RNA, 18 nt, Brucella suis 1330
cgccagcacucugccagg

SEQ ID NO: 454063 - RNA, 13 nt, Brucella suis 1330
cgccagcaccggc

SEQ ID NO: 454064 - RNA, 13 nt, Brucella suis 1330
cgccaccauggcc

SEQ ID NO: 454065 - RNA, 18 nt, Brucella suis 1330
cgccaccauggccgcccc

SEQ ID NO: 454066 - RNA, 23 nt, Brucella suis 1330
cgccaaugcccugcugcaacaaa

SEQ ID NO: 454067 - RNA, 18 nt, Brucella suis 1330
cgcauaagccccggcauc

SEQ ID NO: 454068 - RNA, 14 nt, Brucella suis 1330
cgcaguugcaccgc

SEQ ID NO: 454069 - RNA, 22 nt, Brucella suis 1330
cgcaggcggauauucgccgccu

SEQ ID NO: 454070 - RNA, 19 nt, Brucella suis 1330
cgcaggcgcucggugccgc

SEQ ID NO: 454071 - RNA, 15 nt, Brucella suis 1330
cgcaggacaagccgc

SEQ ID NO: 454072 - RNA, 22 nt, Brucella suis 1330
cgcaggaccacgaacgacaccu

SEQ ID NO: 454073 - RNA, 18 nt, Brucella suis 1330
cgcagccgcgucagccgg

SEQ ID NO: 454074 - RNA, 23 nt, Brucella suis 1330
cgcacgcuuggccucuuccagga

SEQ ID NO: 454075 - RNA, 15 nt, Brucella suis 1330
cgcacgccugccgcg

SEQ ID NO: 454076 - RNA, 15 nt, Brucella suis 1330
cgcaccagcuugagc

SEQ ID NO: 454077 - RNA, 14 nt, Brucella suis 1330
cgcaauaaugcagc

SEQ ID NO: 454078 - RNA, 18 nt, Brucella suis 1330
cgcaauaaugcagcgccg

SEQ ID NO: 454079 - RNA, 20 nt, Brucella suis 1330
cgcaauaaugcagcgccgcg

SEQ ID NO: 454080 - RNA, 16 nt, Brucella suis 1330
cgcaacuggucggcga

SEQ ID NO: 454081 - RNA, 16 nt, Brucella suis 1330
cgcaacucauggaagu

SEQ ID NO: 454082 - RNA, 21 nt, Brucella suis 1330
cgcaaagcgaacgcacugcaa

SEQ ID NO: 454083 - RNA, 16 nt, Brucella suis 1330
cgcaaagcgcgcgcca

SEQ ID NO: 454084 - RNA, 19 nt, Brucella suis 1330
cgcaaagcguuccgcgcaa

SEQ ID NO: 454085 - RNA, 22 nt, Brucella suis 1330
cgcaaaggaggaggacacgucg

SEQ ID NO: 454086 - RNA, 22 nt, Brucella suis 1330
cgauuaccggaacaaguuccuu

SEQ ID NO: 454087 - RNA, 16 nt, Brucella suis 1330
cgauggcgaucacgaa

SEQ ID NO: 454088 - RNA, 18 nt, Brucella suis 1330
cgauggcgccgcauggcg

SEQ ID NO: 454089 - RNA, 19 nt, Brucella suis 1330
cgaugcgcugaacauggcu

SEQ ID NO: 454090 - RNA, 12 nt, Brucella suis 1330
cgaugaugauga

SEQ ID NO: 454091 - RNA, 14 nt, Brucella suis 1330
cgaugaucugcgug

SEQ ID NO: 454092 - RNA, 22 nt, Brucella suis 1330
cgaugaggccgguaauaacuuc

SEQ ID NO: 454093 - RNA, 15 nt, Brucella suis 1330
cgaugacggagcguc

SEQ ID NO: 454094 - RNA, 17 nt, Brucella suis 1330
cgaugacggcgcggcgc

SEQ ID NO: 454095 - RNA, 11 nt, Brucella suis 1330
cgaugacccag

SEQ ID NO: 454096 - RNA, 23 nt, Brucella suis 1330
cgaugaccaccgcgaaagcaccc

SEQ ID NO: 454097 - RNA, 12 nt, Brucella suis 1330
cgaugaagagcg

SEQ ID NO: 454098 - RNA, 15 nt, Brucella suis 1330
cgaucugagaaagcu

SEQ ID NO: 454099 - RNA, 13 nt, Brucella suis 1330
cgaucuggaacag

SEQ ID NO: 454100 - RNA, 17 nt, Brucella suis 1330
cgaucgguggcugcaau

SEQ ID NO: 454101 - RNA, 17 nt, Brucella suis 1330
cgauccuuguucuuggc

SEQ ID NO: 454102 - RNA, 21 nt, Brucella suis 1330
cgauccaguugucgccgggcu

SEQ ID NO: 454103 - RNA, 12 nt, Brucella suis 1330
cgauccaccauc

SEQ ID NO: 454104 - RNA, 15 nt, Brucella suis 1330
cgauaucgagcacga

SEQ ID NO: 454105 - RNA, 15 nt, Brucella suis 1330
cgauagacgcggcgg

SEQ ID NO: 454106 - RNA, 20 nt, Brucella suis 1330
cgauauagacuucagccaga

SEQ ID NO: 454107 - RNA, 16 nt, Brucella suis 1330
cgauaaagaugcgcgc

SEQ ID NO: 454108 - RNA, 14 nt, Brucella suis 1330
ccuucaucaagcug

SEQ ID NO: 454109 - RNA, 15 nt, Brucella suis 1330
ccuuauaggcgcgcg

SEQ ID NO: 454110 - RNA, 17 nt, Brucella suis 1330
ccuuaaccuuuuuccug

SEQ ID NO: 454111 - RNA, 15 nt, Brucella suis 1330
ccuguuccugcaugu

SEQ ID NO: 454112 - RNA, 20 nt, Brucella suis 1330
ccugucuuuuccgcugccag

SEQ ID NO: 454113 - RNA, 15 nt, Brucella suis 1330
ccuggucuagccgcg

SEQ ID NO: 454114 - RNA, 14 nt, Brucella suis 1330
ccuggccggcgccu

SEQ ID NO: 454115 - RNA, 14 nt, Brucella suis 1330
ccuggccgccgccg

SEQ ID NO: 454116 - RNA, 20 nt, Brucella suis 1330
ccugcuucaucgcggcagcc

SEQ ID NO: 454117 - RNA, 13 nt, Brucella suis 1330
ccugcuuccuuuu

SEQ ID NO: 454118 - RNA, 20 nt, Brucella suis 1330
ccugcuuccuuuucggcuuc

SEQ ID NO: 454119 - RNA, 19 nt, Brucella suis 1330
ccugcuucuugccuucauc

SEQ ID NO: 454120 - RNA, 18 nt, Brucella suis 1330
ccugcucauaaacgcugc

SEQ ID NO: 454121 - RNA, 20 nt, Brucella suis 1330
ccugccaucaccagccccca

SEQ ID NO: 454122 - RNA, 21 nt, Brucella suis 1330
ccugccaucaccagcccccag

SEQ ID NO: 454123 - RNA, 16 nt, Brucella suis 1330
ccugccauccgccccg

SEQ ID NO: 454124 - RNA, 16 nt, Brucella suis 1330
ccugccaugccgccaa

SEQ ID NO: 454125 - RNA, 14 nt, Brucella suis 1330
ccugccagcccgcu

SEQ ID NO: 454126 - RNA, 12 nt, Brucella suis 1330
ccugccagcggc

SEQ ID NO: 454127 - RNA, 22 nt, Brucella suis 1330
ccugccaaacuaaaugaagaag

SEQ ID NO: 454128 - RNA, 19 nt, Brucella suis 1330
ccugcagccggaagaacag

SEQ ID NO: 454129 - RNA, 14 nt, Brucella suis 1330
ccugcaaaccggcu

SEQ ID NO: 454130 - RNA, 15 nt, Brucella suis 1330
ccugauccagaagcc

SEQ ID NO: 454131 - RNA, 19 nt, Brucella suis 1330
ccugaccggccacccagcc

SEQ ID NO: 454132 - RNA, 12 nt, Brucella suis 1330
ccugacccggcc

SEQ ID NO: 454133 - RNA, 17 nt, Brucella suis 1330
ccugacccggccuuugc

SEQ ID NO: 454134 - RNA, 14 nt, Brucella suis 1330
ccugaggcauugag

SEQ ID NO: 454135 - RNA, 13 nt, Brucella suis 1330
ccucugccuccau

SEQ ID NO: 454136 - RNA, 14 nt, Brucella suis 1330
ccucugccugcuga

SEQ ID NO: 454137 - RNA, 14 nt, Brucella suis 1330
ccucgucaaaaccg

SEQ ID NO: 454138 - RNA, 14 nt, Brucella suis 1330
ccucgccuuccagc

SEQ ID NO: 454139 - RNA, 16 nt, Brucella suis 1330
ccucgcccugcaauaa

SEQ ID NO: 454140 - RNA, 18 nt, Brucella suis 1330
ccucgcccugcuucacau

SEQ ID NO: 454141 - RNA, 13 nt, Brucella suis 1330
ccucgauuuuugg

SEQ ID NO: 454142 - RNA, 22 nt, Brucella suis 1330
ccucagcuauagccugcgccag

SEQ ID NO: 454143 - RNA, 19 nt, Brucella suis 1330
ccucgaucacgaaagucug

SEQ ID NO: 454144 - RNA, 14 nt, Brucella suis 1330
ccucgaucggugca

SEQ ID NO: 454145 - RNA, 15 nt, Brucella suis 1330
ccucaagcggcucca

SEQ ID NO: 454146 - RNA, 16 nt, Brucella suis 1330
ccucaagugccgccuu

SEQ ID NO: 454147 - RNA, 23 nt, Brucella suis 1330
ccucaauggcauuggcugcuucc

SEQ ID NO: 454148 - RNA, 15 nt, Brucella suis 1330
ccucacccuccaccg

SEQ ID NO: 454149 - RNA, 16 nt, Brucella suis 1330
ccuauuccccuauucc

SEQ ID NO: 454150 - RNA, 19 nt, Brucella suis 1330
ccuauuccccuauuccccu

SEQ ID NO: 454151 - RNA, 16 nt, Brucella suis 1330
ccucaagcaucuugau

SEQ ID NO: 454152 - RNA, 21 nt, Brucella suis 1330
ccuaaagccgcuccauuccca

SEQ ID NO: 454153 - RNA, 20 nt, Brucella suis 1330
ccgugggcaagaucauccgg

SEQ ID NO: 454154 - RNA, 15 nt, Brucella suis 1330
ccgguugguccuugu

SEQ ID NO: 454155 - RNA, 20 nt, Brucella suis 1330
ccgguugcuuccaugcccau

SEQ ID NO: 454156 - RNA, 23 nt, Brucella suis 1330
ccgguugcgccaaaacgcagccg

SEQ ID NO: 454157 - RNA, 15 nt, Brucella suis 1330
ccgguucuuuuccuu

SEQ ID NO: 454158 - RNA, 17 nt, Brucella suis 1330
ccgguucggauccuccu

SEQ ID NO: 454159 - RNA, 16 nt, Brucella suis 1330
ccgguucauuuuuaga

SEQ ID NO: 454160 - RNA, 17 nt, Brucella suis 1330
ccgguguauccaccaga

SEQ ID NO: 454161 - RNA, 17 nt, Brucella suis 1330
ccggugcgauccauauc

SEQ ID NO: 454162 - RNA, 22 nt, Brucella suis 1330
ccggucugucauuugcggcagu

SEQ ID NO: 454163 - RNA, 17 nt, Brucella suis 1330
ccgguccccgccgccga

SEQ ID NO: 454164 - RNA, 18 nt, Brucella suis 1330
ccgguacuggccaagcgu

SEQ ID NO: 454165 - RNA, 22 nt, Brucella suis 1330
ccgggucuucauagaccccgcc

SEQ ID NO: 454166 - RNA, 23 nt, Brucella suis 1330
ccgggucuucgcccggcauggcc

SEQ ID NO: 454167 - RNA, 19 nt, Brucella suis 1330
ccggggggaauggcgcgcg

SEQ ID NO: 454168 - RNA, 17 nt, Brucella suis 1330
ccgggccucgcgcccgg

SEQ ID NO: 454169 - RNA, 21 nt, Brucella suis 1330
ccgggccgcaugauccgcucc

SEQ ID NO: 454170 - RNA, 16 nt, Brucella suis 1330
ccgggcagcggcgcgc

SEQ ID NO: 454171 - RNA, 17 nt, Brucella suis 1330
ccgggcagcggcgcgcc

SEQ ID NO: 454172 - RNA, 16 nt, Brucella suis 1330
ccggcgcggucggcgc

SEQ ID NO: 454173 - RNA, 15 nt, Brucella suis 1330
ccggccuuugcgccg

SEQ ID NO: 454174 - RNA, 18 nt, Brucella suis 1330
ccggccuuugcgcgccug

SEQ ID NO: 454175 - RNA, 21 nt, Brucella suis 1330
ccggccuuguguuucaccaga

SEQ ID NO: 454176 - RNA, 22 nt, Brucella suis 1330
ccggccuuguguuucaccagau

SEQ ID NO: 454177 - RNA, 16 nt, Brucella suis 1330
ccggccuuuuucaguu

SEQ ID NO: 454178 - RNA, 20 nt, Brucella suis 1330
ccggccuugauguccggcgc

SEQ ID NO: 454179 - RNA, 17 nt, Brucella suis 1330
ccggccugguuucacag

SEQ ID NO: 454180 - RNA, 20 nt, Brucella suis 1330
ccggcaguuucugccgcgca

SEQ ID NO: 454181 - RNA, 14 nt, Brucella suis 1330
ccggaugcaaaacc

SEQ ID NO: 454182 - RNA, 15 nt, Brucella suis 1330
ccggaucgaggccga

SEQ ID NO: 454183 - RNA, 22 nt, Brucella suis 1330
ccggaucaaaccggccaugccc

SEQ ID NO: 454184 - RNA, 15 nt, Brucella suis 1330
ccggauaucgccaga

SEQ ID NO: 454185 - RNA, 21 nt, Brucella suis 1330
ccggaccgaaggccagacacu

SEQ ID NO: 454186 - RNA, 14 nt, Brucella suis 1330
ccgcuucugcucac

SEQ ID NO: 454187 - RNA, 15 nt, Brucella suis 1330
ccgcuucuggauuug

SEQ ID NO: 454188 - RNA, 18 nt, Brucella suis 1330
ccgcuucgcugcgguagc

SEQ ID NO: 454189 - RNA, 20 nt, Brucella suis 1330
ccgcuggugcgauccaccau

SEQ ID NO: 454190 - RNA, 15 nt, Brucella suis 1330
ccgcugcaccgggcc

SEQ ID NO: 454191 - RNA, 24 nt, Brucella suis 1330
ccgcugaggcggccggagcgcaga

SEQ ID NO: 454192 - RNA, 11 nt, Brucella suis 1330
ccgcuccuggu

SEQ ID NO: 454193 - RNA, 19 nt, Brucella suis 1330
ccgcucaucgcaguugcac

SEQ ID NO: 454194 - RNA, 15 nt, Brucella suis 1330
ccgcgugaaaagcac

SEQ ID NO: 454195 - RNA, 17 nt, Brucella suis 1330
ccgcgugaaaagcacac

SEQ ID NO: 454196 - RNA, 21 nt, Brucella suis 1330
ccgcgugaagaauggcaagca

SEQ ID NO: 454197 - RNA, 15 nt, Brucella suis 1330
ccgcgguuucuccug

SEQ ID NO: 454198 - RNA, 17 nt, Brucella suis 1330
ccgcggaugacgccgcu

SEQ ID NO: 454199 - RNA, 16 nt, Brucella suis 1330
ccgcgcugaagcggcc

SEQ ID NO: 454200 - RNA, 13 nt, Brucella suis 1330
ccgcgcggcagcg

SEQ ID NO: 454201 - RNA, 22 nt, Brucella suis 1330
ccgcgccaauccaggucagcgg

SEQ ID NO: 454202 - RNA, 14 nt, Brucella suis 1330
ccgcgaucaguucg

SEQ ID NO: 454203 - RNA, 17 nt, Brucella suis 1330
ccgcgauaucgucgcgc

SEQ ID NO: 454204 - RNA, 14 nt, Brucella suis 1330
ccgcgacaucauca

SEQ ID NO: 454205 - RNA, 17 nt, Brucella suis 1330
ccgcgaaagccagaacc

SEQ ID NO: 454206 - RNA, 19 nt, Brucella suis 1330
ccgcgaacgauugggcgau

SEQ ID NO: 454207 - RNA, 14 nt, Brucella suis 1330
ccgcgaaaaagccg

SEQ ID NO: 454208 - RNA, 15 nt, Brucella suis 1330
ccgcgaaaaccggcu

SEQ ID NO: 454209 - RNA, 14 nt, Brucella suis 1330
ccgccgaucaggac

SEQ ID NO: 454210 - RNA, 15 nt, Brucella suis 1330
ccgccgaaagccucg

SEQ ID NO: 454211 - RNA, 21 nt, Brucella suis 1330
ccgcccuggcggcgugcaggc

SEQ ID NO: 454212 - RNA, 21 nt, Brucella suis 1330
ccgcccggaucaaaccggcca

SEQ ID NO: 454213 - RNA, 21 nt, Brucella suis 1330
ccgccaucaggucgagcgccu

SEQ ID NO: 454214 - RNA, 23 nt, Brucella suis 1330
ccgccagccgcaaucagccagaa

SEQ ID NO: 454215 - RNA, 14 nt, Brucella suis 1330
ccgccagcauggcg

SEQ ID NO: 454216 - RNA, 12 nt, Brucella suis 1330
ccgccagcagaa

SEQ ID NO: 454217 - RNA, 11 nt, Brucella suis 1330
ccgccacaugu

SEQ ID NO: 454218 - RNA, 19 nt, Brucella suis 1330
ccgccaauaccgugaucag

SEQ ID NO: 454219 - RNA, 16 nt, Brucella suis 1330
ccgccaauccccucac

SEQ ID NO: 454220 - RNA, 14 nt, Brucella suis 1330
ccgccaagccagcc

SEQ ID NO: 454221 - RNA, 16 nt, Brucella suis 1330
ccgccaagccagcccg

SEQ ID NO: 454222 - RNA, 18 nt, Brucella suis 1330
ccgccaaggaacgcggcc

SEQ ID NO: 454223 - RNA, 19 nt, Brucella suis 1330
ccgcauggucgaugccgcc

SEQ ID NO: 454224 - RNA, 18 nt, Brucella suis 1330
ccgcaugauccgcuccag

SEQ ID NO: 454225 - RNA, 12 nt, Brucella suis 1330
ccgcaucggccu

SEQ ID NO: 454226 - RNA, 18 nt, Brucella suis 1330
ccgcaucguaaucgccgg

SEQ ID NO: 454227 - RNA, 22 nt, Brucella suis 1330
ccgcaucguaaucgccgggccu

SEQ ID NO: 454228 - RNA, 15 nt, Brucella suis 1330
ccgcauaggggcgca

SEQ ID NO: 454229 - RNA, 15 nt, Brucella suis 1330
ccgcacgcaaggcgg

SEQ ID NO: 454230 - RNA, 15 nt, Brucella suis 1330
ccgcaccucuggaug

SEQ ID NO: 454231 - RNA, 17 nt, Brucella suis 1330
ccgcaccgccgaucagg

SEQ ID NO: 454232 - RNA, 23 nt, Brucella suis 1330
ccgcaccgccgaucaggaccggc

SEQ ID NO: 454233 - RNA, 14 nt, Brucella suis 1330
ccgcacccuauucc

SEQ ID NO: 454234 - RNA, 22 nt, Brucella suis 1330
ccgcaaucgccaccggcggcgc

SEQ ID NO: 454235 - RNA, 18 nt, Brucella suis 1330
ccgaugcgggaaaguuau

SEQ ID NO: 454236 - RNA, 13 nt, Brucella suis 1330
ccgaggccgccac

SEQ ID NO: 454237 - RNA, 18 nt, Brucella suis 1330
ccgaggacuucauggcag

SEQ ID NO: 454238 - RNA, 15 nt, Brucella suis 1330
ccgagcauggccugc

SEQ ID NO: 454239 - RNA, 19 nt, Brucella suis 1330
ccgacugcacgucuucggc

SEQ ID NO: 454240 - RNA, 14 nt, Brucella suis 1330
ccgaccuccccccg

SEQ ID NO: 454241 - RNA, 19 nt, Brucella suis 1330
ccgaccgcgaaauagaugu

SEQ ID NO: 454242 - RNA, 18 nt, Brucella suis 1330
ccgacccgucaaugccau

SEQ ID NO: 454243 - RNA, 24 nt, Brucella suis 1330
ccgaccagaacgauggugcggcgc

SEQ ID NO: 454244 - RNA, 20 nt, Brucella suis 1330
ccgacagggcaagcgccugc

SEQ ID NO: 454245 - RNA, 15 nt, Brucella suis 1330
ccgaaggaugcaagc

SEQ ID NO: 454246 - RNA, 15 nt, Brucella suis 1330
ccgaaccgggccgca

SEQ ID NO: 454247 - RNA, 21 nt, Brucella suis 1330
ccgaaccggggcagggcaggc

SEQ ID NO: 454248 - RNA, 18 nt, Brucella suis 1330
ccgaaaugcgcggcggca

SEQ ID NO: 454249 - RNA, 21 nt, Brucella suis 1330
cccucgauuuuuggcagcagu

SEQ ID NO: 454250 - RNA, 21 nt, Brucella suis 1330
cccucgaucagcaccaucgag

SEQ ID NO: 454251 - RNA, 20 nt, Brucella suis 1330
cccucgaucggugcaaugcc

SEQ ID NO: 454252 - RNA, 12 nt, Brucella suis 1330
cccucgaccgcc

SEQ ID NO: 454253 - RNA, 20 nt, Brucella suis 1330
cccucauggcgauaauaauu

SEQ ID NO: 454254 - RNA, 13 nt, Brucella suis 1330
cccuacucccuua

SEQ ID NO: 454255 - RNA, 13 nt, Brucella suis 1330
cccuauuccccua

SEQ ID NO: 454256 - RNA, 14 nt, Brucella suis 1330
cccguuggcgccca

SEQ ID NO: 454257 - RNA, 19 nt, Brucella suis 1330
cccguuugaagagcuuuca

SEQ ID NO: 454258 - RNA, 17 nt, Brucella suis 1330
cccgucaccggcuggca

SEQ ID NO: 454259 - RNA, 13 nt, Brucella suis 1330
cccggugcauuuu

SEQ ID NO: 454260 - RNA, 21 nt, Brucella suis 1330
cccgguggacaugaacacggc

SEQ ID NO: 454261 - RNA, 18 nt, Brucella suis 1330
cccggucacccgcacgcc

SEQ ID NO: 454262 - RNA, 18 nt, Brucella suis 1330
cccgggcagcggcgcgcc

SEQ ID NO: 454263 - RNA, 19 nt, Brucella suis 1330
cccgggcagcggcgcgcca

SEQ ID NO: 454264 - RNA, 15 nt, Brucella suis 1330
cccggcuuucgccgg

SEQ ID NO: 454265 - RNA, 19 nt, Brucella suis 1330
cccggcuuucgccgggguu

SEQ ID NO: 454266 - RNA, 22 nt, Brucella suis 1330
cccggcggugaagaagcgccag

SEQ ID NO: 454267 - RNA, 17 nt, Brucella suis 1330
cccggcgcgaccgcguu

SEQ ID NO: 454268 - RNA, 14 nt, Brucella suis 1330
cccggcgauuucgc

SEQ ID NO: 454269 - RNA, 13 nt, Brucella suis 1330
cccggcgcacggc

SEQ ID NO: 454270 - RNA, 16 nt, Brucella suis 1330
cccggccuuugcgccg

SEQ ID NO: 454271 - RNA, 20 nt, Brucella suis 1330
cccggccuuugcgccggguu

SEQ ID NO: 454272 - RNA, 19 nt, Brucella suis 1330
cccggcauccgaggcgcgc

SEQ ID NO: 454273 - RNA, 20 nt, Brucella suis 1330
cccggcauccgaggcgcgca

SEQ ID NO: 454274 - RNA, 20 nt, Brucella suis 1330
cccggauugggucaacgccc

SEQ ID NO: 454275 - RNA, 19 nt, Brucella suis 1330
cccggaagcgcaaggcggc

SEQ ID NO: 454276 - RNA, 15 nt, Brucella suis 1330
cccgcucuccggcgg

SEQ ID NO: 454277 - RNA, 16 nt, Brucella suis 1330
cccgcugaggcggccg

SEQ ID NO: 454278 - RNA, 21 nt, Brucella suis 1330
cccgcgugaugagccgcuucu

SEQ ID NO: 454279 - RNA, 15 nt, Brucella suis 1330
cccgcggccacaagc

SEQ ID NO: 454280 - RNA, 19 nt, Brucella suis 1330
cccgcggccacaagcgccg

SEQ ID NO: 454281 - RNA, 16 nt, Brucella suis 1330
cccgccuuugccgcaa

SEQ ID NO: 454282 - RNA, 22 nt, Brucella suis 1330
cccgccggggccggaugcgcgg

SEQ ID NO: 454283 - RNA, 21 nt, Brucella suis 1330
cccgcccguccucaucgccgg

SEQ ID NO: 454284 - RNA, 14 nt, Brucella suis 1330
cccgcccgcggcca

SEQ ID NO: 454285 - RNA, 21 nt, Brucella suis 1330
cccgcauggucgaugccgccg

SEQ ID NO: 454286 - RNA, 21 nt, Brucella suis 1330
cccgaucaccgcagucaugcc

SEQ ID NO: 454287 - RNA, 14 nt, Brucella suis 1330
cccgaugagccaaa

SEQ ID NO: 454288 - RNA, 14 nt, Brucella suis 1330
cccgagcgucugau

SEQ ID NO: 454289 - RNA, 18 nt, Brucella suis 1330
cccgagaagcucaacgcc

SEQ ID NO: 454290 - RNA, 19 nt, Brucella suis 1330
cccgaauugcggcugacaa

SEQ ID NO: 454291 - RNA, 21 nt, Brucella suis 1330
ccccucgaucggugcaaugcc

SEQ ID NO: 454292 - RNA, 12 nt, Brucella suis 1330
ccccagccagaa

SEQ ID NO: 454293 - RNA, 21 nt, Brucella suis 1330
ccccacgggauggcggccuug

SEQ ID NO: 454294 - RNA, 16 nt, Brucella suis 1330
ccccagaaggcgcggc

SEQ ID NO: 454295 - RNA, 17 nt, Brucella suis 1330
ccccaccgucaaucgca

SEQ ID NO: 454296 - RNA, 15 nt, Brucella suis 1330
cccagcgguuuuccg

SEQ ID NO: 454297 - RNA, 15 nt, Brucella suis 1330
cccagcaccgcgcca

SEQ ID NO: 454298 - RNA, 19 nt, Brucella suis 1330
cccaccgccugcagccgga

SEQ ID NO: 454299 - RNA, 15 nt, Brucella suis 1330
cccaaccgagcagaa

SEQ ID NO: 454300 - RNA, 13 nt, Brucella suis 1330
cccaacccaucaa

SEQ ID NO: 454301 - RNA, 16 nt, Brucella suis 1330
ccauugcccgcccguc

SEQ ID NO: 454302 - RNA, 23 nt, Brucella suis 1330
ccauugacggagccggacgugac

SEQ ID NO: 454303 - RNA, 15 nt, Brucella suis 1330
ccauuucacccgcca

SEQ ID NO: 454304 - RNA, 14 nt, Brucella suis 1330
ccauuucagguucu

SEQ ID NO: 454305 - RNA, 14 nt, Brucella suis 1330
ccaucuucuuccag

SEQ ID NO: 454306 - RNA, 12 nt, Brucella suis 1330
ccaucuuccuca

SEQ ID NO: 454307 - RNA, 20 nt, Brucella suis 1330
ccaucggcgaggaagagaau

SEQ ID NO: 454308 - RNA, 15 nt, Brucella suis 1330
ccaucgaggaauagg

SEQ ID NO: 454309 - RNA, 16 nt, Brucella suis 1330
ccaucaggucgagcgc

SEQ ID NO: 454310 - RNA, 17 nt, Brucella suis 1330
ccaucccggaaggaaug

SEQ ID NO: 454311 - RNA, 12 nt, Brucella suis 1330
ccaucagccggg

SEQ ID NO: 454312 - RNA, 18 nt, Brucella suis 1330
ccauauccaucugcuccu

SEQ ID NO: 454313 - RNA, 19 nt, Brucella suis 1330
ccauauccucugugacugc

SEQ ID NO: 454314 - RNA, 18 nt, Brucella suis 1330
ccauaugacgcgguccca

SEQ ID NO: 454315 - RNA, 12 nt, Brucella suis 1330
ccauaaagcacc

SEQ ID NO: 454316 - RNA, 17 nt, Brucella suis 1330
ccagucgaggcagccac

SEQ ID NO: 454317 - RNA, 22 nt, Brucella suis 1330
ccagucgaucagugggucccag

SEQ ID NO: 454318 - RNA, 16 nt, Brucella suis 1330
ccaguccuugcccucg

SEQ ID NO: 454319 - RNA, 14 nt, Brucella suis 1330
ccagucauggcgca

SEQ ID NO: 454320 - RNA, 18 nt, Brucella suis 1330
ccagguaucgugcagaag

SEQ ID NO: 454321 - RNA, 18 nt, Brucella suis 1330
ccagcuaaggccggugcg

SEQ ID NO: 454322 - RNA, 13 nt, Brucella suis 1330
ccagcgucggcgg

SEQ ID NO: 454323 - RNA, 22 nt, Brucella suis 1330
ccagcgugaagggcaggaggcc

SEQ ID NO: 454324 - RNA, 13 nt, Brucella suis 1330
ccagcgggcgcga

SEQ ID NO: 454325 - RNA, 17 nt, Brucella suis 1330
ccagcggcacgccgccc

SEQ ID NO: 454326 - RNA, 19 nt, Brucella suis 1330
ccagcgcggcaaugcgcuu

SEQ ID NO: 454327 - RNA, 21 nt, Brucella suis 1330
ccagcgaugauagcgcccgcc

SEQ ID NO: 454328 - RNA, 17 nt, Brucella suis 1330
ccagcgaauagaccaug

SEQ ID NO: 454329 - RNA, 13 nt, Brucella suis 1330
ccagccugcugca

SEQ ID NO: 454330 - RNA, 17 nt, Brucella suis 1330
ccagccuugcccuggcu

SEQ ID NO: 454331 - RNA, 17 nt, Brucella suis 1330
ccagccguuuugcgccc

SEQ ID NO: 454332 - RNA, 20 nt, Brucella suis 1330
ccagccgcgaucacagccgc

SEQ ID NO: 454333 - RNA, 20 nt, Brucella suis 1330
ccagaucccguuuugagaug

SEQ ID NO: 454334 - RNA, 17 nt, Brucella suis 1330
ccagaugugccaccagc

SEQ ID NO: 454335 - RNA, 19 nt, Brucella suis 1330
ccagauugcgccuaccaag

SEQ ID NO: 454336 - RNA, 16 nt, Brucella suis 1330
ccagcaaaagugagaa

SEQ ID NO: 454337 - RNA, 17 nt, Brucella suis 1330
ccagcaaaagugagaaa

SEQ ID NO: 454338 - RNA, 19 nt, Brucella suis 1330
ccagauagauaaacgcacc

SEQ ID NO: 454339 - RNA, 14 nt, Brucella suis 1330
ccagauagccuucc

SEQ ID NO: 454340 - RNA, 20 nt, Brucella suis 1330
ccacuucgucgguugagagc

SEQ ID NO: 454341 - RNA, 19 nt, Brucella suis 1330
ccagaaccaccagagcaaa

SEQ ID NO: 454342 - RNA, 20 nt, Brucella suis 1330
ccagaaccugcccgucuucc

SEQ ID NO: 454343 - RNA, 17 nt, Brucella suis 1330
ccagaaggcgcggcagc

SEQ ID NO: 454344 - RNA, 12 nt, Brucella suis 1330
ccacgcuccaca

SEQ ID NO: 454345 - RNA, 14 nt, Brucella suis 1330
ccacgguuuucgcc

SEQ ID NO: 454346 - RNA, 14 nt, Brucella suis 1330
ccacgcgccgccau

SEQ ID NO: 454347 - RNA, 23 nt, Brucella suis 1330
ccacgauuuccgcgacaucauca

SEQ ID NO: 454348 - RNA, 13 nt, Brucella suis 1330
ccacgaaccgugu

SEQ ID NO: 454349 - RNA, 19 nt, Brucella suis 1330
ccaccgccggcgccgccaa

SEQ ID NO: 454350 - RNA, 15 nt, Brucella suis 1330
ccaccgccugcagcc

SEQ ID NO: 454351 - RNA, 23 nt, Brucella suis 1330
ccacccgaaggacuggaucaccu

SEQ ID NO: 454352 - RNA, 23 nt, Brucella suis 1330
cauugcgcauuacggccagccgg

SEQ ID NO: 454353 - RNA, 20 nt, Brucella suis 1330
cauugcacauagguugaucc

SEQ ID NO: 454354 - RNA, 12 nt, Brucella suis 1330
cauuggaaacgc

SEQ ID NO: 454355 - RNA, 22 nt, Brucella suis 1330
cauuggaaauuauagccgccaa

SEQ ID NO: 454356 - RNA, 19 nt, Brucella suis 1330
cauugaccgaaaauggccc

SEQ ID NO: 454357 - RNA, 23 nt, Brucella suis 1330
cauugacguugauguugauggaa

SEQ ID NO: 454358 - RNA, 18 nt, Brucella suis 1330
cauugaggaucgaccagg

SEQ ID NO: 454359 - RNA, 17 nt, Brucella suis 1330
cauugaacgccuuuuuc

SEQ ID NO: 454360 - RNA, 19 nt, Brucella suis 1330
cauugaacgccuuuuucac

SEQ ID NO: 454361 - RNA, 14 nt, Brucella suis 1330
cauucugcuuauca

SEQ ID NO: 454362 - RNA, 19 nt, Brucella suis 1330
cauuuucgagccaaaaaug

SEQ ID NO: 454363 - RNA, 12 nt, Brucella suis 1330
cauuuucucaag

SEQ ID NO: 454364 - RNA, 18 nt, Brucella suis 1330
cauuaauggcaucgguuu

SEQ ID NO: 454365 - RNA, 21 nt, Brucella suis 1330
cauuacaaaaauggaaaaacc

SEQ ID NO: 454366 - RNA, 23 nt, Brucella suis 1330
cauuacaaaaauggaaaaacccg

SEQ ID NO: 454367 - RNA, 19 nt, Brucella suis 1330
cauggugucauagaccaug

SEQ ID NO: 454368 - RNA, 22 nt, Brucella suis 1330
caugguccgcaccauucugccc

SEQ ID NO: 454369 - RNA, 21 nt, Brucella suis 1330
cauuaaagccauacgacaaua

SEQ ID NO: 454370 - RNA, 14 nt, Brucella suis 1330
caugggcggcggcc

SEQ ID NO: 454371 - RNA, 16 nt, Brucella suis 1330
cauggguggccgccac

SEQ ID NO: 454372 - RNA, 20 nt, Brucella suis 1330
cauggguggccgccacccau

SEQ ID NO: 454373 - RNA, 17 nt, Brucella suis 1330
cauggguggugcccggu

SEQ ID NO: 454374 - RNA, 24 nt, Brucella suis 1330
cauggcugcaacaccaauagcugc

SEQ ID NO: 454375 - RNA, 20 nt, Brucella suis 1330
cauggcuugagcgucaggcc

SEQ ID NO: 454376 - RNA, 15 nt, Brucella suis 1330
cauggaucaacgcag

SEQ ID NO: 454377 - RNA, 15 nt, Brucella suis 1330
cauggauggaauauc

SEQ ID NO: 454378 - RNA, 20 nt, Brucella suis 1330
caugcggugcacgaauugca

SEQ ID NO: 454379 - RNA, 16 nt, Brucella suis 1330
caugcggccagccuau

SEQ ID NO: 454380 - RNA, 18 nt, Brucella suis 1330
caugcgcgcccucgcgcu

SEQ ID NO: 454381 - RNA, 19 nt, Brucella suis 1330
caugcgccagagcauuuuc

SEQ ID NO: 454382 - RNA, 20 nt, Brucella suis 1330
caugcgauagcggcgcggca

SEQ ID NO: 454383 - RNA, 16 nt, Brucella suis 1330
caugccugccgcagcc

SEQ ID NO: 454384 - RNA, 20 nt, Brucella suis 1330
caugccuucccgccagccgu

SEQ ID NO: 454385 - RNA, 20 nt, Brucella suis 1330
caugcccgucagcgcgccgu

SEQ ID NO: 454386 - RNA, 14 nt, Brucella suis 1330
caugcccaugcagu

SEQ ID NO: 454387 - RNA, 18 nt, Brucella suis 1330
caugcccaucaaccgugc

SEQ ID NO: 454388 - RNA, 18 nt, Brucella suis 1330
caugcagacgggacgcag

SEQ ID NO: 454389 - RNA, 21 nt, Brucella suis 1330
caugaaacccgcgaucaccag

SEQ ID NO: 454390 - RNA, 16 nt, Brucella suis 1330
caucuuugcggcgcgc

SEQ ID NO: 454391 - RNA, 21 nt, Brucella suis 1330
caucuuauaaaaaggccgcuc

SEQ ID NO: 454392 - RNA, 15 nt, Brucella suis 1330
caucuucaccuguuc

SEQ ID NO: 454393 - RNA, 13 nt, Brucella suis 1330
caucugccaacca

SEQ ID NO: 454394 - RNA, 19 nt, Brucella suis 1330
caucggggcgagcgcgcca

SEQ ID NO: 454395 - RNA, 18 nt, Brucella suis 1330
caucggcucauccuccac

SEQ ID NO: 454396 - RNA, 21 nt, Brucella suis 1330
caucgcgccgcaacucuuuau

SEQ ID NO: 454397 - RNA, 15 nt, Brucella suis 1330
caucgccuguuccuu

SEQ ID NO: 454398 - RNA, 17 nt, Brucella suis 1330
caucgaguuccgggcuc

SEQ ID NO: 454399 - RNA, 20 nt, Brucella suis 1330
caucgaucacaugcgcgccc

SEQ ID NO: 454400 - RNA, 20 nt, Brucella suis 1330
caucgacaaucuccccuucc

SEQ ID NO: 454401 - RNA, 18 nt, Brucella suis 1330
cauccuugaugcccagcu

SEQ ID NO: 454402 - RNA, 19 nt, Brucella suis 1330
cauccuugaugcccagcuc

SEQ ID NO: 454403 - RNA, 13 nt, Brucella suis 1330
cauccucgccaag

SEQ ID NO: 454404 - RNA, 13 nt, Brucella suis 1330
cauccagaacuuc

SEQ ID NO: 454405 - RNA, 21 nt, Brucella suis 1330
cauccagaacuucgccaagcc

SEQ ID NO: 454406 - RNA, 21 nt, Brucella suis 1330
cauccgccugcgcaugggacu

SEQ ID NO: 454407 - RNA, 16 nt, Brucella suis 1330
cauccggcggcgccca

SEQ ID NO: 454408 - RNA, 14 nt, Brucella suis 1330
caucaucgucuuca

SEQ ID NO: 454409 - RNA, 21 nt, Brucella suis 1330
caucaucgucuucaagcacgc

SEQ ID NO: 454410 - RNA, 19 nt, Brucella suis 1330
caucaucguggcggcaaaa

SEQ ID NO: 454411 - RNA, 13 nt, Brucella suis 1330
caucauugaacug

SEQ ID NO: 454412 - RNA, 18 nt, Brucella suis 1330
caucagucgaauuucagc

SEQ ID NO: 454413 - RNA, 13 nt, Brucella suis 1330
caucagccgggca

SEQ ID NO: 454414 - RNA, 21 nt, Brucella suis 1330
caucagccgggcagugccgga

SEQ ID NO: 454415 - RNA, 20 nt, Brucella suis 1330
caucaccauugcccaaugcg

SEQ ID NO: 454416 - RNA, 13 nt, Brucella suis 1330
cauauaggauucu

SEQ ID NO: 454417 - RNA, 17 nt, Brucella suis 1330
cauaccgucgaggaaaa

SEQ ID NO: 454418 - RNA, 20 nt, Brucella suis 1330
cauacuccccuacucccuua

SEQ ID NO: 454419 - RNA, 17 nt, Brucella suis 1330
cauaaucggcaucggaa

SEQ ID NO: 454420 - RNA, 14 nt, Brucella suis 1330
cauaaucuuuuugc

SEQ ID NO: 454421 - RNA, 23 nt, Brucella suis 1330
cauaaccucgacggcggccuugg

SEQ ID NO: 454422 - RNA, 23 nt, Brucella suis 1330
caguugucgccgggcugcuucuc

SEQ ID NO: 454423 - RNA, 19 nt, Brucella suis 1330
cauaaagauuguaauccau

SEQ ID NO: 454424 - RNA, 12 nt, Brucella suis 1330
cauaaagcacca

SEQ ID NO: 454425 - RNA, 13 nt, Brucella suis 1330
cauaaagcaccau

SEQ ID NO: 454426 - RNA, 20 nt, Brucella suis 1330
cagugaauacuaaucgcaaa

SEQ ID NO: 454427 - RNA, 22 nt, Brucella suis 1330
cagugagcagaagaaagggcgc

SEQ ID NO: 454428 - RNA, 18 nt, Brucella suis 1330
cagugccaccagaugguc

SEQ ID NO: 454429 - RNA, 21 nt, Brucella suis 1330
caguggcaugggagcaccgca

SEQ ID NO: 454430 - RNA, 19 nt, Brucella suis 1330
cagucgagaaaaagaugcg

SEQ ID NO: 454431 - RNA, 22 nt, Brucella suis 1330
cagucacgguugccuugcugaa

SEQ ID NO: 454432 - RNA, 18 nt, Brucella suis 1330
cagguggcugcccgccgc

SEQ ID NO: 454433 - RNA, 21 nt, Brucella suis 1330
cagggucaaaauggccucaga

SEQ ID NO: 454434 - RNA, 17 nt, Brucella suis 1330
caggggugcaaagcuuu

SEQ ID NO: 454435 - RNA, 13 nt, Brucella suis 1330
caggggcagcgcg

SEQ ID NO: 454436 - RNA, 21 nt, Brucella suis 1330
cagggcugccgcacagcauca

SEQ ID NO: 454437 - RNA, 22 nt, Brucella suis 1330
cagggcggaucgugacccgccc

SEQ ID NO: 454438 - RNA, 19 nt, Brucella suis 1330
cagggcgauggauaaagca

SEQ ID NO: 454439 - RNA, 19 nt, Brucella suis 1330
cagggccagaucgcgcgcg

SEQ ID NO: 454440 - RNA, 20 nt, Brucella suis 1330
cagggcauggguggccgcca

SEQ ID NO: 454441 - RNA, 18 nt, Brucella suis 1330
cagggacgagcggcaggc

SEQ ID NO: 454442 - RNA, 14 nt, Brucella suis 1330
caggcuccguugcu

SEQ ID NO: 454443 - RNA, 20 nt, Brucella suis 1330
caggcucccgccugcaauga

SEQ ID NO: 454444 - RNA, 21 nt, Brucella suis 1330
caggcgcgcagcaaccaucau

SEQ ID NO: 454445 - RNA, 16 nt, Brucella suis 1330
caggcgcgaucaugcc

SEQ ID NO: 454446 - RNA, 23 nt, Brucella suis 1330
caggcgcauucgggucacccggc

SEQ ID NO: 454447 - RNA, 14 nt, Brucella suis 1330
caggcgccagccca

SEQ ID NO: 454448 - RNA, 18 nt, Brucella suis 1330
caggcgcaggcccugcau

SEQ ID NO: 454449 - RNA, 19 nt, Brucella suis 1330
caggccgauccugcgcccu

SEQ ID NO: 454450 - RNA, 23 nt, Brucella suis 1330
caggccgagcgcaucggccagcu

SEQ ID NO: 454451 - RNA, 17 nt, Brucella suis 1330
caggcagcgcgguuuuu

SEQ ID NO: 454452 - RNA, 20 nt, Brucella suis 1330
caggcagaugcgaagcggau

SEQ ID NO: 454453 - RNA, 19 nt, Brucella suis 1330
caggcagacggacuucuuc

SEQ ID NO: 454454 - RNA, 14 nt, Brucella suis 1330
caggcacucuccuc

SEQ ID NO: 454455 - RNA, 22 nt, Brucella suis 1330
caggcacucuccucugccugcu

SEQ ID NO: 454456 - RNA, 23 nt, Brucella suis 1330
caggcacucuccucugccugcug

SEQ ID NO: 454457 - RNA, 15 nt, Brucella suis 1330
caggaucgacagccg

SEQ ID NO: 454458 - RNA, 16 nt, Brucella suis 1330
caggaucgccagaagc

SEQ ID NO: 454459 - RNA, 17 nt, Brucella suis 1330
caggaucuuccaucugg

SEQ ID NO: 454460 - RNA, 12 nt, Brucella suis 1330
caggagcggaag

SEQ ID NO: 454461 - RNA, 15 nt, Brucella suis 1330
caggaggccaaaaag

SEQ ID NO: 454462 - RNA, 18 nt, Brucella suis 1330
caggaccggcgaaaaggc

SEQ ID NO: 454463 - RNA, 23 nt, Brucella suis 1330
caggaccgcgaggaagccugcac

SEQ ID NO: 454464 - RNA, 17 nt, Brucella suis 1330
caggaauacgcccugca

SEQ ID NO: 454465 - RNA, 18 nt, Brucella suis 1330
caggaaucauuuucucaa

SEQ ID NO: 454466 - RNA, 20 nt, Brucella suis 1330
caggaaucauuuucucaaga

SEQ ID NO: 454467 - RNA, 17 nt, Brucella suis 1330
caggaacgcaucgagcu

SEQ ID NO: 454468 - RNA, 14 nt, Brucella suis 1330
cagcuugaccagau

SEQ ID NO: 454469 - RNA, 15 nt, Brucella suis 1330
cagcuugaccagaua

SEQ ID NO: 454470 - RNA, 17 nt, Brucella suis 1330
cagcuuauuccugcggc

SEQ ID NO: 454471 - RNA, 16 nt, Brucella suis 1330
cagcucguccaugagc

SEQ ID NO: 454472 - RNA, 15 nt, Brucella suis 1330
cagcucggcuucaaa

SEQ ID NO: 454473 - RNA, 15 nt, Brucella suis 1330
cagcucauggccacg

SEQ ID NO: 454474 - RNA, 19 nt, Brucella suis 1330
cagcggcggguagccgcca

SEQ ID NO: 454475 - RNA, 22 nt, Brucella suis 1330
cagcggcgcgccugggcuuuca

SEQ ID NO: 454476 - RNA, 15 nt, Brucella suis 1330
cagcggccaucuucc

SEQ ID NO: 454477 - RNA, 21 nt, Brucella suis 1330
cagcggcaucaucgucggcca

SEQ ID NO: 454478 - RNA, 14 nt, Brucella suis 1330
cagcgccgcgccca

SEQ ID NO: 454479 - RNA, 15 nt, Brucella suis 1330
cagcgccgaggcgca

SEQ ID NO: 454480 - RNA, 14 nt, Brucella suis 1330
cagcgccacgccuu

SEQ ID NO: 454481 - RNA, 23 nt, Brucella suis 1330
cagcgcauuuucauugccgggcg

SEQ ID NO: 454482 - RNA, 18 nt, Brucella suis 1330
cagcgcaaagcgcgcgcc

SEQ ID NO: 454483 - RNA, 19 nt, Brucella suis 1330
cagcgcaaagcgcgcgcca

SEQ ID NO: 454484 - RNA, 18 nt, Brucella suis 1330
cagcgauugcaccauggu

SEQ ID NO: 454485 - RNA, 18 nt, Brucella suis 1330
cagcgauugcgcauugac

SEQ ID NO: 454486 - RNA, 23 nt, Brucella suis 1330
cagcgaugauagcgcccgccucg

SEQ ID NO: 454487 - RNA, 18 nt, Brucella suis 1330
cagcgauggcgacgcgcu

SEQ ID NO: 454488 - RNA, 21 nt, Brucella suis 1330
cagcgacgacaugaaggagag

SEQ ID NO: 454489 - RNA, 21 nt, Brucella suis 1330
cagcgacaggguaagcgccuu

SEQ ID NO: 454490 - RNA, 19 nt, Brucella suis 1330
cagcgacagcggcgcgccu

SEQ ID NO: 454491 - RNA, 22 nt, Brucella suis 1330
cagcgaauagaccaugccgcca

SEQ ID NO: 454492 - RNA, 16 nt, Brucella suis 1330
cagccuugcccuggcu

SEQ ID NO: 454493 - RNA, 22 nt, Brucella suis 1330
cagccuucccgggagaaaagau

SEQ ID NO: 454494 - RNA, 16 nt, Brucella suis 1330
cagccuggaugacauc

SEQ ID NO: 454495 - RNA, 20 nt, Brucella suis 1330
cagccugcugcauccugcuc

SEQ ID NO: 454496 - RNA, 16 nt, Brucella suis 1330
cagccguuccggcucg

SEQ ID NO: 454497 - RNA, 21 nt, Brucella suis 1330
cagccguuccagggcgcgcca

SEQ ID NO: 454498 - RNA, 23 nt, Brucella suis 1330
cagccguugcgaucuucugcucg

SEQ ID NO: 454499 - RNA, 12 nt, Brucella suis 1330
cagccgggcagu

SEQ ID NO: 454500 - RNA, 16 nt, Brucella suis 1330
cagccgggcagugccg

SEQ ID NO: 454501 - RNA, 15 nt, Brucella suis 1330
cagccgcgaucacag

SEQ ID NO: 454502 - RNA, 21 nt, Brucella suis 1330
cagccgcgaucacagccgcgc

SEQ ID NO: 454503 - RNA, 21 nt, Brucella suis 1330
cagccgcccgccuuggaaacc

SEQ ID NO: 454504 - RNA, 23 nt, Brucella suis 1330
cagccgaucaucagcgaauaggg

SEQ ID NO: 454505 - RNA, 13 nt, Brucella suis 1330
cagccgaaaugag

SEQ ID NO: 454506 - RNA, 22 nt, Brucella suis 1330
cagcccgccccaagaucagcca

SEQ ID NO: 454507 - RNA, 17 nt, Brucella suis 1330
cagccccuugccccggc

SEQ ID NO: 454508 - RNA, 22 nt, Brucella suis 1330
cagcccgaagcgcaaagcccgc

SEQ ID NO: 454509 - RNA, 18 nt, Brucella suis 1330
cagccccgcaauaacgaa

SEQ ID NO: 454510 - RNA, 13 nt, Brucella suis 1330
cagccccgccaga

SEQ ID NO: 454511 - RNA, 17 nt, Brucella suis 1330
cagccaucaggauuugg

SEQ ID NO: 454512 - RNA, 11 nt, Brucella suis 1330
cagccagccga

SEQ ID NO: 454513 - RNA, 20 nt, Brucella suis 1330
cagccagaaagaagaugagc

SEQ ID NO: 454514 - RNA, 15 nt, Brucella suis 1330
cagcauuucagggcu

SEQ ID NO: 454515 - RNA, 22 nt, Brucella suis 1330
cagcauugaacgccuuuuucac

SEQ ID NO: 454516 - RNA, 21 nt, Brucella suis 1330
cagcaugucauccgaaaccag

SEQ ID NO: 454517 - RNA, 14 nt, Brucella suis 1330
cagcaugaucgcca

SEQ ID NO: 454518 - RNA, 11 nt, Brucella suis 1330
cagcaucaugc

SEQ ID NO: 454519 - RNA, 22 nt, Brucella suis 1330
cagcauauugccgagcauggcc

SEQ ID NO: 454520 - RNA, 21 nt, Brucella suis 1330
cagcagguugacgauggggau

SEQ ID NO: 454521 - RNA, 15 nt, Brucella suis 1330
cagcaggccggcgag

SEQ ID NO: 454522 - RNA, 15 nt, Brucella suis 1330
cagcagcgcaaacuc

SEQ ID NO: 454523 - RNA, 20 nt, Brucella suis 1330
cagcagcaggggcagcgcgc

SEQ ID NO: 454524 - RNA, 15 nt, Brucella suis 1330
cagcacuuucgcgua

SEQ ID NO: 454525 - RNA, 15 nt, Brucella suis 1330
cagcacugaaacggg

SEQ ID NO: 454526 - RNA, 13 nt, Brucella suis 1330
cagcaccggcgga

SEQ ID NO: 454527 - RNA, 13 nt, Brucella suis 1330
cagcaccgcgcca

SEQ ID NO: 454528 - RNA, 20 nt, Brucella suis 1330
cagcaauuccugcgccaccu

SEQ ID NO: 454529 - RNA, 18 nt, Brucella suis 1330
cagcaaccgaaagcgccu

SEQ ID NO: 454530 - RNA, 16 nt, Brucella suis 1330
cagcaaccaucaucuc

SEQ ID NO: 454531 - RNA, 16 nt, Brucella suis 1330
cagcaaauucaaagaa

SEQ ID NO: 454532 - RNA, 13 nt, Brucella suis 1330
cagcaaagcccca

SEQ ID NO: 454533 - RNA, 19 nt, Brucella suis 1330
cagauugccgcgcgcggcu

SEQ ID NO: 454534 - RNA, 14 nt, Brucella suis 1330
cagauuggcaacau

SEQ ID NO: 454535 - RNA, 13 nt, Brucella suis 1330
cagauugucuuga

SEQ ID NO: 454536 - RNA, 14 nt, Brucella suis 1330
cagcaaaaccguau

SEQ ID NO: 454537 - RNA, 16 nt, Brucella suis 1330
cagcaaaagugagaaa

SEQ ID NO: 454538 - RNA, 17 nt, Brucella suis 1330
cagcaaaagugagaaac

SEQ ID NO: 454539 - RNA, 22 nt, Brucella suis 1330
cagauggcguucugaaaccgca

SEQ ID NO: 454540 - RNA, 16 nt, Brucella suis 1330
cagauugaucgcaagc

SEQ ID NO: 454541 - RNA, 19 nt, Brucella suis 1330
cagauugaucgcaagccaa

SEQ ID NO: 454542 - RNA, 20 nt, Brucella suis 1330
cagaugcggcgcgcauuuuc

SEQ ID NO: 454543 - RNA, 20 nt, Brucella suis 1330
cagaugaucauaacagaugc

SEQ ID NO: 454544 - RNA, 22 nt, Brucella suis 1330
cagaugcagcggaacuggauga

SEQ ID NO: 454545 - RNA, 15 nt, Brucella suis 1330
cagaucgugaucuuc

SEQ ID NO: 454546 - RNA, 20 nt, Brucella suis 1330
cagaucgcgcggcgaaacgc

SEQ ID NO: 454547 - RNA, 17 nt, Brucella suis 1330
cagaucggaaucaaaac

SEQ ID NO: 454548 - RNA, 15 nt, Brucella suis 1330
cagauccgcugacug

SEQ ID NO: 454549 - RNA, 20 nt, Brucella suis 1330
cagaucgacagcggaagcgc

SEQ ID NO: 454550 - RNA, 22 nt, Brucella suis 1330
cagaucgaaaugcgcucuagac

SEQ ID NO: 454551 - RNA, 18 nt, Brucella suis 1330
cagaucccguuuugagau

SEQ ID NO: 454552 - RNA, 13 nt, Brucella suis 1330
cagaucaucguca

SEQ ID NO: 454553 - RNA, 19 nt, Brucella suis 1330
cagaucaucgucaugcaga

SEQ ID NO: 454554 - RNA, 21 nt, Brucella suis 1330
cagaucaucgucaugcagacg

SEQ ID NO: 454555 - RNA, 18 nt, Brucella suis 1330
cagaucaugaggacauuc

SEQ ID NO: 454556 - RNA, 14 nt, Brucella suis 1330
cagauauccauugu

SEQ ID NO: 454557 - RNA, 13 nt, Brucella suis 1330
cagauaaagcagg

SEQ ID NO: 454558 - RNA, 22 nt, Brucella suis 1330
cagauaaagcaggaucgacagc

SEQ ID NO: 454559 - RNA, 15 nt, Brucella suis 1330
cagagcuucgccgcc

SEQ ID NO: 454560 - RNA, 18 nt, Brucella suis 1330
cagagccuguuccaaaag

SEQ ID NO: 454561 - RNA, 22 nt, Brucella suis 1330
cagagcgauuucuggagccgcu

SEQ ID NO: 454562 - RNA, 15 nt, Brucella suis 1330
cagagcggguuccca

SEQ ID NO: 454563 - RNA, 16 nt, Brucella suis 1330
cagagcggguucccac

SEQ ID NO: 454564 - RNA, 22 nt, Brucella suis 1330
cagagcgguuccuguuuuaaca

SEQ ID NO: 454565 - RNA, 14 nt, Brucella suis 1330
cagacguuccagau

SEQ ID NO: 454566 - RNA, 14 nt, Brucella suis 1330
cagagacaggaaaa

SEQ ID NO: 454567 - RNA, 12 nt, Brucella suis 1330
cagagcaaauac

SEQ ID NO: 454568 - RNA, 16 nt, Brucella suis 1330
cagaccaucggcaaca

SEQ ID NO: 454569 - RNA, 23 nt, Brucella suis 1330
cagaccgcccccucgcaaccaug

SEQ ID NO: 454570 - RNA, 19 nt, Brucella suis 1330
cagacauggaagaugacgc

SEQ ID NO: 454571 - RNA, 14 nt, Brucella suis 1330
cagaauaucugaau

SEQ ID NO: 454572 - RNA, 17 nt, Brucella suis 1330
cagaauaucugaaucuc

SEQ ID NO: 454573 - RNA, 20 nt, Brucella suis 1330
cagaauggcgauaucaccaa

SEQ ID NO: 454574 - RNA, 21 nt, Brucella suis 1330
cagaauuuggaaguuuuccug

SEQ ID NO: 454575 - RNA, 13 nt, Brucella suis 1330
cagaagugcugcu

SEQ ID NO: 454576 - RNA, 20 nt, Brucella suis 1330
cagaagguuucagccuccug

SEQ ID NO: 454577 - RNA, 23 nt, Brucella suis 1330
cagaagaucgucggcaagcugga

SEQ ID NO: 454578 - RNA, 18 nt, Brucella suis 1330
cagaagcguaaugccccg

SEQ ID NO: 454579 - RNA, 21 nt, Brucella suis 1330
cagaaccugcccgucuuccuc

SEQ ID NO: 454580 - RNA, 15 nt, Brucella suis 1330
cagaaccgcaucgac

SEQ ID NO: 454581 - RNA, 17 nt, Brucella suis 1330
cagaaccaccagagcaa

SEQ ID NO: 454582 - RNA, 17 nt, Brucella suis 1330
cagaacuucgccaagcc

SEQ ID NO: 454583 - RNA, 13 nt, Brucella suis 1330
cagaagaaagggc

SEQ ID NO: 454584 - RNA, 15 nt, Brucella suis 1330
cagaaagaaagcugu

SEQ ID NO: 454585 - RNA, 10 nt, Brucella suis 1330
cagaaaucag

SEQ ID NO: 454586 - RNA, 17 nt, Brucella suis 1330
cagaaauccacuacaac

SEQ ID NO: 454587 - RNA, 22 nt, Brucella suis 1330
cagaaauggccccauaaagcug

SEQ ID NO: 454588 - RNA, 16 nt, Brucella suis 1330
cagaacacgcgcaccg

SEQ ID NO: 454589 - RNA, 22 nt, Brucella suis 1330
cacuucuuuauggcucagagaa

SEQ ID NO: 454590 - RNA, 22 nt, Brucella suis 1330
cacuucccgcgccucacccucc

SEQ ID NO: 454591 - RNA, 21 nt, Brucella suis 1330
cacuucgaucgacccgccaug

SEQ ID NO: 454592 - RNA, 14 nt, Brucella suis 1330
cacuuacaaaugca

SEQ ID NO: 454593 - RNA, 17 nt, Brucella suis 1330
cacuuacaaaugcaagu

SEQ ID NO: 454594 - RNA, 17 nt, Brucella suis 1330
cacugggcgacccagcc

SEQ ID NO: 454595 - RNA, 21 nt, Brucella suis 1330
cacuggaaauauucgggcggc

SEQ ID NO: 454596 - RNA, 22 nt, Brucella suis 1330
cacuggaaauauucgggcggca

SEQ ID NO: 454597 - RNA, 23 nt, Brucella suis 1330
cacuggcaacgacggcuguuuuc

SEQ ID NO: 454598 - RNA, 19 nt, Brucella suis 1330
cacugcaaaaaauaccagu

SEQ ID NO: 454599 - RNA, 14 nt, Brucella suis 1330
cacugcaaggaagg

SEQ ID NO: 454600 - RNA, 22 nt, Brucella suis 1330
cacugcaaggaaggucagaaga

SEQ ID NO: 454601 - RNA, 20 nt, Brucella suis 1330
caaugugcgggcuucuucca

SEQ ID NO: 454602 - RNA, 14 nt, Brucella suis 1330
caaugggcggggcu

SEQ ID NO: 454603 - RNA, 19 nt, Brucella suis 1330
caauggcugucaaugcagc

SEQ ID NO: 454604 - RNA, 15 nt, Brucella suis 1330
caauggccgcgcggu

SEQ ID NO: 454605 - RNA, 17 nt, Brucella suis 1330
caaugacggcauuuugc

SEQ ID NO: 454606 - RNA, 21 nt, Brucella suis 1330
caaugacggcauuuugcgaaa

SEQ ID NO: 454607 - RNA, 12 nt, Brucella suis 1330
caaugaacaaca

SEQ ID NO: 454608 - RNA, 15 nt, Brucella suis 1330
caaugaagcaaaggu

SEQ ID NO: 454609 - RNA, 21 nt, Brucella suis 1330
caaugaaagcaacgcccuuca

SEQ ID NO: 454610 - RNA, 15 nt, Brucella suis 1330
caaucuugaccuggc

SEQ ID NO: 454611 - RNA, 19 nt, Brucella suis 1330
caaucuugccaacauggcu

SEQ ID NO: 454612 - RNA, 17 nt, Brucella suis 1330
caaugaucuggcgcgcg

SEQ ID NO: 454613 - RNA, 17 nt, Brucella suis 1330
caaugaucuggcuugca

SEQ ID NO: 454614 - RNA, 16 nt, Brucella suis 1330
caaugcaacgaaggau

SEQ ID NO: 454615 - RNA, 19 nt, Brucella suis 1330
caaucucaaaacgcggaag

SEQ ID NO: 454616 - RNA, 14 nt, Brucella suis 1330
caauccggcagcuu

SEQ ID NO: 454617 - RNA, 17 nt, Brucella suis 1330
caauaggacgaaauuug

SEQ ID NO: 454618 - RNA, 22 nt, Brucella suis 1330
caaggggcggaacaggcagcau

SEQ ID NO: 454619 - RNA, 19 nt, Brucella suis 1330
caaggcggcuggaacgagc

SEQ ID NO: 454620 - RNA, 18 nt, Brucella suis 1330
caagggccgcaucggaag

SEQ ID NO: 454621 - RNA, 20 nt, Brucella suis 1330
caagggccgcaucggaaggg

SEQ ID NO: 454622 - RNA, 21 nt, Brucella suis 1330
caaggagcgagcuugcaauga

SEQ ID NO: 454623 - RNA, 14 nt, Brucella suis 1330
caaggaaaaaaccg

SEQ ID NO: 454624 - RNA, 19 nt, Brucella suis 1330
caaggaaagaucugcaucc

SEQ ID NO: 454625 - RNA, 16 nt, Brucella suis 1330
caagcggcgucaggcc

SEQ ID NO: 454626 - RNA, 15 nt, Brucella suis 1330
caagcggcuccacca

SEQ ID NO: 454627 - RNA, 16 nt, Brucella suis 1330
caagcggcuccaccac

SEQ ID NO: 454628 - RNA, 18 nt, Brucella suis 1330
caagcgucuucugagaaa

SEQ ID NO: 454629 - RNA, 19 nt, Brucella suis 1330
caagcgucuucugagaaaa

SEQ ID NO: 454630 - RNA, 13 nt, Brucella suis 1330
caagccccagcac

SEQ ID NO: 454631 - RNA, 12 nt, Brucella suis 1330
caagccaaagcc

SEQ ID NO: 454632 - RNA, 18 nt, Brucella suis 1330
caagcauuccgggccgca

SEQ ID NO: 454633 - RNA, 15 nt, Brucella suis 1330
caagcaggcauuggc

SEQ ID NO: 454634 - RNA, 15 nt, Brucella suis 1330
caagcagggcauggg

SEQ ID NO: 454635 - RNA, 16 nt, Brucella suis 1330
caagcagaugcagcgg

SEQ ID NO: 454636 - RNA, 13 nt, Brucella suis 1330
caacuuccuugcc

SEQ ID NO: 454637 - RNA, 18 nt, Brucella suis 1330
caacuucgggggaaugcg

SEQ ID NO: 454638 - RNA, 22 nt, Brucella suis 1330
caacgcugcaacaaaugcaaau

SEQ ID NO: 454639 - RNA, 18 nt, Brucella suis 1330
caacgcuuugaccgccgc

SEQ ID NO: 454640 - RNA, 18 nt, Brucella suis 1330
caacuggcgcagcagcac

SEQ ID NO: 454641 - RNA, 17 nt, Brucella suis 1330
caaccccgcacggucau

SEQ ID NO: 454642 - RNA, 13 nt, Brucella suis 1330
caacccauuuuca

SEQ ID NO: 454643 - RNA, 19 nt, Brucella suis 1330
caacccauuuucaugggua

SEQ ID NO: 454644 - RNA, 16 nt, Brucella suis 1330
caaccauugaucuucu

SEQ ID NO: 454645 - RNA, 15 nt, Brucella suis 1330
caaccauauaaagcu

SEQ ID NO: 454646 - RNA, 21 nt, Brucella suis 1330
caacauggugaugcgaauuuc

SEQ ID NO: 454647 - RNA, 21 nt, Brucella suis 1330
caacagggcgaaaagccgccu

SEQ ID NO: 454648 - RNA, 14 nt, Brucella suis 1330
caaccaaagaaaaa

SEQ ID NO: 454649 - RNA, 20 nt, Brucella suis 1330
caacaggaaagaguuggccc

SEQ ID NO: 454650 - RNA, 19 nt, Brucella suis 1330
caacacgcgcuccagcuca

SEQ ID NO: 454651 - RNA, 18 nt, Brucella suis 1330
caacaccaauagcugcgg

SEQ ID NO: 454652 - RNA, 19 nt, Brucella suis 1330
caaaugccgaagcccaugg

SEQ ID NO: 454653 - RNA, 17 nt, Brucella suis 1330
caaagccgaaugccagu

SEQ ID NO: 454654 - RNA, 16 nt, Brucella suis 1330
caaagaaguugggggc

SEQ ID NO: 454655 - RNA, 17 nt, Brucella suis 1330
caaaagcuccaccaccc

SEQ ID NO: 454656 - RNA, 14 nt, Brucella suis 1330
caaaagcuuuguau

SEQ ID NO: 454657 - RNA, 22 nt, Brucella suis 1330
caaaagcuuuguauuucaaugc

SEQ ID NO: 454658 - RNA, 13 nt, Brucella suis 1330
caaaagcgcgccg

SEQ ID NO: 454659 - RNA, 14 nt, Brucella suis 1330
caaaagaaaccccg

SEQ ID NO: 454660 - RNA, 14 nt, Brucella suis 1330
caaaacgcugccag

SEQ ID NO: 454661 - RNA, 18 nt, Brucella suis 1330
caaaacugaucguugaag

SEQ ID NO: 454662 - RNA, 18 nt, Brucella suis 1330
caaaaccacgguggcuca

SEQ ID NO: 454663 - RNA, 20 nt, Brucella suis 1330
caaaaccgcuucgcacuuuu

SEQ ID NO: 454664 - RNA, 12 nt, Brucella suis 1330
caaaaccgugca

SEQ ID NO: 454665 - RNA, 15 nt, Brucella suis 1330
caaaacaaaagauua

SEQ ID NO: 454666 - RNA, 18 nt, Brucella suis 1330
caaaaacgagggguuuug

SEQ ID NO: 454667 - RNA, 20 nt, Brucella suis 1330
caaaaaauaucuuuuuucaa

SEQ ID NO: 454668 - RNA, 11 nt, Brucella suis 1330
caaaaaacugg

SEQ ID NO: 454669 - RNA, 17 nt, Brucella suis 1330
auuuuuggcagcaguca

SEQ ID NO: 454670 - RNA, 23 nt, Brucella suis 1330
auuuucauggguaccuuccagca

SEQ ID NO: 454671 - RNA, 14 nt, Brucella suis 1330
auuuucgagccaaa

SEQ ID NO: 454672 - RNA, 12 nt, Brucella suis 1330
auuuucugcauc

SEQ ID NO: 454673 - RNA, 10 nt, Brucella suis 1330
auuuugauug

SEQ ID NO: 454674 - RNA, 18 nt, Brucella suis 1330
auuugaguuuuucuucca

SEQ ID NO: 454675 - RNA, 15 nt, Brucella suis 1330
auuugcgcaccagau

SEQ ID NO: 454676 - RNA, 19 nt, Brucella suis 1330
auuuguaguucaggccggc

SEQ ID NO: 454677 - RNA, 13 nt, Brucella suis 1330
auuugaacaaaga

SEQ ID NO: 454678 - RNA, 18 nt, Brucella suis 1330
auuugaacaaagaugaau

SEQ ID NO: 454679 - RNA, 15 nt, Brucella suis 1330
auuucaugaaaaugc

SEQ ID NO: 454680 - RNA, 17 nt, Brucella suis 1330
auuucaugaaaaugcca

SEQ ID NO: 454681 - RNA, 18 nt, Brucella suis 1330
auugggagcgcagugccu

SEQ ID NO: 454682 - RNA, 18 nt, Brucella suis 1330
auuggcaagcgccaugaa

SEQ ID NO: 454683 - RNA, 20 nt, Brucella suis 1330
auugcuguugcgcuccuauu

SEQ ID NO: 454684 - RNA, 22 nt, Brucella suis 1330
auugcuguugcgcuccuauuuc

SEQ ID NO: 454685 - RNA, 19 nt, Brucella suis 1330
auugccguugagaaucgca

SEQ ID NO: 454686 - RNA, 16 nt, Brucella suis 1330
auugccgcccugcgcc

SEQ ID NO: 454687 - RNA, 21 nt, Brucella suis 1330
auugcccuuccgggccgcaag

SEQ ID NO: 454688 - RNA, 17 nt, Brucella suis 1330
auugcccuaucaagaau

SEQ ID NO: 454689 - RNA, 19 nt, Brucella suis 1330
auugcccuaucaagaaugu

SEQ ID NO: 454690 - RNA, 15 nt, Brucella suis 1330
auugcacagcggucg

SEQ ID NO: 454691 - RNA, 16 nt, Brucella suis 1330
auugcacagcggucga

SEQ ID NO: 454692 - RNA, 15 nt, Brucella suis 1330
auucaggaucuuucc

SEQ ID NO: 454693 - RNA, 22 nt, Brucella suis 1330
auucugcuuaucaaggccgggc

SEQ ID NO: 454694 - RNA, 22 nt, Brucella suis 1330
auugucaggaaaaaucuguuca

SEQ ID NO: 454695 - RNA, 17 nt, Brucella suis 1330
auuguuccagccgggcu

SEQ ID NO: 454696 - RNA, 23 nt, Brucella suis 1330
auuguuccggcacucgaaaauca

SEQ ID NO: 454697 - RNA, 10 nt, Brucella suis 1330
auuguugcga

SEQ ID NO: 454698 - RNA, 18 nt, Brucella suis 1330
auuucagcaggcguugca

SEQ ID NO: 454699 - RNA, 17 nt, Brucella suis 1330
auuauuuagauuugcuu

SEQ ID NO: 454700 - RNA, 18 nt, Brucella suis 1330
auuauccugaaaauacuc

SEQ ID NO: 454701 - RNA, 22 nt, Brucella suis 1330
auuaucgcgaagaagaauacgc

SEQ ID NO: 454702 - RNA, 19 nt, Brucella suis 1330
auuaucggcggcuuccucg

SEQ ID NO: 454703 - RNA, 21 nt, Brucella suis 1330
auuaucuuccugcgaaaaccu

SEQ ID NO: 454704 - RNA, 14 nt, Brucella suis 1330
auuauuuuuacaaa

SEQ ID NO: 454705 - RNA, 15 nt, Brucella suis 1330
auuauuuuuacaaaa

SEQ ID NO: 454706 - RNA, 16 nt, Brucella suis 1330
auuauuuuuacaaaaa

SEQ ID NO: 454707 - RNA, 12 nt, Brucella suis 1330
auucaaaacaug

SEQ ID NO: 454708 - RNA, 19 nt, Brucella suis 1330
auucagagcgauuucugga

SEQ ID NO: 454709 - RNA, 14 nt, Brucella suis 1330
auuaguaucggcag

SEQ ID NO: 454710 - RNA, 22 nt, Brucella suis 1330
auuagagcgccgaucugauuca

SEQ ID NO: 454711 - RNA, 14 nt, Brucella suis 1330
auuagauacauaua

SEQ ID NO: 454712 - RNA, 21 nt, Brucella suis 1330
auuacaaaaauggaaaaaccc

SEQ ID NO: 454713 - RNA, 12 nt, Brucella suis 1330
auuacggccagc

SEQ ID NO: 454714 - RNA, 19 nt, Brucella suis 1330
auguucaaggcugcucaga

SEQ ID NO: 454715 - RNA, 22 nt, Brucella suis 1330
auguuugguuuuagaagcuuuu

SEQ ID NO: 454716 - RNA, 12 nt, Brucella suis 1330
auguggaaggcg

SEQ ID NO: 454717 - RNA, 19 nt, Brucella suis 1330
auguccggcgcgcugcaau

SEQ ID NO: 454718 - RNA, 24 nt, Brucella suis 1330
augguuucggcgucugccggagcg

SEQ ID NO: 454719 - RNA, 22 nt, Brucella suis 1330
augguuugcagcaauuccugcg

SEQ ID NO: 454720 - RNA, 21 nt, Brucella suis 1330
auggucugcgccaguuccuga

SEQ ID NO: 454721 - RNA, 16 nt, Brucella suis 1330
auggugucauagacca

SEQ ID NO: 454722 - RNA, 22 nt, Brucella suis 1330
auggggcaccaugcggcuccag

SEQ ID NO: 454723 - RNA, 14 nt, Brucella suis 1330
augggcgcaccgca

SEQ ID NO: 454724 - RNA, 13 nt, Brucella suis 1330
augggcggccacg

SEQ ID NO: 454725 - RNA, 21 nt, Brucella suis 1330
augggcggggagcaggcaggc

SEQ ID NO: 454726 - RNA, 19 nt, Brucella suis 1330
augggcgguauugcugccg

SEQ ID NO: 454727 - RNA, 14 nt, Brucella suis 1330
augggcaagacaga

SEQ ID NO: 454728 - RNA, 16 nt, Brucella suis 1330
auggcucagagaagug

SEQ ID NO: 454729 - RNA, 21 nt, Brucella suis 1330
auggcucaugcggguggguuu

SEQ ID NO: 454730 - RNA, 10 nt, Brucella suis 1330
auggcggcgc

SEQ ID NO: 454731 - RNA, 17 nt, Brucella suis 1330
auggcgggccauuucca

SEQ ID NO: 454732 - RNA, 18 nt, Brucella suis 1330
auggcgggccauuuccaa

SEQ ID NO: 454733 - RNA, 14 nt, Brucella suis 1330
auggcggaauagcg

SEQ ID NO: 454734 - RNA, 16 nt, Brucella suis 1330
auggcggagagcgcga

SEQ ID NO: 454735 - RNA, 19 nt, Brucella suis 1330
auggcccagaaccugcccg

SEQ ID NO: 454736 - RNA, 15 nt, Brucella suis 1330
auggcagaccccauc

SEQ ID NO: 454737 - RNA, 14 nt, Brucella suis 1330
augcgcaugaucau

SEQ ID NO: 454738 - RNA, 15 nt, Brucella suis 1330
augcgcaaccaaaac

SEQ ID NO: 454739 - RNA, 19 nt, Brucella suis 1330
augcgcaaccaaaacauac

SEQ ID NO: 454740 - RNA, 16 nt, Brucella suis 1330
augcgcaaaacgcuug

SEQ ID NO: 454741 - RNA, 21 nt, Brucella suis 1330
augcgcaaaacgcuugacgaa

SEQ ID NO: 454742 - RNA, 14 nt, Brucella suis 1330
augccuuucagguc

SEQ ID NO: 454743 - RNA, 15 nt, Brucella suis 1330
augccuuucaggucg

SEQ ID NO: 454744 - RNA, 15 nt, Brucella suis 1330
augccugccgcagcc

SEQ ID NO: 454745 - RNA, 17 nt, Brucella suis 1330
augccugccgcagccag

SEQ ID NO: 454746 - RNA, 17 nt, Brucella suis 1330
augccguuuucaucaaa

SEQ ID NO: 454747 - RNA, 21 nt, Brucella suis 1330
augccguuuucaucaaauuug

SEQ ID NO: 454748 - RNA, 23 nt, Brucella suis 1330
augccgugcacuucgagcaggcg

SEQ ID NO: 454749 - RNA, 15 nt, Brucella suis 1330
augccggcgaucuuu

SEQ ID NO: 454750 - RNA, 22 nt, Brucella suis 1330
augccgcaugauaggcaacauc

SEQ ID NO: 454751 - RNA, 13 nt, Brucella suis 1330
augccgaagccag

SEQ ID NO: 454752 - RNA, 19 nt, Brucella suis 1330
augcccggcgcgaccgcgu

SEQ ID NO: 454753 - RNA, 22 nt, Brucella suis 1330
augcccggcgcgaccgcguuca

SEQ ID NO: 454754 - RNA, 21 nt, Brucella suis 1330
augcccaucaaccgugcauuc

SEQ ID NO: 454755 - RNA, 20 nt, Brucella suis 1330
augcagcgccgcgcccacca

SEQ ID NO: 454756 - RNA, 23 nt, Brucella suis 1330
augcagcggcgcacucaucaaaa

SEQ ID NO: 454757 - RNA, 20 nt, Brucella suis 1330
augcaagccggucugucauu

SEQ ID NO: 454758 - RNA, 19 nt, Brucella suis 1330
augauugucugcgugauau

SEQ ID NO: 454759 - RNA, 22 nt, Brucella suis 1330
augauuuccucagcgguaaagg

SEQ ID NO: 454760 - RNA, 14 nt, Brucella suis 1330
augauggcccuugu

SEQ ID NO: 454761 - RNA, 20 nt, Brucella suis 1330
augaugacggcgauaaucca

SEQ ID NO: 454762 - RNA, 17 nt, Brucella suis 1330
augacauccaugaaagc

SEQ ID NO: 454763 - RNA, 19 nt, Brucella suis 1330
augaauggggggcaggcaa

SEQ ID NO: 454764 - RNA, 13 nt, Brucella suis 1330
augacgaaaugaa

SEQ ID NO: 454765 - RNA, 16 nt, Brucella suis 1330
augacgagccucgccc

SEQ ID NO: 454766 - RNA, 22 nt, Brucella suis 1330
augacgcccagcgaauagacca

SEQ ID NO: 454767 - RNA, 18 nt, Brucella suis 1330
augacgccgggcauggaa

SEQ ID NO: 454768 - RNA, 15 nt, Brucella suis 1330
augagaaccggcucg

SEQ ID NO: 454769 - RNA, 16 nt, Brucella suis 1330
augagaaggcaagccc

SEQ ID NO: 454770 - RNA, 16 nt, Brucella suis 1330
augaagaccuggaacg

SEQ ID NO: 454771 - RNA, 18 nt, Brucella suis 1330
augaaagaacggcccgca

SEQ ID NO: 454772 - RNA, 17 nt, Brucella suis 1330
aucuugaccuggccagc

SEQ ID NO: 454773 - RNA, 13 nt, Brucella suis 1330
aucuucuugcauu

SEQ ID NO: 454774 - RNA, 17 nt, Brucella suis 1330
aucugcggcgucagggc

SEQ ID NO: 454775 - RNA, 18 nt, Brucella suis 1330
aucugccgucagcaaaau

SEQ ID NO: 454776 - RNA, 21 nt, Brucella suis 1330
aucugcaucccgaaaagugcg

SEQ ID NO: 454777 - RNA, 22 nt, Brucella suis 1330
aucugacccggcgcaaaggccg

SEQ ID NO: 454778 - RNA, 21 nt, Brucella suis 1330
aucucguucacaaucuugcca

SEQ ID NO: 454779 - RNA, 19 nt, Brucella suis 1330
aucucacacugcaaaacug

SEQ ID NO: 454780 - RNA, 20 nt, Brucella suis 1330
aucucaccggaagguuuuuc

SEQ ID NO: 454781 - RNA, 19 nt, Brucella suis 1330
aucuaguggagcaccgccc

SEQ ID NO: 454782 - RNA, 16 nt, Brucella suis 1330
aucguuaugcucuauu

SEQ ID NO: 454783 - RNA, 16 nt, Brucella suis 1330
aucguggcggcaaaaa

SEQ ID NO: 454784 - RNA, 17 nt, Brucella suis 1330
aucguggucgccucuuc

SEQ ID NO: 454785 - RNA, 20 nt, Brucella suis 1330
aucgugccgccgugaaaaua

SEQ ID NO: 454786 - RNA, 19 nt, Brucella suis 1330
aucgugccggaauggccac

SEQ ID NO: 454787 - RNA, 16 nt, Brucella suis 1330
aucggggcgagcgcgc

SEQ ID NO: 454788 - RNA, 21 nt, Brucella suis 1330
aucggguguuugcgacgggcg

SEQ ID NO: 454789 - RNA, 15 nt, Brucella suis 1330
aucgguacggaaagg

SEQ ID NO: 454790 - RNA, 21 nt, Brucella suis 1330
aucggcgaggucucccggcac

SEQ ID NO: 454791 - RNA, 20 nt, Brucella suis 1330
aucggccauuucggcuucca

SEQ ID NO: 454792 - RNA, 17 nt, Brucella suis 1330
aucggaugcuccacggc

SEQ ID NO: 454793 - RNA, 13 nt, Brucella suis 1330
aucgcgcugcucg

SEQ ID NO: 454794 - RNA, 17 nt, Brucella suis 1330
aucgcgcguaucgacac

SEQ ID NO: 454795 - RNA, 15 nt, Brucella suis 1330
aucgcgcgaccaggu

SEQ ID NO: 454796 - RNA, 18 nt, Brucella suis 1330
aucgcccucgaucagcac

SEQ ID NO: 454797 - RNA, 14 nt, Brucella suis 1330
aucgcccgcccggc

SEQ ID NO: 454798 - RNA, 21 nt, Brucella suis 1330
aucgcccacgaggaucggcac

SEQ ID NO: 454799 - RNA, 18 nt, Brucella suis 1330
aucgaucacaugcgcgcc

SEQ ID NO: 454800 - RNA, 19 nt, Brucella suis 1330
aucgauuugcgcaccagau

SEQ ID NO: 454801 - RNA, 14 nt, Brucella suis 1330
aucgcaagccaaag

SEQ ID NO: 454802 - RNA, 23 nt, Brucella suis 1330
aucgaggaauuuccgcuccuggu

SEQ ID NO: 454803 - RNA, 20 nt, Brucella suis 1330
aucgagcgcgaaggacagaa

SEQ ID NO: 454804 - RNA, 14 nt, Brucella suis 1330
aucagcucuucaca

SEQ ID NO: 454805 - RNA, 22 nt, Brucella suis 1330
aucagcgucagcgcaaagccug

SEQ ID NO: 454806 - RNA, 20 nt, Brucella suis 1330
aucagccgcccgccuuggaa

SEQ ID NO: 454807 - RNA, 22 nt, Brucella suis 1330
aucagauggguugcgauggcgc

SEQ ID NO: 454808 - RNA, 15 nt, Brucella suis 1330
aucagauagccggug

SEQ ID NO: 454809 - RNA, 23 nt, Brucella suis 1330
aucagaccgaugcucuaacuauu

SEQ ID NO: 454810 - RNA, 12 nt, Brucella suis 1330
aucagaaaucag

SEQ ID NO: 454811 - RNA, 16 nt, Brucella suis 1330
aucagaaaucagucca

SEQ ID NO: 454812 - RNA, 17 nt, Brucella suis 1330
aucagaagugcugcugc

SEQ ID NO: 454813 - RNA, 19 nt, Brucella suis 1330
aucacuucgucgcugacuu

SEQ ID NO: 454814 - RNA, 14 nt, Brucella suis 1330
aucacuugcaagcg

SEQ ID NO: 454815 - RNA, 23 nt, Brucella suis 1330
aucacgucgauggccgaauagcg

SEQ ID NO: 454816 - RNA, 21 nt, Brucella suis 1330
aucacggccauugcccaaaag

SEQ ID NO: 454817 - RNA, 23 nt, Brucella suis 1330
aucacgcggcgcaaagcccagcc

SEQ ID NO: 454818 - RNA, 16 nt, Brucella suis 1330
aucaccuguuccgcau

SEQ ID NO: 454819 - RNA, 21 nt, Brucella suis 1330
aucaccauuuucgcacgcgca

SEQ ID NO: 454820 - RNA, 15 nt, Brucella suis 1330
aucacccagaaaacg

SEQ ID NO: 454821 - RNA, 19 nt, Brucella suis 1330
aucaaugcaccccaugaga

SEQ ID NO: 454822 - RNA, 17 nt, Brucella suis 1330
aucaaugugaaggcgcu

SEQ ID NO: 454823 - RNA, 16 nt, Brucella suis 1330
aucaagcgucaugcca

SEQ ID NO: 454824 - RNA, 21 nt, Brucella suis 1330
aucaagcgcucagcuuuucca

SEQ ID NO: 454825 - RNA, 17 nt, Brucella suis 1330
aucaacgcugcaacaaa

SEQ ID NO: 454826 - RNA, 18 nt, Brucella suis 1330
aucaacgcugcaacaaau

SEQ ID NO: 454827 - RNA, 22 nt, Brucella suis 1330
aucaaccuuuucggcaaggaug

SEQ ID NO: 454828 - RNA, 16 nt, Brucella suis 1330
auauucaggaucuuuc

SEQ ID NO: 454829 - RNA, 18 nt, Brucella suis 1330
auauucaggaucuuucca

SEQ ID NO: 454830 - RNA, 18 nt, Brucella suis 1330
auauugcagacacgcuuu

SEQ ID NO: 454831 - RNA, 19 nt, Brucella suis 1330
auauugcgcauaucgcgcg

SEQ ID NO: 454832 - RNA, 16 nt, Brucella suis 1330
auauugugccagaaug

SEQ ID NO: 454833 - RNA, 23 nt, Brucella suis 1330
auauauguccugugaaggccugu

SEQ ID NO: 454834 - RNA, 17 nt, Brucella suis 1330
auaucagcccgcuuuua

SEQ ID NO: 454835 - RNA, 21 nt, Brucella suis 1330
auaggucgugcuauagccacc

SEQ ID NO: 454836 - RNA, 18 nt, Brucella suis 1330
auaggcguugaugacgaa

SEQ ID NO: 454837 - RNA, 12 nt, Brucella suis 1330
auagggaauggu

SEQ ID NO: 454838 - RNA, 17 nt, Brucella suis 1330
auaggcaacaggcguca

SEQ ID NO: 454839 - RNA, 16 nt, Brucella suis 1330
auagcguaaaacgcac

SEQ ID NO: 454840 - RNA, 13 nt, Brucella suis 1330
auagcccugaucg

SEQ ID NO: 454841 - RNA, 17 nt, Brucella suis 1330
auagcgcgcccaaucuc

SEQ ID NO: 454842 - RNA, 12 nt, Brucella suis 1330
auagcccggcag

SEQ ID NO: 454843 - RNA, 13 nt, Brucella suis 1330
auagcucauguuc

SEQ ID NO: 454844 - RNA, 18 nt, Brucella suis 1330
auagcucgacgcuuucca

SEQ ID NO: 454845 - RNA, 23 nt, Brucella suis 1330
auagaugagcugguuuuucacca

SEQ ID NO: 454846 - RNA, 19 nt, Brucella suis 1330
auagauguucuuccccguc

SEQ ID NO: 454847 - RNA, 21 nt, Brucella suis 1330
auagagcgccgaucugauuga

SEQ ID NO: 454848 - RNA, 14 nt, Brucella suis 1330
auagauaaacgcac

SEQ ID NO: 454849 - RNA, 17 nt, Brucella suis 1330
auacuuguaaggugaug

SEQ ID NO: 454850 - RNA, 18 nt, Brucella suis 1330
auagacuucagccagaau

SEQ ID NO: 454851 - RNA, 11 nt, Brucella suis 1330
auagagcagca

SEQ ID NO: 454852 - RNA, 17 nt, Brucella suis 1330
auacuccccuacucccu

SEQ ID NO: 454853 - RNA, 20 nt, Brucella suis 1330
auacuccccuacucccuuau

SEQ ID NO: 454854 - RNA, 16 nt, Brucella suis 1330
auacgugcaagagcaa

SEQ ID NO: 454855 - RNA, 20 nt, Brucella suis 1330
auaccgguacuggccaagcg

SEQ ID NO: 454856 - RNA, 12 nt, Brucella suis 1330
auacgccccgug

SEQ ID NO: 454857 - RNA, 22 nt, Brucella suis 1330
auacgucacccgccuugcagau

SEQ ID NO: 454858 - RNA, 20 nt, Brucella suis 1330
aguugcuccagcccuuuccu

SEQ ID NO: 454859 - RNA, 16 nt, Brucella suis 1330
aguugcaccgcccgga

SEQ ID NO: 454860 - RNA, 15 nt, Brucella suis 1330
aguucguugugccag

SEQ ID NO: 454861 - RNA, 20 nt, Brucella suis 1330
aguucguugugccagaaggu

SEQ ID NO: 454862 - RNA, 12 nt, Brucella suis 1330
aguuccuucuug

SEQ ID NO: 454863 - RNA, 14 nt, Brucella suis 1330
aguuccauugcaac

SEQ ID NO: 454864 - RNA, 22 nt, Brucella suis 1330
agugugcagacaggccagucgc

SEQ ID NO: 454865 - RNA, 22 nt, Brucella suis 1330
aguguccacgcgcuugaggcuc

SEQ ID NO: 454866 - RNA, 22 nt, Brucella suis 1330
agugucgaccggcggcaggcag

SEQ ID NO: 454867 - RNA, 23 nt, Brucella suis 1330
agugugaaacgccuacgcgggga

SEQ ID NO: 454868 - RNA, 13 nt, Brucella suis 1330
agugcgcacauug

SEQ ID NO: 454869 - RNA, 21 nt, Brucella suis 1330
agugcgcacgccugccgcgcg

SEQ ID NO: 454870 - RNA, 23 nt, Brucella suis 1330
agugcgaagcgguuuugcguagg

SEQ ID NO: 454871 - RNA, 22 nt, Brucella suis 1330
agugcgcagcaucugcgcgagg

SEQ ID NO: 454872 - RNA, 24 nt, Brucella suis 1330
agugcgccaccgcgaaagccagaa

SEQ ID NO: 454873 - RNA, 23 nt, Brucella suis 1330
agugcugaaaaggcuggccaugc

SEQ ID NO: 454874 - RNA, 19 nt, Brucella suis 1330
agugagcagaagaaagggc

SEQ ID NO: 454875 - RNA, 18 nt, Brucella suis 1330
agucgcccacgguuuuug

SEQ ID NO: 454876 - RNA, 14 nt, Brucella suis 1330
agucgacaauguca

SEQ ID NO: 454877 - RNA, 22 nt, Brucella suis 1330
agucugaucgacgaggaagguu

SEQ ID NO: 454878 - RNA, 21 nt, Brucella suis 1330
agucuggaacguguugagauc

SEQ ID NO: 454879 - RNA, 19 nt, Brucella suis 1330
agucuucuugugaacaugg

SEQ ID NO: 454880 - RNA, 15 nt, Brucella suis 1330
agugaccagcgccga

SEQ ID NO: 454881 - RNA, 18 nt, Brucella suis 1330
auaaaaaggaugaaugcc

SEQ ID NO: 454882 - RNA, 15 nt, Brucella suis 1330
auaaacccgccccca

SEQ ID NO: 454883 - RNA, 14 nt, Brucella suis 1330
auaaagcaccauga

SEQ ID NO: 454884 - RNA, 16 nt, Brucella suis 1330
auaaagcguggcgaug

SEQ ID NO: 454885 - RNA, 23 nt, Brucella suis 1330
auaagcgccauaggucgugcauu

SEQ ID NO: 454886 - RNA, 11 nt, Brucella suis 1330
auaagcggcaa

SEQ ID NO: 454887 - RNA, 16 nt, Brucella suis 1330
auaauagucgaaaaaa

SEQ ID NO: 454888 - RNA, 20 nt, Brucella suis 1330
auaaucagcagaaggaugau

SEQ ID NO: 454889 - RNA, 22 nt, Brucella suis 1330
auaaucagccucguaaagaucg

SEQ ID NO: 454890 - RNA, 20 nt, Brucella suis 1330
auaaucuuuuugcaggaaau

SEQ ID NO: 454891 - RNA, 17 nt, Brucella suis 1330
auaaugcgacaaaacaa

SEQ ID NO: 454892 - RNA, 16 nt, Brucella suis 1330
agguugaugccgggca

SEQ ID NO: 454893 - RNA, 16 nt, Brucella suis 1330
agguugagcugcucgg

SEQ ID NO: 454894 - RNA, 18 nt, Brucella suis 1330
agguguuucgcgcaaugg

SEQ ID NO: 454895 - RNA, 17 nt, Brucella suis 1330
aggugaaggccugcuuc

SEQ ID NO: 454896 - RNA, 21 nt, Brucella suis 1330
aggugacgcuauccacgcccu

SEQ ID NO: 454897 - RNA, 15 nt, Brucella suis 1330
aggugagcggcaggc

SEQ ID NO: 454898 - RNA, 20 nt, Brucella suis 1330
aggugagcggcaggccgcaa

SEQ ID NO: 454899 - RNA, 13 nt, Brucella suis 1330
aggucuuucugcu

SEQ ID NO: 454900 - RNA, 17 nt, Brucella suis 1330
aggucauaaugcaugga

SEQ ID NO: 454901 - RNA, 17 nt, Brucella suis 1330
aggucagaagaccaaac

SEQ ID NO: 454902 - RNA, 17 nt, Brucella suis 1330
agguauagauaucgagc

SEQ ID NO: 454903 - RNA, 12 nt, Brucella suis 1330
agggucgcgacc

SEQ ID NO: 454904 - RNA, 17 nt, Brucella suis 1330
agggucgcgaccuucuu

SEQ ID NO: 454905 - RNA, 15 nt, Brucella suis 1330
aggggcagcgcgcgg

SEQ ID NO: 454906 - RNA, 17 nt, Brucella suis 1330
agggcguauccggcccc

SEQ ID NO: 454907 - RNA, 15 nt, Brucella suis 1330
agggcgggcggccag

SEQ ID NO: 454908 - RNA, 19 nt, Brucella suis 1330
agggcgggcggccaggaca

SEQ ID NO: 454909 - RNA, 21 nt, Brucella suis 1330
agggcgguugcacgcacaucg

SEQ ID NO: 454910 - RNA, 15 nt, Brucella suis 1330
agggcguagauagcg

SEQ ID NO: 454911 - RNA, 20 nt, Brucella suis 1330
agggcggcuuucgccgcccu

SEQ ID NO: 454912 - RNA, 21 nt, Brucella suis 1330
agggcgggcaugggcaccugg

SEQ ID NO: 454913 - RNA, 17 nt, Brucella suis 1330
agggcggcaagcugcuc

SEQ ID NO: 454914 - RNA, 22 nt, Brucella suis 1330
agggccuggccgauuuccgcuu

SEQ ID NO: 454915 - RNA, 15 nt, Brucella suis 1330
agggccgugaccagc

SEQ ID NO: 454916 - RNA, 20 nt, Brucella suis 1330
agggccgguuucccggcccu

SEQ ID NO: 454917 - RNA, 21 nt, Brucella suis 1330
agggccgguuucccggcccuu

SEQ ID NO: 454918 - RNA, 15 nt, Brucella suis 1330
agggccgcucaaggc

SEQ ID NO: 454919 - RNA, 21 nt, Brucella suis 1330
agggccacuccguugccgaga

SEQ ID NO: 454920 - RNA, 14 nt, Brucella suis 1330
agggcaaggcgcgc

SEQ ID NO: 454921 - RNA, 18 nt, Brucella suis 1330
agggcaauuggcccccaa

SEQ ID NO: 454922 - RNA, 16 nt, Brucella suis 1330
agggcaguagggcagu

SEQ ID NO: 454923 - RNA, 20 nt, Brucella suis 1330
agggaggcaucagccucccu

SEQ ID NO: 454924 - RNA, 14 nt, Brucella suis 1330
agggauaaagccug

SEQ ID NO: 454925 - RNA, 21 nt, Brucella suis 1330
agggauugcgcaagugcugca

SEQ ID NO: 454926 - RNA, 13 nt, Brucella suis 1330
agggaaugggauc

SEQ ID NO: 454927 - RNA, 15 nt, Brucella suis 1330
agggaacugcggauc

SEQ ID NO: 454928 - RNA, 22 nt, Brucella suis 1330
agggaaacacucugccugcccu

SEQ ID NO: 454929 - RNA, 21 nt, Brucella suis 1330
agggaaagcgggccugugcuu

SEQ ID NO: 454930 - RNA, 23 nt, Brucella suis 1330
aggcuucgcuucgcuccgcaccu

SEQ ID NO: 454931 - RNA, 13 nt, Brucella suis 1330
aggcuucggccgc

SEQ ID NO: 454932 - RNA, 21 nt, Brucella suis 1330
aggcuuccgaaucgcuguugg

SEQ ID NO: 454933 - RNA, 14 nt, Brucella suis 1330
aggcuguccggcuc

SEQ ID NO: 454934 - RNA, 15 nt, Brucella suis 1330
aggcuggccaugcgg

SEQ ID NO: 454935 - RNA, 15 nt, Brucella suis 1330
aggcuggcaucgcca

SEQ ID NO: 454936 - RNA, 22 nt, Brucella suis 1330
aggcugaguuuuccgcuuucuu

SEQ ID NO: 454937 - RNA, 15 nt, Brucella suis 1330
aggcucggcaaaggg

SEQ ID NO: 454938 - RNA, 17 nt, Brucella suis 1330
aggcguucccagacaug

SEQ ID NO: 454939 - RNA, 18 nt, Brucella suis 1330
aggcguugaugacgaaaa

SEQ ID NO: 454940 - RNA, 13 nt, Brucella suis 1330
aggcggcgcucga

SEQ ID NO: 454941 - RNA, 22 nt, Brucella suis 1330
aggcggcccuuuucuauugaac

SEQ ID NO: 454942 - RNA, 17 nt, Brucella suis 1330
aggcggauuuccugccu

SEQ ID NO: 454943 - RNA, 21 nt, Brucella suis 1330
aggcgcuuuuucacgcgggcg

SEQ ID NO: 454944 - RNA, 13 nt, Brucella suis 1330
aggcgcucuuucc

SEQ ID NO: 454945 - RNA, 14 nt, Brucella suis 1330
aggcgcggcgugga

SEQ ID NO: 454946 - RNA, 12 nt, Brucella suis 1330
aggcgcgcgccu

SEQ ID NO: 454947 - RNA, 22 nt, Brucella suis 1330
aggcgaguuuucaaaccaaaaa

SEQ ID NO: 454948 - RNA, 22 nt, Brucella suis 1330
aggcgacgagaccugccaucac

SEQ ID NO: 454949 - RNA, 22 nt, Brucella suis 1330
aggcgagaugccgugggcaaga

SEQ ID NO: 454950 - RNA, 13 nt, Brucella suis 1330
aggccuucuuccc

SEQ ID NO: 454951 - RNA, 16 nt, Brucella suis 1330
aggccucugccuccau

SEQ ID NO: 454952 - RNA, 13 nt, Brucella suis 1330
aggccggguuuuu

SEQ ID NO: 454953 - RNA, 17 nt, Brucella suis 1330
aggccgguaagcccugu

SEQ ID NO: 454954 - RNA, 12 nt, Brucella suis 1330
aggccgcgccga

SEQ ID NO: 454955 - RNA, 20 nt, Brucella suis 1330
aggccgcgcuccagaucgug

SEQ ID NO: 454956 - RNA, 14 nt, Brucella suis 1330
aggccgagcgccgc

SEQ ID NO: 454957 - RNA, 13 nt, Brucella suis 1330
aggccgaccgcaa

SEQ ID NO: 454958 - RNA, 21 nt, Brucella suis 1330
aggcccuucagggacgagcgg

SEQ ID NO: 454959 - RNA, 13 nt, Brucella suis 1330
aggcccgccucga

SEQ ID NO: 454960 - RNA, 22 nt, Brucella suis 1330
aggccccgucauucaucagcac

SEQ ID NO: 454961 - RNA, 17 nt, Brucella suis 1330
aggcccccuguuucugc

SEQ ID NO: 454962 - RNA, 11 nt, Brucella suis 1330
aggcccauugg

SEQ ID NO: 454963 - RNA, 18 nt, Brucella suis 1330
aggccagucgcugcccca

SEQ ID NO: 454964 - RNA, 22 nt, Brucella suis 1330
aggccaccguuucggguggccu

SEQ ID NO: 454965 - RNA, 15 nt, Brucella suis 1330
aggccaaaaagcgua

SEQ ID NO: 454966 - RNA, 17 nt, Brucella suis 1330
aggcagccgugagcaug

SEQ ID NO: 454967 - RNA, 22 nt, Brucella suis 1330
aggcagccgugagcauggcaag

SEQ ID NO: 454968 - RNA, 21 nt, Brucella suis 1330
aggcacuggucgggauugucg

SEQ ID NO: 454969 - RNA, 16 nt, Brucella suis 1330
aggcagacauggccuu

SEQ ID NO: 454970 - RNA, 15 nt, Brucella suis 1330
aggcaagccccagca

SEQ ID NO: 454971 - RNA, 12 nt, Brucella suis 1330
aggcaaagcgga

SEQ ID NO: 454972 - RNA, 20 nt, Brucella suis 1330
aggcaaagccgaaugccagu

SEQ ID NO: 454973 - RNA, 17 nt, Brucella suis 1330
aggauucgaaccucuga

SEQ ID NO: 454974 - RNA, 18 nt, Brucella suis 1330
aggauucgaaccucugac

SEQ ID NO: 454975 - RNA, 18 nt, Brucella suis 1330
aggauugccgccgcacuu

SEQ ID NO: 454976 - RNA, 22 nt, Brucella suis 1330
aggaugugagcgaauaugcggg

SEQ ID NO: 454977 - RNA, 17 nt, Brucella suis 1330
aggaugagggagagaac

SEQ ID NO: 454978 - RNA, 21 nt, Brucella suis 1330
aggaugagggagagaacacag

SEQ ID NO: 454979 - RNA, 22 nt, Brucella suis 1330
aggaugaaugccgaagccaggu

SEQ ID NO: 454980 - RNA, 16 nt, Brucella suis 1330
aggaucggcagcagcg

SEQ ID NO: 454981 - RNA, 14 nt, Brucella suis 1330
aggaucgaagggcu

SEQ ID NO: 454982 - RNA, 19 nt, Brucella suis 1330
aggaucgccagaagcguaa

SEQ ID NO: 454983 - RNA, 14 nt, Brucella suis 1330
aggagccggaaaau

SEQ ID NO: 454984 - RNA, 13 nt, Brucella suis 1330
aggagcggaagca

SEQ ID NO: 454985 - RNA, 21 nt, Brucella suis 1330
aggacgaaccccgcaucauga

SEQ ID NO: 454986 - RNA, 13 nt, Brucella suis 1330
aggaaucagcaag

SEQ ID NO: 454987 - RNA, 15 nt, Brucella suis 1330
aggaaugggcgggga

SEQ ID NO: 454988 - RNA, 22 nt, Brucella suis 1330
aggaauuucagcgaagcgauga

SEQ ID NO: 454989 - RNA, 14 nt, Brucella suis 1330
aggaaguggaagca

SEQ ID NO: 454990 - RNA, 19 nt, Brucella suis 1330
aggaagagaaucuugcccu

SEQ ID NO: 454991 - RNA, 23 nt, Brucella suis 1330
aggaagaaggcgacgagaccugc

SEQ ID NO: 454992 - RNA, 14 nt, Brucella suis 1330
aggaacgccgccgg

SEQ ID NO: 454993 - RNA, 13 nt, Brucella suis 1330
aggaacgcggccu

SEQ ID NO: 454994 - RNA, 14 nt, Brucella suis 1330
aggaaauugacgcc

SEQ ID NO: 454995 - RNA, 20 nt, Brucella suis 1330
aggaaauugacgccauugac

SEQ ID NO: 454996 - RNA, 22 nt, Brucella suis 1330
aggaaaaaaccggcgaugaggg

SEQ ID NO: 454997 - RNA, 13 nt, Brucella suis 1330
agcuuuuuauuaa

SEQ ID NO: 454998 - RNA, 21 nt, Brucella suis 1330
agcuugcgcacacggcgcagg

SEQ ID NO: 454999 - RNA, 18 nt, Brucella suis 1330
agcuugcgcagcgccgca

SEQ ID NO: 455000 - RNA, 19 nt, Brucella suis 1330
agcuugcccucgccuucca

SEQ ID NO: 455001 - RNA, 13 nt, Brucella suis 1330
agcuugcccguca

SEQ ID NO: 455002 - RNA, 13 nt, Brucella suis 1330
agcuugcaaugag

SEQ ID NO: 455003 - RNA, 16 nt, Brucella suis 1330
agcuugcagugcagga

SEQ ID NO: 455004 - RNA, 18 nt, Brucella suis 1330
agcuuucacucuccagau

SEQ ID NO: 455005 - RNA, 16 nt, Brucella suis 1330
agcuuugcaccgcgcc

SEQ ID NO: 455006 - RNA, 12 nt, Brucella suis 1330
agcuucggaaga

SEQ ID NO: 455007 - RNA, 19 nt, Brucella suis 1330
agcuuccgucagggccgau

SEQ ID NO: 455008 - RNA, 16 nt, Brucella suis 1330
agcuucacauccuuca

SEQ ID NO: 455009 - RNA, 14 nt, Brucella suis 1330
agcuguugcagccg

SEQ ID NO: 455010 - RNA, 14 nt, Brucella suis 1330
agcuguguggccuu

SEQ ID NO: 455011 - RNA, 20 nt, Brucella suis 1330
agcugguuuuucaccaucuc

SEQ ID NO: 455012 - RNA, 15 nt, Brucella suis 1330
agcuggaaggccagg

SEQ ID NO: 455013 - RNA, 18 nt, Brucella suis 1330
agcugcuggcggguccag

SEQ ID NO: 455014 - RNA, 14 nt, Brucella suis 1330
agcugcugggugaa

SEQ ID NO: 455015 - RNA, 19 nt, Brucella suis 1330
agcugccgcgaaaaagccg

SEQ ID NO: 455016 - RNA, 14 nt, Brucella suis 1330
agcgugucuugccc

SEQ ID NO: 455017 - RNA, 15 nt, Brucella suis 1330
agcgugucuugccca

SEQ ID NO: 455018 - RNA, 18 nt, Brucella suis 1330
agcgugucuugcccagaa

SEQ ID NO: 455019 - RNA, 14 nt, Brucella suis 1330
agcgugccguguag

SEQ ID NO: 455020 - RNA, 14 nt, Brucella suis 1330
agcggcucgaccgu

SEQ ID NO: 455021 - RNA, 15 nt, Brucella suis 1330
agcggcgugccgggc

SEQ ID NO: 455022 - RNA, 12 nt, Brucella suis 1330
agcggcgcggca

SEQ ID NO: 455023 - RNA, 16 nt, Brucella suis 1330
agcggcgaguugccac

SEQ ID NO: 455024 - RNA, 20 nt, Brucella suis 1330
agcggaaccaucaucuucac

SEQ ID NO: 455025 - RNA, 17 nt, Brucella suis 1330
agcgcggagaugauggc

SEQ ID NO: 455026 - RNA, 23 nt, Brucella suis 1330
agcgcgccggucuucauggcuug

SEQ ID NO: 455027 - RNA, 16 nt, Brucella suis 1330
agcgcgccaucggcac

SEQ ID NO: 455028 - RNA, 15 nt, Brucella suis 1330
agauugaucccgauc

SEQ ID NO: 455029 - RNA, 12 nt, Brucella suis 1330
agauugcagcaa

SEQ ID NO: 455030 - RNA, 16 nt, Brucella suis 1330
agauugggcagcagau

SEQ ID NO: 455031 - RNA, 15 nt, Brucella suis 1330
agauucaaaacauga

SEQ ID NO: 455032 - RNA, 20 nt, Brucella suis 1330
agauggguugcgauggcgcc

SEQ ID NO: 455033 - RNA, 22 nt, Brucella suis 1330
agauggcguucugaaaccgcag

SEQ ID NO: 455034 - RNA, 19 nt, Brucella suis 1330
agauggcgaaugcccuuga

SEQ ID NO: 455035 - RNA, 20 nt, Brucella suis 1330
agauggccgcuuugcggagg

SEQ ID NO: 455036 - RNA, 13 nt, Brucella suis 1330
agauggacauagc

SEQ ID NO: 455037 - RNA, 18 nt, Brucella suis 1330
agaugcgcgucaaaacaa

SEQ ID NO: 455038 - RNA, 14 nt, Brucella suis 1330
agaugcgccgggca

SEQ ID NO: 455039 - RNA, 18 nt, Brucella suis 1330
agaugcgcgcaaggaaag

SEQ ID NO: 455040 - RNA, 20 nt, Brucella suis 1330
agauggaaagagccuguuca

SEQ ID NO: 455041 - RNA, 14 nt, Brucella suis 1330
agaugcagcggcgc

SEQ ID NO: 455042 - RNA, 10 nt, Brucella suis 1330
agaugcagcg

SEQ ID NO: 455043 - RNA, 16 nt, Brucella suis 1330
agaugaugaagaaaag

SEQ ID NO: 455044 - RNA, 18 nt, Brucella suis 1330
agaugacgcccagcgaau

SEQ ID NO: 455045 - RNA, 18 nt, Brucella suis 1330
agaugagcgacaggaaca

SEQ ID NO: 455046 - RNA, 17 nt, Brucella suis 1330
agaugagcugguuuuuc

SEQ ID NO: 455047 - RNA, 16 nt, Brucella suis 1330
agaucugcaucccgaa

SEQ ID NO: 455048 - RNA, 17 nt, Brucella suis 1330
agaucugcaucccgaaa

SEQ ID NO: 455049 - RNA, 20 nt, Brucella suis 1330
agaucugcaucccgaaaagu

SEQ ID NO: 455050 - RNA, 17 nt, Brucella suis 1330
agaucuguaucccgaaa

SEQ ID NO: 455051 - RNA, 20 nt, Brucella suis 1330
agaucuguaucccgaaaagu

SEQ ID NO: 455052 - RNA, 16 nt, Brucella suis 1330
agaucggaugcuccac

SEQ ID NO: 455053 - RNA, 23 nt, Brucella suis 1330
agaucggacgggcagaacaguuu

SEQ ID NO: 455054 - RNA, 13 nt, Brucella suis 1330
agaucggcgaggu

SEQ ID NO: 455055 - RNA, 19 nt, Brucella suis 1330
agaucgugggccucaagcg

SEQ ID NO: 455056 - RNA, 18 nt, Brucella suis 1330
agaucgugaucuucggca

SEQ ID NO: 455057 - RNA, 22 nt, Brucella suis 1330
agauccgcugacugcgccaucc

SEQ ID NO: 455058 - RNA, 14 nt, Brucella suis 1330
agauccaccgcgcu

SEQ ID NO: 455059 - RNA, 10 nt, Brucella suis 1330
agaucagcca

SEQ ID NO: 455060 - RNA, 20 nt, Brucella suis 1330
agaucagagcgguuucgguu

SEQ ID NO: 455061 - RNA, 18 nt, Brucella suis 1330
agaucaaagguaaggccg

SEQ ID NO: 455062 - RNA, 20 nt, Brucella suis 1330
agaucaauacgcucgcacau

SEQ ID NO: 455063 - RNA, 18 nt, Brucella suis 1330
agauaucgagcgccagau

SEQ ID NO: 455064 - RNA, 14 nt, Brucella suis 1330
agagugaugcagau

SEQ ID NO: 455065 - RNA, 13 nt, Brucella suis 1330
agagcuucuuuuc

SEQ ID NO: 455066 - RNA, 19 nt, Brucella suis 1330
agagcgcaucccgaaaagu

SEQ ID NO: 455067 - RNA, 18 nt, Brucella suis 1330
agaggguuccgaauacaa

SEQ ID NO: 455068 - RNA, 18 nt, Brucella suis 1330
agagauuucaccacgcca

SEQ ID NO: 455069 - RNA, 21 nt, Brucella suis 1330
agacggcggguggcagcgauu

SEQ ID NO: 455070 - RNA, 22 nt, Brucella suis 1330
agaccugcaccgcgugaagaau

SEQ ID NO: 455071 - RNA, 16 nt, Brucella suis 1330
agaccaucgaaagccc

SEQ ID NO: 455072 - RNA, 22 nt, Brucella suis 1330
agaccaugacgccgcuccagcc

SEQ ID NO: 455073 - RNA, 17 nt, Brucella suis 1330
agaccgucuggccugaa

SEQ ID NO: 455074 - RNA, 14 nt, Brucella suis 1330
agacauauugcccu

SEQ ID NO: 455075 - RNA, 15 nt, Brucella suis 1330
agaccagcaggaaga

SEQ ID NO: 455076 - RNA, 17 nt, Brucella suis 1330
agaauggagcauuucca

SEQ ID NO: 455077 - RNA, 22 nt, Brucella suis 1330
agaagguuacuugcgcuuugca

SEQ ID NO: 455078 - RNA, 17 nt, Brucella suis 1330
agaacuucggcauggca

SEQ ID NO: 455079 - RNA, 20 nt, Brucella suis 1330
agaacuucggcauggcagcc

SEQ ID NO: 455080 - RNA, 17 nt, Brucella suis 1330
agaaccgaggcaaugaa

SEQ ID NO: 455081 - RNA, 23 nt, Brucella suis 1330
agaacagcgcgaacaugccugcc

SEQ ID NO: 455082 - RNA, 19 nt, Brucella suis 1330
agaacauauccgucugauc

SEQ ID NO: 455083 - RNA, 13 nt, Brucella suis 1330
agaacauauccug

SEQ ID NO: 455084 - RNA, 14 nt, Brucella suis 1330
agaaccaccagagc

SEQ ID NO: 455085 - RNA, 19 nt, Brucella suis 1330
agaaccaccagagcaaaaa

SEQ ID NO: 455086 - RNA, 14 nt, Brucella suis 1330
agaacacagccccu

SEQ ID NO: 455087 - RNA, 15 nt, Brucella suis 1330
agaacacagccccuu

SEQ ID NO: 455088 - RNA, 23 nt, Brucella suis 1330
agaaacgguuuugcguuggaaaa

SEQ ID NO: 455089 - RNA, 18 nt, Brucella suis 1330
acuucgcgggcaauggcc

SEQ ID NO: 455090 - RNA, 23 nt, Brucella suis 1330
acuucaaguuucggaucggcaag

SEQ ID NO: 455091 - RNA, 16 nt, Brucella suis 1330
acuguucuuccgagaa

SEQ ID NO: 455092 - RNA, 22 nt, Brucella suis 1330
acuguucuuugcagccuccucg

SEQ ID NO: 455093 - RNA, 22 nt, Brucella suis 1330
acuggcggaugaagaagauaau

SEQ ID NO: 455094 - RNA, 12 nt, Brucella suis 1330
acuggcagggcu

SEQ ID NO: 455095 - RNA, 15 nt, Brucella suis 1330
acuggcaagugugca

SEQ ID NO: 455096 - RNA, 21 nt, Brucella suis 1330
acuggauuucgagcugacgaa

SEQ ID NO: 455097 - RNA, 15 nt, Brucella suis 1330
acugcugccaaaaau

SEQ ID NO: 455098 - RNA, 15 nt, Brucella suis 1330
acugcuaaugcguuu

SEQ ID NO: 455099 - RNA, 16 nt, Brucella suis 1330
acugcgcgcaaaccag

SEQ ID NO: 455100 - RNA, 18 nt, Brucella suis 1330
acugcgcgcaaaccagga

SEQ ID NO: 455101 - RNA, 18 nt, Brucella suis 1330
acugccuuacugcccuau

SEQ ID NO: 455102 - RNA, 18 nt, Brucella suis 1330
acugccgcguccggcauu

SEQ ID NO: 455103 - RNA, 22 nt, Brucella suis 1330
acugcccauaucuucgcccuga

SEQ ID NO: 455104 - RNA, 14 nt, Brucella suis 1330
acugcccuauugcc

SEQ ID NO: 455105 - RNA, 21 nt, Brucella suis 1330
acugcaucacagucacgccau

SEQ ID NO: 455106 - RNA, 18 nt, Brucella suis 1330
acugcauuggcgauuuuc

SEQ ID NO: 455107 - RNA, 20 nt, Brucella suis 1330
acugcauuggcgauuuucug

SEQ ID NO: 455108 - RNA, 12 nt, Brucella suis 1330
acugauuuucaa

SEQ ID NO: 455109 - RNA, 16 nt, Brucella suis 1330
acugcaaaaaauacca

SEQ ID NO: 455110 - RNA, 21 nt, Brucella suis 1330
acugcaaucugguccacgccc

SEQ ID NO: 455111 - RNA, 22 nt, Brucella suis 1330
acucgaagauggaacggaaaau

SEQ ID NO: 455112 - RNA, 12 nt, Brucella suis 1330
acucgaaaauca

SEQ ID NO: 455113 - RNA, 20 nt, Brucella suis 1330
acuauuuccaucgcuugaac

SEQ ID NO: 455114 - RNA, 16 nt, Brucella suis 1330
acgucguggccagccg

SEQ ID NO: 455115 - RNA, 21 nt, Brucella suis 1330
acgucgaaauccguuucggaa

SEQ ID NO: 455116 - RNA, 19 nt, Brucella suis 1330
acguacauuguuccggcac

SEQ ID NO: 455117 - RNA, 18 nt, Brucella suis 1330
acgguuuugcguuggaaa

SEQ ID NO: 455118 - RNA, 19 nt, Brucella suis 1330
acggucugugucacgcagc

SEQ ID NO: 455119 - RNA, 15 nt, Brucella suis 1330
acggucagaucaucu

SEQ ID NO: 455120 - RNA, 15 nt, Brucella suis 1330
acgggcgagcgccag

SEQ ID NO: 455121 - RNA, 16 nt, Brucella suis 1330
acgggcgaacgggggc

SEQ ID NO: 455122 - RNA, 21 nt, Brucella suis 1330
acggcggccuuggaggcggca

SEQ ID NO: 455123 - RNA, 19 nt, Brucella suis 1330
acggcgaaagcugccgcga

SEQ ID NO: 455124 - RNA, 13 nt, Brucella suis 1330
acggccaugcgca

SEQ ID NO: 455125 - RNA, 23 nt, Brucella suis 1330
acggcaagguggaucuugcgguu

SEQ ID NO: 455126 - RNA, 12 nt, Brucella suis 1330
acggauuuccac

SEQ ID NO: 455127 - RNA, 23 nt, Brucella suis 1330
acggaacgucacagauucaaaac

SEQ ID NO: 455128 - RNA, 13 nt, Brucella suis 1330
acgcaaggcggcu

SEQ ID NO: 455129 - RNA, 17 nt, Brucella suis 1330
acgcaaggcggcuggaa

SEQ ID NO: 455130 - RNA, 17 nt, Brucella suis 1330
acgcaaucuuugauaga

SEQ ID NO: 455131 - RNA, 21 nt, Brucella suis 1330
acgcaaugugcgggcuucuuc

SEQ ID NO: 455132 - RNA, 15 nt, Brucella suis 1330
acgcaaaggccaccc

SEQ ID NO: 455133 - RNA, 14 nt, Brucella suis 1330
acgauggcccagcg

SEQ ID NO: 455134 - RNA, 15 nt, Brucella suis 1330
acgaucuccaguaaa

SEQ ID NO: 455135 - RNA, 20 nt, Brucella suis 1330
acgauccagaucuuccuguc

SEQ ID NO: 455136 - RNA, 17 nt, Brucella suis 1330
acgauaccgagaacggc

SEQ ID NO: 455137 - RNA, 21 nt, Brucella suis 1330
acgaguaucuggcgauaaaga

SEQ ID NO: 455138 - RNA, 13 nt, Brucella suis 1330
acgagggguuuug

SEQ ID NO: 455139 - RNA, 23 nt, Brucella suis 1330
acgagaugcgcuuuccgggcugc

SEQ ID NO: 455140 - RNA, 14 nt, Brucella suis 1330
acgagacaaggcaa

SEQ ID NO: 455141 - RNA, 14 nt, Brucella suis 1330
acgacugaaauaau

SEQ ID NO: 455142 - RNA, 19 nt, Brucella suis 1330
acgacaugaaggagaggcc

SEQ ID NO: 455143 - RNA, 16 nt, Brucella suis 1330
acgaccagcgcaaugc

SEQ ID NO: 455144 - RNA, 14 nt, Brucella suis 1330
acgaauucaaccau

SEQ ID NO: 455145 - RNA, 15 nt, Brucella suis 1330
acgaacucgaugccu

SEQ ID NO: 455146 - RNA, 14 nt, Brucella suis 1330
acgaaaugaaagcc

SEQ ID NO: 455147 - RNA, 20 nt, Brucella suis 1330
acgaaagccacgcuccacac

SEQ ID NO: 455148 - RNA, 22 nt, Brucella suis 1330
acgaaaagcaggaucagggcca

SEQ ID NO: 455149 - RNA, 15 nt, Brucella suis 1330
acgaaaauaucggcu

SEQ ID NO: 455150 - RNA, 22 nt, Brucella suis 1330
accuuugaaauaauugucagga

SEQ ID NO: 455151 - RNA, 22 nt, Brucella suis 1330
accuuuucggcaaggaugcugc

SEQ ID NO: 455152 - RNA, 19 nt, Brucella suis 1330
accuugggguggucccaaa

SEQ ID NO: 455153 - RNA, 13 nt, Brucella suis 1330
accuucggccagc

SEQ ID NO: 455154 - RNA, 17 nt, Brucella suis 1330
accuuccgggcaauauc

SEQ ID NO: 455155 - RNA, 21 nt, Brucella suis 1330
accuuaaaguacacuccgcuc

SEQ ID NO: 455156 - RNA, 21 nt, Brucella suis 1330
accugggccacggcgaaagcu

SEQ ID NO: 455157 - RNA, 12 nt, Brucella suis 1330
accuggccagcc

SEQ ID NO: 455158 - RNA, 13 nt, Brucella suis 1330
accuggccagcca

SEQ ID NO: 455159 - RNA, 16 nt, Brucella suis 1330
accugcuucuugccuu

SEQ ID NO: 455160 - RNA, 21 nt, Brucella suis 1330
accugcccgucuuccuccgca

SEQ ID NO: 455161 - RNA, 17 nt, Brucella suis 1330
accugcccgcacccuau

SEQ ID NO: 455162 - RNA, 16 nt, Brucella suis 1330
accugauccagaagcc

SEQ ID NO: 455163 - RNA, 20 nt, Brucella suis 1330
accucguucaacgagaacaa

SEQ ID NO: 455164 - RNA, 13 nt, Brucella suis 1330
accucgaaaacau

SEQ ID NO: 455165 - RNA, 13 nt, Brucella suis 1330
accucauuugcca

SEQ ID NO: 455166 - RNA, 17 nt, Brucella suis 1330
accucauuugccaccug

SEQ ID NO: 455167 - RNA, 17 nt, Brucella suis 1330
accucccuguccugcca

SEQ ID NO: 455168 - RNA, 17 nt, Brucella suis 1330
accucaggaugagggag

SEQ ID NO: 455169 - RNA, 18 nt, Brucella suis 1330
accguugcauauuccaca

SEQ ID NO: 455170 - RNA, 22 nt, Brucella suis 1330
accguuuggaugugcagcgugc

SEQ ID NO: 455171 - RNA, 18 nt, Brucella suis 1330
accuaaaccuuugaaaua

SEQ ID NO: 455172 - RNA, 20 nt, Brucella suis 1330
accuaaaccuuugaaauaau

SEQ ID NO: 455173 - RNA, 21 nt, Brucella suis 1330
accuaaaccuuugaaauaauu

SEQ ID NO: 455174 - RNA, 13 nt, Brucella suis 1330
accguggcggccg

SEQ ID NO: 455175 - RNA, 21 nt, Brucella suis 1330
accggcugucccugcgggcca

SEQ ID NO: 455176 - RNA, 22 nt, Brucella suis 1330
accggcuucggccauuucaggu

SEQ ID NO: 455177 - RNA, 13 nt, Brucella suis 1330
accggcugggccu

SEQ ID NO: 455178 - RNA, 12 nt, Brucella suis 1330
accggcgaaaag

SEQ ID NO: 455179 - RNA, 14 nt, Brucella suis 1330
accggcgaaaaggc

SEQ ID NO: 455180 - RNA, 15 nt, Brucella suis 1330
accggcgaaaaggcg

SEQ ID NO: 455181 - RNA, 15 nt, Brucella suis 1330
accggccaugcccau

SEQ ID NO: 455182 - RNA, 12 nt, Brucella suis 1330
accggcauggau

SEQ ID NO: 455183 - RNA, 17 nt, Brucella suis 1330
accggccacccagcccg

SEQ ID NO: 455184 - RNA, 18 nt, Brucella suis 1330
accggccacccagcccga

SEQ ID NO: 455185 - RNA, 16 nt, Brucella suis 1330
accggccauaugaacg

SEQ ID NO: 455186 - RNA, 17 nt, Brucella suis 1330
accgcgcguaucggcaa

SEQ ID NO: 455187 - RNA, 22 nt, Brucella suis 1330
accgcucuagguacaugagcac

SEQ ID NO: 455188 - RNA, 17 nt, Brucella suis 1330
accgcgaaagccagaac

SEQ ID NO: 455189 - RNA, 13 nt, Brucella suis 1330
accgccuuuucca

SEQ ID NO: 455190 - RNA, 16 nt, Brucella suis 1330
accgccuuuuccagug

SEQ ID NO: 455191 - RNA, 17 nt, Brucella suis 1330
accgcauggaaacgcug

SEQ ID NO: 455192 - RNA, 20 nt, Brucella suis 1330
accgcacgcaaggcggcugg

SEQ ID NO: 455193 - RNA, 15 nt, Brucella suis 1330
accgcacguuggggg

SEQ ID NO: 455194 - RNA, 16 nt, Brucella suis 1330
accgcacguuggggga

SEQ ID NO: 455195 - RNA, 13 nt, Brucella suis 1330
accccucccucac

SEQ ID NO: 455196 - RNA, 19 nt, Brucella suis 1330
accgaugacgagccucgcc

SEQ ID NO: 455197 - RNA, 20 nt, Brucella suis 1330
accccgcacggucaugaugc

SEQ ID NO: 455198 - RNA, 19 nt, Brucella suis 1330
accccaugagaaggcaagc

SEQ ID NO: 455199 - RNA, 15 nt, Brucella suis 1330
acccagcuaaggccg

SEQ ID NO: 455200 - RNA, 18 nt, Brucella suis 1330
accauucugcccagaaau

SEQ ID NO: 455201 - RNA, 11 nt, Brucella suis 1330
accauauccuc

SEQ ID NO: 455202 - RNA, 13 nt, Brucella suis 1330
accaguggccuuc

SEQ ID NO: 455203 - RNA, 14 nt, Brucella suis 1330
accagguugcgccg

SEQ ID NO: 455204 - RNA, 14 nt, Brucella suis 1330
accagcgcauggca

SEQ ID NO: 455205 - RNA, 16 nt, Brucella suis 1330
accagcgcauggcaug

SEQ ID NO: 455206 - RNA, 21 nt, Brucella suis 1330
accagccuugcccuggcucuu

SEQ ID NO: 455207 - RNA, 19 nt, Brucella suis 1330
accagaucaagcgcucagc

SEQ ID NO: 455208 - RNA, 13 nt, Brucella suis 1330
accagagacagug

SEQ ID NO: 455209 - RNA, 17 nt, Brucella suis 1330
accacgauggaaggaaa

SEQ ID NO: 455210 - RNA, 23 nt, Brucella suis 1330
accaccgggcagucagcaccgua

SEQ ID NO: 455211 - RNA, 13 nt, Brucella suis 1330
accaccggccuga

SEQ ID NO: 455212 - RNA, 22 nt, Brucella suis 1330
accaccggccugagccauaucg

SEQ ID NO: 455213 - RNA, 14 nt, Brucella suis 1330
accacgacaaaacc

SEQ ID NO: 455214 - RNA, 16 nt, Brucella suis 1330
accaccagagcaaaaa

SEQ ID NO: 455215 - RNA, 11 nt, Brucella suis 1330
accaaggcagg

SEQ ID NO: 455216 - RNA, 22 nt, Brucella suis 1330
accaacccuuuuccgcaccgcc

SEQ ID NO: 455217 - RNA, 16 nt, Brucella suis 1330
accaacccuuuuucau

SEQ ID NO: 455218 - RNA, 23 nt, Brucella suis 1330
accaaucggccuuguaggaaagc

SEQ ID NO: 455219 - RNA, 20 nt, Brucella suis 1330
acauggcgggccaugccugc

SEQ ID NO: 455220 - RNA, 16 nt, Brucella suis 1330
acauuucaugaaaaug

SEQ ID NO: 455221 - RNA, 19 nt, Brucella suis 1330
acauuucaugaaaaugcca

SEQ ID NO: 455222 - RNA, 20 nt, Brucella suis 1330
acaugaugaucgccagcacg

SEQ ID NO: 455223 - RNA, 12 nt, Brucella suis 1330
acaugccaagag

SEQ ID NO: 455224 - RNA, 20 nt, Brucella suis 1330
acaugcuugccgaccuugag

SEQ ID NO: 455225 - RNA, 15 nt, Brucella suis 1330
acauggaaaugcagg

SEQ ID NO: 455226 - RNA, 17 nt, Brucella suis 1330
acaugagcaccggaagc

SEQ ID NO: 455227 - RNA, 21 nt, Brucella suis 1330
acaucgcccugaagaagcuuc

SEQ ID NO: 455228 - RNA, 13 nt, Brucella suis 1330
acauauucuuccg

SEQ ID NO: 455229 - RNA, 15 nt, Brucella suis 1330
acauauucuuccguc

SEQ ID NO: 455230 - RNA, 23 nt, Brucella suis 1330
acauauuugucgccgacuuucaa

SEQ ID NO: 455231 - RNA, 13 nt, Brucella suis 1330
acaucauugaacu

SEQ ID NO: 455232 - RNA, 19 nt, Brucella suis 1330
acaucauugaacugcggcu

SEQ ID NO: 455233 - RNA, 17 nt, Brucella suis 1330
acagucgaagcggccuu

SEQ ID NO: 455234 - RNA, 21 nt, Brucella suis 1330
acagggugacgacugaaauaa

SEQ ID NO: 455235 - RNA, 16 nt, Brucella suis 1330
acagggcgaaaagccg

SEQ ID NO: 455236 - RNA, 23 nt, Brucella suis 1330
acagggcgcugcgaaggcccuuc

SEQ ID NO: 455237 - RNA, 18 nt, Brucella suis 1330
acaggcucgggcagcuug

SEQ ID NO: 455238 - RNA, 17 nt, Brucella suis 1330
acaggcagcaugaacca

SEQ ID NO: 455239 - RNA, 22 nt, Brucella suis 1330
acaggagcggaagcauauguuc

SEQ ID NO: 455240 - RNA, 13 nt, Brucella suis 1330
acagcggcgcgcc

SEQ ID NO: 455241 - RNA, 13 nt, Brucella suis 1330
acagccuggauga

SEQ ID NO: 455242 - RNA, 20 nt, Brucella suis 1330
acagccuggcggcuauucca

SEQ ID NO: 455243 - RNA, 22 nt, Brucella suis 1330
acagccgguucggauccuccug

SEQ ID NO: 455244 - RNA, 19 nt, Brucella suis 1330
acagccuagacagcagugc

SEQ ID NO: 455245 - RNA, 16 nt, Brucella suis 1330
acagccagaaagaaga

SEQ ID NO: 455246 - RNA, 13 nt, Brucella suis 1330
acagagacaggaa

SEQ ID NO: 455247 - RNA, 17 nt, Brucella suis 1330
acagaugcgggacuugc

SEQ ID NO: 455248 - RNA, 20 nt, Brucella suis 1330
acagauugcuaaaugcaagc

SEQ ID NO: 455249 - RNA, 17 nt, Brucella suis 1330
acacuuuucgggaugcg

SEQ ID NO: 455250 - RNA, 22 nt, Brucella suis 1330
acacuuuucgggaugcgcucua

SEQ ID NO: 455251 - RNA, 22 nt, Brucella suis 1330
aauugguguagaagacaaagcc

SEQ ID NO: 455252 - RNA, 15 nt, Brucella suis 1330
aauugucaggaaaaa

SEQ ID NO: 455253 - RNA, 13 nt, Brucella suis 1330
aauuguuccagcc

SEQ ID NO: 455254 - RNA, 17 nt, Brucella suis 1330
aauuauugcgcuaucag

SEQ ID NO: 455255 - RNA, 21 nt, Brucella suis 1330
aauuccaugcgauagcggcgc

SEQ ID NO: 455256 - RNA, 19 nt, Brucella suis 1330
aauuccugcgccaccugca

SEQ ID NO: 455257 - RNA, 21 nt, Brucella suis 1330
aaugcgcuucuuccuucggca

SEQ ID NO: 455258 - RNA, 14 nt, Brucella suis 1330
aauggagcauuucc

SEQ ID NO: 455259 - RNA, 13 nt, Brucella suis 1330
aauggcccuguca

SEQ ID NO: 455260 - RNA, 14 nt, Brucella suis 1330
aaugcagccagagc

SEQ ID NO: 455261 - RNA, 20 nt, Brucella suis 1330
aaugcagcggguucauuuuc

SEQ ID NO: 455262 - RNA, 15 nt, Brucella suis 1330
aaugcaggcgcggca

SEQ ID NO: 455263 - RNA, 18 nt, Brucella suis 1330
aaugccggcgaucuuuuc

SEQ ID NO: 455264 - RNA, 21 nt, Brucella suis 1330
aaugccgugaagugaaaccag

SEQ ID NO: 455265 - RNA, 19 nt, Brucella suis 1330
aaugccuggcucaaacccg

SEQ ID NO: 455266 - RNA, 16 nt, Brucella suis 1330
aaugcgacaaaacaaa

SEQ ID NO: 455267 - RNA, 15 nt, Brucella suis 1330
aaugaacaacacaac

SEQ ID NO: 455268 - RNA, 13 nt, Brucella suis 1330
aaugcaaaugccg

SEQ ID NO: 455269 - RNA, 12 nt, Brucella suis 1330
aaucgcgcggcu

SEQ ID NO: 455270 - RNA, 16 nt, Brucella suis 1330
aauccuucagaagcac

SEQ ID NO: 455271 - RNA, 13 nt, Brucella suis 1330
aaucgcuggaacc

SEQ ID NO: 455272 - RNA, 13 nt, Brucella suis 1330
aaucgcuucacgc

SEQ ID NO: 455273 - RNA, 23 nt, Brucella suis 1330
aaucccggcuguuacauaugcug

SEQ ID NO: 455274 - RNA, 13 nt, Brucella suis 1330
aauccccucaccu

SEQ ID NO: 455275 - RNA, 15 nt, Brucella suis 1330
aaucccgaaaaguug

SEQ ID NO: 455276 - RNA, 16 nt, Brucella suis 1330
aaucagggaaaagccg

SEQ ID NO: 455277 - RNA, 23 nt, Brucella suis 1330
aaucauuuucucaagaugaaagg

SEQ ID NO: 455278 - RNA, 18 nt, Brucella suis 1330
aauagggaaacggccagg

SEQ ID NO: 455279 - RNA, 19 nt, Brucella suis 1330
aauagggaaacggccaggg

SEQ ID NO: 455280 - RNA, 18 nt, Brucella suis 1330
aauauagccgaugcagau

SEQ ID NO: 455281 - RNA, 20 nt, Brucella suis 1330
aauauagccgaugcagaugc

SEQ ID NO: 455282 - RNA, 20 nt, Brucella suis 1330
aauaugcgccuugcgccgca

SEQ ID NO: 455283 - RNA, 13 nt, Brucella suis 1330
aauagcauggccc

SEQ ID NO: 455284 - RNA, 12 nt, Brucella suis 1330
aauagcacauau

SEQ ID NO: 455285 - RNA, 20 nt, Brucella suis 1330
aauagaugagcugguuuuuc

SEQ ID NO: 455286 - RNA, 13 nt, Brucella suis 1330
aauagauuguggc

SEQ ID NO: 455287 - RNA, 19 nt, Brucella suis 1330
aauaauugucaggaaaaau

SEQ ID NO: 455288 - RNA, 17 nt, Brucella suis 1330
aauaagcuuuucauuuu

SEQ ID NO: 455289 - RNA, 22 nt, Brucella suis 1330
aauaaucguaucgccaaagacc

SEQ ID NO: 455290 - RNA, 15 nt, Brucella suis 1330
aagugugaugcgguu

SEQ ID NO: 455291 - RNA, 22 nt, Brucella suis 1330
aagugugcagacaggccagucg

SEQ ID NO: 455292 - RNA, 16 nt, Brucella suis 1330
aagggugcaagcgcaa

SEQ ID NO: 455293 - RNA, 16 nt, Brucella suis 1330
aagguauuugauguuu

SEQ ID NO: 455294 - RNA, 22 nt, Brucella suis 1330
aagguauuugauguuuuaggca

SEQ ID NO: 455295 - RNA, 23 nt, Brucella suis 1330
aaggaucgaagggcugagggaaa

SEQ ID NO: 455296 - RNA, 19 nt, Brucella suis 1330
aagcuugaucgccgcacgg

SEQ ID NO: 455297 - RNA, 20 nt, Brucella suis 1330
aaggaaaaaaccggcgauga

SEQ ID NO: 455298 - RNA, 15 nt, Brucella suis 1330
aaggaacgcggccuu

SEQ ID NO: 455299 - RNA, 18 nt, Brucella suis 1330
aagcgggaucagaaauca

SEQ ID NO: 455300 - RNA, 21 nt, Brucella suis 1330
aagcgggccuuuuucaugcug

SEQ ID NO: 455301 - RNA, 15 nt, Brucella suis 1330
aagcgcgccgaaaau

SEQ ID NO: 455302 - RNA, 22 nt, Brucella suis 1330
aagcgccuacgcggggaaauca

SEQ ID NO: 455303 - RNA, 18 nt, Brucella suis 1330
aagcgcauccagccggcg

SEQ ID NO: 455304 - RNA, 14 nt, Brucella suis 1330
aagcgcaaaacagc

SEQ ID NO: 455305 - RNA, 16 nt, Brucella suis 1330
aagcgaacgcacugca

SEQ ID NO: 455306 - RNA, 22 nt, Brucella suis 1330
aagcgaagaacagaagcaccag

SEQ ID NO: 455307 - RNA, 13 nt, Brucella suis 1330
aagcgaagauccc

SEQ ID NO: 455308 - RNA, 22 nt, Brucella suis 1330
aagcgacgauaucgccugcuuc

SEQ ID NO: 455309 - RNA, 19 nt, Brucella suis 1330
aagccuuuucgauaacgaa

SEQ ID NO: 455310 - RNA, 23 nt, Brucella suis 1330
aagccugcuacaaaaaacaacag

SEQ ID NO: 455311 - RNA, 16 nt, Brucella suis 1330
aagccggucugucauu

SEQ ID NO: 455312 - RNA, 16 nt, Brucella suis 1330
aagccgccucugucac

SEQ ID NO: 455313 - RNA, 23 nt, Brucella suis 1330
aagcccuuccacugcaaggaagg

SEQ ID NO: 455314 - RNA, 15 nt, Brucella suis 1330
aagccgaaugccagu

SEQ ID NO: 455315 - RNA, 16 nt, Brucella suis 1330
aagccgaaugccagug

SEQ ID NO: 455316 - RNA, 16 nt, Brucella suis 1330
aagcccggcuggaaca

SEQ ID NO: 455317 - RNA, 17 nt, Brucella suis 1330
aagcccgccacgaggaa

SEQ ID NO: 455318 - RNA, 19 nt, Brucella suis 1330
aagcccgccacgaggaaga

SEQ ID NO: 455319 - RNA, 21 nt, Brucella suis 1330
aagcccgccacgaggaagaaa

SEQ ID NO: 455320 - RNA, 23 nt, Brucella suis 1330
aagccccauguuuaugaaaacau

SEQ ID NO: 455321 - RNA, 20 nt, Brucella suis 1330
aagcccaagaaagaucagcc

SEQ ID NO: 455322 - RNA, 19 nt, Brucella suis 1330
aagccaucuuucuugaagu

SEQ ID NO: 455323 - RNA, 21 nt, Brucella suis 1330
aagaagcgcgggguguugcuc

SEQ ID NO: 455324 - RNA, 16 nt, Brucella suis 1330
aagaaggcgacgagac

SEQ ID NO: 455325 - RNA, 18 nt, Brucella suis 1330
aagaagauaaucagcaga

SEQ ID NO: 455326 - RNA, 19 nt, Brucella suis 1330
aagaagauaaucagcagaa

SEQ ID NO: 455327 - RNA, 14 nt, Brucella suis 1330
aagaacagcgcgaa

SEQ ID NO: 455328 - RNA, 12 nt, Brucella suis 1330
aagaacggcagg

SEQ ID NO: 455329 - RNA, 17 nt, Brucella suis 1330
aacuuccgguauaugca

SEQ ID NO: 455330 - RNA, 22 nt, Brucella suis 1330
aacuuccgguauaugcaccagc

SEQ ID NO: 455331 - RNA, 23 nt, Brucella suis 1330
aacuucgccaagcccuuccacug

SEQ ID NO: 455332 - RNA, 20 nt, Brucella suis 1330
aacuugcccgcauagccauc

SEQ ID NO: 455333 - RNA, 21 nt, Brucella suis 1330
aacuuugugccgccgcugaaa

SEQ ID NO: 455334 - RNA, 13 nt, Brucella suis 1330
aacuggcggauga

SEQ ID NO: 455335 - RNA, 19 nt, Brucella suis 1330
aacuggcggaugaagaaga

SEQ ID NO: 455336 - RNA, 23 nt, Brucella suis 1330
aacuggauccggcgaauggcuug

SEQ ID NO: 455337 - RNA, 18 nt, Brucella suis 1330
aacugcggaucggcuuca

SEQ ID NO: 455338 - RNA, 19 nt, Brucella suis 1330
aacugaaaaaggccgggaa

SEQ ID NO: 455339 - RNA, 17 nt, Brucella suis 1330
aacugagggauagaugg

SEQ ID NO: 455340 - RNA, 13 nt, Brucella suis 1330
aacucucacagcc

SEQ ID NO: 455341 - RNA, 23 nt, Brucella suis 1330
aacucuuuauccgugucguucuc

SEQ ID NO: 455342 - RNA, 15 nt, Brucella suis 1330
aacgucacagauuca

SEQ ID NO: 455343 - RNA, 21 nt, Brucella suis 1330
aacuacagccuggcggcuauu

SEQ ID NO: 455344 - RNA, 17 nt, Brucella suis 1330
aacuaccaucugccguc

SEQ ID NO: 455345 - RNA, 23 nt, Brucella suis 1330
aacgguggccuuccuucauacaa

SEQ ID NO: 455346 - RNA, 19 nt, Brucella suis 1330
aacgggggcgaucaucaau

SEQ ID NO: 455347 - RNA, 23 nt, Brucella suis 1330
aacgggcgagggcgggcggccag

SEQ ID NO: 455348 - RNA, 17 nt, Brucella suis 1330
aacggcugcaacaaaag

SEQ ID NO: 455349 - RNA, 18 nt, Brucella suis 1330
aacggcggaaagaagccc

SEQ ID NO: 455350 - RNA, 16 nt, Brucella suis 1330
aacggcccaugagcuu

SEQ ID NO: 455351 - RNA, 18 nt, Brucella suis 1330
aacggcccaugagcuuca

SEQ ID NO: 455352 - RNA, 22 nt, Brucella suis 1330
aacggauugccgagaucaccca

SEQ ID NO: 455353 - RNA, 13 nt, Brucella suis 1330
aacgcugcaacaa

SEQ ID NO: 455354 - RNA, 14 nt, Brucella suis 1330
aacgcugcaacaaa

SEQ ID NO: 455355 - RNA, 18 nt, Brucella suis 1330
aacgccuuuuucacugca

SEQ ID NO: 455356 - RNA, 18 nt, Brucella suis 1330
aacgcccgaucagauagc

SEQ ID NO: 455357 - RNA, 19 nt, Brucella suis 1330
aacgcccuucaaaccaucc

SEQ ID NO: 455358 - RNA, 19 nt, Brucella suis 1330
aacgcaauggagcaggaag

SEQ ID NO: 455359 - RNA, 19 nt, Brucella suis 1330
aacgcaccgggcuuuuuga

SEQ ID NO: 455360 - RNA, 19 nt, Brucella suis 1330
aacgcaccgugcuccagau

SEQ ID NO: 455361 - RNA, 22 nt, Brucella suis 1330
aacgcaccgugcuccagauacc

SEQ ID NO: 455362 - RNA, 13 nt, Brucella suis 1330
aacgcagcaucac

SEQ ID NO: 455363 - RNA, 22 nt, Brucella suis 1330
aacgcagccgggcuuugcauug

SEQ ID NO: 455364 - RNA, 17 nt, Brucella suis 1330
aacgaggccgaccagaa

SEQ ID NO: 455365 - RNA, 22 nt, Brucella suis 1330
aacgacuuuggccgucucugaa

SEQ ID NO: 455366 - RNA, 23 nt, Brucella suis 1330
aacgacuuuggccgucucugaag

SEQ ID NO: 455367 - RNA, 16 nt, Brucella suis 1330
aacgagacaaggcaau

SEQ ID NO: 455368 - RNA, 22 nt, Brucella suis 1330
aacgaauacagugacgcgcgca

SEQ ID NO: 455369 - RNA, 18 nt, Brucella suis 1330
aaccuuuucggcaaggau

SEQ ID NO: 455370 - RNA, 19 nt, Brucella suis 1330
aaccugcccgucgcaggcg

SEQ ID NO: 455371 - RNA, 20 nt, Brucella suis 1330
aaccuccgguucaugccgga

SEQ ID NO: 455372 - RNA, 21 nt, Brucella suis 1330
aaccuccgguucaugccggag

SEQ ID NO: 455373 - RNA, 15 nt, Brucella suis 1330
aaccuccgacaccag

SEQ ID NO: 455374 - RNA, 15 nt, Brucella suis 1330
aaccucgggcagggu

SEQ ID NO: 455375 - RNA, 20 nt, Brucella suis 1330
aacccuuuuucaugcaugau

SEQ ID NO: 455376 - RNA, 16 nt, Brucella suis 1330
aacccgccaccagacc

SEQ ID NO: 455377 - RNA, 13 nt, Brucella suis 1330
aaccccggcagcc

SEQ ID NO: 455378 - RNA, 16 nt, Brucella suis 1330
aaccccggcagccuuc

SEQ ID NO: 455379 - RNA, 16 nt, Brucella suis 1330
aacccaucaaugcacc

SEQ ID NO: 455380 - RNA, 12 nt, Brucella suis 1330
aaccaugcguuu

SEQ ID NO: 455381 - RNA, 17 nt, Brucella suis 1330
aaccaguggccuucagc

SEQ ID NO: 455382 - RNA, 19 nt, Brucella suis 1330
aaccauauaaagcuugaac

SEQ ID NO: 455383 - RNA, 14 nt, Brucella suis 1330
aaccaggccgcggg

SEQ ID NO: 455384 - RNA, 15 nt, Brucella suis 1330
aaccacgguggcuca

SEQ ID NO: 455385 - RNA, 21 nt, Brucella suis 1330
aacaugccugccgcagccagg

SEQ ID NO: 455386 - RNA, 22 nt, Brucella suis 1330
aacaugccugccgcagccaggg

SEQ ID NO: 455387 - RNA, 16 nt, Brucella suis 1330
aacauggaaaagcccg

SEQ ID NO: 455388 - RNA, 20 nt, Brucella suis 1330
aacauggacugaaugcagau

SEQ ID NO: 455389 - RNA, 22 nt, Brucella suis 1330
aacauggugaugcgaauuucau

SEQ ID NO: 455390 - RNA, 19 nt, Brucella suis 1330
aacaucccgguugagccgu

SEQ ID NO: 455391 - RNA, 18 nt, Brucella suis 1330
aacaucgacauggacagg

SEQ ID NO: 455392 - RNA, 14 nt, Brucella suis 1330
aacagggcgaaaag

SEQ ID NO: 455393 - RNA, 22 nt, Brucella suis 1330
aacauauaaagcaaaggccccg

SEQ ID NO: 455394 - RNA, 19 nt, Brucella suis 1330
aacagcguucaacuccguc

SEQ ID NO: 455395 - RNA, 18 nt, Brucella suis 1330
aacagcgcgaacaugccu

SEQ ID NO: 455396 - RNA, 22 nt, Brucella suis 1330
aacagcaguaccgacaugccaa

SEQ ID NO: 455397 - RNA, 14 nt, Brucella suis 1330
aacagcaagguauu

SEQ ID NO: 455398 - RNA, 13 nt, Brucella suis 1330
aacacgagagcgu

SEQ ID NO: 455399 - RNA, 17 nt, Brucella suis 1330
aacaccguggacgucgu

SEQ ID NO: 455400 - RNA, 22 nt, Brucella suis 1330
aacaccaaaaacuuggaaauug

SEQ ID NO: 455401 - RNA, 15 nt, Brucella suis 1330
aacacaaucgccgga

SEQ ID NO: 455402 - RNA, 13 nt, Brucella suis 1330
aaauugcacauga

SEQ ID NO: 455403 - RNA, 13 nt, Brucella suis 1330
aacaaaagaagau

SEQ ID NO: 455404 - RNA, 15 nt, Brucella suis 1330
aacaaaagaagauuu

SEQ ID NO: 455405 - RNA, 12 nt, Brucella suis 1330
aacaaaaugccc

SEQ ID NO: 455406 - RNA, 19 nt, Brucella suis 1330
aacaacgggguugagguuc

SEQ ID NO: 455407 - RNA, 17 nt, Brucella suis 1330
aacaagcagaugcagcg

SEQ ID NO: 455408 - RNA, 21 nt, Brucella suis 1330
uuuagauuaugcuuuaaaagc

SEQ ID NO: 455409 - RNA, 23 nt, Brucella suis 1330
uuuaugcuggcagcggcaggagc

SEQ ID NO: 455410 - RNA, 21 nt, Brucella suis 1330
uuguuccagccgggcuuuccu

SEQ ID NO: 455411 - RNA, 20 nt, Brucella suis 1330
uuguuccagucgccuuccgg

SEQ ID NO: 455412 - RNA, 14 nt, Brucella suis 1330
uuguguacccaaac

SEQ ID NO: 455413 - RNA, 13 nt, Brucella suis 1330
uugugugccugug

SEQ ID NO: 455414 - RNA, 19 nt, Brucella suis 1330
uuguucgacuugaagagcc

SEQ ID NO: 455415 - RNA, 17 nt, Brucella suis 1330
uuguugaaagaaaagac

SEQ ID NO: 455416 - RNA, 16 nt, Brucella suis 1330
uuguggcaaaagccuc

SEQ ID NO: 455417 - RNA, 19 nt, Brucella suis 1330
uugugaucgccacucuugu

SEQ ID NO: 455418 - RNA, 17 nt, Brucella suis 1330
uugucgucgugcagcgg

SEQ ID NO: 455419 - RNA, 18 nt, Brucella suis 1330
uugucuguuguguuguug

SEQ ID NO: 455420 - RNA, 13 nt, Brucella suis 1330
uugucgagcggca

SEQ ID NO: 455421 - RNA, 18 nt, Brucella suis 1330
uugucgccgacuuucaau

SEQ ID NO: 455422 - RNA, 18 nt, Brucella suis 1330
uuguagacgaucuugcca

SEQ ID NO: 455423 - RNA, 13 nt, Brucella suis 1330
uugguugcgcgcc

SEQ ID NO: 455424 - RNA, 15 nt, Brucella suis 1330
uuguaauugaugcca

SEQ ID NO: 455425 - RNA, 22 nt, Brucella suis 1330
uugguaaaggcgaguuuucaaa

SEQ ID NO: 455426 - RNA, 11 nt, Brucella suis 1330
uugggcagcag

SEQ ID NO: 455427 - RNA, 19 nt, Brucella suis 1330
uugggagcggcgccaacca

SEQ ID NO: 455428 - RNA, 15 nt, Brucella suis 1330
uuggcuaaagauacc

SEQ ID NO: 455429 - RNA, 18 nt, Brucella suis 1330
uuggcucgaaaaugcucu

SEQ ID NO: 455430 - RNA, 14 nt, Brucella suis 1330
uuggccucuuccag

SEQ ID NO: 455431 - RNA, 18 nt, Brucella suis 1330
uuggauagaccaccgcac

SEQ ID NO: 455432 - RNA, 15 nt, Brucella suis 1330
uuggcaacaucacca

SEQ ID NO: 455433 - RNA, 15 nt, Brucella suis 1330
uugcuucgcaccuuc

SEQ ID NO: 455434 - RNA, 15 nt, Brucella suis 1330
uugcuuuauccgcaa

SEQ ID NO: 455435 - RNA, 19 nt, Brucella suis 1330
uugcggggcuuccacagcc

SEQ ID NO: 455436 - RNA, 14 nt, Brucella suis 1330
uugcggcuugccac

SEQ ID NO: 455437 - RNA, 14 nt, Brucella suis 1330
uugcgggaacccuc

SEQ ID NO: 455438 - RNA, 14 nt, Brucella suis 1330
uugcgcguugcguc

SEQ ID NO: 455439 - RNA, 15 nt, Brucella suis 1330
uugcgauauccagcu

SEQ ID NO: 455440 - RNA, 12 nt, Brucella suis 1330
uugcgaaccgga

SEQ ID NO: 455441 - RNA, 17 nt, Brucella suis 1330
uugcgaccaugagcaga

SEQ ID NO: 455442 - RNA, 19 nt, Brucella suis 1330
uugccgugguaugccagcc

SEQ ID NO: 455443 - RNA, 23 nt, Brucella suis 1330
uugcaucugauuugaaaagcccc

SEQ ID NO: 455444 - RNA, 22 nt, Brucella suis 1330
uugauuucggauugaagccgau

SEQ ID NO: 455445 - RNA, 21 nt, Brucella suis 1330
uugaucgcaagccaaagcccg

SEQ ID NO: 455446 - RNA, 18 nt, Brucella suis 1330
uugaggcauugcgcggca

SEQ ID NO: 455447 - RNA, 18 nt, Brucella suis 1330
uugaggcgggggcgcuuu

SEQ ID NO: 455448 - RNA, 14 nt, Brucella suis 1330
uugaggauuuccac

SEQ ID NO: 455449 - RNA, 21 nt, Brucella suis 1330
uugauaaucggacagauugcu

SEQ ID NO: 455450 - RNA, 20 nt, Brucella suis 1330
uugagccgcgccaugccauc

SEQ ID NO: 455451 - RNA, 21 nt, Brucella suis 1330
uucuuggccaugaugccgaca

SEQ ID NO: 455452 - RNA, 20 nt, Brucella suis 1330
uucuucggccaugcguugcu

SEQ ID NO: 455453 - RNA, 17 nt, Brucella suis 1330
uucuuccaguuucugaa

SEQ ID NO: 455454 - RNA, 17 nt, Brucella suis 1330
uucuuccaguuccuucu

SEQ ID NO: 455455 - RNA, 18 nt, Brucella suis 1330
uucuuccaguuccuucuu

SEQ ID NO: 455456 - RNA, 16 nt, Brucella suis 1330
uucuucaccagccuug

SEQ ID NO: 455457 - RNA, 21 nt, Brucella suis 1330
uucuucaccagccuugagggc

SEQ ID NO: 455458 - RNA, 23 nt, Brucella suis 1330
uucuuccagacagccuugucgcc

SEQ ID NO: 455459 - RNA, 14 nt, Brucella suis 1330
uucugggccuuugu

SEQ ID NO: 455460 - RNA, 15 nt, Brucella suis 1330
uucuguuaucccuca

SEQ ID NO: 455461 - RNA, 18 nt, Brucella suis 1330
uucugagaaaaaaaugcg

SEQ ID NO: 455462 - RNA, 18 nt, Brucella suis 1330
uucuccgcagccgccaac

SEQ ID NO: 455463 - RNA, 21 nt, Brucella suis 1330
uucguugcuuccguggcaaug

SEQ ID NO: 455464 - RNA, 12 nt, Brucella suis 1330
uucguugugcca

SEQ ID NO: 455465 - RNA, 13 nt, Brucella suis 1330
uucguccuugacg

SEQ ID NO: 455466 - RNA, 19 nt, Brucella suis 1330
uucggggcuuggcuugccg

SEQ ID NO: 455467 - RNA, 16 nt, Brucella suis 1330
uucgggcggcaccccc

SEQ ID NO: 455468 - RNA, 12 nt, Brucella suis 1330
uucggccugugc

SEQ ID NO: 455469 - RNA, 12 nt, Brucella suis 1330
uucggccagcgc

SEQ ID NO: 455470 - RNA, 14 nt, Brucella suis 1330
uucgcgcagaaggc

SEQ ID NO: 455471 - RNA, 12 nt, Brucella suis 1330
uucgcccacgcc

SEQ ID NO: 455472 - RNA, 22 nt, Brucella suis 1330
uucgccagcaccucgaaaacau

SEQ ID NO: 455473 - RNA, 23 nt, Brucella suis 1330
uucgauggcguucgucaaugcgc

SEQ ID NO: 455474 - RNA, 21 nt, Brucella suis 1330
uucgaucgacccgccaugcgg

SEQ ID NO: 455475 - RNA, 15 nt, Brucella suis 1330
uucgagcgccuugga

SEQ ID NO: 455476 - RNA, 20 nt, Brucella suis 1330
uucgagcugacgaauaauga

SEQ ID NO: 455477 - RNA, 13 nt, Brucella suis 1330
uucgagccaaaag

SEQ ID NO: 455478 - RNA, 13 nt, Brucella suis 1330
uuccuuaucgagg

SEQ ID NO: 455479 - RNA, 14 nt, Brucella suis 1330
uuccuucuccaucu

SEQ ID NO: 455480 - RNA, 18 nt, Brucella suis 1330
uuccgguauaugcaccag

SEQ ID NO: 455481 - RNA, 18 nt, Brucella suis 1330
uuccgguuaaaauggaau

SEQ ID NO: 455482 - RNA, 19 nt, Brucella suis 1330
uuccguuuuaaccggaacc

SEQ ID NO: 455483 - RNA, 22 nt, Brucella suis 1330
uuccugacccauggccugcugc

SEQ ID NO: 455484 - RNA, 18 nt, Brucella suis 1330
uuccugaccguuucgaua

SEQ ID NO: 455485 - RNA, 18 nt, Brucella suis 1330
uuccgggaauuccugaac

SEQ ID NO: 455486 - RNA, 16 nt, Brucella suis 1330
uuccgggucuucgccc

SEQ ID NO: 455487 - RNA, 16 nt, Brucella suis 1330
uuccgccgaucugcac

SEQ ID NO: 455488 - RNA, 12 nt, Brucella suis 1330
uuccgccucccu

SEQ ID NO: 455489 - RNA, 20 nt, Brucella suis 1330
uuccgcgcaaaaucugcucg

SEQ ID NO: 455490 - RNA, 21 nt, Brucella suis 1330
uuccccgcauaaaugcuccug

SEQ ID NO: 455491 - RNA, 22 nt, Brucella suis 1330
uuccccuaaaucacucccgcau

SEQ ID NO: 455492 - RNA, 17 nt, Brucella suis 1330
uuccccuauuccccuau

SEQ ID NO: 455493 - RNA, 19 nt, Brucella suis 1330
uucccccaauaucgcgccg

SEQ ID NO: 455494 - RNA, 17 nt, Brucella suis 1330
uucaugccgccgugggc

SEQ ID NO: 455495 - RNA, 15 nt, Brucella suis 1330
uucaugcugauugga

SEQ ID NO: 455496 - RNA, 16 nt, Brucella suis 1330
uucauggcuugaagcg

SEQ ID NO: 455497 - RNA, 14 nt, Brucella suis 1330
uucauucaaucugc

SEQ ID NO: 455498 - RNA, 16 nt, Brucella suis 1330
uucauuuuuagaagau

SEQ ID NO: 455499 - RNA, 22 nt, Brucella suis 1330
uucaucagcacgaaaugaaagc

SEQ ID NO: 455500 - RNA, 19 nt, Brucella suis 1330
uucagcgccacgccuucaa

SEQ ID NO: 455501 - RNA, 15 nt, Brucella suis 1330
uucagcgaagcgaug

SEQ ID NO: 455502 - RNA, 18 nt, Brucella suis 1330
uucaguuuguugaaacag

SEQ ID NO: 455503 - RNA, 23 nt, Brucella suis 1330
uucauaaacgcggguggauggaa

SEQ ID NO: 455504 - RNA, 21 nt, Brucella suis 1330
uucacgcgagcgcagcggcag

SEQ ID NO: 455505 - RNA, 22 nt, Brucella suis 1330
uucaccagucacgguugccuug

SEQ ID NO: 455506 - RNA, 18 nt, Brucella suis 1330
uucagaaagaaagcuguc

SEQ ID NO: 455507 - RNA, 14 nt, Brucella suis 1330
uucagccugcgagg

SEQ ID NO: 455508 - RNA, 15 nt, Brucella suis 1330
uucaaucugcauaau

SEQ ID NO: 455509 - RNA, 15 nt, Brucella suis 1330
uucacaugcuugccg

SEQ ID NO: 455510 - RNA, 14 nt, Brucella suis 1330
uuauucgucagcuc

SEQ ID NO: 455511 - RNA, 19 nt, Brucella suis 1330
uuauuggaacucgaagaug

SEQ ID NO: 455512 - RNA, 12 nt, Brucella suis 1330
uucaacgcuguc

SEQ ID NO: 455513 - RNA, 19 nt, Brucella suis 1330
uucaacuccgucagacgau

SEQ ID NO: 455514 - RNA, 18 nt, Brucella suis 1330
uucaacuguguugccagc

SEQ ID NO: 455515 - RNA, 13 nt, Brucella suis 1330
uuacgcgccgcca

SEQ ID NO: 455516 - RNA, 18 nt, Brucella suis 1330
uuacgcgccgccaggcaa

SEQ ID NO: 455517 - RNA, 21 nt, Brucella suis 1330
uuacgccauauugggagcgca

SEQ ID NO: 455518 - RNA, 13 nt, Brucella suis 1330
uuacgggcggcag

SEQ ID NO: 455519 - RNA, 21 nt, Brucella suis 1330
uuagauuaugcuuuaaaagca

SEQ ID NO: 455520 - RNA, 20 nt, Brucella suis 1330
uuacaaaaauggaaaaaccc

SEQ ID NO: 455521 - RNA, 21 nt, Brucella suis 1330
uuacaucaaaccaguugaagc

SEQ ID NO: 455522 - RNA, 16 nt, Brucella suis 1330
uguuuucgcgcagaag

SEQ ID NO: 455523 - RNA, 12 nt, Brucella suis 1330
uguuuuggaaag

SEQ ID NO: 455524 - RNA, 16 nt, Brucella suis 1330
uguuuuuacgcauuau

SEQ ID NO: 455525 - RNA, 13 nt, Brucella suis 1330
uguuguuucaggc

SEQ ID NO: 455526 - RNA, 20 nt, Brucella suis 1330
uguugccggaaauugggauc

SEQ ID NO: 455527 - RNA, 19 nt, Brucella suis 1330
uguugcacuuuggcaacaa

SEQ ID NO: 455528 - RNA, 15 nt, Brucella suis 1330
uguugcagccguccc

SEQ ID NO: 455529 - RNA, 14 nt, Brucella suis 1330
uguucuuugcagcc

SEQ ID NO: 455530 - RNA, 17 nt, Brucella suis 1330
uguucgaugccauucac

SEQ ID NO: 455531 - RNA, 16 nt, Brucella suis 1330
uguucggguagagcuu

SEQ ID NO: 455532 - RNA, 20 nt, Brucella suis 1330
uguuccagccgggcuuuccu

SEQ ID NO: 455533 - RNA, 23 nt, Brucella suis 1330
uguuccagccgggcuuuccugca

SEQ ID NO: 455534 - RNA, 19 nt, Brucella suis 1330
uguuccgcaccgcacuggg

SEQ ID NO: 455535 - RNA, 17 nt, Brucella suis 1330
uguggugugagugcgca

SEQ ID NO: 455536 - RNA, 16 nt, Brucella suis 1330
uguggcaaaagccucc

SEQ ID NO: 455537 - RNA, 20 nt, Brucella suis 1330
ugugugaacaggucugacgg

SEQ ID NO: 455538 - RNA, 16 nt, Brucella suis 1330
ugugcgggcuucuucc

SEQ ID NO: 455539 - RNA, 18 nt, Brucella suis 1330
ugugcgggcuucuuccag

SEQ ID NO: 455540 - RNA, 23 nt, Brucella suis 1330
ugugcgggcuucuuccaguuccu

SEQ ID NO: 455541 - RNA, 18 nt, Brucella suis 1330
ugugcauaggauucgcgg

SEQ ID NO: 455542 - RNA, 13 nt, Brucella suis 1330
ugugcagcgugcc

SEQ ID NO: 455543 - RNA, 17 nt, Brucella suis 1330
ugucgcggccuugaucc

SEQ ID NO: 455544 - RNA, 16 nt, Brucella suis 1330
uguccaccaccugccc

SEQ ID NO: 455545 - RNA, 15 nt, Brucella suis 1330
uguccagaaagagca

SEQ ID NO: 455546 - RNA, 16 nt, Brucella suis 1330
uguccagaaagagcau

SEQ ID NO: 455547 - RNA, 16 nt, Brucella suis 1330
ugucacgccggcauca

SEQ ID NO: 455548 - RNA, 12 nt, Brucella suis 1330
uguaggaaagca

SEQ ID NO: 455549 - RNA, 21 nt, Brucella suis 1330
uguacacgccaaccaaagaaa

SEQ ID NO: 455550 - RNA, 23 nt, Brucella suis 1330
uggucuucuugcguggcgggggc

SEQ ID NO: 455551 - RNA, 17 nt, Brucella suis 1330
uggucgacaaugaagca

SEQ ID NO: 455552 - RNA, 13 nt, Brucella suis 1330
uggucaugcgcgg

SEQ ID NO: 455553 - RNA, 19 nt, Brucella suis 1330
uggucaugcgcggcauggg

SEQ ID NO: 455554 - RNA, 15 nt, Brucella suis 1330
uggucaagagcccca

SEQ ID NO: 455555 - RNA, 23 nt, Brucella suis 1330
ugguaaaaugcaccgccugccag

SEQ ID NO: 455556 - RNA, 20 nt, Brucella suis 1330
uggggcuuuuuacauucugu

SEQ ID NO: 455557 - RNA, 15 nt, Brucella suis 1330
uggggcaugacaucc

SEQ ID NO: 455558 - RNA, 19 nt, Brucella suis 1330
ugggcguguuugcggccuu

SEQ ID NO: 455559 - RNA, 16 nt, Brucella suis 1330
ugggcggcggccgggc

SEQ ID NO: 455560 - RNA, 20 nt, Brucella suis 1330
ugggcggggagcaggcaggc

SEQ ID NO: 455561 - RNA, 18 nt, Brucella suis 1330
ugggcaaggccagagagc

SEQ ID NO: 455562 - RNA, 13 nt, Brucella suis 1330
ugggcaagugcac

SEQ ID NO: 455563 - RNA, 12 nt, Brucella suis 1330
uggcuuccagca

SEQ ID NO: 455564 - RNA, 20 nt, Brucella suis 1330
uggcuuccagcgucaggaca

SEQ ID NO: 455565 - RNA, 17 nt, Brucella suis 1330
uggcuucaacaugcaca

SEQ ID NO: 455566 - RNA, 21 nt, Brucella suis 1330
uggcguugcggcggucggccu

SEQ ID NO: 455567 - RNA, 17 nt, Brucella suis 1330
uggcguugagccgcgcc

SEQ ID NO: 455568 - RNA, 14 nt, Brucella suis 1330
uggcggggcagggg

SEQ ID NO: 455569 - RNA, 18 nt, Brucella suis 1330
uggcgggccauuuccaau

SEQ ID NO: 455570 - RNA, 18 nt, Brucella suis 1330
uggcggcaaaaagcggcg

SEQ ID NO: 455571 - RNA, 14 nt, Brucella suis 1330
uggcggaugaagaa

SEQ ID NO: 455572 - RNA, 16 nt, Brucella suis 1330
uggcggauugcagcgg

SEQ ID NO: 455573 - RNA, 20 nt, Brucella suis 1330
uggcgcucaugaaacugucc

SEQ ID NO: 455574 - RNA, 14 nt, Brucella suis 1330
uggcgaucacgaaa

SEQ ID NO: 455575 - RNA, 23 nt, Brucella suis 1330
uggcgauaaagaugcgcgccagc

SEQ ID NO: 455576 - RNA, 19 nt, Brucella suis 1330
uggccucgauggccugcac

SEQ ID NO: 455577 - RNA, 21 nt, Brucella suis 1330
uggccucgauggccugcacau

SEQ ID NO: 455578 - RNA, 13 nt, Brucella suis 1330
uggccucuuccag

SEQ ID NO: 455579 - RNA, 14 nt, Brucella suis 1330
uggccucuuccagg

SEQ ID NO: 455580 - RNA, 16 nt, Brucella suis 1330
uggccucuuccaggag

SEQ ID NO: 455581 - RNA, 23 nt, Brucella suis 1330
uggccgucccggaagccgccuuc

SEQ ID NO: 455582 - RNA, 17 nt, Brucella suis 1330
uggccgucgcguucagc

SEQ ID NO: 455583 - RNA, 23 nt, Brucella suis 1330
uggccggcgccuuguucuuuguc

SEQ ID NO: 455584 - RNA, 23 nt, Brucella suis 1330
uggccgcuuugcggaggcggcug

SEQ ID NO: 455585 - RNA, 13 nt, Brucella suis 1330
uggccgccccggc

SEQ ID NO: 455586 - RNA, 21 nt, Brucella suis 1330
uggcagcaaauucaaagaauu

SEQ ID NO: 455587 - RNA, 22 nt, Brucella suis 1330
uggcaaucuugaccuggccagc

SEQ ID NO: 455588 - RNA, 22 nt, Brucella suis 1330
ugcguuaaagagccauuauucu

SEQ ID NO: 455589 - RNA, 21 nt, Brucella suis 1330
ugcguaccauaggcgcgcgca

SEQ ID NO: 455590 - RNA, 18 nt, Brucella suis 1330
ugcggguugcgcccggau

SEQ ID NO: 455591 - RNA, 13 nt, Brucella suis 1330
ugcggggcuucca

SEQ ID NO: 455592 - RNA, 16 nt, Brucella suis 1330
ugcgggcuucuuccag

SEQ ID NO: 455593 - RNA, 23 nt, Brucella suis 1330
ugcgggcaagcauuccgggccgc

SEQ ID NO: 455594 - RNA, 18 nt, Brucella suis 1330
ugcggaggcggcugccuu

SEQ ID NO: 455595 - RNA, 14 nt, Brucella suis 1330
ugcgcugauucugg

SEQ ID NO: 455596 - RNA, 18 nt, Brucella suis 1330
ugcgcgcgccaucggcaa

SEQ ID NO: 455597 - RNA, 18 nt, Brucella suis 1330
ugcgcggacgggcaggca

SEQ ID NO: 455598 - RNA, 16 nt, Brucella suis 1330
ugcgcgaauuccaugc

SEQ ID NO: 455599 - RNA, 15 nt, Brucella suis 1330
ugcgccuaccaaggc

SEQ ID NO: 455600 - RNA, 21 nt, Brucella suis 1330
ugcgcaucuuugcccuugccu

SEQ ID NO: 455601 - RNA, 18 nt, Brucella suis 1330
ugcgcaugaagcgcggcg

SEQ ID NO: 455602 - RNA, 22 nt, Brucella suis 1330
ugcgcaugaucauauacggcuu

SEQ ID NO: 455603 - RNA, 15 nt, Brucella suis 1330
ugcgcauuacggcca

SEQ ID NO: 455604 - RNA, 17 nt, Brucella suis 1330
ugcgcaugggacuggac

SEQ ID NO: 455605 - RNA, 18 nt, Brucella suis 1330
ugcgcagcucggcuucaa

SEQ ID NO: 455606 - RNA, 18 nt, Brucella suis 1330
ugccguugagaaucgcac

SEQ ID NO: 455607 - RNA, 23 nt, Brucella suis 1330
ugccguuuuucacauagccugca

SEQ ID NO: 455608 - RNA, 12 nt, Brucella suis 1330
ugccgggcgggc

SEQ ID NO: 455609 - RNA, 15 nt, Brucella suis 1330
ugccgggcgggcagc

SEQ ID NO: 455610 - RNA, 21 nt, Brucella suis 1330
ugccgggcgggcagcacugaa

SEQ ID NO: 455611 - RNA, 13 nt, Brucella suis 1330
ugccgcuuccagc

SEQ ID NO: 455612 - RNA, 17 nt, Brucella suis 1330
ugccgcuuuucauguuu

SEQ ID NO: 455613 - RNA, 21 nt, Brucella suis 1330
ugccgcucggcgaugaagcgg

SEQ ID NO: 455614 - RNA, 16 nt, Brucella suis 1330
ugccgcguccggcauu

SEQ ID NO: 455615 - RNA, 23 nt, Brucella suis 1330
ugccgcggcucucacgcgcagca

SEQ ID NO: 455616 - RNA, 20 nt, Brucella suis 1330
ugccgcgcgcggcuuccagc

SEQ ID NO: 455617 - RNA, 21 nt, Brucella suis 1330
ugccgccuuucaugcccugac

SEQ ID NO: 455618 - RNA, 13 nt, Brucella suis 1330
ugccgccgcugaa

SEQ ID NO: 455619 - RNA, 16 nt, Brucella suis 1330
ugccgccgcuuccagc

SEQ ID NO: 455620 - RNA, 20 nt, Brucella suis 1330
ugccgcccaucccggaagga

SEQ ID NO: 455621 - RNA, 13 nt, Brucella suis 1330
ugccgcaggauuu

SEQ ID NO: 455622 - RNA, 14 nt, Brucella suis 1330
ugccgcagccaggg

SEQ ID NO: 455623 - RNA, 17 nt, Brucella suis 1330
ugccgcaacaagacgga

SEQ ID NO: 455624 - RNA, 18 nt, Brucella suis 1330
ugccgauuucggcgugca

SEQ ID NO: 455625 - RNA, 18 nt, Brucella suis 1330
ugccgauggugacggucg

SEQ ID NO: 455626 - RNA, 14 nt, Brucella suis 1330
ugccgaagccaggu

SEQ ID NO: 455627 - RNA, 16 nt, Brucella suis 1330
ugccgaagcccauggc

SEQ ID NO: 455628 - RNA, 12 nt, Brucella suis 1330
ugccgaaaagcc

SEQ ID NO: 455629 - RNA, 19 nt, Brucella suis 1330
ugcccuugcgaauggcaau

SEQ ID NO: 455630 - RNA, 18 nt, Brucella suis 1330
ugcccuggaugcggaaca

SEQ ID NO: 455631 - RNA, 17 nt, Brucella suis 1330
ugcccuugagagccaga

SEQ ID NO: 455632 - RNA, 17 nt, Brucella suis 1330
ugcccuuccgggccgca

SEQ ID NO: 455633 - RNA, 17 nt, Brucella suis 1330
ugcccugcugcaacaaa

SEQ ID NO: 455634 - RNA, 14 nt, Brucella suis 1330
ugcccucgccgccg

SEQ ID NO: 455635 - RNA, 20 nt, Brucella suis 1330
ugcccggaagcgaaaugccg

SEQ ID NO: 455636 - RNA, 15 nt, Brucella suis 1330
ugcccgccggggccg

SEQ ID NO: 455637 - RNA, 15 nt, Brucella suis 1330
ugcccgccgcaagcu

SEQ ID NO: 455638 - RNA, 21 nt, Brucella suis 1330
ugcccgcacccuauuccccua

SEQ ID NO: 455639 - RNA, 22 nt, Brucella suis 1330
ugcccgcacccuauuccccuau

SEQ ID NO: 455640 - RNA, 14 nt, Brucella suis 1330
ugcccgccaauacc

SEQ ID NO: 455641 - RNA, 11 nt, Brucella suis 1330
ugccccggcac

SEQ ID NO: 455642 - RNA, 13 nt, Brucella suis 1330
ugccccggcaccg

SEQ ID NO: 455643 - RNA, 16 nt, Brucella suis 1330
ugcccauugcccgccc

SEQ ID NO: 455644 - RNA, 18 nt, Brucella suis 1330
ugcccauguccgccugau

SEQ ID NO: 455645 - RNA, 16 nt, Brucella suis 1330
ugcccacaucgccuug

SEQ ID NO: 455646 - RNA, 20 nt, Brucella suis 1330
ugcccaaaagcgcgccgaaa

SEQ ID NO: 455647 - RNA, 21 nt, Brucella suis 1330
ugccauucugucggcgcugcu

SEQ ID NO: 455648 - RNA, 13 nt, Brucella suis 1330
ugccauugccgcg

SEQ ID NO: 455649 - RNA, 21 nt, Brucella suis 1330
ugccauggaacagacaggauu

SEQ ID NO: 455650 - RNA, 14 nt, Brucella suis 1330
ugccauggcaguga

SEQ ID NO: 455651 - RNA, 13 nt, Brucella suis 1330
ugccauccacaaa

SEQ ID NO: 455652 - RNA, 13 nt, Brucella suis 1330
ugccaucgcgcca

SEQ ID NO: 455653 - RNA, 19 nt, Brucella suis 1330
ugccauagccuuucugcca

SEQ ID NO: 455654 - RNA, 20 nt, Brucella suis 1330
ugccaucaagcgucaugcca

SEQ ID NO: 455655 - RNA, 21 nt, Brucella suis 1330
ugccagcccgaagcgcaaagc

SEQ ID NO: 455656 - RNA, 23 nt, Brucella suis 1330
ugccaaccguaucauccggcgug

SEQ ID NO: 455657 - RNA, 18 nt, Brucella suis 1330
ugccaaccauugaucuuc

SEQ ID NO: 455658 - RNA, 17 nt, Brucella suis 1330
ugccagaugugccacca

SEQ ID NO: 455659 - RNA, 13 nt, Brucella suis 1330
ugccagcaauugc

SEQ ID NO: 455660 - RNA, 20 nt, Brucella suis 1330
ugcaugugcggugagaagaa

SEQ ID NO: 455661 - RNA, 15 nt, Brucella suis 1330
ugcaugggcaagaca

SEQ ID NO: 455662 - RNA, 17 nt, Brucella suis 1330
ugcaucgaaugccgcau

SEQ ID NO: 455663 - RNA, 12 nt, Brucella suis 1330
ugcauauuaagc

SEQ ID NO: 455664 - RNA, 14 nt, Brucella suis 1330
ugcauauuccacau

SEQ ID NO: 455665 - RNA, 14 nt, Brucella suis 1330
ugcagggcuugcuu

SEQ ID NO: 455666 - RNA, 21 nt, Brucella suis 1330
ugcagagcgcauccagcgagu

SEQ ID NO: 455667 - RNA, 21 nt, Brucella suis 1330
ugcagauaaagggugauggcg

SEQ ID NO: 455668 - RNA, 18 nt, Brucella suis 1330
ugcagaacaaagaaguug

SEQ ID NO: 455669 - RNA, 15 nt, Brucella suis 1330
ugcagaacgucucgg

SEQ ID NO: 455670 - RNA, 19 nt, Brucella suis 1330
ugcaccgcgccggaaggcg

SEQ ID NO: 455671 - RNA, 15 nt, Brucella suis 1330
ugcaccgauggccag

SEQ ID NO: 455672 - RNA, 12 nt, Brucella suis 1330
ugcacccggcac

SEQ ID NO: 455673 - RNA, 20 nt, Brucella suis 1330
ugauuucuucccgaaagcuu

SEQ ID NO: 455674 - RNA, 13 nt, Brucella suis 1330
ugauggugcccag

SEQ ID NO: 455675 - RNA, 14 nt, Brucella suis 1330
ugauguucggcaag

SEQ ID NO: 455676 - RNA, 21 nt, Brucella suis 1330
ugauguucggcaaggccgcgc

SEQ ID NO: 455677 - RNA, 21 nt, Brucella suis 1330
ugauuucaauaacaaaggccg

SEQ ID NO: 455678 - RNA, 18 nt, Brucella suis 1330
ugauuuccccgcauaaau

SEQ ID NO: 455679 - RNA, 19 nt, Brucella suis 1330
ugauuuccgcuucugcuuu

SEQ ID NO: 455680 - RNA, 19 nt, Brucella suis 1330
ugaugccguuuucaucaaa

SEQ ID NO: 455681 - RNA, 22 nt, Brucella suis 1330
ugaugcagauaaaaaggaugaa

SEQ ID NO: 455682 - RNA, 19 nt, Brucella suis 1330
ugaucucggagcggccgga

SEQ ID NO: 455683 - RNA, 12 nt, Brucella suis 1330
ugaucuugucca

SEQ ID NO: 455684 - RNA, 12 nt, Brucella suis 1330
ugaugaaaaacc

SEQ ID NO: 455685 - RNA, 15 nt, Brucella suis 1330
ugauccagaagccgc

SEQ ID NO: 455686 - RNA, 14 nt, Brucella suis 1330
ugaucguauagccc

SEQ ID NO: 455687 - RNA, 13 nt, Brucella suis 1330
ugaucgugccgga

SEQ ID NO: 455688 - RNA, 15 nt, Brucella suis 1330
ugaggccauuuugac

SEQ ID NO: 455689 - RNA, 14 nt, Brucella suis 1330
ugaggccgcgcgcg

SEQ ID NO: 455690 - RNA, 19 nt, Brucella suis 1330
ugagguguuucgcgcaaug

SEQ ID NO: 455691 - RNA, 16 nt, Brucella suis 1330
ugagguugagcugcuc

SEQ ID NO: 455692 - RNA, 13 nt, Brucella suis 1330
ugaggauuuccac

SEQ ID NO: 455693 - RNA, 20 nt, Brucella suis 1330
ugagcgcaaggcuucgccag

SEQ ID NO: 455694 - RNA, 15 nt, Brucella suis 1330
ugagccgcuucugcu

SEQ ID NO: 455695 - RNA, 16 nt, Brucella suis 1330
ugagcagcggcaaaaa

SEQ ID NO: 455696 - RNA, 18 nt, Brucella suis 1330
ugagcagaagaaagggcg

SEQ ID NO: 455697 - RNA, 17 nt, Brucella suis 1330
ugacuuuaauugucggc

SEQ ID NO: 455698 - RNA, 14 nt, Brucella suis 1330
ugacgaaacgcggc

SEQ ID NO: 455699 - RNA, 14 nt, Brucella suis 1330
ugaccuuggccacg

SEQ ID NO: 455700 - RNA, 17 nt, Brucella suis 1330
ugaccugacuugaaguc

SEQ ID NO: 455701 - RNA, 18 nt, Brucella suis 1330
ugaccggccacccagccc

SEQ ID NO: 455702 - RNA, 19 nt, Brucella suis 1330
ugaccggccacccagcccg

SEQ ID NO: 455703 - RNA, 22 nt, Brucella suis 1330
ugaccauauugcugggcaagug

SEQ ID NO: 455704 - RNA, 18 nt, Brucella suis 1330
ugacaagcgugagcuuca

SEQ ID NO: 455705 - RNA, 21 nt, Brucella suis 1330
ugacaagaucgucacugcaaa

SEQ ID NO: 455706 - RNA, 17 nt, Brucella suis 1330
ugacaccuucggccagc

SEQ ID NO: 455707 - RNA, 13 nt, Brucella suis 1330
ugaaucaccagcg

SEQ ID NO: 455708 - RNA, 23 nt, Brucella suis 1330
ugaaucagaucggcgcucuaauc

SEQ ID NO: 455709 - RNA, 19 nt, Brucella suis 1330
ugaauccuuccugauuuac

SEQ ID NO: 455710 - RNA, 22 nt, Brucella suis 1330
ugaaucugaggccauuuugacc

SEQ ID NO: 455711 - RNA, 22 nt, Brucella suis 1330
ugaauugcccacauagggccuu

SEQ ID NO: 455712 - RNA, 18 nt, Brucella suis 1330
ugaauuucggcgacuggc

SEQ ID NO: 455713 - RNA, 23 nt, Brucella suis 1330
ugaagcgccgauaccgacggucg

SEQ ID NO: 455714 - RNA, 13 nt, Brucella suis 1330
ugaagccuuccgc

SEQ ID NO: 455715 - RNA, 21 nt, Brucella suis 1330
ugaacgcauagagccacgaga

SEQ ID NO: 455716 - RNA, 20 nt, Brucella suis 1330
ugaagagccgcaggcacugg

SEQ ID NO: 455717 - RNA, 20 nt, Brucella suis 1330
ugaagagcguugcugccgga

SEQ ID NO: 455718 - RNA, 23 nt, Brucella suis 1330
ugaacagaucggaaucaaaaccc

SEQ ID NO: 455719 - RNA, 17 nt, Brucella suis 1330
ugaacaacacaacaccg

SEQ ID NO: 455720 - RNA, 12 nt, Brucella suis 1330
ugaacaagcaga

SEQ ID NO: 455721 - RNA, 15 nt, Brucella suis 1330
ugaacaagcagaugc

SEQ ID NO: 455722 - RNA, 16 nt, Brucella suis 1330
ugaaauauuuauccgc

SEQ ID NO: 455723 - RNA, 22 nt, Brucella suis 1330
ugaaagaacggcaggaucuucc

SEQ ID NO: 455724 - RNA, 19 nt, Brucella suis 1330
ugaaauagcgguugcagcc

SEQ ID NO: 455725 - RNA, 18 nt, Brucella suis 1330
ucuucgcguuccacgauu

SEQ ID NO: 455726 - RNA, 17 nt, Brucella suis 1330
ucuuccucacccuucaa

SEQ ID NO: 455727 - RNA, 19 nt, Brucella suis 1330
ucuuccaguuccuucuuga

SEQ ID NO: 455728 - RNA, 14 nt, Brucella suis 1330
ucuuauaguuuucu

SEQ ID NO: 455729 - RNA, 17 nt, Brucella suis 1330
ucugucaccacaucggc

SEQ ID NO: 455730 - RNA, 18 nt, Brucella suis 1330
ucuguacauacaugauga

SEQ ID NO: 455731 - RNA, 14 nt, Brucella suis 1330
ucuguaucccgaaa

SEQ ID NO: 455732 - RNA, 17 nt, Brucella suis 1330
ucugcaucgagcggcac

SEQ ID NO: 455733 - RNA, 13 nt, Brucella suis 1330
ucugcuugccgcc

SEQ ID NO: 455734 - RNA, 21 nt, Brucella suis 1330
ucugcuugguuuccgccagca

SEQ ID NO: 455735 - RNA, 13 nt, Brucella suis 1330
ucugcacagccug

SEQ ID NO: 455736 - RNA, 21 nt, Brucella suis 1330
ucugaccuuccugacccaugg

SEQ ID NO: 455737 - RNA, 13 nt, Brucella suis 1330
ucucgacagccau

SEQ ID NO: 455738 - RNA, 15 nt, Brucella suis 1330
ucucgcaaaacacca

SEQ ID NO: 455739 - RNA, 21 nt, Brucella suis 1330
ucuccggcccauaccgcgcca

SEQ ID NO: 455740 - RNA, 17 nt, Brucella suis 1330
ucuccaguaaagucuga

SEQ ID NO: 455741 - RNA, 12 nt, Brucella suis 1330
ucuccgcccaua

SEQ ID NO: 455742 - RNA, 19 nt, Brucella suis 1330
ucucaugauggcccuugug

SEQ ID NO: 455743 - RNA, 15 nt, Brucella suis 1330
ucucagcguuuucug

SEQ ID NO: 455744 - RNA, 20 nt, Brucella suis 1330
ucucagcguuuucugaaaga

SEQ ID NO: 455745 - RNA, 21 nt, Brucella suis 1330
ucucagcguuuucugaaagaa

SEQ ID NO: 455746 - RNA, 18 nt, Brucella suis 1330
ucucacagccaucaggau

SEQ ID NO: 455747 - RNA, 19 nt, Brucella suis 1330
aaaugccauggaacagaca

SEQ ID NO: 455748 - RNA, 17 nt, Brucella suis 1330
aaaugccgcacagauca

SEQ ID NO: 455749 - RNA, 18 nt, Brucella suis 1330
ucucacgcgcagcagcau

SEQ ID NO: 455750 - RNA, 13 nt, Brucella suis 1330
ucuauuuuuccac

SEQ ID NO: 455751 - RNA, 13 nt, Brucella suis 1330
ucuauccgcugau

SEQ ID NO: 455752 - RNA, 15 nt, Brucella suis 1330
ucuaucgccuggcau

SEQ ID NO: 455753 - RNA, 23 nt, Brucella suis 1330
aaaugcaagcgucuucugagaaa

SEQ ID NO: 455754 - RNA, 13 nt, Brucella suis 1330
ucuaauccuuugu

SEQ ID NO: 455755 - RNA, 24 nt, Brucella suis 1330
ucuaauccuuuguuuugacgcgca

SEQ ID NO: 455756 - RNA, 13 nt, Brucella suis 1330
ucuaaccauuugu

SEQ ID NO: 455757 - RNA, 18 nt, Brucella suis 1330
ucuaacuauuuauucuga

SEQ ID NO: 455758 - RNA, 19 nt, Brucella suis 1330
ucguucacaaucuugccaa

SEQ ID NO: 455759 - RNA, 12 nt, Brucella suis 1330
ucguuccgggug

SEQ ID NO: 455760 - RNA, 21 nt, Brucella suis 1330
ucguuacgccacugcgaaagc

SEQ ID NO: 455761 - RNA, 20 nt, Brucella suis 1330
ucgugucgauugccugugcg

SEQ ID NO: 455762 - RNA, 20 nt, Brucella suis 1330
ucgugugaccuuggccacga

SEQ ID NO: 455763 - RNA, 16 nt, Brucella suis 1330
ucgugggccucaagcg

SEQ ID NO: 455764 - RNA, 12 nt, Brucella suis 1330
ucgugccgccuu

SEQ ID NO: 455765 - RNA, 17 nt, Brucella suis 1330
ucgugccggaauggcca

SEQ ID NO: 455766 - RNA, 21 nt, Brucella suis 1330
ucgugccuggcgaaaacggcc

SEQ ID NO: 455767 - RNA, 15 nt, Brucella suis 1330
ucgugauguugcggg

SEQ ID NO: 455768 - RNA, 22 nt, Brucella suis 1330
ucgugcauuugacguccggcuu

SEQ ID NO: 455769 - RNA, 20 nt, Brucella suis 1330
ucgucuuccuuauccugaug

SEQ ID NO: 455770 - RNA, 12 nt, Brucella suis 1330
ucgucugcaucc

SEQ ID NO: 455771 - RNA, 19 nt, Brucella suis 1330
ucgucgcugacuucaaaau

SEQ ID NO: 455772 - RNA, 15 nt, Brucella suis 1330
ucgucgaguucugcg

SEQ ID NO: 455773 - RNA, 21 nt, Brucella suis 1330
ucgucacccgcgucgucugca

SEQ ID NO: 455774 - RNA, 22 nt, Brucella suis 1330
ucgguucgcuggccaugaugcc

SEQ ID NO: 455775 - RNA, 14 nt, Brucella suis 1330
ucgguuuucaaugc

SEQ ID NO: 455776 - RNA, 18 nt, Brucella suis 1330
ucgguuuucaaugccugg

SEQ ID NO: 455777 - RNA, 14 nt, Brucella suis 1330
ucggugccugacug

SEQ ID NO: 455778 - RNA, 14 nt, Brucella suis 1330
ucggugaaauauuu

SEQ ID NO: 455779 - RNA, 21 nt, Brucella suis 1330
ucggucagggcaauccuuucc

SEQ ID NO: 455780 - RNA, 22 nt, Brucella suis 1330
ucggucagggcaauccuuucca

SEQ ID NO: 455781 - RNA, 21 nt, Brucella suis 1330
ucggguagagcuucuuuucga

SEQ ID NO: 455782 - RNA, 20 nt, Brucella suis 1330
ucggggcguccgccaccgcc

SEQ ID NO: 455783 - RNA, 22 nt, Brucella suis 1330
ucggguguuugcgacgggcgag

SEQ ID NO: 455784 - RNA, 19 nt, Brucella suis 1330
ucggguuugaugaggcgga

SEQ ID NO: 455785 - RNA, 19 nt, Brucella suis 1330
ucgggcgcgaucucguccu

SEQ ID NO: 455786 - RNA, 14 nt, Brucella suis 1330
ucgggcagcuuguc

SEQ ID NO: 455787 - RNA, 15 nt, Brucella suis 1330
ucgggaucaaugauc

SEQ ID NO: 455788 - RNA, 15 nt, Brucella suis 1330
ucgggaccaccggcc

SEQ ID NO: 455789 - RNA, 22 nt, Brucella suis 1330
ucggcuuuacguccggcacgau

SEQ ID NO: 455790 - RNA, 11 nt, Brucella suis 1330
ucggcuggcug

SEQ ID NO: 455791 - RNA, 17 nt, Brucella suis 1330
ucggcucauccuccacg

SEQ ID NO: 455792 - RNA, 12 nt, Brucella suis 1330
ucggcgugcaga

SEQ ID NO: 455793 - RNA, 13 nt, Brucella suis 1330
ucggcggcuuccu

SEQ ID NO: 455794 - RNA, 17 nt, Brucella suis 1330
ucggcgggcuuuuucgu

SEQ ID NO: 455795 - RNA, 19 nt, Brucella suis 1330
ucggcgcucuaauccuuug

SEQ ID NO: 455796 - RNA, 17 nt, Brucella suis 1330
ucggcgacuggcagggc

SEQ ID NO: 455797 - RNA, 18 nt, Brucella suis 1330
ucggcgaggucucccggc

SEQ ID NO: 455798 - RNA, 19 nt, Brucella suis 1330
ucggcgaugaagcgggccg

SEQ ID NO: 455799 - RNA, 14 nt, Brucella suis 1330
ucggccugaugcaa

SEQ ID NO: 455800 - RNA, 18 nt, Brucella suis 1330
ucggcccuggaaagaagc

SEQ ID NO: 455801 - RNA, 23 nt, Brucella suis 1330
ucggcccggucacccgcacgccg

SEQ ID NO: 455802 - RNA, 22 nt, Brucella suis 1330
ucggccagaucauugaaauucu

SEQ ID NO: 455803 - RNA, 19 nt, Brucella suis 1330
ucggcauauuugaggcauu

SEQ ID NO: 455804 - RNA, 13 nt, Brucella suis 1330
ucggcaucggaaa

SEQ ID NO: 455805 - RNA, 19 nt, Brucella suis 1330
ucggcaaggccgcgcucca

SEQ ID NO: 455806 - RNA, 14 nt, Brucella suis 1330
ucggauaagaugcg

SEQ ID NO: 455807 - RNA, 15 nt, Brucella suis 1330
ucggauccuccugcg

SEQ ID NO: 455808 - RNA, 21 nt, Brucella suis 1330
ucggagccuucauugcggcca

SEQ ID NO: 455809 - RNA, 13 nt, Brucella suis 1330
ucggaggcuuccg

SEQ ID NO: 455810 - RNA, 20 nt, Brucella suis 1330
ucggaagggcaaggcgcgcc

SEQ ID NO: 455811 - RNA, 19 nt, Brucella suis 1330
ucgcuuucaaugcuggccu

SEQ ID NO: 455812 - RNA, 23 nt, Brucella suis 1330
ucgcuguuggcaagaaccucgac

SEQ ID NO: 455813 - RNA, 15 nt, Brucella suis 1330
ucgcucaccuuuucc

SEQ ID NO: 455814 - RNA, 21 nt, Brucella suis 1330
ucgcgucagggcgaggaaaau

SEQ ID NO: 455815 - RNA, 15 nt, Brucella suis 1330
ucgcgcgcaagcggc

SEQ ID NO: 455816 - RNA, 14 nt, Brucella suis 1330
ucgcgccggggccg

SEQ ID NO: 455817 - RNA, 14 nt, Brucella suis 1330
ucgcgcaccagcuu

SEQ ID NO: 455818 - RNA, 20 nt, Brucella suis 1330
ucgccuucgcgcaccagacc

SEQ ID NO: 455819 - RNA, 20 nt, Brucella suis 1330
ucgccugcuuccuuuucggc

SEQ ID NO: 455820 - RNA, 15 nt, Brucella suis 1330
ucgccucuucauccg

SEQ ID NO: 455821 - RNA, 18 nt, Brucella suis 1330
ucgccucauggcggcgcu

SEQ ID NO: 455822 - RNA, 17 nt, Brucella suis 1330
ucgccggggggaauggc

SEQ ID NO: 455823 - RNA, 15 nt, Brucella suis 1330
ucgccguccuuugug

SEQ ID NO: 455824 - RNA, 16 nt, Brucella suis 1330
ucgccggaccgugccg

SEQ ID NO: 455825 - RNA, 20 nt, Brucella suis 1330
ucgccgcgcacuggcagcau

SEQ ID NO: 455826 - RNA, 14 nt, Brucella suis 1330
ucgccgcccuugug

SEQ ID NO: 455827 - RNA, 15 nt, Brucella suis 1330
ucgccgauauccucg

SEQ ID NO: 455828 - RNA, 20 nt, Brucella suis 1330
ucgccgacgauuucuuccag

SEQ ID NO: 455829 - RNA, 21 nt, Brucella suis 1330
ucgcccugaagaagcuucaca

SEQ ID NO: 455830 - RNA, 14 nt, Brucella suis 1330
ucgcccauuuucuc

SEQ ID NO: 455831 - RNA, 14 nt, Brucella suis 1330
ucgcccagaaacaa

SEQ ID NO: 455832 - RNA, 21 nt, Brucella suis 1330
ucgcccacgaggaucggcacg

SEQ ID NO: 455833 - RNA, 20 nt, Brucella suis 1330
ucgccaagaagaacacagcc

SEQ ID NO: 455834 - RNA, 17 nt, Brucella suis 1330
uccagccuuuccagaag

SEQ ID NO: 455835 - RNA, 19 nt, Brucella suis 1330
uccagccuuuccagaaggc

SEQ ID NO: 455836 - RNA, 15 nt, Brucella suis 1330
uccagcgaguucggc

SEQ ID NO: 455837 - RNA, 15 nt, Brucella suis 1330
uccagcgugaagggc

SEQ ID NO: 455838 - RNA, 21 nt, Brucella suis 1330
uccagccgggcuuuuuuauuc

SEQ ID NO: 455839 - RNA, 15 nt, Brucella suis 1330
uccagcaaaagugag

SEQ ID NO: 455840 - RNA, 12 nt, Brucella suis 1330
uccagaucggcc

SEQ ID NO: 455841 - RNA, 13 nt, Brucella suis 1330
uccagaucuuccu

SEQ ID NO: 455842 - RNA, 21 nt, Brucella suis 1330
uccaccgcgcugaagcggccu

SEQ ID NO: 455843 - RNA, 13 nt, Brucella suis 1330
uccaccagcauga

SEQ ID NO: 455844 - RNA, 15 nt, Brucella suis 1330
uccacauugccuucg

SEQ ID NO: 455845 - RNA, 16 nt, Brucella suis 1330
uccacaggcgccagcc

SEQ ID NO: 455846 - RNA, 18 nt, Brucella suis 1330
uccacaagcaucugcuca

SEQ ID NO: 455847 - RNA, 21 nt, Brucella suis 1330
uccacaagcaucugcucaaaa

SEQ ID NO: 455848 - RNA, 13 nt, Brucella suis 1330
ucauuuccuucca

SEQ ID NO: 455849 - RNA, 19 nt, Brucella suis 1330
ucauuuauuuuagcugcug

SEQ ID NO: 455850 - RNA, 15 nt, Brucella suis 1330
ucauuuuagaaauuc

SEQ ID NO: 455851 - RNA, 18 nt, Brucella suis 1330
ucauggcggcgcucggcg

SEQ ID NO: 455852 - RNA, 21 nt, Brucella suis 1330
ucauggagauacgcuucaucg

SEQ ID NO: 455853 - RNA, 14 nt, Brucella suis 1330
ucaugcgcggcaug

SEQ ID NO: 455854 - RNA, 19 nt, Brucella suis 1330
ucaugcaggcggaagggcc

SEQ ID NO: 455855 - RNA, 22 nt, Brucella suis 1330
ucaucuggcgggguuuuuuauu

SEQ ID NO: 455856 - RNA, 23 nt, Brucella suis 1330
ucaucuggcgggguuuuuuauug

SEQ ID NO: 455857 - RNA, 17 nt, Brucella suis 1330
ucaucugccaaccauug

SEQ ID NO: 455858 - RNA, 19 nt, Brucella suis 1330
ucaucguggcggcaaaaag

SEQ ID NO: 455859 - RNA, 16 nt, Brucella suis 1330
ucaucggaggcuuccg

SEQ ID NO: 455860 - RNA, 21 nt, Brucella suis 1330
ucaucgcggcagccgccgccg

SEQ ID NO: 455861 - RNA, 14 nt, Brucella suis 1330
ucaucgcgcugcuc

SEQ ID NO: 455862 - RNA, 16 nt, Brucella suis 1330
ucaucgagaauuucuc

SEQ ID NO: 455863 - RNA, 15 nt, Brucella suis 1330
ucaucgccaccaugg

SEQ ID NO: 455864 - RNA, 21 nt, Brucella suis 1330
ucaucccgccccuaaaggcuc

SEQ ID NO: 455865 - RNA, 12 nt, Brucella suis 1330
ucaucagcccau

SEQ ID NO: 455866 - RNA, 14 nt, Brucella suis 1330
ucauaaugcaugga

SEQ ID NO: 455867 - RNA, 15 nt, Brucella suis 1330
ucauaaugcauggag

SEQ ID NO: 455868 - RNA, 20 nt, Brucella suis 1330
ucauaaugcauggaggcaag

SEQ ID NO: 455869 - RNA, 14 nt, Brucella suis 1330
ucauagcgcgugcc

SEQ ID NO: 455870 - RNA, 15 nt, Brucella suis 1330
ucauaguguggaauu

SEQ ID NO: 455871 - RNA, 15 nt, Brucella suis 1330
ucaucaaggaaaaaa

SEQ ID NO: 455872 - RNA, 16 nt, Brucella suis 1330
ucaucaaggaaaaaac

SEQ ID NO: 455873 - RNA, 18 nt, Brucella suis 1330
ucaucaaggaaaaaaccg

SEQ ID NO: 455874 - RNA, 20 nt, Brucella suis 1330
ucaucaccgcgggaaaaauc

SEQ ID NO: 455875 - RNA, 15 nt, Brucella suis 1330
ucagucgaauuucag

SEQ ID NO: 455876 - RNA, 12 nt, Brucella suis 1330
ucauaaggcaau

SEQ ID NO: 455877 - RNA, 13 nt, Brucella suis 1330
ucagggcauugcc

SEQ ID NO: 455878 - RNA, 14 nt, Brucella suis 1330
ucaggaugagggag

SEQ ID NO: 455879 - RNA, 14 nt, Brucella suis 1330
ucaggaucuuucca

SEQ ID NO: 455880 - RNA, 21 nt, Brucella suis 1330
ucaggaucuuuccaaguucau

SEQ ID NO: 455881 - RNA, 17 nt, Brucella suis 1330
ucagggacgagcggcag

SEQ ID NO: 455882 - RNA, 20 nt, Brucella suis 1330
ucagggcaaucugcgcugcc

SEQ ID NO: 455883 - RNA, 15 nt, Brucella suis 1330
ucagcuuuuccauca

SEQ ID NO: 455884 - RNA, 13 nt, Brucella suis 1330
ucagcuugccgcc

SEQ ID NO: 455885 - RNA, 22 nt, Brucella suis 1330
ucagcuugccgccaauccccuc

SEQ ID NO: 455886 - RNA, 17 nt, Brucella suis 1330
ucagcuuuucaccggca

SEQ ID NO: 455887 - RNA, 18 nt, Brucella suis 1330
ucagcgccgcccagggca

SEQ ID NO: 455888 - RNA, 15 nt, Brucella suis 1330
ucagccguugcgauc

SEQ ID NO: 455889 - RNA, 15 nt, Brucella suis 1330
ucagccucccuucau

SEQ ID NO: 455890 - RNA, 15 nt, Brucella suis 1330
ucagccgcccgccuu

SEQ ID NO: 455891 - RNA, 19 nt, Brucella suis 1330
ucacuccgaccauuucccg

SEQ ID NO: 455892 - RNA, 24 nt, Brucella suis 1330
ucacguaggcgcggcguggaaagc

SEQ ID NO: 455893 - RNA, 18 nt, Brucella suis 1330
ucacggucggauaauaga

SEQ ID NO: 455894 - RNA, 22 nt, Brucella suis 1330
ucacgcggcugcucgacaugca

SEQ ID NO: 455895 - RNA, 17 nt, Brucella suis 1330
ucacgcgagcgcagcgg

SEQ ID NO: 455896 - RNA, 13 nt, Brucella suis 1330
ucaccuguggcug

SEQ ID NO: 455897 - RNA, 22 nt, Brucella suis 1330
ucaccucgcccugcuucacaug

SEQ ID NO: 455898 - RNA, 15 nt, Brucella suis 1330
ucaccugagcaagag

SEQ ID NO: 455899 - RNA, 14 nt, Brucella suis 1330
ucaccggcugggcc

SEQ ID NO: 455900 - RNA, 22 nt, Brucella suis 1330
ucaccgcgacgcuucuugcugu

SEQ ID NO: 455901 - RNA, 23 nt, Brucella suis 1330
ucaccagccccgccagaaaaacc

SEQ ID NO: 455902 - RNA, 12 nt, Brucella suis 1330
ucaccauucaca

SEQ ID NO: 455903 - RNA, 21 nt, Brucella suis 1330
ucacauuucaugaaaaugcca

SEQ ID NO: 455904 - RNA, 11 nt, Brucella suis 1330
ucaaugcugca

SEQ ID NO: 455905 - RNA, 13 nt, Brucella suis 1330
ucaauggccgcgc

SEQ ID NO: 455906 - RNA, 12 nt, Brucella suis 1330
ucaaugccaccg

SEQ ID NO: 455907 - RNA, 18 nt, Brucella suis 1330
ucaaugcgaaaaagcggc

SEQ ID NO: 455908 - RNA, 14 nt, Brucella suis 1330
ucaaggcugcugca

SEQ ID NO: 455909 - RNA, 19 nt, Brucella suis 1330
ucaaggccuguuccacacc

SEQ ID NO: 455910 - RNA, 18 nt, Brucella suis 1330
ucaaggcccggugcaauc

SEQ ID NO: 455911 - RNA, 21 nt, Brucella suis 1330
ucaagcaguaugauuugucgg

SEQ ID NO: 455912 - RNA, 17 nt, Brucella suis 1330
ucaagcaucuugauuuc

SEQ ID NO: 455913 - RNA, 17 nt, Brucella suis 1330
ucaagauagcccggcag

SEQ ID NO: 455914 - RNA, 21 nt, Brucella suis 1330
ucaagcacgcugagaagcuug

SEQ ID NO: 455915 - RNA, 18 nt, Brucella suis 1330
ucaacuggcgcagcagca

SEQ ID NO: 455916 - RNA, 12 nt, Brucella suis 1330
ucaagacaagag

SEQ ID NO: 455917 - RNA, 21 nt, Brucella suis 1330
ucaagaggaacgacuuuggcc

SEQ ID NO: 455918 - RNA, 21 nt, Brucella suis 1330
uauuuggcacucauuaucagc

SEQ ID NO: 455919 - RNA, 14 nt, Brucella suis 1330
uauuuuagcugcug

SEQ ID NO: 455920 - RNA, 23 nt, Brucella suis 1330
ucaaaaagggcuuccugcaaaag

SEQ ID NO: 455921 - RNA, 19 nt, Brucella suis 1330
ucaaaccggccaugcccau

SEQ ID NO: 455922 - RNA, 20 nt, Brucella suis 1330
ucaaaguuaaugccuuugcu

SEQ ID NO: 455923 - RNA, 22 nt, Brucella suis 1330
uauuuagauuugcuuaaguguc

SEQ ID NO: 455924 - RNA, 18 nt, Brucella suis 1330
uauuuauucugacgcgca

SEQ ID NO: 455925 - RNA, 23 nt, Brucella suis 1330
uauuuauucugacgcgcaucuua

SEQ ID NO: 455926 - RNA, 13 nt, Brucella suis 1330
uauuccuuugauc

SEQ ID NO: 455927 - RNA, 22 nt, Brucella suis 1330
uauucaucguugcggcuugcca

SEQ ID NO: 455928 - RNA, 16 nt, Brucella suis 1330
uauucaggaucuuucc

SEQ ID NO: 455929 - RNA, 21 nt, Brucella suis 1330
uauccgccaccgguuuucauc

SEQ ID NO: 455930 - RNA, 12 nt, Brucella suis 1330
uauccacgcccu

SEQ ID NO: 455931 - RNA, 16 nt, Brucella suis 1330
uauccaccuggccgcc

SEQ ID NO: 455932 - RNA, 15 nt, Brucella suis 1330
uauccauaucuuucc

SEQ ID NO: 455933 - RNA, 14 nt, Brucella suis 1330
uaucacgcuugccc

SEQ ID NO: 455934 - RNA, 22 nt, Brucella suis 1330
uaucacguaggggucuucucuc

SEQ ID NO: 455935 - RNA, 17 nt, Brucella suis 1330
uaggggucuucucuccg

SEQ ID NO: 455936 - RNA, 13 nt, Brucella suis 1330
uagggcaaggagc

SEQ ID NO: 455937 - RNA, 17 nt, Brucella suis 1330
uagggcaaggagcgagc

SEQ ID NO: 455938 - RNA, 20 nt, Brucella suis 1330
uagggcaaggagcgagcuug

SEQ ID NO: 455939 - RNA, 17 nt, Brucella suis 1330
uaggcgcgcgcaagggc

SEQ ID NO: 455940 - RNA, 22 nt, Brucella suis 1330
uaggauaaugcgauaaaacaaa

SEQ ID NO: 455941 - RNA, 14 nt, Brucella suis 1330
uagcuggaaaaaau

SEQ ID NO: 455942 - RNA, 15 nt, Brucella suis 1330
uagcuuaugcgcgcc

SEQ ID NO: 455943 - RNA, 11 nt, Brucella suis 1330
uagcugcaucc

SEQ ID NO: 455944 - RNA, 21 nt, Brucella suis 1330
uagcggcccgauuccuccggc

SEQ ID NO: 455945 - RNA, 16 nt, Brucella suis 1330
uagcggcgaguugcca

SEQ ID NO: 455946 - RNA, 18 nt, Brucella suis 1330
uagcgccggaaugggccu

SEQ ID NO: 455947 - RNA, 15 nt, Brucella suis 1330
uagcgcauggcagca

SEQ ID NO: 455948 - RNA, 18 nt, Brucella suis 1330
uagcgcagaaugagcuug

SEQ ID NO: 455949 - RNA, 22 nt, Brucella suis 1330
uagcgcagaaugagcuugcgcc

SEQ ID NO: 455950 - RNA, 19 nt, Brucella suis 1330
uagccuuucaccaauggcg

SEQ ID NO: 455951 - RNA, 17 nt, Brucella suis 1330
uagccgguauccagcag

SEQ ID NO: 455952 - RNA, 15 nt, Brucella suis 1330
uagccgccugccuuc

SEQ ID NO: 455953 - RNA, 18 nt, Brucella suis 1330
uagccgccaagccagccc

SEQ ID NO: 455954 - RNA, 16 nt, Brucella suis 1330
uagccccagcccgccc

SEQ ID NO: 455955 - RNA, 15 nt, Brucella suis 1330
uagcauugaaaggca

SEQ ID NO: 455956 - RNA, 18 nt, Brucella suis 1330
uagauguucuuccccguc

SEQ ID NO: 455957 - RNA, 15 nt, Brucella suis 1330
uagauauuucuucca

SEQ ID NO: 455958 - RNA, 16 nt, Brucella suis 1330
uagagaacauauccug

SEQ ID NO: 455959 - RNA, 19 nt, Brucella suis 1330
uagaauucgaugacuuccg

SEQ ID NO: 455960 - RNA, 15 nt, Brucella suis 1330
uagaacagcaagccc

SEQ ID NO: 455961 - RNA, 16 nt, Brucella suis 1330
uacguggcuugaagcu

SEQ ID NO: 455962 - RNA, 15 nt, Brucella suis 1330
uacgugcaagagcaa

SEQ ID NO: 455963 - RNA, 15 nt, Brucella suis 1330
uacgugcuaugcucu

SEQ ID NO: 455964 - RNA, 15 nt, Brucella suis 1330
uacggugacaugggg

SEQ ID NO: 455965 - RNA, 11 nt, Brucella suis 1330
uaccuuccagc

SEQ ID NO: 455966 - RNA, 17 nt, Brucella suis 1330
uacauauacuuacuagu

SEQ ID NO: 455967 - RNA, 15 nt, Brucella suis 1330
uaaucgccgggccuu

SEQ ID NO: 455968 - RNA, 15 nt, Brucella suis 1330
uaaucguaucgccaa

SEQ ID NO: 455969 - RNA, 22 nt, Brucella suis 1330
uaaugccccgcaccgacaaaaa

SEQ ID NO: 455970 - RNA, 14 nt, Brucella suis 1330
uaaccgccaccuuc

SEQ ID NO: 455971 - RNA, 16 nt, Brucella suis 1330
uaacagucgaagcggc

SEQ ID NO: 455972 - RNA, 15 nt, Brucella suis 1330
uaaaugcccuuccuu

SEQ ID NO: 455973 - RNA, 21 nt, Brucella suis 1330
uaaaugccggcgaucuuuucg

SEQ ID NO: 455974 - RNA, 22 nt, Brucella suis 1330
uaacaaaggccgccguccccac

SEQ ID NO: 455975 - RNA, 22 nt, Brucella suis 1330
uaaagcgguuccuguuuuaaca

SEQ ID NO: 455976 - RNA, 22 nt, Brucella suis 1330
uaaaggccgaaauagcggcccg

SEQ ID NO: 455977 - RNA, 18 nt, Brucella suis 1330
uaaaggcgaguuuucaaa

SEQ ID NO: 455978 - RNA, 18 nt, Brucella suis 1330
uaaagcacagccagaaag

SEQ ID NO: 455979 - RNA, 20 nt, Brucella suis 1330
uaaagcacagccagaaagaa

SEQ ID NO: 455980 - RNA, 22 nt, Brucella suis 1330
uaaagcacagccagaaagaaga

SEQ ID NO: 455981 - RNA, 13 nt, Brucella suis 1330
uaaagccuguccu

SEQ ID NO: 455982 - RNA, 23 nt, Brucella suis 1330
uaaaccgaaaggcguugcacaua

SEQ ID NO: 455983 - RNA, 16 nt, Brucella suis 1330
uaaaccuuugaaauaa

SEQ ID NO: 455984 - RNA, 20 nt, Brucella suis 1330
guuuuccgguagcgaaugca

SEQ ID NO: 455985 - RNA, 21 nt, Brucella suis 1330
guuuauuuugauugguggugc

SEQ ID NO: 455986 - RNA, 15 nt, Brucella suis 1330
guuugguuuuagaag

SEQ ID NO: 455987 - RNA, 18 nt, Brucella suis 1330
guuuuucuuuguccagaa

SEQ ID NO: 455988 - RNA, 19 nt, Brucella suis 1330
guuuuucuuuguccagaaa

SEQ ID NO: 455989 - RNA, 12 nt, Brucella suis 1330
guuuuuuuugau

SEQ ID NO: 455990 - RNA, 17 nt, Brucella suis 1330
uaaaaauaaagaaauag

SEQ ID NO: 455991 - RNA, 22 nt, Brucella suis 1330
uaaaaauccauuagauacauau

SEQ ID NO: 455992 - RNA, 13 nt, Brucella suis 1330
uaaaaccggaacc

SEQ ID NO: 455993 - RNA, 23 nt, Brucella suis 1330
uaaaacgcgccgauaccaaggcc

SEQ ID NO: 455994 - RNA, 22 nt, Brucella suis 1330
uaaaaggcaaagccgaaugcca

SEQ ID NO: 455995 - RNA, 21 nt, Brucella suis 1330
guuggauagaccaccgcacgg

SEQ ID NO: 455996 - RNA, 19 nt, Brucella suis 1330
guugaucgaggcaaaugcc

SEQ ID NO: 455997 - RNA, 21 nt, Brucella suis 1330
guugacgaucaccuguggcug

SEQ ID NO: 455998 - RNA, 21 nt, Brucella suis 1330
guugaagcugucgccagcgcc

SEQ ID NO: 455999 - RNA, 16 nt, Brucella suis 1330
guugaagagccuuuuc

SEQ ID NO: 456000 - RNA, 18 nt, Brucella suis 1330
guucuugagguugagcug

SEQ ID NO: 456001 - RNA, 21 nt, Brucella suis 1330
guucuugagguugagcugcuc

SEQ ID NO: 456002 - RNA, 16 nt, Brucella suis 1330
guugaaaagggcaagg

SEQ ID NO: 456003 - RNA, 14 nt, Brucella suis 1330
guucguugaacugc

SEQ ID NO: 456004 - RNA, 22 nt, Brucella suis 1330
guucguugaacugcaucacagu

SEQ ID NO: 456005 - RNA, 15 nt, Brucella suis 1330
guucugaaaccgcag

SEQ ID NO: 456006 - RNA, 19 nt, Brucella suis 1330
guucguagcugcuuugcug

SEQ ID NO: 456007 - RNA, 19 nt, Brucella suis 1330
guucgacuugaagagccgc

SEQ ID NO: 456008 - RNA, 14 nt, Brucella suis 1330
guucgaucgguggc

SEQ ID NO: 456009 - RNA, 14 nt, Brucella suis 1330
guuccgugaaucug

SEQ ID NO: 456010 - RNA, 18 nt, Brucella suis 1330
guucauuuuuagaagauc

SEQ ID NO: 456011 - RNA, 18 nt, Brucella suis 1330
guucauguuuugaaucug

SEQ ID NO: 456012 - RNA, 15 nt, Brucella suis 1330
guucagauugcagca

SEQ ID NO: 456013 - RNA, 22 nt, Brucella suis 1330
guucaagcaguaugauuugucg

SEQ ID NO: 456014 - RNA, 13 nt, Brucella suis 1330
guucaaggcugcu

SEQ ID NO: 456015 - RNA, 22 nt, Brucella suis 1330
guuacauaugcuguuucaaacg

SEQ ID NO: 456016 - RNA, 23 nt, Brucella suis 1330
guuaucauuuauuuuagcugcug

SEQ ID NO: 456017 - RNA, 14 nt, Brucella suis 1330
guuauucccacagu

SEQ ID NO: 456018 - RNA, 22 nt, Brucella suis 1330
guguauccaccagacgauuuuc

SEQ ID NO: 456019 - RNA, 18 nt, Brucella suis 1330
guggucugggcgaugagc

SEQ ID NO: 456020 - RNA, 23 nt, Brucella suis 1330
guggucugggcgaugagcgccau

SEQ ID NO: 456021 - RNA, 18 nt, Brucella suis 1330
gugggccucaagcggcuc

SEQ ID NO: 456022 - RNA, 15 nt, Brucella suis 1330
guggcugggccccaa

SEQ ID NO: 456023 - RNA, 23 nt, Brucella suis 1330
guggcugcaaucaccagagacag

SEQ ID NO: 456024 - RNA, 20 nt, Brucella suis 1330
guggcggcaaaaagcggcgu

SEQ ID NO: 456025 - RNA, 14 nt, Brucella suis 1330
guggacgguugcug

SEQ ID NO: 456026 - RNA, 13 nt, Brucella suis 1330
gugcugcugcaau

SEQ ID NO: 456027 - RNA, 16 nt, Brucella suis 1330
gugcugauugccguga

SEQ ID NO: 456028 - RNA, 17 nt, Brucella suis 1330
gugcgggcuucuuccag

SEQ ID NO: 456029 - RNA, 18 nt, Brucella suis 1330
gugcgcuuccggcugcuu

SEQ ID NO: 456030 - RNA, 22 nt, Brucella suis 1330
gugcgagcaggcuuucggccug

SEQ ID NO: 456031 - RNA, 15 nt, Brucella suis 1330
gugcgacgaggccug

SEQ ID NO: 456032 - RNA, 22 nt, Brucella suis 1330
gugccugacuggcggccaagcg

SEQ ID NO: 456033 - RNA, 20 nt, Brucella suis 1330
gugccuccgacugugauuug

SEQ ID NO: 456034 - RNA, 17 nt, Brucella suis 1330
gugccgcuuccagcauc

SEQ ID NO: 456035 - RNA, 15 nt, Brucella suis 1330
gugccgcgccgauga

SEQ ID NO: 456036 - RNA, 16 nt, Brucella suis 1330
gugccgccaucggcaa

SEQ ID NO: 456037 - RNA, 21 nt, Brucella suis 1330
gugccgaauguggugacggcg

SEQ ID NO: 456038 - RNA, 16 nt, Brucella suis 1330
gugcccuugagagcca

SEQ ID NO: 456039 - RNA, 14 nt, Brucella suis 1330
gugccagcgucggc

SEQ ID NO: 456040 - RNA, 16 nt, Brucella suis 1330
gugccagaauguugag

SEQ ID NO: 456041 - RNA, 16 nt, Brucella suis 1330
gugccaccagcacaca

SEQ ID NO: 456042 - RNA, 20 nt, Brucella suis 1330
gucggcggcgugggcugcug

SEQ ID NO: 456043 - RNA, 20 nt, Brucella suis 1330
gucggcgaauuccacgauga

SEQ ID NO: 456044 - RNA, 19 nt, Brucella suis 1330
gucggccaguuuggcugug

SEQ ID NO: 456045 - RNA, 23 nt, Brucella suis 1330
gucgcgguuugcaagccgcggcg

SEQ ID NO: 456046 - RNA, 13 nt, Brucella suis 1330
gucgcgcucgccg

SEQ ID NO: 456047 - RNA, 16 nt, Brucella suis 1330
gucgcgcgauguuccg

SEQ ID NO: 456048 - RNA, 12 nt, Brucella suis 1330
gucgccagcgcc

SEQ ID NO: 456049 - RNA, 18 nt, Brucella suis 1330
gucgaggaaaaagcccgc

SEQ ID NO: 456050 - RNA, 15 nt, Brucella suis 1330
gucgacaaugaagca

SEQ ID NO: 456051 - RNA, 13 nt, Brucella suis 1330
gucgaaaccuugu

SEQ ID NO: 456052 - RNA, 23 nt, Brucella suis 1330
guccgccugaucgucaggcgcau

SEQ ID NO: 456053 - RNA, 16 nt, Brucella suis 1330
guccgccaccgccggc

SEQ ID NO: 456054 - RNA, 14 nt, Brucella suis 1330
guccgaaugcaagg

SEQ ID NO: 456055 - RNA, 14 nt, Brucella suis 1330
gucccuugccgccu

SEQ ID NO: 456056 - RNA, 20 nt, Brucella suis 1330
gucccgugucggagccggcc

SEQ ID NO: 456057 - RNA, 20 nt, Brucella suis 1330
guccaguggacugauuuccc

SEQ ID NO: 456058 - RNA, 20 nt, Brucella suis 1330
guccacuggacugauuucug

SEQ ID NO: 456059 - RNA, 19 nt, Brucella suis 1330
guccacuggacugauuuuu

SEQ ID NO: 456060 - RNA, 13 nt, Brucella suis 1330
gucaugcgcggca

SEQ ID NO: 456061 - RNA, 20 nt, Brucella suis 1330
gucauaggcaauaccaagcg

SEQ ID NO: 456062 - RNA, 18 nt, Brucella suis 1330
gucagcuuggaaagcugu

SEQ ID NO: 456063 - RNA, 23 nt, Brucella suis 1330
gucagcaaaauggugcugccaug

SEQ ID NO: 456064 - RNA, 19 nt, Brucella suis 1330
gucagaaagucugcuuccg

SEQ ID NO: 456065 - RNA, 15 nt, Brucella suis 1330
gucacgaucuugccg

SEQ ID NO: 456066 - RNA, 17 nt, Brucella suis 1330
gucacgauggcccagcg

SEQ ID NO: 456067 - RNA, 18 nt, Brucella suis 1330
gucacauaaagcguggcg

SEQ ID NO: 456068 - RNA, 15 nt, Brucella suis 1330
gucaauacaccugca

SEQ ID NO: 456069 - RNA, 17 nt, Brucella suis 1330
gucaaaaagggcuuccu

SEQ ID NO: 456070 - RNA, 13 nt, Brucella suis 1330
guaucggaugcga

SEQ ID NO: 456071 - RNA, 22 nt, Brucella suis 1330
guaucggcggcaagcgcgugga

SEQ ID NO: 456072 - RNA, 15 nt, Brucella suis 1330
guaucgugcagaagu

SEQ ID NO: 456073 - RNA, 20 nt, Brucella suis 1330
guaguucaggccggccuuga

SEQ ID NO: 456074 - RNA, 15 nt, Brucella suis 1330
guauagcgaugaaga

SEQ ID NO: 456075 - RNA, 15 nt, Brucella suis 1330
guaggcguuucacac

SEQ ID NO: 456076 - RNA, 19 nt, Brucella suis 1330
guagggcaguagggcagua

SEQ ID NO: 456077 - RNA, 17 nt, Brucella suis 1330
guagcgcgagcaaugau

SEQ ID NO: 456078 - RNA, 14 nt, Brucella suis 1330
guagagugcuuccu

SEQ ID NO: 456079 - RNA, 20 nt, Brucella suis 1330
guagagcuucuuuucgauga

SEQ ID NO: 456080 - RNA, 14 nt, Brucella suis 1330
guagaauucgauga

SEQ ID NO: 456081 - RNA, 20 nt, Brucella suis 1330
guagaaaauauagccgccug

SEQ ID NO: 456082 - RNA, 15 nt, Brucella suis 1330
guagaagacaaagcc

SEQ ID NO: 456083 - RNA, 17 nt, Brucella suis 1330
guaccgacaugccaaga

SEQ ID NO: 456084 - RNA, 15 nt, Brucella suis 1330
guaauauugaagccg

SEQ ID NO: 456085 - RNA, 15 nt, Brucella suis 1330
guaaccgucuugaac

SEQ ID NO: 456086 - RNA, 20 nt, Brucella suis 1330
guaaaacgcaccgugcucca

SEQ ID NO: 456087 - RNA, 22 nt, Brucella suis 1330
guaaaacgcaccgugcuccaga

SEQ ID NO: 456088 - RNA, 21 nt, Brucella suis 1330
gguuuuggcaucagucgaauu

SEQ ID NO: 456089 - RNA, 17 nt, Brucella suis 1330
gguuuugggaaacaugc

SEQ ID NO: 456090 - RNA, 21 nt, Brucella suis 1330
guaaaaccauccccgccauga

SEQ ID NO: 456091 - RNA, 13 nt, Brucella suis 1330
gguuugaaaaugu

SEQ ID NO: 456092 - RNA, 14 nt, Brucella suis 1330
gguugccuugccca

SEQ ID NO: 456093 - RNA, 20 nt, Brucella suis 1330
gguugcaggcgcaggcccug

SEQ ID NO: 456094 - RNA, 22 nt, Brucella suis 1330
gguugcaggcgcaggcccugca

SEQ ID NO: 456095 - RNA, 20 nt, Brucella suis 1330
gguucuugagguugagcugc

SEQ ID NO: 456096 - RNA, 23 nt, Brucella suis 1330
gguucuugagguugagcugcucg

SEQ ID NO: 456097 - RNA, 19 nt, Brucella suis 1330
gguucucgaaucccgguga

SEQ ID NO: 456098 - RNA, 19 nt, Brucella suis 1330
gguucgggcauuguggugc

SEQ ID NO: 456099 - RNA, 19 nt, Brucella suis 1330
gguucgcuggccaugaugc

SEQ ID NO: 456100 - RNA, 21 nt, Brucella suis 1330
gguucgcccaugccgcaggau

SEQ ID NO: 456101 - RNA, 19 nt, Brucella suis 1330
gguuccagcgauuccauuu

SEQ ID NO: 456102 - RNA, 19 nt, Brucella suis 1330
ggugcugccauggcaguga

SEQ ID NO: 456103 - RNA, 16 nt, Brucella suis 1330
ggugcgcggaaaaugu

SEQ ID NO: 456104 - RNA, 21 nt, Brucella suis 1330
ggugccugacuggcggccaag

SEQ ID NO: 456105 - RNA, 14 nt, Brucella suis 1330
ggugccgaaggccu

SEQ ID NO: 456106 - RNA, 13 nt, Brucella suis 1330
ggugcccagagcg

SEQ ID NO: 456107 - RNA, 14 nt, Brucella suis 1330
ggugccaagaagaa

SEQ ID NO: 456108 - RNA, 19 nt, Brucella suis 1330
ggugcagucuucggccggg

SEQ ID NO: 456109 - RNA, 21 nt, Brucella suis 1330
ggugcagucuucggccgggca

SEQ ID NO: 456110 - RNA, 13 nt, Brucella suis 1330
ggugacggcggca

SEQ ID NO: 456111 - RNA, 17 nt, Brucella suis 1330
ggcuccguccggccagu

SEQ ID NO: 456112 - RNA, 17 nt, Brucella suis 1330
ggcguuuccaaugcacu

SEQ ID NO: 456113 - RNA, 13 nt, Brucella suis 1330
ggcuaaagauacc

SEQ ID NO: 456114 - RNA, 19 nt, Brucella suis 1330
ggcuaaagauaccagauca

SEQ ID NO: 456115 - RNA, 20 nt, Brucella suis 1330
ggcuaaagcauaucuuccag

SEQ ID NO: 456116 - RNA, 16 nt, Brucella suis 1330
ggcguucgucaaugcg

SEQ ID NO: 456117 - RNA, 17 nt, Brucella suis 1330
ggcguuaugagcugcau

SEQ ID NO: 456118 - RNA, 17 nt, Brucella suis 1330
ggcguguuugcggccuu

SEQ ID NO: 456119 - RNA, 13 nt, Brucella suis 1330
ggcguggaaagcu

SEQ ID NO: 456120 - RNA, 14 nt, Brucella suis 1330
ggcguggaaagcug

SEQ ID NO: 456121 - RNA, 15 nt, Brucella suis 1330
ggcgugcgcuguacu

SEQ ID NO: 456122 - RNA, 13 nt, Brucella suis 1330
ggcgugccgggcg

SEQ ID NO: 456123 - RNA, 17 nt, Brucella suis 1330
ggcguccuucaggcccu

SEQ ID NO: 456124 - RNA, 20 nt, Brucella suis 1330
ggcgucagcuugaccagaua

SEQ ID NO: 456125 - RNA, 13 nt, Brucella suis 1330
ggcgucaggccaa

SEQ ID NO: 456126 - RNA, 19 nt, Brucella suis 1330
ggcgguuuugagcugcugg

SEQ ID NO: 456127 - RNA, 15 nt, Brucella suis 1330
ggcgguugugcgccc

SEQ ID NO: 456128 - RNA, 12 nt, Brucella suis 1330
ggcggucggcgg

SEQ ID NO: 456129 - RNA, 14 nt, Brucella suis 1330
ggcggucggcggcg

SEQ ID NO: 456130 - RNA, 19 nt, Brucella suis 1330
ggcggcuuccucggcggcg

SEQ ID NO: 456131 - RNA, 23 nt, Brucella suis 1330
ggcggcuggaacgagcuccccgg

SEQ ID NO: 456132 - RNA, 16 nt, Brucella suis 1330
ggcggcgugggcugcu

SEQ ID NO: 456133 - RNA, 18 nt, Brucella suis 1330
ggcggcguuucgccccgu

SEQ ID NO: 456134 - RNA, 14 nt, Brucella suis 1330
ggcggcgguaccga

SEQ ID NO: 456135 - RNA, 14 nt, Brucella suis 1330
ggcggccggagcgc

SEQ ID NO: 456136 - RNA, 20 nt, Brucella suis 1330
ggcggaacugcaugggcucg

SEQ ID NO: 456137 - RNA, 20 nt, Brucella suis 1330
ggcgcuuuuucacgcgggcg

SEQ ID NO: 456138 - RNA, 22 nt, Brucella suis 1330
ggcggaaaggauuuccuguccc

SEQ ID NO: 456139 - RNA, 16 nt, Brucella suis 1330
ggcggaacaggcagca

SEQ ID NO: 456140 - RNA, 16 nt, Brucella suis 1330
ggcgcuggccuugcca

SEQ ID NO: 456141 - RNA, 20 nt, Brucella suis 1330
ggcgcugcuggccgucgcgu

SEQ ID NO: 456142 - RNA, 15 nt, Brucella suis 1330
ggcgcucuaauccuu

SEQ ID NO: 456143 - RNA, 19 nt, Brucella suis 1330
ggcgcgugugcauaggauu

SEQ ID NO: 456144 - RNA, 21 nt, Brucella suis 1330
ggcgcgggaugacgccgggca

SEQ ID NO: 456145 - RNA, 17 nt, Brucella suis 1330
ggcgcgaggcggcugcg

SEQ ID NO: 456146 - RNA, 20 nt, Brucella suis 1330
ggcgccugguuaugcggaug

SEQ ID NO: 456147 - RNA, 22 nt, Brucella suis 1330
ggcgccgucgggaccaccggcc

SEQ ID NO: 456148 - RNA, 15 nt, Brucella suis 1330
ggcgcccgcccgccg

SEQ ID NO: 456149 - RNA, 16 nt, Brucella suis 1330
ggcgcauucggccgcc

SEQ ID NO: 456150 - RNA, 17 nt, Brucella suis 1330
ggcgcauucaggcggcc

SEQ ID NO: 456151 - RNA, 20 nt, Brucella suis 1330
ggcgcaaugugcuggcggcc

SEQ ID NO: 456152 - RNA, 21 nt, Brucella suis 1330
ggcgcaaucggcacucuggcc

SEQ ID NO: 456153 - RNA, 21 nt, Brucella suis 1330
ggcgauggucgcaagacccaa

SEQ ID NO: 456154 - RNA, 15 nt, Brucella suis 1330
ggcgauccaauauug

SEQ ID NO: 456155 - RNA, 21 nt, Brucella suis 1330
ggcgauccaauauugccuucc

SEQ ID NO: 456156 - RNA, 17 nt, Brucella suis 1330
ggcgagggcgggcggcc

SEQ ID NO: 456157 - RNA, 15 nt, Brucella suis 1330
ggccuugcggcggcg

SEQ ID NO: 456158 - RNA, 18 nt, Brucella suis 1330
ggccuugcgguccggcca

SEQ ID NO: 456159 - RNA, 18 nt, Brucella suis 1330
ggccuuccuugacgcuga

SEQ ID NO: 456160 - RNA, 22 nt, Brucella suis 1330
ggccugugcgacgaggccugaa

SEQ ID NO: 456161 - RNA, 22 nt, Brucella suis 1330
ggccuguuccacaccugcacca

SEQ ID NO: 456162 - RNA, 18 nt, Brucella suis 1330
ggccuucagcacauccug

SEQ ID NO: 456163 - RNA, 19 nt, Brucella suis 1330
ggccuggucuagccgcgca

SEQ ID NO: 456164 - RNA, 18 nt, Brucella suis 1330
ggccugcgcgcgcauggc

SEQ ID NO: 456165 - RNA, 19 nt, Brucella suis 1330
ggccugagccauaucgggg

SEQ ID NO: 456166 - RNA, 13 nt, Brucella suis 1330
ggccugaaugcaa

SEQ ID NO: 456167 - RNA, 14 nt, Brucella suis 1330
ggccugaaagcugc

SEQ ID NO: 456168 - RNA, 10 nt, Brucella suis 1330
ggccugaacc

SEQ ID NO: 456169 - RNA, 14 nt, Brucella suis 1330
ggccucugccucca

SEQ ID NO: 456170 - RNA, 16 nt, Brucella suis 1330
ggccucuuccaggaga

SEQ ID NO: 456171 - RNA, 20 nt, Brucella suis 1330
ggccucaagcggcuccacca

SEQ ID NO: 456172 - RNA, 21 nt, Brucella suis 1330
ggccucaagcggcuccaccac

SEQ ID NO: 456173 - RNA, 18 nt, Brucella suis 1330
ggccucaagugccgccuu

SEQ ID NO: 456174 - RNA, 15 nt, Brucella suis 1330
ggccuaccauauccu

SEQ ID NO: 456175 - RNA, 22 nt, Brucella suis 1330
ggccuaccccucccucacccug

SEQ ID NO: 456176 - RNA, 20 nt, Brucella suis 1330
ggccguugcuuucggcggca

SEQ ID NO: 456177 - RNA, 17 nt, Brucella suis 1330
ggccguuacgaugacaa

SEQ ID NO: 456178 - RNA, 21 nt, Brucella suis 1330
ggccguuccgccgaucugcac

SEQ ID NO: 456179 - RNA, 16 nt, Brucella suis 1330
ggccgugaccagcgca

SEQ ID NO: 456180 - RNA, 13 nt, Brucella suis 1330
ggccgucgaucag

SEQ ID NO: 456181 - RNA, 10 nt, Brucella suis 1330
ggccggugcg

SEQ ID NO: 456182 - RNA, 20 nt, Brucella suis 1330
ggccgguaagcccugucagc

SEQ ID NO: 456183 - RNA, 22 nt, Brucella suis 1330
ggccgggaggcacgucccgccc

SEQ ID NO: 456184 - RNA, 15 nt, Brucella suis 1330
ggccggcagcgguuc

SEQ ID NO: 456185 - RNA, 24 nt, Brucella suis 1330
ggccggagcgcagaucggcgagcg

SEQ ID NO: 456186 - RNA, 18 nt, Brucella suis 1330
ggccgcuugcgacaccug

SEQ ID NO: 456187 - RNA, 17 nt, Brucella suis 1330
ggccgcuuugcggaggc

SEQ ID NO: 456188 - RNA, 22 nt, Brucella suis 1330
ggccggaaaucuuggcuaucac

SEQ ID NO: 456189 - RNA, 16 nt, Brucella suis 1330
ggccggaagcgcgcgu

SEQ ID NO: 456190 - RNA, 16 nt, Brucella suis 1330
ggccgcugccugcaca

SEQ ID NO: 456191 - RNA, 23 nt, Brucella suis 1330
ggccgcucgcugcggcgaugggc

SEQ ID NO: 456192 - RNA, 17 nt, Brucella suis 1330
ggccgcucuucggggcg

SEQ ID NO: 456193 - RNA, 21 nt, Brucella suis 1330
ggccgcucuucggggcggccu

SEQ ID NO: 456194 - RNA, 16 nt, Brucella suis 1330
ggccgccgucgcggcu

SEQ ID NO: 456195 - RNA, 14 nt, Brucella suis 1330
ggccgcaucggaag

SEQ ID NO: 456196 - RNA, 17 nt, Brucella suis 1330
ggccgcagugagcagaa

SEQ ID NO: 456197 - RNA, 22 nt, Brucella suis 1330
ggccgcaaagcgaacgcacugc

SEQ ID NO: 456198 - RNA, 17 nt, Brucella suis 1330
ggccgauugccgagccg

SEQ ID NO: 456199 - RNA, 16 nt, Brucella suis 1330
ggccgaugacggcgcg

SEQ ID NO: 456200 - RNA, 16 nt, Brucella suis 1330
ggccgauccugcgccc

SEQ ID NO: 456201 - RNA, 22 nt, Brucella suis 1330
ggccgagcgcaucggccagcug

SEQ ID NO: 456202 - RNA, 23 nt, Brucella suis 1330
ggccauugcccaaaagcgcgccg

SEQ ID NO: 456203 - RNA, 21 nt, Brucella suis 1330
ggccauuucauuaucggcggc

SEQ ID NO: 456204 - RNA, 14 nt, Brucella suis 1330
ggcccaaaggccgc

SEQ ID NO: 456205 - RNA, 17 nt, Brucella suis 1330
ggcccaaaggccgcgcc

SEQ ID NO: 456206 - RNA, 16 nt, Brucella suis 1330
ggccaguucagcggcg

SEQ ID NO: 456207 - RNA, 21 nt, Brucella suis 1330
ggccagccgcaaugagcccgc

SEQ ID NO: 456208 - RNA, 13 nt, Brucella suis 1330
ggccagccagcgc

SEQ ID NO: 456209 - RNA, 14 nt, Brucella suis 1330
ggccagccagcgca

SEQ ID NO: 456210 - RNA, 19 nt, Brucella suis 1330
ggccaagaucgacaaagcc

SEQ ID NO: 456211 - RNA, 15 nt, Brucella suis 1330
ggccaacucuuuccu

SEQ ID NO: 456212 - RNA, 18 nt, Brucella suis 1330
ggccaaaggucggcggcg

SEQ ID NO: 456213 - RNA, 22 nt, Brucella suis 1330
ggcauguugcccaucgcgcuug

SEQ ID NO: 456214 - RNA, 19 nt, Brucella suis 1330
ggcaugggcaacccggcgg

SEQ ID NO: 456215 - RNA, 19 nt, Brucella suis 1330
ggcauggcguagaaauagg

SEQ ID NO: 456216 - RNA, 21 nt, Brucella suis 1330
ggcaguucaaugggcggggcu

SEQ ID NO: 456217 - RNA, 19 nt, Brucella suis 1330
ggcagugcgagcgugaagg

SEQ ID NO: 456218 - RNA, 17 nt, Brucella suis 1330
ggcaguccccgugccgg

SEQ ID NO: 456219 - RNA, 15 nt, Brucella suis 1330
ggcaguagggcagua

SEQ ID NO: 456220 - RNA, 14 nt, Brucella suis 1330
ggcagcggcgcgcc

SEQ ID NO: 456221 - RNA, 19 nt, Brucella suis 1330
ggcagcggcgcgccaaaag

SEQ ID NO: 456222 - RNA, 17 nt, Brucella suis 1330
ggcagcggcgugccggg

SEQ ID NO: 456223 - RNA, 16 nt, Brucella suis 1330
ggcagcaugaucgcca

SEQ ID NO: 456224 - RNA, 18 nt, Brucella suis 1330
ggcagcacugaaacggga

SEQ ID NO: 456225 - RNA, 21 nt, Brucella suis 1330
ggcagcacugucgaugagacc

SEQ ID NO: 456226 - RNA, 15 nt, Brucella suis 1330
ggcacgaaaagcagg

SEQ ID NO: 456227 - RNA, 13 nt, Brucella suis 1330
ggcacgaacagau

SEQ ID NO: 456228 - RNA, 17 nt, Brucella suis 1330
ggcaccgcaaagagaac

SEQ ID NO: 456229 - RNA, 15 nt, Brucella suis 1330
ggcacccacugcccg

SEQ ID NO: 456230 - RNA, 20 nt, Brucella suis 1330
ggcaauggcgggccauuucc

SEQ ID NO: 456231 - RNA, 16 nt, Brucella suis 1330
ggcaaucguguccaca

SEQ ID NO: 456232 - RNA, 17 nt, Brucella suis 1330
ggcaaucuugaccuggc

SEQ ID NO: 456233 - RNA, 22 nt, Brucella suis 1330
ggcaaucuugaccuggccagcc

SEQ ID NO: 456234 - RNA, 20 nt, Brucella suis 1330
ggcaaagcggaucagcgcgc

SEQ ID NO: 456235 - RNA, 12 nt, Brucella suis 1330
ggauuucaucca

SEQ ID NO: 456236 - RNA, 17 nt, Brucella suis 1330
ggauugcgcaagugcug

SEQ ID NO: 456237 - RNA, 16 nt, Brucella suis 1330
ggauugcuauugaaug

SEQ ID NO: 456238 - RNA, 22 nt, Brucella suis 1330
ggaucgaggccgaacgaggcga

SEQ ID NO: 456239 - RNA, 18 nt, Brucella suis 1330
ggauaguucaaggcugcu

SEQ ID NO: 456240 - RNA, 13 nt, Brucella suis 1330
ggagcggccggau

SEQ ID NO: 456241 - RNA, 19 nt, Brucella suis 1330
ggagcgcguuuugaucuga

SEQ ID NO: 456242 - RNA, 22 nt, Brucella suis 1330
ggagccucaucggcgggccagg

SEQ ID NO: 456243 - RNA, 15 nt, Brucella suis 1330
ggacgggcaggcaga

SEQ ID NO: 456244 - RNA, 13 nt, Brucella suis 1330
ggacgcagccuuu

SEQ ID NO: 456245 - RNA, 17 nt, Brucella suis 1330
ggacgaucuggaaggcc

SEQ ID NO: 456246 - RNA, 14 nt, Brucella suis 1330
ggaccauaaaucag

SEQ ID NO: 456247 - RNA, 21 nt, Brucella suis 1330
ggaccauauccaucugcuccu

SEQ ID NO: 456248 - RNA, 19 nt, Brucella suis 1330
ggaccacgcagggucgcga

SEQ ID NO: 456249 - RNA, 23 nt, Brucella suis 1330
ggaauauagccgaugcagaugcc

SEQ ID NO: 456250 - RNA, 22 nt, Brucella suis 1330
ggaaggaaagccguuucgauca

SEQ ID NO: 456251 - RNA, 24 nt, Brucella suis 1330
ggaagaucauaaaccgaaaggcgu

SEQ ID NO: 456252 - RNA, 19 nt, Brucella suis 1330
ggaagauccccagccagaa

SEQ ID NO: 456253 - RNA, 22 nt, Brucella suis 1330
ggaaccgaccugcuucuugccu

SEQ ID NO: 456254 - RNA, 23 nt, Brucella suis 1330
ggaaauaucgccgacgauuucuu

SEQ ID NO: 456255 - RNA, 18 nt, Brucella suis 1330
ggaaauauucgggcggca

SEQ ID NO: 456256 - RNA, 12 nt, Brucella suis 1330
ggaaagauccuu

SEQ ID NO: 456257 - RNA, 15 nt, Brucella suis 1330
ggaaacucucacagc

SEQ ID NO: 456258 - RNA, 12 nt, Brucella suis 1330
ggaaacggccag

SEQ ID NO: 456259 - RNA, 20 nt, Brucella suis 1330
ggaaacggcgcaucauccug

SEQ ID NO: 456260 - RNA, 16 nt, Brucella suis 1330
ggaaacgggaaagggc

SEQ ID NO: 456261 - RNA, 15 nt, Brucella suis 1330
ggaaacacucugccu

SEQ ID NO: 456262 - RNA, 23 nt, Brucella suis 1330
ggaaaagcucgcgucccgcacgc

SEQ ID NO: 456263 - RNA, 19 nt, Brucella suis 1330
gcuuuuuucgauugaaaaa

SEQ ID NO: 456264 - RNA, 18 nt, Brucella suis 1330
ggaaaaaaccggcgauga

SEQ ID NO: 456265 - RNA, 12 nt, Brucella suis 1330
gcuuuucccaau

SEQ ID NO: 456266 - RNA, 16 nt, Brucella suis 1330
gcuuuuuauccuccca

SEQ ID NO: 456267 - RNA, 14 nt, Brucella suis 1330
gcuuucuuccagcu

SEQ ID NO: 456268 - RNA, 20 nt, Brucella suis 1330
gcuuucggcggcaguuucac

SEQ ID NO: 456269 - RNA, 16 nt, Brucella suis 1330
gcuuugaccgccgcga

SEQ ID NO: 456270 - RNA, 14 nt, Brucella suis 1330
gcuuugaugcguug

SEQ ID NO: 456271 - RNA, 16 nt, Brucella suis 1330
gcuuuggaggaaccaa

SEQ ID NO: 456272 - RNA, 14 nt, Brucella suis 1330
gcugucgcccagaa

SEQ ID NO: 456273 - RNA, 15 nt, Brucella suis 1330
aaaggaaagauccuu

SEQ ID NO: 456274 - RNA, 14 nt, Brucella suis 1330
gcugguuuaagccu

SEQ ID NO: 456275 - RNA, 18 nt, Brucella suis 1330
gcuguaaccgccaccuuc

SEQ ID NO: 456276 - RNA, 21 nt, Brucella suis 1330
gcuguaaccgccaccuucggg

SEQ ID NO: 456277 - RNA, 23 nt, Brucella suis 1330
aaagcugguugcgcggccagcca

SEQ ID NO: 456278 - RNA, 16 nt, Brucella suis 1330
gcugguaauagcccgg

SEQ ID NO: 456279 - RNA, 14 nt, Brucella suis 1330
gcuggcgcggcgga

SEQ ID NO: 456280 - RNA, 21 nt, Brucella suis 1330
gcuggccaugcgggcacgcuc

SEQ ID NO: 456281 - RNA, 13 nt, Brucella suis 1330
gcuggccaccaga

SEQ ID NO: 456282 - RNA, 15 nt, Brucella suis 1330
gcuggccaccagaaa

SEQ ID NO: 456283 - RNA, 21 nt, Brucella suis 1330
gcugcgguagcgcauggcagc

SEQ ID NO: 456284 - RNA, 15 nt, Brucella suis 1330
gcugcccgccgcaag

SEQ ID NO: 456285 - RNA, 23 nt, Brucella suis 1330
gcugcauccugcucggcgcggcg

SEQ ID NO: 456286 - RNA, 23 nt, Brucella suis 1330
gcugcaucggcaaaucaggcagg

SEQ ID NO: 456287 - RNA, 16 nt, Brucella suis 1330
gcugcaauggucgaca

SEQ ID NO: 456288 - RNA, 14 nt, Brucella suis 1330
gcugaugauuuccc

SEQ ID NO: 456289 - RNA, 21 nt, Brucella suis 1330
gcugaaacgagacaaggcaau

SEQ ID NO: 456290 - RNA, 17 nt, Brucella suis 1330
gcugacuucaaaauugg

SEQ ID NO: 456291 - RNA, 13 nt, Brucella suis 1330
gcugagugagccu

SEQ ID NO: 456292 - RNA, 18 nt, Brucella suis 1330
gcucuucggggcggccuu

SEQ ID NO: 456293 - RNA, 17 nt, Brucella suis 1330
gcucuucacagcggacu

SEQ ID NO: 456294 - RNA, 15 nt, Brucella suis 1330
gcucuggaauuucua

SEQ ID NO: 456295 - RNA, 13 nt, Brucella suis 1330
gcucugaaacuga

SEQ ID NO: 456296 - RNA, 15 nt, Brucella suis 1330
gcucugcgcccaggc

SEQ ID NO: 456297 - RNA, 18 nt, Brucella suis 1330
gcucucacgcgcagcagc

SEQ ID NO: 456298 - RNA, 22 nt, Brucella suis 1330
gcucuccggcaaaacggcaggc

SEQ ID NO: 456299 - RNA, 22 nt, Brucella suis 1330
gcucggcgcggcguucggcaag

SEQ ID NO: 456300 - RNA, 19 nt, Brucella suis 1330
gcucggcgaugaagcgggc

SEQ ID NO: 456301 - RNA, 22 nt, Brucella suis 1330
gcuccagggugccgucgcgcuc

SEQ ID NO: 456302 - RNA, 17 nt, Brucella suis 1330
gcucagcuucgggaagu

SEQ ID NO: 456303 - RNA, 19 nt, Brucella suis 1330
gcucagcuuuuccaucacu

SEQ ID NO: 456304 - RNA, 21 nt, Brucella suis 1330
gcucagagaagugagcgcaag

SEQ ID NO: 456305 - RNA, 15 nt, Brucella suis 1330
gcucaccaaaaggcg

SEQ ID NO: 456306 - RNA, 15 nt, Brucella suis 1330
gcucaccuuuuccac

SEQ ID NO: 456307 - RNA, 18 nt, Brucella suis 1330
gcucaagcuccagcgugc

SEQ ID NO: 456308 - RNA, 13 nt, Brucella suis 1330
gcucaaggccugu

SEQ ID NO: 456309 - RNA, 21 nt, Brucella suis 1330
gcucaaggccuguuccacacc

SEQ ID NO: 456310 - RNA, 21 nt, Brucella suis 1330
gcuauuugaguuuuucuucca

SEQ ID NO: 456311 - RNA, 16 nt, Brucella suis 1330
gcucaaaacgauccag

SEQ ID NO: 456312 - RNA, 16 nt, Brucella suis 1330
gcuauugaaugccaga

SEQ ID NO: 456313 - RNA, 15 nt, Brucella suis 1330
gcuaucaacgcugca

SEQ ID NO: 456314 - RNA, 17 nt, Brucella suis 1330
gcuaucaacgcugcaac

SEQ ID NO: 456315 - RNA, 18 nt, Brucella suis 1330
gcuaucaacgcugcaaca

SEQ ID NO: 456316 - RNA, 19 nt, Brucella suis 1330
gcuaucaacgcugcaacaa

SEQ ID NO: 456317 - RNA, 11 nt, Brucella suis 1330
gcuacugacaa

SEQ ID NO: 456318 - RNA, 13 nt, Brucella suis 1330
gcuaaaaagcgcg

SEQ ID NO: 456319 - RNA, 13 nt, Brucella suis 1330
gcguuuuccauga

SEQ ID NO: 456320 - RNA, 17 nt, Brucella suis 1330
gcguuggccgcggccgg

SEQ ID NO: 456321 - RNA, 21 nt, Brucella suis 1330
gcguuggaaaaugcgacaaaa

SEQ ID NO: 456322 - RNA, 16 nt, Brucella suis 1330
gcguugcggccgggcc

SEQ ID NO: 456323 - RNA, 23 nt, Brucella suis 1330
gcguugcgcucaccaccuucgcc

SEQ ID NO: 456324 - RNA, 15 nt, Brucella suis 1330
gcguugccuugcugg

SEQ ID NO: 456325 - RNA, 13 nt, Brucella suis 1330
gcguugaugacga

SEQ ID NO: 456326 - RNA, 19 nt, Brucella suis 1330
gcguugcaagauccucgcc

SEQ ID NO: 456327 - RNA, 20 nt, Brucella suis 1330
gcguucgucaaugcgcgccc

SEQ ID NO: 456328 - RNA, 21 nt, Brucella suis 1330
gcguucugaaaccgcaggcgu

SEQ ID NO: 456329 - RNA, 16 nt, Brucella suis 1330
gcguucagccaccgac

SEQ ID NO: 456330 - RNA, 13 nt, Brucella suis 1330
gcguucacauuga

SEQ ID NO: 456331 - RNA, 14 nt, Brucella suis 1330
gcguguagccgcga

SEQ ID NO: 456332 - RNA, 20 nt, Brucella suis 1330
gcgugggaaaccgcgcggcg

SEQ ID NO: 456333 - RNA, 17 nt, Brucella suis 1330
gcgucuucugagaaaaa

SEQ ID NO: 456334 - RNA, 21 nt, Brucella suis 1330
gcgucgggauggagcgcacac

SEQ ID NO: 456335 - RNA, 17 nt, Brucella suis 1330
gcgucgucaacggcaag

SEQ ID NO: 456336 - RNA, 18 nt, Brucella suis 1330
gcgucgauacugcgggcg

SEQ ID NO: 456337 - RNA, 14 nt, Brucella suis 1330
gcgucgagcaggcu

SEQ ID NO: 456338 - RNA, 21 nt, Brucella suis 1330
gcguccgacaugggccgggcg

SEQ ID NO: 456339 - RNA, 21 nt, Brucella suis 1330
gcgucagggcgaggaaaaucg

SEQ ID NO: 456340 - RNA, 16 nt, Brucella suis 1330
gcgucaggccaaagcc

SEQ ID NO: 456341 - RNA, 17 nt, Brucella suis 1330
gcgucagcgcaaagccu

SEQ ID NO: 456342 - RNA, 18 nt, Brucella suis 1330
gcguagaaauagggccag

SEQ ID NO: 456343 - RNA, 19 nt, Brucella suis 1330
gcguagaaauagggccaga

SEQ ID NO: 456344 - RNA, 17 nt, Brucella suis 1330
gcguaccauaggcgcgc

SEQ ID NO: 456345 - RNA, 17 nt, Brucella suis 1330
gcguaaaaauaaagaaa

SEQ ID NO: 456346 - RNA, 16 nt, Brucella suis 1330
gcguaaaccucccugu

SEQ ID NO: 456347 - RNA, 19 nt, Brucella suis 1330
gcgguugcgacauugaggc

SEQ ID NO: 456348 - RNA, 20 nt, Brucella suis 1330
gcgguuccagcgauuccauu

SEQ ID NO: 456349 - RNA, 20 nt, Brucella suis 1330
gcggugcacgaauugcacgg

SEQ ID NO: 456350 - RNA, 15 nt, Brucella suis 1330
gcggugacggcggca

SEQ ID NO: 456351 - RNA, 15 nt, Brucella suis 1330
gcggguugcgcccgg

SEQ ID NO: 456352 - RNA, 17 nt, Brucella suis 1330
gcgguaccgaagagcuu

SEQ ID NO: 456353 - RNA, 16 nt, Brucella suis 1330
gcgggguguacaacaa

SEQ ID NO: 456354 - RNA, 12 nt, Brucella suis 1330
gcgggggcggcg

SEQ ID NO: 456355 - RNA, 19 nt, Brucella suis 1330
gcggggcuguagcgcgcac

SEQ ID NO: 456356 - RNA, 12 nt, Brucella suis 1330
gcggggcuucca

SEQ ID NO: 456357 - RNA, 12 nt, Brucella suis 1330
gcgggcggcggc

SEQ ID NO: 456358 - RNA, 14 nt, Brucella suis 1330
gcgggcggcggcuc

SEQ ID NO: 456359 - RNA, 23 nt, Brucella suis 1330
gcgggcaugaaaacgccgcggcg

SEQ ID NO: 456360 - RNA, 22 nt, Brucella suis 1330
gcgggcaaaggcgauggcuugc

SEQ ID NO: 456361 - RNA, 12 nt, Brucella suis 1330
gcggcuuccucg

SEQ ID NO: 456362 - RNA, 23 nt, Brucella suis 1330
gcggcuucgaucguuucgccaug

SEQ ID NO: 456363 - RNA, 17 nt, Brucella suis 1330
gcgggaucagaaaucag

SEQ ID NO: 456364 - RNA, 20 nt, Brucella suis 1330
gcggcuucagaucgcgcggc

SEQ ID NO: 456365 - RNA, 20 nt, Brucella suis 1330
gcggcaggugccaucaagcg

SEQ ID NO: 456366 - RNA, 22 nt, Brucella suis 1330
gcggcaguuucaccauggccgc

SEQ ID NO: 456367 - RNA, 17 nt, Brucella suis 1330
gcggcauauugcggcgg

SEQ ID NO: 456368 - RNA, 22 nt, Brucella suis 1330
gcggcaagauagccccagcccg

SEQ ID NO: 456369 - RNA, 16 nt, Brucella suis 1330
gcggcaagcugcucgc

SEQ ID NO: 456370 - RNA, 17 nt, Brucella suis 1330
gcggaugcguggcugug

SEQ ID NO: 456371 - RNA, 14 nt, Brucella suis 1330
gcggaugcgcggcg

SEQ ID NO: 456372 - RNA, 15 nt, Brucella suis 1330
gcggaugcgcggcgc

SEQ ID NO: 456373 - RNA, 15 nt, Brucella suis 1330
gcggaugauguugcg

SEQ ID NO: 456374 - RNA, 14 nt, Brucella suis 1330
gcggaucagcgcgc

SEQ ID NO: 456375 - RNA, 17 nt, Brucella suis 1330
gcggauaaacgcuuccu

SEQ ID NO: 456376 - RNA, 19 nt, Brucella suis 1330
gcggagcaacaccccgcgc

SEQ ID NO: 456377 - RNA, 20 nt, Brucella suis 1330
gcggagcguccggcgcgguc

SEQ ID NO: 456378 - RNA, 14 nt, Brucella suis 1330
gcgcuugccgccgg

SEQ ID NO: 456379 - RNA, 23 nt, Brucella suis 1330
gcgcguuuuuauuugaacaaaga

SEQ ID NO: 456380 - RNA, 16 nt, Brucella suis 1330
gcgcggugcugcaccg

SEQ ID NO: 456381 - RNA, 22 nt, Brucella suis 1330
gcgcgggcuuuccagcccccuu

SEQ ID NO: 456382 - RNA, 16 nt, Brucella suis 1330
gcgcgggcaagcggga

SEQ ID NO: 456383 - RNA, 16 nt, Brucella suis 1330
gcgcggcggcaacggg

SEQ ID NO: 456384 - RNA, 14 nt, Brucella suis 1330
gcgcggcggcaccg

SEQ ID NO: 456385 - RNA, 16 nt, Brucella suis 1330
gcgcggaucguacggc

SEQ ID NO: 456386 - RNA, 17 nt, Brucella suis 1330
gcgcgccggucuucaug

SEQ ID NO: 456387 - RNA, 22 nt, Brucella suis 1330
gcgcgccggucuucauggcuug

SEQ ID NO: 456388 - RNA, 17 nt, Brucella suis 1330
gcgcgcccugcagggcg

SEQ ID NO: 456389 - RNA, 15 nt, Brucella suis 1330
gcgcgcccggcggcu

SEQ ID NO: 456390 - RNA, 21 nt, Brucella suis 1330
gcgcgcaccgauggagcgccc

SEQ ID NO: 456391 - RNA, 13 nt, Brucella suis 1330
gcgcgaggcggcu

SEQ ID NO: 456392 - RNA, 14 nt, Brucella suis 1330
gcgcgaggcggcug

SEQ ID NO: 456393 - RNA, 14 nt, Brucella suis 1330
gcgcgaauuuucuc

SEQ ID NO: 456394 - RNA, 15 nt, Brucella suis 1330
gcgauccuuguucuu

SEQ ID NO: 456395 - RNA, 19 nt, Brucella suis 1330
gcgauccugcugcgcggca

SEQ ID NO: 456396 - RNA, 15 nt, Brucella suis 1330
gcgaucagguugaug

SEQ ID NO: 456397 - RNA, 22 nt, Brucella suis 1330
gcgaucagguugaugccgggca

SEQ ID NO: 456398 - RNA, 14 nt, Brucella suis 1330
gcgaucaugcccac

SEQ ID NO: 456399 - RNA, 16 nt, Brucella suis 1330
gcgagugucacgcugc

SEQ ID NO: 456400 - RNA, 18 nt, Brucella suis 1330
gcgaggggaugggggccg

SEQ ID NO: 456401 - RNA, 22 nt, Brucella suis 1330
gcgaggggaugggggccgggcg

SEQ ID NO: 456402 - RNA, 21 nt, Brucella suis 1330
gcgagcguuuccggccuggcg

SEQ ID NO: 456403 - RNA, 15 nt, Brucella suis 1330
gcgaggagcguucca

SEQ ID NO: 456404 - RNA, 21 nt, Brucella suis 1330
gcgagcgucuuggcgucggug

SEQ ID NO: 456405 - RNA, 15 nt, Brucella suis 1330
gcgagcacgccgcuc

SEQ ID NO: 456406 - RNA, 22 nt, Brucella suis 1330
gcgacuuccaguggaagcacau

SEQ ID NO: 456407 - RNA, 13 nt, Brucella suis 1330
gcgacuucaccug

SEQ ID NO: 456408 - RNA, 19 nt, Brucella suis 1330
gcgacugucaccgccagca

SEQ ID NO: 456409 - RNA, 23 nt, Brucella suis 1330
gcgacugcuaaugcguuuucgag

SEQ ID NO: 456410 - RNA, 16 nt, Brucella suis 1330
gcgacguauauccggu

SEQ ID NO: 456411 - RNA, 21 nt, Brucella suis 1330
gcgacgcugcaacacgccgcc

SEQ ID NO: 456412 - RNA, 16 nt, Brucella suis 1330
gcgacgauaucgccug

SEQ ID NO: 456413 - RNA, 21 nt, Brucella suis 1330
gcgacgauaucgccugcuucc

SEQ ID NO: 456414 - RNA, 14 nt, Brucella suis 1330
gcgacgagaccugc

SEQ ID NO: 456415 - RNA, 13 nt, Brucella suis 1330
gcgacccgcgccc

SEQ ID NO: 456416 - RNA, 23 nt, Brucella suis 1330
gcgacccagccaacggugcgggc

SEQ ID NO: 456417 - RNA, 20 nt, Brucella suis 1330
gcgaccaugagcagacggcc

SEQ ID NO: 456418 - RNA, 16 nt, Brucella suis 1330
gcgaccaccauggagg

SEQ ID NO: 456419 - RNA, 22 nt, Brucella suis 1330
gcgacauguuuuggaaagaaau

SEQ ID NO: 456420 - RNA, 12 nt, Brucella suis 1330
gcgacagcggcg

SEQ ID NO: 456421 - RNA, 22 nt, Brucella suis 1330
gcgacagcggcgcgccugggcu

SEQ ID NO: 456422 - RNA, 15 nt, Brucella suis 1330
gcgacaccugcggcg

SEQ ID NO: 456423 - RNA, 20 nt, Brucella suis 1330
gcgacacggccgaucgccag

SEQ ID NO: 456424 - RNA, 18 nt, Brucella suis 1330
gcgaauguauagcgauga

SEQ ID NO: 456425 - RNA, 19 nt, Brucella suis 1330
gcgaauuccacgaugagaa

SEQ ID NO: 456426 - RNA, 16 nt, Brucella suis 1330
gcgacaaaacaaaugg

SEQ ID NO: 456427 - RNA, 21 nt, Brucella suis 1330
gcgaaaccggaacgccuaagg

SEQ ID NO: 456428 - RNA, 14 nt, Brucella suis 1330
gcgaaaccauggag

SEQ ID NO: 456429 - RNA, 15 nt, Brucella suis 1330
gcgaaaaugauagcu

SEQ ID NO: 456430 - RNA, 13 nt, Brucella suis 1330
gcgaaaaccugcu

SEQ ID NO: 456431 - RNA, 22 nt, Brucella suis 1330
gcgaaaacggccaugcgcauga

SEQ ID NO: 456432 - RNA, 18 nt, Brucella suis 1330
gccuuuaccgccggggcu

SEQ ID NO: 456433 - RNA, 13 nt, Brucella suis 1330
gccuuggaaacca

SEQ ID NO: 456434 - RNA, 17 nt, Brucella suis 1330
gccuuggaauggcgcac

SEQ ID NO: 456435 - RNA, 19 nt, Brucella suis 1330
gccuuguaggaaagcacac

SEQ ID NO: 456436 - RNA, 13 nt, Brucella suis 1330
gccuugcggcggc

SEQ ID NO: 456437 - RNA, 22 nt, Brucella suis 1330
gccuugcggcggcguuccagcu

SEQ ID NO: 456438 - RNA, 17 nt, Brucella suis 1330
gccuugcccuggcucuu

SEQ ID NO: 456439 - RNA, 19 nt, Brucella suis 1330
gccuugcccauggugccag

SEQ ID NO: 456440 - RNA, 12 nt, Brucella suis 1330
gccuugccaaaa

SEQ ID NO: 456441 - RNA, 20 nt, Brucella suis 1330
gccuucgacaaccgcgccgc

SEQ ID NO: 456442 - RNA, 18 nt, Brucella suis 1330
gccuuccuucauacaagu

SEQ ID NO: 456443 - RNA, 15 nt, Brucella suis 1330
gccuucccagccggg

SEQ ID NO: 456444 - RNA, 23 nt, Brucella suis 1330
gccuucccgauugcccauugccc

SEQ ID NO: 456445 - RNA, 14 nt, Brucella suis 1330
gccuucaucggcaa

SEQ ID NO: 456446 - RNA, 23 nt, Brucella suis 1330
gccugugcuucccggaauguauc

SEQ ID NO: 456447 - RNA, 22 nt, Brucella suis 1330
gccugugggaagacucauuguc

SEQ ID NO: 456448 - RNA, 17 nt, Brucella suis 1330
gccuguguggcccugau

SEQ ID NO: 456449 - RNA, 14 nt, Brucella suis 1330
gccugguuucacag

SEQ ID NO: 456450 - RNA, 18 nt, Brucella suis 1330
gccuggucuagccgcgca

SEQ ID NO: 456451 - RNA, 23 nt, Brucella suis 1330
gccugcuacaaaaaacaacagca

SEQ ID NO: 456452 - RNA, 13 nt, Brucella suis 1330
gccugcgcauggg

SEQ ID NO: 456453 - RNA, 20 nt, Brucella suis 1330
gccugcgccagcgauugcgc

SEQ ID NO: 456454 - RNA, 21 nt, Brucella suis 1330
gccugcgaggauuucaggugg

SEQ ID NO: 456455 - RNA, 14 nt, Brucella suis 1330
gccugccagcccgc

SEQ ID NO: 456456 - RNA, 20 nt, Brucella suis 1330
gccugccagcccgcuugcuu

SEQ ID NO: 456457 - RNA, 21 nt, Brucella suis 1330
gccugccaugccgaaggcgaa

SEQ ID NO: 456458 - RNA, 21 nt, Brucella suis 1330
gccugcaucauaggcccaggc

SEQ ID NO: 456459 - RNA, 18 nt, Brucella suis 1330
gccugcacauaaaguuca

SEQ ID NO: 456460 - RNA, 21 nt, Brucella suis 1330
gccugcacaucaccauugccc

SEQ ID NO: 456461 - RNA, 18 nt, Brucella suis 1330
gccugaugauccuggucu

SEQ ID NO: 456462 - RNA, 13 nt, Brucella suis 1330
gccugaggccgga

SEQ ID NO: 456463 - RNA, 12 nt, Brucella suis 1330
gccugaacagcg

SEQ ID NO: 456464 - RNA, 21 nt, Brucella suis 1330
gccugacccggccuuugcgcc

SEQ ID NO: 456465 - RNA, 22 nt, Brucella suis 1330
gccugaccggccacccagcccg

SEQ ID NO: 456466 - RNA, 15 nt, Brucella suis 1330
gccguugagcuguuu

SEQ ID NO: 456467 - RNA, 22 nt, Brucella suis 1330
gccuaacaggaacgccgccgga

SEQ ID NO: 456468 - RNA, 15 nt, Brucella suis 1330
gccuaccccucccuc

SEQ ID NO: 456469 - RNA, 18 nt, Brucella suis 1330
gccgugcacuucgagcag

SEQ ID NO: 456470 - RNA, 20 nt, Brucella suis 1330
gccgucgagggcaccggccu

SEQ ID NO: 456471 - RNA, 14 nt, Brucella suis 1330
gccgucgagcagca

SEQ ID NO: 456472 - RNA, 15 nt, Brucella suis 1330
gccgucgagcagcau

SEQ ID NO: 456473 - RNA, 21 nt, Brucella suis 1330
gccggugcugucgcccagaac

SEQ ID NO: 456474 - RNA, 23 nt, Brucella suis 1330
gccggucccgugucggagccggc

SEQ ID NO: 456475 - RNA, 18 nt, Brucella suis 1330
gccgguauuuugcaacug

SEQ ID NO: 456476 - RNA, 15 nt, Brucella suis 1330
gccgguauccagcag

SEQ ID NO: 456477 - RNA, 23 nt, Brucella suis 1330
gccgguauccagcagauccguga

SEQ ID NO: 456478 - RNA, 13 nt, Brucella suis 1330
gccgguauccagc

SEQ ID NO: 456479 - RNA, 15 nt, Brucella suis 1330
gccgguaagcccugu

SEQ ID NO: 456480 - RNA, 16 nt, Brucella suis 1330
gccgggguuucuucau

SEQ ID NO: 456481 - RNA, 20 nt, Brucella suis 1330
gccggggaagggucacuucc

SEQ ID NO: 456482 - RNA, 14 nt, Brucella suis 1330
gccggggcaggcuc

SEQ ID NO: 456483 - RNA, 15 nt, Brucella suis 1330
gccgggcgggcagca

SEQ ID NO: 456484 - RNA, 20 nt, Brucella suis 1330
gccgggcacgaaaagcagga

SEQ ID NO: 456485 - RNA, 20 nt, Brucella suis 1330
gccgggaaaucugcgcgcgc

SEQ ID NO: 456486 - RNA, 21 nt, Brucella suis 1330
gccgggaaaucugcgcgcgcg

SEQ ID NO: 456487 - RNA, 17 nt, Brucella suis 1330
gccggcgccuuguucuu

SEQ ID NO: 456488 - RNA, 18 nt, Brucella suis 1330
gccggcgccuuguucuuu

SEQ ID NO: 456489 - RNA, 12 nt, Brucella suis 1330
gccggcgccgcc

SEQ ID NO: 456490 - RNA, 21 nt, Brucella suis 1330
gccggcgauaccagacgcgca

SEQ ID NO: 456491 - RNA, 15 nt, Brucella suis 1330
gccggcgaucuuuuc

SEQ ID NO: 456492 - RNA, 19 nt, Brucella suis 1330
gccggcaugaaugugccug

SEQ ID NO: 456493 - RNA, 22 nt, Brucella suis 1330
gccggcaugaaugugccuguga

SEQ ID NO: 456494 - RNA, 13 nt, Brucella suis 1330
gccggagcgcaga

SEQ ID NO: 456495 - RNA, 19 nt, Brucella suis 1330
gccggacgugacaucaagc

SEQ ID NO: 456496 - RNA, 12 nt, Brucella suis 1330
gccggaccgugc

SEQ ID NO: 456497 - RNA, 18 nt, Brucella suis 1330
gccggaauaucauccagu

SEQ ID NO: 456498 - RNA, 18 nt, Brucella suis 1330
gccgcggaugacgccgcu

SEQ ID NO: 456499 - RNA, 13 nt, Brucella suis 1330
gccgcgcgcggcu

SEQ ID NO: 456500 - RNA, 13 nt, Brucella suis 1330
gccgcgcgcgcgc

SEQ ID NO: 456501 - RNA, 13 nt, Brucella suis 1330
gccgcgcccacca

SEQ ID NO: 456502 - RNA, 24 nt, Brucella suis 1330
gccgcgacugucaccgccagcaga

SEQ ID NO: 456503 - RNA, 16 nt, Brucella suis 1330
gccgccucugucaccu

SEQ ID NO: 456504 - RNA, 20 nt, Brucella suis 1330
gccgccauggucgcgcacca

SEQ ID NO: 456505 - RNA, 12 nt, Brucella suis 1330
gccgccauggcc

SEQ ID NO: 456506 - RNA, 15 nt, Brucella suis 1330
gccgccaauccccuc

SEQ ID NO: 456507 - RNA, 19 nt, Brucella suis 1330
gccgccaauccccucaccu

SEQ ID NO: 456508 - RNA, 20 nt, Brucella suis 1330
gccgcaggaacgcaucgagc

SEQ ID NO: 456509 - RNA, 19 nt, Brucella suis 1330
gccgcaauugccgcugccg

SEQ ID NO: 456510 - RNA, 21 nt, Brucella suis 1330
gccgaugggccggucuucccg

SEQ ID NO: 456511 - RNA, 16 nt, Brucella suis 1330
gccgaugcagaugcca

SEQ ID NO: 456512 - RNA, 21 nt, Brucella suis 1330
gccgaucaucagcccauagau

SEQ ID NO: 456513 - RNA, 20 nt, Brucella suis 1330
gccgacgcggcaggugccau

SEQ ID NO: 456514 - RNA, 19 nt, Brucella suis 1330
gccgaccuccccccgcguc

SEQ ID NO: 456515 - RNA, 12 nt, Brucella suis 1330
gccgaauagcgc

SEQ ID NO: 456516 - RNA, 17 nt, Brucella suis 1330
aaagcgggcgcuccagc

SEQ ID NO: 456517 - RNA, 14 nt, Brucella suis 1330
gccgaagccaggca

SEQ ID NO: 456518 - RNA, 18 nt, Brucella suis 1330
gccgaaggaugcaagccg

SEQ ID NO: 456519 - RNA, 16 nt, Brucella suis 1330
gcccuucaucaagcug

SEQ ID NO: 456520 - RNA, 20 nt, Brucella suis 1330
gcccuuccacugcaaggaag

SEQ ID NO: 456521 - RNA, 13 nt, Brucella suis 1330
gcccuuuuccgcu

SEQ ID NO: 456522 - RNA, 18 nt, Brucella suis 1330
gcccugacucugaccuuc

SEQ ID NO: 456523 - RNA, 20 nt, Brucella suis 1330
gcccugacucugaccuuccu

SEQ ID NO: 456524 - RNA, 21 nt, Brucella suis 1330
gcccugacucugaccuuccug

SEQ ID NO: 456525 - RNA, 18 nt, Brucella suis 1330
gcccucgcgccaauagga

SEQ ID NO: 456526 - RNA, 13 nt, Brucella suis 1330
gcccucaaccgag

SEQ ID NO: 456527 - RNA, 14 nt, Brucella suis 1330
gcccgugccgcguu

SEQ ID NO: 456528 - RNA, 15 nt, Brucella suis 1330
gcccgugacaagugg

SEQ ID NO: 456529 - RNA, 16 nt, Brucella suis 1330
gcccgucgaccagcgc

SEQ ID NO: 456530 - RNA, 21 nt, Brucella suis 1330
gcccgucgaccagcgcauggc

SEQ ID NO: 456531 - RNA, 15 nt, Brucella suis 1330
gcccgucaccgcggc

SEQ ID NO: 456532 - RNA, 13 nt, Brucella suis 1330
gcccggugcagcg

SEQ ID NO: 456533 - RNA, 19 nt, Brucella suis 1330
gcccggucucgcgaccggg

SEQ ID NO: 456534 - RNA, 20 nt, Brucella suis 1330
gcccggucgaccaugaggug

SEQ ID NO: 456535 - RNA, 13 nt, Brucella suis 1330
gcccggucggguu

SEQ ID NO: 456536 - RNA, 23 nt, Brucella suis 1330
gcccgccacaugggcggcggccg

SEQ ID NO: 456537 - RNA, 16 nt, Brucella suis 1330
gccccggagcggggcc

SEQ ID NO: 456538 - RNA, 16 nt, Brucella suis 1330
gccccgcugaggcggc

SEQ ID NO: 456539 - RNA, 17 nt, Brucella suis 1330
gccccgcugaggcggcc

SEQ ID NO: 456540 - RNA, 21 nt, Brucella suis 1330
gccccgcgugaugagccgcuu

SEQ ID NO: 456541 - RNA, 22 nt, Brucella suis 1330
gccccgcgugaugagccgcuuc

SEQ ID NO: 456542 - RNA, 14 nt, Brucella suis 1330
gccccgauuuuggc

SEQ ID NO: 456543 - RNA, 14 nt, Brucella suis 1330
gccccgacgaaacc

SEQ ID NO: 456544 - RNA, 15 nt, Brucella suis 1330
gccccauaaagcugg

SEQ ID NO: 456545 - RNA, 19 nt, Brucella suis 1330
gccccaagaucagccacau

SEQ ID NO: 456546 - RNA, 18 nt, Brucella suis 1330
gcccaugaucgcgccauc

SEQ ID NO: 456547 - RNA, 19 nt, Brucella suis 1330
gcccaggccucugccucca

SEQ ID NO: 456548 - RNA, 14 nt, Brucella suis 1330
gcccagcaccgcgc

SEQ ID NO: 456549 - RNA, 20 nt, Brucella suis 1330
gcccagaccgucaaaacgcc

SEQ ID NO: 456550 - RNA, 11 nt, Brucella suis 1330
gccauuuucau

SEQ ID NO: 456551 - RNA, 22 nt, Brucella suis 1330
gccauucacuugcgauuugaca

SEQ ID NO: 456552 - RNA, 19 nt, Brucella suis 1330
gccauggucgcgcaccagc

SEQ ID NO: 456553 - RNA, 16 nt, Brucella suis 1330
gccaugaaacccgcga

SEQ ID NO: 456554 - RNA, 20 nt, Brucella suis 1330
gccaucgccgacgcgcguga

SEQ ID NO: 456555 - RNA, 23 nt, Brucella suis 1330
gccaucaagcgucaugccaaccg

SEQ ID NO: 456556 - RNA, 19 nt, Brucella suis 1330
gccauagcgcagaaugagc

SEQ ID NO: 456557 - RNA, 19 nt, Brucella suis 1330
gccauagaacagcaagccc

SEQ ID NO: 456558 - RNA, 13 nt, Brucella suis 1330
gccaguuucauuu

SEQ ID NO: 456559 - RNA, 16 nt, Brucella suis 1330
gccauaaagcaccaug

SEQ ID NO: 456560 - RNA, 16 nt, Brucella suis 1330
gccauaaaucgacggg

SEQ ID NO: 456561 - RNA, 20 nt, Brucella suis 1330
gccagugucgaccggcggca

SEQ ID NO: 456562 - RNA, 22 nt, Brucella suis 1330
gccagugucgaccggcggcagg

SEQ ID NO: 456563 - RNA, 20 nt, Brucella suis 1330
gccagucauugacggcagcc

SEQ ID NO: 456564 - RNA, 21 nt, Brucella suis 1330
gccagucauugacggcagccu

SEQ ID NO: 456565 - RNA, 19 nt, Brucella suis 1330
gccaguaggccccgucauu

SEQ ID NO: 456566 - RNA, 19 nt, Brucella suis 1330
gccagguggcugcccgccg

SEQ ID NO: 456567 - RNA, 20 nt, Brucella suis 1330
gccagguggcugcccgccgc

SEQ ID NO: 456568 - RNA, 15 nt, Brucella suis 1330
gccacuucgcgggca

SEQ ID NO: 456569 - RNA, 13 nt, Brucella suis 1330
gccacgaaacgcc

SEQ ID NO: 456570 - RNA, 13 nt, Brucella suis 1330
gccaccggcggcg

SEQ ID NO: 456571 - RNA, 22 nt, Brucella suis 1330
gccaccgguuuucaucgcguca

SEQ ID NO: 456572 - RNA, 13 nt, Brucella suis 1330
gccaccauggccg

SEQ ID NO: 456573 - RNA, 16 nt, Brucella suis 1330
gccaccauggccgccc

SEQ ID NO: 456574 - RNA, 16 nt, Brucella suis 1330
gccaauccccucaccu

SEQ ID NO: 456575 - RNA, 13 nt, Brucella suis 1330
gccaaggagcgcg

SEQ ID NO: 456576 - RNA, 16 nt, Brucella suis 1330
gccaaggcugcgcgca

SEQ ID NO: 456577 - RNA, 19 nt, Brucella suis 1330
gccaagcuuuugcagccgu

SEQ ID NO: 456578 - RNA, 18 nt, Brucella suis 1330
gccaaggccggaagcgcg

SEQ ID NO: 456579 - RNA, 14 nt, Brucella suis 1330
gccaagcgccacgc

SEQ ID NO: 456580 - RNA, 17 nt, Brucella suis 1330
gccaagacuuuccaucc

SEQ ID NO: 456581 - RNA, 18 nt, Brucella suis 1330
gccaagaagaacacagcc

SEQ ID NO: 456582 - RNA, 19 nt, Brucella suis 1330
gccaaccauauuggcggca

SEQ ID NO: 456583 - RNA, 13 nt, Brucella suis 1330
gccaaaagauucc

SEQ ID NO: 456584 - RNA, 13 nt, Brucella suis 1330
gccaaaagugcgc

SEQ ID NO: 456585 - RNA, 21 nt, Brucella suis 1330
gccaaaaaucgagggguuuuu

SEQ ID NO: 456586 - RNA, 22 nt, Brucella suis 1330
gcauuuuucgccgcgcacuggc

SEQ ID NO: 456587 - RNA, 21 nt, Brucella suis 1330
gcauucugccgguucugcaug

SEQ ID NO: 456588 - RNA, 22 nt, Brucella suis 1330
gcauguuucgauucgcccggcc

SEQ ID NO: 456589 - RNA, 21 nt, Brucella suis 1330
gcaugaacucgccauaauauu

SEQ ID NO: 456590 - RNA, 14 nt, Brucella suis 1330
gcaugaaaacgccg

SEQ ID NO: 456591 - RNA, 15 nt, Brucella suis 1330
gcaucuuuuccgaaa

SEQ ID NO: 456592 - RNA, 18 nt, Brucella suis 1330
gcaucgguggcauugccc

SEQ ID NO: 456593 - RNA, 15 nt, Brucella suis 1330
gcaucguaaucgccg

SEQ ID NO: 456594 - RNA, 19 nt, Brucella suis 1330
gcaucguaaucgccgggcc

SEQ ID NO: 456595 - RNA, 21 nt, Brucella suis 1330
gcaucggccugacggugcagc

SEQ ID NO: 456596 - RNA, 20 nt, Brucella suis 1330
gcaucgcgaggcuauuuauu

SEQ ID NO: 456597 - RNA, 16 nt, Brucella suis 1330
gcaucccgaaaagugc

SEQ ID NO: 456598 - RNA, 21 nt, Brucella suis 1330
gcauccgaaaugcgcggcggc

SEQ ID NO: 456599 - RNA, 18 nt, Brucella suis 1330
gcauccaugagcagcggc

SEQ ID NO: 456600 - RNA, 12 nt, Brucella suis 1330
gcaucacuggca

SEQ ID NO: 456601 - RNA, 19 nt, Brucella suis 1330
gcaguacgguuauggcuca

SEQ ID NO: 456602 - RNA, 13 nt, Brucella suis 1330
gcaguagggcagu

SEQ ID NO: 456603 - RNA, 19 nt, Brucella suis 1330
gcaguagggcaguagggca

SEQ ID NO: 456604 - RNA, 18 nt, Brucella suis 1330
gcagguuccaguccagcg

SEQ ID NO: 456605 - RNA, 22 nt, Brucella suis 1330
gcaggugauagaccgucuggcc

SEQ ID NO: 456606 - RNA, 20 nt, Brucella suis 1330
gcagggucugcgccagauca

SEQ ID NO: 456607 - RNA, 20 nt, Brucella suis 1330
gcaggcuuuauuccaucagc

SEQ ID NO: 456608 - RNA, 15 nt, Brucella suis 1330
gcaggcgcucggugc

SEQ ID NO: 456609 - RNA, 18 nt, Brucella suis 1330
gcaggccauucccgccuc

SEQ ID NO: 456610 - RNA, 18 nt, Brucella suis 1330
gcaggcaggccgccuggg

SEQ ID NO: 456611 - RNA, 17 nt, Brucella suis 1330
gcaggcacuggucggga

SEQ ID NO: 456612 - RNA, 13 nt, Brucella suis 1330
gcaggaucuucca

SEQ ID NO: 456613 - RNA, 22 nt, Brucella suis 1330
gcagcucggcuucaaaggccug

SEQ ID NO: 456614 - RNA, 13 nt, Brucella suis 1330
gcagcggcgacgg

SEQ ID NO: 456615 - RNA, 18 nt, Brucella suis 1330
gcagcggaacuggaugac

SEQ ID NO: 456616 - RNA, 22 nt, Brucella suis 1330
gcagcgcauuuucauugccggg

SEQ ID NO: 456617 - RNA, 16 nt, Brucella suis 1330
gcagcgauauccggca

SEQ ID NO: 456618 - RNA, 17 nt, Brucella suis 1330
gcagccuugagcugguc

SEQ ID NO: 456619 - RNA, 20 nt, Brucella suis 1330
gcagccgugaaacagugccg

SEQ ID NO: 456620 - RNA, 20 nt, Brucella suis 1330
gcagccagggauugcgcaag

SEQ ID NO: 456621 - RNA, 18 nt, Brucella suis 1330
gcagcaucugcgcgagga

SEQ ID NO: 456622 - RNA, 12 nt, Brucella suis 1330
gcagcagcaucg

SEQ ID NO: 456623 - RNA, 19 nt, Brucella suis 1330
gcagcaccggcggaaggcu

SEQ ID NO: 456624 - RNA, 18 nt, Brucella suis 1330
gcagaugcaccaucaucg

SEQ ID NO: 456625 - RNA, 21 nt, Brucella suis 1330
gcagaucaguccuugaccgcu

SEQ ID NO: 456626 - RNA, 19 nt, Brucella suis 1330
gcagaucuguaucccgaaa

SEQ ID NO: 456627 - RNA, 19 nt, Brucella suis 1330
gcagauaaaaaggaugaau

SEQ ID NO: 456628 - RNA, 23 nt, Brucella suis 1330
gcagaggauaacauggccgucuu

SEQ ID NO: 456629 - RNA, 17 nt, Brucella suis 1330
gcagacgugaccgccug

SEQ ID NO: 456630 - RNA, 17 nt, Brucella suis 1330
gcagacgggacgcaggc

SEQ ID NO: 456631 - RNA, 20 nt, Brucella suis 1330
gcagacgggacgcaggcgga

SEQ ID NO: 456632 - RNA, 21 nt, Brucella suis 1330
gcagacgggacgcaggcggau

SEQ ID NO: 456633 - RNA, 17 nt, Brucella suis 1330
gcagaccacccggccgc

SEQ ID NO: 456634 - RNA, 14 nt, Brucella suis 1330
gcagaagaaagggc

SEQ ID NO: 456635 - RNA, 15 nt, Brucella suis 1330
gcagaauaucugaau

SEQ ID NO: 456636 - RNA, 18 nt, Brucella suis 1330
gcagaauuucagcuuccc

SEQ ID NO: 456637 - RNA, 18 nt, Brucella suis 1330
gcagacacgcuuuuucgc

SEQ ID NO: 456638 - RNA, 13 nt, Brucella suis 1330
gcacuuccagaua

SEQ ID NO: 456639 - RNA, 16 nt, Brucella suis 1330
gcacuuuggcaacaag

SEQ ID NO: 456640 - RNA, 15 nt, Brucella suis 1330
gcacucaucaaaagc

SEQ ID NO: 456641 - RNA, 21 nt, Brucella suis 1330
gcacgucaucaucgucuucaa

SEQ ID NO: 456642 - RNA, 17 nt, Brucella suis 1330
gcacguugcgccuggcg

SEQ ID NO: 456643 - RNA, 19 nt, Brucella suis 1330
gcacgcuuggccucuucca

SEQ ID NO: 456644 - RNA, 19 nt, Brucella suis 1330
gcacgcgcgaaaccaugga

SEQ ID NO: 456645 - RNA, 16 nt, Brucella suis 1330
gcacgccugccgcgcg

SEQ ID NO: 456646 - RNA, 15 nt, Brucella suis 1330
gcacgcaaggcggcu

SEQ ID NO: 456647 - RNA, 19 nt, Brucella suis 1330
gcacgaucgguucgccgcu

SEQ ID NO: 456648 - RNA, 18 nt, Brucella suis 1330
gcacgaccagaagcccgc

SEQ ID NO: 456649 - RNA, 16 nt, Brucella suis 1330
gcacgaauugcacggu

SEQ ID NO: 456650 - RNA, 20 nt, Brucella suis 1330
gcacgaaaagcaggaucagg

SEQ ID NO: 456651 - RNA, 17 nt, Brucella suis 1330
gcaccgugcuccagaua

SEQ ID NO: 456652 - RNA, 16 nt, Brucella suis 1330
gcaccguuucucugcu

SEQ ID NO: 456653 - RNA, 21 nt, Brucella suis 1330
gcaccguuucucugcucgccu

SEQ ID NO: 456654 - RNA, 19 nt, Brucella suis 1330
gcaccgggccgucaaaagg

SEQ ID NO: 456655 - RNA, 18 nt, Brucella suis 1330
gcaccgggucgagaaugg

SEQ ID NO: 456656 - RNA, 13 nt, Brucella suis 1330
gcaccggccuuga

SEQ ID NO: 456657 - RNA, 13 nt, Brucella suis 1330
gcaccgcgccgga

SEQ ID NO: 456658 - RNA, 16 nt, Brucella suis 1330
gcaccgccugcgcgca

SEQ ID NO: 456659 - RNA, 20 nt, Brucella suis 1330
gcaccgccugcgcgcauuuc

SEQ ID NO: 456660 - RNA, 14 nt, Brucella suis 1330
gcaccgcccguccc

SEQ ID NO: 456661 - RNA, 16 nt, Brucella suis 1330
gcaccgauggccagga

SEQ ID NO: 456662 - RNA, 18 nt, Brucella suis 1330
gcaccgcacuggggacau

SEQ ID NO: 456663 - RNA, 18 nt, Brucella suis 1330
gcaccgauccgcaacuca

SEQ ID NO: 456664 - RNA, 18 nt, Brucella suis 1330
gcaccgaccgggcuugca

SEQ ID NO: 456665 - RNA, 19 nt, Brucella suis 1330
gcaccgaaggcaagcaggc

SEQ ID NO: 456666 - RNA, 18 nt, Brucella suis 1330
gcacccgcaacccauuuu

SEQ ID NO: 456667 - RNA, 23 nt, Brucella suis 1330
gcaccccaugagaaggcaagccc

SEQ ID NO: 456668 - RNA, 14 nt, Brucella suis 1330
gcacccacugcccg

SEQ ID NO: 456669 - RNA, 14 nt, Brucella suis 1330
gcaccaugagcgcc

SEQ ID NO: 456670 - RNA, 17 nt, Brucella suis 1330
gcaccauucugcccaga

SEQ ID NO: 456671 - RNA, 22 nt, Brucella suis 1330
gcaccauucuugcgcccuccac

SEQ ID NO: 456672 - RNA, 19 nt, Brucella suis 1330
gcaccaucaucguggcggc

SEQ ID NO: 456673 - RNA, 22 nt, Brucella suis 1330
gcacauccugcaccggcuuccc

SEQ ID NO: 456674 - RNA, 20 nt, Brucella suis 1330
gcacauccauaugcagcggc

SEQ ID NO: 456675 - RNA, 17 nt, Brucella suis 1330
gcacaucaucggucagg

SEQ ID NO: 456676 - RNA, 19 nt, Brucella suis 1330
gcacagcggucgaaaccuu

SEQ ID NO: 456677 - RNA, 14 nt, Brucella suis 1330
gcacacagccaaga

SEQ ID NO: 456678 - RNA, 16 nt, Brucella suis 1330
gcacaccaaaagagcg

SEQ ID NO: 456679 - RNA, 12 nt, Brucella suis 1330
gcacaagaagca

SEQ ID NO: 456680 - RNA, 14 nt, Brucella suis 1330
gcacaaaagaaacc

SEQ ID NO: 456681 - RNA, 23 nt, Brucella suis 1330
gcaaugugcgggcuucuuccagu

SEQ ID NO: 456682 - RNA, 17 nt, Brucella suis 1330
gcaauggaaaaggccug

SEQ ID NO: 456683 - RNA, 14 nt, Brucella suis 1330
gcaauggccuugcc

SEQ ID NO: 456684 - RNA, 21 nt, Brucella suis 1330
gcaauggcgggccauuuccaa

SEQ ID NO: 456685 - RNA, 20 nt, Brucella suis 1330
gcaauggcugucaaugcagc

SEQ ID NO: 456686 - RNA, 18 nt, Brucella suis 1330
gcaaucggcacucuggcc

SEQ ID NO: 456687 - RNA, 22 nt, Brucella suis 1330
gcaaucgccguaaauuaugaga

SEQ ID NO: 456688 - RNA, 19 nt, Brucella suis 1330
gcaaugauagcuggaaaaa

SEQ ID NO: 456689 - RNA, 18 nt, Brucella suis 1330
gcaaugcaccgauggcca

SEQ ID NO: 456690 - RNA, 23 nt, Brucella suis 1330
gcaauccuggugcgcagcucggc

SEQ ID NO: 456691 - RNA, 15 nt, Brucella suis 1330
gcaaucacgcggcgc

SEQ ID NO: 456692 - RNA, 17 nt, Brucella suis 1330
gcaauaugcgccuugcg

SEQ ID NO: 456693 - RNA, 11 nt, Brucella suis 1330
gcaauaaugca

SEQ ID NO: 456694 - RNA, 18 nt, Brucella suis 1330
gcaagugugcgcgcgcca

SEQ ID NO: 456695 - RNA, 13 nt, Brucella suis 1330
gcaaguggcgcug

SEQ ID NO: 456696 - RNA, 22 nt, Brucella suis 1330
gcaaguggcgcugacgcuugau

SEQ ID NO: 456697 - RNA, 19 nt, Brucella suis 1330
gcaauaaaaggcaaagccg

SEQ ID NO: 456698 - RNA, 22 nt, Brucella suis 1330
gcaaggggcggaacaggcagca

SEQ ID NO: 456699 - RNA, 16 nt, Brucella suis 1330
gcaagggcuggcucua

SEQ ID NO: 456700 - RNA, 12 nt, Brucella suis 1330
gcaagggcaagc

SEQ ID NO: 456701 - RNA, 14 nt, Brucella suis 1330
gcaaggcggcugga

SEQ ID NO: 456702 - RNA, 13 nt, Brucella suis 1330
gcaaggcgcgccc

SEQ ID NO: 456703 - RNA, 13 nt, Brucella suis 1330
gcaagcugugugg

SEQ ID NO: 456704 - RNA, 21 nt, Brucella suis 1330
gcaagcucgccauccuugaac

SEQ ID NO: 456705 - RNA, 13 nt, Brucella suis 1330
gcaagcggcuuca

SEQ ID NO: 456706 - RNA, 22 nt, Brucella suis 1330
gcaagcgcggucagcucgucca

SEQ ID NO: 456707 - RNA, 21 nt, Brucella suis 1330
gcaagccgcggcgcgaccugc

SEQ ID NO: 456708 - RNA, 23 nt, Brucella suis 1330
gcaagccgcggcgcgaccugcuc

SEQ ID NO: 456709 - RNA, 17 nt, Brucella suis 1330
gcaagccaaagcccgug

SEQ ID NO: 456710 - RNA, 15 nt, Brucella suis 1330
gcaagauggcugccc

SEQ ID NO: 456711 - RNA, 23 nt, Brucella suis 1330
gcaacuguucgggcgugaaagac

SEQ ID NO: 456712 - RNA, 22 nt, Brucella suis 1330
aaagcggauuggcguucacauu

SEQ ID NO: 456713 - RNA, 15 nt, Brucella suis 1330
gcaacuuccuugccg

SEQ ID NO: 456714 - RNA, 15 nt, Brucella suis 1330
aaagcgcaucccgaa

SEQ ID NO: 456715 - RNA, 23 nt, Brucella suis 1330
aaagcgcggagcaacaccccgcg

SEQ ID NO: 456716 - RNA, 16 nt, Brucella suis 1330
gcaacgcgcccgccac

SEQ ID NO: 456717 - RNA, 20 nt, Brucella suis 1330
gcaacgcucucguguuaucu

SEQ ID NO: 456718 - RNA, 20 nt, Brucella suis 1330
gcaacgcaauggagcaggaa

SEQ ID NO: 456719 - RNA, 17 nt, Brucella suis 1330
gcaacgaauacagugac

SEQ ID NO: 456720 - RNA, 21 nt, Brucella suis 1330
gcaacgaauacagugacgcgc

SEQ ID NO: 456721 - RNA, 23 nt, Brucella suis 1330
gcaacgaauacagugacgcgcgc

SEQ ID NO: 456722 - RNA, 14 nt, Brucella suis 1330
gcaaccggcgggcg

SEQ ID NO: 456723 - RNA, 19 nt, Brucella suis 1330
gcaaccgccagaucgacag

SEQ ID NO: 456724 - RNA, 15 nt, Brucella suis 1330
gaucacagccgcgcc

SEQ ID NO: 456725 - RNA, 22 nt, Brucella suis 1330
gaucacagccgcgccaauccag

SEQ ID NO: 456726 - RNA, 14 nt, Brucella suis 1330
gaucaauucccugg

SEQ ID NO: 456727 - RNA, 19 nt, Brucella suis 1330
gaucacaacgccgucagcc

SEQ ID NO: 456728 - RNA, 19 nt, Brucella suis 1330
gauaucgccugaaaccguc

SEQ ID NO: 456729 - RNA, 18 nt, Brucella suis 1330
gauauccauaucuuucca

SEQ ID NO: 456730 - RNA, 19 nt, Brucella suis 1330
gauauccauuguggagcag

SEQ ID NO: 456731 - RNA, 14 nt, Brucella suis 1330
gauauucgccgccu

SEQ ID NO: 456732 - RNA, 16 nt, Brucella suis 1330
gauauucggccagcaa

SEQ ID NO: 456733 - RNA, 16 nt, Brucella suis 1330
gauauugaccuuggca

SEQ ID NO: 456734 - RNA, 17 nt, Brucella suis 1330
gauagccauagcgcaga

SEQ ID NO: 456735 - RNA, 23 nt, Brucella suis 1330
gauacgguucacgccauaagccg

SEQ ID NO: 456736 - RNA, 22 nt, Brucella suis 1330
gauagcgcccgccucgcaggca

SEQ ID NO: 456737 - RNA, 17 nt, Brucella suis 1330
gauaguucaaggcugcu

SEQ ID NO: 456738 - RNA, 22 nt, Brucella suis 1330
gauacccaugcgaugagccuuc

SEQ ID NO: 456739 - RNA, 22 nt, Brucella suis 1330
gauacauauacuuacuaguggu

SEQ ID NO: 456740 - RNA, 17 nt, Brucella suis 1330
gauaauagaugagcugg

SEQ ID NO: 456741 - RNA, 18 nt, Brucella suis 1330
gauaauagaugagcuggu

SEQ ID NO: 456742 - RNA, 19 nt, Brucella suis 1330
gauaaucggacagauugcu

SEQ ID NO: 456743 - RNA, 20 nt, Brucella suis 1330
gauaaucuggcugguagcgc

SEQ ID NO: 456744 - RNA, 18 nt, Brucella suis 1330
gauaauugaucggcugga

SEQ ID NO: 456745 - RNA, 12 nt, Brucella suis 1330
gaguuggcccgc

SEQ ID NO: 456746 - RNA, 19 nt, Brucella suis 1330
gaguuuuucggccaguuca

SEQ ID NO: 456747 - RNA, 15 nt, Brucella suis 1330
gaguuuuucuuccag

SEQ ID NO: 456748 - RNA, 18 nt, Brucella suis 1330
gauaaagccuguccuugu

SEQ ID NO: 456749 - RNA, 21 nt, Brucella suis 1330
gagguucuugagguugagcug

SEQ ID NO: 456750 - RNA, 17 nt, Brucella suis 1330
gagguugagcugcucgg

SEQ ID NO: 456751 - RNA, 22 nt, Brucella suis 1330
gagggcgggcaugggcaccugg

SEQ ID NO: 456752 - RNA, 14 nt, Brucella suis 1330
gagggccucgauuu

SEQ ID NO: 456753 - RNA, 17 nt, Brucella suis 1330
gagggccucgauuucau

SEQ ID NO: 456754 - RNA, 14 nt, Brucella suis 1330
gagggcgcagcagc

SEQ ID NO: 456755 - RNA, 17 nt, Brucella suis 1330
gagggcgcagcagcgca

SEQ ID NO: 456756 - RNA, 19 nt, Brucella suis 1330
gaggcuuccgaaucgcugu

SEQ ID NO: 456757 - RNA, 16 nt, Brucella suis 1330
gagggaaacacucugc

SEQ ID NO: 456758 - RNA, 16 nt, Brucella suis 1330
gaggcaaugaaaacgg

SEQ ID NO: 456759 - RNA, 21 nt, Brucella suis 1330
gaggcaaaugccgaagcccau

SEQ ID NO: 456760 - RNA, 18 nt, Brucella suis 1330
gaggaucgaccaggaugu

SEQ ID NO: 456761 - RNA, 14 nt, Brucella suis 1330
gaggacgauggaag

SEQ ID NO: 456762 - RNA, 14 nt, Brucella suis 1330
gaggacaaggccuu

SEQ ID NO: 456763 - RNA, 14 nt, Brucella suis 1330
gaggaaguggaagc

SEQ ID NO: 456764 - RNA, 20 nt, Brucella suis 1330
gagcuuguugcggcgagcga

SEQ ID NO: 456765 - RNA, 12 nt, Brucella suis 1330
gagccuuugcuu

SEQ ID NO: 456766 - RNA, 19 nt, Brucella suis 1330
gagccuuugcuucacgcuc

SEQ ID NO: 456767 - RNA, 13 nt, Brucella suis 1330
gagcgaccagcaa

SEQ ID NO: 456768 - RNA, 14 nt, Brucella suis 1330
gagcugcuggguga

SEQ ID NO: 456769 - RNA, 15 nt, Brucella suis 1330
gagccgcgccaugcc

SEQ ID NO: 456770 - RNA, 15 nt, Brucella suis 1330
gagccgcucuaacua

SEQ ID NO: 456771 - RNA, 14 nt, Brucella suis 1330
gagccgcuucugcu

SEQ ID NO: 456772 - RNA, 19 nt, Brucella suis 1330
gagccauaucggggcgucc

SEQ ID NO: 456773 - RNA, 16 nt, Brucella suis 1330
gagcauggccugcgca

SEQ ID NO: 456774 - RNA, 20 nt, Brucella suis 1330
gagcauggcaaggccacgca

SEQ ID NO: 456775 - RNA, 21 nt, Brucella suis 1330
gagcauucccuucgcgccgcc

SEQ ID NO: 456776 - RNA, 16 nt, Brucella suis 1330
aaagcaggaucggcag

SEQ ID NO: 456777 - RNA, 13 nt, Brucella suis 1330
gagcaggcucccg

SEQ ID NO: 456778 - RNA, 17 nt, Brucella suis 1330
gagcacgccgcucagga

SEQ ID NO: 456779 - RNA, 19 nt, Brucella suis 1330
gagcaccgcccguccccca

SEQ ID NO: 456780 - RNA, 15 nt, Brucella suis 1330
gagaugcgcuuuccg

SEQ ID NO: 456781 - RNA, 20 nt, Brucella suis 1330
gagauauccauaucuuucca

SEQ ID NO: 456782 - RNA, 20 nt, Brucella suis 1330
gagagcaugaucgcccgccc

SEQ ID NO: 456783 - RNA, 20 nt, Brucella suis 1330
gagaccugccaucaccagcc

SEQ ID NO: 456784 - RNA, 22 nt, Brucella suis 1330
gagaacuucggcauggcagccg

SEQ ID NO: 456785 - RNA, 13 nt, Brucella suis 1330
gagaacggcggcg

SEQ ID NO: 456786 - RNA, 14 nt, Brucella suis 1330
gagaacggcggcgg

SEQ ID NO: 456787 - RNA, 22 nt, Brucella suis 1330
gagaacggcggcggcgaugccu

SEQ ID NO: 456788 - RNA, 22 nt, Brucella suis 1330
gagaaaauggcgcuagcgauga

SEQ ID NO: 456789 - RNA, 19 nt, Brucella suis 1330
gacuuuucagccucggaaa

SEQ ID NO: 456790 - RNA, 18 nt, Brucella suis 1330
gacuugaagagccgcagg

SEQ ID NO: 456791 - RNA, 20 nt, Brucella suis 1330
gacuugaagagccgcaggca

SEQ ID NO: 456792 - RNA, 14 nt, Brucella suis 1330
gacuucagccagaa

SEQ ID NO: 456793 - RNA, 12 nt, Brucella suis 1330
gacuucaucgcg

SEQ ID NO: 456794 - RNA, 17 nt, Brucella suis 1330
gacuuauuccgugccuu

SEQ ID NO: 456795 - RNA, 23 nt, Brucella suis 1330
gacuuauuccgugccuugaauag

SEQ ID NO: 456796 - RNA, 17 nt, Brucella suis 1330
gacugucaccgccagca

SEQ ID NO: 456797 - RNA, 24 nt, Brucella suis 1330
gacugcggcaacggcgcuggccuu

SEQ ID NO: 456798 - RNA, 15 nt, Brucella suis 1330
gacucuuuucgcccg

SEQ ID NO: 456799 - RNA, 12 nt, Brucella suis 1330
gacugaaauaau

SEQ ID NO: 456800 - RNA, 14 nt, Brucella suis 1330
gacguggagcaggc

SEQ ID NO: 456801 - RNA, 18 nt, Brucella suis 1330
gacggggauugcuauuga

SEQ ID NO: 456802 - RNA, 12 nt, Brucella suis 1330
gacgggcaggca

SEQ ID NO: 456803 - RNA, 19 nt, Brucella suis 1330
gacgcuacccauucauuuc

SEQ ID NO: 456804 - RNA, 21 nt, Brucella suis 1330
gacgcgugaaaauagcugggu

SEQ ID NO: 456805 - RNA, 13 nt, Brucella suis 1330
gacgcggucccac

SEQ ID NO: 456806 - RNA, 13 nt, Brucella suis 1330
gacgcgcauuuuc

SEQ ID NO: 456807 - RNA, 19 nt, Brucella suis 1330
gacgagcgcacgcaggcau

SEQ ID NO: 456808 - RNA, 22 nt, Brucella suis 1330
gacgagaugcgcuuuccgggcu

SEQ ID NO: 456809 - RNA, 15 nt, Brucella suis 1330
gacgacgaaucuuca

SEQ ID NO: 456810 - RNA, 14 nt, Brucella suis 1330
gacgaauggugagg

SEQ ID NO: 456811 - RNA, 17 nt, Brucella suis 1330
gaccucgucaaaaccgu

SEQ ID NO: 456812 - RNA, 20 nt, Brucella suis 1330
gaccguucaacuggcgcagc

SEQ ID NO: 456813 - RNA, 15 nt, Brucella suis 1330
gaccguugcgcggcg

SEQ ID NO: 456814 - RNA, 13 nt, Brucella suis 1330
gaccgugccgcuu

SEQ ID NO: 456815 - RNA, 16 nt, Brucella suis 1330
gaccgugccgcuucca

SEQ ID NO: 456816 - RNA, 15 nt, Brucella suis 1330
gaccgucaaaacgcc

SEQ ID NO: 456817 - RNA, 21 nt, Brucella suis 1330
gaccgggcuucuuguugaaag

SEQ ID NO: 456818 - RNA, 14 nt, Brucella suis 1330
gaccggcuggucaa

SEQ ID NO: 456819 - RNA, 18 nt, Brucella suis 1330
gacccgucaaugccaucc

SEQ ID NO: 456820 - RNA, 17 nt, Brucella suis 1330
gacccagccaagcgcca

SEQ ID NO: 456821 - RNA, 10 nt, Brucella suis 1330
gaccauuucc

SEQ ID NO: 456822 - RNA, 17 nt, Brucella suis 1330
gacccaauccgccaacg

SEQ ID NO: 456823 - RNA, 16 nt, Brucella suis 1330
gaccagcgcaaugccc

SEQ ID NO: 456824 - RNA, 23 nt, Brucella suis 1330
gaccagcgcauggcauggcuuga

SEQ ID NO: 456825 - RNA, 17 nt, Brucella suis 1330
gaccagccuugcccugg

SEQ ID NO: 456826 - RNA, 19 nt, Brucella suis 1330
gaccagccuugcccuggcu

SEQ ID NO: 456827 - RNA, 14 nt, Brucella suis 1330
gacauucugcacgu

SEQ ID NO: 456828 - RNA, 15 nt, Brucella suis 1330
gacauauucuuccgu

SEQ ID NO: 456829 - RNA, 15 nt, Brucella suis 1330
gacaggaacaucaua

SEQ ID NO: 456830 - RNA, 12 nt, Brucella suis 1330
gacagcacugcc

SEQ ID NO: 456831 - RNA, 21 nt, Brucella suis 1330
gacagaauuuggaaguuuucc

SEQ ID NO: 456832 - RNA, 18 nt, Brucella suis 1330
gacacguccgggaagcag

SEQ ID NO: 456833 - RNA, 16 nt, Brucella suis 1330
gacaccuucggccagc

SEQ ID NO: 456834 - RNA, 19 nt, Brucella suis 1330
gacaccuucggccagcgca

SEQ ID NO: 456835 - RNA, 18 nt, Brucella suis 1330
gaauggagcauuuccagc

SEQ ID NO: 456836 - RNA, 16 nt, Brucella suis 1330
gacaaagaucaucgcc

SEQ ID NO: 456837 - RNA, 15 nt, Brucella suis 1330
gacaagccgcuccgc

SEQ ID NO: 456838 - RNA, 16 nt, Brucella suis 1330
gacaagcgugagcuuc

SEQ ID NO: 456839 - RNA, 17 nt, Brucella suis 1330
gacaagcgugagcuuca

SEQ ID NO: 456840 - RNA, 19 nt, Brucella suis 1330
gacaagcucgcguuccagc

SEQ ID NO: 456841 - RNA, 19 nt, Brucella suis 1330
gacaaucaggccgauccug

SEQ ID NO: 456842 - RNA, 14 nt, Brucella suis 1330
gacaaucuccccuu

SEQ ID NO: 456843 - RNA, 19 nt, Brucella suis 1330
gaaucuaagcggaaaacgg

SEQ ID NO: 456844 - RNA, 20 nt, Brucella suis 1330
gaaucugccuugucagaagc

SEQ ID NO: 456845 - RNA, 16 nt, Brucella suis 1330
gaaugcagaucagucc

SEQ ID NO: 456846 - RNA, 17 nt, Brucella suis 1330
gaaugcagacaaguccu

SEQ ID NO: 456847 - RNA, 15 nt, Brucella suis 1330
gaauaggagccggcc

SEQ ID NO: 456848 - RNA, 14 nt, Brucella suis 1330
gaauagggcaugga

SEQ ID NO: 456849 - RNA, 20 nt, Brucella suis 1330
gaauaucuacagacuagaca

SEQ ID NO: 456850 - RNA, 20 nt, Brucella suis 1330
gaagugagcgcaaggcuucg

SEQ ID NO: 456851 - RNA, 15 nt, Brucella suis 1330
gaagugcauaugaug

SEQ ID NO: 456852 - RNA, 14 nt, Brucella suis 1330
gaagguuucagccu

SEQ ID NO: 456853 - RNA, 21 nt, Brucella suis 1330
gaaguaggugcgcggguauug

SEQ ID NO: 456854 - RNA, 22 nt, Brucella suis 1330
gaaggcguuggccgcggccggu

SEQ ID NO: 456855 - RNA, 22 nt, Brucella suis 1330
gaaggcugccgggguuuuucuu

SEQ ID NO: 456856 - RNA, 15 nt, Brucella suis 1330
gaagcugccgcggcu

SEQ ID NO: 456857 - RNA, 19 nt, Brucella suis 1330
gaagcugcgcgaaccagau

SEQ ID NO: 456858 - RNA, 18 nt, Brucella suis 1330
gaagcugucgccagcgcc

SEQ ID NO: 456859 - RNA, 15 nt, Brucella suis 1330
aaagauaccagauca

SEQ ID NO: 456860 - RNA, 19 nt, Brucella suis 1330
gaagcgaagaacagaagca

SEQ ID NO: 456861 - RNA, 15 nt, Brucella suis 1330
gaagccgauccgcag

SEQ ID NO: 456862 - RNA, 22 nt, Brucella suis 1330
gaagauugaugauaggcugcuu

SEQ ID NO: 456863 - RNA, 18 nt, Brucella suis 1330
gaagagacuguucuuugc

SEQ ID NO: 456864 - RNA, 15 nt, Brucella suis 1330
gaagacgaucuuuuc

SEQ ID NO: 456865 - RNA, 16 nt, Brucella suis 1330
gaagacgaucuuuucc

SEQ ID NO: 456866 - RNA, 14 nt, Brucella suis 1330
gaagaccuucugga

SEQ ID NO: 456867 - RNA, 17 nt, Brucella suis 1330
gaagaccuucuggaagc

SEQ ID NO: 456868 - RNA, 12 nt, Brucella suis 1330
gaagaugcaaug

SEQ ID NO: 456869 - RNA, 20 nt, Brucella suis 1330
gaagaagauaaucagcagaa

SEQ ID NO: 456870 - RNA, 21 nt, Brucella suis 1330
gaagaagauaaucagcagaag

SEQ ID NO: 456871 - RNA, 19 nt, Brucella suis 1330
gaagaagcgccagcuuccg

SEQ ID NO: 456872 - RNA, 17 nt, Brucella suis 1330
gaagaagcuucacaucc

SEQ ID NO: 456873 - RNA, 16 nt, Brucella suis 1330
gaagaauggcaagcag

SEQ ID NO: 456874 - RNA, 20 nt, Brucella suis 1330
gaacaggucugacgggauga

SEQ ID NO: 456875 - RNA, 16 nt, Brucella suis 1330
gaacagguugcgccac

SEQ ID NO: 456876 - RNA, 13 nt, Brucella suis 1330
gaacagaucgcca

SEQ ID NO: 456877 - RNA, 20 nt, Brucella suis 1330
gaacagaucggaaucaaaac

SEQ ID NO: 456878 - RNA, 20 nt, Brucella suis 1330
gaacagaagcaccagcgcgc

SEQ ID NO: 456879 - RNA, 13 nt, Brucella suis 1330
gaacaagcagaug

SEQ ID NO: 456880 - RNA, 14 nt, Brucella suis 1330
gaacaacacaacac

SEQ ID NO: 456881 - RNA, 20 nt, Brucella suis 1330
gaaauuggccgcugccugca

SEQ ID NO: 456882 - RNA, 22 nt, Brucella suis 1330
gaaauuggccgcugccugcaca

SEQ ID NO: 456883 - RNA, 20 nt, Brucella suis 1330
aaagagccauuauucuccca

SEQ ID NO: 456884 - RNA, 18 nt, Brucella suis 1330
gaaaggugaaggccugcu

SEQ ID NO: 456885 - RNA, 24 nt, Brucella suis 1330
gaaaggcuucgcgaacaugcgcca

SEQ ID NO: 456886 - RNA, 18 nt, Brucella suis 1330
gaaaggaugacggcuuca

SEQ ID NO: 456887 - RNA, 16 nt, Brucella suis 1330
gaaagucugcuuccgc

SEQ ID NO: 456888 - RNA, 22 nt, Brucella suis 1330
gaaaucaguccaguggacugau

SEQ ID NO: 456889 - RNA, 22 nt, Brucella suis 1330
gaaauccauagcgaauggcaau

SEQ ID NO: 456890 - RNA, 15 nt, Brucella suis 1330
gaaagcccggcugga

SEQ ID NO: 456891 - RNA, 16 nt, Brucella suis 1330
gaaagaucagccagcc

SEQ ID NO: 456892 - RNA, 13 nt, Brucella suis 1330
gaaagccagaacc

SEQ ID NO: 456893 - RNA, 19 nt, Brucella suis 1330
gaaagacucgaacaggccc

SEQ ID NO: 456894 - RNA, 14 nt, Brucella suis 1330
gaaacggcagccga

SEQ ID NO: 456895 - RNA, 20 nt, Brucella suis 1330
gaaacggccaagcaggagau

SEQ ID NO: 456896 - RNA, 14 nt, Brucella suis 1330
gaaacggccagggc

SEQ ID NO: 456897 - RNA, 15 nt, Brucella suis 1330
gaaaccuugccgcgu

SEQ ID NO: 456898 - RNA, 21 nt, Brucella suis 1330
gaaacccgcgaucaccagccc

SEQ ID NO: 456899 - RNA, 19 nt, Brucella suis 1330
gaaaccaucaacgggauga

SEQ ID NO: 456900 - RNA, 15 nt, Brucella suis 1330
gaaaccaucgagcau

SEQ ID NO: 456901 - RNA, 17 nt, Brucella suis 1330
gaaaccaucgagcauuu

SEQ ID NO: 456902 - RNA, 16 nt, Brucella suis 1330
gaaacaaggccgagcg

SEQ ID NO: 456903 - RNA, 15 nt, Brucella suis 1330
gaaaagccggagcau

SEQ ID NO: 456904 - RNA, 22 nt, Brucella suis 1330
gaaaauauagccgccugccuuc

SEQ ID NO: 456905 - RNA, 23 nt, Brucella suis 1330
cuuuugacggcccggugcagcgg

SEQ ID NO: 456906 - RNA, 17 nt, Brucella suis 1330
gaaaaaaggucgcccga

SEQ ID NO: 456907 - RNA, 13 nt, Brucella suis 1330
gaaaaacccgguc

SEQ ID NO: 456908 - RNA, 18 nt, Brucella suis 1330
cuuugccgucuucgauca

SEQ ID NO: 456909 - RNA, 18 nt, Brucella suis 1330
cuuucugcuucuguugca

SEQ ID NO: 456910 - RNA, 15 nt, Brucella suis 1330
cuuucuggacaaaga

SEQ ID NO: 456911 - RNA, 16 nt, Brucella suis 1330
cuuucuggacaaagaa

SEQ ID NO: 456912 - RNA, 20 nt, Brucella suis 1330
cuuucugccaggagaugagg

SEQ ID NO: 456913 - RNA, 18 nt, Brucella suis 1330
cuuucggcggcaguuuca

SEQ ID NO: 456914 - RNA, 19 nt, Brucella suis 1330
cuuuccugcauaauuauug

SEQ ID NO: 456915 - RNA, 14 nt, Brucella suis 1330
cuuuccggcuucca

SEQ ID NO: 456916 - RNA, 17 nt, Brucella suis 1330
cuuucgauuuuugccag

SEQ ID NO: 456917 - RNA, 23 nt, Brucella suis 1330
cuuucgcuuccguaucuccgggc

SEQ ID NO: 456918 - RNA, 11 nt, Brucella suis 1330
cuuucacuuuu

SEQ ID NO: 456919 - RNA, 22 nt, Brucella suis 1330
cuuuauggcucagagaagugag

SEQ ID NO: 456920 - RNA, 19 nt, Brucella suis 1330
aaagaauucccggcugagc

SEQ ID NO: 456921 - RNA, 23 nt, Brucella suis 1330
aaagacacgguuccaccggcugu

SEQ ID NO: 456922 - RNA, 17 nt, Brucella suis 1330
cuugucgcggccuugau

SEQ ID NO: 456923 - RNA, 17 nt, Brucella suis 1330
cuugucgaaggaucgaa

SEQ ID NO: 456924 - RNA, 13 nt, Brucella suis 1330
cuuguucggcuuu

SEQ ID NO: 456925 - RNA, 19 nt, Brucella suis 1330
cuugggauucucgaacagg

SEQ ID NO: 456926 - RNA, 20 nt, Brucella suis 1330
cuugggauucucgaacaggu

SEQ ID NO: 456927 - RNA, 14 nt, Brucella suis 1330
cuuggcgacggcca

SEQ ID NO: 456928 - RNA, 16 nt, Brucella suis 1330
cuuggccucuuccagg

SEQ ID NO: 456929 - RNA, 17 nt, Brucella suis 1330
cuuggcaauauauacac

SEQ ID NO: 456930 - RNA, 16 nt, Brucella suis 1330
cuuggcaaucuugacc

SEQ ID NO: 456931 - RNA, 12 nt, Brucella suis 1330
cuuggcaccgcc

SEQ ID NO: 456932 - RNA, 23 nt, Brucella suis 1330
cuuggaacguacaccgaggccgc

SEQ ID NO: 456933 - RNA, 15 nt, Brucella suis 1330
cuugcuugccauucu

SEQ ID NO: 456934 - RNA, 14 nt, Brucella suis 1330
cuugcuuugcccuu

SEQ ID NO: 456935 - RNA, 21 nt, Brucella suis 1330
cuugcuguaaccgccaccuuc

SEQ ID NO: 456936 - RNA, 19 nt, Brucella suis 1330
cuugcugaaacgagacaag

SEQ ID NO: 456937 - RNA, 22 nt, Brucella suis 1330
cuugcgguugcaacgacauaga

SEQ ID NO: 456938 - RNA, 19 nt, Brucella suis 1330
cuugcggcgauaacugaau

SEQ ID NO: 456939 - RNA, 18 nt, Brucella suis 1330
cuugcgcccuccaccgcu

SEQ ID NO: 456940 - RNA, 20 nt, Brucella suis 1330
cuugcgccaaucgccgcgau

SEQ ID NO: 456941 - RNA, 14 nt, Brucella suis 1330
cuugcgauuuccuu

SEQ ID NO: 456942 - RNA, 17 nt, Brucella suis 1330
cuugcgauuuccuugcc

SEQ ID NO: 456943 - RNA, 15 nt, Brucella suis 1330
cuugcgaaccaucac

SEQ ID NO: 456944 - RNA, 22 nt, Brucella suis 1330
cuugccggccugaaacagcaua

SEQ ID NO: 456945 - RNA, 18 nt, Brucella suis 1330
cuugccgggcgggcagca

SEQ ID NO: 456946 - RNA, 16 nt, Brucella suis 1330
cuugccgccgcuucca

SEQ ID NO: 456947 - RNA, 19 nt, Brucella suis 1330
cuugccgaccuccccccgc

SEQ ID NO: 456948 - RNA, 22 nt, Brucella suis 1330
cuugcccgcauagccaucgccg

SEQ ID NO: 456949 - RNA, 17 nt, Brucella suis 1330
cuugccccggcaccgcg

SEQ ID NO: 456950 - RNA, 14 nt, Brucella suis 1330
cuugccgaaaagcc

SEQ ID NO: 456951 - RNA, 20 nt, Brucella suis 1330
aaacuugugcgugccauaca

SEQ ID NO: 456952 - RNA, 15 nt, Brucella suis 1330
cuugccgaaaagccg

SEQ ID NO: 456953 - RNA, 15 nt, Brucella suis 1330
cuugccagucuugcg

SEQ ID NO: 456954 - RNA, 17 nt, Brucella suis 1330
cuugccauuuuccgugg

SEQ ID NO: 456955 - RNA, 20 nt, Brucella suis 1330
cuugccauuuuccguggcgc

SEQ ID NO: 456956 - RNA, 21 nt, Brucella suis 1330
cuugccaccacgauggaagga

SEQ ID NO: 456957 - RNA, 23 nt, Brucella suis 1330
cuugcauuauuuagauuugcuua

SEQ ID NO: 456958 - RNA, 16 nt, Brucella suis 1330
cuugcauuccagaagg

SEQ ID NO: 456959 - RNA, 21 nt, Brucella suis 1330
cuugcauucgcucgaagaguu

SEQ ID NO: 456960 - RNA, 12 nt, Brucella suis 1330
cuugaugcccag

SEQ ID NO: 456961 - RNA, 14 nt, Brucella suis 1330
cuugaugcccagcu

SEQ ID NO: 456962 - RNA, 17 nt, Brucella suis 1330
cuugaugauagaauaaa

SEQ ID NO: 456963 - RNA, 18 nt, Brucella suis 1330
cuugaucuggguaaagcg

SEQ ID NO: 456964 - RNA, 19 nt, Brucella suis 1330
cuugauguccggcgcgcug

SEQ ID NO: 456965 - RNA, 20 nt, Brucella suis 1330
cuugaucgaaugguucuuca

SEQ ID NO: 456966 - RNA, 23 nt, Brucella suis 1330
cuugaucgauuugcgcaccagau

SEQ ID NO: 456967 - RNA, 16 nt, Brucella suis 1330
cuugagguugagcugc

SEQ ID NO: 456968 - RNA, 22 nt, Brucella suis 1330
cuugagggcagcggucacagaa

SEQ ID NO: 456969 - RNA, 20 nt, Brucella suis 1330
cuugagcuucaucuucuugg

SEQ ID NO: 456970 - RNA, 18 nt, Brucella suis 1330
cuugagaucguaggcuuu

SEQ ID NO: 456971 - RNA, 22 nt, Brucella suis 1330
cuugagauauccauaucuuucc

SEQ ID NO: 456972 - RNA, 14 nt, Brucella suis 1330
cuugaccuggccag

SEQ ID NO: 456973 - RNA, 15 nt, Brucella suis 1330
cuugaccagauagcc

SEQ ID NO: 456974 - RNA, 12 nt, Brucella suis 1330
cuugaagcugcc

SEQ ID NO: 456975 - RNA, 18 nt, Brucella suis 1330
cuugaagcugccgcggcu

SEQ ID NO: 456976 - RNA, 18 nt, Brucella suis 1330
cuugaagucaucaccgcg

SEQ ID NO: 456977 - RNA, 15 nt, Brucella suis 1330
cuugaaccuccacgc

SEQ ID NO: 456978 - RNA, 15 nt, Brucella suis 1330
cuugaacaucagaag

SEQ ID NO: 456979 - RNA, 20 nt, Brucella suis 1330
cuucuugguuucuucggccc

SEQ ID NO: 456980 - RNA, 22 nt, Brucella suis 1330
cuucugguugcuauaagcaaca

SEQ ID NO: 456981 - RNA, 21 nt, Brucella suis 1330
cuucucuugccgccgcuucca

SEQ ID NO: 456982 - RNA, 12 nt, Brucella suis 1330
cuucucgaacug

SEQ ID NO: 456983 - RNA, 20 nt, Brucella suis 1330
cuucuccaaagggugcgagc

SEQ ID NO: 456984 - RNA, 16 nt, Brucella suis 1330
cuucgguaaagccgcg

SEQ ID NO: 456985 - RNA, 19 nt, Brucella suis 1330
cuucgcgccgccuucaaaa

SEQ ID NO: 456986 - RNA, 14 nt, Brucella suis 1330
cuucgagcaggcgg

SEQ ID NO: 456987 - RNA, 20 nt, Brucella suis 1330
cuucgacugaacauggaaaa

SEQ ID NO: 456988 - RNA, 19 nt, Brucella suis 1330
cuuccuguccgacauccau

SEQ ID NO: 456989 - RNA, 20 nt, Brucella suis 1330
cuuccugcgaaaaccugcuc

SEQ ID NO: 456990 - RNA, 22 nt, Brucella suis 1330
cuuccuaauggaugacgccugc

SEQ ID NO: 456991 - RNA, 13 nt, Brucella suis 1330
cuuccgggaauuc

SEQ ID NO: 456992 - RNA, 15 nt, Brucella suis 1330
cuuccgucagggccg

SEQ ID NO: 456993 - RNA, 17 nt, Brucella suis 1330
cuuccgucgcacgcuug

SEQ ID NO: 456994 - RNA, 17 nt, Brucella suis 1330
cuuccggcagaccggau

SEQ ID NO: 456995 - RNA, 15 nt, Brucella suis 1330
cuucccguaauuccc

SEQ ID NO: 456996 - RNA, 16 nt, Brucella suis 1330
cuucccgcgccucacc

SEQ ID NO: 456997 - RNA, 21 nt, Brucella suis 1330
cuucccgcgccucacccucca

SEQ ID NO: 456998 - RNA, 22 nt, Brucella suis 1330
cuucccggauugggucaacgcc

SEQ ID NO: 456999 - RNA, 12 nt, Brucella suis 1330
cuucccgcccgu

SEQ ID NO: 457000 - RNA, 18 nt, Brucella suis 1330
cuuccaguuucugaaugc

SEQ ID NO: 457001 - RNA, 23 nt, Brucella suis 1330
cuuccaguggaagcacauggcgg

SEQ ID NO: 457002 - RNA, 14 nt, Brucella suis 1330
cuuccaguuccuuc

SEQ ID NO: 457003 - RNA, 17 nt, Brucella suis 1330
cuuccaguuccuucuug

SEQ ID NO: 457004 - RNA, 16 nt, Brucella suis 1330
cuuccagagccucggc

SEQ ID NO: 457005 - RNA, 18 nt, Brucella suis 1330
cuucauugcgcuugccgc

SEQ ID NO: 457006 - RNA, 19 nt, Brucella suis 1330
cuucagucuggauuccuuc

SEQ ID NO: 457007 - RNA, 23 nt, Brucella suis 1330
cuucagggacgagcggcaggccg

SEQ ID NO: 457008 - RNA, 15 nt, Brucella suis 1330
cuucaggcccuugcc

SEQ ID NO: 457009 - RNA, 14 nt, Brucella suis 1330
cuucacccacgcca

SEQ ID NO: 457010 - RNA, 18 nt, Brucella suis 1330
cuucaagcgcaagcugug

SEQ ID NO: 457011 - RNA, 19 nt, Brucella suis 1330
cuuaugaucgccgcccuug

SEQ ID NO: 457012 - RNA, 23 nt, Brucella suis 1330
cuuagagaccuugaugauagaau

SEQ ID NO: 457013 - RNA, 17 nt, Brucella suis 1330
cuguuucgaggcccagg

SEQ ID NO: 457014 - RNA, 23 nt, Brucella suis 1330
cuguucgaugccauucacuugcg

SEQ ID NO: 457015 - RNA, 17 nt, Brucella suis 1330
cuggcccucgcggaaaa

SEQ ID NO: 457016 - RNA, 18 nt, Brucella suis 1330
cuguuaucccucaaaacg

SEQ ID NO: 457017 - RNA, 18 nt, Brucella suis 1330
cuuaaucccuuacuccau

SEQ ID NO: 457018 - RNA, 23 nt, Brucella suis 1330
cuggccaugaugccggucgcagg

SEQ ID NO: 457019 - RNA, 22 nt, Brucella suis 1330
cuggcauuauuccgccugcaac

SEQ ID NO: 457020 - RNA, 19 nt, Brucella suis 1330
cuggcauccagcacuucca

SEQ ID NO: 457021 - RNA, 15 nt, Brucella suis 1330
cugcuuaucaaggcc

SEQ ID NO: 457022 - RNA, 14 nt, Brucella suis 1330
cugcuuugcugggc

SEQ ID NO: 457023 - RNA, 15 nt, Brucella suis 1330
cuggaaaaaauccgc

SEQ ID NO: 457024 - RNA, 19 nt, Brucella suis 1330
cuggaauuucuaaaaugaa

SEQ ID NO: 457025 - RNA, 13 nt, Brucella suis 1330
cugcugcauccug

SEQ ID NO: 457026 - RNA, 17 nt, Brucella suis 1330
cugcucgaucuggccga

SEQ ID NO: 457027 - RNA, 23 nt, Brucella suis 1330
cugcuccugcgucgcauccagaa

SEQ ID NO: 457028 - RNA, 20 nt, Brucella suis 1330
cugcguuucggcggcuuucc

SEQ ID NO: 457029 - RNA, 16 nt, Brucella suis 1330
cugcggcggcgucagc

SEQ ID NO: 457030 - RNA, 22 nt, Brucella suis 1330
cugcgcgcaaaaucuuucgcuu

SEQ ID NO: 457031 - RNA, 13 nt, Brucella suis 1330
cugcgcgaaaucg

SEQ ID NO: 457032 - RNA, 15 nt, Brucella suis 1330
cugcgcccugucaga

SEQ ID NO: 457033 - RNA, 22 nt, Brucella suis 1330
cugccuuacugcccuauugccu

SEQ ID NO: 457034 - RNA, 18 nt, Brucella suis 1330
cugccgggguuucuuuug

SEQ ID NO: 457035 - RNA, 17 nt, Brucella suis 1330
cugccggugccggcagg

SEQ ID NO: 457036 - RNA, 13 nt, Brucella suis 1330
cugccgcagccag

SEQ ID NO: 457037 - RNA, 14 nt, Brucella suis 1330
cugccgcagccagg

SEQ ID NO: 457038 - RNA, 15 nt, Brucella suis 1330
cugccgcaacaagac

SEQ ID NO: 457039 - RNA, 13 nt, Brucella suis 1330
cugcccgccgcaa

SEQ ID NO: 457040 - RNA, 18 nt, Brucella suis 1330
cugcccgcacccuauucc

SEQ ID NO: 457041 - RNA, 14 nt, Brucella suis 1330
cugccauccgcccc

SEQ ID NO: 457042 - RNA, 17 nt, Brucella suis 1330
cugccauccgccccgau

SEQ ID NO: 457043 - RNA, 18 nt, Brucella suis 1330
cugccaugccgccaaggc

SEQ ID NO: 457044 - RNA, 15 nt, Brucella suis 1330
cugccaaccauugau

SEQ ID NO: 457045 - RNA, 18 nt, Brucella suis 1330
cugccaucaccagccccc

SEQ ID NO: 457046 - RNA, 21 nt, Brucella suis 1330
cugcaugugcggugagaagaa

SEQ ID NO: 457047 - RNA, 14 nt, Brucella suis 1330
cugcaucgggcgcu

SEQ ID NO: 457048 - RNA, 12 nt, Brucella suis 1330
cugcaucgagcg

SEQ ID NO: 457049 - RNA, 17 nt, Brucella suis 1330
cugcaucgagcggcacg

SEQ ID NO: 457050 - RNA, 19 nt, Brucella suis 1330
cugcaucgagcggcacgau

SEQ ID NO: 457051 - RNA, 20 nt, Brucella suis 1330
cugcaucauaggcccaggcc

SEQ ID NO: 457052 - RNA, 18 nt, Brucella suis 1330
cugcaucaugucauggcc

SEQ ID NO: 457053 - RNA, 15 nt, Brucella suis 1330
cugcacacccuugau

SEQ ID NO: 457054 - RNA, 16 nt, Brucella suis 1330
cugcaaucaccagaga

SEQ ID NO: 457055 - RNA, 17 nt, Brucella suis 1330
cugcaauccacaggaga

SEQ ID NO: 457056 - RNA, 16 nt, Brucella suis 1330
cugcaagcgcgacaag

SEQ ID NO: 457057 - RNA, 20 nt, Brucella suis 1330
cugcaacgcgccaaacugca

SEQ ID NO: 457058 - RNA, 20 nt, Brucella suis 1330
cugaucgcaagcaggcauug

SEQ ID NO: 457059 - RNA, 19 nt, Brucella suis 1330
cugaucgagauaagcgcca

SEQ ID NO: 457060 - RNA, 13 nt, Brucella suis 1330
cugauccugcuuc

SEQ ID NO: 457061 - RNA, 23 nt, Brucella suis 1330
cugauaagggcgcuuuucccaau

SEQ ID NO: 457062 - RNA, 16 nt, Brucella suis 1330
cugagaucgaugcgcu

SEQ ID NO: 457063 - RNA, 15 nt, Brucella suis 1330
cugacggaguugaac

SEQ ID NO: 457064 - RNA, 17 nt, Brucella suis 1330
cugaccuuccugaccca

SEQ ID NO: 457065 - RNA, 19 nt, Brucella suis 1330
cugacccauggccugcugc

SEQ ID NO: 457066 - RNA, 23 nt, Brucella suis 1330
cugaccagccuugcccuggcucu

SEQ ID NO: 457067 - RNA, 11 nt, Brucella suis 1330
cugaagcggcc

SEQ ID NO: 457068 - RNA, 17 nt, Brucella suis 1330
cugaagaagcuucacau

SEQ ID NO: 457069 - RNA, 20 nt, Brucella suis 1330
cugaacauggcugcaacacc

SEQ ID NO: 457070 - RNA, 14 nt, Brucella suis 1330
cugaaccacuuccg

SEQ ID NO: 457071 - RNA, 20 nt, Brucella suis 1330
cugaaacgggaccaagcccg

SEQ ID NO: 457072 - RNA, 21 nt, Brucella suis 1330
cugaaacgggaccaagcccgu

SEQ ID NO: 457073 - RNA, 18 nt, Brucella suis 1330
cugaaaaaggccgggaaa

SEQ ID NO: 457074 - RNA, 13 nt, Brucella suis 1330
cugaaaaggcuca

SEQ ID NO: 457075 - RNA, 13 nt, Brucella suis 1330
cucuucugcaucg

SEQ ID NO: 457076 - RNA, 19 nt, Brucella suis 1330
cucuucggggcggccuuuu

SEQ ID NO: 457077 - RNA, 14 nt, Brucella suis 1330
cucuuccggcgucu

SEQ ID NO: 457078 - RNA, 13 nt, Brucella suis 1330
cucugucagcuuu

SEQ ID NO: 457079 - RNA, 15 nt, Brucella suis 1330
cucuucauccggcag

SEQ ID NO: 457080 - RNA, 20 nt, Brucella suis 1330
cucucgucgagaagcaucag

SEQ ID NO: 457081 - RNA, 13 nt, Brucella suis 1330
cucuccucugccu

SEQ ID NO: 457082 - RNA, 15 nt, Brucella suis 1330
cucucacagccauca

SEQ ID NO: 457083 - RNA, 15 nt, Brucella suis 1330
cucuauuggaucagu

SEQ ID NO: 457084 - RNA, 21 nt, Brucella suis 1330
cucguccucgaucaaacccuc

SEQ ID NO: 457085 - RNA, 17 nt, Brucella suis 1330
cucguccuucgaggcuu

SEQ ID NO: 457086 - RNA, 16 nt, Brucella suis 1330
cucgucgagaagcauc

SEQ ID NO: 457087 - RNA, 21 nt, Brucella suis 1330
cucggccuggucuagccgcgc

SEQ ID NO: 457088 - RNA, 18 nt, Brucella suis 1330
cucggcccuggaaagaag

SEQ ID NO: 457089 - RNA, 19 nt, Brucella suis 1330
cucggcaaagggaauacca

SEQ ID NO: 457090 - RNA, 23 nt, Brucella suis 1330
cucggcaaagggaauaccaagcu

SEQ ID NO: 457091 - RNA, 13 nt, Brucella suis 1330
cucggcaagcucg

SEQ ID NO: 457092 - RNA, 22 nt, Brucella suis 1330
cucgaucuugcugaugagccgc

SEQ ID NO: 457093 - RNA, 17 nt, Brucella suis 1330
cucgaucacgaaagucu

SEQ ID NO: 457094 - RNA, 14 nt, Brucella suis 1330
cucgacgcuuucca

SEQ ID NO: 457095 - RNA, 23 nt, Brucella suis 1330
cucgacaguuggauagaccaccg

SEQ ID NO: 457096 - RNA, 18 nt, Brucella suis 1330
cucgaauuccaccgccuu

SEQ ID NO: 457097 - RNA, 17 nt, Brucella suis 1330
cucgacagcacugccac

SEQ ID NO: 457098 - RNA, 20 nt, Brucella suis 1330
cucgacagcacugccaccau

SEQ ID NO: 457099 - RNA, 16 nt, Brucella suis 1330
cuccugugcauugcca

SEQ ID NO: 457100 - RNA, 20 nt, Brucella suis 1330
cuccggaucugguacugcgu

SEQ ID NO: 457101 - RNA, 20 nt, Brucella suis 1330
cuccggcaaaacggcaggca

SEQ ID NO: 457102 - RNA, 22 nt, Brucella suis 1330
cuccggcaaaacggcaggcauu

SEQ ID NO: 457103 - RNA, 22 nt, Brucella suis 1330
cucccuguccugccagcggcag

SEQ ID NO: 457104 - RNA, 15 nt, Brucella suis 1330
cuccgcaccucagga

SEQ ID NO: 457105 - RNA, 17 nt, Brucella suis 1330
cuccgcaccucaggaug

SEQ ID NO: 457106 - RNA, 21 nt, Brucella suis 1330
cucccgaaagugggaaccggu

SEQ ID NO: 457107 - RNA, 19 nt, Brucella suis 1330
cucccgaaggauuuuccaa

SEQ ID NO: 457108 - RNA, 13 nt, Brucella suis 1330
cuccaguuccggc

SEQ ID NO: 457109 - RNA, 18 nt, Brucella suis 1330
cuccaucgcaaaggagga

SEQ ID NO: 457110 - RNA, 15 nt, Brucella suis 1330
cuccagcucauggcc

SEQ ID NO: 457111 - RNA, 21 nt, Brucella suis 1330
cucauggcuuccugcgucuug

SEQ ID NO: 457112 - RNA, 14 nt, Brucella suis 1330
cucaucgcgcugcu

SEQ ID NO: 457113 - RNA, 13 nt, Brucella suis 1330
cucauccuccacg

SEQ ID NO: 457114 - RNA, 22 nt, Brucella suis 1330
cucauccuccacgacgggagcc

SEQ ID NO: 457115 - RNA, 15 nt, Brucella suis 1330
cucaucgcaguugca

SEQ ID NO: 457116 - RNA, 14 nt, Brucella suis 1330
cucauccacaguca

SEQ ID NO: 457117 - RNA, 22 nt, Brucella suis 1330
cucauauauucaucguugcggc

SEQ ID NO: 457118 - RNA, 21 nt, Brucella suis 1330
cucauaguugaaaagggcaag

SEQ ID NO: 457119 - RNA, 21 nt, Brucella suis 1330
cucauauggaugccgccgcag

SEQ ID NO: 457120 - RNA, 13 nt, Brucella suis 1330
cucagagaaguga

SEQ ID NO: 457121 - RNA, 15 nt, Brucella suis 1330
cucaagauacaaaaa

SEQ ID NO: 457122 - RNA, 21 nt, Brucella suis 1330
cucaagauacaaaaaaucccg

SEQ ID NO: 457123 - RNA, 22 nt, Brucella suis 1330
cucaagugccgccuugcggaua

SEQ ID NO: 457124 - RNA, 14 nt, Brucella suis 1330
cucaccuuuuccac

SEQ ID NO: 457125 - RNA, 19 nt, Brucella suis 1330
cucacuccgaccauuuccc

SEQ ID NO: 457126 - RNA, 11 nt, Brucella suis 1330
cuagcggauga

SEQ ID NO: 457127 - RNA, 13 nt, Brucella suis 1330
cuacgcaaaaccg

SEQ ID NO: 457128 - RNA, 21 nt, Brucella suis 1330
cuaaaaagcgcgcgcaaaaga

SEQ ID NO: 457129 - RNA, 16 nt, Brucella suis 1330
cuaaagccgcuccauu

SEQ ID NO: 457130 - RNA, 19 nt, Brucella suis 1330
cuaaaugaagaagcgcggg

SEQ ID NO: 457131 - RNA, 20 nt, Brucella suis 1330
cuaaaugcaagcgucuucug

SEQ ID NO: 457132 - RNA, 17 nt, Brucella suis 1330
cguugcuuucggcggca

SEQ ID NO: 457133 - RNA, 12 nt, Brucella suis 1330
cguugcgcggcg

SEQ ID NO: 457134 - RNA, 18 nt, Brucella suis 1330
cguugccgaucagcaucg

SEQ ID NO: 457135 - RNA, 12 nt, Brucella suis 1330
cguuccagccgu

SEQ ID NO: 457136 - RNA, 19 nt, Brucella suis 1330
cgugucgauugccugugcg

SEQ ID NO: 457137 - RNA, 15 nt, Brucella suis 1330
cgugucuugcccaga

SEQ ID NO: 457138 - RNA, 21 nt, Brucella suis 1330
cguguagggcaaggagcgagc

SEQ ID NO: 457139 - RNA, 21 nt, Brucella suis 1330
cguggugagugcgaaagcacc

SEQ ID NO: 457140 - RNA, 18 nt, Brucella suis 1330
cguggucgccucuucauc

SEQ ID NO: 457141 - RNA, 21 nt, Brucella suis 1330
cguggcuugaagcugccgcgg

SEQ ID NO: 457142 - RNA, 18 nt, Brucella suis 1330
cguggcuuuuccggcggc

SEQ ID NO: 457143 - RNA, 12 nt, Brucella suis 1330
cguggcggggca

SEQ ID NO: 457144 - RNA, 15 nt, Brucella suis 1330
cguggagcaggccau

SEQ ID NO: 457145 - RNA, 15 nt, Brucella suis 1330
cgugcggugcuccca

SEQ ID NO: 457146 - RNA, 20 nt, Brucella suis 1330
cgugcgccugaggccggacg

SEQ ID NO: 457147 - RNA, 20 nt, Brucella suis 1330
cgugccaucggugccugacu

SEQ ID NO: 457148 - RNA, 21 nt, Brucella suis 1330
cgugccaucggugccugacug

SEQ ID NO: 457149 - RNA, 15 nt, Brucella suis 1330
cgugauauugcagac

SEQ ID NO: 457150 - RNA, 14 nt, Brucella suis 1330
cgugacgagcgcac

SEQ ID NO: 457151 - RNA, 14 nt, Brucella suis 1330
cgugacaucaagcc

SEQ ID NO: 457152 - RNA, 20 nt, Brucella suis 1330
cgugaccagccccugcacgu

SEQ ID NO: 457153 - RNA, 22 nt, Brucella suis 1330
cgucugccggagcgaccagcaa

SEQ ID NO: 457154 - RNA, 21 nt, Brucella suis 1330
cgucugauuggguuuggcccc

SEQ ID NO: 457155 - RNA, 14 nt, Brucella suis 1330
cgucgaggaaaaag

SEQ ID NO: 457156 - RNA, 17 nt, Brucella suis 1330
cgucgagcagcaucuug

SEQ ID NO: 457157 - RNA, 22 nt, Brucella suis 1330
cgucgaaauccuucagaagcac

SEQ ID NO: 457158 - RNA, 17 nt, Brucella suis 1330
cguccugugcggcugca

SEQ ID NO: 457159 - RNA, 15 nt, Brucella suis 1330
cguccggccagccga

SEQ ID NO: 457160 - RNA, 18 nt, Brucella suis 1330
cguccaugagcgcaccau

SEQ ID NO: 457161 - RNA, 20 nt, Brucella suis 1330
cguccagcgcguugccuugc

SEQ ID NO: 457162 - RNA, 14 nt, Brucella suis 1330
cgucagcgcgccgu

SEQ ID NO: 457163 - RNA, 20 nt, Brucella suis 1330
cgucagccgguucuuuuccu

SEQ ID NO: 457164 - RNA, 12 nt, Brucella suis 1330
cgucacggucag

SEQ ID NO: 457165 - RNA, 15 nt, Brucella suis 1330
cgucaaugcgcgccc

SEQ ID NO: 457166 - RNA, 13 nt, Brucella suis 1330
cgucacagauuca

SEQ ID NO: 457167 - RNA, 17 nt, Brucella suis 1330
cgucacagauucaaaac

SEQ ID NO: 457168 - RNA, 23 nt, Brucella suis 1330
cgucaaucacgccacugcccugg

SEQ ID NO: 457169 - RNA, 14 nt, Brucella suis 1330
cguagucuggugcu

SEQ ID NO: 457170 - RNA, 14 nt, Brucella suis 1330
cguaaagcgcgcca

SEQ ID NO: 457171 - RNA, 15 nt, Brucella suis 1330
cguaaagcagauggc

SEQ ID NO: 457172 - RNA, 15 nt, Brucella suis 1330
cgguuugcaagccgc

SEQ ID NO: 457173 - RNA, 13 nt, Brucella suis 1330
cgguuuuuccaaa

SEQ ID NO: 457174 - RNA, 22 nt, Brucella suis 1330
cgguugcgccgguguagagcug

SEQ ID NO: 457175 - RNA, 18 nt, Brucella suis 1330
cgguugcaggcgcaggcc

SEQ ID NO: 457176 - RNA, 17 nt, Brucella suis 1330
cgguugaggauuuccac

SEQ ID NO: 457177 - RNA, 16 nt, Brucella suis 1330
cgguuccuguuuuaac

SEQ ID NO: 457178 - RNA, 20 nt, Brucella suis 1330
cggugguuucccuugaagaa

SEQ ID NO: 457179 - RNA, 14 nt, Brucella suis 1330
cgguggacaugaac

SEQ ID NO: 457180 - RNA, 13 nt, Brucella suis 1330
cgguggcauugcc

SEQ ID NO: 457181 - RNA, 16 nt, Brucella suis 1330
cggugcgggcaagggc

SEQ ID NO: 457182 - RNA, 21 nt, Brucella suis 1330
cggugcgcccgcgauagguga

SEQ ID NO: 457183 - RNA, 18 nt, Brucella suis 1330
cggugccgcgcgguacgg

SEQ ID NO: 457184 - RNA, 23 nt, Brucella suis 1330
cggucucgugugaccuuggccac

SEQ ID NO: 457185 - RNA, 20 nt, Brucella suis 1330
cggucugucauuugcggcag

SEQ ID NO: 457186 - RNA, 23 nt, Brucella suis 1330
cggucuugccggccugaaacagc

SEQ ID NO: 457187 - RNA, 13 nt, Brucella suis 1330
cggucuugcgcuu

SEQ ID NO: 457188 - RNA, 13 nt, Brucella suis 1330
cggucgggaagcc

SEQ ID NO: 457189 - RNA, 17 nt, Brucella suis 1330
cggucgggaagcccagc

SEQ ID NO: 457190 - RNA, 13 nt, Brucella suis 1330
cggucgcuugccu

SEQ ID NO: 457191 - RNA, 16 nt, Brucella suis 1330
cggucgccgcccgguu

SEQ ID NO: 457192 - RNA, 16 nt, Brucella suis 1330
cggucgagugcggcca

SEQ ID NO: 457193 - RNA, 11 nt, Brucella suis 1330
cgguccgccgg

SEQ ID NO: 457194 - RNA, 13 nt, Brucella suis 1330
cgguccccgccgc

SEQ ID NO: 457195 - RNA, 17 nt, Brucella suis 1330
cggucaguucgucggcc

SEQ ID NO: 457196 - RNA, 20 nt, Brucella suis 1330
cggucaggcuuuccgacagg

SEQ ID NO: 457197 - RNA, 16 nt, Brucella suis 1330
cggucacgcuccgcca

SEQ ID NO: 457198 - RNA, 21 nt, Brucella suis 1330
cgguauucuugcgaaccauca

SEQ ID NO: 457199 - RNA, 18 nt, Brucella suis 1330
cgguagcgcauggcagca

SEQ ID NO: 457200 - RNA, 18 nt, Brucella suis 1330
cgguacgccauagacgcc

SEQ ID NO: 457201 - RNA, 24 nt, Brucella suis 1330
cgguaagcccugucagcgccgccc

SEQ ID NO: 457202 - RNA, 18 nt, Brucella suis 1330
cgguaagcgaccaccacc

SEQ ID NO: 457203 - RNA, 22 nt, Brucella suis 1330
cgguaauaacgacgcccgcccc

SEQ ID NO: 457204 - RNA, 18 nt, Brucella suis 1330
cggguugacgaucaccug

SEQ ID NO: 457205 - RNA, 20 nt, Brucella suis 1330
cggguugcaccgcucucggc

SEQ ID NO: 457206 - RNA, 15 nt, Brucella suis 1330
cggguuuuggcauca

SEQ ID NO: 457207 - RNA, 21 nt, Brucella suis 1330
cggguguuugcgacgggcgag

SEQ ID NO: 457208 - RNA, 18 nt, Brucella suis 1330
cgggugaacuggcaagug

SEQ ID NO: 457209 - RNA, 19 nt, Brucella suis 1330
cgggucuucgcccggcaug

SEQ ID NO: 457210 - RNA, 15 nt, Brucella suis 1330
cgggguuucuucauu

SEQ ID NO: 457211 - RNA, 16 nt, Brucella suis 1330
cgggguguacaacaac

SEQ ID NO: 457212 - RNA, 18 nt, Brucella suis 1330
cggggcuguagcgcgcac

SEQ ID NO: 457213 - RNA, 15 nt, Brucella suis 1330
cggggcuuccacagc

SEQ ID NO: 457214 - RNA, 16 nt, Brucella suis 1330
cggggcguccgccacc

SEQ ID NO: 457215 - RNA, 13 nt, Brucella suis 1330
cggggcggacggg

SEQ ID NO: 457216 - RNA, 18 nt, Brucella suis 1330
cggggcgacgcugcaaca

SEQ ID NO: 457217 - RNA, 20 nt, Brucella suis 1330
cggggcaggggugcaaagcu

SEQ ID NO: 457218 - RNA, 16 nt, Brucella suis 1330
cggggaaaucagucca

SEQ ID NO: 457219 - RNA, 23 nt, Brucella suis 1330
cgggcuuugccgcauaaagcaca

SEQ ID NO: 457220 - RNA, 16 nt, Brucella suis 1330
cgggcgcuccagccgg

SEQ ID NO: 457221 - RNA, 13 nt, Brucella suis 1330
cgggccugugcuu

SEQ ID NO: 457222 - RNA, 13 nt, Brucella suis 1330
cgggccuuuuuca

SEQ ID NO: 457223 - RNA, 20 nt, Brucella suis 1330
cgggccgguggaauagccgg

SEQ ID NO: 457224 - RNA, 22 nt, Brucella suis 1330
cgggcccuucgcuuucaauggc

SEQ ID NO: 457225 - RNA, 21 nt, Brucella suis 1330
cgggcccuucucgacagccau

SEQ ID NO: 457226 - RNA, 19 nt, Brucella suis 1330
cgggccagguaucgugcag

SEQ ID NO: 457227 - RNA, 20 nt, Brucella suis 1330
cgggcaugaaaacgccgcgg

SEQ ID NO: 457228 - RNA, 22 nt, Brucella suis 1330
cgggcacgaaaagcaggaucag

SEQ ID NO: 457229 - RNA, 17 nt, Brucella suis 1330
cgggcaaaggcgauggc

SEQ ID NO: 457230 - RNA, 22 nt, Brucella suis 1330
cgggaucagaaaucaguccagu

SEQ ID NO: 457231 - RNA, 13 nt, Brucella suis 1330
cgggagggaugcu

SEQ ID NO: 457232 - RNA, 14 nt, Brucella suis 1330
cgggauaagagacc

SEQ ID NO: 457233 - RNA, 20 nt, Brucella suis 1330
cgggagauguguaggcuggc

SEQ ID NO: 457234 - RNA, 14 nt, Brucella suis 1330
cgggaaauuucagc

SEQ ID NO: 457235 - RNA, 15 nt, Brucella suis 1330
cggcuuuuuauccuc

SEQ ID NO: 457236 - RNA, 17 nt, Brucella suis 1330
cggcuuuuuauccuccc

SEQ ID NO: 457237 - RNA, 15 nt, Brucella suis 1330
cggcuuucgccgccc

SEQ ID NO: 457238 - RNA, 14 nt, Brucella suis 1330
cggcuugccaccac

SEQ ID NO: 457239 - RNA, 24 nt, Brucella suis 1330
cggcuugccagaugugccaccagc

SEQ ID NO: 457240 - RNA, 22 nt, Brucella suis 1330
cggcuuccagauugucuugauc

SEQ ID NO: 457241 - RNA, 15 nt, Brucella suis 1330
cggcuuccagcgccu

SEQ ID NO: 457242 - RNA, 19 nt, Brucella suis 1330
cggcuucagaucgcgcggc

SEQ ID NO: 457243 - RNA, 15 nt, Brucella suis 1330
cggcuguuacauaug

SEQ ID NO: 457244 - RNA, 17 nt, Brucella suis 1330
cggcugguuggccagau

SEQ ID NO: 457245 - RNA, 14 nt, Brucella suis 1330
cggcugggccuugu

SEQ ID NO: 457246 - RNA, 22 nt, Brucella suis 1330
cggcuggaacgagcuccccggc

SEQ ID NO: 457247 - RNA, 13 nt, Brucella suis 1330
cggcugcggcgcc

SEQ ID NO: 457248 - RNA, 17 nt, Brucella suis 1330
cggcugccgcaauccug

SEQ ID NO: 457249 - RNA, 13 nt, Brucella suis 1330
cggcugcaacaaa

SEQ ID NO: 457250 - RNA, 20 nt, Brucella suis 1330
cggcugcaacaaaagaagau

SEQ ID NO: 457251 - RNA, 20 nt, Brucella suis 1330
cggcugaucuggaaggaaag

SEQ ID NO: 457252 - RNA, 15 nt, Brucella suis 1330
cggcucucacgcgca

SEQ ID NO: 457253 - RNA, 18 nt, Brucella suis 1330
cggcucucacgcgcagca

SEQ ID NO: 457254 - RNA, 17 nt, Brucella suis 1330
cggcucgcucgacugga

SEQ ID NO: 457255 - RNA, 19 nt, Brucella suis 1330
cggcucgccgaguggcccg

SEQ ID NO: 457256 - RNA, 16 nt, Brucella suis 1330
cggcucaucgcgcugc

SEQ ID NO: 457257 - RNA, 17 nt, Brucella suis 1330
cggcgucugccggagcg

SEQ ID NO: 457258 - RNA, 17 nt, Brucella suis 1330
cggcguccauugccggu

SEQ ID NO: 457259 - RNA, 19 nt, Brucella suis 1330
cggcgucagcuugaccaga

SEQ ID NO: 457260 - RNA, 18 nt, Brucella suis 1330
cggcgucagggcauugcc

SEQ ID NO: 457261 - RNA, 12 nt, Brucella suis 1330
aaaaaaaucucg

SEQ ID NO: 457262 - RNA, 10 nt, Brucella suis 1330
aaaaaacacc

SEQ ID NO: 457263 - RNA, 18 nt, Brucella suis 1330
aaaaaagcgcggagcaac

SEQ ID NO: 457264 - RNA, 22 nt, Brucella suis 1330
aaaaaaggaugaugaccugacu

SEQ ID NO: 457265 - RNA, 20 nt, Brucella suis 1330
aaaaaauaccaguguugcga

SEQ ID NO: 457266 - RNA, 11 nt, Brucella suis 1330
aaaaaaucacc

SEQ ID NO: 457267 - RNA, 12 nt, Brucella suis 1330
aaaaaauaccag

SEQ ID NO: 457268 - RNA, 21 nt, Brucella suis 1330
aaaaaaucucgguuaucauuu

SEQ ID NO: 457269 - RNA, 17 nt, Brucella suis 1330
aaaaauaaagaaauagc

SEQ ID NO: 457270 - RNA, 16 nt, Brucella suis 1330
aaaaauaccaguguug

SEQ ID NO: 457271 - RNA, 19 nt, Brucella suis 1330
aaaaaucccggaauuugca

SEQ ID NO: 457272 - RNA, 17 nt, Brucella suis 1330
aaaacauuaaccaauca

SEQ ID NO: 457273 - RNA, 20 nt, Brucella suis 1330
aaaacggcccaugagcuuca

SEQ ID NO: 457274 - RNA, 17 nt, Brucella suis 1330
aaaacggcugcaacaaa

SEQ ID NO: 457275 - RNA, 21 nt, Brucella suis 1330
aaaacggcugcaacaaaagaa

SEQ ID NO: 457276 - RNA, 23 nt, Brucella suis 1330
aaaacggcugcaacaaaagaaga

SEQ ID NO: 457277 - RNA, 21 nt, Brucella suis 1330
aaaagcccgccacgaggaaga

SEQ ID NO: 457278 - RNA, 17 nt, Brucella suis 1330
aaaaguggaaccgcucu

SEQ ID NO: 457279 - RNA, 12 nt, Brucella suis 1330
aaaaucgacagg

SEQ ID NO: 457280 - RNA, 18 nt, Brucella suis 1330
aaaaucgagggguuuuuc

SEQ ID NO: 457281 - RNA, 16 nt, Brucella suis 1330
aaacaaaagauuagag

SEQ ID NO: 457282 - RNA, 20 nt, Brucella suis 1330
aaaugccggcgaucuuuucg

SEQ ID NO: 457283 - RNA, 14 nt, Brucella suis 1330
aaaugcgcgcggca

SEQ ID NO: 457284 - RNA, 20 nt, Brucella suis 1330
aaaugcuccuuccugcggca

SEQ ID NO: 457285 - RNA, 19 nt, Brucella suis 1330
aaauggaaaaacccggccu

SEQ ID NO: 457286 - RNA, 22 nt, Brucella suis 1330
aaaaagcggcgucagcagguug

SEQ ID NO: 457287 - RNA, 14 nt, Brucella suis 1330
aaaaagcgcgcgca

SEQ ID NO: 457288 - RNA, 19 nt, Brucella suis 1330
aaauaauagucgaaaaaag

SEQ ID NO: 457289 - RNA, 17 nt, Brucella suis 1330
aaaucaaccucgcggca

SEQ ID NO: 457290 - RNA, 14 nt, Brucella suis 1330
aaaucaguccacug

SEQ ID NO: 457291 - RNA, 19 nt, Brucella suis 1330
aaaucaguccacuggacug

SEQ ID NO: 457292 - RNA, 20 nt, Brucella suis 1330
aaaucaguccacuggacuga

SEQ ID NO: 457293 - RNA, 13 nt, Brucella suis 1330
aaagggaauacca

SEQ ID NO: 457294 - RNA, 18 nt, Brucella suis 1330
aaaggccuccguaacaau

SEQ ID NO: 457295 - RNA, 19 nt, Brucella suis 1330
aaagggccgccuugcuuga

SEQ ID NO: 457296 - RNA, 17 nt, Brucella suis 1330
aaagccccgcucaucug

SEQ ID NO: 457297 - RNA, 15 nt, Brucella suis 1330
aaagcccagccguuu

SEQ ID NO: 457298 - RNA, 13 nt, Brucella suis 1330
aaagcccggauga

SEQ ID NO: 457299 - RNA, 20 nt, Brucella suis 1330
aaagccgagcugcaagggaa

SEQ ID NO: 457300 - RNA, 12 nt, Brucella suis 1330
aaagcuggauga

SEQ ID NO: 457301 - RNA, 23 nt, Brucella suis 1330
aaagcuggcauccagcacuucca

SEQ ID NO: 457302 - RNA, 20 nt, Brucella suis 1330
aaaggcaaagccgaaugcca

SEQ ID NO: 457303 - RNA, 17 nt, Brucella suis 1330
aaagaguuggcccgcgu

SEQ ID NO: 457304 - RNA, 15 nt, Brucella suis 1330
aaagaguuguagcgg

SEQ ID NO: 457305 - RNA, 16 nt, Brucella suis 1330
aaagaucagccagccg

SEQ ID NO: 457306 - RNA, 16 nt, Brucella suis 1330
aaagccacaacgcugu

SEQ ID NO: 457307 - RNA, 20 nt, Brucella suis 1330
aaagccacaacgcugucugu

SEQ ID NO: 457308 - RNA, 19 nt, Brucella suis 1330
aaagccagaaccaccagag

SEQ ID NO: 457309 - RNA, 23 nt, Brucella suis 1330
aaagccauacgacaauaaucuca

SEQ ID NO: 457310 - RNA, 16 nt, Brucella suis 1330
aaacucaucaaaagcu

SEQ ID NO: 457311 - RNA, 19 nt, Brucella suis 1330
aaacucgucggguuuuggc

SEQ ID NO: 457312 - RNA, 14 nt, Brucella suis 1330
aaacggcugcaaca

SEQ ID NO: 457313 - RNA, 19 nt, Brucella suis 1330
aaacggcugcaacaaaaga

SEQ ID NO: 457314 - RNA, 22 nt, Brucella suis 1330
aaacgcuuuccggcaaaaaacu

SEQ ID NO: 457315 - RNA, 17 nt, Brucella suis 1330
aaacggaaacguugaaa

SEQ ID NO: 457316 - RNA, 13 nt, Brucella suis 1330
aaacggccaagca

SEQ ID NO: 457317 - RNA, 22 nt, Brucella suis 1330
aaacgguuuucggaaaagaugc

SEQ ID NO: 457318 - RNA, 12 nt, Brucella suis 1330
aaacaagcuuua

SEQ ID NO: 457319 - RNA, 22 nt, Brucella suis 1330
aaacgaacgccugauugaucgu

SEQ ID NO: 457320 - RNA, 13 nt, Brucella suis 1330
aaacgccaccuuu

SEQ ID NO: 457321 - RNA, 20 nt, Brucella suis 1330
aaacgccccgccaaaaagca

SEQ ID NO: 457322 - RNA, 16 nt, Brucella suis 1330
aaaauaguccaguagc

SEQ ID NO: 457323 - RNA, 14 nt, Brucella suis 1330
cacggcgcaggcag

SEQ ID NO: 457324 - RNA, 21 nt, Brucella suis 1330
cacggcgaaugacuucaucgc

SEQ ID NO: 457325 - RNA, 22 nt, Brucella suis 1330
cacggcagaguggacgguugcu

SEQ ID NO: 457326 - RNA, 14 nt, Brucella suis 1330
cacgcuccgccacu

SEQ ID NO: 457327 - RNA, 18 nt, Brucella suis 1330
cacggauagaaccaccgc

SEQ ID NO: 457328 - RNA, 15 nt, Brucella suis 1330
cacgcgcuccagcuc

SEQ ID NO: 457329 - RNA, 14 nt, Brucella suis 1330
cacgcgcagcagca

SEQ ID NO: 457330 - RNA, 15 nt, Brucella suis 1330
cacgcgccgccaucu

SEQ ID NO: 457331 - RNA, 12 nt, Brucella suis 1330
cacgccgccaua

SEQ ID NO: 457332 - RNA, 22 nt, Brucella suis 1330
cacgcccuuggcgagaauugca

SEQ ID NO: 457333 - RNA, 19 nt, Brucella suis 1330
cacgauggccgaaccgucc

SEQ ID NO: 457334 - RNA, 23 nt, Brucella suis 1330
cacgauuuccgcgacaucaucaa

SEQ ID NO: 457335 - RNA, 18 nt, Brucella suis 1330
cacgaugcgcagccgcgu

SEQ ID NO: 457336 - RNA, 14 nt, Brucella suis 1330
cacgauggaaggaa

SEQ ID NO: 457337 - RNA, 13 nt, Brucella suis 1330
cacgaugagaaug

SEQ ID NO: 457338 - RNA, 16 nt, Brucella suis 1330
caccuucaugaaacag

SEQ ID NO: 457339 - RNA, 15 nt, Brucella suis 1330
cacgaacagcagcag

SEQ ID NO: 457340 - RNA, 23 nt, Brucella suis 1330
cacgaaccguguucgcacaagaa

SEQ ID NO: 457341 - RNA, 15 nt, Brucella suis 1330
cacgaacgacaccuu

SEQ ID NO: 457342 - RNA, 19 nt, Brucella suis 1330
caccgcucgcccuccggac

SEQ ID NO: 457343 - RNA, 19 nt, Brucella suis 1330
caccgcgugaagaauggca

SEQ ID NO: 457344 - RNA, 22 nt, Brucella suis 1330
caccgcgugaagaauggcaagc

SEQ ID NO: 457345 - RNA, 20 nt, Brucella suis 1330
caccgcgaaagcacccgcuu

SEQ ID NO: 457346 - RNA, 19 nt, Brucella suis 1330
caccgcgaaagccagaacc

SEQ ID NO: 457347 - RNA, 21 nt, Brucella suis 1330
cacccuuggcgacggccagcg

SEQ ID NO: 457348 - RNA, 17 nt, Brucella suis 1330
cacccuucaacagcccg

SEQ ID NO: 457349 - RNA, 12 nt, Brucella suis 1330
caccccgcgcuu

SEQ ID NO: 457350 - RNA, 17 nt, Brucella suis 1330
caccccaugagaaggca

SEQ ID NO: 457351 - RNA, 17 nt, Brucella suis 1330
caccagcggcacgccgc

SEQ ID NO: 457352 - RNA, 19 nt, Brucella suis 1330
caccagcggcacgccgccc

SEQ ID NO: 457353 - RNA, 22 nt, Brucella suis 1330
caccagcgcgccgaucacgacc

SEQ ID NO: 457354 - RNA, 12 nt, Brucella suis 1330
caccagagacag

SEQ ID NO: 457355 - RNA, 22 nt, Brucella suis 1330
caccacgauuucgcccacgccc

SEQ ID NO: 457356 - RNA, 17 nt, Brucella suis 1330
caccacgaccuggguug

SEQ ID NO: 457357 - RNA, 16 nt, Brucella suis 1330
caccacaugcuccagg

SEQ ID NO: 457358 - RNA, 20 nt, Brucella suis 1330
cacaucgccuugcagauaaa

SEQ ID NO: 457359 - RNA, 18 nt, Brucella suis 1330
cacauccguuacacgccc

SEQ ID NO: 457360 - RNA, 21 nt, Brucella suis 1330
cacauccguuacacgccccuc

SEQ ID NO: 457361 - RNA, 16 nt, Brucella suis 1330
cacauagccugcaagc

SEQ ID NO: 457362 - RNA, 22 nt, Brucella suis 1330
cacauagccugcaagcgcgaca

SEQ ID NO: 457363 - RNA, 11 nt, Brucella suis 1330
cacagccccuu

SEQ ID NO: 457364 - RNA, 13 nt, Brucella suis 1330
cacacgaacagca

SEQ ID NO: 457365 - RNA, 15 nt, Brucella suis 1330
cacacgaacagcagc

SEQ ID NO: 457366 - RNA, 13 nt, Brucella suis 1330
cacaagcgccggu

SEQ ID NO: 457367 - RNA, 21 nt, Brucella suis 1330
cacaacugcggguaugcgcau

SEQ ID NO: 457368 - RNA, 13 nt, Brucella suis 1330
caauugcgcgccu

SEQ ID NO: 457369 - RNA, 17 nt, Brucella suis 1330
caaugugaaugaaaaaa

SEQ ID NO: 457370 - RNA, 13 nt, Brucella suis 1330
caauucccuggcu

SEQ ID NO: 457371 - RNA, 14 nt, Brucella suis 1330
caauuccugcgcca

SEQ ID NO: 457372 - RNA, 16 nt, Brucella suis 1330
caaugcucgauggucc

SEQ ID NO: 457373 - RNA, 15 nt, Brucella suis 1330
caauggagcaggaag

SEQ ID NO: 457374 - RNA, 22 nt, Brucella suis 1330
caauggcgggccauuuccaaug

SEQ ID NO: 457375 - RNA, 23 nt, Brucella suis 1330
caauggcgggccauuuccaaugc

SEQ ID NO: 457376 - RNA, 13 nt, Brucella suis 1330
caauggcugucaa

SEQ ID NO: 457377 - RNA, 11 nt, Brucella suis 1330
caauccccuca

SEQ ID NO: 457378 - RNA, 17 nt, Brucella suis 1330
caauccccucaccuugc

SEQ ID NO: 457379 - RNA, 18 nt, Brucella suis 1330
caauccccucaccuugcc

SEQ ID NO: 457380 - RNA, 11 nt, Brucella suis 1330
caauccuuucc

SEQ ID NO: 457381 - RNA, 16 nt, Brucella suis 1330
caaucguguccacaug

SEQ ID NO: 457382 - RNA, 23 nt, Brucella suis 1330
caaucgugccgccgugaaaauaa

SEQ ID NO: 457383 - RNA, 18 nt, Brucella suis 1330
caaucucacacugcaaaa

SEQ ID NO: 457384 - RNA, 17 nt, Brucella suis 1330
caaucugcgcugcccuc

SEQ ID NO: 457385 - RNA, 19 nt, Brucella suis 1330
caauccaggucagcggcgg

SEQ ID NO: 457386 - RNA, 15 nt, Brucella suis 1330
caauaucgcgccggg

SEQ ID NO: 457387 - RNA, 19 nt, Brucella suis 1330
caaucaccagagacagugg

SEQ ID NO: 457388 - RNA, 23 nt, Brucella suis 1330
caaucacgccacugcccuggaua

SEQ ID NO: 457389 - RNA, 16 nt, Brucella suis 1330
caaucacggcaaucag

SEQ ID NO: 457390 - RNA, 20 nt, Brucella suis 1330
caaucacggcaaucagcacg

SEQ ID NO: 457391 - RNA, 16 nt, Brucella suis 1330
caagugaagcgaagaa

SEQ ID NO: 457392 - RNA, 14 nt, Brucella suis 1330
caaguggcuuuuca

SEQ ID NO: 457393 - RNA, 19 nt, Brucella suis 1330
caagugugaaagcacaaag

SEQ ID NO: 457394 - RNA, 20 nt, Brucella suis 1330
caagugugaaagcacaaaga

SEQ ID NO: 457395 - RNA, 17 nt, Brucella suis 1330
caagugugcgcgcgcca

SEQ ID NO: 457396 - RNA, 19 nt, Brucella suis 1330
caaggaugugagcgaauau

SEQ ID NO: 457397 - RNA, 14 nt, Brucella suis 1330
caaggaugcugcca

SEQ ID NO: 457398 - RNA, 13 nt, Brucella suis 1330
caagcuggaaggc

SEQ ID NO: 457399 - RNA, 18 nt, Brucella suis 1330
caagcuggaaggccaggc

SEQ ID NO: 457400 - RNA, 17 nt, Brucella suis 1330
caagcugcgucguggca

SEQ ID NO: 457401 - RNA, 21 nt, Brucella suis 1330
caaguucaugccugucaaaac

SEQ ID NO: 457402 - RNA, 13 nt, Brucella suis 1330
caauaaaaggcaa

SEQ ID NO: 457403 - RNA, 15 nt, Brucella suis 1330
caauacaccugcauc

SEQ ID NO: 457404 - RNA, 21 nt, Brucella suis 1330
caagccgcggcgcgaccugcu

SEQ ID NO: 457405 - RNA, 19 nt, Brucella suis 1330
caagcccuuccacugcaag

SEQ ID NO: 457406 - RNA, 14 nt, Brucella suis 1330
caagaucagccaca

SEQ ID NO: 457407 - RNA, 18 nt, Brucella suis 1330
caagaucggacgggcaga

SEQ ID NO: 457408 - RNA, 14 nt, Brucella suis 1330
caagauacaaaaaa

SEQ ID NO: 457409 - RNA, 18 nt, Brucella suis 1330
caagauacaaaaaauccc

SEQ ID NO: 457410 - RNA, 22 nt, Brucella suis 1330
caagauagccccagcccgcccc

SEQ ID NO: 457411 - RNA, 15 nt, Brucella suis 1330
caagauagcccggca

SEQ ID NO: 457412 - RNA, 19 nt, Brucella suis 1330
caagaauaggagccggcca

SEQ ID NO: 457413 - RNA, 22 nt, Brucella suis 1330
caacgcuugaaccgagggaggc

SEQ ID NO: 457414 - RNA, 15 nt, Brucella suis 1330
caacgcugcaacaaa

SEQ ID NO: 457415 - RNA, 16 nt, Brucella suis 1330
caaccggcucgcucga

SEQ ID NO: 457416 - RNA, 21 nt, Brucella suis 1330
caaccauauuggcggcaagcu

SEQ ID NO: 457417 - RNA, 22 nt, Brucella suis 1330
caaccaucuucuggaaguccuc

SEQ ID NO: 457418 - RNA, 17 nt, Brucella suis 1330
caaccagcgacagggua

SEQ ID NO: 457419 - RNA, 17 nt, Brucella suis 1330
caacaucgccugaggca

SEQ ID NO: 457420 - RNA, 14 nt, Brucella suis 1330
caacaaaugcaaau

SEQ ID NO: 457421 - RNA, 12 nt, Brucella suis 1330
caacaaaagaag

SEQ ID NO: 457422 - RNA, 13 nt, Brucella suis 1330
caaaucagcuugg

SEQ ID NO: 457423 - RNA, 21 nt, Brucella suis 1330
caaagggaauaccaagcucgu

SEQ ID NO: 457424 - RNA, 15 nt, Brucella suis 1330
caaauaucggauucu

SEQ ID NO: 457425 - RNA, 19 nt, Brucella suis 1330
caaauucauugaaauauuc

SEQ ID NO: 457426 - RNA, 21 nt, Brucella suis 1330
caaauucucgucacacaccaa

SEQ ID NO: 457427 - RNA, 15 nt, Brucella suis 1330
caaagcggaucagcg

SEQ ID NO: 457428 - RNA, 18 nt, Brucella suis 1330
caaaggagcauggcucug

SEQ ID NO: 457429 - RNA, 14 nt, Brucella suis 1330
caaagcgcgcgcca

SEQ ID NO: 457430 - RNA, 14 nt, Brucella suis 1330
caaagaucaaaggu

SEQ ID NO: 457431 - RNA, 15 nt, Brucella suis 1330
caaagaccagcagga

SEQ ID NO: 457432 - RNA, 16 nt, Brucella suis 1330
caaacgaauuuggugc

SEQ ID NO: 457433 - RNA, 22 nt, Brucella suis 1330
caaaagucguccugugcggcug

SEQ ID NO: 457434 - RNA, 20 nt, Brucella suis 1330
caaaagcugccgcaacaaga

SEQ ID NO: 457435 - RNA, 21 nt, Brucella suis 1330
caaaacggcaggcauucagaa

SEQ ID NO: 457436 - RNA, 21 nt, Brucella suis 1330
caaaacggcccaugagcuuca

SEQ ID NO: 457437 - RNA, 22 nt, Brucella suis 1330
caaaacugaucguugaaggcgu

SEQ ID NO: 457438 - RNA, 20 nt, Brucella suis 1330
caaaagaacggggaucagaa

SEQ ID NO: 457439 - RNA, 24 nt, Brucella suis 1330
caaaagaacggggaucagaagugc

SEQ ID NO: 457440 - RNA, 21 nt, Brucella suis 1330
auuuucgccagacgcgguuca

SEQ ID NO: 457441 - RNA, 15 nt, Brucella suis 1330
auuuucguugcuucc

SEQ ID NO: 457442 - RNA, 15 nt, Brucella suis 1330
auuuuugaaaacauc

SEQ ID NO: 457443 - RNA, 21 nt, Brucella suis 1330
auuugaggauugccgccgcac

SEQ ID NO: 457444 - RNA, 14 nt, Brucella suis 1330
auuugaaaagcccc

SEQ ID NO: 457445 - RNA, 16 nt, Brucella suis 1330
auuugaacaaagauga

SEQ ID NO: 457446 - RNA, 23 nt, Brucella suis 1330
auuucgguuuucgugccgcaacg

SEQ ID NO: 457447 - RNA, 18 nt, Brucella suis 1330
auuuccgcgacaucauca

SEQ ID NO: 457448 - RNA, 22 nt, Brucella suis 1330
auuuccgcgacaucaucaagga

SEQ ID NO: 457449 - RNA, 23 nt, Brucella suis 1330
auuucacccgccagaugaucaua

SEQ ID NO: 457450 - RNA, 15 nt, Brucella suis 1330
auuuccaucgcuuga

SEQ ID NO: 457451 - RNA, 22 nt, Brucella suis 1330
auuuccaucgcuugaaccucca

SEQ ID NO: 457452 - RNA, 14 nt, Brucella suis 1330
aaaaguccuuuccg

SEQ ID NO: 457453 - RNA, 13 nt, Brucella suis 1330
auugggcagcaga

SEQ ID NO: 457454 - RNA, 20 nt, Brucella suis 1330
auuggugccgaaugugguga

SEQ ID NO: 457455 - RNA, 13 nt, Brucella suis 1330
auugcgggcauga

SEQ ID NO: 457456 - RNA, 13 nt, Brucella suis 1330
auugcuaaaugca

SEQ ID NO: 457457 - RNA, 15 nt, Brucella suis 1330
auugcuaaaugcaag

SEQ ID NO: 457458 - RNA, 13 nt, Brucella suis 1330
auugcgcuugccg

SEQ ID NO: 457459 - RNA, 22 nt, Brucella suis 1330
auugccugugccaaugacaugg

SEQ ID NO: 457460 - RNA, 18 nt, Brucella suis 1330
auugccuuaaucccuuac

SEQ ID NO: 457461 - RNA, 10 nt, Brucella suis 1330
auugcccgga

SEQ ID NO: 457462 - RNA, 21 nt, Brucella suis 1330
auugccgcauaggcuuucagc

SEQ ID NO: 457463 - RNA, 12 nt, Brucella suis 1330
auugcccauugc

SEQ ID NO: 457464 - RNA, 13 nt, Brucella suis 1330
auugcccgcccgu

SEQ ID NO: 457465 - RNA, 19 nt, Brucella suis 1330
auugcaggucuuucugcuu

SEQ ID NO: 457466 - RNA, 20 nt, Brucella suis 1330
auugcagacacgcuuuuucg

SEQ ID NO: 457467 - RNA, 23 nt, Brucella suis 1330
auugcacagcggucgaaaccuug

SEQ ID NO: 457468 - RNA, 16 nt, Brucella suis 1330
auugaugauaggcugc

SEQ ID NO: 457469 - RNA, 16 nt, Brucella suis 1330
auucuuccagaaugcg

SEQ ID NO: 457470 - RNA, 16 nt, Brucella suis 1330
auucugaaugacgacc

SEQ ID NO: 457471 - RNA, 15 nt, Brucella suis 1330
auucgucagcucgaa

SEQ ID NO: 457472 - RNA, 18 nt, Brucella suis 1330
auucuaucgccuggcauu

SEQ ID NO: 457473 - RNA, 18 nt, Brucella suis 1330
auucuccuauugccagac

SEQ ID NO: 457474 - RNA, 22 nt, Brucella suis 1330
auucucgcccaaggucggcuca

SEQ ID NO: 457475 - RNA, 21 nt, Brucella suis 1330
auucccgaagacgaucuuuuc

SEQ ID NO: 457476 - RNA, 13 nt, Brucella suis 1330
auucccgcagcau

SEQ ID NO: 457477 - RNA, 18 nt, Brucella suis 1330
auuccaucagccgggcag

SEQ ID NO: 457478 - RNA, 18 nt, Brucella suis 1330
aaaaggaugaaugccgaa

SEQ ID NO: 457479 - RNA, 16 nt, Brucella suis 1330
auguuccugcggaaug

SEQ ID NO: 457480 - RNA, 19 nt, Brucella suis 1330
auguucggcaaggccgcgc

SEQ ID NO: 457481 - RNA, 22 nt, Brucella suis 1330
augugccaccagcacacagcca

SEQ ID NO: 457482 - RNA, 22 nt, Brucella suis 1330
augugcgggcuucuuccaguuc

SEQ ID NO: 457483 - RNA, 16 nt, Brucella suis 1330
augugcggugagaaga

SEQ ID NO: 457484 - RNA, 17 nt, Brucella suis 1330
augucuagagcauuuuu

SEQ ID NO: 457485 - RNA, 20 nt, Brucella suis 1330
aaaagcccgccacgaggaag

SEQ ID NO: 457486 - RNA, 23 nt, Brucella suis 1330
aaaagcccgccacgaggaagaaa

SEQ ID NO: 457487 - RNA, 16 nt, Brucella suis 1330
aaaagccggagcauuc

SEQ ID NO: 457488 - RNA, 12 nt, Brucella suis 1330
aaaagccuccag

SEQ ID NO: 457489 - RNA, 21 nt, Brucella suis 1330
aaaagcgcaacuuuguuguug

SEQ ID NO: 457490 - RNA, 17 nt, Brucella suis 1330
aaaagcgcggagcaaca

SEQ ID NO: 457491 - RNA, 19 nt, Brucella suis 1330
aaaagcggcgucagcaggu

SEQ ID NO: 457492 - RNA, 23 nt, Brucella suis 1330
aaaagcggcgucagcagguugac

SEQ ID NO: 457493 - RNA, 14 nt, Brucella suis 1330
auuaugcuuuaaaa

SEQ ID NO: 457494 - RNA, 21 nt, Brucella suis 1330
auggugcugccauggcaguga

SEQ ID NO: 457495 - RNA, 15 nt, Brucella suis 1330
auggugugcaaugca

SEQ ID NO: 457496 - RNA, 17 nt, Brucella suis 1330
augggcggcggccgggc

SEQ ID NO: 457497 - RNA, 18 nt, Brucella suis 1330
augggcggcggccgggcg

SEQ ID NO: 457498 - RNA, 18 nt, Brucella suis 1330
auggggauugacgccccc

SEQ ID NO: 457499 - RNA, 21 nt, Brucella suis 1330
auggcucagcuucgggaagug

SEQ ID NO: 457500 - RNA, 15 nt, Brucella suis 1330
augggcgagccgagc

SEQ ID NO: 457501 - RNA, 19 nt, Brucella suis 1330
auggcccagcgguuuuccg

SEQ ID NO: 457502 - RNA, 17 nt, Brucella suis 1330
auggagcauuuccagca

SEQ ID NO: 457503 - RNA, 18 nt, Brucella suis 1330
auggaaagagccuguuca

SEQ ID NO: 457504 - RNA, 15 nt, Brucella suis 1330
auggaagaugacgcc

SEQ ID NO: 457505 - RNA, 20 nt, Brucella suis 1330
auggaagaugacgcccagcg

SEQ ID NO: 457506 - RNA, 16 nt, Brucella suis 1330
auggaaggaaagccca

SEQ ID NO: 457507 - RNA, 11 nt, Brucella suis 1330
auggaauaucg

SEQ ID NO: 457508 - RNA, 20 nt, Brucella suis 1330
augcgcgccagccgccagca

SEQ ID NO: 457509 - RNA, 14 nt, Brucella suis 1330
augcgcgcccggcg

SEQ ID NO: 457510 - RNA, 19 nt, Brucella suis 1330
augcgcgaauuuucucagc

SEQ ID NO: 457511 - RNA, 20 nt, Brucella suis 1330
augcgccacaccggaggaga

SEQ ID NO: 457512 - RNA, 22 nt, Brucella suis 1330
augcgccacaccggaggagagc

SEQ ID NO: 457513 - RNA, 20 nt, Brucella suis 1330
augcgccacgagaaccgcgc

SEQ ID NO: 457514 - RNA, 14 nt, Brucella suis 1330
augccugccaugcc

SEQ ID NO: 457515 - RNA, 18 nt, Brucella suis 1330
augccuucccgccagccg

SEQ ID NO: 457516 - RNA, 22 nt, Brucella suis 1330
augccgcccaucccggaaggaa

SEQ ID NO: 457517 - RNA, 19 nt, Brucella suis 1330
augccgauacuguagaaaa

SEQ ID NO: 457518 - RNA, 16 nt, Brucella suis 1330
augccgaagcccaugg

SEQ ID NO: 457519 - RNA, 23 nt, Brucella suis 1330
augccgaaggcgaagccgaagaa

SEQ ID NO: 457520 - RNA, 15 nt, Brucella suis 1330
augcagcauaggcac

SEQ ID NO: 457521 - RNA, 12 nt, Brucella suis 1330
augcagcggguu

SEQ ID NO: 457522 - RNA, 23 nt, Brucella suis 1330
augcaccccaugagaaggcaagc

SEQ ID NO: 457523 - RNA, 13 nt, Brucella suis 1330
augcacccggcac

SEQ ID NO: 457524 - RNA, 20 nt, Brucella suis 1330
augcacauccucggcccugg

SEQ ID NO: 457525 - RNA, 14 nt, Brucella suis 1330
augauuuccucagc

SEQ ID NO: 457526 - RNA, 23 nt, Brucella suis 1330
augauggccgggaaugcggaagc

SEQ ID NO: 457527 - RNA, 17 nt, Brucella suis 1330
augaucuuugucggguc

SEQ ID NO: 457528 - RNA, 13 nt, Brucella suis 1330
augacgcggguga

SEQ ID NO: 457529 - RNA, 21 nt, Brucella suis 1330
augacgccgggcauggaagcc

SEQ ID NO: 457530 - RNA, 12 nt, Brucella suis 1330
augaaaaacccc

SEQ ID NO: 457531 - RNA, 12 nt, Brucella suis 1330
augaaaaugcca

SEQ ID NO: 457532 - RNA, 21 nt, Brucella suis 1330
augaagaagauaaucagcaga

SEQ ID NO: 457533 - RNA, 14 nt, Brucella suis 1330
augaagaccuggaa

SEQ ID NO: 457534 - RNA, 19 nt, Brucella suis 1330
augaagcaaaggucgggug

SEQ ID NO: 457535 - RNA, 19 nt, Brucella suis 1330
aucuugaccuggccagcca

SEQ ID NO: 457536 - RNA, 22 nt, Brucella suis 1330
aucuguucauguuuugaaucug

SEQ ID NO: 457537 - RNA, 15 nt, Brucella suis 1330
aucugguccacgccc

SEQ ID NO: 457538 - RNA, 22 nt, Brucella suis 1330
aucugcuugguuuccgccagca

SEQ ID NO: 457539 - RNA, 16 nt, Brucella suis 1330
aucugcaucccgaaaa

SEQ ID NO: 457540 - RNA, 19 nt, Brucella suis 1330
aucguugaaggcguuggcc

SEQ ID NO: 457541 - RNA, 21 nt, Brucella suis 1330
aucguugcggcuugccaccac

SEQ ID NO: 457542 - RNA, 21 nt, Brucella suis 1330
aucgugccgccuucggcugcu

SEQ ID NO: 457543 - RNA, 23 nt, Brucella suis 1330
aucgugccgccuucggcugcuuc

SEQ ID NO: 457544 - RNA, 22 nt, Brucella suis 1330
aucgugcagaaguuucagcgca

SEQ ID NO: 457545 - RNA, 22 nt, Brucella suis 1330
aucgugagcgagcgcacauaaa

SEQ ID NO: 457546 - RNA, 18 nt, Brucella suis 1330
aucgucguccagcccugc

SEQ ID NO: 457547 - RNA, 20 nt, Brucella suis 1330
aucggcacuucgccaaagau

SEQ ID NO: 457548 - RNA, 13 nt, Brucella suis 1330
aucggcagcagcg

SEQ ID NO: 457549 - RNA, 17 nt, Brucella suis 1330
aucggcaacaagagggc

SEQ ID NO: 457550 - RNA, 17 nt, Brucella suis 1330
aucgcgguuuucaagau

SEQ ID NO: 457551 - RNA, 18 nt, Brucella suis 1330
aucgcguaagucccauug

SEQ ID NO: 457552 - RNA, 19 nt, Brucella suis 1330
aucgcgucccuugccgccu

SEQ ID NO: 457553 - RNA, 12 nt, Brucella suis 1330
aucgcuggaacc

SEQ ID NO: 457554 - RNA, 12 nt, Brucella suis 1330
aucgccguccuu

SEQ ID NO: 457555 - RNA, 14 nt, Brucella suis 1330
aucgccugaaugaa

SEQ ID NO: 457556 - RNA, 16 nt, Brucella suis 1330
aucgccuggcauugcg

SEQ ID NO: 457557 - RNA, 17 nt, Brucella suis 1330
aucgccgggccuugcca

SEQ ID NO: 457558 - RNA, 22 nt, Brucella suis 1330
aucgccgcgcgggcuugaacaa

SEQ ID NO: 457559 - RNA, 16 nt, Brucella suis 1330
aucgcccgcccggcau

SEQ ID NO: 457560 - RNA, 23 nt, Brucella suis 1330
aucgagaucgcgcguaucgacac

SEQ ID NO: 457561 - RNA, 21 nt, Brucella suis 1330
aucgagauugggcgcgcuaug

SEQ ID NO: 457562 - RNA, 14 nt, Brucella suis 1330
auccuucacuucau

SEQ ID NO: 457563 - RNA, 16 nt, Brucella suis 1330
auccuuuccaguucca

SEQ ID NO: 457564 - RNA, 19 nt, Brucella suis 1330
auccuuuccaguuccauug

SEQ ID NO: 457565 - RNA, 23 nt, Brucella suis 1330
auccugaccgugauucuuucuuc

SEQ ID NO: 457566 - RNA, 20 nt, Brucella suis 1330
auccucugugacugcggcaa

SEQ ID NO: 457567 - RNA, 15 nt, Brucella suis 1330
auccucgguuuucaa

SEQ ID NO: 457568 - RNA, 23 nt, Brucella suis 1330
auccucgguuuucaaugccuggc

SEQ ID NO: 457569 - RNA, 17 nt, Brucella suis 1330
auccuccugcgcccauu

SEQ ID NO: 457570 - RNA, 22 nt, Brucella suis 1330
auccucaacgaccauuuccgca

SEQ ID NO: 457571 - RNA, 17 nt, Brucella suis 1330
auccucaagcaucuuga

SEQ ID NO: 457572 - RNA, 20 nt, Brucella suis 1330
auccucaagcaucuugauuu

SEQ ID NO: 457573 - RNA, 19 nt, Brucella suis 1330
auccggcguggugcccgcc

SEQ ID NO: 457574 - RNA, 18 nt, Brucella suis 1330
auccagcuugcagugcag

SEQ ID NO: 457575 - RNA, 23 nt, Brucella suis 1330
auccagcugagcuacgggugcuu

SEQ ID NO: 457576 - RNA, 14 nt, Brucella suis 1330
auccaguuucuugu

SEQ ID NO: 457577 - RNA, 15 nt, Brucella suis 1330
auccauaucuuucca

SEQ ID NO: 457578 - RNA, 14 nt, Brucella suis 1330
auccagcacuucca

SEQ ID NO: 457579 - RNA, 17 nt, Brucella suis 1330
auccagcacuuccagau

SEQ ID NO: 457580 - RNA, 23 nt, Brucella suis 1330
auccacucggcggcaucgcccga

SEQ ID NO: 457581 - RNA, 14 nt, Brucella suis 1330
auccagaucuuccu

SEQ ID NO: 457582 - RNA, 15 nt, Brucella suis 1330
auccacgauauguuc

SEQ ID NO: 457583 - RNA, 16 nt, Brucella suis 1330
aucauuggauagaugg

SEQ ID NO: 457584 - RNA, 19 nt, Brucella suis 1330
aucaugcucgucggaaaua

SEQ ID NO: 457585 - RNA, 16 nt, Brucella suis 1330
aucaucugccaaccau

SEQ ID NO: 457586 - RNA, 14 nt, Brucella suis 1330
aucagguugaugcc

SEQ ID NO: 457587 - RNA, 20 nt, Brucella suis 1330
aucaguacgccgccuuccca

SEQ ID NO: 457588 - RNA, 18 nt, Brucella suis 1330
aucagggcaaucugcgcu

SEQ ID NO: 457589 - RNA, 18 nt, Brucella suis 1330
aucagucgaauuucagca

SEQ ID NO: 457590 - RNA, 17 nt, Brucella suis 1330
aaaacgaggccgaccag

SEQ ID NO: 457591 - RNA, 14 nt, Brucella suis 1330
aaaacggcccauga

SEQ ID NO: 457592 - RNA, 18 nt, Brucella suis 1330
aucagcaccaucgaggaa

SEQ ID NO: 457593 - RNA, 20 nt, Brucella suis 1330
aucagaagugcugcugcaau

SEQ ID NO: 457594 - RNA, 21 nt, Brucella suis 1330
aucagaagugcugcugcaauc

SEQ ID NO: 457595 - RNA, 20 nt, Brucella suis 1330
aucacgaagagugcggcugu

SEQ ID NO: 457596 - RNA, 20 nt, Brucella suis 1330
aucacccgauaaacccgccc

SEQ ID NO: 457597 - RNA, 20 nt, Brucella suis 1330
aucaccagcgucgcaccgga

SEQ ID NO: 457598 - RNA, 15 nt, Brucella suis 1330
aucaccaauauugca

SEQ ID NO: 457599 - RNA, 17 nt, Brucella suis 1330
aucacagccgcgccaau

SEQ ID NO: 457600 - RNA, 13 nt, Brucella suis 1330
auauguuccugcg

SEQ ID NO: 457601 - RNA, 17 nt, Brucella suis 1330
auauuccuucuccaucu

SEQ ID NO: 457602 - RNA, 21 nt, Brucella suis 1330
auauccgccaccgguuuucau

SEQ ID NO: 457603 - RNA, 18 nt, Brucella suis 1330
auaguccaguagcuucug

SEQ ID NO: 457604 - RNA, 18 nt, Brucella suis 1330
auaggugcgcggacgggc

SEQ ID NO: 457605 - RNA, 17 nt, Brucella suis 1330
auaggugagcggcaggc

SEQ ID NO: 457606 - RNA, 18 nt, Brucella suis 1330
auagggaaacggccaggg

SEQ ID NO: 457607 - RNA, 16 nt, Brucella suis 1330
auaggcguugaugacg

SEQ ID NO: 457608 - RNA, 14 nt, Brucella suis 1330
auaggccguuccgc

SEQ ID NO: 457609 - RNA, 22 nt, Brucella suis 1330
auaggccucggugcagccgaac

SEQ ID NO: 457610 - RNA, 20 nt, Brucella suis 1330
auaggcgcgcgcaagggccg

SEQ ID NO: 457611 - RNA, 20 nt, Brucella suis 1330
auagccgagauagacaugcg

SEQ ID NO: 457612 - RNA, 22 nt, Brucella suis 1330
auagaggaacucgcccaccgaa

SEQ ID NO: 457613 - RNA, 14 nt, Brucella suis 1330
auagagccacgaga

SEQ ID NO: 457614 - RNA, 15 nt, Brucella suis 1330
auagagccacgagaa

SEQ ID NO: 457615 - RNA, 19 nt, Brucella suis 1330
auaggaaucagcaaguuua

SEQ ID NO: 457616 - RNA, 14 nt, Brucella suis 1330
auagaccaugacgc

SEQ ID NO: 457617 - RNA, 19 nt, Brucella suis 1330
auagaccaugccgccagcc

SEQ ID NO: 457618 - RNA, 17 nt, Brucella suis 1330
auagaaggaauccgguu

SEQ ID NO: 457619 - RNA, 23 nt, Brucella suis 1330
auagaauaaagccauauuuuguu

SEQ ID NO: 457620 - RNA, 23 nt, Brucella suis 1330
auaccagaucaagcgcucagcuu

SEQ ID NO: 457621 - RNA, 16 nt, Brucella suis 1330
auacauggcguaggca

SEQ ID NO: 457622 - RNA, 15 nt, Brucella suis 1330
auaagcaacagggcg

SEQ ID NO: 457623 - RNA, 20 nt, Brucella suis 1330
auaagccgccucaaugguca

SEQ ID NO: 457624 - RNA, 20 nt, Brucella suis 1330
auaagccggcaugaaugugc

SEQ ID NO: 457625 - RNA, 22 nt, Brucella suis 1330
auaauauucagcgaaccugauc

SEQ ID NO: 457626 - RNA, 19 nt, Brucella suis 1330
auaaucguaucgccaaaga

SEQ ID NO: 457627 - RNA, 19 nt, Brucella suis 1330
auaaaaggcaaagccgaau

SEQ ID NO: 457628 - RNA, 16 nt, Brucella suis 1330
auaaacagcguuucca

SEQ ID NO: 457629 - RNA, 14 nt, Brucella suis 1330
auaaagaugcgcgc

SEQ ID NO: 457630 - RNA, 13 nt, Brucella suis 1330
auaaagcuugaac

SEQ ID NO: 457631 - RNA, 15 nt, Brucella suis 1330
aguugcuccagcccu

SEQ ID NO: 457632 - RNA, 21 nt, Brucella suis 1330
aguucuugucugucaccacau

SEQ ID NO: 457633 - RNA, 18 nt, Brucella suis 1330
aguuccggcggaaagcgc

SEQ ID NO: 457634 - RNA, 17 nt, Brucella suis 1330
aguucaaggcugcugca

SEQ ID NO: 457635 - RNA, 15 nt, Brucella suis 1330
agugugcgcgcgcca

SEQ ID NO: 457636 - RNA, 17 nt, Brucella suis 1330
agugagcagaagaaagg

SEQ ID NO: 457637 - RNA, 21 nt, Brucella suis 1330
agugagccuuccguugcagcc

SEQ ID NO: 457638 - RNA, 15 nt, Brucella suis 1330
agucuucggccgggc

SEQ ID NO: 457639 - RNA, 16 nt, Brucella suis 1330
agucuugcguuaaaga

SEQ ID NO: 457640 - RNA, 20 nt, Brucella suis 1330
agucuggauuccuucaccac

SEQ ID NO: 457641 - RNA, 20 nt, Brucella suis 1330
agugaaaccagcguggcuuu

SEQ ID NO: 457642 - RNA, 23 nt, Brucella suis 1330
aguccuugcccucgaucccuauc

SEQ ID NO: 457643 - RNA, 15 nt, Brucella suis 1330
aguccccgugccgga

SEQ ID NO: 457644 - RNA, 14 nt, Brucella suis 1330
aguccacuggacug

SEQ ID NO: 457645 - RNA, 22 nt, Brucella suis 1330
aguccagcuuuccgcaucgcaa

SEQ ID NO: 457646 - RNA, 15 nt, Brucella suis 1330
agucacgccaucagc

SEQ ID NO: 457647 - RNA, 15 nt, Brucella suis 1330
aguacggcgcgcuga

SEQ ID NO: 457648 - RNA, 19 nt, Brucella suis 1330
agguuacauggacgcgguu

SEQ ID NO: 457649 - RNA, 20 nt, Brucella suis 1330
aggugcgcggacgggcaggc

SEQ ID NO: 457650 - RNA, 14 nt, Brucella suis 1330
aggugccaucaagc

SEQ ID NO: 457651 - RNA, 16 nt, Brucella suis 1330
aggucgagaucgaccg

SEQ ID NO: 457652 - RNA, 19 nt, Brucella suis 1330
aggucaaaaagggcuuccu

SEQ ID NO: 457653 - RNA, 20 nt, Brucella suis 1330
agggucaaaauggccucaga

SEQ ID NO: 457654 - RNA, 15 nt, Brucella suis 1330
aggggugcaaagcuu

SEQ ID NO: 457655 - RNA, 13 nt, Brucella suis 1330
aggggaugggggc

SEQ ID NO: 457656 - RNA, 19 nt, Brucella suis 1330
aggggaugggggccgggcg

SEQ ID NO: 457657 - RNA, 12 nt, Brucella suis 1330
agggcgcgccag

SEQ ID NO: 457658 - RNA, 19 nt, Brucella suis 1330
agggcgcgccaguaggccc

SEQ ID NO: 457659 - RNA, 13 nt, Brucella suis 1330
agggcaguagggc

SEQ ID NO: 457660 - RNA, 15 nt, Brucella suis 1330
agggcaguagggcag

SEQ ID NO: 457661 - RNA, 22 nt, Brucella suis 1330
agggcaguagggcaguagggca

SEQ ID NO: 457662 - RNA, 21 nt, Brucella suis 1330
agggcagcggucacagaagca

SEQ ID NO: 457663 - RNA, 17 nt, Brucella suis 1330
aggcugucgaaugucuu

SEQ ID NO: 457664 - RNA, 19 nt, Brucella suis 1330
aggcuuccgaaucgcuguu

SEQ ID NO: 457665 - RNA, 21 nt, Brucella suis 1330
aggcugcugcacuugcgccaa

SEQ ID NO: 457666 - RNA, 13 nt, Brucella suis 1330
aggcugagugagc

SEQ ID NO: 457667 - RNA, 15 nt, Brucella suis 1330
aggcugaguuuuccg

SEQ ID NO: 457668 - RNA, 23 nt, Brucella suis 1330
aggcuccguugcuuuauccgcaa

SEQ ID NO: 457669 - RNA, 17 nt, Brucella suis 1330
aggcucgggcagcuugu

SEQ ID NO: 457670 - RNA, 12 nt, Brucella suis 1330
aggcgggaaggc

SEQ ID NO: 457671 - RNA, 20 nt, Brucella suis 1330
aggccauucccgccucagcc

SEQ ID NO: 457672 - RNA, 12 nt, Brucella suis 1330
aggcagggagga

SEQ ID NO: 457673 - RNA, 16 nt, Brucella suis 1330
aggcagcaugaaccaa

SEQ ID NO: 457674 - RNA, 20 nt, Brucella suis 1330
aggcagccgugagcauggca

SEQ ID NO: 457675 - RNA, 20 nt, Brucella suis 1330
aggcaaauguuggaaucaga

SEQ ID NO: 457676 - RNA, 12 nt, Brucella suis 1330
aggaugcugcca

SEQ ID NO: 457677 - RNA, 15 nt, Brucella suis 1330
aggaucgaagggcug

SEQ ID NO: 457678 - RNA, 16 nt, Brucella suis 1330
aggaucgaagggcuga

SEQ ID NO: 457679 - RNA, 21 nt, Brucella suis 1330
aggauaaccuucuggaaaagu

SEQ ID NO: 457680 - RNA, 17 nt, Brucella suis 1330
aggauagcguaaaacgc

SEQ ID NO: 457681 - RNA, 15 nt, Brucella suis 1330
aggacggugaacauu

SEQ ID NO: 457682 - RNA, 20 nt, Brucella suis 1330
aggaaucauuuucucaagau

SEQ ID NO: 457683 - RNA, 10 nt, Brucella suis 1330
aggaaaaagc

SEQ ID NO: 457684 - RNA, 23 nt, Brucella suis 1330
aggaaaaagcccgccacgaggaa

SEQ ID NO: 457685 - RNA, 14 nt, Brucella suis 1330
aggaaucagcaagu

SEQ ID NO: 457686 - RNA, 19 nt, Brucella suis 1330
agcuugcggcggauuucau

SEQ ID NO: 457687 - RNA, 13 nt, Brucella suis 1330
agcuuggaaagcu

SEQ ID NO: 457688 - RNA, 14 nt, Brucella suis 1330
agcuuggaaagcug

SEQ ID NO: 457689 - RNA, 21 nt, Brucella suis 1330
agcuuuuuauuaaauggcuuc

SEQ ID NO: 457690 - RNA, 17 nt, Brucella suis 1330
agcuugaccagauagcc

SEQ ID NO: 457691 - RNA, 14 nt, Brucella suis 1330
agcuucaggcucuu

SEQ ID NO: 457692 - RNA, 16 nt, Brucella suis 1330
agcuucaggucggcau

SEQ ID NO: 457693 - RNA, 20 nt, Brucella suis 1330
agcuguugcagccgucccuc

SEQ ID NO: 457694 - RNA, 20 nt, Brucella suis 1330
agcuguuugcgauugaggcc

SEQ ID NO: 457695 - RNA, 21 nt, Brucella suis 1330
agcucguccaugagcgcacca

SEQ ID NO: 457696 - RNA, 22 nt, Brucella suis 1330
agcucggacaaugcuccgggcu

SEQ ID NO: 457697 - RNA, 17 nt, Brucella suis 1330
agcgucuguacauacau

SEQ ID NO: 457698 - RNA, 22 nt, Brucella suis 1330
agcgucuguacauacaugauga

SEQ ID NO: 457699 - RNA, 20 nt, Brucella suis 1330
agcgucacaaaacagacgcc

SEQ ID NO: 457700 - RNA, 17 nt, Brucella suis 1330
agcguauucagggacag

SEQ ID NO: 457701 - RNA, 20 nt, Brucella suis 1330
agcguacaccgaccagcgca

SEQ ID NO: 457702 - RNA, 22 nt, Brucella suis 1330
agcggucacagaagcaagcacu

SEQ ID NO: 457703 - RNA, 13 nt, Brucella suis 1330
agcggcgacggcg

SEQ ID NO: 457704 - RNA, 13 nt, Brucella suis 1330
agcggcaggccgc

SEQ ID NO: 457705 - RNA, 12 nt, Brucella suis 1330
agcggcacauga

SEQ ID NO: 457706 - RNA, 15 nt, Brucella suis 1330
agcggcacauucuug

SEQ ID NO: 457707 - RNA, 16 nt, Brucella suis 1330
agcggcaccucgcugg

SEQ ID NO: 457708 - RNA, 15 nt, Brucella suis 1330
agcggaucagcgcgc

SEQ ID NO: 457709 - RNA, 17 nt, Brucella suis 1330
agcggaucagcgcgccg

SEQ ID NO: 457710 - RNA, 14 nt, Brucella suis 1330
agcgcugucagccg

SEQ ID NO: 457711 - RNA, 16 nt, Brucella suis 1330
agcgcggaaugacaug

SEQ ID NO: 457712 - RNA, 17 nt, Brucella suis 1330
agcgcggaaugacaugg

SEQ ID NO: 457713 - RNA, 17 nt, Brucella suis 1330
agcgcgcgugagcgcgc

SEQ ID NO: 457714 - RNA, 14 nt, Brucella suis 1330
agcgcgccacggau

SEQ ID NO: 457715 - RNA, 20 nt, Brucella suis 1330
agcgcgcaccgauggagcgc

SEQ ID NO: 457716 - RNA, 23 nt, Brucella suis 1330
agcgccuacgcagggaaaucagu

SEQ ID NO: 457717 - RNA, 17 nt, Brucella suis 1330
agcgccggaaugggccu

SEQ ID NO: 457718 - RNA, 19 nt, Brucella suis 1330
agcgcccgguggacaugaa

SEQ ID NO: 457719 - RNA, 22 nt, Brucella suis 1330
agcgcccgaugaucuguucagc

SEQ ID NO: 457720 - RNA, 22 nt, Brucella suis 1330
agcgcaggcgcgaucaugccca

SEQ ID NO: 457721 - RNA, 22 nt, Brucella suis 1330
agcgcauuuucauugccgggcg

SEQ ID NO: 457722 - RNA, 16 nt, Brucella suis 1330
agcgacgacaugaagg

SEQ ID NO: 457723 - RNA, 16 nt, Brucella suis 1330
agcgacaggaacauca

SEQ ID NO: 457724 - RNA, 17 nt, Brucella suis 1330
agcgaccagcaacgcgc

SEQ ID NO: 457725 - RNA, 21 nt, Brucella suis 1330
agcgaaauaaucguaucgcca

SEQ ID NO: 457726 - RNA, 12 nt, Brucella suis 1330
agccuuggcccu

SEQ ID NO: 457727 - RNA, 14 nt, Brucella suis 1330
agccuuggcccuuu

SEQ ID NO: 457728 - RNA, 15 nt, Brucella suis 1330
agccuugcccuggcu

SEQ ID NO: 457729 - RNA, 21 nt, Brucella suis 1330
agccuugagcauauucagggc

SEQ ID NO: 457730 - RNA, 21 nt, Brucella suis 1330
agccuuccguugcagcccaac

SEQ ID NO: 457731 - RNA, 20 nt, Brucella suis 1330
agccuccugugcauugccaa

SEQ ID NO: 457732 - RNA, 21 nt, Brucella suis 1330
agccguaccggcaucagccuu

SEQ ID NO: 457733 - RNA, 21 nt, Brucella suis 1330
agccggugcugucgcccagaa

SEQ ID NO: 457734 - RNA, 18 nt, Brucella suis 1330
agccgguaauauugaagc

SEQ ID NO: 457735 - RNA, 13 nt, Brucella suis 1330
agccgugacagaa

SEQ ID NO: 457736 - RNA, 14 nt, Brucella suis 1330
agccguuccagggc

SEQ ID NO: 457737 - RNA, 17 nt, Brucella suis 1330
agccguuccagggcgcg

SEQ ID NO: 457738 - RNA, 22 nt, Brucella suis 1330
agccggccacgaaaugggggcc

SEQ ID NO: 457739 - RNA, 22 nt, Brucella suis 1330
agccgcuugcauuccagaaggu

SEQ ID NO: 457740 - RNA, 18 nt, Brucella suis 1330
agccgcugaaccacugau

SEQ ID NO: 457741 - RNA, 11 nt, Brucella suis 1330
agccgcggcgc

SEQ ID NO: 457742 - RNA, 13 nt, Brucella suis 1330
agccgcuccauuc

SEQ ID NO: 457743 - RNA, 15 nt, Brucella suis 1330
agccgccuuccuuga

SEQ ID NO: 457744 - RNA, 17 nt, Brucella suis 1330
agccgccucugucaccu

SEQ ID NO: 457745 - RNA, 21 nt, Brucella suis 1330
agccgcccgccuuggaaacca

SEQ ID NO: 457746 - RNA, 20 nt, Brucella suis 1330
agccgccauaccgucgagga

SEQ ID NO: 457747 - RNA, 21 nt, Brucella suis 1330
agccgccauaccgucgaggaa

SEQ ID NO: 457748 - RNA, 22 nt, Brucella suis 1330
agccgaucuggcugagauaaac

SEQ ID NO: 457749 - RNA, 16 nt, Brucella suis 1330
agcccugcacaccaaa

SEQ ID NO: 457750 - RNA, 21 nt, Brucella suis 1330
agccagguggcugcccgccgc

SEQ ID NO: 457751 - RNA, 22 nt, Brucella suis 1330
agccagcccgugacguccacca

SEQ ID NO: 457752 - RNA, 14 nt, Brucella suis 1330
agccaaagcccgug

SEQ ID NO: 457753 - RNA, 14 nt, Brucella suis 1330
agcaucuugccaag

SEQ ID NO: 457754 - RNA, 17 nt, Brucella suis 1330
agcauuccgauggaacu

SEQ ID NO: 457755 - RNA, 18 nt, Brucella suis 1330
agcauuccgauggaacug

SEQ ID NO: 457756 - RNA, 22 nt, Brucella suis 1330
agccaaaagugcgaagcgccga

SEQ ID NO: 457757 - RNA, 20 nt, Brucella suis 1330
agcaucgaccagccggggcg

SEQ ID NO: 457758 - RNA, 14 nt, Brucella suis 1330
agcauauguuccug

SEQ ID NO: 457759 - RNA, 22 nt, Brucella suis 1330
agcauauugccgagcauggccu

SEQ ID NO: 457760 - RNA, 23 nt, Brucella suis 1330
agcauauugccgagcauggccug

SEQ ID NO: 457761 - RNA, 14 nt, Brucella suis 1330
agcaggaagaaggc

SEQ ID NO: 457762 - RNA, 14 nt, Brucella suis 1330
agcagacgggaagc

SEQ ID NO: 457763 - RNA, 13 nt, Brucella suis 1330
agcagaaggauga

SEQ ID NO: 457764 - RNA, 16 nt, Brucella suis 1330
agcacuuccagauaga

SEQ ID NO: 457765 - RNA, 16 nt, Brucella suis 1330
agcacccgcuugggca

SEQ ID NO: 457766 - RNA, 15 nt, Brucella suis 1330
agcacauggcggccu

SEQ ID NO: 457767 - RNA, 19 nt, Brucella suis 1330
agcacacggucaugcaggc

SEQ ID NO: 457768 - RNA, 12 nt, Brucella suis 1330
agcaauuccugc

SEQ ID NO: 457769 - RNA, 19 nt, Brucella suis 1330
agcaaucgacaauugccca

SEQ ID NO: 457770 - RNA, 21 nt, Brucella suis 1330
agcaaucucacacugcaaaac

SEQ ID NO: 457771 - RNA, 18 nt, Brucella suis 1330
agcaagguauuugauguu

SEQ ID NO: 457772 - RNA, 17 nt, Brucella suis 1330
agauuaugcuuuaaaag

SEQ ID NO: 457773 - RNA, 18 nt, Brucella suis 1330
agaugcugaacaagcaga

SEQ ID NO: 457774 - RNA, 21 nt, Brucella suis 1330
agaugcagcggaacuggauga

SEQ ID NO: 457775 - RNA, 15 nt, Brucella suis 1330
agaugcaaugcaccg

SEQ ID NO: 457776 - RNA, 21 nt, Brucella suis 1330
agaucugcaucccgaaaagug

SEQ ID NO: 457777 - RNA, 16 nt, Brucella suis 1330
agaucuguaucccgaa

SEQ ID NO: 457778 - RNA, 22 nt, Brucella suis 1330
agaucuguaucccgaaaagugc

SEQ ID NO: 457779 - RNA, 16 nt, Brucella suis 1330
agaucgugucauagcc

SEQ ID NO: 457780 - RNA, 14 nt, Brucella suis 1330
agaucggcgcucua

SEQ ID NO: 457781 - RNA, 20 nt, Brucella suis 1330
agaucgcgcgcaacgcaaug

SEQ ID NO: 457782 - RNA, 19 nt, Brucella suis 1330
agaucgaagcgaaagugac

SEQ ID NO: 457783 - RNA, 15 nt, Brucella suis 1330
agaucgacaaagccu

SEQ ID NO: 457784 - RNA, 22 nt, Brucella suis 1330
agaucgaccugagccucgggca

SEQ ID NO: 457785 - RNA, 20 nt, Brucella suis 1330
agaucgacgcagaaauugca

SEQ ID NO: 457786 - RNA, 23 nt, Brucella suis 1330
agaucgauggugcggaacaaugc

SEQ ID NO: 457787 - RNA, 15 nt, Brucella suis 1330
agauccgcugacugc

SEQ ID NO: 457788 - RNA, 19 nt, Brucella suis 1330
agauccgcugacugcgcca

SEQ ID NO: 457789 - RNA, 15 nt, Brucella suis 1330
agauauuucuuccag

SEQ ID NO: 457790 - RNA, 17 nt, Brucella suis 1330
agaucacccagaaaacg

SEQ ID NO: 457791 - RNA, 12 nt, Brucella suis 1330
agauacaaaaaa

SEQ ID NO: 457792 - RNA, 19 nt, Brucella suis 1330
agauacaaaaaaucccgga

SEQ ID NO: 457793 - RNA, 14 nt, Brucella suis 1330
agauaaucagcaga

SEQ ID NO: 457794 - RNA, 22 nt, Brucella suis 1330
agagucgccgaaauuggccgcu

SEQ ID NO: 457795 - RNA, 17 nt, Brucella suis 1330
agagccgcucuggacga

SEQ ID NO: 457796 - RNA, 23 nt, Brucella suis 1330
agagccgcucuggacgaaaggcg

SEQ ID NO: 457797 - RNA, 11 nt, Brucella suis 1330
agagcgguucc

SEQ ID NO: 457798 - RNA, 22 nt, Brucella suis 1330
agagcaaauacaccaaugcagg

SEQ ID NO: 457799 - RNA, 23 nt, Brucella suis 1330
agagcauuuuucgggcgaaugga

SEQ ID NO: 457800 - RNA, 15 nt, Brucella suis 1330
agagcauuuccagca

SEQ ID NO: 457801 - RNA, 18 nt, Brucella suis 1330
agagcauuuccagcaaaa

SEQ ID NO: 457802 - RNA, 17 nt, Brucella suis 1330
agagccgcaggcacugg

SEQ ID NO: 457803 - RNA, 23 nt, Brucella suis 1330
agagauuucaccacgccaucuuc

SEQ ID NO: 457804 - RNA, 15 nt, Brucella suis 1330
agacuuuccauccag

SEQ ID NO: 457805 - RNA, 13 nt, Brucella suis 1330
agagacaggaaaa

SEQ ID NO: 457806 - RNA, 19 nt, Brucella suis 1330
agacuggaaugucucgcag

SEQ ID NO: 457807 - RNA, 18 nt, Brucella suis 1330
agacggacuucuucacca

SEQ ID NO: 457808 - RNA, 21 nt, Brucella suis 1330
agacggacuucuucaccagcc

SEQ ID NO: 457809 - RNA, 23 nt, Brucella suis 1330
agacucgaacaggcccaccgugc

SEQ ID NO: 457810 - RNA, 20 nt, Brucella suis 1330
agaauucauguucgagauau

SEQ ID NO: 457811 - RNA, 12 nt, Brucella suis 1330
agaauuucucuu

SEQ ID NO: 457812 - RNA, 14 nt, Brucella suis 1330
agaaguugggggcc

SEQ ID NO: 457813 - RNA, 21 nt, Brucella suis 1330
agaagucgauguucggguaga

SEQ ID NO: 457814 - RNA, 21 nt, Brucella suis 1330
agaagugcugcugcaauccac

SEQ ID NO: 457815 - RNA, 21 nt, Brucella suis 1330
agaauacgguccugcaaaccg

SEQ ID NO: 457816 - RNA, 12 nt, Brucella suis 1330
agaaugcguggc

SEQ ID NO: 457817 - RNA, 13 nt, Brucella suis 1330
agaaccaucggaa

SEQ ID NO: 457818 - RNA, 23 nt, Brucella suis 1330
agaacggcaggaucuuccaucug

SEQ ID NO: 457819 - RNA, 15 nt, Brucella suis 1330
acuuucaagcgggua

SEQ ID NO: 457820 - RNA, 20 nt, Brucella suis 1330
acuugucgcuacguggcuug

SEQ ID NO: 457821 - RNA, 22 nt, Brucella suis 1330
acuugguugccagcaauugcuu

SEQ ID NO: 457822 - RNA, 23 nt, Brucella suis 1330
acuugguugccagcaauugcuuc

SEQ ID NO: 457823 - RNA, 16 nt, Brucella suis 1330
acuugcgcuuugcaag

SEQ ID NO: 457824 - RNA, 18 nt, Brucella suis 1330
acuuggaaauugacauuu

SEQ ID NO: 457825 - RNA, 14 nt, Brucella suis 1330
acuggguugaacgg

SEQ ID NO: 457826 - RNA, 14 nt, Brucella suis 1330
acugggcggccagc

SEQ ID NO: 457827 - RNA, 12 nt, Brucella suis 1330
acugaaugcaga

SEQ ID NO: 457828 - RNA, 23 nt, Brucella suis 1330
acugagaacuucggcauggcagc

SEQ ID NO: 457829 - RNA, 18 nt, Brucella suis 1330
acucgaugccuuucuggu

SEQ ID NO: 457830 - RNA, 18 nt, Brucella suis 1330
acuccauuaaucaaaaac

SEQ ID NO: 457831 - RNA, 16 nt, Brucella suis 1330
acuccgaccauuuccc

SEQ ID NO: 457832 - RNA, 16 nt, Brucella suis 1330
acucauuaucagcauu

SEQ ID NO: 457833 - RNA, 16 nt, Brucella suis 1330
acguuccgugaaucug

SEQ ID NO: 457834 - RNA, 15 nt, Brucella suis 1330
acguggcuugaagcu

SEQ ID NO: 457835 - RNA, 22 nt, Brucella suis 1330
acguccuuggcacguugcgccu

SEQ ID NO: 457836 - RNA, 19 nt, Brucella suis 1330
acgucaucaucgucuucaa

SEQ ID NO: 457837 - RNA, 15 nt, Brucella suis 1330
acgucaauagcaugg

SEQ ID NO: 457838 - RNA, 21 nt, Brucella suis 1330
acgucaauagcauggccccgg

SEQ ID NO: 457839 - RNA, 11 nt, Brucella suis 1330
acgucaacagc

SEQ ID NO: 457840 - RNA, 19 nt, Brucella suis 1330
acgucacagauucaaaaca

SEQ ID NO: 457841 - RNA, 14 nt, Brucella suis 1330
acguauauccggua

SEQ ID NO: 457842 - RNA, 14 nt, Brucella suis 1330
acgguugccuugcu

SEQ ID NO: 457843 - RNA, 16 nt, Brucella suis 1330
acggucuugccggccu

SEQ ID NO: 457844 - RNA, 15 nt, Brucella suis 1330
acggucggaauaucg

SEQ ID NO: 457845 - RNA, 13 nt, Brucella suis 1330
acgggccagaaug

SEQ ID NO: 457846 - RNA, 15 nt, Brucella suis 1330
acgggagcagcucua

SEQ ID NO: 457847 - RNA, 20 nt, Brucella suis 1330
acggcggccuuggaggcggc

SEQ ID NO: 457848 - RNA, 17 nt, Brucella suis 1330
acggcggcagaauaucu

SEQ ID NO: 457849 - RNA, 15 nt, Brucella suis 1330
acggccaagcaggag

SEQ ID NO: 457850 - RNA, 14 nt, Brucella suis 1330
acggcauucaaaaa

SEQ ID NO: 457851 - RNA, 16 nt, Brucella suis 1330
acggcauucaaaaacg

SEQ ID NO: 457852 - RNA, 21 nt, Brucella suis 1330
acgcggcaggugccaucaagc

SEQ ID NO: 457853 - RNA, 22 nt, Brucella suis 1330
acgcggauaucggcgcggauga

SEQ ID NO: 457854 - RNA, 18 nt, Brucella suis 1330
acgcgcuaaaaagcgcgc

SEQ ID NO: 457855 - RNA, 16 nt, Brucella suis 1330
acgcgccaaacugcac

SEQ ID NO: 457856 - RNA, 12 nt, Brucella suis 1330
acgcgcagcagc

SEQ ID NO: 457857 - RNA, 13 nt, Brucella suis 1330
acgcgcagcagca

SEQ ID NO: 457858 - RNA, 18 nt, Brucella suis 1330
acgccuuuuucacugcau

SEQ ID NO: 457859 - RNA, 17 nt, Brucella suis 1330
acgccuuauaggcgcgc

SEQ ID NO: 457860 - RNA, 13 nt, Brucella suis 1330
acgccuucaaagc

SEQ ID NO: 457861 - RNA, 20 nt, Brucella suis 1330
acgccggccugguuucacag

SEQ ID NO: 457862 - RNA, 23 nt, Brucella suis 1330
acgccgccuuaucggggcggcgu

SEQ ID NO: 457863 - RNA, 18 nt, Brucella suis 1330
acgcccuuggcgagaauu

SEQ ID NO: 457864 - RNA, 19 nt, Brucella suis 1330
acgagcuccccggcgggug

SEQ ID NO: 457865 - RNA, 17 nt, Brucella suis 1330
acgagcgcacgcaggca

SEQ ID NO: 457866 - RNA, 15 nt, Brucella suis 1330
acgagauugccgcca

SEQ ID NO: 457867 - RNA, 12 nt, Brucella suis 1330
acgacugaaaua

SEQ ID NO: 457868 - RNA, 15 nt, Brucella suis 1330
acgacugaaauaaua

SEQ ID NO: 457869 - RNA, 19 nt, Brucella suis 1330
acgacccguuugaagagcu

SEQ ID NO: 457870 - RNA, 14 nt, Brucella suis 1330
acgacauagauucc

SEQ ID NO: 457871 - RNA, 13 nt, Brucella suis 1330
acgacagggcgcu

SEQ ID NO: 457872 - RNA, 14 nt, Brucella suis 1330
accuuguugacauu

SEQ ID NO: 457873 - RNA, 15 nt, Brucella suis 1330
accuucuggaaaagu

SEQ ID NO: 457874 - RNA, 14 nt, Brucella suis 1330
accuucuggaagcg

SEQ ID NO: 457875 - RNA, 14 nt, Brucella suis 1330
accuuccagcaugg

SEQ ID NO: 457876 - RNA, 15 nt, Brucella suis 1330
accuucuuggagccg

SEQ ID NO: 457877 - RNA, 15 nt, Brucella suis 1330
accugccaucaccag

SEQ ID NO: 457878 - RNA, 12 nt, Brucella suis 1330
accugcccgcac

SEQ ID NO: 457879 - RNA, 20 nt, Brucella suis 1330
accuccacgcucaacacucu

SEQ ID NO: 457880 - RNA, 16 nt, Brucella suis 1330
accucauuuugcuggc

SEQ ID NO: 457881 - RNA, 14 nt, Brucella suis 1330
accgugcuccagau

SEQ ID NO: 457882 - RNA, 16 nt, Brucella suis 1330
accgugcuccagauac

SEQ ID NO: 457883 - RNA, 22 nt, Brucella suis 1330
accguucaacuggcgcagcagc

SEQ ID NO: 457884 - RNA, 17 nt, Brucella suis 1330
accgugccgagaaugcg

SEQ ID NO: 457885 - RNA, 17 nt, Brucella suis 1330
accgucgaggaaaaagc

SEQ ID NO: 457886 - RNA, 15 nt, Brucella suis 1330
accguccacgauggc

SEQ ID NO: 457887 - RNA, 14 nt, Brucella suis 1330
accggcauggauca

SEQ ID NO: 457888 - RNA, 12 nt, Brucella suis 1330
accggcauugag

SEQ ID NO: 457889 - RNA, 18 nt, Brucella suis 1330
accggcauugagccgcgc

SEQ ID NO: 457890 - RNA, 17 nt, Brucella suis 1330
accggcacccacugccc

SEQ ID NO: 457891 - RNA, 14 nt, Brucella suis 1330
accgcaaagagaac

SEQ ID NO: 457892 - RNA, 15 nt, Brucella suis 1330
accgaggccgccacc

SEQ ID NO: 457893 - RNA, 14 nt, Brucella suis 1330
accgaggcaaugaa

SEQ ID NO: 457894 - RNA, 19 nt, Brucella suis 1330
accgacacguccgggaagc

SEQ ID NO: 457895 - RNA, 15 nt, Brucella suis 1330
accgacaaaaacaga

SEQ ID NO: 457896 - RNA, 21 nt, Brucella suis 1330
accgaacugggcggccagcuc

SEQ ID NO: 457897 - RNA, 21 nt, Brucella suis 1330
accgaacgcgccuuuucuuca

SEQ ID NO: 457898 - RNA, 19 nt, Brucella suis 1330
accgaacggaucaggcgcc

SEQ ID NO: 457899 - RNA, 18 nt, Brucella suis 1330
accgaauccacguuugga

SEQ ID NO: 457900 - RNA, 13 nt, Brucella suis 1330
acccuuuuccgca

SEQ ID NO: 457901 - RNA, 19 nt, Brucella suis 1330
acccuuggcgacggccagc

SEQ ID NO: 457902 - RNA, 22 nt, Brucella suis 1330
acccuuggcgacggccagcgcg

SEQ ID NO: 457903 - RNA, 16 nt, Brucella suis 1330
acccgccagaugauca

SEQ ID NO: 457904 - RNA, 12 nt, Brucella suis 1330
acccggucuuga

SEQ ID NO: 457905 - RNA, 19 nt, Brucella suis 1330
acccuaccgaacccggauc

SEQ ID NO: 457906 - RNA, 12 nt, Brucella suis 1330
acccgaaaggau

SEQ ID NO: 457907 - RNA, 13 nt, Brucella suis 1330
acccgagcgucug

SEQ ID NO: 457908 - RNA, 18 nt, Brucella suis 1330
acccauuaccgaggggaa

SEQ ID NO: 457909 - RNA, 15 nt, Brucella suis 1330
accaucggcaacaag

SEQ ID NO: 457910 - RNA, 17 nt, Brucella suis 1330
accaucgaaagcccguc

SEQ ID NO: 457911 - RNA, 15 nt, Brucella suis 1330
accauauuggcggca

SEQ ID NO: 457912 - RNA, 23 nt, Brucella suis 1330
accauauuugccgccagaaaaug

SEQ ID NO: 457913 - RNA, 14 nt, Brucella suis 1330
accauauccaucug

SEQ ID NO: 457914 - RNA, 21 nt, Brucella suis 1330
accaggcccauuggaaauuau

SEQ ID NO: 457915 - RNA, 13 nt, Brucella suis 1330
accagcgugcagc

SEQ ID NO: 457916 - RNA, 12 nt, Brucella suis 1330
accagcaggaag

SEQ ID NO: 457917 - RNA, 19 nt, Brucella suis 1330
accagcaacgcgcccgcca

SEQ ID NO: 457918 - RNA, 20 nt, Brucella suis 1330
accagagagcggauugcugu

SEQ ID NO: 457919 - RNA, 13 nt, Brucella suis 1330
accaagaccgccg

SEQ ID NO: 457920 - RNA, 18 nt, Brucella suis 1330
accagacgauuuucgcca

SEQ ID NO: 457921 - RNA, 15 nt, Brucella suis 1330
acaugcuccagggug

SEQ ID NO: 457922 - RNA, 14 nt, Brucella suis 1330
acaugccugccgca

SEQ ID NO: 457923 - RNA, 23 nt, Brucella suis 1330
acaucgguggugccgaaggccuc

SEQ ID NO: 457924 - RNA, 20 nt, Brucella suis 1330
acaucgucggucgucauuuc

SEQ ID NO: 457925 - RNA, 18 nt, Brucella suis 1330
acaugaacagaucggaau

SEQ ID NO: 457926 - RNA, 14 nt, Brucella suis 1330
acaugaaggagagg

SEQ ID NO: 457927 - RNA, 14 nt, Brucella suis 1330
acauccuucacuuc

SEQ ID NO: 457928 - RNA, 20 nt, Brucella suis 1330
acaucaaugugaaggcgcug

SEQ ID NO: 457929 - RNA, 14 nt, Brucella suis 1330
acauugucugaaaa

SEQ ID NO: 457930 - RNA, 22 nt, Brucella suis 1330
acauuguuccggcacucgaaaa

SEQ ID NO: 457931 - RNA, 12 nt, Brucella suis 1330
accaaaacuucc

SEQ ID NO: 457932 - RNA, 13 nt, Brucella suis 1330
accaaagaaaaaa

SEQ ID NO: 457933 - RNA, 19 nt, Brucella suis 1330
acauaaaguucacgcgcca

SEQ ID NO: 457934 - RNA, 21 nt, Brucella suis 1330
acagugaccagcgccgaggcg

SEQ ID NO: 457935 - RNA, 16 nt, Brucella suis 1330
acagggugacgacuga

SEQ ID NO: 457936 - RNA, 20 nt, Brucella suis 1330
acagggcaagcgccugcugc

SEQ ID NO: 457937 - RNA, 23 nt, Brucella suis 1330
acaggcucgggcagcuugucgaa

SEQ ID NO: 457938 - RNA, 21 nt, Brucella suis 1330
acagccuuggaauggcgcaca

SEQ ID NO: 457939 - RNA, 15 nt, Brucella suis 1330
acagccuuggcuucc

SEQ ID NO: 457940 - RNA, 21 nt, Brucella suis 1330
acagccuagacagcagugccu

SEQ ID NO: 457941 - RNA, 17 nt, Brucella suis 1330
acagccuggaugacauc

SEQ ID NO: 457942 - RNA, 12 nt, Brucella suis 1330
acagccuggcgg

SEQ ID NO: 457943 - RNA, 20 nt, Brucella suis 1330
acagccagaaagaagaugag

SEQ ID NO: 457944 - RNA, 12 nt, Brucella suis 1330
acagcaagccca

SEQ ID NO: 457945 - RNA, 17 nt, Brucella suis 1330
acacggccgaucgccag

SEQ ID NO: 457946 - RNA, 18 nt, Brucella suis 1330
acacgccgccgcgcggca

SEQ ID NO: 457947 - RNA, 14 nt, Brucella suis 1330
acaccuucggccag

SEQ ID NO: 457948 - RNA, 23 nt, Brucella suis 1330
acaccuucggccagcgcaaagcg

SEQ ID NO: 457949 - RNA, 20 nt, Brucella suis 1330
acacgaacagcagcaggggc

SEQ ID NO: 457950 - RNA, 23 nt, Brucella suis 1330
acaccgcgcaauaaugcagcgcc

SEQ ID NO: 457951 - RNA, 16 nt, Brucella suis 1330
acaccaaaagagcgcu

SEQ ID NO: 457952 - RNA, 21 nt, Brucella suis 1330
acaagcuucaggcucuugucg

SEQ ID NO: 457953 - RNA, 18 nt, Brucella suis 1330
acaagcuugauaaggccg

SEQ ID NO: 457954 - RNA, 18 nt, Brucella suis 1330
acaagcgugagcuucagg

SEQ ID NO: 457955 - RNA, 17 nt, Brucella suis 1330
acaacgcaaaggccacc

SEQ ID NO: 457956 - RNA, 16 nt, Brucella suis 1330
acaaguuccuuuucca

SEQ ID NO: 457957 - RNA, 22 nt, Brucella suis 1330
acaauauuguucgacuugaaga

SEQ ID NO: 457958 - RNA, 13 nt, Brucella suis 1330
acaaugccuugag

SEQ ID NO: 457959 - RNA, 14 nt, Brucella suis 1330
acaauuccagccgg

SEQ ID NO: 457960 - RNA, 15 nt, Brucella suis 1330
acaaaagaagauuuc

SEQ ID NO: 457961 - RNA, 11 nt, Brucella suis 1330
acaaaaugccc

SEQ ID NO: 457962 - RNA, 10 nt, Brucella suis 1330
acaaagauga

SEQ ID NO: 457963 - RNA, 18 nt, Brucella suis 1330
acaaagcccgucucgucg

SEQ ID NO: 457964 - RNA, 21 nt, Brucella suis 1330
acaaaugcaaaugccgcacag

SEQ ID NO: 457965 - RNA, 17 nt, Brucella suis 1330
acaacagcaguaccgac

SEQ ID NO: 457966 - RNA, 16 nt, Brucella suis 1330
acaaccgcgccgcugg

SEQ ID NO: 457967 - RNA, 19 nt, Brucella suis 1330
aauugcuuuccugcacaug

SEQ ID NO: 457968 - RNA, 22 nt, Brucella suis 1330
aauugcaucgcgguuuucaaga

SEQ ID NO: 457969 - RNA, 13 nt, Brucella suis 1330
aauugucaggaaa

SEQ ID NO: 457970 - RNA, 17 nt, Brucella suis 1330
aauugucaggaaaaauc

SEQ ID NO: 457971 - RNA, 23 nt, Brucella suis 1330
aaugugcccuugagagccagauc

SEQ ID NO: 457972 - RNA, 17 nt, Brucella suis 1330
aaugugccugaaacaag

SEQ ID NO: 457973 - RNA, 16 nt, Brucella suis 1330
aaugcggaagcgagaa

SEQ ID NO: 457974 - RNA, 22 nt, Brucella suis 1330
aauggcccugucagcgaaacca

SEQ ID NO: 457975 - RNA, 12 nt, Brucella suis 1330
aauggccuugcc

SEQ ID NO: 457976 - RNA, 16 nt, Brucella suis 1330
aauggcgcgcgcggcu

SEQ ID NO: 457977 - RNA, 21 nt, Brucella suis 1330
aaugccaagugaagcgaagaa

SEQ ID NO: 457978 - RNA, 17 nt, Brucella suis 1330
aaugccacccuuugugc

SEQ ID NO: 457979 - RNA, 20 nt, Brucella suis 1330
aaugcgauaaaaugaaaagc

SEQ ID NO: 457980 - RNA, 23 nt, Brucella suis 1330
aaugcacccggcaccgcaaagag

SEQ ID NO: 457981 - RNA, 17 nt, Brucella suis 1330
aaugcaccgccugccag

SEQ ID NO: 457982 - RNA, 21 nt, Brucella suis 1330
aaugcaccgccugccagcccg

SEQ ID NO: 457983 - RNA, 20 nt, Brucella suis 1330
aaugcaaaugccgcacagau

SEQ ID NO: 457984 - RNA, 19 nt, Brucella suis 1330
aaucuugacguuauuuccg

SEQ ID NO: 457985 - RNA, 22 nt, Brucella suis 1330
aaucugcucguccggccagccg

SEQ ID NO: 457986 - RNA, 14 nt, Brucella suis 1330
aaucugcuugguuu

SEQ ID NO: 457987 - RNA, 23 nt, Brucella suis 1330
aaucuggagugcacggccaugaa

SEQ ID NO: 457988 - RNA, 18 nt, Brucella suis 1330
aaucugacccggcgcaaa

SEQ ID NO: 457989 - RNA, 15 nt, Brucella suis 1330
aaucuguucacauuu

SEQ ID NO: 457990 - RNA, 19 nt, Brucella suis 1330
aaucgaugacaucuucuuc

SEQ ID NO: 457991 - RNA, 18 nt, Brucella suis 1330
aaucgccaccggcggcgc

SEQ ID NO: 457992 - RNA, 15 nt, Brucella suis 1330
aaucgagggguuuuu

SEQ ID NO: 457993 - RNA, 17 nt, Brucella suis 1330
aauccuuccugauuuac

SEQ ID NO: 457994 - RNA, 23 nt, Brucella suis 1330
aauccggcgugaucgggaaauaa

SEQ ID NO: 457995 - RNA, 14 nt, Brucella suis 1330
aaucccuuacucca

SEQ ID NO: 457996 - RNA, 17 nt, Brucella suis 1330
aaucccuuacuccauua

SEQ ID NO: 457997 - RNA, 20 nt, Brucella suis 1330
aauccgauuaucgcgaagaa

SEQ ID NO: 457998 - RNA, 17 nt, Brucella suis 1330
aaucauuuucucaagau

SEQ ID NO: 457999 - RNA, 23 nt, Brucella suis 1330
aauccauuagauacauauacuua

SEQ ID NO: 458000 - RNA, 19 nt, Brucella suis 1330
aauauucaggaucuuucca

SEQ ID NO: 458001 - RNA, 17 nt, Brucella suis 1330
aauauugccuuccccau

SEQ ID NO: 458002 - RNA, 22 nt, Brucella suis 1330
aaucaccagagacaguggcucu

SEQ ID NO: 458003 - RNA, 13 nt, Brucella suis 1330
aaucacuugcaag

SEQ ID NO: 458004 - RNA, 18 nt, Brucella suis 1330
aaucagaccgaugcucua

SEQ ID NO: 458005 - RNA, 17 nt, Brucella suis 1330
aauacuaaucgcaaaaa

SEQ ID NO: 458006 - RNA, 13 nt, Brucella suis 1330
aauacgccuggcc

SEQ ID NO: 458007 - RNA, 17 nt, Brucella suis 1330
aagugaucucggccugg

SEQ ID NO: 458008 - RNA, 10 nt, Brucella suis 1330
aagugcugcu

SEQ ID NO: 458009 - RNA, 13 nt, Brucella suis 1330
aagugcugcugca

SEQ ID NO: 458010 - RNA, 21 nt, Brucella suis 1330
aaguaacugauucuaucgccu

SEQ ID NO: 458011 - RNA, 11 nt, Brucella suis 1330
aagugguguug

SEQ ID NO: 458012 - RNA, 19 nt, Brucella suis 1330
aagugucguugacacgcuu

SEQ ID NO: 458013 - RNA, 11 nt, Brucella suis 1330
aauaaagccau

SEQ ID NO: 458014 - RNA, 16 nt, Brucella suis 1330
aauaaagccauauuuu

SEQ ID NO: 458015 - RNA, 22 nt, Brucella suis 1330
aagguuacuugcgcuuugcaag

SEQ ID NO: 458016 - RNA, 18 nt, Brucella suis 1330
aagguguaggugccgaga

SEQ ID NO: 458017 - RNA, 23 nt, Brucella suis 1330
aaggucuuccgggacaaucuugc

SEQ ID NO: 458018 - RNA, 20 nt, Brucella suis 1330
aagggcaggaggccaaaaag

SEQ ID NO: 458019 - RNA, 15 nt, Brucella suis 1330
aaggcgugaaccaca

SEQ ID NO: 458020 - RNA, 15 nt, Brucella suis 1330
aaggcgggaaggcaa

SEQ ID NO: 458021 - RNA, 16 nt, Brucella suis 1330
aaggcgggaaggcaau

SEQ ID NO: 458022 - RNA, 13 nt, Brucella suis 1330
aaggcgagcaggc

SEQ ID NO: 458023 - RNA, 16 nt, Brucella suis 1330
aaggccuguuccacac

SEQ ID NO: 458024 - RNA, 15 nt, Brucella suis 1330
aaggcaagcaggcgc

SEQ ID NO: 458025 - RNA, 13 nt, Brucella suis 1330
aaggcaagcccca

SEQ ID NO: 458026 - RNA, 16 nt, Brucella suis 1330
aaggauuuccuguccc

SEQ ID NO: 458027 - RNA, 21 nt, Brucella suis 1330
aaggagccgcugcgcagaaga

SEQ ID NO: 458028 - RNA, 13 nt, Brucella suis 1330
aaggaaaaaaccg

SEQ ID NO: 458029 - RNA, 23 nt, Brucella suis 1330
aaggaaaagcuggcauccagcac

SEQ ID NO: 458030 - RNA, 13 nt, Brucella suis 1330
aaggaaagcccag

SEQ ID NO: 458031 - RNA, 22 nt, Brucella suis 1330
aagcugcgucguggcaucauaa

SEQ ID NO: 458032 - RNA, 23 nt, Brucella suis 1330
aagcuuaacccaaccaccauuuu

SEQ ID NO: 458033 - RNA, 23 nt, Brucella suis 1330
aagcgcguacauuuuugaaaaca

SEQ ID NO: 458034 - RNA, 21 nt, Brucella suis 1330
aagccgaugcgcugaacaugg

SEQ ID NO: 458035 - RNA, 14 nt, Brucella suis 1330
aagcgugagcuuca

SEQ ID NO: 458036 - RNA, 14 nt, Brucella suis 1330
aagcucgcgucccg

SEQ ID NO: 458037 - RNA, 21 nt, Brucella suis 1330
aagcccguaccaacccuuuuc

SEQ ID NO: 458038 - RNA, 14 nt, Brucella suis 1330
aagccgaagaacag

SEQ ID NO: 458039 - RNA, 15 nt, Brucella suis 1330
aagccaguccuugcc

SEQ ID NO: 458040 - RNA, 16 nt, Brucella suis 1330
aagcccagaaauccau

SEQ ID NO: 458041 - RNA, 15 nt, Brucella suis 1330
aagcccagcgccuuc

SEQ ID NO: 458042 - RNA, 22 nt, Brucella suis 1330
aagccacgaagcgguugcugga

SEQ ID NO: 458043 - RNA, 14 nt, Brucella suis 1330
aagccagcccguga

SEQ ID NO: 458044 - RNA, 16 nt, Brucella suis 1330
aagcaggaucgacagc

SEQ ID NO: 458045 - RNA, 18 nt, Brucella suis 1330
aagcaggaucggcagcag

SEQ ID NO: 458046 - RNA, 20 nt, Brucella suis 1330
aagcaggcauuggcggauga

SEQ ID NO: 458047 - RNA, 14 nt, Brucella suis 1330
aagcauauugaagu

SEQ ID NO: 458048 - RNA, 24 nt, Brucella suis 1330
aagcaucugcucaaaacgauccag

SEQ ID NO: 458049 - RNA, 16 nt, Brucella suis 1330
aagcagacgggaagcg

SEQ ID NO: 458050 - RNA, 23 nt, Brucella suis 1330
aagcagcaaaaccguauaggcaa

SEQ ID NO: 458051 - RNA, 16 nt, Brucella suis 1330
aagcacuacgucaaca

SEQ ID NO: 458052 - RNA, 16 nt, Brucella suis 1330
aagcaccaugagcgcc

SEQ ID NO: 458053 - RNA, 18 nt, Brucella suis 1330
aagcaccaugagcgccgu

SEQ ID NO: 458054 - RNA, 16 nt, Brucella suis 1330
aagauugcggcugaua

SEQ ID NO: 458055 - RNA, 17 nt, Brucella suis 1330
aagaugcgcgccagccg

SEQ ID NO: 458056 - RNA, 15 nt, Brucella suis 1330
aagaugcuugaggau

SEQ ID NO: 458057 - RNA, 22 nt, Brucella suis 1330
aagaauucccggcugagcagau

SEQ ID NO: 458058 - RNA, 16 nt, Brucella suis 1330
aagaugagcgacagga

SEQ ID NO: 458059 - RNA, 22 nt, Brucella suis 1330
aagaagaugagcgacaggaaca

SEQ ID NO: 458060 - RNA, 21 nt, Brucella suis 1330
aagaagauuucguacugcaau

SEQ ID NO: 458061 - RNA, 17 nt, Brucella suis 1330
aagaacagaagcaccag

SEQ ID NO: 458062 - RNA, 19 nt, Brucella suis 1330
aagaaagcccggcgauuuc

SEQ ID NO: 458063 - RNA, 19 nt, Brucella suis 1330
aacuugcccgaugugauau

SEQ ID NO: 458064 - RNA, 15 nt, Brucella suis 1330
aacuggcgcagcagc

SEQ ID NO: 458065 - RNA, 22 nt, Brucella suis 1330
aacuggauccggcgaauggcuu

SEQ ID NO: 458066 - RNA, 16 nt, Brucella suis 1330
aacugcaucacaguca

SEQ ID NO: 458067 - RNA, 21 nt, Brucella suis 1330
aacugcggguaugcgcaugau

SEQ ID NO: 458068 - RNA, 19 nt, Brucella suis 1330
aacugcaccgucucguuga

SEQ ID NO: 458069 - RNA, 14 nt, Brucella suis 1330
aacuaccaucugcc

SEQ ID NO: 458070 - RNA, 13 nt, Brucella suis 1330
aacggucuggcgu

SEQ ID NO: 458071 - RNA, 21 nt, Brucella suis 1330
aacgguuuucggaaaagaugc

SEQ ID NO: 458072 - RNA, 12 nt, Brucella suis 1330
aacgcugcaaca

SEQ ID NO: 458073 - RNA, 18 nt, Brucella suis 1330
aacgcugcaacaaaugca

SEQ ID NO: 458074 - RNA, 14 nt, Brucella suis 1330
aacgccgaagcuug

SEQ ID NO: 458075 - RNA, 12 nt, Brucella suis 1330
aaccggaagcgc

SEQ ID NO: 458076 - RNA, 13 nt, Brucella suis 1330
aaccgcucuggaa

SEQ ID NO: 458077 - RNA, 13 nt, Brucella suis 1330
aaccgagcagccg

SEQ ID NO: 458078 - RNA, 24 nt, Brucella suis 1330
aaccgagcagccgcgaacgauugg

SEQ ID NO: 458079 - RNA, 19 nt, Brucella suis 1330
aacccggccucugcaagag

SEQ ID NO: 458080 - RNA, 13 nt, Brucella suis 1330
aacauacuccccu

SEQ ID NO: 458081 - RNA, 12 nt, Brucella suis 1330
aacauacugccu

SEQ ID NO: 458082 - RNA, 13 nt, Brucella suis 1330
aacagcagcaggg

SEQ ID NO: 458083 - RNA, 17 nt, Brucella suis 1330
aacagcauauugccgag

SEQ ID NO: 458084 - RNA, 21 nt, Brucella suis 1330
aacagcaagcccagaaaucca

SEQ ID NO: 458085 - RNA, 14 nt, Brucella suis 1330
aacacuucgaucga

SEQ ID NO: 458086 - RNA, 16 nt, Brucella suis 1330
aacaccgcgcaauaau

SEQ ID NO: 458087 - RNA, 21 nt, Brucella suis 1330
aacaccgcgcaauaaugcagc

SEQ ID NO: 458088 - RNA, 18 nt, Brucella suis 1330
aaaaagggcuuccugcaa

SEQ ID NO: 458089 - RNA, 18 nt, Brucella suis 1330
cggcgauuucgccgggcu

SEQ ID NO: 458090 - RNA, 14 nt, Brucella suis 1330
cggcgcaaaggccg

SEQ ID NO: 458091 - RNA, 15 nt, Brucella suis 1330
cggccuuuuugucag

SEQ ID NO: 458092 - RNA, 20 nt, Brucella suis 1330
cggccuugacggagagaggg

SEQ ID NO: 458093 - RNA, 15 nt, Brucella suis 1330
cggccuuugcgccgg

SEQ ID NO: 458094 - RNA, 16 nt, Brucella suis 1330
cggccuuugcgccggg

SEQ ID NO: 458095 - RNA, 17 nt, Brucella suis 1330
cggccuugaucggcaug

SEQ ID NO: 458096 - RNA, 19 nt, Brucella suis 1330
cggccuggucuagccgcgc

SEQ ID NO: 458097 - RNA, 16 nt, Brucella suis 1330
cggccuaccauauccu

SEQ ID NO: 458098 - RNA, 19 nt, Brucella suis 1330
cggcccuggaaagaagcga

SEQ ID NO: 458099 - RNA, 23 nt, Brucella suis 1330
cggcccggucacccgcacgccgu

SEQ ID NO: 458100 - RNA, 14 nt, Brucella suis 1330
cggccauuucaggu

SEQ ID NO: 458101 - RNA, 12 nt, Brucella suis 1330
cggccacgcgca

SEQ ID NO: 458102 - RNA, 14 nt, Brucella suis 1330
cggccacgcgcaga

SEQ ID NO: 458103 - RNA, 15 nt, Brucella suis 1330
cggccacgaaauggg

SEQ ID NO: 458104 - RNA, 15 nt, Brucella suis 1330
cggccacaagcgccg

SEQ ID NO: 458105 - RNA, 15 nt, Brucella suis 1330
cggcauugagccgcg

SEQ ID NO: 458106 - RNA, 17 nt, Brucella suis 1330
cggcauugccugugcca

SEQ ID NO: 458107 - RNA, 18 nt, Brucella suis 1330
cggcaccgcaaagagaac

SEQ ID NO: 458108 - RNA, 16 nt, Brucella suis 1330
cggcaaucagaucggu

SEQ ID NO: 458109 - RNA, 15 nt, Brucella suis 1330
cggcaaggccgcgcu

SEQ ID NO: 458110 - RNA, 19 nt, Brucella suis 1330
cggcaaggccgcgcuccag

SEQ ID NO: 458111 - RNA, 21 nt, Brucella suis 1330
cggcaaggccgcgcuccagau

SEQ ID NO: 458112 - RNA, 12 nt, Brucella suis 1330
cggcaagcugcu

SEQ ID NO: 458113 - RNA, 13 nt, Brucella suis 1330
cggcaagauggcu

SEQ ID NO: 458114 - RNA, 22 nt, Brucella suis 1330
cggcaagauagccccagcccgc

SEQ ID NO: 458115 - RNA, 14 nt, Brucella suis 1330
cggcaacgggcgag

SEQ ID NO: 458116 - RNA, 19 nt, Brucella suis 1330
cggcaaaggccgccgucgc

SEQ ID NO: 458117 - RNA, 22 nt, Brucella suis 1330
cggcaaaugucacgcucgucgg

SEQ ID NO: 458118 - RNA, 18 nt, Brucella suis 1330
cggauuuuucucaaugcg

SEQ ID NO: 458119 - RNA, 17 nt, Brucella suis 1330
cggauuggcguucacau

SEQ ID NO: 458120 - RNA, 17 nt, Brucella suis 1330
cggauucuuaugccaga

SEQ ID NO: 458121 - RNA, 18 nt, Brucella suis 1330
cggaugcgcacauauuug

SEQ ID NO: 458122 - RNA, 19 nt, Brucella suis 1330
cggaugcggaaacccgacc

SEQ ID NO: 458123 - RNA, 23 nt, Brucella suis 1330
cggaugcgaccucgucaaaaccg

SEQ ID NO: 458124 - RNA, 23 nt, Brucella suis 1330
cggaucgugacccgcccuucauc

SEQ ID NO: 458125 - RNA, 17 nt, Brucella suis 1330
cggaucgugagguucuu

SEQ ID NO: 458126 - RNA, 15 nt, Brucella suis 1330
cggaucggccagaua

SEQ ID NO: 458127 - RNA, 17 nt, Brucella suis 1330
cggaucauccauuccuc

SEQ ID NO: 458128 - RNA, 22 nt, Brucella suis 1330
cggaucauccuugaugcccagc

SEQ ID NO: 458129 - RNA, 13 nt, Brucella suis 1330
cggauauggucgu

SEQ ID NO: 458130 - RNA, 16 nt, Brucella suis 1330
cggauaucuuccugaa

SEQ ID NO: 458131 - RNA, 16 nt, Brucella suis 1330
cggauaagaugcgcgc

SEQ ID NO: 458132 - RNA, 14 nt, Brucella suis 1330
cggauaauagauga

SEQ ID NO: 458133 - RNA, 18 nt, Brucella suis 1330
cggagguucgaauccucu

SEQ ID NO: 458134 - RNA, 11 nt, Brucella suis 1330
cggaggcuucc

SEQ ID NO: 458135 - RNA, 12 nt, Brucella suis 1330
cggaggcuuccg

SEQ ID NO: 458136 - RNA, 20 nt, Brucella suis 1330
cggagcggaguguacuguua

SEQ ID NO: 458137 - RNA, 18 nt, Brucella suis 1330
cggagcguccgagcggca

SEQ ID NO: 458138 - RNA, 21 nt, Brucella suis 1330
cggagcguccgagcggcagcg

SEQ ID NO: 458139 - RNA, 21 nt, Brucella suis 1330
cggagcuaaaguaucucucgc

SEQ ID NO: 458140 - RNA, 21 nt, Brucella suis 1330
cggagccgaagucacgauggc

SEQ ID NO: 458141 - RNA, 21 nt, Brucella suis 1330
cggagccucaucggcgggcca

SEQ ID NO: 458142 - RNA, 17 nt, Brucella suis 1330
cggagagagggccgcuc

SEQ ID NO: 458143 - RNA, 14 nt, Brucella suis 1330
cggacggauggcau

SEQ ID NO: 458144 - RNA, 15 nt, Brucella suis 1330
cggacgaccauggcg

SEQ ID NO: 458145 - RNA, 16 nt, Brucella suis 1330
cggaccgugccgcuuc

SEQ ID NO: 458146 - RNA, 17 nt, Brucella suis 1330
cggaauucauccgccuu

SEQ ID NO: 458147 - RNA, 18 nt, Brucella suis 1330
cggaaugggccugaugau

SEQ ID NO: 458148 - RNA, 18 nt, Brucella suis 1330
cggaauagaugagcagua

SEQ ID NO: 458149 - RNA, 15 nt, Brucella suis 1330
cggaagggcaaggcg

SEQ ID NO: 458150 - RNA, 18 nt, Brucella suis 1330
cggaacgcugaucgccuu

SEQ ID NO: 458151 - RNA, 13 nt, Brucella suis 1330
cggaaagggcugc

SEQ ID NO: 458152 - RNA, 19 nt, Brucella suis 1330
cggaaagguguccuccagc

SEQ ID NO: 458153 - RNA, 15 nt, Brucella suis 1330
cggaaaaugcccggc

SEQ ID NO: 458154 - RNA, 14 nt, Brucella suis 1330
cggaaacccgacca

SEQ ID NO: 458155 - RNA, 20 nt, Brucella suis 1330
cggaaacgcgugccagcauu

SEQ ID NO: 458156 - RNA, 15 nt, Brucella suis 1330
cggaacaaugcaauc

SEQ ID NO: 458157 - RNA, 21 nt, Brucella suis 1330
cggaacaggcagcaugaacca

SEQ ID NO: 458158 - RNA, 14 nt, Brucella suis 1330
cggaaccaaggucu

SEQ ID NO: 458159 - RNA, 18 nt, Brucella suis 1330
cggaaccauggcugcgau

SEQ ID NO: 458160 - RNA, 18 nt, Brucella suis 1330
cggaaaacggcugcaaca

SEQ ID NO: 458161 - RNA, 20 nt, Brucella suis 1330
cgcuuuuacgcgccgccagg

SEQ ID NO: 458162 - RNA, 20 nt, Brucella suis 1330
cgcuuucuucgauggugagu

SEQ ID NO: 458163 - RNA, 17 nt, Brucella suis 1330
cgcuacccauucauuuc

SEQ ID NO: 458164 - RNA, 19 nt, Brucella suis 1330
cgcgugaaaauagcugggu

SEQ ID NO: 458165 - RNA, 21 nt, Brucella suis 1330
cgcgucuuauaguuuucuggc

SEQ ID NO: 458166 - RNA, 15 nt, Brucella suis 1330
cgcguccuucaggcc

SEQ ID NO: 458167 - RNA, 16 nt, Brucella suis 1330
cgcguccuucaggccg

SEQ ID NO: 458168 - RNA, 18 nt, Brucella suis 1330
cgcggcuugcgcgacgau

SEQ ID NO: 458169 - RNA, 23 nt, Brucella suis 1330
cgcggcgaaacgccugucacgau

SEQ ID NO: 458170 - RNA, 13 nt, Brucella suis 1330
cgcggccacaagc

SEQ ID NO: 458171 - RNA, 15 nt, Brucella suis 1330
cgcgcuuaugaucug

SEQ ID NO: 458172 - RNA, 13 nt, Brucella suis 1330
cgcgcgcgcgcag

SEQ ID NO: 458173 - RNA, 14 nt, Brucella suis 1330
cgcgccgccuucaa

SEQ ID NO: 458174 - RNA, 14 nt, Brucella suis 1330
cgcgcccgccacau

SEQ ID NO: 458175 - RNA, 13 nt, Brucella suis 1330
cgcgcccaccacg

SEQ ID NO: 458176 - RNA, 13 nt, Brucella suis 1330
cgcgccaauccag

SEQ ID NO: 458177 - RNA, 17 nt, Brucella suis 1330
cgcgccaaacugcaccg

SEQ ID NO: 458178 - RNA, 15 nt, Brucella suis 1330
cgcgcauugacgcgc

SEQ ID NO: 458179 - RNA, 17 nt, Brucella suis 1330
cgcgcauugacgcgcac

SEQ ID NO: 458180 - RNA, 14 nt, Brucella suis 1330
cgcgcagacgcagc

SEQ ID NO: 458181 - RNA, 12 nt, Brucella suis 1330
cgcgcagaaggc

SEQ ID NO: 458182 - RNA, 19 nt, Brucella suis 1330
cgcgcaccgauggagcgcc

SEQ ID NO: 458183 - RNA, 20 nt, Brucella suis 1330
cgcgcaacacgcgcuccagc

SEQ ID NO: 458184 - RNA, 17 nt, Brucella suis 1330
cgcgcaaaaucugcucg

SEQ ID NO: 458185 - RNA, 15 nt, Brucella suis 1330
cgcgauggaccauau

SEQ ID NO: 458186 - RNA, 22 nt, Brucella suis 1330
cgcgaugauggcagaccccauc

SEQ ID NO: 458187 - RNA, 14 nt, Brucella suis 1330
cgcgaucacggcca

SEQ ID NO: 458188 - RNA, 19 nt, Brucella suis 1330
cgcgacugucaccgccagc

SEQ ID NO: 458189 - RNA, 22 nt, Brucella suis 1330
cgcgaagaccuucuggaagcgc

SEQ ID NO: 458190 - RNA, 19 nt, Brucella suis 1330
cgcgaaaccauggagcgca

SEQ ID NO: 458191 - RNA, 19 nt, Brucella suis 1330
cgccuuuugcggggcuucc

SEQ ID NO: 458192 - RNA, 14 nt, Brucella suis 1330
cgccuugcgccgca

SEQ ID NO: 458193 - RNA, 23 nt, Brucella suis 1330
cgccuugcagaugagcggcagca

SEQ ID NO: 458194 - RNA, 24 nt, Brucella suis 1330
cgccuugcggcauauccggaccga

SEQ ID NO: 458195 - RNA, 13 nt, Brucella suis 1330
cgccuugcuugaa

SEQ ID NO: 458196 - RNA, 18 nt, Brucella suis 1330
cgccuuuaccgccggggc

SEQ ID NO: 458197 - RNA, 14 nt, Brucella suis 1330
cgccuuugccgcgc

SEQ ID NO: 458198 - RNA, 16 nt, Brucella suis 1330
cgccugugugaacagg

SEQ ID NO: 458199 - RNA, 23 nt, Brucella suis 1330
cgccugcuuccuuuucggcuucc

SEQ ID NO: 458200 - RNA, 12 nt, Brucella suis 1330
cgccugcugcca

SEQ ID NO: 458201 - RNA, 12 nt, Brucella suis 1330
cgccgucgggac

SEQ ID NO: 458202 - RNA, 23 nt, Brucella suis 1330
cgccgucgggaccaccggccuga

SEQ ID NO: 458203 - RNA, 13 nt, Brucella suis 1330
cgccgguuuuccg

SEQ ID NO: 458204 - RNA, 13 nt, Brucella suis 1330
cgccggcgccgcc

SEQ ID NO: 458205 - RNA, 20 nt, Brucella suis 1330
cgccggaccgugccgcuucc

SEQ ID NO: 458206 - RNA, 16 nt, Brucella suis 1330
cgccggaaugggccug

SEQ ID NO: 458207 - RNA, 16 nt, Brucella suis 1330
cgccgcuuucuuccag

SEQ ID NO: 458208 - RNA, 21 nt, Brucella suis 1330
cgccgcuuucuuccagcuugc

SEQ ID NO: 458209 - RNA, 22 nt, Brucella suis 1330
cgccgcgucuuauaguuuucug

SEQ ID NO: 458210 - RNA, 14 nt, Brucella suis 1330
aaacguacauuguu

SEQ ID NO: 458211 - RNA, 14 nt, Brucella suis 1330
cgccgcgcacuggc

SEQ ID NO: 458212 - RNA, 20 nt, Brucella suis 1330
cgccgcgauugcaucggcag

SEQ ID NO: 458213 - RNA, 12 nt, Brucella suis 1330
cgccgccuucaa

SEQ ID NO: 458214 - RNA, 22 nt, Brucella suis 1330
cgccgccuucaaaacgcagcau

SEQ ID NO: 458215 - RNA, 20 nt, Brucella suis 1330
cgccgcccaggaccgcgcag

SEQ ID NO: 458216 - RNA, 21 nt, Brucella suis 1330
cgccgcccaggaccgcgcaga

SEQ ID NO: 458217 - RNA, 14 nt, Brucella suis 1330
cgccgcacuuacaa

SEQ ID NO: 458218 - RNA, 11 nt, Brucella suis 1330
cgccgcagacc

SEQ ID NO: 458219 - RNA, 16 nt, Brucella suis 1330
cgccgauauccucgaa

SEQ ID NO: 458220 - RNA, 23 nt, Brucella suis 1330
cgccgaggaggggacgcagccuu

SEQ ID NO: 458221 - RNA, 16 nt, Brucella suis 1330
cgccgagauugggcag

SEQ ID NO: 458222 - RNA, 23 nt, Brucella suis 1330
cgccgacaaaaaacaccgcgcaa

SEQ ID NO: 458223 - RNA, 13 nt, Brucella suis 1330
cgcccgcccccgc

SEQ ID NO: 458224 - RNA, 11 nt, Brucella suis 1330
cgcccgcccgc

SEQ ID NO: 458225 - RNA, 19 nt, Brucella suis 1330
cgcccgauauccggcuggg

SEQ ID NO: 458226 - RNA, 18 nt, Brucella suis 1330
cgcccgacaaagaucauc

SEQ ID NO: 458227 - RNA, 23 nt, Brucella suis 1330
cgccccgcgugaugagccgcuuc

SEQ ID NO: 458228 - RNA, 15 nt, Brucella suis 1330
cgcccauuuucucca

SEQ ID NO: 458229 - RNA, 23 nt, Brucella suis 1330
cgcccagggcagauauuucaugg

SEQ ID NO: 458230 - RNA, 13 nt, Brucella suis 1330
cgcccaggcgccc

SEQ ID NO: 458231 - RNA, 17 nt, Brucella suis 1330
cgcccaccacgacaaaa

SEQ ID NO: 458232 - RNA, 16 nt, Brucella suis 1330
cgccaugccauccucg

SEQ ID NO: 458233 - RNA, 23 nt, Brucella suis 1330
cgccaugcacccgucgcuaccau

SEQ ID NO: 458234 - RNA, 17 nt, Brucella suis 1330
cgccacggauuuccacc

SEQ ID NO: 458235 - RNA, 13 nt, Brucella suis 1330
cgccaccggcggc

SEQ ID NO: 458236 - RNA, 13 nt, Brucella suis 1330
cgccacaugggcg

SEQ ID NO: 458237 - RNA, 18 nt, Brucella suis 1330
cgccaaugcccugcugca

SEQ ID NO: 458238 - RNA, 14 nt, Brucella suis 1330
cgccaagccagccc

SEQ ID NO: 458239 - RNA, 16 nt, Brucella suis 1330
cgccaauaccgugauc

SEQ ID NO: 458240 - RNA, 22 nt, Brucella suis 1330
cgccaagaagaacacagccccu

SEQ ID NO: 458241 - RNA, 14 nt, Brucella suis 1330
cgccaaaagauucc

SEQ ID NO: 458242 - RNA, 17 nt, Brucella suis 1330
cgccaaagaccagcagg

SEQ ID NO: 458243 - RNA, 20 nt, Brucella suis 1330
cgcauucuggacgugcuggu

SEQ ID NO: 458244 - RNA, 17 nt, Brucella suis 1330
cgcauucagagcuucau

SEQ ID NO: 458245 - RNA, 20 nt, Brucella suis 1330
cgcauggguggugcccggug

SEQ ID NO: 458246 - RNA, 22 nt, Brucella suis 1330
cgcaugaacaugcgccacuucc

SEQ ID NO: 458247 - RNA, 22 nt, Brucella suis 1330
cgcaucuuuuccgaaaaccguu

SEQ ID NO: 458248 - RNA, 17 nt, Brucella suis 1330
cgcaucggucagcacgc

SEQ ID NO: 458249 - RNA, 22 nt, Brucella suis 1330
cgcaucgacaaucuccccuucc

SEQ ID NO: 458250 - RNA, 17 nt, Brucella suis 1330
cgcaucauccugagcuu

SEQ ID NO: 458251 - RNA, 16 nt, Brucella suis 1330
cgcauagagccacgag

SEQ ID NO: 458252 - RNA, 21 nt, Brucella suis 1330
cgcaggcuuuauuccaucagc

SEQ ID NO: 458253 - RNA, 20 nt, Brucella suis 1330
cgcaggcggaugaagcgccg

SEQ ID NO: 458254 - RNA, 21 nt, Brucella suis 1330
cgcaggcagggaggagccgau

SEQ ID NO: 458255 - RNA, 15 nt, Brucella suis 1330
cgcagcgucgagcag

SEQ ID NO: 458256 - RNA, 16 nt, Brucella suis 1330
cgcaggacaagccgcu

SEQ ID NO: 458257 - RNA, 18 nt, Brucella suis 1330
cgcaccugacggcgcagc

SEQ ID NO: 458258 - RNA, 12 nt, Brucella suis 1330
cgcacauccaua

SEQ ID NO: 458259 - RNA, 21 nt, Brucella suis 1330
cgcaacgcaauggagcaggaa

SEQ ID NO: 458260 - RNA, 15 nt, Brucella suis 1330
cgcaaccaugcguuu

SEQ ID NO: 458261 - RNA, 17 nt, Brucella suis 1330
cgcaaaggcaggcacac

SEQ ID NO: 458262 - RNA, 19 nt, Brucella suis 1330
cgcaaaggcaggcacaccc

SEQ ID NO: 458263 - RNA, 18 nt, Brucella suis 1330
cgcaaaggccggguuuuu

SEQ ID NO: 458264 - RNA, 17 nt, Brucella suis 1330
cgauugucgagccgcaa

SEQ ID NO: 458265 - RNA, 15 nt, Brucella suis 1330
cgauugcgcauugac

SEQ ID NO: 458266 - RNA, 16 nt, Brucella suis 1330
cgcaaaaaaggcgcga

SEQ ID NO: 458267 - RNA, 17 nt, Brucella suis 1330
cgcaaaagagaaacccc

SEQ ID NO: 458268 - RNA, 12 nt, Brucella suis 1330
cgcaaagagaac

SEQ ID NO: 458269 - RNA, 13 nt, Brucella suis 1330
cgaugccugccgg

SEQ ID NO: 458270 - RNA, 23 nt, Brucella suis 1330
cgaugauggcagaccccaucagc

SEQ ID NO: 458271 - RNA, 21 nt, Brucella suis 1330
cgaugaucuguucagccgcag

SEQ ID NO: 458272 - RNA, 14 nt, Brucella suis 1330
cgauaucugcaaca

SEQ ID NO: 458273 - RNA, 22 nt, Brucella suis 1330
cgauacagcccaugacagcaac

SEQ ID NO: 458274 - RNA, 15 nt, Brucella suis 1330
cgauaaacccgcccc

SEQ ID NO: 458275 - RNA, 20 nt, Brucella suis 1330
cgauaaagaugcgcgccagc

SEQ ID NO: 458276 - RNA, 16 nt, Brucella suis 1330
cgagugcggccugcac

SEQ ID NO: 458277 - RNA, 16 nt, Brucella suis 1330
cgaguggucugggcga

SEQ ID NO: 458278 - RNA, 20 nt, Brucella suis 1330
cgaggucucccggcacgacc

SEQ ID NO: 458279 - RNA, 23 nt, Brucella suis 1330
cgaggggaugggggccgggcgca

SEQ ID NO: 458280 - RNA, 23 nt, Brucella suis 1330
cgaggccauggcuucaagcggcg

SEQ ID NO: 458281 - RNA, 13 nt, Brucella suis 1330
cgaggaagagaau

SEQ ID NO: 458282 - RNA, 18 nt, Brucella suis 1330
cgaggaaauugacgccau

SEQ ID NO: 458283 - RNA, 18 nt, Brucella suis 1330
cgagcugacgaauaauga

SEQ ID NO: 458284 - RNA, 14 nt, Brucella suis 1330
cgagcggcaggccg

SEQ ID NO: 458285 - RNA, 17 nt, Brucella suis 1330
cgagcgcagcggcagca

SEQ ID NO: 458286 - RNA, 17 nt, Brucella suis 1330
cgagcgcaucggccagc

SEQ ID NO: 458287 - RNA, 13 nt, Brucella suis 1330
cgagcaaugauag

SEQ ID NO: 458288 - RNA, 19 nt, Brucella suis 1330
cgagauggccuugugcaga

SEQ ID NO: 458289 - RNA, 22 nt, Brucella suis 1330
cgagaucgaccgccuugagauc

SEQ ID NO: 458290 - RNA, 22 nt, Brucella suis 1330
cgagaucgucugaacggaucuu

SEQ ID NO: 458291 - RNA, 13 nt, Brucella suis 1330
cgagacggaacgc

SEQ ID NO: 458292 - RNA, 15 nt, Brucella suis 1330
cgagacaaggcaaug

SEQ ID NO: 458293 - RNA, 21 nt, Brucella suis 1330
cgagaagcgguguggcccggu

SEQ ID NO: 458294 - RNA, 18 nt, Brucella suis 1330
cgagaagcucaacgccgu

SEQ ID NO: 458295 - RNA, 21 nt, Brucella suis 1330
cgagaaugaggccgaugauga

SEQ ID NO: 458296 - RNA, 17 nt, Brucella suis 1330
cgagaacccguuccuug

SEQ ID NO: 458297 - RNA, 16 nt, Brucella suis 1330
cgagaaccagcggcca

SEQ ID NO: 458298 - RNA, 14 nt, Brucella suis 1330
cgacuugaagagcc

SEQ ID NO: 458299 - RNA, 20 nt, Brucella suis 1330
cgacugucaccgccagcaga

SEQ ID NO: 458300 - RNA, 22 nt, Brucella suis 1330
cgaauagcgcaucgccaccguu

SEQ ID NO: 458301 - RNA, 21 nt, Brucella suis 1330
cgaauaggcgcgcacauccau

SEQ ID NO: 458302 - RNA, 20 nt, Brucella suis 1330
cgaauagggaaacggccagg

SEQ ID NO: 458303 - RNA, 17 nt, Brucella suis 1330
cgaauacaagcccaaga

SEQ ID NO: 458304 - RNA, 14 nt, Brucella suis 1330
cgaagggcugaggg

SEQ ID NO: 458305 - RNA, 17 nt, Brucella suis 1330
cgaagcgggaucagaaa

SEQ ID NO: 458306 - RNA, 19 nt, Brucella suis 1330
cgaagauaagcggcaaagg

SEQ ID NO: 458307 - RNA, 12 nt, Brucella suis 1330
cgaacgggaaca

SEQ ID NO: 458308 - RNA, 21 nt, Brucella suis 1330
cgaagacgaucuuuuccauau

SEQ ID NO: 458309 - RNA, 20 nt, Brucella suis 1330
cgaaccagauccaccgcgcu

SEQ ID NO: 458310 - RNA, 16 nt, Brucella suis 1330
cgaacagguugcgcca

SEQ ID NO: 458311 - RNA, 16 nt, Brucella suis 1330
cgaacagaucgccaag

SEQ ID NO: 458312 - RNA, 16 nt, Brucella suis 1330
cgaaaugcgcgcggca

SEQ ID NO: 458313 - RNA, 14 nt, Brucella suis 1330
cgaaaugcgcggcg

SEQ ID NO: 458314 - RNA, 11 nt, Brucella suis 1330
cgaaagcggcg

SEQ ID NO: 458315 - RNA, 23 nt, Brucella suis 1330
cgaaauagauguucuuccccguc

SEQ ID NO: 458316 - RNA, 18 nt, Brucella suis 1330
cgaaaauaucggcugucu

SEQ ID NO: 458317 - RNA, 14 nt, Brucella suis 1330
cgaaaauggugaug

SEQ ID NO: 458318 - RNA, 12 nt, Brucella suis 1330
cgaaaaaagaau

SEQ ID NO: 458319 - RNA, 20 nt, Brucella suis 1330
cgaaaaccguucacacuuuu

SEQ ID NO: 458320 - RNA, 17 nt, Brucella suis 1330
cgaaaaccguuucacac

SEQ ID NO: 458321 - RNA, 21 nt, Brucella suis 1330
cgaaaaccguuucacacuuuu

SEQ ID NO: 458322 - RNA, 18 nt, Brucella suis 1330
ccuuuuuccugaucuugc

SEQ ID NO: 458323 - RNA, 22 nt, Brucella suis 1330
ccuuuucagcggagauuucacc

SEQ ID NO: 458324 - RNA, 23 nt, Brucella suis 1330
ccuuuuccgcaaaaaucuucucg

SEQ ID NO: 458325 - RNA, 20 nt, Brucella suis 1330
ccuugccgucaacagccuug

SEQ ID NO: 458326 - RNA, 18 nt, Brucella suis 1330
ccuugcgauuuccuugcc

SEQ ID NO: 458327 - RNA, 20 nt, Brucella suis 1330
ccuugcgcaccgcacgcaag

SEQ ID NO: 458328 - RNA, 23 nt, Brucella suis 1330
ccuugcccccacaacugcgggua

SEQ ID NO: 458329 - RNA, 18 nt, Brucella suis 1330
ccuugccccggcaccgcg

SEQ ID NO: 458330 - RNA, 21 nt, Brucella suis 1330
ccuugcagaugagcggcagca

SEQ ID NO: 458331 - RNA, 23 nt, Brucella suis 1330
ccuugcagaugagcggcagcagc

SEQ ID NO: 458332 - RNA, 17 nt, Brucella suis 1330
ccuugaugauagaauaa

SEQ ID NO: 458333 - RNA, 22 nt, Brucella suis 1330
ccuugauccgucacggucagau

SEQ ID NO: 458334 - RNA, 22 nt, Brucella suis 1330
ccuugaucguauagcccugauc

SEQ ID NO: 458335 - RNA, 17 nt, Brucella suis 1330
ccuucuggaaaagugca

SEQ ID NO: 458336 - RNA, 13 nt, Brucella suis 1330
ccuucggcugcuu

SEQ ID NO: 458337 - RNA, 16 nt, Brucella suis 1330
ccuucggcugcuuccg

SEQ ID NO: 458338 - RNA, 19 nt, Brucella suis 1330
ccuguucaauaagcuuuuc

SEQ ID NO: 458339 - RNA, 19 nt, Brucella suis 1330
ccuguggagagaggaagca

SEQ ID NO: 458340 - RNA, 23 nt, Brucella suis 1330
ccuguggcuguuucgcauugccc

SEQ ID NO: 458341 - RNA, 18 nt, Brucella suis 1330
ccuguguucggcaacgcc

SEQ ID NO: 458342 - RNA, 22 nt, Brucella suis 1330
ccuguucaagcaguaugauuug

SEQ ID NO: 458343 - RNA, 17 nt, Brucella suis 1330
ccugugcggcugcaaau

SEQ ID NO: 458344 - RNA, 14 nt, Brucella suis 1330
ccugugcauugcca

SEQ ID NO: 458345 - RNA, 19 nt, Brucella suis 1330
ccugcugcaacaaaaugcc

SEQ ID NO: 458346 - RNA, 13 nt, Brucella suis 1330
ccugcgucgggug

SEQ ID NO: 458347 - RNA, 19 nt, Brucella suis 1330
ccugcggaaugcccuggau

SEQ ID NO: 458348 - RNA, 17 nt, Brucella suis 1330
ccugcgcgcgcauggcg

SEQ ID NO: 458349 - RNA, 12 nt, Brucella suis 1330
ccugcgcccugu

SEQ ID NO: 458350 - RNA, 22 nt, Brucella suis 1330
ccugcgaugcgccagcgaugau

SEQ ID NO: 458351 - RNA, 13 nt, Brucella suis 1330
ccugccggucccg

SEQ ID NO: 458352 - RNA, 22 nt, Brucella suis 1330
ccugccggucccgugucggagc

SEQ ID NO: 458353 - RNA, 22 nt, Brucella suis 1330
ccugccgcgccgaaccgggccg

SEQ ID NO: 458354 - RNA, 21 nt, Brucella suis 1330
ccugcauaucgauaucaugcu

SEQ ID NO: 458355 - RNA, 12 nt, Brucella suis 1330
ccugcaaaagcg

SEQ ID NO: 458356 - RNA, 20 nt, Brucella suis 1330
ccugcaaaccggcugccgca

SEQ ID NO: 458357 - RNA, 13 nt, Brucella suis 1330
ccugaugcaaugc

SEQ ID NO: 458358 - RNA, 21 nt, Brucella suis 1330
ccugaugccguuuucaucaaa

SEQ ID NO: 458359 - RNA, 19 nt, Brucella suis 1330
ccugaucguguugaccaca

SEQ ID NO: 458360 - RNA, 18 nt, Brucella suis 1330
ccugaccggccacccagc

SEQ ID NO: 458361 - RNA, 22 nt, Brucella suis 1330
ccugaccggccacccagcccga

SEQ ID NO: 458362 - RNA, 14 nt, Brucella suis 1330
ccugacccauggcc

SEQ ID NO: 458363 - RNA, 19 nt, Brucella suis 1330
ccugacccauggccugcug

SEQ ID NO: 458364 - RNA, 21 nt, Brucella suis 1330
ccugacccggccuuugcgccg

SEQ ID NO: 458365 - RNA, 20 nt, Brucella suis 1330
ccucuucguccucgcgccag

SEQ ID NO: 458366 - RNA, 21 nt, Brucella suis 1330
ccucuaaucgcgagcagcgcg

SEQ ID NO: 458367 - RNA, 23 nt, Brucella suis 1330
ccucugccuccauggcgucccca

SEQ ID NO: 458368 - RNA, 14 nt, Brucella suis 1330
ccucguuugcacuu

SEQ ID NO: 458369 - RNA, 21 nt, Brucella suis 1330
ccucguuuuugacugcugcca

SEQ ID NO: 458370 - RNA, 14 nt, Brucella suis 1330
ccucggugcagccg

SEQ ID NO: 458371 - RNA, 18 nt, Brucella suis 1330
ccucggcccuggaaagaa

SEQ ID NO: 458372 - RNA, 17 nt, Brucella suis 1330
ccucgcggaaaagcucg

SEQ ID NO: 458373 - RNA, 22 nt, Brucella suis 1330
ccuccgacaccagccguuccag

SEQ ID NO: 458374 - RNA, 20 nt, Brucella suis 1330
ccucaccuugccgggcgggc

SEQ ID NO: 458375 - RNA, 16 nt, Brucella suis 1330
ccucaagauacaaaaa

SEQ ID NO: 458376 - RNA, 17 nt, Brucella suis 1330
ccuauuccccuauuccc

SEQ ID NO: 458377 - RNA, 15 nt, Brucella suis 1330
ccgugcggccuugcg

SEQ ID NO: 458378 - RNA, 17 nt, Brucella suis 1330
ccgugcgauagcccucu

SEQ ID NO: 458379 - RNA, 17 nt, Brucella suis 1330
ccgucgggaccaccggc

SEQ ID NO: 458380 - RNA, 14 nt, Brucella suis 1330
ccgucgccgaccgc

SEQ ID NO: 458381 - RNA, 17 nt, Brucella suis 1330
ccguccuucaccacgau

SEQ ID NO: 458382 - RNA, 16 nt, Brucella suis 1330
ccgucauucaucagca

SEQ ID NO: 458383 - RNA, 12 nt, Brucella suis 1330
ccgucaaaaggu

SEQ ID NO: 458384 - RNA, 21 nt, Brucella suis 1330
ccguaucacgccgcgacuccu

SEQ ID NO: 458385 - RNA, 13 nt, Brucella suis 1330
ccguaauggcgcg

SEQ ID NO: 458386 - RNA, 16 nt, Brucella suis 1330
ccggugccggcaggcu

SEQ ID NO: 458387 - RNA, 17 nt, Brucella suis 1330
ccgggcggcgcggcggc

SEQ ID NO: 458388 - RNA, 22 nt, Brucella suis 1330
ccgggcggcuugccagaugugc

SEQ ID NO: 458389 - RNA, 20 nt, Brucella suis 1330
aaaccucgggcagggucaaa

SEQ ID NO: 458390 - RNA, 20 nt, Brucella suis 1330
ccgggacaaucuugcgcagc

SEQ ID NO: 458391 - RNA, 22 nt, Brucella suis 1330
ccgggaaaucugcgcgcgcgca

SEQ ID NO: 458392 - RNA, 21 nt, Brucella suis 1330
ccggcuuucgccgggguuucu

SEQ ID NO: 458393 - RNA, 13 nt, Brucella suis 1330
ccggcuucggcca

SEQ ID NO: 458394 - RNA, 13 nt, Brucella suis 1330
ccggcucugcgga

SEQ ID NO: 458395 - RNA, 22 nt, Brucella suis 1330
aaaccgcuucgcacuuuugcug

SEQ ID NO: 458396 - RNA, 19 nt, Brucella suis 1330
ccggcggaaggcugaguga

SEQ ID NO: 458397 - RNA, 22 nt, Brucella suis 1330
ccggcgcgggcuuuccagcccc

SEQ ID NO: 458398 - RNA, 18 nt, Brucella suis 1330
ccggcgcggucggcgcca

SEQ ID NO: 458399 - RNA, 16 nt, Brucella suis 1330
ccggcgcaucuguucu

SEQ ID NO: 458400 - RNA, 22 nt, Brucella suis 1330
ccggccugaugccuugggaggc

SEQ ID NO: 458401 - RNA, 16 nt, Brucella suis 1330
ccggcccauaccgcgc

SEQ ID NO: 458402 - RNA, 16 nt, Brucella suis 1330
ccggcccacccaccgc

SEQ ID NO: 458403 - RNA, 17 nt, Brucella suis 1330
ccggcccacccaccgcc

SEQ ID NO: 458404 - RNA, 16 nt, Brucella suis 1330
ccggcccaaaggccgc

SEQ ID NO: 458405 - RNA, 20 nt, Brucella suis 1330
ccggcccaaaggccgcgccg

SEQ ID NO: 458406 - RNA, 16 nt, Brucella suis 1330
ccggauacaugcagau

SEQ ID NO: 458407 - RNA, 14 nt, Brucella suis 1330
ccggagcgaccagc

SEQ ID NO: 458408 - RNA, 18 nt, Brucella suis 1330
ccggacgugacaucaagc

SEQ ID NO: 458409 - RNA, 23 nt, Brucella suis 1330
ccggacgugacaucaagccccuu

SEQ ID NO: 458410 - RNA, 17 nt, Brucella suis 1330
ccggaagagccgggcug

SEQ ID NO: 458411 - RNA, 14 nt, Brucella suis 1330
ccggaagccgccuu

SEQ ID NO: 458412 - RNA, 17 nt, Brucella suis 1330
ccggaaccgaccugcuu

SEQ ID NO: 458413 - RNA, 14 nt, Brucella suis 1330
ccgcugccagcuac

SEQ ID NO: 458414 - RNA, 13 nt, Brucella suis 1330
ccgcugaggcggc

SEQ ID NO: 458415 - RNA, 18 nt, Brucella suis 1330
ccgcugaggcggccggag

SEQ ID NO: 458416 - RNA, 19 nt, Brucella suis 1330
ccgcucucggcuccggauc

SEQ ID NO: 458417 - RNA, 16 nt, Brucella suis 1330
ccgcucuaacuauuug

SEQ ID NO: 458418 - RNA, 16 nt, Brucella suis 1330
ccgcucgcccuccgga

SEQ ID NO: 458419 - RNA, 20 nt, Brucella suis 1330
ccgcuccagccgagcgccag

SEQ ID NO: 458420 - RNA, 16 nt, Brucella suis 1330
ccgcuccggcgucagc

SEQ ID NO: 458421 - RNA, 20 nt, Brucella suis 1330
ccgcucaugcgguagaauuc

SEQ ID NO: 458422 - RNA, 12 nt, Brucella suis 1330
ccgcguccuuuu

SEQ ID NO: 458423 - RNA, 15 nt, Brucella suis 1330
ccgcgcuucuucauu

SEQ ID NO: 458424 - RNA, 21 nt, Brucella suis 1330
ccgcgcguaucuucaagcucg

SEQ ID NO: 458425 - RNA, 14 nt, Brucella suis 1330
ccgcgccaugccau

SEQ ID NO: 458426 - RNA, 21 nt, Brucella suis 1330
ccgcgccaugccauccucgcc

SEQ ID NO: 458427 - RNA, 21 nt, Brucella suis 1330
ccgcgcaauaaugcagcgccg

SEQ ID NO: 458428 - RNA, 22 nt, Brucella suis 1330
ccgcgauaggugacgcgggcau

SEQ ID NO: 458429 - RNA, 23 nt, Brucella suis 1330
ccgccuugcagaugagcggcagc

SEQ ID NO: 458430 - RNA, 21 nt, Brucella suis 1330
ccgccuucaaaacgcagcauc

SEQ ID NO: 458431 - RNA, 23 nt, Brucella suis 1330
ccgccuucaaaacgcagcaucac

SEQ ID NO: 458432 - RNA, 15 nt, Brucella suis 1330
ccgccuggcccggcu

SEQ ID NO: 458433 - RNA, 14 nt, Brucella suis 1330
ccgccugcagccgg

SEQ ID NO: 458434 - RNA, 13 nt, Brucella suis 1330
ccgcagcccggac

SEQ ID NO: 458435 - RNA, 13 nt, Brucella suis 1330
ccgcagccgccau

SEQ ID NO: 458436 - RNA, 12 nt, Brucella suis 1330
ccgcagccaggg

SEQ ID NO: 458437 - RNA, 23 nt, Brucella suis 1330
ccgcacguugggggacgggcggu

SEQ ID NO: 458438 - RNA, 17 nt, Brucella suis 1330
ccgcacccuauuccccu

SEQ ID NO: 458439 - RNA, 21 nt, Brucella suis 1330
ccgcaagcuggaaccagcgug

SEQ ID NO: 458440 - RNA, 12 nt, Brucella suis 1330
ccgcaaccagcg

SEQ ID NO: 458441 - RNA, 16 nt, Brucella suis 1330
ccgcaaaggcaggcac

SEQ ID NO: 458442 - RNA, 14 nt, Brucella suis 1330
ccgaugcagaugcc

SEQ ID NO: 458443 - RNA, 17 nt, Brucella suis 1330
ccgaugcagaugccaug

SEQ ID NO: 458444 - RNA, 20 nt, Brucella suis 1330
ccgaucuguucauguuuuga

SEQ ID NO: 458445 - RNA, 23 nt, Brucella suis 1330
ccgauccugcgcccugucagaaa

SEQ ID NO: 458446 - RNA, 20 nt, Brucella suis 1330
ccgaucaggcaguccccgug

SEQ ID NO: 458447 - RNA, 16 nt, Brucella suis 1330
ccgauacuguagaaaa

SEQ ID NO: 458448 - RNA, 19 nt, Brucella suis 1330
ccgauaaugcgaacaguuu

SEQ ID NO: 458449 - RNA, 12 nt, Brucella suis 1330
ccgaggcgcgca

SEQ ID NO: 458450 - RNA, 15 nt, Brucella suis 1330
ccgaggccgccaccg

SEQ ID NO: 458451 - RNA, 13 nt, Brucella suis 1330
ccgagcgccgccg

SEQ ID NO: 458452 - RNA, 21 nt, Brucella suis 1330
ccgacgggcgaacgggggcga

SEQ ID NO: 458453 - RNA, 16 nt, Brucella suis 1330
ccgacaaaaaacaccg

SEQ ID NO: 458454 - RNA, 17 nt, Brucella suis 1330
ccgacaaaaaacaccgc

SEQ ID NO: 458455 - RNA, 12 nt, Brucella suis 1330
ccgacaagcagc

SEQ ID NO: 458456 - RNA, 14 nt, Brucella suis 1330
aaaccaaaaaaccu

SEQ ID NO: 458457 - RNA, 21 nt, Brucella suis 1330
aaacaucuuauaaaaaggccg

SEQ ID NO: 458458 - RNA, 17 nt, Brucella suis 1330
cccuuuuccgcaccgcc

SEQ ID NO: 458459 - RNA, 19 nt, Brucella suis 1330
cccuuggccggaauggcga

SEQ ID NO: 458460 - RNA, 22 nt, Brucella suis 1330
cccuugccggauaucgccagaa

SEQ ID NO: 458461 - RNA, 20 nt, Brucella suis 1330
cccuugaucguauagcccug

SEQ ID NO: 458462 - RNA, 16 nt, Brucella suis 1330
cccuugaagaauucau

SEQ ID NO: 458463 - RNA, 14 nt, Brucella suis 1330
cccuguuucugcug

SEQ ID NO: 458464 - RNA, 22 nt, Brucella suis 1330
cccugucagaaagucugcuucc

SEQ ID NO: 458465 - RNA, 22 nt, Brucella suis 1330
cccugucgccgaaaagcgccug

SEQ ID NO: 458466 - RNA, 22 nt, Brucella suis 1330
cccugcuucacaugcuugccga

SEQ ID NO: 458467 - RNA, 17 nt, Brucella suis 1330
cccguccucaucgccgg

SEQ ID NO: 458468 - RNA, 16 nt, Brucella suis 1330
cccggcggcugaaauc

SEQ ID NO: 458469 - RNA, 14 nt, Brucella suis 1330
cccggcgcaaaggc

SEQ ID NO: 458470 - RNA, 22 nt, Brucella suis 1330
cccggcauggccugcgcgcgca

SEQ ID NO: 458471 - RNA, 14 nt, Brucella suis 1330
cccggcaacauggu

SEQ ID NO: 458472 - RNA, 19 nt, Brucella suis 1330
cccggauugggucaacgcc

SEQ ID NO: 458473 - RNA, 13 nt, Brucella suis 1330
cccggacaaagcc

SEQ ID NO: 458474 - RNA, 16 nt, Brucella suis 1330
cccgcuucgaugcgcu

SEQ ID NO: 458475 - RNA, 20 nt, Brucella suis 1330
cccgcgugaugagccgcuuc

SEQ ID NO: 458476 - RNA, 13 nt, Brucella suis 1330
cccgcgccucacc

SEQ ID NO: 458477 - RNA, 23 nt, Brucella suis 1330
cccgcgagggugaaaccguggaa

SEQ ID NO: 458478 - RNA, 14 nt, Brucella suis 1330
cccgccuuggaaac

SEQ ID NO: 458479 - RNA, 15 nt, Brucella suis 1330
cccgccgcgacgaug

SEQ ID NO: 458480 - RNA, 17 nt, Brucella suis 1330
cccgcauagccaucgcc

SEQ ID NO: 458481 - RNA, 20 nt, Brucella suis 1330
cccgcauaaaugcuccuggc

SEQ ID NO: 458482 - RNA, 15 nt, Brucella suis 1330
cccgaucagauagcc

SEQ ID NO: 458483 - RNA, 19 nt, Brucella suis 1330
cccgauaaacccgccccca

SEQ ID NO: 458484 - RNA, 18 nt, Brucella suis 1330
ccccuaaagccgcuccau

SEQ ID NO: 458485 - RNA, 13 nt, Brucella suis 1330
ccccuauuccccu

SEQ ID NO: 458486 - RNA, 17 nt, Brucella suis 1330
ccccgugccggacggga

SEQ ID NO: 458487 - RNA, 18 nt, Brucella suis 1330
ccccgggcagcggcgcgc

SEQ ID NO: 458488 - RNA, 14 nt, Brucella suis 1330
ccccggcaccgcgc

SEQ ID NO: 458489 - RNA, 19 nt, Brucella suis 1330
ccccggcagccuucgcugc

SEQ ID NO: 458490 - RNA, 18 nt, Brucella suis 1330
ccccgcccgcggccacaa

SEQ ID NO: 458491 - RNA, 14 nt, Brucella suis 1330
ccccauguuuauga

SEQ ID NO: 458492 - RNA, 15 nt, Brucella suis 1330
ccccauucaugcacc

SEQ ID NO: 458493 - RNA, 22 nt, Brucella suis 1330
ccccagcguauugccguugaga

SEQ ID NO: 458494 - RNA, 20 nt, Brucella suis 1330
ccccagaaggcgcggcagcu

SEQ ID NO: 458495 - RNA, 20 nt, Brucella suis 1330
cccagccaagcgccacgcgg

SEQ ID NO: 458496 - RNA, 12 nt, Brucella suis 1330
cccagaugcagc

SEQ ID NO: 458497 - RNA, 18 nt, Brucella suis 1330
cccagaugcagcggcgca

SEQ ID NO: 458498 - RNA, 22 nt, Brucella suis 1330
cccagacauggaagaugacgcc

SEQ ID NO: 458499 - RNA, 16 nt, Brucella suis 1330
cccagaguucaaggcc

SEQ ID NO: 458500 - RNA, 12 nt, Brucella suis 1330
cccacgcccagc

SEQ ID NO: 458501 - RNA, 13 nt, Brucella suis 1330
cccacccaccgcc

SEQ ID NO: 458502 - RNA, 14 nt, Brucella suis 1330
cccacccaccgccu

SEQ ID NO: 458503 - RNA, 16 nt, Brucella suis 1330
cccacccaccgccugc

SEQ ID NO: 458504 - RNA, 19 nt, Brucella suis 1330
cccaaaaaucccggaauuu

SEQ ID NO: 458505 - RNA, 17 nt, Brucella suis 1330
ccauuucagguucucga

SEQ ID NO: 458506 - RNA, 15 nt, Brucella suis 1330
cccaaagcgggcgcu

SEQ ID NO: 458507 - RNA, 15 nt, Brucella suis 1330
ccauucugucggcgc

SEQ ID NO: 458508 - RNA, 20 nt, Brucella suis 1330
ccauucaagcggcaugucau

SEQ ID NO: 458509 - RNA, 22 nt, Brucella suis 1330
ccaugcgcucccggucuuccug

SEQ ID NO: 458510 - RNA, 20 nt, Brucella suis 1330
ccaugcggccagccuauauc

SEQ ID NO: 458511 - RNA, 15 nt, Brucella suis 1330
ccaugcgggcacgcu

SEQ ID NO: 458512 - RNA, 19 nt, Brucella suis 1330
ccaugcgcaaccaaaacau

SEQ ID NO: 458513 - RNA, 15 nt, Brucella suis 1330
ccaugccuuucaggu

SEQ ID NO: 458514 - RNA, 17 nt, Brucella suis 1330
ccaucugccgucagcaa

SEQ ID NO: 458515 - RNA, 12 nt, Brucella suis 1330
ccaucugcuccu

SEQ ID NO: 458516 - RNA, 18 nt, Brucella suis 1330
ccaucgcaccauugggca

SEQ ID NO: 458517 - RNA, 19 nt, Brucella suis 1330
ccaucgaaaccggcauuau

SEQ ID NO: 458518 - RNA, 14 nt, Brucella suis 1330
aaacaaggccgagc

SEQ ID NO: 458519 - RNA, 21 nt, Brucella suis 1330
ccaucacgggcuuugccgcau

SEQ ID NO: 458520 - RNA, 20 nt, Brucella suis 1330
ccaucaccgaaauccaggcg

SEQ ID NO: 458521 - RNA, 13 nt, Brucella suis 1330
ccaucaaugcacc

SEQ ID NO: 458522 - RNA, 13 nt, Brucella suis 1330
ccauauccucugu

SEQ ID NO: 458523 - RNA, 14 nt, Brucella suis 1330
ccauagaacagcaa

SEQ ID NO: 458524 - RNA, 18 nt, Brucella suis 1330
ccauauaaagcuugaacc

SEQ ID NO: 458525 - RNA, 21 nt, Brucella suis 1330
ccaguuuauucauuggcggca

SEQ ID NO: 458526 - RNA, 20 nt, Brucella suis 1330
ccagugugaccacugcaucg

SEQ ID NO: 458527 - RNA, 17 nt, Brucella suis 1330
ccaguuccugaaacacc

SEQ ID NO: 458528 - RNA, 14 nt, Brucella suis 1330
ccagugcgccaccg

SEQ ID NO: 458529 - RNA, 15 nt, Brucella suis 1330
ccaguggaagcacau

SEQ ID NO: 458530 - RNA, 16 nt, Brucella suis 1330
ccaguggacugauuuc

SEQ ID NO: 458531 - RNA, 13 nt, Brucella suis 1330
ccagggcgcgcca

SEQ ID NO: 458532 - RNA, 23 nt, Brucella suis 1330
ccaggccgggcuuuggaggaacc

SEQ ID NO: 458533 - RNA, 19 nt, Brucella suis 1330
ccaggccccgaugcggcug

SEQ ID NO: 458534 - RNA, 13 nt, Brucella suis 1330
ccaggcauuggcu

SEQ ID NO: 458535 - RNA, 18 nt, Brucella suis 1330
ccaggaccgcgaggaagc

SEQ ID NO: 458536 - RNA, 14 nt, Brucella suis 1330
ccaggaacggcagg

SEQ ID NO: 458537 - RNA, 13 nt, Brucella suis 1330
ccagcuugcgcac

SEQ ID NO: 458538 - RNA, 13 nt, Brucella suis 1330
ccagcgugcagcc

SEQ ID NO: 458539 - RNA, 14 nt, Brucella suis 1330
ccagcgugcagccu

SEQ ID NO: 458540 - RNA, 20 nt, Brucella suis 1330
ccagcggugacggcggcaga

SEQ ID NO: 458541 - RNA, 17 nt, Brucella suis 1330
ccagcggccaucuucca

SEQ ID NO: 458542 - RNA, 13 nt, Brucella suis 1330
ccagcgccuucag

SEQ ID NO: 458543 - RNA, 18 nt, Brucella suis 1330
ccagcgcauggcauggcu

SEQ ID NO: 458544 - RNA, 20 nt, Brucella suis 1330
ccagcgcaucgucuuccuua

SEQ ID NO: 458545 - RNA, 17 nt, Brucella suis 1330
ccagccuugagggcagc

SEQ ID NO: 458546 - RNA, 12 nt, Brucella suis 1330
ccagcgaauaga

SEQ ID NO: 458547 - RNA, 20 nt, Brucella suis 1330
ccagcgaauagaccaugccg

SEQ ID NO: 458548 - RNA, 22 nt, Brucella suis 1330
ccagccguuccagggcgcgcca

SEQ ID NO: 458549 - RNA, 23 nt, Brucella suis 1330
ccagccgucgagggcaccggccu

SEQ ID NO: 458550 - RNA, 12 nt, Brucella suis 1330
ccacucuugugg

SEQ ID NO: 458551 - RNA, 17 nt, Brucella suis 1330
ccacguuuggagcggcg

SEQ ID NO: 458552 - RNA, 12 nt, Brucella suis 1330
ccacgguuuuug

SEQ ID NO: 458553 - RNA, 15 nt, Brucella suis 1330
ccacgggauggcggc

SEQ ID NO: 458554 - RNA, 12 nt, Brucella suis 1330
ccacgggccaga

SEQ ID NO: 458555 - RNA, 22 nt, Brucella suis 1330
ccacggcgccugugugaacagg

SEQ ID NO: 458556 - RNA, 15 nt, Brucella suis 1330
ccacggaucgacaaa

SEQ ID NO: 458557 - RNA, 13 nt, Brucella suis 1330
ccacggauuucca

SEQ ID NO: 458558 - RNA, 23 nt, Brucella suis 1330
ccacgcuucaugauaaggccgcu

SEQ ID NO: 458559 - RNA, 11 nt, Brucella suis 1330
ccacgcuccac

SEQ ID NO: 458560 - RNA, 17 nt, Brucella suis 1330
ccacgcccagcgcggca

SEQ ID NO: 458561 - RNA, 15 nt, Brucella suis 1330
ccacgaugccugccg

SEQ ID NO: 458562 - RNA, 19 nt, Brucella suis 1330
ccacgacgggagccgcagc

SEQ ID NO: 458563 - RNA, 15 nt, Brucella suis 1330
ccacgagaaaauggc

SEQ ID NO: 458564 - RNA, 23 nt, Brucella suis 1330
ccacgaauuccucuccgcccaua

SEQ ID NO: 458565 - RNA, 14 nt, Brucella suis 1330
ccaccgccugcagc

SEQ ID NO: 458566 - RNA, 19 nt, Brucella suis 1330
ccaccgccugcagccggaa

SEQ ID NO: 458567 - RNA, 14 nt, Brucella suis 1330
ccaccagcacacag

SEQ ID NO: 458568 - RNA, 17 nt, Brucella suis 1330
ccaccagcacacagcca

SEQ ID NO: 458569 - RNA, 20 nt, Brucella suis 1330
ccaccacgauggaaggaaag

SEQ ID NO: 458570 - RNA, 22 nt, Brucella suis 1330
ccaccacgauggaaggaaagcc

SEQ ID NO: 458571 - RNA, 10 nt, Brucella suis 1330
ccacagccuu

SEQ ID NO: 458572 - RNA, 20 nt, Brucella suis 1330
ccaaugcucgaugguccagu

SEQ ID NO: 458573 - RNA, 22 nt, Brucella suis 1330
ccaaugcucgaugguccagucu

SEQ ID NO: 458574 - RNA, 16 nt, Brucella suis 1330
ccaauccccucaccuu

SEQ ID NO: 458575 - RNA, 23 nt, Brucella suis 1330
ccaagugcggucugcuugccgcc

SEQ ID NO: 458576 - RNA, 21 nt, Brucella suis 1330
ccaagugugacuuccgccgug

SEQ ID NO: 458577 - RNA, 13 nt, Brucella suis 1330
ccaaguucaugcc

SEQ ID NO: 458578 - RNA, 20 nt, Brucella suis 1330
ccaagcuugaucgccgcacg

SEQ ID NO: 458579 - RNA, 21 nt, Brucella suis 1330
ccaagacuuuccauccagucg

SEQ ID NO: 458580 - RNA, 17 nt, Brucella suis 1330
ccaaaggucggcggcgu

SEQ ID NO: 458581 - RNA, 16 nt, Brucella suis 1330
cauuugcgaccauggc

SEQ ID NO: 458582 - RNA, 17 nt, Brucella suis 1330
cauugucccaauauagc

SEQ ID NO: 458583 - RNA, 14 nt, Brucella suis 1330
cauuggcgauuuuc

SEQ ID NO: 458584 - RNA, 13 nt, Brucella suis 1330
cauugucggugaa

SEQ ID NO: 458585 - RNA, 15 nt, Brucella suis 1330
cauugcggccaagcg

SEQ ID NO: 458586 - RNA, 18 nt, Brucella suis 1330
cauugcggauacccaugc

SEQ ID NO: 458587 - RNA, 23 nt, Brucella suis 1330
cauugccgggcgcaaccuggcug

SEQ ID NO: 458588 - RNA, 15 nt, Brucella suis 1330
cauuggaaacgccgu

SEQ ID NO: 458589 - RNA, 22 nt, Brucella suis 1330
cauucauaaccgaagaaugcgc

SEQ ID NO: 458590 - RNA, 12 nt, Brucella suis 1330
cauuccucaaga

SEQ ID NO: 458591 - RNA, 19 nt, Brucella suis 1330
cauucaagcggcaugucau

SEQ ID NO: 458592 - RNA, 22 nt, Brucella suis 1330
caugucuccccaaaguggaaag

SEQ ID NO: 458593 - RNA, 21 nt, Brucella suis 1330
caugucauccgaaaccagaac

SEQ ID NO: 458594 - RNA, 18 nt, Brucella suis 1330
cauggcugauuucuuccc

SEQ ID NO: 458595 - RNA, 14 nt, Brucella suis 1330
cauggcuugaagcg

SEQ ID NO: 458596 - RNA, 21 nt, Brucella suis 1330
cauggcuugaagcgugaugau

SEQ ID NO: 458597 - RNA, 21 nt, Brucella suis 1330
cauggcggucgagcuuuccau

SEQ ID NO: 458598 - RNA, 12 nt, Brucella suis 1330
cauggaggcaag

SEQ ID NO: 458599 - RNA, 19 nt, Brucella suis 1330
cauggagcgcauccgccug

SEQ ID NO: 458600 - RNA, 18 nt, Brucella suis 1330
cauggacuuuucagccuc

SEQ ID NO: 458601 - RNA, 15 nt, Brucella suis 1330
cauggaaaacgccgc

SEQ ID NO: 458602 - RNA, 17 nt, Brucella suis 1330
cauggaagaugacgccc

SEQ ID NO: 458603 - RNA, 14 nt, Brucella suis 1330
cauggaagccgaca

SEQ ID NO: 458604 - RNA, 20 nt, Brucella suis 1330
cauggaagccgacagaagau

SEQ ID NO: 458605 - RNA, 22 nt, Brucella suis 1330
cauggaagggcggguucaugau

SEQ ID NO: 458606 - RNA, 15 nt, Brucella suis 1330
caucugccaaccauu

SEQ ID NO: 458607 - RNA, 21 nt, Brucella suis 1330
caucucguucacaaucuugcc

SEQ ID NO: 458608 - RNA, 22 nt, Brucella suis 1330
caucguugcggcuugccaccac

SEQ ID NO: 458609 - RNA, 16 nt, Brucella suis 1330
caucguaaucgccggg

SEQ ID NO: 458610 - RNA, 18 nt, Brucella suis 1330
caucgcgaggcuauuuau

SEQ ID NO: 458611 - RNA, 21 nt, Brucella suis 1330
caucgccugaggcauugagga

SEQ ID NO: 458612 - RNA, 20 nt, Brucella suis 1330
caucgacauggacaggaugc

SEQ ID NO: 458613 - RNA, 18 nt, Brucella suis 1330
caucgacaaucuccccuu

SEQ ID NO: 458614 - RNA, 17 nt, Brucella suis 1330
cauccugcaccggcuuc

SEQ ID NO: 458615 - RNA, 15 nt, Brucella suis 1330
cauccucgccaagcu

SEQ ID NO: 458616 - RNA, 20 nt, Brucella suis 1330
caucauuggaacaagaagcu

SEQ ID NO: 458617 - RNA, 15 nt, Brucella suis 1330
caucaucaaggaaaa

SEQ ID NO: 458618 - RNA, 23 nt, Brucella suis 1330
caucagcggcggguagccgccau

SEQ ID NO: 458619 - RNA, 19 nt, Brucella suis 1330
caucagcccauagaucaga

SEQ ID NO: 458620 - RNA, 15 nt, Brucella suis 1330
caucagccucccuuc

SEQ ID NO: 458621 - RNA, 21 nt, Brucella suis 1330
caucagccucccuucauucaa

SEQ ID NO: 458622 - RNA, 19 nt, Brucella suis 1330
caucagcgaauagggaaac

SEQ ID NO: 458623 - RNA, 14 nt, Brucella suis 1330
caucaaccuuuucg

SEQ ID NO: 458624 - RNA, 20 nt, Brucella suis 1330
caucaaaagcugccgcaaca

SEQ ID NO: 458625 - RNA, 14 nt, Brucella suis 1330
cauaugcuguuuca

SEQ ID NO: 458626 - RNA, 11 nt, Brucella suis 1330
cauaucagacg

SEQ ID NO: 458627 - RNA, 20 nt, Brucella suis 1330
cauaucguugccgaucaugg

SEQ ID NO: 458628 - RNA, 20 nt, Brucella suis 1330
cauaucuuuccauuccagcc

SEQ ID NO: 458629 - RNA, 21 nt, Brucella suis 1330
cauacaugaugaucgccagca

SEQ ID NO: 458630 - RNA, 21 nt, Brucella suis 1330
cauacauggcguaggcauaau

SEQ ID NO: 458631 - RNA, 12 nt, Brucella suis 1330
cauaauccucac

SEQ ID NO: 458632 - RNA, 21 nt, Brucella suis 1330
cauaauugguguagaagacaa

SEQ ID NO: 458633 - RNA, 21 nt, Brucella suis 1330
cauaaaccgaugacgagccuc

SEQ ID NO: 458634 - RNA, 20 nt, Brucella suis 1330
cauaaagcacagccagaaag

SEQ ID NO: 458635 - RNA, 16 nt, Brucella suis 1330
cauaaaugcccuuccu

SEQ ID NO: 458636 - RNA, 13 nt, Brucella suis 1330
cauaacagaugcg

SEQ ID NO: 458637 - RNA, 20 nt, Brucella suis 1330
cauaaggcggaugcgcggcg

SEQ ID NO: 458638 - RNA, 21 nt, Brucella suis 1330
cauaaggcggaugcgcggcgc

SEQ ID NO: 458639 - RNA, 15 nt, Brucella suis 1330
caguuucaccauggc

SEQ ID NO: 458640 - RNA, 13 nt, Brucella suis 1330
caguuucugccgc

SEQ ID NO: 458641 - RNA, 18 nt, Brucella suis 1330
caguugaucgaggcaaau

SEQ ID NO: 458642 - RNA, 22 nt, Brucella suis 1330
caguucgguguuggucugcggc

SEQ ID NO: 458643 - RNA, 19 nt, Brucella suis 1330
caguucguggcggggcagg

SEQ ID NO: 458644 - RNA, 12 nt, Brucella suis 1330
caguuccugaaa

SEQ ID NO: 458645 - RNA, 15 nt, Brucella suis 1330
caguuccugaaacac

SEQ ID NO: 458646 - RNA, 19 nt, Brucella suis 1330
cagugcugaaaaggcuggc

SEQ ID NO: 458647 - RNA, 16 nt, Brucella suis 1330
caguggcagcaggcag

SEQ ID NO: 458648 - RNA, 16 nt, Brucella suis 1330
caguggccuucagcac

SEQ ID NO: 458649 - RNA, 13 nt, Brucella suis 1330
cagugcggcaugg

SEQ ID NO: 458650 - RNA, 14 nt, Brucella suis 1330
cagugcgccaccgc

SEQ ID NO: 458651 - RNA, 17 nt, Brucella suis 1330
cagugccgccaucggca

SEQ ID NO: 458652 - RNA, 18 nt, Brucella suis 1330
cagggcuucaugauggaa

SEQ ID NO: 458653 - RNA, 20 nt, Brucella suis 1330
cagggcuucaugauggaaga

SEQ ID NO: 458654 - RNA, 16 nt, Brucella suis 1330
cagggcuugcuugcca

SEQ ID NO: 458655 - RNA, 22 nt, Brucella suis 1330
cagggauugcgcaagugcugca

SEQ ID NO: 458656 - RNA, 22 nt, Brucella suis 1330
caggcuuuauuccaucagccgg

SEQ ID NO: 458657 - RNA, 19 nt, Brucella suis 1330
caggcuuucggccugugcg

SEQ ID NO: 458658 - RNA, 17 nt, Brucella suis 1330
cagggaaaagccgcgcu

SEQ ID NO: 458659 - RNA, 21 nt, Brucella suis 1330
cagggaaacucucacagccau

SEQ ID NO: 458660 - RNA, 23 nt, Brucella suis 1330
cagggaaacucucacagccauca

SEQ ID NO: 458661 - RNA, 16 nt, Brucella suis 1330
caggcucuugucgaag

SEQ ID NO: 458662 - RNA, 20 nt, Brucella suis 1330
caggcguucccagacaugga

SEQ ID NO: 458663 - RNA, 13 nt, Brucella suis 1330
caggcagggagga

SEQ ID NO: 458664 - RNA, 13 nt, Brucella suis 1330
caggcacacccgg

SEQ ID NO: 458665 - RNA, 16 nt, Brucella suis 1330
caggaugugucggcca

SEQ ID NO: 458666 - RNA, 21 nt, Brucella suis 1330
caggaucgcaccgauauagag

SEQ ID NO: 458667 - RNA, 17 nt, Brucella suis 1330
caggaggccaaaaagcg

SEQ ID NO: 458668 - RNA, 18 nt, Brucella suis 1330
caggacaccgucgccauu

SEQ ID NO: 458669 - RNA, 19 nt, Brucella suis 1330
caggacaccgucgccauua

SEQ ID NO: 458670 - RNA, 20 nt, Brucella suis 1330
caggacaacgucgaaauccg

SEQ ID NO: 458671 - RNA, 17 nt, Brucella suis 1330
caggaccggcgaaaagg

SEQ ID NO: 458672 - RNA, 19 nt, Brucella suis 1330
caggaccgcgcagaucauc

SEQ ID NO: 458673 - RNA, 23 nt, Brucella suis 1330
caggaccguuuggaugugcagcg

SEQ ID NO: 458674 - RNA, 16 nt, Brucella suis 1330
caggaaaucgaugaca

SEQ ID NO: 458675 - RNA, 14 nt, Brucella suis 1330
caggaaagcccggc

SEQ ID NO: 458676 - RNA, 17 nt, Brucella suis 1330
cagcuuuacugccgggu

SEQ ID NO: 458677 - RNA, 13 nt, Brucella suis 1330
cagcuuggaaagc

SEQ ID NO: 458678 - RNA, 14 nt, Brucella suis 1330
cagcuuggaaagcu

SEQ ID NO: 458679 - RNA, 20 nt, Brucella suis 1330
cagcucguccaugagcgcac

SEQ ID NO: 458680 - RNA, 22 nt, Brucella suis 1330
cagcucguccaugagcgcacca

SEQ ID NO: 458681 - RNA, 13 nt, Brucella suis 1330
cagcguugcgcuc

SEQ ID NO: 458682 - RNA, 22 nt, Brucella suis 1330
cagcgugaagggcaggaggcca

SEQ ID NO: 458683 - RNA, 12 nt, Brucella suis 1330
cagcgugcagcc

SEQ ID NO: 458684 - RNA, 13 nt, Brucella suis 1330
cagcgucaggaca

SEQ ID NO: 458685 - RNA, 20 nt, Brucella suis 1330
cagcguccauccggcggcgc

SEQ ID NO: 458686 - RNA, 17 nt, Brucella suis 1330
cagcggugacggcggca

SEQ ID NO: 458687 - RNA, 16 nt, Brucella suis 1330
cagcgguugcggccgc

SEQ ID NO: 458688 - RNA, 14 nt, Brucella suis 1330
cagcgggagaugug

SEQ ID NO: 458689 - RNA, 13 nt, Brucella suis 1330
cagcggcgcgcca

SEQ ID NO: 458690 - RNA, 13 nt, Brucella suis 1330
cagcggcagaccu

SEQ ID NO: 458691 - RNA, 15 nt, Brucella suis 1330
cagcggcagcacaau

SEQ ID NO: 458692 - RNA, 20 nt, Brucella suis 1330
cagcgcauucugcuuaucaa

SEQ ID NO: 458693 - RNA, 16 nt, Brucella suis 1330
cagcgcauaaaggccg

SEQ ID NO: 458694 - RNA, 17 nt, Brucella suis 1330
cagcgcaaagccugcua

SEQ ID NO: 458695 - RNA, 17 nt, Brucella suis 1330
cagcgcaaagcgcgcgc

SEQ ID NO: 458696 - RNA, 16 nt, Brucella suis 1330
cagcgacccgcgcccu

SEQ ID NO: 458697 - RNA, 20 nt, Brucella suis 1330
cagcgacaggguaagcgccu

SEQ ID NO: 458698 - RNA, 17 nt, Brucella suis 1330
cagccuuuccagaaggc

SEQ ID NO: 458699 - RNA, 15 nt, Brucella suis 1330
cagccgugagcaugg

SEQ ID NO: 458700 - RNA, 17 nt, Brucella suis 1330
cagccguaccggcauca

SEQ ID NO: 458701 - RNA, 14 nt, Brucella suis 1330
cagccgggcuuucc

SEQ ID NO: 458702 - RNA, 18 nt, Brucella suis 1330
cagccgggcuuugcauug

SEQ ID NO: 458703 - RNA, 22 nt, Brucella suis 1330
cagcccgcuuuuacgcgccgcc

SEQ ID NO: 458704 - RNA, 13 nt, Brucella suis 1330
cagcccggacagg

SEQ ID NO: 458705 - RNA, 21 nt, Brucella suis 1330
cagcccgccccaagaucagcc

SEQ ID NO: 458706 - RNA, 13 nt, Brucella suis 1330
cagccccuugccc

SEQ ID NO: 458707 - RNA, 15 nt, Brucella suis 1330
cagccccuugccccg

SEQ ID NO: 458708 - RNA, 13 nt, Brucella suis 1330
cagcccgaagacc

SEQ ID NO: 458709 - RNA, 18 nt, Brucella suis 1330
cagcccgaagaccaggcc

SEQ ID NO: 458710 - RNA, 14 nt, Brucella suis 1330
cagccagaaagaag

SEQ ID NO: 458711 - RNA, 19 nt, Brucella suis 1330
cagccaagcgccacgcggg

SEQ ID NO: 458712 - RNA, 20 nt, Brucella suis 1330
cagcagcaucgccgccagca

SEQ ID NO: 458713 - RNA, 18 nt, Brucella suis 1330
cagcagcaaccgccagau

SEQ ID NO: 458714 - RNA, 20 nt, Brucella suis 1330
cagcagauccgugaugaugg

SEQ ID NO: 458715 - RNA, 20 nt, Brucella suis 1330
aaaauggcgcuagcgaugau

SEQ ID NO: 458716 - RNA, 21 nt, Brucella suis 1330
aaaaugccauggaacagacag

SEQ ID NO: 458717 - RNA, 22 nt, Brucella suis 1330
aaaaugccauggaacagacagg

SEQ ID NO: 458718 - RNA, 23 nt, Brucella suis 1330
aaaaugcgcuuaugugaagauuu

SEQ ID NO: 458719 - RNA, 17 nt, Brucella suis 1330
aaaaugauuucgcaaug

SEQ ID NO: 458720 - RNA, 15 nt, Brucella suis 1330
cagauugcgggcaag

SEQ ID NO: 458721 - RNA, 18 nt, Brucella suis 1330
cagauugcgggcaagcau

SEQ ID NO: 458722 - RNA, 18 nt, Brucella suis 1330
cagauucagggcaucgaa

SEQ ID NO: 458723 - RNA, 22 nt, Brucella suis 1330
cagauugaucccgaucugagaa

SEQ ID NO: 458724 - RNA, 18 nt, Brucella suis 1330
cagauugaugaaaaaccc

SEQ ID NO: 458725 - RNA, 19 nt, Brucella suis 1330
aaaaucuguucacauuuca

SEQ ID NO: 458726 - RNA, 14 nt, Brucella suis 1330
aaaauccgcaaugg

SEQ ID NO: 458727 - RNA, 18 nt, Brucella suis 1330
aaaaucaccauuuucgca

SEQ ID NO: 458728 - RNA, 14 nt, Brucella suis 1330
cagagcaaauacac

SEQ ID NO: 458729 - RNA, 18 nt, Brucella suis 1330
cagagccucggcgcggac

SEQ ID NO: 458730 - RNA, 18 nt, Brucella suis 1330
cagagcggguucccacuu

SEQ ID NO: 458731 - RNA, 14 nt, Brucella suis 1330
cagauaaagcagga

SEQ ID NO: 458732 - RNA, 11 nt, Brucella suis 1330
cagacgugacc

SEQ ID NO: 458733 - RNA, 15 nt, Brucella suis 1330
cagacgugaccgccu

SEQ ID NO: 458734 - RNA, 19 nt, Brucella suis 1330
cagacgauccucaagcauc

SEQ ID NO: 458735 - RNA, 15 nt, Brucella suis 1330
cagaccugcaccgcg

SEQ ID NO: 458736 - RNA, 14 nt, Brucella suis 1330
cagaccgaugcucu

SEQ ID NO: 458737 - RNA, 22 nt, Brucella suis 1330
cagaccgcccccucgcaaccau

SEQ ID NO: 458738 - RNA, 13 nt, Brucella suis 1330
cagaccccaucag

SEQ ID NO: 458739 - RNA, 20 nt, Brucella suis 1330
cagacauggccuuugcagaa

SEQ ID NO: 458740 - RNA, 15 nt, Brucella suis 1330
cagaaugagcuugcg

SEQ ID NO: 458741 - RNA, 15 nt, Brucella suis 1330
cagaaugcauuuuuc

SEQ ID NO: 458742 - RNA, 14 nt, Brucella suis 1330
cagaaugcgccgga

SEQ ID NO: 458743 - RNA, 20 nt, Brucella suis 1330
cagaagguacuggcaauaaa

SEQ ID NO: 458744 - RNA, 14 nt, Brucella suis 1330
cagaaggcgcggca

SEQ ID NO: 458745 - RNA, 16 nt, Brucella suis 1330
cagaaggcgggaaggc

SEQ ID NO: 458746 - RNA, 17 nt, Brucella suis 1330
cagaaggcgggaaggca

SEQ ID NO: 458747 - RNA, 16 nt, Brucella suis 1330
cagaacucgauugaca

SEQ ID NO: 458748 - RNA, 18 nt, Brucella suis 1330
cagaacuucgccaagccc

SEQ ID NO: 458749 - RNA, 14 nt, Brucella suis 1330
cagaagaaagggcg

SEQ ID NO: 458750 - RNA, 20 nt, Brucella suis 1330
cagaacgauggugcggcgcg

SEQ ID NO: 458751 - RNA, 13 nt, Brucella suis 1330
cagaaagaaagcu

SEQ ID NO: 458752 - RNA, 12 nt, Brucella suis 1330
cacuuuuaaagc

SEQ ID NO: 458753 - RNA, 20 nt, Brucella suis 1330
aaaauaucuuuuuucaaaga

SEQ ID NO: 458754 - RNA, 14 nt, Brucella suis 1330
cacuugcgauuuga

SEQ ID NO: 458755 - RNA, 19 nt, Brucella suis 1330
cacuuccgcucaucgcagu

SEQ ID NO: 458756 - RNA, 22 nt, Brucella suis 1330
cacugucgggcucaggcugagu

SEQ ID NO: 458757 - RNA, 23 nt, Brucella suis 1330
cacuggggauacgugcaagagca

SEQ ID NO: 458758 - RNA, 22 nt, Brucella suis 1330
cacucggcggcaucgcccgaga

SEQ ID NO: 458759 - RNA, 12 nt, Brucella suis 1330
cacucugccugc

SEQ ID NO: 458760 - RNA, 20 nt, Brucella suis 1330
cacucuuguggugcuugccc

SEQ ID NO: 458761 - RNA, 12 nt, Brucella suis 1330
cacguuggggga

SEQ ID NO: 458762 - RNA, 15 nt, Brucella suis 1330
cacguuugacagccu

SEQ ID NO: 458763 - RNA, 19 nt, Brucella suis 1330
cacuagaauuuguaguuca

SEQ ID NO: 458764 - RNA, 21 nt, Chlamydia trachomatis
uggaccagcgcuuucuaaagc

SEQ ID NO: 458765 - RNA, 18 nt, Chlamydia trachomatis
uggaccagaucauagaaa

SEQ ID NO: 458766 - RNA, 14 nt, Chlamydia trachomatis
uggagcauaaagaa

SEQ ID NO: 458767 - RNA, 18 nt, Chlamydia trachomatis
uggcuuuuacaauagcau

SEQ ID NO: 458768 - RNA, 18 nt, Chlamydia trachomatis
uguagaaagcugggaaau

SEQ ID NO: 458769 - RNA, 13 nt, Chlamydia trachomatis
uguuaaacaucaa

SEQ ID NO: 458770 - RNA, 20 nt, Chlamydia trachomatis
uguuacacagaccuugccau

SEQ ID NO: 458771 - RNA, 18 nt, Chlamydia trachomatis
uguuauccacucuaaagu

SEQ ID NO: 458772 - RNA, 17 nt, Chlamydia trachomatis
uguuucgccaaugaucu

SEQ ID NO: 458773 - RNA, 18 nt, Chlamydia trachomatis
uguuucggaauucauaga

SEQ ID NO: 458774 - RNA, 13 nt, Chlamydia trachomatis
uuaccaaaccuuu

SEQ ID NO: 458775 - RNA, 17 nt, Chlamydia trachomatis
uuaucacauucuuagau

SEQ ID NO: 458776 - RNA, 17 nt, Chlamydia trachomatis
uuauggcucagcuucaa

SEQ ID NO: 458777 - RNA, 19 nt, Chlamydia trachomatis
uuccaauauuauuuacgag

SEQ ID NO: 458778 - RNA, 22 nt, Chlamydia trachomatis
uuccaggacgaacgaagaacga

SEQ ID NO: 458779 - RNA, 17 nt, Chlamydia trachomatis
uuccuacagcuagaaua

SEQ ID NO: 458780 - RNA, 14 nt, Chlamydia trachomatis
uuccucaaaagaac

SEQ ID NO: 458781 - RNA, 15 nt, Chlamydia trachomatis
uugaauuagguaagc

SEQ ID NO: 458782 - RNA, 23 nt, Chlamydia trachomatis
uugagaaauaaucaucucaaguc

SEQ ID NO: 458783 - RNA, 21 nt, Chlamydia trachomatis
uugagaaguaaaacagaagga

SEQ ID NO: 458784 - RNA, 19 nt, Chlamydia trachomatis
uugaucuacagcaaaaccu

SEQ ID NO: 458785 - RNA, 12 nt, Chlamydia trachomatis
uugcaaagagua

SEQ ID NO: 458786 - RNA, 12 nt, Chlamydia trachomatis
uugcacuuuccg

SEQ ID NO: 458787 - RNA, 21 nt, Chlamydia trachomatis
uugccugcuccggcaaauccu

SEQ ID NO: 458788 - RNA, 17 nt, Chlamydia trachomatis
uugcuggguuuuaucaa

SEQ ID NO: 458789 - RNA, 22 nt, Chlamydia trachomatis
uugcuguuaagauaagcagcaa

SEQ ID NO: 458790 - RNA, 14 nt, Chlamydia trachomatis
uugcgugcucuagc

SEQ ID NO: 458791 - RNA, 17 nt, Chlamydia trachomatis
uuggagagaaugaagaa

SEQ ID NO: 458792 - RNA, 12 nt, Chlamydia trachomatis
uuggaaauccuc

SEQ ID NO: 458793 - RNA, 19 nt, Chlamydia trachomatis
uuguauaaguucuuuuugu

SEQ ID NO: 458794 - RNA, 16 nt, Chlamydia trachomatis
uugugcuaaaucucca

SEQ ID NO: 458795 - RNA, 22 nt, Chlamydia trachomatis
uugucagaagaggcaaaaaucu

SEQ ID NO: 458796 - RNA, 15 nt, Chlamydia trachomatis
uuucgaacaaaacuu

SEQ ID NO: 458797 - RNA, 19 nt, Chlamydia trachomatis
uuucgaauuggaucucccu

SEQ ID NO: 458798 - RNA, 18 nt, Chlamydia trachomatis
uuuccgcugcaaucucuu

SEQ ID NO: 458799 - RNA, 12 nt, Chlamydia trachomatis
uuucaucuccuu

SEQ ID NO: 458800 - RNA, 22 nt, Chlamydia trachomatis
uuuauacuagggaauaaaagua

SEQ ID NO: 458801 - RNA, 23 nt, Chlamydia trachomatis
uuuauacuucuuacuuaaaaaac

SEQ ID NO: 458802 - RNA, 17 nt, Chlamydia trachomatis
uuuauacucuaaaaguu

SEQ ID NO: 458803 - RNA, 14 nt, Chlamydia trachomatis
uuuucacaagaccu

SEQ ID NO: 458804 - RNA, 20 nt, Chlamydia trachomatis
uuuuacguaauucaugaucu

SEQ ID NO: 458805 - RNA, 13 nt, Chlamydia trachomatis
guuaacucuuucg

SEQ ID NO: 458806 - RNA, 17 nt, Chlamydia trachomatis
guguaggguagaacagg

SEQ ID NO: 458807 - RNA, 19 nt, Chlamydia trachomatis
guucgcuauaaucccaaaa

SEQ ID NO: 458808 - RNA, 13 nt, Chlamydia trachomatis
guuuaauauuuuu

SEQ ID NO: 458809 - RNA, 23 nt, Chlamydia trachomatis
uaaaugaaaccccucuuucucuc

SEQ ID NO: 458810 - RNA, 16 nt, Chlamydia trachomatis
uaacaacucuccuaau

SEQ ID NO: 458811 - RNA, 23 nt, Chlamydia trachomatis
uaacgaguuuaaaggacccgcua

SEQ ID NO: 458812 - RNA, 15 nt, Chlamydia trachomatis
uaaagauccucuuuc

SEQ ID NO: 458813 - RNA, 21 nt, Chlamydia trachomatis
uaaagaaagccguucccaaua

SEQ ID NO: 458814 - RNA, 13 nt, Chlamydia trachomatis
uaaacuccauugc

SEQ ID NO: 458815 - RNA, 18 nt, Chlamydia trachomatis
uaaaaucacuuucugcuu

SEQ ID NO: 458816 - RNA, 17 nt, Chlamydia trachomatis
uaaaauaucauccgcua

SEQ ID NO: 458817 - RNA, 19 nt, Chlamydia trachomatis
guuuauuaucuagaaaaga

SEQ ID NO: 458818 - RNA, 20 nt, Chlamydia trachomatis
uaaaaagggggcuuuagcag

SEQ ID NO: 458819 - RNA, 15 nt, Chlamydia trachomatis
uaaaaauucuaaagu

SEQ ID NO: 458820 - RNA, 16 nt, Chlamydia trachomatis
uacaccagauccgaua

SEQ ID NO: 458821 - RNA, 23 nt, Chlamydia trachomatis
uaaugagcagaauagauucccuu

SEQ ID NO: 458822 - RNA, 15 nt, Chlamydia trachomatis
uaacugcagcaucua

SEQ ID NO: 458823 - RNA, 20 nt, Chlamydia trachomatis
uaagccgaguagacucuaau

SEQ ID NO: 458824 - RNA, 20 nt, Chlamydia trachomatis
uaaguuccgcucgauauccu

SEQ ID NO: 458825 - RNA, 19 nt, Chlamydia trachomatis
uaccacaauuuuucuugua

SEQ ID NO: 458826 - RNA, 13 nt, Chlamydia trachomatis
uagaaugggaagc

SEQ ID NO: 458827 - RNA, 14 nt, Chlamydia trachomatis
uacuggcagggaua

SEQ ID NO: 458828 - RNA, 22 nt, Chlamydia trachomatis
uacuaucaggaauaaugauuuu

SEQ ID NO: 458829 - RNA, 15 nt, Chlamydia trachomatis
uacucaacacgaaca

SEQ ID NO: 458830 - RNA, 18 nt, Chlamydia trachomatis
uagccaaagguuguugcu

SEQ ID NO: 458831 - RNA, 18 nt, Chlamydia trachomatis
uagcagccaauuucucua

SEQ ID NO: 458832 - RNA, 21 nt, Chlamydia trachomatis
uaucgaaaguaaaauuccuga

SEQ ID NO: 458833 - RNA, 15 nt, Chlamydia trachomatis
uaucugcuauagaaa

SEQ ID NO: 458834 - RNA, 13 nt, Chlamydia trachomatis
ucaaaaauagcaa

SEQ ID NO: 458835 - RNA, 14 nt, Chlamydia trachomatis
uaugcggcaauacc

SEQ ID NO: 458836 - RNA, 18 nt, Chlamydia trachomatis
uaugcuuuuuaauauccu

SEQ ID NO: 458837 - RNA, 22 nt, Chlamydia trachomatis
ucaaauauuuuacggaaagagu

SEQ ID NO: 458838 - RNA, 20 nt, Chlamydia trachomatis
ucaaauuuucaugaaaagcu

SEQ ID NO: 458839 - RNA, 19 nt, Chlamydia trachomatis
ucaaccucucaucaguaaa

SEQ ID NO: 458840 - RNA, 22 nt, Chlamydia trachomatis
ucacaaauaacagaaacguuua

SEQ ID NO: 458841 - RNA, 18 nt, Chlamydia trachomatis
ucagcagcauaaauccuu

SEQ ID NO: 458842 - RNA, 19 nt, Chlamydia trachomatis
ucagcagaucauccauaaa

SEQ ID NO: 458843 - RNA, 19 nt, Chlamydia trachomatis
ucagccaugggaucuagaa

SEQ ID NO: 458844 - RNA, 21 nt, Chlamydia trachomatis
ucauaauuaaagguuucccaa

SEQ ID NO: 458845 - RNA, 13 nt, Chlamydia trachomatis
uccaauccuuggc

SEQ ID NO: 458846 - RNA, 22 nt, Chlamydia trachomatis
uccaguucuggagcaacaacca

SEQ ID NO: 458847 - RNA, 17 nt, Chlamydia trachomatis
uccagcucgaucaauaa

SEQ ID NO: 458848 - RNA, 19 nt, Chlamydia trachomatis
ucccacaaacaaaaaagaa

SEQ ID NO: 458849 - RNA, 16 nt, Chlamydia trachomatis
ucccaaaccuccuaaa

SEQ ID NO: 458850 - RNA, 21 nt, Chlamydia trachomatis
uccauauauucagaagaagag

SEQ ID NO: 458851 - RNA, 14 nt, Chlamydia trachomatis
ucccauaaucucau

SEQ ID NO: 458852 - RNA, 21 nt, Chlamydia trachomatis
uccccuacgcuacgagcaaca

SEQ ID NO: 458853 - RNA, 18 nt, Chlamydia trachomatis
uccgcaaacaaaauaauc

SEQ ID NO: 458854 - RNA, 17 nt, Chlamydia trachomatis
uccggaucaauccccaa

SEQ ID NO: 458855 - RNA, 22 nt, Chlamydia trachomatis
ucgagaaaaugaugaaaaagaa

SEQ ID NO: 458856 - RNA, 16 nt, Chlamydia trachomatis
ucgcccuacggaacca

SEQ ID NO: 458857 - RNA, 14 nt, Chlamydia trachomatis
ucgcuaucaauaaa

SEQ ID NO: 458858 - RNA, 18 nt, Chlamydia trachomatis
ucggcccuugagauccuu

SEQ ID NO: 458859 - RNA, 18 nt, Chlamydia trachomatis
ucgucugcgaaaaagaaa

SEQ ID NO: 458860 - RNA, 12 nt, Chlamydia trachomatis
ucuaaaagaaua

SEQ ID NO: 458861 - RNA, 15 nt, Chlamydia trachomatis
ucuaaaauuuuacgu

SEQ ID NO: 458862 - RNA, 19 nt, Chlamydia trachomatis
ucuaaagucuuaaaagggu

SEQ ID NO: 458863 - RNA, 17 nt, Chlamydia trachomatis
ucuccaaagaauagaau

SEQ ID NO: 458864 - RNA, 15 nt, Chlamydia trachomatis
ucucauaaggaguuu

SEQ ID NO: 458865 - RNA, 21 nt, Chlamydia trachomatis
ucuaagauuuucaucuuccaa

SEQ ID NO: 458866 - RNA, 13 nt, Chlamydia trachomatis
ucuacuuucccua

SEQ ID NO: 458867 - RNA, 23 nt, Chlamydia trachomatis
ugaaagcuagaagaaucauagaa

SEQ ID NO: 458868 - RNA, 23 nt, Chlamydia trachomatis
ugaaagcuauuuucuuccugcuu

SEQ ID NO: 458869 - RNA, 16 nt, Chlamydia trachomatis
ucuuugguaauagcaa

SEQ ID NO: 458870 - RNA, 14 nt, Chlamydia trachomatis
ucuuucaauagcau

SEQ ID NO: 458871 - RNA, 21 nt, Chlamydia trachomatis
ugaaaguagcuacuuucgcuu

SEQ ID NO: 458872 - RNA, 17 nt, Chlamydia trachomatis
ugaagcuaaaaaaucca

SEQ ID NO: 458873 - RNA, 18 nt, Chlamydia trachomatis
ugaagacccguuuucucu

SEQ ID NO: 458874 - RNA, 15 nt, Chlamydia trachomatis
ugaauaagcuugcaa

SEQ ID NO: 458875 - RNA, 17 nt, Chlamydia trachomatis
ugaauauacccauuugc

SEQ ID NO: 458876 - RNA, 18 nt, Chlamydia trachomatis
ugacaauccgaagauuau

SEQ ID NO: 458877 - RNA, 23 nt, Chlamydia trachomatis
ugacgaggggcuaccucuaaaga

SEQ ID NO: 458878 - RNA, 14 nt, Chlamydia trachomatis
ugagcauuucucuc

SEQ ID NO: 458879 - RNA, 14 nt, Chlamydia trachomatis
ugacuguagcaacg

SEQ ID NO: 458880 - RNA, 15 nt, Chlamydia trachomatis
ugacucucauaagaa

SEQ ID NO: 458881 - RNA, 22 nt, Chlamydia trachomatis
ugagcuucucgcuacaaauccu

SEQ ID NO: 458882 - RNA, 22 nt, Chlamydia trachomatis
ugagcuauaccgccucaaacaa

SEQ ID NO: 458883 - RNA, 13 nt, Chlamydia trachomatis
ugauaaaaacucu

SEQ ID NO: 458884 - RNA, 19 nt, Chlamydia trachomatis
ugaugaaaccuaauagaaa

SEQ ID NO: 458885 - RNA, 19 nt, Chlamydia trachomatis
ugauuuuucuuucaaagag

SEQ ID NO: 458886 - RNA, 18 nt, Chlamydia trachomatis
ugcaaagcuuuucuccuu

SEQ ID NO: 458887 - RNA, 22 nt, Chlamydia trachomatis
ugcauaccaagcuuucugccaa

SEQ ID NO: 458888 - RNA, 15 nt, Chlamydia trachomatis
ugcaccggcaaagaa

SEQ ID NO: 458889 - RNA, 16 nt, Chlamydia trachomatis
gccuccgcuaauuuuu

SEQ ID NO: 458890 - RNA, 20 nt, Chlamydia trachomatis
gcgucuaucuaccuuuuucc

SEQ ID NO: 458891 - RNA, 17 nt, Chlamydia trachomatis
gcuaagguaacaaucac

SEQ ID NO: 458892 - RNA, 23 nt, Chlamydia trachomatis
gcuaacuugcaggagauaauuuu

SEQ ID NO: 458893 - RNA, 14 nt, Chlamydia trachomatis
gcuaagaaccacaa

SEQ ID NO: 458894 - RNA, 19 nt, Chlamydia trachomatis
gcuacagaguuaacuauuu

SEQ ID NO: 458895 - RNA, 22 nt, Chlamydia trachomatis
gcuaauaacccgcuuugaaagu

SEQ ID NO: 458896 - RNA, 16 nt, Chlamydia trachomatis
gcuaccaaaaauuuuu

SEQ ID NO: 458897 - RNA, 13 nt, Chlamydia trachomatis
gcucgagaaauga

SEQ ID NO: 458898 - RNA, 17 nt, Chlamydia trachomatis
gcuccuaacaaagcucu

SEQ ID NO: 458899 - RNA, 14 nt, Chlamydia trachomatis
gcucuagcaauaga

SEQ ID NO: 458900 - RNA, 19 nt, Chlamydia trachomatis
gcucuccuaaugaugagaa

SEQ ID NO: 458901 - RNA, 19 nt, Chlamydia trachomatis
gcuuaacuuuguuauuuuu

SEQ ID NO: 458902 - RNA, 15 nt, Chlamydia trachomatis
gcuuccugaacgaua

SEQ ID NO: 458903 - RNA, 20 nt, Chlamydia trachomatis
gcuucugccauuucuaaagg

SEQ ID NO: 458904 - RNA, 14 nt, Chlamydia trachomatis
gcuucugaacgaga

SEQ ID NO: 458905 - RNA, 16 nt, Chlamydia trachomatis
gcuucuaacgcuuccu

SEQ ID NO: 458906 - RNA, 17 nt, Chlamydia trachomatis
gcuucuggcgauaguuc

SEQ ID NO: 458907 - RNA, 20 nt, Chlamydia trachomatis
gcuucuuaguggcuucggga

SEQ ID NO: 458908 - RNA, 20 nt, Chlamydia trachomatis
gcuuugcacaccugcuuucu

SEQ ID NO: 458909 - RNA, 18 nt, Chlamydia trachomatis
ggaaacauuccaaauauu

SEQ ID NO: 458910 - RNA, 16 nt, Chlamydia trachomatis
ggaaaugaaggccaaa

SEQ ID NO: 458911 - RNA, 15 nt, Chlamydia trachomatis
ggaauaaaucucuuc

SEQ ID NO: 458912 - RNA, 21 nt, Chlamydia trachomatis
ggaagugguuaaugucucuuc

SEQ ID NO: 458913 - RNA, 17 nt, Chlamydia trachomatis
ggacgaucauuaggauu

SEQ ID NO: 458914 - RNA, 14 nt, Chlamydia trachomatis
ggagaacucuuucc

SEQ ID NO: 458915 - RNA, 13 nt, Chlamydia trachomatis
ggcuccauaaaag

SEQ ID NO: 458916 - RNA, 17 nt, Chlamydia trachomatis
ggguuuuuuuauugauc

SEQ ID NO: 458917 - RNA, 21 nt, Chlamydia trachomatis
gguuuuaagaccuaguaagug

SEQ ID NO: 458918 - RNA, 12 nt, Chlamydia trachomatis
gguuuugauuuc

SEQ ID NO: 458919 - RNA, 11 nt, Chlamydia trachomatis
guaagaccaaa

SEQ ID NO: 458920 - RNA, 15 nt, Chlamydia trachomatis
guaucgaaaguaaaa

SEQ ID NO: 458921 - RNA, 16 nt, Chlamydia trachomatis
gucaaagaaguaauga

SEQ ID NO: 458922 - RNA, 15 nt, Chlamydia trachomatis
guagcaccaaguucu

SEQ ID NO: 458923 - RNA, 14 nt, Chlamydia trachomatis
gucgaaaagcuucu

SEQ ID NO: 458924 - RNA, 17 nt, Chlamydia trachomatis
guccuuacauaaaaaag

SEQ ID NO: 458925 - RNA, 13 nt, Chlamydia trachomatis
gugaagaaacuuc

SEQ ID NO: 458926 - RNA, 22 nt, Chlamydia trachomatis
gugaugaaaccuaauagaaaua

SEQ ID NO: 458927 - RNA, 15 nt, Chlamydia trachomatis
aagucuuuaauaccu

SEQ ID NO: 458928 - RNA, 17 nt, Chlamydia trachomatis
aagugccaacaucaaaa

SEQ ID NO: 458929 - RNA, 23 nt, Chlamydia trachomatis
gugccucaauuuguagcaaaaga

SEQ ID NO: 458930 - RNA, 21 nt, Chlamydia trachomatis
guuaccugugaagaaacuucu

SEQ ID NO: 458931 - RNA, 22 nt, Chlamydia trachomatis
aaguuccuuagcuaaaagcucu

SEQ ID NO: 458932 - RNA, 14 nt, Chlamydia trachomatis
guuauuuguucucu

SEQ ID NO: 458933 - RNA, 18 nt, Chlamydia trachomatis
guuaauaucccacucuuc

SEQ ID NO: 458934 - RNA, 16 nt, Chlamydia trachomatis
guggccauucuuacua

SEQ ID NO: 458935 - RNA, 15 nt, Chlamydia trachomatis
guuuacaaaugauuu

SEQ ID NO: 458936 - RNA, 21 nt, Chlamydia trachomatis
uaaauccucuuugaauauccg

SEQ ID NO: 458937 - RNA, 14 nt, Chlamydia trachomatis
uaacaauccccaaa

SEQ ID NO: 458938 - RNA, 15 nt, Chlamydia trachomatis
uaacagcaagcuugu

SEQ ID NO: 458939 - RNA, 19 nt, Chlamydia trachomatis
uaaagauccucuuucgcuu

SEQ ID NO: 458940 - RNA, 12 nt, Chlamydia trachomatis
uaaagaaaagcu

SEQ ID NO: 458941 - RNA, 17 nt, Chlamydia trachomatis
uaaacaaggauuuucuu

SEQ ID NO: 458942 - RNA, 22 nt, Chlamydia trachomatis
uaaaagagaagaacccucuuca

SEQ ID NO: 458943 - RNA, 21 nt, Chlamydia trachomatis
uaaaagagcuucuucuaaaga

SEQ ID NO: 458944 - RNA, 15 nt, Chlamydia trachomatis
uaaaagaguuucuuu

SEQ ID NO: 458945 - RNA, 18 nt, Chlamydia trachomatis
uaaaaggcguaaaccuuc

SEQ ID NO: 458946 - RNA, 14 nt, Chlamydia trachomatis
uaaaaguugcucuu

SEQ ID NO: 458947 - RNA, 18 nt, Chlamydia trachomatis
uaagaaauuaacccaaga

SEQ ID NO: 458948 - RNA, 13 nt, Chlamydia trachomatis
uaagaaccacaac

SEQ ID NO: 458949 - RNA, 19 nt, Chlamydia trachomatis
uaagcauagcuucuugcgu

SEQ ID NO: 458950 - RNA, 18 nt, Chlamydia trachomatis
uaauccaugcaucuccuc

SEQ ID NO: 458951 - RNA, 16 nt, Chlamydia trachomatis
uaauucaacauaauaa

SEQ ID NO: 458952 - RNA, 19 nt, Chlamydia trachomatis
uacccugaaagacuuucca

SEQ ID NO: 458953 - RNA, 16 nt, Chlamydia trachomatis
uaccauccgggaauga

SEQ ID NO: 458954 - RNA, 20 nt, Chlamydia trachomatis
uacaaaccgaagagggaaga

SEQ ID NO: 458955 - RNA, 18 nt, Chlamydia trachomatis
uacugucagaccuacaaa

SEQ ID NO: 458956 - RNA, 21 nt, Chlamydia trachomatis
uacuccucgucgaagaaaucc

SEQ ID NO: 458957 - RNA, 18 nt, Chlamydia trachomatis
uagauuagaagauaacaa

SEQ ID NO: 458958 - RNA, 13 nt, Chlamydia trachomatis
uagccaauccgua

SEQ ID NO: 458959 - RNA, 23 nt, Chlamydia trachomatis
uagcuucagaagaagauguuguu

SEQ ID NO: 458960 - RNA, 15 nt, Chlamydia trachomatis
uaguaacggaacucu

SEQ ID NO: 458961 - RNA, 16 nt, Chlamydia trachomatis
uaguuagugaagucug

SEQ ID NO: 458962 - RNA, 18 nt, Chlamydia trachomatis
uagucugggcgaucuccu

SEQ ID NO: 458963 - RNA, 16 nt, Chlamydia trachomatis
uagucaugaauggaaa

SEQ ID NO: 458964 - RNA, 21 nt, Chlamydia trachomatis
uauaaguucagccccuaaagc

SEQ ID NO: 458965 - RNA, 21 nt, Chlamydia trachomatis
uauaaaugaaaccccucuuuc

SEQ ID NO: 458966 - RNA, 17 nt, Chlamydia trachomatis
uauguaaggaaauaccu

SEQ ID NO: 458967 - RNA, 13 nt, Chlamydia trachomatis
uauuccaaauccu

SEQ ID NO: 458968 - RNA, 23 nt, Chlamydia trachomatis
uauuccagcuccuuauaaauccu

SEQ ID NO: 458969 - RNA, 18 nt, Chlamydia trachomatis
uauucguaggguuguuuu

SEQ ID NO: 458970 - RNA, 13 nt, Chlamydia trachomatis
ucaaauuucucua

SEQ ID NO: 458971 - RNA, 23 nt, Chlamydia trachomatis
uauuucucuuccugaauacucaa

SEQ ID NO: 458972 - RNA, 18 nt, Chlamydia trachomatis
ucagagaaaauuucucuu

SEQ ID NO: 458973 - RNA, 16 nt, Chlamydia trachomatis
ucagagccagcuuuaa

SEQ ID NO: 458974 - RNA, 13 nt, Chlamydia trachomatis
ucacuguuuuugc

SEQ ID NO: 458975 - RNA, 18 nt, Chlamydia trachomatis
ucacagaaaguccugcuu

SEQ ID NO: 458976 - RNA, 17 nt, Chlamydia trachomatis
uccacgaauuuucucuc

SEQ ID NO: 458977 - RNA, 17 nt, Chlamydia trachomatis
uccaccuaauuccccaa

SEQ ID NO: 458978 - RNA, 18 nt, Chlamydia trachomatis
uccccaaagucaucgcua

SEQ ID NO: 458979 - RNA, 18 nt, Chlamydia trachomatis
uccugcagcuaaagaauc

SEQ ID NO: 458980 - RNA, 23 nt, Chlamydia trachomatis
uccucuggauauaccacggaaca

SEQ ID NO: 458981 - RNA, 22 nt, Chlamydia trachomatis
uccucuggcuuaucaacaagau

SEQ ID NO: 458982 - RNA, 18 nt, Chlamydia trachomatis
uccuguauaagaaaaagg

SEQ ID NO: 458983 - RNA, 20 nt, Chlamydia trachomatis
ucgaaggaauacccagaagu

SEQ ID NO: 458984 - RNA, 22 nt, Chlamydia trachomatis
ucgcauaguguugaucuuauua

SEQ ID NO: 458985 - RNA, 15 nt, Chlamydia trachomatis
ucgccaaaaaucauu

SEQ ID NO: 458986 - RNA, 22 nt, Chlamydia trachomatis
aauacccaggguagcuguagca

SEQ ID NO: 458987 - RNA, 22 nt, Chlamydia trachomatis
aauaccugagggcgagucucgu

SEQ ID NO: 458988 - RNA, 15 nt, Chlamydia trachomatis
ucgcuaucaauaaaa

SEQ ID NO: 458989 - RNA, 15 nt, Chlamydia trachomatis
ucgucuguucuccuu

SEQ ID NO: 458990 - RNA, 17 nt, Chlamydia trachomatis
ucgucguacuccucguc

SEQ ID NO: 458991 - RNA, 15 nt, Chlamydia trachomatis
ucucaggauaaaacc

SEQ ID NO: 458992 - RNA, 20 nt, Chlamydia trachomatis
ucucggaucgagaagagcca

SEQ ID NO: 458993 - RNA, 12 nt, Chlamydia trachomatis
ucucgcuacaaa

SEQ ID NO: 458994 - RNA, 20 nt, Chlamydia trachomatis
ucucuaaaaucacacaagcu

SEQ ID NO: 458995 - RNA, 13 nt, Chlamydia trachomatis
ucucuuguuucaa

SEQ ID NO: 458996 - RNA, 15 nt, Chlamydia trachomatis
ucucuuuaugaaaaa

SEQ ID NO: 458997 - RNA, 19 nt, Chlamydia trachomatis
ucucuuuucgaacaaaacu

SEQ ID NO: 458998 - RNA, 16 nt, Chlamydia trachomatis
ucugacuuuuuagcau

SEQ ID NO: 458999 - RNA, 16 nt, Chlamydia trachomatis
ucugaacgagaaaaag

SEQ ID NO: 459000 - RNA, 15 nt, Chlamydia trachomatis
ucugcaagaaaauag

SEQ ID NO: 459001 - RNA, 22 nt, Chlamydia trachomatis
ucuuaaacaaaaauaacgauuc

SEQ ID NO: 459002 - RNA, 18 nt, Chlamydia trachomatis
ucuuagauuuucaugcaa

SEQ ID NO: 459003 - RNA, 13 nt, Chlamydia trachomatis
ucuucacaccacg

SEQ ID NO: 459004 - RNA, 13 nt, Chlamydia trachomatis
ucuucacuuugau

SEQ ID NO: 459005 - RNA, 15 nt, Chlamydia trachomatis
ucuucuagagauauc

SEQ ID NO: 459006 - RNA, 13 nt, Chlamydia trachomatis
ucuucuauuuguu

SEQ ID NO: 459007 - RNA, 22 nt, Chlamydia trachomatis
ucuuucaugcgaagcaaauccu

SEQ ID NO: 459008 - RNA, 16 nt, Chlamydia trachomatis
ugaccguuaauauccc

SEQ ID NO: 459009 - RNA, 16 nt, Chlamydia trachomatis
ugacucccauaaucac

SEQ ID NO: 459010 - RNA, 19 nt, Chlamydia trachomatis
ugauaucuucugaagucuu

SEQ ID NO: 459011 - RNA, 17 nt, Chlamydia trachomatis
ugcagagggccucccau

SEQ ID NO: 459012 - RNA, 14 nt, Chlamydia trachomatis
ugcagccuuucccu

SEQ ID NO: 459013 - RNA, 19 nt, Chlamydia trachomatis
aauagccuccaaacauuuu

SEQ ID NO: 459014 - RNA, 20 nt, Chlamydia trachomatis
aauagcacgcaaaacaucua

SEQ ID NO: 459015 - RNA, 22 nt, Chlamydia trachomatis
aauagcaacucuuucauaaaac

SEQ ID NO: 459016 - RNA, 22 nt, Chlamydia trachomatis
aauagcugccagugcucaaaga

SEQ ID NO: 459017 - RNA, 18 nt, Chlamydia trachomatis
aauagcucugcagauuuu

SEQ ID NO: 459018 - RNA, 16 nt, Chlamydia trachomatis
aauagcugacuuugaa

SEQ ID NO: 459019 - RNA, 16 nt, Chlamydia trachomatis
ugccuguggcaacuaa

SEQ ID NO: 459020 - RNA, 17 nt, Chlamydia trachomatis
ugcggauuaaagaagga

SEQ ID NO: 459021 - RNA, 16 nt, Chlamydia trachomatis
ugcuccggcaaauccu

SEQ ID NO: 459022 - RNA, 21 nt, Chlamydia trachomatis
aauaucaaaguagcaaucacu

SEQ ID NO: 459023 - RNA, 14 nt, Chlamydia trachomatis
aauaucuucagaag

SEQ ID NO: 459024 - RNA, 19 nt, Chlamydia trachomatis
uguaggggaaauagcgauu

SEQ ID NO: 459025 - RNA, 17 nt, Chlamydia trachomatis
ugucugugauaucccuu

SEQ ID NO: 459026 - RNA, 18 nt, Chlamydia trachomatis
uguucuuuuaggcaacag

SEQ ID NO: 459027 - RNA, 23 nt, Chlamydia trachomatis
uuaaaggaauaauuuuccacaaa

SEQ ID NO: 459028 - RNA, 21 nt, Chlamydia trachomatis
uuaaaucccaguacaucaaau

SEQ ID NO: 459029 - RNA, 22 nt, Chlamydia trachomatis
uuacaggauagccaaagguugu

SEQ ID NO: 459030 - RNA, 20 nt, Chlamydia trachomatis
uuaacccuucaggaaagccu

SEQ ID NO: 459031 - RNA, 22 nt, Chlamydia trachomatis
uuagcucguuuagcagccugag

SEQ ID NO: 459032 - RNA, 22 nt, Chlamydia trachomatis
uuaggacugccgaacugcuuuc

SEQ ID NO: 459033 - RNA, 21 nt, Chlamydia trachomatis
uuaggccauuucaugacagcu

SEQ ID NO: 459034 - RNA, 21 nt, Chlamydia trachomatis
uuacggaaaguuccaucuccu

SEQ ID NO: 459035 - RNA, 20 nt, Chlamydia trachomatis
uuacggccccuggaauuucu

SEQ ID NO: 459036 - RNA, 17 nt, Chlamydia trachomatis
uuagauacacagaaaga

SEQ ID NO: 459037 - RNA, 22 nt, Chlamydia trachomatis
uucaugaaaagcuuucaaagcg

SEQ ID NO: 459038 - RNA, 20 nt, Chlamydia trachomatis
uucauugacuguagcaacga

SEQ ID NO: 459039 - RNA, 15 nt, Chlamydia trachomatis
uuccauaaaauccaa

SEQ ID NO: 459040 - RNA, 13 nt, Chlamydia trachomatis
uucgaaaagaguu

SEQ ID NO: 459041 - RNA, 17 nt, Chlamydia trachomatis
uuccuugacucuaaaga

SEQ ID NO: 459042 - RNA, 23 nt, Chlamydia trachomatis
uucuaauaauacagauuuuucga

SEQ ID NO: 459043 - RNA, 14 nt, Chlamydia trachomatis
uucuagauagaaga

SEQ ID NO: 459044 - RNA, 19 nt, Chlamydia trachomatis
uucguuacgcguaaagauu

SEQ ID NO: 459045 - RNA, 15 nt, Chlamydia trachomatis
uucuaaagaaaagcu

SEQ ID NO: 459046 - RNA, 13 nt, Chlamydia trachomatis
uucgggauaagau

SEQ ID NO: 459047 - RNA, 21 nt, Chlamydia trachomatis
uugaucuuauuaaccaacucu

SEQ ID NO: 459048 - RNA, 14 nt, Chlamydia trachomatis
uugcauaaggaagc

SEQ ID NO: 459049 - RNA, 18 nt, Chlamydia trachomatis
uuguaaagcauucguuau

SEQ ID NO: 459050 - RNA, 21 nt, Chlamydia trachomatis
uuguaaagcauucguuaucaa

SEQ ID NO: 459051 - RNA, 17 nt, Chlamydia trachomatis
uuguaagaacccuuugu

SEQ ID NO: 459052 - RNA, 15 nt, Chlamydia trachomatis
uugucuacuuuuugu

SEQ ID NO: 459053 - RNA, 13 nt, Chlamydia trachomatis
uuucuuacuccuu

SEQ ID NO: 459054 - RNA, 20 nt, Chlamydia trachomatis
uuucugaguccucuaaagua

SEQ ID NO: 459055 - RNA, 19 nt, Chlamydia trachomatis
uuucuucaggugaucucuu

SEQ ID NO: 459056 - RNA, 19 nt, Chlamydia trachomatis
uuucuugaggaagauaagu

SEQ ID NO: 459057 - RNA, 15 nt, Chlamydia trachomatis
uuuaaagaggaucag

SEQ ID NO: 459058 - RNA, 18 nt, Chlamydia trachomatis
uuugcauguaaucccuuu

SEQ ID NO: 459059 - RNA, 15 nt, Chlamydia trachomatis
uuugauucugcuuug

SEQ ID NO: 459060 - RNA, 16 nt, Chlamydia trachomatis
uuugcaacaaagcuuu

SEQ ID NO: 459061 - RNA, 17 nt, Chlamydia trachomatis
uuugaggaagaaauguu

SEQ ID NO: 459062 - RNA, 17 nt, Chlamydia trachomatis
uuugggauagauagcuc

SEQ ID NO: 459063 - RNA, 17 nt, Chlamydia trachomatis
uuuuaauaggcccguuu

SEQ ID NO: 459064 - RNA, 22 nt, Chlamydia trachomatis
aaucguauaaguuuuaagaaga

SEQ ID NO: 459065 - RNA, 13 nt, Chlamydia trachomatis
uuuuucugcuaga

SEQ ID NO: 459066 - RNA, 21 nt, Chlamydia trachomatis
uuuuaguaccauaacaucuaa

SEQ ID NO: 459067 - RNA, 16 nt, Chlamydia trachomatis
uuuuguuuucaaaagc

SEQ ID NO: 459068 - RNA, 12 nt, Chlamydia trachomatis
uuuuucaaaaau

SEQ ID NO: 459069 - RNA, 21 nt, Chlamydia trachomatis
aaugucgcugaggcaauaaaa

SEQ ID NO: 459070 - RNA, 17 nt, Chlamydia trachomatis
aaugugauugacaacuu

SEQ ID NO: 459071 - RNA, 17 nt, Chlamydia trachomatis
aauguugaagucuccga

SEQ ID NO: 459072 - RNA, 22 nt, Chlamydia trachomatis
aauguuuggauaagaacuucuc

SEQ ID NO: 459073 - RNA, 17 nt, Chlamydia trachomatis
acaaaaaaugcgcucuu

SEQ ID NO: 459074 - RNA, 19 nt, Chlamydia trachomatis
acaaaccaucuguaaagcu

SEQ ID NO: 459075 - RNA, 17 nt, Chlamydia trachomatis
acaaagaucguaaaaua

SEQ ID NO: 459076 - RNA, 22 nt, Chlamydia trachomatis
acaaauuucuauagaagaauuc

SEQ ID NO: 459077 - RNA, 24 nt, Chlamydia trachomatis
acaacuaaaggaaacaagcagauu

SEQ ID NO: 459078 - RNA, 20 nt, Chlamydia trachomatis
acaauaauacaaagcacgau

SEQ ID NO: 459079 - RNA, 16 nt, Chlamydia trachomatis
acaaucucaaaaacac

SEQ ID NO: 459080 - RNA, 20 nt, Chlamydia trachomatis
acacaagcagacaagcaaua

SEQ ID NO: 459081 - RNA, 15 nt, Chlamydia trachomatis
acacagcaucaagaa

SEQ ID NO: 459082 - RNA, 18 nt, Chlamydia trachomatis
acauaaacgguggaacag

SEQ ID NO: 459083 - RNA, 13 nt, Chlamydia trachomatis
accaaagcauuuu

SEQ ID NO: 459084 - RNA, 14 nt, Chlamydia trachomatis
accaaguucuucuu

SEQ ID NO: 459085 - RNA, 16 nt, Chlamydia trachomatis
accaagccauuuccag

SEQ ID NO: 459086 - RNA, 20 nt, Chlamydia trachomatis
accaauagagaccgcucucu

SEQ ID NO: 459087 - RNA, 14 nt, Chlamydia trachomatis
accaaucaaaaacg

SEQ ID NO: 459088 - RNA, 19 nt, Chlamydia trachomatis
acaugauagucagaauaau

SEQ ID NO: 459089 - RNA, 19 nt, Chlamydia trachomatis
accacacuucucgaaaaaa

SEQ ID NO: 459090 - RNA, 16 nt, Chlamydia trachomatis
acccgcggaucccaaa

SEQ ID NO: 459091 - RNA, 20 nt, Chlamydia trachomatis
accuccuuuauauucuucuu

SEQ ID NO: 459092 - RNA, 13 nt, Chlamydia trachomatis
accucaauagcug

SEQ ID NO: 459093 - RNA, 19 nt, Chlamydia trachomatis
accucuuuuuuucccuaga

SEQ ID NO: 459094 - RNA, 18 nt, Chlamydia trachomatis
acgaaguaggagaugcuu

SEQ ID NO: 459095 - RNA, 20 nt, Chlamydia trachomatis
accuuuaccaaagaauucuu

SEQ ID NO: 459096 - RNA, 20 nt, Chlamydia trachomatis
acgcacaaagauuucuucuu

SEQ ID NO: 459097 - RNA, 15 nt, Chlamydia trachomatis
acgaggcacaaaauc

SEQ ID NO: 459098 - RNA, 17 nt, Chlamydia trachomatis
acgccuguuuucuugua

SEQ ID NO: 459099 - RNA, 18 nt, Chlamydia trachomatis
acuaaaugucucuaagua

SEQ ID NO: 459100 - RNA, 15 nt, Chlamydia trachomatis
acucuuccuugauua

SEQ ID NO: 459101 - RNA, 16 nt, Chlamydia trachomatis
acuccagagcaaauag

SEQ ID NO: 459102 - RNA, 21 nt, Chlamydia trachomatis
acuaggcucaugagccucuaa

SEQ ID NO: 459103 - RNA, 21 nt, Chlamydia trachomatis
agaagacgcucauaaagagcc

SEQ ID NO: 459104 - RNA, 19 nt, Chlamydia trachomatis
agaagaaaagagcuuuucu

SEQ ID NO: 459105 - RNA, 20 nt, Chlamydia trachomatis
agaagaagccccaauagcua

SEQ ID NO: 459106 - RNA, 22 nt, Chlamydia trachomatis
agaacugucuucuuucaaagaa

SEQ ID NO: 459107 - RNA, 11 nt, Chlamydia trachomatis
agaaccuucca

SEQ ID NO: 459108 - RNA, 14 nt, Chlamydia trachomatis
agaacccuaucccc

SEQ ID NO: 459109 - RNA, 21 nt, Chlamydia trachomatis
agaagcuaauagcuugaagaa

SEQ ID NO: 459110 - RNA, 12 nt, Chlamydia trachomatis
agaauaacuccc

SEQ ID NO: 459111 - RNA, 21 nt, Chlamydia trachomatis
agaauugccgaaucaaagacu

SEQ ID NO: 459112 - RNA, 21 nt, Chlamydia trachomatis
agacauagcuuguuccguugu

SEQ ID NO: 459113 - RNA, 20 nt, Chlamydia trachomatis
agaccuacaaagauaaucaa

SEQ ID NO: 459114 - RNA, 12 nt, Chlamydia trachomatis
agagccaaaaua

SEQ ID NO: 459115 - RNA, 23 nt, Chlamydia trachomatis
agagcauccauauauucagaaga

SEQ ID NO: 459116 - RNA, 13 nt, Chlamydia trachomatis
agagaaaaucaua

SEQ ID NO: 459117 - RNA, 22 nt, Chlamydia trachomatis
agagacacuauuaaaaaggcua

SEQ ID NO: 459118 - RNA, 20 nt, Chlamydia trachomatis
agaguucuucaaaugcggua

SEQ ID NO: 459119 - RNA, 17 nt, Chlamydia trachomatis
agagucugcuacaaacu

SEQ ID NO: 459120 - RNA, 22 nt, Chlamydia trachomatis
agauacaacuuggaccauaaaa

SEQ ID NO: 459121 - RNA, 15 nt, Chlamydia trachomatis
agcaaaaaaagaggu

SEQ ID NO: 459122 - RNA, 20 nt, Chlamydia trachomatis
agcaagcugaggaagcauuu

SEQ ID NO: 459123 - RNA, 19 nt, Chlamydia trachomatis
agcaauagcgcaaaaggcu

SEQ ID NO: 459124 - RNA, 19 nt, Chlamydia trachomatis
agcaccuguuuaucuucau

SEQ ID NO: 459125 - RNA, 14 nt, Chlamydia trachomatis
agcagcuaauacuu

SEQ ID NO: 459126 - RNA, 22 nt, Chlamydia trachomatis
agcauaguauuacggaaaagcu

SEQ ID NO: 459127 - RNA, 18 nt, Chlamydia trachomatis
agcauguuucggaauuca

SEQ ID NO: 459128 - RNA, 13 nt, Chlamydia trachomatis
agcauaauauccc

SEQ ID NO: 459129 - RNA, 19 nt, Chlamydia trachomatis
agcuucuagaaauucuuca

SEQ ID NO: 459130 - RNA, 16 nt, Chlamydia trachomatis
agcuucgaggagucuc

SEQ ID NO: 459131 - RNA, 18 nt, Chlamydia trachomatis
agcuugaucaaagaaucu

SEQ ID NO: 459132 - RNA, 16 nt, Chlamydia trachomatis
agcuuucguugaucac

SEQ ID NO: 459133 - RNA, 15 nt, Chlamydia trachomatis
agcuuuuuucagaaa

SEQ ID NO: 459134 - RNA, 15 nt, Chlamydia trachomatis
agcuucuucuucucu

SEQ ID NO: 459135 - RNA, 20 nt, Chlamydia trachomatis
aggaacucccucauuaagaa

SEQ ID NO: 459136 - RNA, 14 nt, Chlamydia trachomatis
aggaauccucuucc

SEQ ID NO: 459137 - RNA, 17 nt, Chlamydia trachomatis
agcuuaguuacaagaca

SEQ ID NO: 459138 - RNA, 22 nt, Chlamydia trachomatis
agcugguuuuuuuugaaaaggg

SEQ ID NO: 459139 - RNA, 15 nt, Chlamydia trachomatis
agcugcugcccaaga

SEQ ID NO: 459140 - RNA, 14 nt, Chlamydia trachomatis
aggauaacaaacaa

SEQ ID NO: 459141 - RNA, 13 nt, Chlamydia trachomatis
aggaguaaauccu

SEQ ID NO: 459142 - RNA, 18 nt, Chlamydia trachomatis
aggauccuuaguuagcug

SEQ ID NO: 459143 - RNA, 20 nt, Chlamydia trachomatis
aggauccccacgaccacaaa

SEQ ID NO: 459144 - RNA, 22 nt, Chlamydia trachomatis
aggauaguuucgaguaauucca

SEQ ID NO: 459145 - RNA, 21 nt, Chlamydia trachomatis
aggagaauaccaccauaggua

SEQ ID NO: 459146 - RNA, 18 nt, Chlamydia trachomatis
aggagauaauuuucugac

SEQ ID NO: 459147 - RNA, 14 nt, Chlamydia trachomatis
aggcauacaggaga

SEQ ID NO: 459148 - RNA, 19 nt, Chlamydia trachomatis
aggcuccugcaagggaaca

SEQ ID NO: 459149 - RNA, 17 nt, Chlamydia trachomatis
aggcuccgccuucugca

SEQ ID NO: 459150 - RNA, 22 nt, Chlamydia trachomatis
aggcuccgccuucugcaaugag

SEQ ID NO: 459151 - RNA, 19 nt, Chlamydia trachomatis
aggcucaugaacagcaaga

SEQ ID NO: 459152 - RNA, 16 nt, Chlamydia trachomatis
aggcuucucuuuucga

SEQ ID NO: 459153 - RNA, 24 nt, Chlamydia trachomatis
aggcuucucuuuucgaacaaaacu

SEQ ID NO: 459154 - RNA, 15 nt, Chlamydia trachomatis
aggggaagaaauauu

SEQ ID NO: 459155 - RNA, 17 nt, Chlamydia trachomatis
aggguuaggaaagcacu

SEQ ID NO: 459156 - RNA, 17 nt, Chlamydia trachomatis
aggguccaaacauaaga

SEQ ID NO: 459157 - RNA, 19 nt, Chlamydia trachomatis
aguagaaacuuacuuuucu

SEQ ID NO: 459158 - RNA, 14 nt, Chlamydia trachomatis
aguccggacuuucc

SEQ ID NO: 459159 - RNA, 17 nt, Chlamydia trachomatis
agucaagagcuucuugu

SEQ ID NO: 459160 - RNA, 15 nt, Chlamydia trachomatis
agucucgaaggaaua

SEQ ID NO: 459161 - RNA, 19 nt, Chlamydia trachomatis
aguucgcuauaaucccaaa

SEQ ID NO: 459162 - RNA, 16 nt, Chlamydia trachomatis
aguuucuucgauagaa

SEQ ID NO: 459163 - RNA, 20 nt, Chlamydia trachomatis
aguuugaaucacagaaacuu

SEQ ID NO: 459164 - RNA, 16 nt, Chlamydia trachomatis
auaacagcaagacaac

SEQ ID NO: 459165 - RNA, 13 nt, Chlamydia trachomatis
auaagagcaucuu

SEQ ID NO: 459166 - RNA, 15 nt, Chlamydia trachomatis
auaauacucuucuau

SEQ ID NO: 459167 - RNA, 15 nt, Chlamydia trachomatis
auacacuaucagcca

SEQ ID NO: 459168 - RNA, 16 nt, Chlamydia trachomatis
auagcuucuaauuucu

SEQ ID NO: 459169 - RNA, 15 nt, Chlamydia trachomatis
auagcggguucuuuu

SEQ ID NO: 459170 - RNA, 13 nt, Chlamydia trachomatis
auagcuaaagcag

SEQ ID NO: 459171 - RNA, 15 nt, Chlamydia trachomatis
auaguuuaggcggca

SEQ ID NO: 459172 - RNA, 22 nt, Chlamydia trachomatis
auaguuuaggcggcauuuuauu

SEQ ID NO: 459173 - RNA, 17 nt, Chlamydia trachomatis
auauuccaaagaaaugu

SEQ ID NO: 459174 - RNA, 16 nt, Chlamydia trachomatis
auaucucaggauaaaa

SEQ ID NO: 459175 - RNA, 18 nt, Chlamydia trachomatis
auaucgagcucauuuucu

SEQ ID NO: 459176 - RNA, 18 nt, Chlamydia trachomatis
auauauggacaagcaaua

SEQ ID NO: 459177 - RNA, 16 nt, Chlamydia trachomatis
auauacauauaaugcc

SEQ ID NO: 459178 - RNA, 12 nt, Chlamydia trachomatis
aucaguaaaaau

SEQ ID NO: 459179 - RNA, 14 nt, Chlamydia trachomatis
aucaguaaaaauaa

SEQ ID NO: 459180 - RNA, 22 nt, Chlamydia trachomatis
aucauguuaaggccgagaauuu

SEQ ID NO: 459181 - RNA, 14 nt, Chlamydia trachomatis
auccaucauaaaaa

SEQ ID NO: 459182 - RNA, 14 nt, Chlamydia trachomatis
auccagaaagagcg

SEQ ID NO: 459183 - RNA, 15 nt, Chlamydia trachomatis
auccguaaggaagcc

SEQ ID NO: 459184 - RNA, 19 nt, Chlamydia trachomatis
aucgaucgaagcauuucgu

SEQ ID NO: 459185 - RNA, 15 nt, Chlamydia trachomatis
aucguaaaauagcac

SEQ ID NO: 459186 - RNA, 23 nt, Chlamydia trachomatis
aucucugguaaaaauagaaaacg

SEQ ID NO: 459187 - RNA, 22 nt, Chlamydia trachomatis
aucucuuggagagaaugaagaa

SEQ ID NO: 459188 - RNA, 16 nt, Chlamydia trachomatis
augagcuccaaaguaa

SEQ ID NO: 459189 - RNA, 24 nt, Chlamydia trachomatis
augagccgauccaucaacuguucu

SEQ ID NO: 459190 - RNA, 19 nt, Chlamydia trachomatis
augagcuuagauuuagcug

SEQ ID NO: 459191 - RNA, 11 nt, Chlamydia trachomatis
augagcauuug

SEQ ID NO: 459192 - RNA, 23 nt, Chlamydia trachomatis
augagccuugccuacagaaucag

SEQ ID NO: 459193 - RNA, 18 nt, Chlamydia trachomatis
augaucucugcagaagaa

SEQ ID NO: 459194 - RNA, 21 nt, Chlamydia trachomatis
augccuuuuguuuucaaaagc

SEQ ID NO: 459195 - RNA, 22 nt, Chlamydia trachomatis
augcgucuucccugaggcuuua

SEQ ID NO: 459196 - RNA, 16 nt, Chlamydia trachomatis
augcguuaaacuuucu

SEQ ID NO: 459197 - RNA, 15 nt, Chlamydia trachomatis
auggugaaacuuucc

SEQ ID NO: 459198 - RNA, 13 nt, Chlamydia trachomatis
auuacgaauuucu

SEQ ID NO: 459199 - RNA, 15 nt, Chlamydia trachomatis
auuaucuagaaaaga

SEQ ID NO: 459200 - RNA, 15 nt, Chlamydia trachomatis
auucaaaauagcagu

SEQ ID NO: 459201 - RNA, 16 nt, Chlamydia trachomatis
auuuccguuccgucag

SEQ ID NO: 459202 - RNA, 19 nt, Chlamydia trachomatis
auuuaucggcuaacgaguu

SEQ ID NO: 459203 - RNA, 18 nt, Chlamydia trachomatis
auuuaccggguagauaca

SEQ ID NO: 459204 - RNA, 19 nt, Chlamydia trachomatis
auuucuaggcugacuuuca

SEQ ID NO: 459205 - RNA, 19 nt, Chlamydia trachomatis
auuucuauagaagaauucg

SEQ ID NO: 459206 - RNA, 18 nt, Chlamydia trachomatis
auuucucuaggaacauuu

SEQ ID NO: 459207 - RNA, 15 nt, Chlamydia trachomatis
auuucuucuguagcc

SEQ ID NO: 459208 - RNA, 21 nt, Chlamydia trachomatis
auuugcucgcaauagauaguc

SEQ ID NO: 459209 - RNA, 16 nt, Chlamydia trachomatis
auuuggaucucuuaga

SEQ ID NO: 459210 - RNA, 21 nt, Chlamydia trachomatis
auuuggcaauggcaaaaucuu

SEQ ID NO: 459211 - RNA, 24 nt, Chlamydia trachomatis
auuugucuucgcaaacugcucuuc

SEQ ID NO: 459212 - RNA, 15 nt, Chlamydia trachomatis
auuuucguauugauc

SEQ ID NO: 459213 - RNA, 23 nt, Chlamydia trachomatis
auuuucagcaaaagaagaaucuu

SEQ ID NO: 459214 - RNA, 16 nt, Chlamydia trachomatis
auuuuucagaaaaagu

SEQ ID NO: 459215 - RNA, 16 nt, Chlamydia trachomatis
auuuuuuagauagcgc

SEQ ID NO: 459216 - RNA, 20 nt, Chlamydia trachomatis
auuuuuuuauccaaaaaagu

SEQ ID NO: 459217 - RNA, 23 nt, Chlamydia trachomatis
caaaaaagaaucuaaaaagccau

SEQ ID NO: 459218 - RNA, 23 nt, Chlamydia trachomatis
caaaaaagcgucuccaaaagugu

SEQ ID NO: 459219 - RNA, 14 nt, Chlamydia trachomatis
caaacagaaccuuu

SEQ ID NO: 459220 - RNA, 15 nt, Chlamydia trachomatis
caaaacuaaaaguug

SEQ ID NO: 459221 - RNA, 14 nt, Chlamydia trachomatis
caaaacaagccuuu

SEQ ID NO: 459222 - RNA, 21 nt, Chlamydia trachomatis
caaacgaucgauccuguuugu

SEQ ID NO: 459223 - RNA, 22 nt, Chlamydia trachomatis
caacuggcaagucuaggagaua

SEQ ID NO: 459224 - RNA, 15 nt, Chlamydia trachomatis
caagcagauucuuug

SEQ ID NO: 459225 - RNA, 20 nt, Chlamydia trachomatis
caaggauuuuuuucccacaa

SEQ ID NO: 459226 - RNA, 15 nt, Chlamydia trachomatis
caauggcaaaacuuc

SEQ ID NO: 459227 - RNA, 23 nt, Chlamydia trachomatis
caauuccacgaagagcaaaauca

SEQ ID NO: 459228 - RNA, 22 nt, Chlamydia trachomatis
cacaaaggaacaucgagaaaau

SEQ ID NO: 459229 - RNA, 20 nt, Chlamydia trachomatis
cacaugccaucguugauauu

SEQ ID NO: 459230 - RNA, 14 nt, Chlamydia trachomatis
cacgauguucccca

SEQ ID NO: 459231 - RNA, 22 nt, Chlamydia trachomatis
cacugagaggaguuuuuuucac

SEQ ID NO: 459232 - RNA, 13 nt, Chlamydia trachomatis
cacugcaacuaau

SEQ ID NO: 459233 - RNA, 16 nt, Chlamydia trachomatis
caguacaucaaauaau

SEQ ID NO: 459234 - RNA, 19 nt, Chlamydia trachomatis
cauaccaagauuagauaca

SEQ ID NO: 459235 - RNA, 18 nt, Chlamydia trachomatis
cauacucuaaaaagcguu

SEQ ID NO: 459236 - RNA, 13 nt, Chlamydia trachomatis
cauaugcucuuuc

SEQ ID NO: 459237 - RNA, 19 nt, Chlamydia trachomatis
caugacauacauaagaaca

SEQ ID NO: 459238 - RNA, 11 nt, Chlamydia trachomatis
caucuuuucgc

SEQ ID NO: 459239 - RNA, 20 nt, Chlamydia trachomatis
caucuucaauggcaaaacuu

SEQ ID NO: 459240 - RNA, 18 nt, Chlamydia trachomatis
caugaucaaagaaagcuu

SEQ ID NO: 459241 - RNA, 23 nt, Chlamydia trachomatis
caugaugaugagagcagcuacaa

SEQ ID NO: 459242 - RNA, 14 nt, Chlamydia trachomatis
cauugaaaucagaa

SEQ ID NO: 459243 - RNA, 20 nt, Chlamydia trachomatis
cauuguaaauagacuucuuc

SEQ ID NO: 459244 - RNA, 15 nt, Chlamydia trachomatis
ccaaagaaauagcua

SEQ ID NO: 459245 - RNA, 23 nt, Chlamydia trachomatis
ccaauaauccauuccggcucucu

SEQ ID NO: 459246 - RNA, 16 nt, Chlamydia trachomatis
ccaccauagguagaaa

SEQ ID NO: 459247 - RNA, 23 nt, Chlamydia trachomatis
ccaccauagguagaaaaggauag

SEQ ID NO: 459248 - RNA, 16 nt, Chlamydia trachomatis
ccaccagacuauuucu

SEQ ID NO: 459249 - RNA, 14 nt, Chlamydia trachomatis
ccagcauucauaaa

SEQ ID NO: 459250 - RNA, 19 nt, Chlamydia trachomatis
ccagcgaggcuucaauaau

SEQ ID NO: 459251 - RNA, 17 nt, Chlamydia trachomatis
ccauaacguccgcuccu

SEQ ID NO: 459252 - RNA, 23 nt, Chlamydia trachomatis
ccauuuaauauggacuucccuaa

SEQ ID NO: 459253 - RNA, 21 nt, Chlamydia trachomatis
ccauuggaauuuucaucaaaa

SEQ ID NO: 459254 - RNA, 13 nt, Chlamydia trachomatis
ccgaaaaaaagau

SEQ ID NO: 459255 - RNA, 20 nt, Chlamydia trachomatis
ccgcucuuccauaauuucua

SEQ ID NO: 459256 - RNA, 14 nt, Chlamydia trachomatis
ccguaaggaagcca

SEQ ID NO: 459257 - RNA, 18 nt, Chlamydia trachomatis
ccucgcagagaaagagcc

SEQ ID NO: 459258 - RNA, 13 nt, Chlamydia trachomatis
ccuccuaaauacc

SEQ ID NO: 459259 - RNA, 18 nt, Chlamydia trachomatis
ccuccugcguuagcaaga

SEQ ID NO: 459260 - RNA, 12 nt, Chlamydia trachomatis
ccuccuccucgc

SEQ ID NO: 459261 - RNA, 12 nt, Chlamydia trachomatis
ccucuuuuucac

SEQ ID NO: 459262 - RNA, 14 nt, Chlamydia trachomatis
ccucugucaauaaa

SEQ ID NO: 459263 - RNA, 20 nt, Chlamydia trachomatis
ccuucauuucaagagagauc

SEQ ID NO: 459264 - RNA, 17 nt, Chlamydia trachomatis
ccuuuccauacaucauc

SEQ ID NO: 459265 - RNA, 18 nt, Chlamydia trachomatis
cgaagaacucaaaagcuu

SEQ ID NO: 459266 - RNA, 20 nt, Chlamydia trachomatis
cgagucaugacaaagccccu

SEQ ID NO: 459267 - RNA, 11 nt, Chlamydia trachomatis
cgauauuucuu

SEQ ID NO: 459268 - RNA, 14 nt, Chlamydia trachomatis
cgauucaaaagcua

SEQ ID NO: 459269 - RNA, 12 nt, Chlamydia trachomatis
cgccaacuauug

SEQ ID NO: 459270 - RNA, 18 nt, Chlamydia trachomatis
cgcguaauuuucuagcuu

SEQ ID NO: 459271 - RNA, 19 nt, Chlamydia trachomatis
cgcugcuaaagcagcagaa

SEQ ID NO: 459272 - RNA, 14 nt, Chlamydia trachomatis
cggacaaauuucua

SEQ ID NO: 459273 - RNA, 12 nt, Chlamydia trachomatis
cguaaaagagau

SEQ ID NO: 459274 - RNA, 22 nt, Chlamydia trachomatis
cguauauaucuuaauugaaaua

SEQ ID NO: 459275 - RNA, 21 nt, Chlamydia trachomatis
cgucugaaacuagucucuucu

SEQ ID NO: 459276 - RNA, 17 nt, Chlamydia trachomatis
cguucugcaaucucuuc

SEQ ID NO: 459277 - RNA, 14 nt, Chlamydia trachomatis
cguuuguaagaucu

SEQ ID NO: 459278 - RNA, 11 nt, Chlamydia trachomatis
cguuucuuagg

SEQ ID NO: 459279 - RNA, 17 nt, Chlamydia trachomatis
cuaaaaugcaaagcuuu

SEQ ID NO: 459280 - RNA, 19 nt, Chlamydia trachomatis
cuaaagaagccauaguaga

SEQ ID NO: 459281 - RNA, 22 nt, Chlamydia trachomatis
cuaaagaagccauaguagaaau

SEQ ID NO: 459282 - RNA, 14 nt, Chlamydia trachomatis
cuauuagauugcga

SEQ ID NO: 459283 - RNA, 17 nt, Chlamydia trachomatis
cuaauuaauaacgcccu

SEQ ID NO: 459284 - RNA, 13 nt, Chlamydia trachomatis
cuaauuccuucaa

SEQ ID NO: 459285 - RNA, 22 nt, Chlamydia trachomatis
cuaagcaccuuuacaaucaucu

SEQ ID NO: 459286 - RNA, 13 nt, Chlamydia trachomatis
cuaaggaguuuaa

SEQ ID NO: 459287 - RNA, 19 nt, Chlamydia trachomatis
cuaacuguacacagggugc

SEQ ID NO: 459288 - RNA, 17 nt, Chlamydia trachomatis
cuaacuuuucaaguucu

SEQ ID NO: 459289 - RNA, 21 nt, Chlamydia trachomatis
cuaagucuguugccugcaaag

SEQ ID NO: 459290 - RNA, 17 nt, Chlamydia trachomatis
cuauuuucaaaaccuug

SEQ ID NO: 459291 - RNA, 14 nt, Chlamydia trachomatis
cuauuuuccucuuc

SEQ ID NO: 459292 - RNA, 13 nt, Chlamydia trachomatis
cuccaucugacuu

SEQ ID NO: 459293 - RNA, 21 nt, Chlamydia trachomatis
cuccuaaaguaagauuuuuca

SEQ ID NO: 459294 - RNA, 20 nt, Chlamydia trachomatis
cucgauccgguucuuuugua

SEQ ID NO: 459295 - RNA, 14 nt, Chlamydia trachomatis
cucgauauccugaa

SEQ ID NO: 459296 - RNA, 22 nt, Chlamydia trachomatis
cucugguacucaucuuuuuuaa

SEQ ID NO: 459297 - RNA, 19 nt, Chlamydia trachomatis
cugacuacagucuuccucu

SEQ ID NO: 459298 - RNA, 23 nt, Chlamydia trachomatis
cugagucucgcgcuaaaaccuua

SEQ ID NO: 459299 - RNA, 19 nt, Chlamydia trachomatis
cugcaauaaggggaagaaa

SEQ ID NO: 459300 - RNA, 24 nt, Chlamydia trachomatis
cugauuccgagggaaucauuugcc

SEQ ID NO: 459301 - RNA, 14 nt, Chlamydia trachomatis
cugcaccucuuuca

SEQ ID NO: 459302 - RNA, 15 nt, Chlamydia trachomatis
cugcggacugcauca

SEQ ID NO: 459303 - RNA, 18 nt, Chlamydia trachomatis
cugcuccggcaaauccug

SEQ ID NO: 459304 - RNA, 21 nt, Chlamydia trachomatis
cugcuaauaguucucugcaua

SEQ ID NO: 459305 - RNA, 23 nt, Chlamydia trachomatis
cugcuuucuuuguuccuacuaaa

SEQ ID NO: 459306 - RNA, 15 nt, Chlamydia trachomatis
cuguauuuccuucga

SEQ ID NO: 459307 - RNA, 20 nt, Chlamydia trachomatis
cuguguauuuauauaggcuu

SEQ ID NO: 459308 - RNA, 15 nt, Chlamydia trachomatis
cuuaucguagagauc

SEQ ID NO: 459309 - RNA, 21 nt, Chlamydia trachomatis
cuucaauaauguugaagucuc

SEQ ID NO: 459310 - RNA, 19 nt, Chlamydia trachomatis
cuucaauagcaggaacuuc

SEQ ID NO: 459311 - RNA, 21 nt, Chlamydia trachomatis
cuguuguguaucaaaaucaau

SEQ ID NO: 459312 - RNA, 20 nt, Chlamydia trachomatis
cuucccuuaaacauacacag

SEQ ID NO: 459313 - RNA, 14 nt, Chlamydia trachomatis
cuucuagauagaag

SEQ ID NO: 459314 - RNA, 21 nt, Chlamydia trachomatis
cuucuuuauaaucgaucacag

SEQ ID NO: 459315 - RNA, 16 nt, Chlamydia trachomatis
cuucuugagaaaacuu

SEQ ID NO: 459316 - RNA, 15 nt, Chlamydia trachomatis
cuucuguuuuuucag

SEQ ID NO: 459317 - RNA, 17 nt, Chlamydia trachomatis
cuucuggcgaaucaauu

SEQ ID NO: 459318 - RNA, 21 nt, Chlamydia trachomatis
cuucuggcgaaucaauuucua

SEQ ID NO: 459319 - RNA, 23 nt, Chlamydia trachomatis
cuuggcuugcgcaaucauaucaa

SEQ ID NO: 459320 - RNA, 13 nt, Chlamydia trachomatis
cuuucauaaaacc

SEQ ID NO: 459321 - RNA, 16 nt, Chlamydia trachomatis
cuuugauuaaccaaaa

SEQ ID NO: 459322 - RNA, 11 nt, Chlamydia trachomatis
gaaaaaaagag

SEQ ID NO: 459323 - RNA, 18 nt, Chlamydia trachomatis
cuuugucuauaagguuca

SEQ ID NO: 459324 - RNA, 19 nt, Chlamydia trachomatis
gaaaaagggagaggauucc

SEQ ID NO: 459325 - RNA, 22 nt, Chlamydia trachomatis
gaaaauacgcgcgcuaagacuu

SEQ ID NO: 459326 - RNA, 14 nt, Chlamydia trachomatis
gaaaauagcaucuc

SEQ ID NO: 459327 - RNA, 19 nt, Chlamydia trachomatis
gaacgcaauguuuuacaaa

SEQ ID NO: 459328 - RNA, 20 nt, Chlamydia trachomatis
gaagaagauguuguuaaagc

SEQ ID NO: 459329 - RNA, 23 nt, Chlamydia trachomatis
gaagagcuuugcacaccugcuuu

SEQ ID NO: 459330 - RNA, 15 nt, Chlamydia trachomatis
gaagauacagccugc

SEQ ID NO: 459331 - RNA, 21 nt, Chlamydia trachomatis
gaagauauucaugugaacaga

SEQ ID NO: 459332 - RNA, 17 nt, Chlamydia trachomatis
gaagacgcucauaaaga

SEQ ID NO: 459333 - RNA, 16 nt, Chlamydia trachomatis
gaagcauucucucaua

SEQ ID NO: 459334 - RNA, 13 nt, Chlamydia trachomatis
gaagauucuaaaa

SEQ ID NO: 459335 - RNA, 18 nt, Chlamydia trachomatis
gaagcuccucuucuucug

SEQ ID NO: 459336 - RNA, 16 nt, Chlamydia trachomatis
gaaguaacaccucuuc

SEQ ID NO: 459337 - RNA, 14 nt, Chlamydia trachomatis
gaaguucuugcuug

SEQ ID NO: 459338 - RNA, 16 nt, Chlamydia trachomatis
gaauccuugaaccaaa

SEQ ID NO: 459339 - RNA, 19 nt, Chlamydia trachomatis
gaauuacccugaaagacuu

SEQ ID NO: 459340 - RNA, 20 nt, Chlamydia trachomatis
gaccaagguuguuauguaga

SEQ ID NO: 459341 - RNA, 16 nt, Chlamydia trachomatis
gacgaacgaagaacga

SEQ ID NO: 459342 - RNA, 17 nt, Chlamydia trachomatis
gagccuuuuauucuuca

SEQ ID NO: 459343 - RNA, 15 nt, Chlamydia trachomatis
gagcuuguucuucga

SEQ ID NO: 459344 - RNA, 22 nt, Chlamydia trachomatis
gagcuguuuuugcaacaaagcu

SEQ ID NO: 459345 - RNA, 15 nt, Chlamydia trachomatis
gaggaucuccagaaa

SEQ ID NO: 459346 - RNA, 20 nt, Chlamydia trachomatis
gaggcucuagguagucucua

SEQ ID NO: 459347 - RNA, 20 nt, Chlamydia trachomatis
gaggccuccagcuucuucua

SEQ ID NO: 459348 - RNA, 22 nt, Chlamydia trachomatis
gauagugacgugaggaaguucu

SEQ ID NO: 459349 - RNA, 19 nt, Chlamydia trachomatis
gauauccaucauaaaaaga

SEQ ID NO: 459350 - RNA, 13 nt, Chlamydia trachomatis
gaucaauccccaa

SEQ ID NO: 459351 - RNA, 20 nt, Chlamydia trachomatis
gauaagcaagcauaauuccu

SEQ ID NO: 459352 - RNA, 15 nt, Chlamydia trachomatis
gaucgccucuaaagc

SEQ ID NO: 459353 - RNA, 18 nt, Chlamydia trachomatis
gaucuaugugcaagauau

SEQ ID NO: 459354 - RNA, 18 nt, Chlamydia trachomatis
gaucuugaucugaaaaga

SEQ ID NO: 459355 - RNA, 22 nt, Chlamydia trachomatis
gaucugcgguauccauacgaaa

SEQ ID NO: 459356 - RNA, 15 nt, Chlamydia trachomatis
gaugagagaaaaggc

SEQ ID NO: 459357 - RNA, 22 nt, Chlamydia trachomatis
gauuuguucucuaauccguagu

SEQ ID NO: 459358 - RNA, 19 nt, Chlamydia trachomatis
gcaaaacuucgggauaaga

SEQ ID NO: 459359 - RNA, 17 nt, Chlamydia trachomatis
gauuuuucuuucaaaga

SEQ ID NO: 459360 - RNA, 19 nt, Chlamydia trachomatis
gcagagccaaaacaaacaa

SEQ ID NO: 459361 - RNA, 17 nt, Chlamydia trachomatis
gcagucgcgcagcuucu

SEQ ID NO: 459362 - RNA, 19 nt, Chlamydia trachomatis
gccaccuugccaaccacug

SEQ ID NO: 459363 - RNA, 13 nt, Chlamydia trachomatis
aaaaagcuaucau

SEQ ID NO: 459364 - RNA, 14 nt, Chlamydia trachomatis
aaacuucaaacucg

SEQ ID NO: 459365 - RNA, 17 nt, Chlamydia trachomatis
aaacuucaaacucgucc

SEQ ID NO: 459366 - RNA, 23 nt, Chlamydia trachomatis
aaacgcauuacauauagcaugga

SEQ ID NO: 459367 - RNA, 20 nt, Chlamydia trachomatis
aaagcuuucuuccccaaagc

SEQ ID NO: 459368 - RNA, 17 nt, Chlamydia trachomatis
aaagcuuuuuccaaagc

SEQ ID NO: 459369 - RNA, 20 nt, Chlamydia trachomatis
aaagucaggauuuucuaggu

SEQ ID NO: 459370 - RNA, 14 nt, Chlamydia trachomatis
aaagucucuaaagc

SEQ ID NO: 459371 - RNA, 11 nt, Chlamydia trachomatis
aaauaggaucc

SEQ ID NO: 459372 - RNA, 15 nt, Chlamydia trachomatis
aaauaguucacucca

SEQ ID NO: 459373 - RNA, 19 nt, Chlamydia trachomatis
aaaguuggucgcagaauaa

SEQ ID NO: 459374 - RNA, 13 nt, Chlamydia trachomatis
aaauacaaaucuu

SEQ ID NO: 459375 - RNA, 14 nt, Chlamydia trachomatis
aaaagccauagcca

SEQ ID NO: 459376 - RNA, 20 nt, Chlamydia trachomatis
aaaaccuuuugaaacaucuu

SEQ ID NO: 459377 - RNA, 16 nt, Chlamydia trachomatis
aaaagaucucauagca

SEQ ID NO: 459378 - RNA, 21 nt, Chlamydia trachomatis
aaaagaugauagcagcaguuu

SEQ ID NO: 459379 - RNA, 20 nt, Chlamydia trachomatis
aaauugugauuuuucgcuau

SEQ ID NO: 459380 - RNA, 18 nt, Chlamydia trachomatis
aaauauuuauuggcggca

SEQ ID NO: 459381 - RNA, 21 nt, Chlamydia trachomatis
aaaucacuuuuaccguuccau

SEQ ID NO: 459382 - RNA, 21 nt, Chlamydia trachomatis
aaaucuccuccgagaaauacg

SEQ ID NO: 459383 - RNA, 22 nt, Chlamydia trachomatis
aaaaggcuuacagagagcuuuu

SEQ ID NO: 459384 - RNA, 20 nt, Chlamydia trachomatis
aaaagcgaggcuucaaagaa

SEQ ID NO: 459385 - RNA, 19 nt, Chlamydia trachomatis
aacaaggcuuuuccauucc

SEQ ID NO: 459386 - RNA, 21 nt, Chlamydia trachomatis
aacagaaggaguuuuucuccu

SEQ ID NO: 459387 - RNA, 14 nt, Chlamydia trachomatis
aacaucuuuagaau

SEQ ID NO: 459388 - RNA, 18 nt, Chlamydia trachomatis
aacaugcucaacauuaga

SEQ ID NO: 459389 - RNA, 15 nt, Chlamydia trachomatis
aaccauccuucugau

SEQ ID NO: 459390 - RNA, 20 nt, Chlamydia trachomatis
aacccucgcagagaaagagc

SEQ ID NO: 459391 - RNA, 23 nt, Chlamydia trachomatis
aacgcacuccaauauauggacaa

SEQ ID NO: 459392 - RNA, 23 nt, Chlamydia trachomatis
aacgauguucacacuuucuucca

SEQ ID NO: 459393 - RNA, 13 nt, Chlamydia trachomatis
aacgaaucgcuga

SEQ ID NO: 459394 - RNA, 18 nt, Chlamydia trachomatis
aacgaacuuuccauagca

SEQ ID NO: 459395 - RNA, 23 nt, Chlamydia trachomatis
aacgaaguuagcauguucagaau

SEQ ID NO: 459396 - RNA, 11 nt, Chlamydia trachomatis
aaccuucugac

SEQ ID NO: 459397 - RNA, 19 nt, Chlamydia trachomatis
aagaucucuuucucuagaa

SEQ ID NO: 459398 - RNA, 16 nt, Chlamydia trachomatis
aagagccaaaauauac

SEQ ID NO: 459399 - RNA, 20 nt, Chlamydia trachomatis
aagagcugcugucagaagaa

SEQ ID NO: 459400 - RNA, 17 nt, Chlamydia trachomatis
aagauaagcagcaauag

SEQ ID NO: 459401 - RNA, 16 nt, Chlamydia trachomatis
aacuacaacaaguucc

SEQ ID NO: 459402 - RNA, 23 nt, Chlamydia trachomatis
aagccccaauagcuaagguaaca

SEQ ID NO: 459403 - RNA, 13 nt, Chlamydia trachomatis
aagcauccaagac

SEQ ID NO: 459404 - RNA, 15 nt, Chlamydia trachomatis
aagcaugauauuuug

SEQ ID NO: 459405 - RNA, 23 nt, Chlamydia trachomatis
aagcuaauuuuucucuaauaguu

SEQ ID NO: 459406 - RNA, 17 nt, Chlamydia trachomatis
aagcucuagcaauagag

SEQ ID NO: 459407 - RNA, 23 nt, Chlamydia trachomatis
aagcucugaguuaaaggaaggga

SEQ ID NO: 459408 - RNA, 15 nt, Chlamydia trachomatis
aagcuucuaagaaca

SEQ ID NO: 459409 - RNA, 21 nt, Chlamydia trachomatis
aaggaaugauaagggaaucau

SEQ ID NO: 459410 - RNA, 21 nt, Chlamydia trachomatis
aagcuuuuuccaaagcuucua

SEQ ID NO: 459411 - RNA, 20 nt, Chlamydia trachomatis
aaggaauguggagcuaucau

SEQ ID NO: 459412 - RNA, 15 nt, Chlamydia trachomatis
aagggaauagccuau

SEQ ID NO: 459413 - RNA, 20 nt, Chlamydia trachomatis
aaggcgcagcuuucguugau

SEQ ID NO: 459414 - RNA, 17 nt, Chlamydia trachomatis
aagggggacaaaaauac

SEQ ID NO: 459415 - RNA, 21 nt, Chlamydia trachomatis
aagggugcuaacuuucuucca

SEQ ID NO: 459416 - RNA, 15 nt, Chlamydia trachomatis
aagguucuucuucga

SEQ ID NO: 459417 - RNA, 16 nt, Chlamydia trachomatis
aaguaagcgcuuccau

SEQ ID NO: 459418 - RNA, 21 nt, Chlamydia trachomatis
aaguagguuuaaccuuugcau

SEQ ID NO: 459419 - RNA, 15 nt, Chlamydia trachomatis
aauacccagaaguau

SEQ ID NO: 459420 - RNA, 16 nt, Chlamydia trachomatis
aauaauacaaagcacg

SEQ ID NO: 459421 - RNA, 23 nt, Chlamydia trachomatis
aauaagaugaugaguggauacgc

SEQ ID NO: 459422 - RNA, 14 nt, Chlamydia trachomatis
aauagcagcauucu

SEQ ID NO: 459423 - RNA, 21 nt, Chlamydia trachomatis
aauccaccguacgauauccau

SEQ ID NO: 459424 - RNA, 18 nt, Chlamydia trachomatis
aaucaugaugaugagagc

SEQ ID NO: 459425 - RNA, 22 nt, Chlamydia trachomatis
aauccuuugacgacaacaugaa

SEQ ID NO: 459426 - RNA, 20 nt, Chlamydia trachomatis
aaucucuuggagagaaugaa

SEQ ID NO: 459427 - RNA, 23 nt, Chlamydia trachomatis
aaucucuuuagcaugcacaucua

SEQ ID NO: 459428 - RNA, 14 nt, Chlamydia trachomatis
aaucugucuaagau

SEQ ID NO: 459429 - RNA, 20 nt, Chlamydia trachomatis
aaucuguucagaacucaaaa

SEQ ID NO: 459430 - RNA, 18 nt, Chlamydia trachomatis
aauggaccagaucauaga

SEQ ID NO: 459431 - RNA, 14 nt, Chlamydia trachomatis
aaugugucuaaaga

SEQ ID NO: 459432 - RNA, 17 nt, Chlamydia trachomatis
aauucuaucaacaucug

SEQ ID NO: 459433 - RNA, 18 nt, Chlamydia trachomatis
acagcaugaacagcuucg

SEQ ID NO: 459434 - RNA, 14 nt, Chlamydia trachomatis
aauuuuaaaaucuc

SEQ ID NO: 459435 - RNA, 19 nt, Chlamydia trachomatis
acagucuguguuugcacaa

SEQ ID NO: 459436 - RNA, 16 nt, Chlamydia trachomatis
acaucaggggaauucg

SEQ ID NO: 459437 - RNA, 15 nt, Chlamydia trachomatis
acaucucguugcuau

SEQ ID NO: 459438 - RNA, 17 nt, Chlamydia trachomatis
acauuucugcaacucuc

SEQ ID NO: 459439 - RNA, 19 nt, Chlamydia trachomatis
accaaagaauucuugcuau

SEQ ID NO: 459440 - RNA, 17 nt, Chlamydia trachomatis
accaauauuuuuucuau

SEQ ID NO: 459441 - RNA, 12 nt, Chlamydia trachomatis
accagauccgau

SEQ ID NO: 459442 - RNA, 14 nt, Chlamydia trachomatis
acccaaucuucuaa

SEQ ID NO: 459443 - RNA, 14 nt, Chlamydia trachomatis
accccuaaaggaag

SEQ ID NO: 459444 - RNA, 16 nt, Chlamydia trachomatis
acccucuucauaaaac

SEQ ID NO: 459445 - RNA, 16 nt, Chlamydia trachomatis
acccuccgacccaaga

SEQ ID NO: 459446 - RNA, 19 nt, Chlamydia trachomatis
acccuguaaaaggcgcaga

SEQ ID NO: 459447 - RNA, 16 nt, Chlamydia trachomatis
accuguugcuuuucga

SEQ ID NO: 459448 - RNA, 16 nt, Chlamydia trachomatis
acgcaucccaaaauag

SEQ ID NO: 459449 - RNA, 16 nt, Chlamydia trachomatis
acgccauaucaaagcu

SEQ ID NO: 459450 - RNA, 21 nt, Chlamydia trachomatis
aaacauuugcgugauaaaaac

SEQ ID NO: 459451 - RNA, 13 nt, Chlamydia trachomatis
acgcguucuucug

SEQ ID NO: 459452 - RNA, 13 nt, Chlamydia trachomatis
acuauuucuucua

SEQ ID NO: 459453 - RNA, 17 nt, Chlamydia trachomatis
acuauuaaaaaggcuag

SEQ ID NO: 459454 - RNA, 16 nt, Chlamydia trachomatis
acuccaccuaggauag

SEQ ID NO: 459455 - RNA, 21 nt, Chlamydia trachomatis
acuccugcagcuaaagaaucu

SEQ ID NO: 459456 - RNA, 19 nt, Chlamydia trachomatis
acucgcaucauccuugccc

SEQ ID NO: 459457 - RNA, 18 nt, Chlamydia trachomatis
acugcucuucuaacuuuu

SEQ ID NO: 459458 - RNA, 15 nt, Chlamydia trachomatis
acucugcaaaaucuu

SEQ ID NO: 459459 - RNA, 15 nt, Chlamydia trachomatis
acucuaaagaauagu

SEQ ID NO: 459460 - RNA, 15 nt, Chlamydia trachomatis
acugcugcuaucauc

SEQ ID NO: 459461 - RNA, 14 nt, Chlamydia trachomatis
acuucuauccggag

SEQ ID NO: 459462 - RNA, 15 nt, Chlamydia trachomatis
acuucucuuguucug

SEQ ID NO: 459463 - RNA, 22 nt, Chlamydia trachomatis
acuucuucgucugugagagagc

SEQ ID NO: 459464 - RNA, 21 nt, Chlamydia trachomatis
acuucuuuaaagccuuucucu

SEQ ID NO: 459465 - RNA, 13 nt, Chlamydia trachomatis
agcacuucuucuu

SEQ ID NO: 459466 - RNA, 12 nt, Chlamydia trachomatis
agcacgauaaaa

SEQ ID NO: 459467 - RNA, 15 nt, Chlamydia trachomatis
agcaaauaauagcuu

SEQ ID NO: 459468 - RNA, 14 nt, Chlamydia trachomatis
acuuuauuauugaa

SEQ ID NO: 459469 - RNA, 13 nt, Chlamydia trachomatis
agccaauccguau

SEQ ID NO: 459470 - RNA, 23 nt, Chlamydia trachomatis
agccuguuucuuaucagcauccc

SEQ ID NO: 459471 - RNA, 21 nt, Chlamydia trachomatis
agcuauucccacuacauucuu

SEQ ID NO: 459472 - RNA, 17 nt, Chlamydia trachomatis
aggcauaaaagagaaga

SEQ ID NO: 459473 - RNA, 16 nt, Chlamydia trachomatis
aggcucuugaaaagga

SEQ ID NO: 459474 - RNA, 16 nt, Chlamydia trachomatis
aggcuccccagaaaaa

SEQ ID NO: 459475 - RNA, 20 nt, Chlamydia trachomatis
aggcucuaucggaauagcaa

SEQ ID NO: 459476 - RNA, 23 nt, Chlamydia trachomatis
aggcuccugcaagggaacaaacc

SEQ ID NO: 459477 - RNA, 22 nt, Chlamydia trachomatis
aggucauucgucaaagaaguaa

SEQ ID NO: 459478 - RNA, 21 nt, Chlamydia trachomatis
aguaacuuaugaaaacuuugu

SEQ ID NO: 459479 - RNA, 17 nt, Chlamydia trachomatis
aguaauacucuuaucgu

SEQ ID NO: 459480 - RNA, 18 nt, Chlamydia trachomatis
aguaaacugucuauugga

SEQ ID NO: 459481 - RNA, 18 nt, Chlamydia trachomatis
agucagaagcuauuccau

SEQ ID NO: 459482 - RNA, 22 nt, Chlamydia trachomatis
agucucgaauucuaucaacauc

SEQ ID NO: 459483 - RNA, 22 nt, Chlamydia trachomatis
agucuucucgagaagaaaaacg

SEQ ID NO: 459484 - RNA, 21 nt, Chlamydia trachomatis
aguucucugcauagagaacuc

SEQ ID NO: 459485 - RNA, 22 nt, Chlamydia trachomatis
aguucguuacgcguaaagauuu

SEQ ID NO: 459486 - RNA, 16 nt, Chlamydia trachomatis
auaacuaagaucucca

SEQ ID NO: 459487 - RNA, 18 nt, Chlamydia trachomatis
auaagaucuuuacuuucu

SEQ ID NO: 459488 - RNA, 18 nt, Chlamydia trachomatis
auaagcaagcauaauucc

SEQ ID NO: 459489 - RNA, 11 nt, Chlamydia trachomatis
aguuucuucua

SEQ ID NO: 459490 - RNA, 15 nt, Chlamydia trachomatis
aguuucugaaaaguc

SEQ ID NO: 459491 - RNA, 22 nt, Chlamydia trachomatis
auacgcaaguauuggagacaac

SEQ ID NO: 459492 - RNA, 21 nt, Chlamydia trachomatis
auacgcgcgcuaagacuuucu

SEQ ID NO: 459493 - RNA, 14 nt, Chlamydia trachomatis
auacuaaacuaucu

SEQ ID NO: 459494 - RNA, 21 nt, Chlamydia trachomatis
auacuucuuacuuaaaaaaca

SEQ ID NO: 459495 - RNA, 15 nt, Chlamydia trachomatis
auacucuuaucguag

SEQ ID NO: 459496 - RNA, 22 nt, Chlamydia trachomatis
auacucuuaucguagagaucuu

SEQ ID NO: 459497 - RNA, 15 nt, Chlamydia trachomatis
auagaaaauggcugc

SEQ ID NO: 459498 - RNA, 23 nt, Chlamydia trachomatis
auagcaucuucacaguucguugu

SEQ ID NO: 459499 - RNA, 16 nt, Chlamydia trachomatis
auagguaaagaaguuu

SEQ ID NO: 459500 - RNA, 21 nt, Chlamydia trachomatis
auaggcauacaggagagacau

SEQ ID NO: 459501 - RNA, 17 nt, Chlamydia trachomatis
auagggggaguucuauu

SEQ ID NO: 459502 - RNA, 17 nt, Chlamydia trachomatis
auaugcucuuucccgau

SEQ ID NO: 459503 - RNA, 20 nt, Chlamydia trachomatis
aucacagaaacuucuucuaa

SEQ ID NO: 459504 - RNA, 16 nt, Chlamydia trachomatis
aucaagaaucgcuuug

SEQ ID NO: 459505 - RNA, 16 nt, Chlamydia trachomatis
aucaaauuucuucgau

SEQ ID NO: 459506 - RNA, 13 nt, Chlamydia trachomatis
aucaacagaagaa

SEQ ID NO: 459507 - RNA, 12 nt, Chlamydia trachomatis
aucgauaggcau

SEQ ID NO: 459508 - RNA, 12 nt, Chlamydia trachomatis
aucgagaaaaug

SEQ ID NO: 459509 - RNA, 17 nt, Chlamydia trachomatis
aucgccuauagaagacu

SEQ ID NO: 459510 - RNA, 19 nt, Chlamydia trachomatis
aucggaccacauucuuucu

SEQ ID NO: 459511 - RNA, 16 nt, Chlamydia trachomatis
aucuaugaaaaaagcu

SEQ ID NO: 459512 - RNA, 13 nt, Chlamydia trachomatis
aucuagaaaagag

SEQ ID NO: 459513 - RNA, 15 nt, Chlamydia trachomatis
aucuagaaaagagca

SEQ ID NO: 459514 - RNA, 20 nt, Chlamydia trachomatis
aucucgagcuaagaaaauaa

SEQ ID NO: 459515 - RNA, 10 nt, Chlamydia trachomatis
aucuguagca

SEQ ID NO: 459516 - RNA, 12 nt, Chlamydia trachomatis
aucugguauucu

SEQ ID NO: 459517 - RNA, 14 nt, Chlamydia trachomatis
aucuucaacaagau

SEQ ID NO: 459518 - RNA, 21 nt, Chlamydia trachomatis
aucuucggacauugaacauuu

SEQ ID NO: 459519 - RNA, 16 nt, Chlamydia trachomatis
augaauggaaaguacu

SEQ ID NO: 459520 - RNA, 16 nt, Chlamydia trachomatis
augacugcgcuaugag

SEQ ID NO: 459521 - RNA, 21 nt, Chlamydia trachomatis
augaguaucuagacauagcuu

SEQ ID NO: 459522 - RNA, 14 nt, Chlamydia trachomatis
augcguuucuucug

SEQ ID NO: 459523 - RNA, 19 nt, Chlamydia trachomatis
augcuugcguauagagcau

SEQ ID NO: 459524 - RNA, 18 nt, Chlamydia trachomatis
augcuguaaaacauuucu

SEQ ID NO: 459525 - RNA, 20 nt, Chlamydia trachomatis
auguaggagcgaaaucgaaa

SEQ ID NO: 459526 - RNA, 16 nt, Chlamydia trachomatis
auucaauccagacucu

SEQ ID NO: 459527 - RNA, 20 nt, Chlamydia trachomatis
auucaucuauuuuuauugag

SEQ ID NO: 459528 - RNA, 17 nt, Chlamydia trachomatis
auuaacaggaagaauau

SEQ ID NO: 459529 - RNA, 16 nt, Chlamydia trachomatis
auuaauaacgcccucu

SEQ ID NO: 459530 - RNA, 17 nt, Chlamydia trachomatis
auuagggaaaaacuuuu

SEQ ID NO: 459531 - RNA, 21 nt, Chlamydia trachomatis
auuaaacuaugcaaaguuucu

SEQ ID NO: 459532 - RNA, 22 nt, Chlamydia trachomatis
auucuugcuaagaacauaacaa

SEQ ID NO: 459533 - RNA, 18 nt, Chlamydia trachomatis
auucuuuuaagaaugcgg

SEQ ID NO: 459534 - RNA, 17 nt, Chlamydia trachomatis
auucuucucgaacucag

SEQ ID NO: 459535 - RNA, 20 nt, Chlamydia trachomatis
auucuucuugaucggagucu

SEQ ID NO: 459536 - RNA, 14 nt, Chlamydia trachomatis
auugacaacuuucu

SEQ ID NO: 459537 - RNA, 16 nt, Chlamydia trachomatis
auugcuguuaagauaa

SEQ ID NO: 459538 - RNA, 18 nt, Chlamydia trachomatis
caaauacugggaaaucau

SEQ ID NO: 459539 - RNA, 16 nt, Chlamydia trachomatis
caacguuacuaccgau

SEQ ID NO: 459540 - RNA, 20 nt, Chlamydia trachomatis
caauccgccuccggcuccca

SEQ ID NO: 459541 - RNA, 18 nt, Chlamydia trachomatis
caauccuuggcaagaagc

SEQ ID NO: 459542 - RNA, 16 nt, Chlamydia trachomatis
cacgcuacaugcagga

SEQ ID NO: 459543 - RNA, 20 nt, Chlamydia trachomatis
aaacugcucaaggaaacucu

SEQ ID NO: 459544 - RNA, 16 nt, Chlamydia trachomatis
aaacuuagaggccgau

SEQ ID NO: 459545 - RNA, 16 nt, Chlamydia trachomatis
cagaaagagaaucauc

SEQ ID NO: 459546 - RNA, 14 nt, Chlamydia trachomatis
cagagaaaaagauu

SEQ ID NO: 459547 - RNA, 20 nt, Chlamydia trachomatis
cagacgauauuuaagauaga

SEQ ID NO: 459548 - RNA, 13 nt, Chlamydia trachomatis
cagcuuaaggguu

SEQ ID NO: 459549 - RNA, 21 nt, Chlamydia trachomatis
caguugaguaaucacucucuc

SEQ ID NO: 459550 - RNA, 15 nt, Chlamydia trachomatis
caguuugucuuagaa

SEQ ID NO: 459551 - RNA, 16 nt, Chlamydia trachomatis
cauaaaaaagagguau

SEQ ID NO: 459552 - RNA, 22 nt, Chlamydia trachomatis
cauaaucuuccuguaagaggau

SEQ ID NO: 459553 - RNA, 15 nt, Chlamydia trachomatis
cauaaucugauucgc

SEQ ID NO: 459554 - RNA, 21 nt, Chlamydia trachomatis
cauaguauuacggaaaagcuu

SEQ ID NO: 459555 - RNA, 19 nt, Chlamydia trachomatis
cauuauccauaaaaauaau

SEQ ID NO: 459556 - RNA, 14 nt, Chlamydia trachomatis
cauuaucucgacuu

SEQ ID NO: 459557 - RNA, 20 nt, Chlamydia trachomatis
cauucuucugaacaacaucc

SEQ ID NO: 459558 - RNA, 19 nt, Chlamydia trachomatis
cauuaggauuaaaauccau

SEQ ID NO: 459559 - RNA, 15 nt, Chlamydia trachomatis
cauuuuaauaagauu

SEQ ID NO: 459560 - RNA, 20 nt, Chlamydia trachomatis
cauuucucuccaaaccaguu

SEQ ID NO: 459561 - RNA, 15 nt, Chlamydia trachomatis
ccaaaaaucauuucc

SEQ ID NO: 459562 - RNA, 22 nt, Chlamydia trachomatis
ccaaaaaaaggcucuauacaga

SEQ ID NO: 459563 - RNA, 20 nt, Chlamydia trachomatis
aaauaaucuuguaauaucaa

SEQ ID NO: 459564 - RNA, 16 nt, Chlamydia trachomatis
aaauaucauucccuac

SEQ ID NO: 459565 - RNA, 21 nt, Chlamydia trachomatis
ccaucaucgaugauaucuucu

SEQ ID NO: 459566 - RNA, 22 nt, Chlamydia trachomatis
ccaucucggaucgagaagagcc

SEQ ID NO: 459567 - RNA, 18 nt, Chlamydia trachomatis
ccaucuacaaaaccaaaa

SEQ ID NO: 459568 - RNA, 12 nt, Chlamydia trachomatis
ccaugaugcugc

SEQ ID NO: 459569 - RNA, 14 nt, Chlamydia trachomatis
ccauggaauagcuu

SEQ ID NO: 459570 - RNA, 20 nt, Chlamydia trachomatis
cccgauucaaaaaucgcuga

SEQ ID NO: 459571 - RNA, 15 nt, Chlamydia trachomatis
cccuaguacaaaaau

SEQ ID NO: 459572 - RNA, 20 nt, Chlamydia trachomatis
cccucuuuagccaauuucca

SEQ ID NO: 459573 - RNA, 15 nt, Chlamydia trachomatis
aaaugaccuuucccu

SEQ ID NO: 459574 - RNA, 12 nt, Chlamydia trachomatis
aaauucuaaagu

SEQ ID NO: 459575 - RNA, 20 nt, Chlamydia trachomatis
aaauucuucaugcaauugau

SEQ ID NO: 459576 - RNA, 20 nt, Chlamydia trachomatis
ccucauccuuuuggaagauc

SEQ ID NO: 459577 - RNA, 16 nt, Chlamydia trachomatis
ccuccuagaaagaacc

SEQ ID NO: 459578 - RNA, 11 nt, Chlamydia trachomatis
ccuucauuuca

SEQ ID NO: 459579 - RNA, 16 nt, Chlamydia trachomatis
ccuucaggauuccgga

SEQ ID NO: 459580 - RNA, 21 nt, Chlamydia trachomatis
ccuucuuuaccgauaauuuua

SEQ ID NO: 459581 - RNA, 18 nt, Chlamydia trachomatis
ccuucuuuauaaucgauc

SEQ ID NO: 459582 - RNA, 21 nt, Chlamydia trachomatis
cgaaaaucacuuuuaccguuc

SEQ ID NO: 459583 - RNA, 23 nt, Chlamydia trachomatis
ccuuuucuagagaagagagcauc

SEQ ID NO: 459584 - RNA, 19 nt, Chlamydia trachomatis
ccuuuuuugcuaaaagaaa

SEQ ID NO: 459585 - RNA, 23 nt, Chlamydia trachomatis
cgaauaccccaaauguugcgaua

SEQ ID NO: 459586 - RNA, 15 nt, Chlamydia trachomatis
aacaaucaaagcacc

SEQ ID NO: 459587 - RNA, 20 nt, Chlamydia trachomatis
aacaaugcugauaaaaauaa

SEQ ID NO: 459588 - RNA, 17 nt, Chlamydia trachomatis
cgauaguaccauaaucc

SEQ ID NO: 459589 - RNA, 17 nt, Chlamydia trachomatis
cgauauacgcucuuuca

SEQ ID NO: 459590 - RNA, 16 nt, Chlamydia trachomatis
cgaugagcaccucuuc

SEQ ID NO: 459591 - RNA, 16 nt, Chlamydia trachomatis
aacagauugagaauaa

SEQ ID NO: 459592 - RNA, 22 nt, Chlamydia trachomatis
cgcuagaaacagccugcuuucu

SEQ ID NO: 459593 - RNA, 12 nt, Chlamydia trachomatis
cggauacaauac

SEQ ID NO: 459594 - RNA, 16 nt, Chlamydia trachomatis
cggcaagacucuuuca

SEQ ID NO: 459595 - RNA, 22 nt, Chlamydia trachomatis
cggccuguaugugaaaauaucu

SEQ ID NO: 459596 - RNA, 16 nt, Chlamydia trachomatis
cgucuagcuuuuuuca

SEQ ID NO: 459597 - RNA, 14 nt, Chlamydia trachomatis
cguuacuaccgaua

SEQ ID NO: 459598 - RNA, 14 nt, Chlamydia trachomatis
cuaaaaucaccaua

SEQ ID NO: 459599 - RNA, 12 nt, Chlamydia trachomatis
cuaaagaagcca

SEQ ID NO: 459600 - RNA, 18 nt, Chlamydia trachomatis
cuaaagacagcauaauug

SEQ ID NO: 459601 - RNA, 22 nt, Chlamydia trachomatis
cuaaagagaucucuccagaguu

SEQ ID NO: 459602 - RNA, 15 nt, Chlamydia trachomatis
cuaaagaaaagcuuu

SEQ ID NO: 459603 - RNA, 14 nt, Chlamydia trachomatis
cuaaaggauaagga

SEQ ID NO: 459604 - RNA, 14 nt, Chlamydia trachomatis
cuaaagucuccaua

SEQ ID NO: 459605 - RNA, 16 nt, Chlamydia trachomatis
cuaaauaccacaauuu

SEQ ID NO: 459606 - RNA, 17 nt, Chlamydia trachomatis
cuaaaugcuguaaaaca

SEQ ID NO: 459607 - RNA, 20 nt, Chlamydia trachomatis
cuaauguagacccugcauua

SEQ ID NO: 459608 - RNA, 22 nt, Chlamydia trachomatis
cuaauaggguuaggaaagcacu

SEQ ID NO: 459609 - RNA, 22 nt, Chlamydia trachomatis
cuaauauagaauugacgaaucg

SEQ ID NO: 459610 - RNA, 14 nt, Chlamydia trachomatis
cuaagaaaaaccuu

SEQ ID NO: 459611 - RNA, 22 nt, Chlamydia trachomatis
cuaauaaacagaucuuuuucau

SEQ ID NO: 459612 - RNA, 19 nt, Chlamydia trachomatis
cuacaggaguaaauccugc

SEQ ID NO: 459613 - RNA, 22 nt, Chlamydia trachomatis
cuacaagaccucuccauccugc

SEQ ID NO: 459614 - RNA, 17 nt, Chlamydia trachomatis
cuagaagaaucauagaa

SEQ ID NO: 459615 - RNA, 13 nt, Chlamydia trachomatis
cuagaauagcagc

SEQ ID NO: 459616 - RNA, 19 nt, Chlamydia trachomatis
cuccuuugcuaacaaagaa

SEQ ID NO: 459617 - RNA, 17 nt, Chlamydia trachomatis
cuccucuucuaucgcuu

SEQ ID NO: 459618 - RNA, 20 nt, Chlamydia trachomatis
cuccguggcaagcaacgaaa

SEQ ID NO: 459619 - RNA, 19 nt, Chlamydia trachomatis
cuccguucaaagcaaacuu

SEQ ID NO: 459620 - RNA, 21 nt, Chlamydia trachomatis
cucuuccgaguaaucaaaaaa

SEQ ID NO: 459621 - RNA, 22 nt, Chlamydia trachomatis
cucucuaaaaacucuuuuucua

SEQ ID NO: 459622 - RNA, 20 nt, Chlamydia trachomatis
cucuccauuuaagacuacag

SEQ ID NO: 459623 - RNA, 20 nt, Chlamydia trachomatis
cucuccagaguucauuuuuu

SEQ ID NO: 459624 - RNA, 20 nt, Chlamydia trachomatis
cucuucguaguaacuuauga

SEQ ID NO: 459625 - RNA, 23 nt, Chlamydia trachomatis
cugcgacguaacaccaaauccuc

SEQ ID NO: 459626 - RNA, 21 nt, Chlamydia trachomatis
cugcuaaauccauucgcauua

SEQ ID NO: 459627 - RNA, 17 nt, Chlamydia trachomatis
cugcugauaaauuucuu

SEQ ID NO: 459628 - RNA, 21 nt, Chlamydia trachomatis
cugcugacaauccgaagauua

SEQ ID NO: 459629 - RNA, 22 nt, Chlamydia trachomatis
cugcuuuauccaaagauagaua

SEQ ID NO: 459630 - RNA, 21 nt, Chlamydia trachomatis
cuggcagggauaguaaaaacu

SEQ ID NO: 459631 - RNA, 17 nt, Chlamydia trachomatis
cugggaggagaacucuu

SEQ ID NO: 459632 - RNA, 17 nt, Chlamydia trachomatis
cugguagaaagcuacag

SEQ ID NO: 459633 - RNA, 18 nt, Chlamydia trachomatis
cuguaauguccucuuuau

SEQ ID NO: 459634 - RNA, 17 nt, Chlamydia trachomatis
cugucguuaaagaauua

SEQ ID NO: 459635 - RNA, 21 nt, Chlamydia trachomatis
cuucaccaacuccaagcauua

SEQ ID NO: 459636 - RNA, 22 nt, Chlamydia trachomatis
cuucacccauaaaaaagaggua

SEQ ID NO: 459637 - RNA, 19 nt, Chlamydia trachomatis
cuuaggaacucccucauua

SEQ ID NO: 459638 - RNA, 14 nt, Chlamydia trachomatis
cuuacgagcuuucu

SEQ ID NO: 459639 - RNA, 20 nt, Chlamydia trachomatis
cuuacaucaggggaauucgc

SEQ ID NO: 459640 - RNA, 16 nt, Chlamydia trachomatis
cuuaauugccucguga

SEQ ID NO: 459641 - RNA, 19 nt, Chlamydia trachomatis
cuucccagcgucuccaaau

SEQ ID NO: 459642 - RNA, 19 nt, Chlamydia trachomatis
cuucgagcuguuuuugcaa

SEQ ID NO: 459643 - RNA, 13 nt, Chlamydia trachomatis
cuucgagaauauu

SEQ ID NO: 459644 - RNA, 20 nt, Chlamydia trachomatis
cuucgccgggggagccaaaa

SEQ ID NO: 459645 - RNA, 19 nt, Chlamydia trachomatis
cuucuaacuacucccaaau

SEQ ID NO: 459646 - RNA, 15 nt, Chlamydia trachomatis
cuucuaacuuuucaa

SEQ ID NO: 459647 - RNA, 14 nt, Chlamydia trachomatis
cuucuagagauauc

SEQ ID NO: 459648 - RNA, 18 nt, Chlamydia trachomatis
cuucugccgaaggcaauu

SEQ ID NO: 459649 - RNA, 19 nt, Chlamydia trachomatis
cuucucuaaaugagcgauc

SEQ ID NO: 459650 - RNA, 13 nt, Chlamydia trachomatis
cuugaaauucaau

SEQ ID NO: 459651 - RNA, 15 nt, Chlamydia trachomatis
cuucuucacccauaa

SEQ ID NO: 459652 - RNA, 23 nt, Chlamydia trachomatis
cuugauauucccuucuauuucuc

SEQ ID NO: 459653 - RNA, 18 nt, Chlamydia trachomatis
cuugcaacucuuauaaca

SEQ ID NO: 459654 - RNA, 17 nt, Chlamydia trachomatis
cuuuaaaagcugcuuua

SEQ ID NO: 459655 - RNA, 13 nt, Chlamydia trachomatis
gaaacuucuucua

SEQ ID NO: 459656 - RNA, 18 nt, Chlamydia trachomatis
gaacauccaccagcaguc

SEQ ID NO: 459657 - RNA, 15 nt, Chlamydia trachomatis
gaaccacaaccucuc

SEQ ID NO: 459658 - RNA, 20 nt, Chlamydia trachomatis
gaacugucuucuuucaaaga

SEQ ID NO: 459659 - RNA, 16 nt, Chlamydia trachomatis
gaacuuuauuauugaa

SEQ ID NO: 459660 - RNA, 19 nt, Chlamydia trachomatis
gaagacuucgaggcucccc

SEQ ID NO: 459661 - RNA, 14 nt, Chlamydia trachomatis
gaagagagcaucua

SEQ ID NO: 459662 - RNA, 19 nt, Chlamydia trachomatis
gaagcucggucucauuaua

SEQ ID NO: 459663 - RNA, 15 nt, Chlamydia trachomatis
gaaguaaaacagaag

SEQ ID NO: 459664 - RNA, 13 nt, Chlamydia trachomatis
gaauccaaagucu

SEQ ID NO: 459665 - RNA, 21 nt, Chlamydia trachomatis
gaaucuucuucggaaagcacu

SEQ ID NO: 459666 - RNA, 21 nt, Chlamydia trachomatis
gaaugugacacaucgaugcuc

SEQ ID NO: 459667 - RNA, 22 nt, Chlamydia trachomatis
aacgaagccaaaagaucuugau

SEQ ID NO: 459668 - RNA, 16 nt, Chlamydia trachomatis
gacccaugaacagcau

SEQ ID NO: 459669 - RNA, 19 nt, Chlamydia trachomatis
gaccgaagaacucaaaagc

SEQ ID NO: 459670 - RNA, 14 nt, Chlamydia trachomatis
aacguuucuguuca

SEQ ID NO: 459671 - RNA, 22 nt, Chlamydia trachomatis
gagaacaucucggucuuagaag

SEQ ID NO: 459672 - RNA, 16 nt, Chlamydia trachomatis
gacuuuuuagcaucug

SEQ ID NO: 459673 - RNA, 20 nt, Chlamydia trachomatis
gagagaggagaaaaacuccu

SEQ ID NO: 459674 - RNA, 18 nt, Chlamydia trachomatis
gagcaauauguuauacgc

SEQ ID NO: 459675 - RNA, 13 nt, Chlamydia trachomatis
gagucuucccuua

SEQ ID NO: 459676 - RNA, 19 nt, Chlamydia trachomatis
gaggcggcaaguccuucua

SEQ ID NO: 459677 - RNA, 20 nt, Chlamydia trachomatis
gaguuuuaggcguuccugca

SEQ ID NO: 459678 - RNA, 14 nt, Chlamydia trachomatis
gauaaauaaucucg

SEQ ID NO: 459679 - RNA, 12 nt, Chlamydia trachomatis
gaguuuaugaua

SEQ ID NO: 459680 - RNA, 16 nt, Chlamydia trachomatis
gauaggaaaaagcuau

SEQ ID NO: 459681 - RNA, 18 nt, Chlamydia trachomatis
gauagaguuuguuccaug

SEQ ID NO: 459682 - RNA, 21 nt, Chlamydia trachomatis
gauacuuuaccgcaaauaucc

SEQ ID NO: 459683 - RNA, 12 nt, Chlamydia trachomatis
gauagaaacucc

SEQ ID NO: 459684 - RNA, 15 nt, Chlamydia trachomatis
gauaucccuuuccaa

SEQ ID NO: 459685 - RNA, 16 nt, Chlamydia trachomatis
gaucuaauucuagcaa

SEQ ID NO: 459686 - RNA, 16 nt, Chlamydia trachomatis
gaugcuucugccuuuu

SEQ ID NO: 459687 - RNA, 13 nt, Chlamydia trachomatis
gauuaucuaaagc

SEQ ID NO: 459688 - RNA, 22 nt, Chlamydia trachomatis
gauuauaccagcagacccaaau

SEQ ID NO: 459689 - RNA, 23 nt, Chlamydia trachomatis
gauucuuugguaauagcaaagaa

SEQ ID NO: 459690 - RNA, 16 nt, Chlamydia trachomatis
gauucugcuccaaaga

SEQ ID NO: 459691 - RNA, 14 nt, Chlamydia trachomatis
gauuggaucagcuc

SEQ ID NO: 459692 - RNA, 11 nt, Chlamydia trachomatis
gauuucuucuu

SEQ ID NO: 459693 - RNA, 20 nt, Chlamydia trachomatis
gcaaaagcgaggcuucaaag

SEQ ID NO: 459694 - RNA, 18 nt, Chlamydia trachomatis
gcaacaaauaccaaaaua

SEQ ID NO: 459695 - RNA, 15 nt, Chlamydia trachomatis
gcaacuugagcaucu

SEQ ID NO: 459696 - RNA, 23 nt, Chlamydia trachomatis
gcaacuaauauuagauagcuucu

SEQ ID NO: 459697 - RNA, 18 nt, Chlamydia trachomatis
gcaagcucaacaaggauu

SEQ ID NO: 459698 - RNA, 11 nt, Chlamydia trachomatis
gcaaucucuug

SEQ ID NO: 459699 - RNA, 19 nt, Chlamydia trachomatis
gcaccuuuacaaucaucuu

SEQ ID NO: 459700 - RNA, 19 nt, Chlamydia trachomatis
gcacccgcggaucccaaag

SEQ ID NO: 459701 - RNA, 23 nt, Chlamydia trachomatis
gcauaguuccuguauucgcuauu

SEQ ID NO: 459702 - RNA, 19 nt, Chlamydia trachomatis
gcauuccaggacgaacgaa

SEQ ID NO: 459703 - RNA, 19 nt, Chlamydia trachomatis
gcauuugucuucgcaaacu

SEQ ID NO: 459704 - RNA, 12 nt, Chlamydia trachomatis
gcauuuguggac

SEQ ID NO: 459705 - RNA, 14 nt, Chlamydia trachomatis
gccaaaaagacuac

SEQ ID NO: 459706 - RNA, 14 nt, Chlamydia trachomatis
gccaaagaaauagc

SEQ ID NO: 459707 - RNA, 14 nt, Chlamydia trachomatis
gccauacaaagauu

SEQ ID NO: 459708 - RNA, 15 nt, Chlamydia trachomatis
aagaaucuucuucga

SEQ ID NO: 459709 - RNA, 13 nt, Chlamydia trachomatis
aagaaugcuugau

SEQ ID NO: 459710 - RNA, 18 nt, Chlamydia trachomatis
aagagcuaaacuucuugu

SEQ ID NO: 459711 - RNA, 13 nt, Chlamydia trachomatis
aagagcuucuugu

SEQ ID NO: 459712 - RNA, 21 nt, Chlamydia trachomatis
aagauaacaauccuagacgau

SEQ ID NO: 459713 - RNA, 13 nt, Chlamydia trachomatis
aagaucucuacau

SEQ ID NO: 459714 - RNA, 14 nt, Chlamydia trachomatis
aagaucuucagaaa

SEQ ID NO: 459715 - RNA, 15 nt, Chlamydia trachomatis
aagcauuucucucca

SEQ ID NO: 459716 - RNA, 11 nt, Chlamydia trachomatis
aagcauagcuu

SEQ ID NO: 459717 - RNA, 24 nt, Chlamydia trachomatis
aagccaucucggaucgagaagagc

SEQ ID NO: 459718 - RNA, 19 nt, Chlamydia trachomatis
aagcccuugagagcaagcc

SEQ ID NO: 459719 - RNA, 16 nt, Chlamydia trachomatis
gcgauuacuucagcaa

SEQ ID NO: 459720 - RNA, 14 nt, Chlamydia trachomatis
gcgcuggcuuuguc

SEQ ID NO: 459721 - RNA, 21 nt, Chlamydia trachomatis
aagccuuucucuaaaagaaga

SEQ ID NO: 459722 - RNA, 20 nt, Chlamydia trachomatis
aagcguucuccgaguuuauc

SEQ ID NO: 459723 - RNA, 15 nt, Chlamydia trachomatis
aagcucuaacucuuc

SEQ ID NO: 459724 - RNA, 17 nt, Chlamydia trachomatis
aagcuagaaaauagcau

SEQ ID NO: 459725 - RNA, 14 nt, Chlamydia trachomatis
aagcuagaagaaga

SEQ ID NO: 459726 - RNA, 16 nt, Chlamydia trachomatis
aagcuauuuucuuccu

SEQ ID NO: 459727 - RNA, 13 nt, Chlamydia trachomatis
aagcuccaaagaa

SEQ ID NO: 459728 - RNA, 19 nt, Chlamydia trachomatis
aagcuucugccauuucuaa

SEQ ID NO: 459729 - RNA, 12 nt, Chlamydia trachomatis
aagcuuuagcuc

SEQ ID NO: 459730 - RNA, 18 nt, Chlamydia trachomatis
aagcuuucugccaaagac

SEQ ID NO: 459731 - RNA, 20 nt, Chlamydia trachomatis
gcuaaacuucuuguuaauga

SEQ ID NO: 459732 - RNA, 19 nt, Chlamydia trachomatis
gcuauaccgccucaaacaa

SEQ ID NO: 459733 - RNA, 19 nt, Chlamydia trachomatis
gcuaggcaaauauccuaaa

SEQ ID NO: 459734 - RNA, 21 nt, Chlamydia trachomatis
gcuagaaacagccugcuuucu

SEQ ID NO: 459735 - RNA, 14 nt, Chlamydia trachomatis
gcuaccaagcuucu

SEQ ID NO: 459736 - RNA, 18 nt, Chlamydia trachomatis
gcuauagcgucuugcuaa

SEQ ID NO: 459737 - RNA, 19 nt, Chlamydia trachomatis
gcuaugaaaaauccuucca

SEQ ID NO: 459738 - RNA, 18 nt, Chlamydia trachomatis
gcuaugcgcggaaggaaa

SEQ ID NO: 459739 - RNA, 22 nt, Chlamydia trachomatis
gcuaugcgcggaaggaaaaaga

SEQ ID NO: 459740 - RNA, 23 nt, Chlamydia trachomatis
gcuaugcgcggaaggaaaaagaa

SEQ ID NO: 459741 - RNA, 22 nt, Chlamydia trachomatis
gcucaacucgcuccagaacgaa

SEQ ID NO: 459742 - RNA, 22 nt, Chlamydia trachomatis
gcucuucaguacuuacgagauc

SEQ ID NO: 459743 - RNA, 19 nt, Chlamydia trachomatis
gcugcugacaauccgaaga

SEQ ID NO: 459744 - RNA, 16 nt, Chlamydia trachomatis
ggaacaggggaccaaa

SEQ ID NO: 459745 - RNA, 22 nt, Chlamydia trachomatis
ggaauaauuuuccacaaauauu

SEQ ID NO: 459746 - RNA, 18 nt, Chlamydia trachomatis
ggaaggauguuucccuuu

SEQ ID NO: 459747 - RNA, 13 nt, Chlamydia trachomatis
ggaagaucucuuu

SEQ ID NO: 459748 - RNA, 15 nt, Chlamydia trachomatis
ggaagagagaacaaa

SEQ ID NO: 459749 - RNA, 13 nt, Chlamydia trachomatis
ggaauucuuggau

SEQ ID NO: 459750 - RNA, 19 nt, Chlamydia trachomatis
ggaccuccucuucuaucgc

SEQ ID NO: 459751 - RNA, 15 nt, Chlamydia trachomatis
aaggagcuucuuuau

SEQ ID NO: 459752 - RNA, 17 nt, Chlamydia trachomatis
aaggagaauaccaccau

SEQ ID NO: 459753 - RNA, 16 nt, Chlamydia trachomatis
aaggaucuuccagccu

SEQ ID NO: 459754 - RNA, 21 nt, Chlamydia trachomatis
aaggauucauauguucuuuga

SEQ ID NO: 459755 - RNA, 23 nt, Chlamydia trachomatis
aaggauuuuuuucccacaaacaa

SEQ ID NO: 459756 - RNA, 17 nt, Chlamydia trachomatis
aaggcaugagauauagu

SEQ ID NO: 459757 - RNA, 16 nt, Chlamydia trachomatis
ggaguauuuucaaaaa

SEQ ID NO: 459758 - RNA, 17 nt, Chlamydia trachomatis
aaggcgaauucuuugau

SEQ ID NO: 459759 - RNA, 16 nt, Chlamydia trachomatis
ggcgaaaguuuccuua

SEQ ID NO: 459760 - RNA, 13 nt, Chlamydia trachomatis
gggcacaacgccc

SEQ ID NO: 459761 - RNA, 19 nt, Chlamydia trachomatis
ggggagcugauguaagcga

SEQ ID NO: 459762 - RNA, 19 nt, Chlamydia trachomatis
gguaaaggaaguugagaag

SEQ ID NO: 459763 - RNA, 19 nt, Chlamydia trachomatis
ggucaaaauuaucuaaaaa

SEQ ID NO: 459764 - RNA, 19 nt, Chlamydia trachomatis
guaaaauagcacgcaaaac

SEQ ID NO: 459765 - RNA, 15 nt, Chlamydia trachomatis
guaaagcuucgcuuu

SEQ ID NO: 459766 - RNA, 12 nt, Chlamydia trachomatis
guaaauauuuug

SEQ ID NO: 459767 - RNA, 16 nt, Chlamydia trachomatis
guaagcaacaauaucc

SEQ ID NO: 459768 - RNA, 23 nt, Chlamydia trachomatis
guaauaacugagccaagaacaaa

SEQ ID NO: 459769 - RNA, 18 nt, Chlamydia trachomatis
guaauuuucuagcuucuu

SEQ ID NO: 459770 - RNA, 19 nt, Chlamydia trachomatis
guagauucagcaagauucu

SEQ ID NO: 459771 - RNA, 21 nt, Chlamydia trachomatis
guagcgauuuucugaaguucu

SEQ ID NO: 459772 - RNA, 19 nt, Chlamydia trachomatis
aaguccuuaucuucuugag

SEQ ID NO: 459773 - RNA, 19 nt, Chlamydia trachomatis
guaucuguuaguagcuucu

SEQ ID NO: 459774 - RNA, 17 nt, Chlamydia trachomatis
uggucagcucauuagaa

SEQ ID NO: 459775 - RNA, 14 nt, Chlamydia trachomatis
ugguauucuaaagu

SEQ ID NO: 459776 - RNA, 23 nt, Chlamydia trachomatis
ugucuaaggaugcaaauaagaaa

SEQ ID NO: 459777 - RNA, 15 nt, Chlamydia trachomatis
ugucuauaaauuaua

SEQ ID NO: 459778 - RNA, 15 nt, Chlamydia trachomatis
uuacgagaucgccuu

SEQ ID NO: 459779 - RNA, 16 nt, Chlamydia trachomatis
uuacgcgucuaaaaca

SEQ ID NO: 459780 - RNA, 18 nt, Chlamydia trachomatis
uuacuaacaucaaagauc

SEQ ID NO: 459781 - RNA, 19 nt, Chlamydia trachomatis
uuaaagccuuuuuacgcau

SEQ ID NO: 459782 - RNA, 18 nt, Chlamydia trachomatis
uuauccgcaguaaaaucu

SEQ ID NO: 459783 - RNA, 20 nt, Chlamydia trachomatis
uuaucggcuaacgaguuuaa

SEQ ID NO: 459784 - RNA, 20 nt, Chlamydia trachomatis
uuauucuguuucagaaacuu

SEQ ID NO: 459785 - RNA, 14 nt, Chlamydia trachomatis
uucaaagaacaaga

SEQ ID NO: 459786 - RNA, 15 nt, Chlamydia trachomatis
uucagcaaaaaaauc

SEQ ID NO: 459787 - RNA, 13 nt, Chlamydia trachomatis
uuccaaagcuucu

SEQ ID NO: 459788 - RNA, 16 nt, Chlamydia trachomatis
uuccuuagaaagaauu

SEQ ID NO: 459789 - RNA, 15 nt, Chlamydia trachomatis
uuccugcuucaaaaa

SEQ ID NO: 459790 - RNA, 21 nt, Chlamydia trachomatis
uucgaauaguauacuuuagau

SEQ ID NO: 459791 - RNA, 16 nt, Chlamydia trachomatis
uucguaugcaacuugu

SEQ ID NO: 459792 - RNA, 14 nt, Chlamydia trachomatis
uucugaaucaaaca

SEQ ID NO: 459793 - RNA, 17 nt, Chlamydia trachomatis
uucucggaaaagauauc

SEQ ID NO: 459794 - RNA, 16 nt, Chlamydia trachomatis
uucucuagaauuuccc

SEQ ID NO: 459795 - RNA, 14 nt, Chlamydia trachomatis
uucuugaggaagau

SEQ ID NO: 459796 - RNA, 22 nt, Chlamydia trachomatis
uuuagaauccaaagucucgaau

SEQ ID NO: 459797 - RNA, 15 nt, Chlamydia trachomatis
uuuaauugagaagua

SEQ ID NO: 459798 - RNA, 17 nt, Chlamydia trachomatis
uuguaauaucaaagagu

SEQ ID NO: 459799 - RNA, 13 nt, Chlamydia trachomatis
uuuuguaggagaa

SEQ ID NO: 459800 - RNA, 13 nt, Chlamydia trachomatis
uuuuuaggaggaa

SEQ ID NO: 459801 - RNA, 19 nt, Chlamydia trachomatis
uuuugcuaugaaaaauccu

SEQ ID NO: 459802 - RNA, 19 nt, Chlamydia trachomatis
uuuucccacaaacaaaaaa

SEQ ID NO: 459803 - RNA, 16 nt, Chlamydia trachomatis
uuuguguauggaagua

SEQ ID NO: 459804 - RNA, 15 nt, Chlamydia trachomatis
uuucuaaaaaacuuu

SEQ ID NO: 459805 - RNA, 20 nt, Chlamydia trachomatis
uuuccccuacaaacauccuu

SEQ ID NO: 459806 - RNA, 17 nt, Chlamydia trachomatis
uuugcuaacaaagaauu

SEQ ID NO: 459807 - RNA, 22 nt, Chlamydia trachomatis
uuucuucccuuuuuucuguuug

SEQ ID NO: 459808 - RNA, 16 nt, Chlamydia trachomatis
uuucuuucaaagagau

SEQ ID NO: 459809 - RNA, 22 nt, Chlamydia trachomatis
guuguauaaacccacgaaaaga

SEQ ID NO: 459810 - RNA, 20 nt, Chlamydia trachomatis
guuucuguaggagagaaucu

SEQ ID NO: 459811 - RNA, 16 nt, Chlamydia trachomatis
guuucgucucuuuaag

SEQ ID NO: 459812 - RNA, 14 nt, Chlamydia trachomatis
uaaaaugcaaagcu

SEQ ID NO: 459813 - RNA, 16 nt, Chlamydia trachomatis
uaaagcagaaacagcu

SEQ ID NO: 459814 - RNA, 22 nt, Chlamydia trachomatis
uaacacggccauuauaaacuuu

SEQ ID NO: 459815 - RNA, 19 nt, Chlamydia trachomatis
uaacuuuuucucuugcuuc

SEQ ID NO: 459816 - RNA, 21 nt, Chlamydia trachomatis
uaagcuugaucaaagaaucuu

SEQ ID NO: 459817 - RNA, 19 nt, Chlamydia trachomatis
uaagaucuuuacuuucuuu

SEQ ID NO: 459818 - RNA, 16 nt, Chlamydia trachomatis
uaagaugguugcucuu

SEQ ID NO: 459819 - RNA, 18 nt, Chlamydia trachomatis
uaauauggacuucccuaa

SEQ ID NO: 459820 - RNA, 16 nt, Chlamydia trachomatis
uaauauuuuuucccuu

SEQ ID NO: 459821 - RNA, 15 nt, Chlamydia trachomatis
uaaucaaaccuaagu

SEQ ID NO: 459822 - RNA, 21 nt, Chlamydia trachomatis
uacaaggcucuugaaaaggag

SEQ ID NO: 459823 - RNA, 15 nt, Chlamydia trachomatis
uacgcugguauacca

SEQ ID NO: 459824 - RNA, 22 nt, Chlamydia trachomatis
uaccucuuuuuuucccuagaaa

SEQ ID NO: 459825 - RNA, 19 nt, Chlamydia trachomatis
uacucauccuaacuguaca

SEQ ID NO: 459826 - RNA, 19 nt, Chlamydia trachomatis
uagaucgguugcauccaau

SEQ ID NO: 459827 - RNA, 17 nt, Chlamydia trachomatis
uagcuuuccucacacac

SEQ ID NO: 459828 - RNA, 15 nt, Chlamydia trachomatis
uaggggaagaaucaa

SEQ ID NO: 459829 - RNA, 17 nt, Chlamydia trachomatis
uagggagguauuccugu

SEQ ID NO: 459830 - RNA, 13 nt, Chlamydia trachomatis
uaucaauuccugu

SEQ ID NO: 459831 - RNA, 19 nt, Chlamydia trachomatis
uaucauugaaaucagaaac

SEQ ID NO: 459832 - RNA, 13 nt, Chlamydia trachomatis
uaucuaaaauccc

SEQ ID NO: 459833 - RNA, 15 nt, Chlamydia trachomatis
uaucuaaaaucccua

SEQ ID NO: 459834 - RNA, 17 nt, Chlamydia trachomatis
uauuaaacucccaaaac

SEQ ID NO: 459835 - RNA, 22 nt, Chlamydia trachomatis
uauguaagccuaaaacucccau

SEQ ID NO: 459836 - RNA, 16 nt, Chlamydia trachomatis
uaguacguguuaucaa

SEQ ID NO: 459837 - RNA, 18 nt, Chlamydia trachomatis
uaguaaugugucuaaaga

SEQ ID NO: 459838 - RNA, 21 nt, Chlamydia trachomatis
uagguucuuugaucaaauccu

SEQ ID NO: 459839 - RNA, 20 nt, Chlamydia trachomatis
uauaaacccacgaaaagacu

SEQ ID NO: 459840 - RNA, 11 nt, Chlamydia trachomatis
uauaggauuug

SEQ ID NO: 459841 - RNA, 20 nt, Chlamydia trachomatis
uauaggggugagcuccuaag

SEQ ID NO: 459842 - RNA, 19 nt, Chlamydia trachomatis
uauagguuccaucuaaagg

SEQ ID NO: 459843 - RNA, 15 nt, Chlamydia trachomatis
uauauaggcuuccaa

SEQ ID NO: 459844 - RNA, 13 nt, Chlamydia trachomatis
uauuuucaaaaau

SEQ ID NO: 459845 - RNA, 19 nt, Chlamydia trachomatis
ucaucggcuugcccaaacu

SEQ ID NO: 459846 - RNA, 23 nt, Chlamydia trachomatis
ucaucggcuugcccaaacuccau

SEQ ID NO: 459847 - RNA, 20 nt, Chlamydia trachomatis
ucauuaucguucucuaaaga

SEQ ID NO: 459848 - RNA, 14 nt, Chlamydia trachomatis
uccaccguagaaca

SEQ ID NO: 459849 - RNA, 18 nt, Chlamydia trachomatis
uccaucugacuuuuuagc

SEQ ID NO: 459850 - RNA, 16 nt, Chlamydia trachomatis
uccaucauaaaaagau

SEQ ID NO: 459851 - RNA, 14 nt, Chlamydia trachomatis
ucccucuagcaacc

SEQ ID NO: 459852 - RNA, 16 nt, Chlamydia trachomatis
ucccucuagcaaccaa

SEQ ID NO: 459853 - RNA, 13 nt, Chlamydia trachomatis
ucccuuagcaaca

SEQ ID NO: 459854 - RNA, 18 nt, Chlamydia trachomatis
ucccugcucuugaagaua

SEQ ID NO: 459855 - RNA, 23 nt, Chlamydia trachomatis
uccguaaugaucagcaaaaagag

SEQ ID NO: 459856 - RNA, 21 nt, Chlamydia trachomatis
uccgguuuccaaauaggaucc

SEQ ID NO: 459857 - RNA, 13 nt, Chlamydia trachomatis
uccucaaaaaagg

SEQ ID NO: 459858 - RNA, 18 nt, Chlamydia trachomatis
uccucuggcuuaucaaca

SEQ ID NO: 459859 - RNA, 18 nt, Chlamydia trachomatis
uccugaauggucaauaau

SEQ ID NO: 459860 - RNA, 19 nt, Chlamydia trachomatis
uccuguagggaagauagga

SEQ ID NO: 459861 - RNA, 12 nt, Chlamydia trachomatis
ucgaaaagagcu

SEQ ID NO: 459862 - RNA, 20 nt, Chlamydia trachomatis
ucgaaugccccagaaacacu

SEQ ID NO: 459863 - RNA, 14 nt, Chlamydia trachomatis
ucgcuaaauugaaa

SEQ ID NO: 459864 - RNA, 14 nt, Chlamydia trachomatis
ucgcuacaaauccu

SEQ ID NO: 459865 - RNA, 16 nt, Chlamydia trachomatis
ucggaauagcaacucu

SEQ ID NO: 459866 - RNA, 23 nt, Chlamydia trachomatis
ucggauaaucaaaucgaaacugu

SEQ ID NO: 459867 - RNA, 19 nt, Chlamydia trachomatis
ucggaugaccgaaucucaa

SEQ ID NO: 459868 - RNA, 14 nt, Chlamydia trachomatis
ucuauuaagaaucu

SEQ ID NO: 459869 - RNA, 13 nt, Chlamydia trachomatis
ucuacgaucugcc

SEQ ID NO: 459870 - RNA, 20 nt, Chlamydia trachomatis
ucuaauaggguuaggaaagc

SEQ ID NO: 459871 - RNA, 13 nt, Chlamydia trachomatis
ucucgaaugcugu

SEQ ID NO: 459872 - RNA, 12 nt, Chlamydia trachomatis
ucucuccccaua

SEQ ID NO: 459873 - RNA, 19 nt, Chlamydia trachomatis
ucucugguaaaaauagaaa

SEQ ID NO: 459874 - RNA, 15 nt, Chlamydia trachomatis
ucucuaacaaugacu

SEQ ID NO: 459875 - RNA, 23 nt, Chlamydia trachomatis
ucugcauugguauugccaugggc

SEQ ID NO: 459876 - RNA, 13 nt, Chlamydia trachomatis
ucugcaaaaucuu

SEQ ID NO: 459877 - RNA, 15 nt, Chlamydia trachomatis
ucugcaacaaauacc

SEQ ID NO: 459878 - RNA, 16 nt, Chlamydia trachomatis
ucugagaugaaaauau

SEQ ID NO: 459879 - RNA, 21 nt, Chlamydia trachomatis
ucugauaaaugucccugaaca

SEQ ID NO: 459880 - RNA, 23 nt, Chlamydia trachomatis
ucucuuuauagaaggucugaaca

SEQ ID NO: 459881 - RNA, 22 nt, Chlamydia trachomatis
ucucuuuuuacaacucugaaca

SEQ ID NO: 459882 - RNA, 13 nt, Chlamydia trachomatis
ucugaacauacaa

SEQ ID NO: 459883 - RNA, 22 nt, Chlamydia trachomatis
ucuggacuauuuucaaaaccuu

SEQ ID NO: 459884 - RNA, 21 nt, Chlamydia trachomatis
ucuggagguuuaggagagagc

SEQ ID NO: 459885 - RNA, 16 nt, Chlamydia trachomatis
ucugcuaaaaaugcuu

SEQ ID NO: 459886 - RNA, 17 nt, Chlamydia trachomatis
ucuuacuccuaaaguaa

SEQ ID NO: 459887 - RNA, 14 nt, Chlamydia trachomatis
ucuucagaaaucuu

SEQ ID NO: 459888 - RNA, 13 nt, Chlamydia trachomatis
ucuucaggagcau

SEQ ID NO: 459889 - RNA, 19 nt, Chlamydia trachomatis
ucuucauaagaaaauucuu

SEQ ID NO: 459890 - RNA, 13 nt, Chlamydia trachomatis
ucuucgaaaucuu

SEQ ID NO: 459891 - RNA, 20 nt, Chlamydia trachomatis
ucuucucuuuuagcgaucuc

SEQ ID NO: 459892 - RNA, 14 nt, Chlamydia trachomatis
ucuuuaagcaacaa

SEQ ID NO: 459893 - RNA, 16 nt, Chlamydia trachomatis
ucuuguagaaaaagau

SEQ ID NO: 459894 - RNA, 22 nt, Chlamydia trachomatis
ucuuuacuaggagcaaaaagug

SEQ ID NO: 459895 - RNA, 23 nt, Chlamydia trachomatis
ucuuuucuuauaaaguccggacu

SEQ ID NO: 459896 - RNA, 14 nt, Chlamydia trachomatis
ucuuuuguuugcac

SEQ ID NO: 459897 - RNA, 19 nt, Chlamydia trachomatis
ugaaaaugcucuaaaggau

SEQ ID NO: 459898 - RNA, 21 nt, Chlamydia trachomatis
ugaaaacuuuguauuaacgau

SEQ ID NO: 459899 - RNA, 17 nt, Chlamydia trachomatis
ugaaaagcuuucaaagc

SEQ ID NO: 459900 - RNA, 13 nt, Chlamydia trachomatis
ugagaagaaaggu

SEQ ID NO: 459901 - RNA, 19 nt, Chlamydia trachomatis
ugaguaaucacucucucga

SEQ ID NO: 459902 - RNA, 17 nt, Chlamydia trachomatis
ugagugaaaaauagaau

SEQ ID NO: 459903 - RNA, 15 nt, Chlamydia trachomatis
ugauaaauucuaaac

SEQ ID NO: 459904 - RNA, 13 nt, Chlamydia trachomatis
ugauacaauuccu

SEQ ID NO: 459905 - RNA, 22 nt, Chlamydia trachomatis
ugaugauagucugcaauccaau

SEQ ID NO: 459906 - RNA, 21 nt, Chlamydia trachomatis
ugcagaggggggcuugcacaa

SEQ ID NO: 459907 - RNA, 13 nt, Chlamydia trachomatis
ugcagcuaaagaa

SEQ ID NO: 459908 - RNA, 23 nt, Chlamydia trachomatis
ugccaucauuaucuucuucuaau

SEQ ID NO: 459909 - RNA, 13 nt, Chlamydia trachomatis
ugcgcaacguuuc

SEQ ID NO: 459910 - RNA, 12 nt, Chlamydia trachomatis
ugcuaacuuucu

SEQ ID NO: 459911 - RNA, 14 nt, Chlamydia trachomatis
ugcugcagaaaucc

SEQ ID NO: 459912 - RNA, 23 nt, Chlamydia trachomatis
gccuguuuucuuguagaaaaaga

SEQ ID NO: 459913 - RNA, 15 nt, Chlamydia trachomatis
gcgaugccaaagaaa

SEQ ID NO: 459914 - RNA, 17 nt, Chlamydia trachomatis
gcuacccccuucuccuu

SEQ ID NO: 459915 - RNA, 19 nt, Chlamydia trachomatis
gcuacugucgaacgcuucu

SEQ ID NO: 459916 - RNA, 20 nt, Chlamydia trachomatis
gcuacugucgaacgcuucuu

SEQ ID NO: 459917 - RNA, 19 nt, Chlamydia trachomatis
gcuagaaaauagcaucucu

SEQ ID NO: 459918 - RNA, 17 nt, Chlamydia trachomatis
gcuacggaaaccaauaa

SEQ ID NO: 459919 - RNA, 22 nt, Chlamydia trachomatis
gcuaucaauaaagaagccuucu

SEQ ID NO: 459920 - RNA, 16 nt, Chlamydia trachomatis
gcuaggguucuaaaga

SEQ ID NO: 459921 - RNA, 14 nt, Chlamydia trachomatis
gcuauuuucagcaa

SEQ ID NO: 459922 - RNA, 11 nt, Chlamydia trachomatis
gcuccaaagau

SEQ ID NO: 459923 - RNA, 16 nt, Chlamydia trachomatis
gcuccacaagaaguaa

SEQ ID NO: 459924 - RNA, 11 nt, Chlamydia trachomatis
gcugaaacuug

SEQ ID NO: 459925 - RNA, 15 nt, Chlamydia trachomatis
gcugccaaagcuucg

SEQ ID NO: 459926 - RNA, 13 nt, Chlamydia trachomatis
gcugcuuggaaua

SEQ ID NO: 459927 - RNA, 20 nt, Chlamydia trachomatis
gcuguauagaguaaguuucu

SEQ ID NO: 459928 - RNA, 17 nt, Chlamydia trachomatis
gcuuuauccaaagauag

SEQ ID NO: 459929 - RNA, 17 nt, Chlamydia trachomatis
gcuuguaugguuugucc

SEQ ID NO: 459930 - RNA, 15 nt, Chlamydia trachomatis
gcuuuugcaaacaau

SEQ ID NO: 459931 - RNA, 14 nt, Chlamydia trachomatis
gcuuuuucuucucu

SEQ ID NO: 459932 - RNA, 17 nt, Chlamydia trachomatis
gcuuuugcugcuucacu

SEQ ID NO: 459933 - RNA, 18 nt, Chlamydia trachomatis
gcuuuuuccaaagcuucu

SEQ ID NO: 459934 - RNA, 17 nt, Chlamydia trachomatis
gcuuuuuuuuucagcaa

SEQ ID NO: 459935 - RNA, 14 nt, Chlamydia trachomatis
ggaaaaauuucuuc

SEQ ID NO: 459936 - RNA, 15 nt, Chlamydia trachomatis
ggauaagaucucauc

SEQ ID NO: 459937 - RNA, 18 nt, Chlamydia trachomatis
ggccucccuaucaauucc

SEQ ID NO: 459938 - RNA, 16 nt, Chlamydia trachomatis
ggcgagcauaucuccu

SEQ ID NO: 459939 - RNA, 20 nt, Chlamydia trachomatis
ggcgacacgcuucuucaaag

SEQ ID NO: 459940 - RNA, 19 nt, Chlamydia trachomatis
ggcuaagaaaaaccuuucu

SEQ ID NO: 459941 - RNA, 14 nt, Chlamydia trachomatis
ggcuuccaaaucug

SEQ ID NO: 459942 - RNA, 24 nt, Chlamydia trachomatis
gggcuuggcggauaucuucuugaa

SEQ ID NO: 459943 - RNA, 16 nt, Chlamydia trachomatis
guaaauuuucaauagc

SEQ ID NO: 459944 - RNA, 22 nt, Chlamydia trachomatis
guaaaagagauucuuugacgau

SEQ ID NO: 459945 - RNA, 15 nt, Chlamydia trachomatis
guaaaagaguaagug

SEQ ID NO: 459946 - RNA, 14 nt, Chlamydia trachomatis
guaagcgcuuccau

SEQ ID NO: 459947 - RNA, 18 nt, Chlamydia trachomatis
guacuggggucagcauuu

SEQ ID NO: 459948 - RNA, 12 nt, Chlamydia trachomatis
guauucuaaagu

SEQ ID NO: 459949 - RNA, 13 nt, Chlamydia trachomatis
guauuaacgauug

SEQ ID NO: 459950 - RNA, 17 nt, Chlamydia trachomatis
gucauggugacgaaucc

SEQ ID NO: 459951 - RNA, 20 nt, Chlamydia trachomatis
gucauucggcggguauguaa

SEQ ID NO: 459952 - RNA, 14 nt, Chlamydia trachomatis
guccgauaggaaaa

SEQ ID NO: 459953 - RNA, 19 nt, Chlamydia trachomatis
gucuagcuuuuuucagaaa

SEQ ID NO: 459954 - RNA, 23 nt, Chlamydia trachomatis
gucuuaaaaggguagaaaaagag

SEQ ID NO: 459955 - RNA, 18 nt, Chlamydia trachomatis
gucuuuagaagaaaagag

SEQ ID NO: 459956 - RNA, 21 nt, Chlamydia trachomatis
gugagcccuccugcagacaua

SEQ ID NO: 459957 - RNA, 22 nt, Chlamydia trachomatis
guggacuuuagauagucuucua

SEQ ID NO: 459958 - RNA, 22 nt, Chlamydia trachomatis
gugggcuaucaguggcuauauu

SEQ ID NO: 459959 - RNA, 20 nt, Chlamydia trachomatis
gugcuccugguccaaggaau

SEQ ID NO: 459960 - RNA, 15 nt, Chlamydia trachomatis
guuagguaaucuucu

SEQ ID NO: 459961 - RNA, 17 nt, Chlamydia trachomatis
guuauccacucuaaagu

SEQ ID NO: 459962 - RNA, 17 nt, Chlamydia trachomatis
guugaucuuccucuuga

SEQ ID NO: 459963 - RNA, 15 nt, Chlamydia trachomatis
guuggcgaauuucuu

SEQ ID NO: 459964 - RNA, 15 nt, Chlamydia trachomatis
guugcucgauccaaa

SEQ ID NO: 459965 - RNA, 18 nt, Chlamydia trachomatis
guuucuaugauucuucua

SEQ ID NO: 459966 - RNA, 18 nt, Chlamydia trachomatis
guuucugaaucaaacaga

SEQ ID NO: 459967 - RNA, 22 nt, Chlamydia trachomatis
guuucuugcugggagauagcuc

SEQ ID NO: 459968 - RNA, 20 nt, Chlamydia trachomatis
guuugaaucacagaaacuuc

SEQ ID NO: 459969 - RNA, 24 nt, Chlamydia trachomatis
guuugaucaccggaccuccucuuc

SEQ ID NO: 459970 - RNA, 11 nt, Chlamydia trachomatis
guuuucaaaag

SEQ ID NO: 459971 - RNA, 24 nt, Chlamydia trachomatis
uaaaaacgggagcgggagagagcc

SEQ ID NO: 459972 - RNA, 22 nt, Chlamydia trachomatis
uaaaauggaaauaaaaagccca

SEQ ID NO: 459973 - RNA, 21 nt, Chlamydia trachomatis
uaacggaguagagguuuccuu

SEQ ID NO: 459974 - RNA, 19 nt, Chlamydia trachomatis
uaacugggauaagaaaucu

SEQ ID NO: 459975 - RNA, 13 nt, Chlamydia trachomatis
uaauauccccauc

SEQ ID NO: 459976 - RNA, 21 nt, Chlamydia trachomatis
uaaucaaaccuaaguagcaaa

SEQ ID NO: 459977 - RNA, 18 nt, Chlamydia trachomatis
uaagguggcacacuccau

SEQ ID NO: 459978 - RNA, 15 nt, Chlamydia trachomatis
uaagucaaaagaauc

SEQ ID NO: 459979 - RNA, 12 nt, Chlamydia trachomatis
uaccaaaauccu

SEQ ID NO: 459980 - RNA, 13 nt, Chlamydia trachomatis
uaccaaaauccuu

SEQ ID NO: 459981 - RNA, 15 nt, Chlamydia trachomatis
uacaugcaggauauu

SEQ ID NO: 459982 - RNA, 23 nt, Chlamydia trachomatis
uacaucuguagagccaugaucaa

SEQ ID NO: 459983 - RNA, 18 nt, Chlamydia trachomatis
uacaaguauuucuuguug

SEQ ID NO: 459984 - RNA, 19 nt, Chlamydia trachomatis
uacaauguacgcuaaaaac

SEQ ID NO: 459985 - RNA, 12 nt, Chlamydia trachomatis
uacaauuccugc

SEQ ID NO: 459986 - RNA, 17 nt, Chlamydia trachomatis
uacaaaucuuuuaucuu

SEQ ID NO: 459987 - RNA, 23 nt, Chlamydia trachomatis
uacaacgaguugaucuuccucuu

SEQ ID NO: 459988 - RNA, 22 nt, Chlamydia trachomatis
uaauucuaaugcuuuguagaua

SEQ ID NO: 459989 - RNA, 19 nt, Chlamydia trachomatis
uacgagaggguuucuucuu

SEQ ID NO: 459990 - RNA, 18 nt, Chlamydia trachomatis
uagaaaguccaagauuau

SEQ ID NO: 459991 - RNA, 16 nt, Chlamydia trachomatis
uagacgauccgcuucc

SEQ ID NO: 459992 - RNA, 12 nt, Chlamydia trachomatis
uacugcuacaaa

SEQ ID NO: 459993 - RNA, 17 nt, Chlamydia trachomatis
uagaaacagccugcuuu

SEQ ID NO: 459994 - RNA, 22 nt, Chlamydia trachomatis
uagaaacuauugaucaaaguau

SEQ ID NO: 459995 - RNA, 19 nt, Chlamydia trachomatis
uacuaaggugaguuucccu

SEQ ID NO: 459996 - RNA, 17 nt, Chlamydia trachomatis
uagcgaaaaaucacaau

SEQ ID NO: 459997 - RNA, 12 nt, Chlamydia trachomatis
uaggcucgccau

SEQ ID NO: 459998 - RNA, 16 nt, Chlamydia trachomatis
uaggcgaauuucucua

SEQ ID NO: 459999 - RNA, 18 nt, Chlamydia trachomatis
aaguuuuuguuuuuuuca

SEQ ID NO: 460000 - RNA, 12 nt, Chlamydia trachomatis
aauaaaagcucc

SEQ ID NO: 460001 - RNA, 17 nt, Chlamydia trachomatis
aauaaagauagcaucuu

SEQ ID NO: 460002 - RNA, 13 nt, Chlamydia trachomatis
uauaugcucuuug

SEQ ID NO: 460003 - RNA, 18 nt, Chlamydia trachomatis
uauacccgacuaaaaaau

SEQ ID NO: 460004 - RNA, 16 nt, Chlamydia trachomatis
uaucuuguguagaaga

SEQ ID NO: 460005 - RNA, 20 nt, Chlamydia trachomatis
uaugaauauuuaagggaagc

SEQ ID NO: 460006 - RNA, 16 nt, Chlamydia trachomatis
uaugacccagaaucau

SEQ ID NO: 460007 - RNA, 13 nt, Chlamydia trachomatis
uaucuagaaaacg

SEQ ID NO: 460008 - RNA, 14 nt, Chlamydia trachomatis
uaucuaaagaaaug

SEQ ID NO: 460009 - RNA, 18 nt, Chlamydia trachomatis
ucaaaccuaaguagcaaa

SEQ ID NO: 460010 - RNA, 19 nt, Chlamydia trachomatis
ucaaaccuaaguagcaaau

SEQ ID NO: 460011 - RNA, 22 nt, Chlamydia trachomatis
ucaaaaugaucgccucuaaagc

SEQ ID NO: 460012 - RNA, 15 nt, Chlamydia trachomatis
ucaaauccugcuucc

SEQ ID NO: 460013 - RNA, 19 nt, Chlamydia trachomatis
ucacaaaccaaaaccacac

SEQ ID NO: 460014 - RNA, 19 nt, Chlamydia trachomatis
ucaaugagcgcuuuuucuu

SEQ ID NO: 460015 - RNA, 22 nt, Chlamydia trachomatis
aauaauaccuuaauaagcuuuu

SEQ ID NO: 460016 - RNA, 15 nt, Chlamydia trachomatis
ucacuacuucaucga

SEQ ID NO: 460017 - RNA, 20 nt, Chlamydia trachomatis
aauaagaaauuaacccaaga

SEQ ID NO: 460018 - RNA, 17 nt, Chlamydia trachomatis
aauaaccugaagauuuu

SEQ ID NO: 460019 - RNA, 22 nt, Chlamydia trachomatis
ucaguuugaaucacagaaacuu

SEQ ID NO: 460020 - RNA, 13 nt, Chlamydia trachomatis
ucauaaaaaagac

SEQ ID NO: 460021 - RNA, 19 nt, Chlamydia trachomatis
ucaucaugagaacgauuuu

SEQ ID NO: 460022 - RNA, 19 nt, Chlamydia trachomatis
ucauuaggauuaaaaucca

SEQ ID NO: 460023 - RNA, 18 nt, Chlamydia trachomatis
ucaugucuucuuucucuu

SEQ ID NO: 460024 - RNA, 22 nt, Chlamydia trachomatis
uccauaauuaaaggcucuguua

SEQ ID NO: 460025 - RNA, 22 nt, Chlamydia trachomatis
uccauauauucagaagaagagc

SEQ ID NO: 460026 - RNA, 13 nt, Chlamydia trachomatis
uccgcagcaugaa

SEQ ID NO: 460027 - RNA, 15 nt, Chlamydia trachomatis
ucccgguaauagaag

SEQ ID NO: 460028 - RNA, 13 nt, Chlamydia trachomatis
uccggacuuuccu

SEQ ID NO: 460029 - RNA, 18 nt, Chlamydia trachomatis
uccuaugcaguaaagaaa

SEQ ID NO: 460030 - RNA, 13 nt, Chlamydia trachomatis
uccuuacauaaaa

SEQ ID NO: 460031 - RNA, 16 nt, Chlamydia trachomatis
ucgaaaacaaagaguu

SEQ ID NO: 460032 - RNA, 21 nt, Chlamydia trachomatis
ucgaacucagcuuccuuggcu

SEQ ID NO: 460033 - RNA, 14 nt, Chlamydia trachomatis
ucgauacucaucga

SEQ ID NO: 460034 - RNA, 22 nt, Chlamydia trachomatis
ucgcaaguucuccuucuuguga

SEQ ID NO: 460035 - RNA, 17 nt, Chlamydia trachomatis
ucgcagagaaagagcca

SEQ ID NO: 460036 - RNA, 15 nt, Chlamydia trachomatis
ucgcggaagaaagca

SEQ ID NO: 460037 - RNA, 13 nt, Chlamydia trachomatis
ucggaaaagauau

SEQ ID NO: 460038 - RNA, 18 nt, Chlamydia trachomatis
ucguaaaaacugucgaag

SEQ ID NO: 460039 - RNA, 14 nt, Chlamydia trachomatis
ucguaagcaaacag

SEQ ID NO: 460040 - RNA, 24 nt, Chlamydia trachomatis
ucguaagcaacaauauccuccaua

SEQ ID NO: 460041 - RNA, 23 nt, Chlamydia trachomatis
ucguguguguguguaaccuuccc

SEQ ID NO: 460042 - RNA, 22 nt, Chlamydia trachomatis
ucguucuacaggaguaaauccu

SEQ ID NO: 460043 - RNA, 13 nt, Chlamydia trachomatis
ucuccuaaaagcc

SEQ ID NO: 460044 - RNA, 13 nt, Chlamydia trachomatis
ucuccuaaauccu

SEQ ID NO: 460045 - RNA, 21 nt, Chlamydia trachomatis
ucuagugccucaauuuguagc

SEQ ID NO: 460046 - RNA, 13 nt, Chlamydia trachomatis
ucuagagguuuaa

SEQ ID NO: 460047 - RNA, 12 nt, Chlamydia trachomatis
ucuaaaagaguu

SEQ ID NO: 460048 - RNA, 20 nt, Chlamydia trachomatis
aauacgugcccaugagaaac

SEQ ID NO: 460049 - RNA, 19 nt, Chlamydia trachomatis
aauacuaaacuaucuaaaa

SEQ ID NO: 460050 - RNA, 15 nt, Chlamydia trachomatis
ugaaaauaucuaagc

SEQ ID NO: 460051 - RNA, 17 nt, Chlamydia trachomatis
ugaaaaugcucuaaagg

SEQ ID NO: 460052 - RNA, 18 nt, Chlamydia trachomatis
ucuuuguucacagaaagu

SEQ ID NO: 460053 - RNA, 15 nt, Chlamydia trachomatis
ucuuuugaagaugga

SEQ ID NO: 460054 - RNA, 15 nt, Chlamydia trachomatis
ucuucccaacuuuuu

SEQ ID NO: 460055 - RNA, 22 nt, Chlamydia trachomatis
ucuucgaauccuaaaaucacca

SEQ ID NO: 460056 - RNA, 20 nt, Chlamydia trachomatis
ucuugaguagaagaaugaaa

SEQ ID NO: 460057 - RNA, 14 nt, Chlamydia trachomatis
ucuucuucuuuagc

SEQ ID NO: 460058 - RNA, 16 nt, Chlamydia trachomatis
ugaagaaguuuacgaa

SEQ ID NO: 460059 - RNA, 19 nt, Chlamydia trachomatis
ugaauuccaaguugcuugg

SEQ ID NO: 460060 - RNA, 21 nt, Chlamydia trachomatis
ugacugcggcagcugcuugga

SEQ ID NO: 460061 - RNA, 15 nt, Chlamydia trachomatis
ugagauguuuacgag

SEQ ID NO: 460062 - RNA, 21 nt, Chlamydia trachomatis
ugagccuucaauucuugcuuc

SEQ ID NO: 460063 - RNA, 16 nt, Chlamydia trachomatis
ugcaaacaaaagagau

SEQ ID NO: 460064 - RNA, 19 nt, Chlamydia trachomatis
ugcaacaagaacgcuuucc

SEQ ID NO: 460065 - RNA, 22 nt, Chlamydia trachomatis
ugcacaaaggaacaucgagaaa

SEQ ID NO: 460066 - RNA, 18 nt, Chlamydia trachomatis
ugcaguggaagauagaag

SEQ ID NO: 460067 - RNA, 21 nt, Chlamydia trachomatis
ugccaaaaagaaaaucagaaa

SEQ ID NO: 460068 - RNA, 15 nt, Chlamydia trachomatis
ugccauuucuaaagg

SEQ ID NO: 460069 - RNA, 22 nt, Chlamydia trachomatis
aauaggguuaggaaagcacuuu

SEQ ID NO: 460070 - RNA, 14 nt, Chlamydia trachomatis
ugcgcaucaaagga

SEQ ID NO: 460071 - RNA, 19 nt, Chlamydia trachomatis
ugcuaaccguucuugacaa

SEQ ID NO: 460072 - RNA, 19 nt, Chlamydia trachomatis
uggaagaucucuuucucua

SEQ ID NO: 460073 - RNA, 18 nt, Chlamydia trachomatis
uggagaauuggaaacucu

SEQ ID NO: 460074 - RNA, 18 nt, Chlamydia trachomatis
uggagcacucucaacgaa

SEQ ID NO: 460075 - RNA, 14 nt, Chlamydia trachomatis
uggaucucuuagac

SEQ ID NO: 460076 - RNA, 17 nt, Chlamydia trachomatis
uggcaauggcaaaaucu

SEQ ID NO: 460077 - RNA, 13 nt, Chlamydia trachomatis
uggcagaacucgc

SEQ ID NO: 460078 - RNA, 20 nt, Chlamydia trachomatis
ugguaacaccaaaaaaucca

SEQ ID NO: 460079 - RNA, 19 nt, Chlamydia trachomatis
aaucaauuucuagaauuuu

SEQ ID NO: 460080 - RNA, 19 nt, Chlamydia trachomatis
aaucacagauaacgauucc

SEQ ID NO: 460081 - RNA, 23 nt, Chlamydia trachomatis
uguaucccuaguacaaaaauacu

SEQ ID NO: 460082 - RNA, 14 nt, Chlamydia trachomatis
uguaucaaaaucaa

SEQ ID NO: 460083 - RNA, 16 nt, Chlamydia trachomatis
ugucgagauaaaaacc

SEQ ID NO: 460084 - RNA, 14 nt, Chlamydia trachomatis
uguccuuuauucaa

SEQ ID NO: 460085 - RNA, 20 nt, Chlamydia trachomatis
uguuucaaagaugcgaucuc

SEQ ID NO: 460086 - RNA, 19 nt, Chlamydia trachomatis
uguuucuaauggaugaucu

SEQ ID NO: 460087 - RNA, 20 nt, Chlamydia trachomatis
uguuugggcugcugcuugga

SEQ ID NO: 460088 - RNA, 13 nt, Chlamydia trachomatis
uuaauuuuuuaga

SEQ ID NO: 460089 - RNA, 16 nt, Chlamydia trachomatis
uguuaacucuuucgau

SEQ ID NO: 460090 - RNA, 23 nt, Chlamydia trachomatis
uguguugcaaagagagcaacgag

SEQ ID NO: 460091 - RNA, 15 nt, Chlamydia trachomatis
uuaucguaccccaaa

SEQ ID NO: 460092 - RNA, 18 nt, Chlamydia trachomatis
uuaccuugaguccgcaaa

SEQ ID NO: 460093 - RNA, 20 nt, Chlamydia trachomatis
uucacagagcuucucuaaau

SEQ ID NO: 460094 - RNA, 11 nt, Chlamydia trachomatis
uuauuuacgau

SEQ ID NO: 460095 - RNA, 16 nt, Chlamydia trachomatis
uucaaacauagaagga

SEQ ID NO: 460096 - RNA, 16 nt, Chlamydia trachomatis
uucaacuggccuuuuu

SEQ ID NO: 460097 - RNA, 19 nt, Chlamydia trachomatis
uucauaacaccugcauagc

SEQ ID NO: 460098 - RNA, 20 nt, Chlamydia trachomatis
uucagguugagcaagcucaa

SEQ ID NO: 460099 - RNA, 21 nt, Chlamydia trachomatis
uucaguguugagaagcuuagu

SEQ ID NO: 460100 - RNA, 19 nt, Chlamydia trachomatis
uuccuacucggccagagcu

SEQ ID NO: 460101 - RNA, 22 nt, Chlamydia trachomatis
uuccuggauccaaaaaagaauc

SEQ ID NO: 460102 - RNA, 23 nt, Chlamydia trachomatis
uucgucaaagaaguaaugaaggu

SEQ ID NO: 460103 - RNA, 14 nt, Chlamydia trachomatis
uucguacugcauug

SEQ ID NO: 460104 - RNA, 19 nt, Chlamydia trachomatis
uucgguauugaaagcaugu

SEQ ID NO: 460105 - RNA, 19 nt, Chlamydia trachomatis
uucucuuuaauaacugcau

SEQ ID NO: 460106 - RNA, 18 nt, Chlamydia trachomatis
uucucucuaaaaucacac

SEQ ID NO: 460107 - RNA, 21 nt, Chlamydia trachomatis
uucuaggucugaagaaaaauc

SEQ ID NO: 460108 - RNA, 18 nt, Chlamydia trachomatis
uucuugcgaugccucuaa

SEQ ID NO: 460109 - RNA, 16 nt, Chlamydia trachomatis
uucuugauaaauaauc

SEQ ID NO: 460110 - RNA, 13 nt, Chlamydia trachomatis
uugaacaacuccu

SEQ ID NO: 460111 - RNA, 14 nt, Chlamydia trachomatis
uugaucaaagaauc

SEQ ID NO: 460112 - RNA, 16 nt, Chlamydia trachomatis
uugagaauccaaauuu

SEQ ID NO: 460113 - RNA, 15 nt, Chlamydia trachomatis
uugcuguauagagua

SEQ ID NO: 460114 - RNA, 13 nt, Chlamydia trachomatis
uugcuccacacaa

SEQ ID NO: 460115 - RNA, 18 nt, Chlamydia trachomatis
uugcuaugaaaaauccuu

SEQ ID NO: 460116 - RNA, 17 nt, Chlamydia trachomatis
uuggagugacuagccaa

SEQ ID NO: 460117 - RNA, 19 nt, Chlamydia trachomatis
uuuacgcacaaagauuucu

SEQ ID NO: 460118 - RNA, 12 nt, Chlamydia trachomatis
uuuacugucgau

SEQ ID NO: 460119 - RNA, 19 nt, Chlamydia trachomatis
uuuaaggacuucaacaaac

SEQ ID NO: 460120 - RNA, 17 nt, Chlamydia trachomatis
uuuaauaaguuuuucaa

SEQ ID NO: 460121 - RNA, 18 nt, Chlamydia trachomatis
aauccuguggucacaaga

SEQ ID NO: 460122 - RNA, 19 nt, Chlamydia trachomatis
uuguagugaaguucccuuu

SEQ ID NO: 460123 - RNA, 20 nt, Chlamydia trachomatis
uuguuccuaauuuaaaaucu

SEQ ID NO: 460124 - RNA, 12 nt, Chlamydia trachomatis
uuucagaaaagc

SEQ ID NO: 460125 - RNA, 22 nt, Chlamydia trachomatis
uuuccacagguugcaucaacaa

SEQ ID NO: 460126 - RNA, 14 nt, Chlamydia trachomatis
uuuccucuagcaga

SEQ ID NO: 460127 - RNA, 16 nt, Chlamydia trachomatis
uuuucuagugcaugga

SEQ ID NO: 460128 - RNA, 22 nt, Chlamydia trachomatis
uuuucuuuccuagcgaagucuu

SEQ ID NO: 460129 - RNA, 17 nt, Chlamydia trachomatis
uuuucccuagaaaaucu

SEQ ID NO: 460130 - RNA, 16 nt, Chlamydia trachomatis
uuucuacggaaagguu

SEQ ID NO: 460131 - RNA, 17 nt, Chlamydia trachomatis
uuuguucucuaaagauu

SEQ ID NO: 460132 - RNA, 15 nt, Chlamydia trachomatis
uuuuaaaaucuccuc

SEQ ID NO: 460133 - RNA, 12 nt, Chlamydia trachomatis
aaucucaaaaac

SEQ ID NO: 460134 - RNA, 16 nt, Chlamydia trachomatis
uuuuggaagaucucuu

SEQ ID NO: 460135 - RNA, 17 nt, Chlamydia trachomatis
aaucuuucuuucuaaga

SEQ ID NO: 460136 - RNA, 18 nt, Chlamydia trachomatis
aaugcuucuuaacugcag

SEQ ID NO: 460137 - RNA, 17 nt, Chlamydia trachomatis
acacauccuucugcuau

SEQ ID NO: 460138 - RNA, 23 nt, Chlamydia trachomatis
aauuucugggaaaauuaaaaggc

SEQ ID NO: 460139 - RNA, 14 nt, Chlamydia trachomatis
acacuuuucagcuu

SEQ ID NO: 460140 - RNA, 18 nt, Chlamydia trachomatis
acacuugauaaauagcaa

SEQ ID NO: 460141 - RNA, 19 nt, Chlamydia trachomatis
acagagcccuucuuuuccu

SEQ ID NO: 460142 - RNA, 21 nt, Chlamydia trachomatis
acagauauaacaacggcauag

SEQ ID NO: 460143 - RNA, 23 nt, Chlamydia trachomatis
acagcaagacaacguuacuaccg

SEQ ID NO: 460144 - RNA, 18 nt, Chlamydia trachomatis
acagauuuagagaauaau

SEQ ID NO: 460145 - RNA, 16 nt, Chlamydia trachomatis
acagcuagaauagcag

SEQ ID NO: 460146 - RNA, 13 nt, Chlamydia trachomatis
acaggaagaauau

SEQ ID NO: 460147 - RNA, 12 nt, Chlamydia trachomatis
acauuccaaaua

SEQ ID NO: 460148 - RNA, 12 nt, Chlamydia trachomatis
accaguugcuaa

SEQ ID NO: 460149 - RNA, 15 nt, Chlamydia trachomatis
accaguuucuucuac

SEQ ID NO: 460150 - RNA, 16 nt, Chlamydia trachomatis
acccgaggaagcaaua

SEQ ID NO: 460151 - RNA, 16 nt, Chlamydia trachomatis
accugugaagaaacuu

SEQ ID NO: 460152 - RNA, 19 nt, Chlamydia trachomatis
acgagaucugcaucuuuau

SEQ ID NO: 460153 - RNA, 14 nt, Chlamydia trachomatis
acgauaaacagauc

SEQ ID NO: 460154 - RNA, 20 nt, Chlamydia trachomatis
acgauauuuaagauagaugc

SEQ ID NO: 460155 - RNA, 20 nt, Chlamydia trachomatis
acgcaacccuaaaucuccuc

SEQ ID NO: 460156 - RNA, 17 nt, Chlamydia trachomatis
acgcauuugcucuucca

SEQ ID NO: 460157 - RNA, 21 nt, Chlamydia trachomatis
acgcuccaaauaaaacgaaaa

SEQ ID NO: 460158 - RNA, 11 nt, Chlamydia trachomatis
acuaucuccua

SEQ ID NO: 460159 - RNA, 19 nt, Chlamydia trachomatis
acuaucauugagcaaaaaa

SEQ ID NO: 460160 - RNA, 13 nt, Chlamydia trachomatis
acucaaaaauucc

SEQ ID NO: 460161 - RNA, 22 nt, Chlamydia trachomatis
acucuaucccgcgguagaaagu

SEQ ID NO: 460162 - RNA, 17 nt, Chlamydia trachomatis
acucuauuaagaaucuu

SEQ ID NO: 460163 - RNA, 20 nt, Chlamydia trachomatis
acucucgggccaaaaagacu

SEQ ID NO: 460164 - RNA, 20 nt, Chlamydia trachomatis
acugcgugaccguuaauauc

SEQ ID NO: 460165 - RNA, 17 nt, Chlamydia trachomatis
acuuccccauucuucuc

SEQ ID NO: 460166 - RNA, 20 nt, Chlamydia trachomatis
acugucgaacgcuucuuccc

SEQ ID NO: 460167 - RNA, 14 nt, Chlamydia trachomatis
acuucaauagcagg

SEQ ID NO: 460168 - RNA, 21 nt, Chlamydia trachomatis
acuucugcuaaaaaugcuugc

SEQ ID NO: 460169 - RNA, 16 nt, Chlamydia trachomatis
acuugagaacaaacca

SEQ ID NO: 460170 - RNA, 21 nt, Chlamydia trachomatis
agacucaaauuuucaugaaaa

SEQ ID NO: 460171 - RNA, 15 nt, Chlamydia trachomatis
agacucaaucaccac

SEQ ID NO: 460172 - RNA, 19 nt, Chlamydia trachomatis
agagagauugauaggguug

SEQ ID NO: 460173 - RNA, 16 nt, Chlamydia trachomatis
agaaacuguaaugucc

SEQ ID NO: 460174 - RNA, 14 nt, Chlamydia trachomatis
agaaagcuacaguc

SEQ ID NO: 460175 - RNA, 22 nt, Chlamydia trachomatis
agagauauugucuacuuuuugu

SEQ ID NO: 460176 - RNA, 20 nt, Chlamydia trachomatis
agagauauaagagaagguaa

SEQ ID NO: 460177 - RNA, 18 nt, Chlamydia trachomatis
agagauuuccucuucuag

SEQ ID NO: 460178 - RNA, 20 nt, Chlamydia trachomatis
agagcuguuguuaauaucag

SEQ ID NO: 460179 - RNA, 16 nt, Chlamydia trachomatis
agagguagccaaagaa

SEQ ID NO: 460180 - RNA, 18 nt, Chlamydia trachomatis
agaugacuugcccgacag

SEQ ID NO: 460181 - RNA, 21 nt, Chlamydia trachomatis
agcacccuuuuuauaaucucc

SEQ ID NO: 460182 - RNA, 14 nt, Chlamydia trachomatis
agcacuauaucucc

SEQ ID NO: 460183 - RNA, 15 nt, Chlamydia trachomatis
agcaaauaaagaggu

SEQ ID NO: 460184 - RNA, 14 nt, Chlamydia trachomatis
agcaacaauauccu

SEQ ID NO: 460185 - RNA, 15 nt, Chlamydia trachomatis
agcauaucuccuaaa

SEQ ID NO: 460186 - RNA, 17 nt, Chlamydia trachomatis
agcaugccgcacauccg

SEQ ID NO: 460187 - RNA, 13 nt, Chlamydia trachomatis
agccaauuuccau

SEQ ID NO: 460188 - RNA, 18 nt, Chlamydia trachomatis
agccguuuucagguugag

SEQ ID NO: 460189 - RNA, 12 nt, Chlamydia trachomatis
agccuuucucua

SEQ ID NO: 460190 - RNA, 18 nt, Chlamydia trachomatis
agccuuggauuucuucug

SEQ ID NO: 460191 - RNA, 14 nt, Chlamydia trachomatis
agcgugcauuugag

SEQ ID NO: 460192 - RNA, 21 nt, Chlamydia trachomatis
agcuacagcaauagagauauc

SEQ ID NO: 460193 - RNA, 20 nt, Chlamydia trachomatis
agcuccuaucacucccugca

SEQ ID NO: 460194 - RNA, 23 nt, Chlamydia trachomatis
agcucuguucaauuguuggacaa

SEQ ID NO: 460195 - RNA, 15 nt, Chlamydia trachomatis
agcugccgaaacuag

SEQ ID NO: 460196 - RNA, 18 nt, Chlamydia trachomatis
aggcauuccuuucuucca

SEQ ID NO: 460197 - RNA, 14 nt, Chlamydia trachomatis
aggcccuucuugag

SEQ ID NO: 460198 - RNA, 23 nt, Chlamydia trachomatis
agggagcagcuuuucuaacguuc

SEQ ID NO: 460199 - RNA, 16 nt, Chlamydia trachomatis
aggcgcccacagaaca

SEQ ID NO: 460200 - RNA, 20 nt, Chlamydia trachomatis
agggauagaaacuccguagu

SEQ ID NO: 460201 - RNA, 17 nt, Chlamydia trachomatis
aggucucucuuuaugaa

SEQ ID NO: 460202 - RNA, 15 nt, Chlamydia trachomatis
agguuuauaacucca

SEQ ID NO: 460203 - RNA, 18 nt, Chlamydia trachomatis
agguucuucaacaacuuc

SEQ ID NO: 460204 - RNA, 19 nt, Chlamydia trachomatis
agguucccuugaaagacac

SEQ ID NO: 460205 - RNA, 20 nt, Chlamydia trachomatis
aguauuaaacuucaaacucg

SEQ ID NO: 460206 - RNA, 19 nt, Chlamydia trachomatis
aguauccauauccaugaag

SEQ ID NO: 460207 - RNA, 22 nt, Chlamydia trachomatis
aguaucuguuaguagcuucucu

SEQ ID NO: 460208 - RNA, 23 nt, Chlamydia trachomatis
aguucccuuuuguuccagaaaaa

SEQ ID NO: 460209 - RNA, 20 nt, Chlamydia trachomatis
aguucuucuuccacagaagu

SEQ ID NO: 460210 - RNA, 13 nt, Chlamydia trachomatis
auaaaagaagcag

SEQ ID NO: 460211 - RNA, 13 nt, Chlamydia trachomatis
aguuguaaagcau

SEQ ID NO: 460212 - RNA, 20 nt, Chlamydia trachomatis
aguuuaaaggacccgcuauu

SEQ ID NO: 460213 - RNA, 21 nt, Chlamydia trachomatis
auaauccuaugcaguaaagaa

SEQ ID NO: 460214 - RNA, 15 nt, Chlamydia trachomatis
auacaucaucucuca

SEQ ID NO: 460215 - RNA, 15 nt, Chlamydia trachomatis
auagaucuaaagcag

SEQ ID NO: 460216 - RNA, 17 nt, Chlamydia trachomatis
aucacuccaagaagagu

SEQ ID NO: 460217 - RNA, 22 nt, Chlamydia trachomatis
aucacuaaaaguaguccuauca

SEQ ID NO: 460218 - RNA, 20 nt, Chlamydia trachomatis
aucacagaucucaucaggau

SEQ ID NO: 460219 - RNA, 17 nt, Chlamydia trachomatis
aucacacgggucucuau

SEQ ID NO: 460220 - RNA, 14 nt, Chlamydia trachomatis
auccgcuucuucug

SEQ ID NO: 460221 - RNA, 22 nt, Chlamydia trachomatis
auccucaaaaaaggcauaaaag

SEQ ID NO: 460222 - RNA, 14 nt, Chlamydia trachomatis
auccuacacaagcu

SEQ ID NO: 460223 - RNA, 21 nt, Chlamydia trachomatis
auccuggaguauuuucaaaaa

SEQ ID NO: 460224 - RNA, 19 nt, Chlamydia trachomatis
auccuuuauggguagcgau

SEQ ID NO: 460225 - RNA, 18 nt, Chlamydia trachomatis
aucgagcaaccagcgcau

SEQ ID NO: 460226 - RNA, 22 nt, Chlamydia trachomatis
aucggcaaaagaucucauagca

SEQ ID NO: 460227 - RNA, 14 nt, Chlamydia trachomatis
aucugggauauaua

SEQ ID NO: 460228 - RNA, 18 nt, Chlamydia trachomatis
aucuuguaauaucaaaga

SEQ ID NO: 460229 - RNA, 22 nt, Chlamydia trachomatis
aucuucuucuaagcuagaaaau

SEQ ID NO: 460230 - RNA, 22 nt, Chlamydia trachomatis
aucuucucuugaaucaaaaagu

SEQ ID NO: 460231 - RNA, 16 nt, Chlamydia trachomatis
aucuucaacaagauuu

SEQ ID NO: 460232 - RNA, 16 nt, Chlamydia trachomatis
augacagcuucuugaa

SEQ ID NO: 460233 - RNA, 14 nt, Chlamydia trachomatis
augacaaacuuucu

SEQ ID NO: 460234 - RNA, 22 nt, Chlamydia trachomatis
augaaaccuaauagaaauagcu

SEQ ID NO: 460235 - RNA, 16 nt, Chlamydia trachomatis
aucuuucacaacccaa

SEQ ID NO: 460236 - RNA, 19 nt, Chlamydia trachomatis
aucuuucgaauuggaucuc

SEQ ID NO: 460237 - RNA, 20 nt, Chlamydia trachomatis
aucuuugaagguaagaaagu

SEQ ID NO: 460238 - RNA, 20 nt, Chlamydia trachomatis
aucuuuuacuggagaacagu

SEQ ID NO: 460239 - RNA, 15 nt, Chlamydia trachomatis
aucuuuuuauugaug

SEQ ID NO: 460240 - RNA, 14 nt, Chlamydia trachomatis
augauaagggaauc

SEQ ID NO: 460241 - RNA, 15 nt, Chlamydia trachomatis
augauagacaagacu

SEQ ID NO: 460242 - RNA, 12 nt, Chlamydia trachomatis
augcagcaucca

SEQ ID NO: 460243 - RNA, 22 nt, Chlamydia trachomatis
auguaaggaaauaccuuguuuu

SEQ ID NO: 460244 - RNA, 13 nt, Chlamydia trachomatis
auucagcaaaaaa

SEQ ID NO: 460245 - RNA, 17 nt, Chlamydia trachomatis
auucagaacaagugcag

SEQ ID NO: 460246 - RNA, 13 nt, Chlamydia trachomatis
auucagaauauag

SEQ ID NO: 460247 - RNA, 14 nt, Chlamydia trachomatis
auuccuaggaauga

SEQ ID NO: 460248 - RNA, 18 nt, Chlamydia trachomatis
auucuuugguaauagcaa

SEQ ID NO: 460249 - RNA, 13 nt, Chlamydia trachomatis
auucuugccaccg

SEQ ID NO: 460250 - RNA, 15 nt, Chlamydia trachomatis
auugaauaaaucuau

SEQ ID NO: 460251 - RNA, 13 nt, Chlamydia trachomatis
auugagaaauaau

SEQ ID NO: 460252 - RNA, 15 nt, Chlamydia trachomatis
auugggcauauuaga

SEQ ID NO: 460253 - RNA, 13 nt, Chlamydia trachomatis
caaagaaauagcu

SEQ ID NO: 460254 - RNA, 12 nt, Chlamydia trachomatis
auugugccaccg

SEQ ID NO: 460255 - RNA, 15 nt, Chlamydia trachomatis
caaccaccuguugcu

SEQ ID NO: 460256 - RNA, 18 nt, Chlamydia trachomatis
caagcugacaaagcuucc

SEQ ID NO: 460257 - RNA, 20 nt, Chlamydia trachomatis
caaggcuccguucaaagcaa

SEQ ID NO: 460258 - RNA, 20 nt, Chlamydia trachomatis
caauaauucaggcucuuuca

SEQ ID NO: 460259 - RNA, 19 nt, Chlamydia trachomatis
caauaucuguuuuucccca

SEQ ID NO: 460260 - RNA, 14 nt, Chlamydia trachomatis
caauagcauuucug

SEQ ID NO: 460261 - RNA, 16 nt, Chlamydia trachomatis
cacaauuuuuguuccu

SEQ ID NO: 460262 - RNA, 16 nt, Chlamydia trachomatis
caccuaaugagcagaa

SEQ ID NO: 460263 - RNA, 14 nt, Chlamydia trachomatis
cacguagucauuga

SEQ ID NO: 460264 - RNA, 17 nt, Chlamydia trachomatis
cagaaacuucaguuugu

SEQ ID NO: 460265 - RNA, 19 nt, Chlamydia trachomatis
cacucauuaccauacagac

SEQ ID NO: 460266 - RNA, 16 nt, Chlamydia trachomatis
cagaccuacaaagaua

SEQ ID NO: 460267 - RNA, 18 nt, Chlamydia trachomatis
cagauuuuucaaaaauag

SEQ ID NO: 460268 - RNA, 21 nt, Chlamydia trachomatis
cagcaaaaccuuuuacaguuc

SEQ ID NO: 460269 - RNA, 20 nt, Chlamydia trachomatis
cagcaagcuugucuccuucu

SEQ ID NO: 460270 - RNA, 21 nt, Chlamydia trachomatis
cagcauccucaaaaaaggcau

SEQ ID NO: 460271 - RNA, 20 nt, Chlamydia trachomatis
cagcgauugaucuaucgcuu

SEQ ID NO: 460272 - RNA, 14 nt, Chlamydia trachomatis
cagcuaauaaguuc

SEQ ID NO: 460273 - RNA, 20 nt, Chlamydia trachomatis
cagcuucuucuucucuuucg

SEQ ID NO: 460274 - RNA, 14 nt, Chlamydia trachomatis
caucgaaaaucacu

SEQ ID NO: 460275 - RNA, 16 nt, Chlamydia trachomatis
cauuauguaagaguuu

SEQ ID NO: 460276 - RNA, 16 nt, Chlamydia trachomatis
cauuauuaacaggaag

SEQ ID NO: 460277 - RNA, 19 nt, Chlamydia trachomatis
cauuauuauuuaaaacaau

SEQ ID NO: 460278 - RNA, 21 nt, Chlamydia trachomatis
cauuauuuuuucgagaacgaa

SEQ ID NO: 460279 - RNA, 18 nt, Chlamydia trachomatis
cauuaccuaggacagaca

SEQ ID NO: 460280 - RNA, 12 nt, Chlamydia trachomatis
cauuuaaaaguc

SEQ ID NO: 460281 - RNA, 19 nt, Chlamydia trachomatis
cauuucugcaacucucuug

SEQ ID NO: 460282 - RNA, 16 nt, Chlamydia trachomatis
ccaaaaacaaucaaag

SEQ ID NO: 460283 - RNA, 11 nt, Chlamydia trachomatis
ccaaaaagaaa

SEQ ID NO: 460284 - RNA, 22 nt, Chlamydia trachomatis
ccaaaauaucuacuucuuguuc

SEQ ID NO: 460285 - RNA, 14 nt, Chlamydia trachomatis
ccacccuucccaac

SEQ ID NO: 460286 - RNA, 15 nt, Chlamydia trachomatis
ccaucauuaucuucu

SEQ ID NO: 460287 - RNA, 18 nt, Chlamydia trachomatis
ccaucuuuaaagaggauc

SEQ ID NO: 460288 - RNA, 22 nt, Chlamydia trachomatis
ccaugaucucugcagaagaagc

SEQ ID NO: 460289 - RNA, 23 nt, Chlamydia trachomatis
cccuucuaacuacucccaaauca

SEQ ID NO: 460290 - RNA, 14 nt, Chlamydia trachomatis
cccuucaauuucuu

SEQ ID NO: 460291 - RNA, 22 nt, Chlamydia trachomatis
cccuuuguaguuagacaaaaaa

SEQ ID NO: 460292 - RNA, 22 nt, Chlamydia trachomatis
cccuuuuaaagggggacaaaaa

SEQ ID NO: 460293 - RNA, 20 nt, Chlamydia trachomatis
cccuuuuguuccagaaaaaa

SEQ ID NO: 460294 - RNA, 14 nt, Chlamydia trachomatis
ccgcugauuagaaa

SEQ ID NO: 460295 - RNA, 13 nt, Chlamydia trachomatis
ccgguaaucaaag

SEQ ID NO: 460296 - RNA, 12 nt, Chlamydia trachomatis
ccuaaagaagcc

SEQ ID NO: 460297 - RNA, 21 nt, Chlamydia trachomatis
ccucuaaacaagguucuucaa

SEQ ID NO: 460298 - RNA, 15 nt, Chlamydia trachomatis
ccugcauaauagcuu

SEQ ID NO: 460299 - RNA, 22 nt, Chlamydia trachomatis
ccuggauccaaaaaagaaucua

SEQ ID NO: 460300 - RNA, 18 nt, Chlamydia trachomatis
ccuuauacaucagagcaa

SEQ ID NO: 460301 - RNA, 23 nt, Chlamydia trachomatis
ccuuguaucuugugcaaacaaaa

SEQ ID NO: 460302 - RNA, 20 nt, Chlamydia trachomatis
cgaagcaaaacgcccuccaa

SEQ ID NO: 460303 - RNA, 13 nt, Chlamydia trachomatis
cgaagucuucuau

SEQ ID NO: 460304 - RNA, 11 nt, Chlamydia trachomatis
cgacaguuuga

SEQ ID NO: 460305 - RNA, 16 nt, Chlamydia trachomatis
cgagcucccauuucug

SEQ ID NO: 460306 - RNA, 15 nt, Chlamydia trachomatis
cgauuuuuaaaagac

SEQ ID NO: 460307 - RNA, 16 nt, Chlamydia trachomatis
cgauuuuuaaaagacc

SEQ ID NO: 460308 - RNA, 13 nt, Chlamydia trachomatis
cgcauaugcagaa

SEQ ID NO: 460309 - RNA, 17 nt, Chlamydia trachomatis
cggauaggaaaaagcua

SEQ ID NO: 460310 - RNA, 19 nt, Chlamydia trachomatis
cgggauauguuaaagccca

SEQ ID NO: 460311 - RNA, 22 nt, Chlamydia trachomatis
cgguaauagaaguuacuuuucu

SEQ ID NO: 460312 - RNA, 16 nt, Chlamydia trachomatis
cguccacucuucaggu

SEQ ID NO: 460313 - RNA, 14 nt, Chlamydia trachomatis
cgucuaaaacaauu

SEQ ID NO: 460314 - RNA, 17 nt, Chlamydia trachomatis
cgugacgaauaaucaau

SEQ ID NO: 460315 - RNA, 19 nt, Chlamydia trachomatis
cguguaauuuccuauuucu

SEQ ID NO: 460316 - RNA, 23 nt, Chlamydia trachomatis
cucaaaguuuuuguuuuuuucaa

SEQ ID NO: 460317 - RNA, 12 nt, Chlamydia trachomatis
cucaauagcagc

SEQ ID NO: 460318 - RNA, 16 nt, Chlamydia trachomatis
cuauaccuaaaaguuu

SEQ ID NO: 460319 - RNA, 17 nt, Chlamydia trachomatis
cuagagauaucacuacc

SEQ ID NO: 460320 - RNA, 23 nt, Chlamydia trachomatis
cuacuauccgaagcugcaauaga

SEQ ID NO: 460321 - RNA, 20 nt, Chlamydia trachomatis
cuacauucagaauauagcug

SEQ ID NO: 460322 - RNA, 12 nt, Chlamydia trachomatis
cuccauuuccau

SEQ ID NO: 460323 - RNA, 18 nt, Chlamydia trachomatis
cucccaauauacaaguau

SEQ ID NO: 460324 - RNA, 20 nt, Chlamydia trachomatis
cucaucgaagcauagggcua

SEQ ID NO: 460325 - RNA, 17 nt, Chlamydia trachomatis
cuccgacccaagacacg

SEQ ID NO: 460326 - RNA, 22 nt, Chlamydia trachomatis
cuccgaugccgcagaaaaaacc

SEQ ID NO: 460327 - RNA, 16 nt, Chlamydia trachomatis
cuccuucuacaaaaaa

SEQ ID NO: 460328 - RNA, 16 nt, Chlamydia trachomatis
cucgagcuaagaaaau

SEQ ID NO: 460329 - RNA, 17 nt, Chlamydia trachomatis
cucgagccuguuuagaa

SEQ ID NO: 460330 - RNA, 23 nt, Chlamydia trachomatis
cucuuuguugggcaaucaagcua

SEQ ID NO: 460331 - RNA, 21 nt, Chlamydia trachomatis
cucuuuuuaaaucaauuucuc

SEQ ID NO: 460332 - RNA, 18 nt, Chlamydia trachomatis
cucuuuuucagacaaaaa

SEQ ID NO: 460333 - RNA, 17 nt, Chlamydia trachomatis
cuguugagaaaaacucu

SEQ ID NO: 460334 - RNA, 16 nt, Chlamydia trachomatis
cuucagcacguaguuu

SEQ ID NO: 460335 - RNA, 21 nt, Chlamydia trachomatis
cuuccucucucucaccgaaaa

SEQ ID NO: 460336 - RNA, 18 nt, Chlamydia trachomatis
cuuccugaacgauaacag

SEQ ID NO: 460337 - RNA, 15 nt, Chlamydia trachomatis
cuuccauggauaaaa

SEQ ID NO: 460338 - RNA, 17 nt, Chlamydia trachomatis
cuucgcuuccugcauga

SEQ ID NO: 460339 - RNA, 18 nt, Chlamydia trachomatis
cuucuacauccaaaaauu

SEQ ID NO: 460340 - RNA, 14 nt, Chlamydia trachomatis
cuugcgaugccucu

SEQ ID NO: 460341 - RNA, 13 nt, Chlamydia trachomatis
cuuuaaaugcugc

SEQ ID NO: 460342 - RNA, 15 nt, Chlamydia trachomatis
cuuuaccaaagaauu

SEQ ID NO: 460343 - RNA, 14 nt, Chlamydia trachomatis
cuuuagcacuacag

SEQ ID NO: 460344 - RNA, 23 nt, Chlamydia trachomatis
cuuuuagcgaucucccguacuuu

SEQ ID NO: 460345 - RNA, 23 nt, Chlamydia trachomatis
cuuuauccggagcuuuagaaaua

SEQ ID NO: 460346 - RNA, 21 nt, Chlamydia trachomatis
cuuuauuauugaaaaagcuuu

SEQ ID NO: 460347 - RNA, 17 nt, Chlamydia trachomatis
cuuuucgaacaaaacuu

SEQ ID NO: 460348 - RNA, 18 nt, Chlamydia trachomatis
cuuuugcaaaaauuuuca

SEQ ID NO: 460349 - RNA, 19 nt, Chlamydia trachomatis
cuuuuggaagaucucuuuc

SEQ ID NO: 460350 - RNA, 17 nt, Chlamydia trachomatis
cuuuuucuacuguagca

SEQ ID NO: 460351 - RNA, 19 nt, Chlamydia trachomatis
gaaacuuacuuuucuuagu

SEQ ID NO: 460352 - RNA, 20 nt, Chlamydia trachomatis
gaacaaaccaucuguaaagc

SEQ ID NO: 460353 - RNA, 15 nt, Chlamydia trachomatis
gaacagcucuaaaga

SEQ ID NO: 460354 - RNA, 23 nt, Chlamydia trachomatis
gaacauaacaaggcuuuuccauu

SEQ ID NO: 460355 - RNA, 18 nt, Chlamydia trachomatis
gaacaguguccuuccaug

SEQ ID NO: 460356 - RNA, 14 nt, Chlamydia trachomatis
gaaccauuuucaug

SEQ ID NO: 460357 - RNA, 17 nt, Chlamydia trachomatis
gaaccuagaucuaagga

SEQ ID NO: 460358 - RNA, 22 nt, Chlamydia trachomatis
gaaucaucugguauucuaaaua

SEQ ID NO: 460359 - RNA, 15 nt, Chlamydia trachomatis
gaaucuguccaaaga

SEQ ID NO: 460360 - RNA, 14 nt, Chlamydia trachomatis
gaaucugucuaaga

SEQ ID NO: 460361 - RNA, 16 nt, Chlamydia trachomatis
gaaucuaaaaagccau

SEQ ID NO: 460362 - RNA, 21 nt, Chlamydia trachomatis
gaauccucuaauaaacagauc

SEQ ID NO: 460363 - RNA, 18 nt, Chlamydia trachomatis
gaauaauagaaaaacuau

SEQ ID NO: 460364 - RNA, 14 nt, Chlamydia trachomatis
gaauuuuucuaaaa

SEQ ID NO: 460365 - RNA, 20 nt, Chlamydia trachomatis
gaauuuccagcuuaaugaua

SEQ ID NO: 460366 - RNA, 12 nt, Chlamydia trachomatis
gaauuucuugaa

SEQ ID NO: 460367 - RNA, 19 nt, Chlamydia trachomatis
gacaacguuacuaccgaua

SEQ ID NO: 460368 - RNA, 16 nt, Chlamydia trachomatis
gacgaauaaucaaucc

SEQ ID NO: 460369 - RNA, 14 nt, Chlamydia trachomatis
gacuuuagauaguc

SEQ ID NO: 460370 - RNA, 15 nt, Chlamydia trachomatis
gacuucuucuagaga

SEQ ID NO: 460371 - RNA, 14 nt, Chlamydia trachomatis
gacuugagcgucuu

SEQ ID NO: 460372 - RNA, 19 nt, Chlamydia trachomatis
gacuucacugccuuuagga

SEQ ID NO: 460373 - RNA, 16 nt, Chlamydia trachomatis
gagaagagccaucaaa

SEQ ID NO: 460374 - RNA, 17 nt, Chlamydia trachomatis
gagaaguaaaacagaag

SEQ ID NO: 460375 - RNA, 18 nt, Chlamydia trachomatis
gagacagcacuucuucuu

SEQ ID NO: 460376 - RNA, 18 nt, Chlamydia trachomatis
gagauacggcuaacucca

SEQ ID NO: 460377 - RNA, 20 nt, Chlamydia trachomatis
gagaggccuccauuuccaug

SEQ ID NO: 460378 - RNA, 14 nt, Chlamydia trachomatis
gagagcuuuacgac

SEQ ID NO: 460379 - RNA, 23 nt, Chlamydia trachomatis
gagcagagguaugcagacucaaa

SEQ ID NO: 460380 - RNA, 12 nt, Chlamydia trachomatis
gaguuuguggaa

SEQ ID NO: 460381 - RNA, 19 nt, Chlamydia trachomatis
gauaaaacccuaagacuau

SEQ ID NO: 460382 - RNA, 22 nt, Chlamydia trachomatis
gagucugcuccaccuucuuugg

SEQ ID NO: 460383 - RNA, 12 nt, Chlamydia trachomatis
gauagcaacgag

SEQ ID NO: 460384 - RNA, 19 nt, Chlamydia trachomatis
gauaccaagccauuuccag

SEQ ID NO: 460385 - RNA, 13 nt, Chlamydia trachomatis
gauaaauauuuua

SEQ ID NO: 460386 - RNA, 16 nt, Chlamydia trachomatis
gauauguuaaagccca

SEQ ID NO: 460387 - RNA, 21 nt, Chlamydia trachomatis
gauauagguuccaucuaaagg

SEQ ID NO: 460388 - RNA, 16 nt, Chlamydia trachomatis
gauauaaagaagacuu

SEQ ID NO: 460389 - RNA, 18 nt, Chlamydia trachomatis
gauauggaagaacagcag

SEQ ID NO: 460390 - RNA, 15 nt, Chlamydia trachomatis
gaucaugggaaauaa

SEQ ID NO: 460391 - RNA, 19 nt, Chlamydia trachomatis
gaucuccuuccucuuuaac

SEQ ID NO: 460392 - RNA, 23 nt, Chlamydia trachomatis
gaucuguaacuacaucuaaaaga

SEQ ID NO: 460393 - RNA, 12 nt, Chlamydia trachomatis
gaugaaccauuu

SEQ ID NO: 460394 - RNA, 15 nt, Chlamydia trachomatis
gaugccugggcuuca

SEQ ID NO: 460395 - RNA, 14 nt, Chlamydia trachomatis
gauucaaaagcuau

SEQ ID NO: 460396 - RNA, 11 nt, Chlamydia trachomatis
gauuucuucug

SEQ ID NO: 460397 - RNA, 12 nt, Chlamydia trachomatis
gauuuccucuuc

SEQ ID NO: 460398 - RNA, 22 nt, Chlamydia trachomatis
gcaaaggcgcagcuuucguuga

SEQ ID NO: 460399 - RNA, 17 nt, Chlamydia trachomatis
gcaauuuacuaucagga

SEQ ID NO: 460400 - RNA, 15 nt, Chlamydia trachomatis
gcacaauaacagcac

SEQ ID NO: 460401 - RNA, 17 nt, Chlamydia trachomatis
gcagacucaaagcuucc

SEQ ID NO: 460402 - RNA, 20 nt, Chlamydia trachomatis
gcaucuggagauacagaauc

SEQ ID NO: 460403 - RNA, 18 nt, Chlamydia trachomatis
gcauucucucauaagauc

SEQ ID NO: 460404 - RNA, 14 nt, Chlamydia trachomatis
aaaaugcaaagcuu

SEQ ID NO: 460405 - RNA, 22 nt, Chlamydia trachomatis
aaaagaugauagcagcaguuuu

SEQ ID NO: 460406 - RNA, 23 nt, Chlamydia trachomatis
aaaagcccagaacaacuucucuu

SEQ ID NO: 460407 - RNA, 15 nt, Chlamydia trachomatis
aaaagcuccuaaaga

SEQ ID NO: 460408 - RNA, 12 nt, Chlamydia trachomatis
aaaaucccuucc

SEQ ID NO: 460409 - RNA, 13 nt, Chlamydia trachomatis
aaaacaaaacuac

SEQ ID NO: 460410 - RNA, 22 nt, Chlamydia trachomatis
aaaaacuggagaauccauaacg

SEQ ID NO: 460411 - RNA, 23 nt, Chlamydia trachomatis
aaaaaucuugucguuccucuaga

SEQ ID NO: 460412 - RNA, 18 nt, Chlamydia trachomatis
aaacccucugcauagcua

SEQ ID NO: 460413 - RNA, 15 nt, Chlamydia trachomatis
aaacaaaaacucuca

SEQ ID NO: 460414 - RNA, 16 nt, Chlamydia trachomatis
aaacaccucaacgccu

SEQ ID NO: 460415 - RNA, 14 nt, Chlamydia trachomatis
aaagagagcaacga

SEQ ID NO: 460416 - RNA, 12 nt, Chlamydia trachomatis
aaagaaaaauaa

SEQ ID NO: 460417 - RNA, 20 nt, Chlamydia trachomatis
aaagaagaucccauaaucuc

SEQ ID NO: 460418 - RNA, 15 nt, Chlamydia trachomatis
aaagacaaaacuucu

SEQ ID NO: 460419 - RNA, 17 nt, Chlamydia trachomatis
aaagcgaucagcucucc

SEQ ID NO: 460420 - RNA, 18 nt, Chlamydia trachomatis
aaagggggacaaaaauac

SEQ ID NO: 460421 - RNA, 17 nt, Chlamydia trachomatis
aaaagaaaaaaagaggu

SEQ ID NO: 460422 - RNA, 12 nt, Chlamydia trachomatis
aaaagaaaaauc

SEQ ID NO: 460423 - RNA, 14 nt, Chlamydia trachomatis
aaaacgcucuccaa

SEQ ID NO: 460424 - RNA, 20 nt, Chlamydia trachomatis
aaaacgguguuagaaaauac

SEQ ID NO: 460425 - RNA, 15 nt, Chlamydia trachomatis
aaaacuccaagcacu

SEQ ID NO: 460426 - RNA, 14 nt, Chlamydia trachomatis
aacaccaaaaaauc

SEQ ID NO: 460427 - RNA, 19 nt, Chlamydia trachomatis
aacaaagcaucuuuaccau

SEQ ID NO: 460428 - RNA, 14 nt, Chlamydia trachomatis
aacaacaaagaacu

SEQ ID NO: 460429 - RNA, 23 nt, Chlamydia trachomatis
aacgccguguucggaauggauac

SEQ ID NO: 460430 - RNA, 21 nt, Chlamydia trachomatis
aacucucaaaucguucuacca

SEQ ID NO: 460431 - RNA, 17 nt, Chlamydia trachomatis
aacuucauauucccugu

SEQ ID NO: 460432 - RNA, 20 nt, Chlamydia trachomatis
aacuuggucagcucauuaga

SEQ ID NO: 460433 - RNA, 15 nt, Chlamydia trachomatis
aacugcucaaggaaa

SEQ ID NO: 460434 - RNA, 14 nt, Chlamydia trachomatis
aagaauuucuugaa

SEQ ID NO: 460435 - RNA, 17 nt, Chlamydia trachomatis
aagaagcgaagcauucu

SEQ ID NO: 460436 - RNA, 12 nt, Chlamydia trachomatis
aagaagcuaucu

SEQ ID NO: 460437 - RNA, 18 nt, Chlamydia trachomatis
aagaagggagugcauagc

SEQ ID NO: 460438 - RNA, 13 nt, Chlamydia trachomatis
aagaauucuugcu

SEQ ID NO: 460439 - RNA, 20 nt, Chlamydia trachomatis
aagaaagcuuauaacuaaga

SEQ ID NO: 460440 - RNA, 20 nt, Chlamydia trachomatis
aagaaauauucccaaagcua

SEQ ID NO: 460441 - RNA, 19 nt, Chlamydia trachomatis
aagaacacacuuuccccau

SEQ ID NO: 460442 - RNA, 11 nt, Chlamydia trachomatis
aagaacugcag

SEQ ID NO: 460443 - RNA, 18 nt, Chlamydia trachomatis
aagccauacaaagauugc

SEQ ID NO: 460444 - RNA, 14 nt, Chlamydia trachomatis
aagacguucuugcu

SEQ ID NO: 460445 - RNA, 19 nt, Chlamydia trachomatis
aagguaacuguggguuuuu

SEQ ID NO: 460446 - RNA, 17 nt, Chlamydia trachomatis
aaggcuuauucucuuua

SEQ ID NO: 460447 - RNA, 20 nt, Chlamydia trachomatis
aaguuccgguauauucuuca

SEQ ID NO: 460448 - RNA, 14 nt, Chlamydia trachomatis
aaguucuucuucca

SEQ ID NO: 460449 - RNA, 13 nt, Chlamydia trachomatis
aauaaucgaguga

SEQ ID NO: 460450 - RNA, 22 nt, Chlamydia trachomatis
aagucuuuaauaccuucuuaca

SEQ ID NO: 460451 - RNA, 15 nt, Chlamydia trachomatis
aauauccuccaaaga

SEQ ID NO: 460452 - RNA, 15 nt, Chlamydia trachomatis
aauaucugcucuaaa

SEQ ID NO: 460453 - RNA, 13 nt, Chlamydia trachomatis
aauaugacagagc

SEQ ID NO: 460454 - RNA, 17 nt, Chlamydia trachomatis
aauauggacuucccuaa

SEQ ID NO: 460455 - RNA, 14 nt, Chlamydia trachomatis
aauauucuuuucca

SEQ ID NO: 460456 - RNA, 19 nt, Chlamydia trachomatis
aaucuuguaauaucaaaga

SEQ ID NO: 460457 - RNA, 20 nt, Chlamydia trachomatis
aaucuucuucggaaagcacu

SEQ ID NO: 460458 - RNA, 14 nt, Chlamydia trachomatis
aaugacucaaaaag

SEQ ID NO: 460459 - RNA, 19 nt, Chlamydia trachomatis
aaugagaaauaaaaaccuu

SEQ ID NO: 460460 - RNA, 17 nt, Chlamydia trachomatis
aauuccaaauaauacuc

SEQ ID NO: 460461 - RNA, 22 nt, Chlamydia trachomatis
aauuguacacgauguuccccau

SEQ ID NO: 460462 - RNA, 16 nt, Chlamydia trachomatis
aauuguccaagcucga

SEQ ID NO: 460463 - RNA, 19 nt, Chlamydia trachomatis
acaaauccuagaagagcug

SEQ ID NO: 460464 - RNA, 21 nt, Chlamydia trachomatis
acaaaucuuucuuucuaagaa

SEQ ID NO: 460465 - RNA, 23 nt, Chlamydia trachomatis
acaaaauaaucggcaaaagaucu

SEQ ID NO: 460466 - RNA, 16 nt, Chlamydia trachomatis
aauuucucuaggaaca

SEQ ID NO: 460467 - RNA, 15 nt, Chlamydia trachomatis
acaaaaaagaaagcu

SEQ ID NO: 460468 - RNA, 13 nt, Chlamydia trachomatis
acaaggcuaagaa

SEQ ID NO: 460469 - RNA, 22 nt, Chlamydia trachomatis
acacacuggguaucugaacaag

SEQ ID NO: 460470 - RNA, 23 nt, Chlamydia trachomatis
aaaaguuuucgaauuuuuuucuu

SEQ ID NO: 460471 - RNA, 14 nt, Chlamydia trachomatis
acacguuuuagaau

SEQ ID NO: 460472 - RNA, 16 nt, Chlamydia trachomatis
acacuuuucagcuuuu

SEQ ID NO: 460473 - RNA, 23 nt, Chlamydia trachomatis
acacugcgugaccguuaauaucc

SEQ ID NO: 460474 - RNA, 16 nt, Chlamydia trachomatis
acagagcuucucuaaa

SEQ ID NO: 460475 - RNA, 17 nt, Chlamydia trachomatis
acaggaccagagaucau

SEQ ID NO: 460476 - RNA, 16 nt, Chlamydia trachomatis
aaaaucuucauaagaa

SEQ ID NO: 460477 - RNA, 18 nt, Chlamydia trachomatis
aaaauuagggaaaaacuu

SEQ ID NO: 460478 - RNA, 20 nt, Chlamydia trachomatis
accucagauuuaucugcuau

SEQ ID NO: 460479 - RNA, 13 nt, Chlamydia trachomatis
accguuagcauag

SEQ ID NO: 460480 - RNA, 16 nt, Chlamydia trachomatis
acgaaagcuaagauuc

SEQ ID NO: 460481 - RNA, 17 nt, Chlamydia trachomatis
accuuuugaaacaucuu

SEQ ID NO: 460482 - RNA, 19 nt, Chlamydia trachomatis
accuugaguccgcaaacaa

SEQ ID NO: 460483 - RNA, 14 nt, Chlamydia trachomatis
aaaauuucucuucc

SEQ ID NO: 460484 - RNA, 19 nt, Chlamydia trachomatis
aaaauuugucgugccagca

SEQ ID NO: 460485 - RNA, 23 nt, Chlamydia trachomatis
aaaauuuugaggcucucuagcaa

SEQ ID NO: 460486 - RNA, 19 nt, Chlamydia trachomatis
aaacaauauucuuuuccau

SEQ ID NO: 460487 - RNA, 20 nt, Chlamydia trachomatis
aaacaauauucuuuuccaua

SEQ ID NO: 460488 - RNA, 18 nt, Chlamydia trachomatis
aaacacaaaagcauugaa

SEQ ID NO: 460489 - RNA, 22 nt, Chlamydia trachomatis
acgaguucgccccucuuuuuca

SEQ ID NO: 460490 - RNA, 23 nt, Chlamydia trachomatis
aaacaggagaaagaaccucaaua

SEQ ID NO: 460491 - RNA, 20 nt, Chlamydia trachomatis
acguuagcaaagacauaaaa

SEQ ID NO: 460492 - RNA, 23 nt, Chlamydia trachomatis
acguuccguucgggucauaaaca

SEQ ID NO: 460493 - RNA, 15 nt, Chlamydia trachomatis
acuauccaaagcugc

SEQ ID NO: 460494 - RNA, 20 nt, Chlamydia trachomatis
acuuuucucccuaagaucuc

SEQ ID NO: 460495 - RNA, 15 nt, Chlamydia trachomatis
agaaaaagaaaaggc

SEQ ID NO: 460496 - RNA, 15 nt, Chlamydia trachomatis
agaaaagaggaguug

SEQ ID NO: 460497 - RNA, 15 nt, Chlamydia trachomatis
agaaaaucauagaua

SEQ ID NO: 460498 - RNA, 14 nt, Chlamydia trachomatis
agaaacugaaagau

SEQ ID NO: 460499 - RNA, 18 nt, Chlamydia trachomatis
agaacaucggaccacauu

SEQ ID NO: 460500 - RNA, 13 nt, Chlamydia trachomatis
agaaucuuuggaa

SEQ ID NO: 460501 - RNA, 17 nt, Chlamydia trachomatis
agaaggucugaacaacu

SEQ ID NO: 460502 - RNA, 17 nt, Chlamydia trachomatis
agaaguaacaccucuuc

SEQ ID NO: 460503 - RNA, 17 nt, Chlamydia trachomatis
agaaguaaugaagguuu

SEQ ID NO: 460504 - RNA, 23 nt, Chlamydia trachomatis
agacccguuuucucuugaaaaaa

SEQ ID NO: 460505 - RNA, 13 nt, Chlamydia trachomatis
agacuucuucuaa

SEQ ID NO: 460506 - RNA, 20 nt, Chlamydia trachomatis
agacuucuucuaaaggauag

SEQ ID NO: 460507 - RNA, 18 nt, Chlamydia trachomatis
agagacgcaugcuucuuu

SEQ ID NO: 460508 - RNA, 19 nt, Chlamydia trachomatis
agagaaagcucgaauacga

SEQ ID NO: 460509 - RNA, 18 nt, Chlamydia trachomatis
agagcgguugcacaaauc

SEQ ID NO: 460510 - RNA, 14 nt, Chlamydia trachomatis
agagaucuucugaa

SEQ ID NO: 460511 - RNA, 22 nt, Chlamydia trachomatis
agagauguuuguguuucuaaaa

SEQ ID NO: 460512 - RNA, 22 nt, Chlamydia trachomatis
agacucuuucaauagcauuucu

SEQ ID NO: 460513 - RNA, 14 nt, Chlamydia trachomatis
agauagucuucuac

SEQ ID NO: 460514 - RNA, 20 nt, Chlamydia trachomatis
agauaucuuuacucuuuucu

SEQ ID NO: 460515 - RNA, 13 nt, Chlamydia trachomatis
agauauucccuaa

SEQ ID NO: 460516 - RNA, 17 nt, Chlamydia trachomatis
agaucaaggauccagga

SEQ ID NO: 460517 - RNA, 21 nt, Chlamydia trachomatis
agaucaaggauccaggagaug

SEQ ID NO: 460518 - RNA, 22 nt, Chlamydia trachomatis
agaguuucuuuguucacagaaa

SEQ ID NO: 460519 - RNA, 23 nt, Chlamydia trachomatis
agagguucuauaccuaaaaguuu

SEQ ID NO: 460520 - RNA, 18 nt, Chlamydia trachomatis
agagcugcugucagaaga

SEQ ID NO: 460521 - RNA, 18 nt, Chlamydia trachomatis
agagcugaggagggauaa

SEQ ID NO: 460522 - RNA, 15 nt, Chlamydia trachomatis
agaucuaugaaaaaa

SEQ ID NO: 460523 - RNA, 21 nt, Chlamydia trachomatis
agcauagcgcuucccgcuauu

SEQ ID NO: 460524 - RNA, 18 nt, Chlamydia trachomatis
agccauacuuacuucuau

SEQ ID NO: 460525 - RNA, 18 nt, Chlamydia trachomatis
agccucuaacucuucugg

SEQ ID NO: 460526 - RNA, 21 nt, Chlamydia trachomatis
agccuaugcgugucacagacu

SEQ ID NO: 460527 - RNA, 14 nt, Chlamydia trachomatis
agccuaaauagcuc

SEQ ID NO: 460528 - RNA, 18 nt, Chlamydia trachomatis
agcgauugaucuaucgcu

SEQ ID NO: 460529 - RNA, 19 nt, Chlamydia trachomatis
agcgauagaauuucuuccu

SEQ ID NO: 460530 - RNA, 19 nt, Chlamydia trachomatis
agcgauuuucaguguugag

SEQ ID NO: 460531 - RNA, 19 nt, Chlamydia trachomatis
agcgucuccaaaaguguuu

SEQ ID NO: 460532 - RNA, 19 nt, Chlamydia trachomatis
agcuaaucaugaugaugag

SEQ ID NO: 460533 - RNA, 12 nt, Chlamydia trachomatis
agcucgagucuc

SEQ ID NO: 460534 - RNA, 17 nt, Chlamydia trachomatis
agcucggucucauuaua

SEQ ID NO: 460535 - RNA, 18 nt, Chlamydia trachomatis
agcuucuaauuucuuucu

SEQ ID NO: 460536 - RNA, 22 nt, Chlamydia trachomatis
agcuucucaacacugaaaaucg

SEQ ID NO: 460537 - RNA, 18 nt, Chlamydia trachomatis
agcuucugguguaggaaa

SEQ ID NO: 460538 - RNA, 11 nt, Chlamydia trachomatis
agcuucuucuu

SEQ ID NO: 460539 - RNA, 14 nt, Chlamydia trachomatis
agcuucuuuaggau

SEQ ID NO: 460540 - RNA, 23 nt, Chlamydia trachomatis
aggaacaucgagaaaaugaugaa

SEQ ID NO: 460541 - RNA, 14 nt, Chlamydia trachomatis
aggaacuucuucau

SEQ ID NO: 460542 - RNA, 22 nt, Chlamydia trachomatis
aggaaugguuacuugccucuuc

SEQ ID NO: 460543 - RNA, 18 nt, Chlamydia trachomatis
aggacgaucauuaggauu

SEQ ID NO: 460544 - RNA, 20 nt, Chlamydia trachomatis
aggagcuugagagcauucuu

SEQ ID NO: 460545 - RNA, 15 nt, Chlamydia trachomatis
aggcaaaaaucugca

SEQ ID NO: 460546 - RNA, 17 nt, Chlamydia trachomatis
aggauucaaaauagcag

SEQ ID NO: 460547 - RNA, 15 nt, Chlamydia trachomatis
aggcuucaaagaaca

SEQ ID NO: 460548 - RNA, 14 nt, Chlamydia trachomatis
aggcuuccaaaucu

SEQ ID NO: 460549 - RNA, 22 nt, Chlamydia trachomatis
agggaacaaaccaauuaaguuc

SEQ ID NO: 460550 - RNA, 16 nt, Chlamydia trachomatis
agggaauaaaaguacu

SEQ ID NO: 460551 - RNA, 22 nt, Chlamydia trachomatis
aggguucucuuuuuaaaaggcu

SEQ ID NO: 460552 - RNA, 14 nt, Chlamydia trachomatis
agggucacugggau

SEQ ID NO: 460553 - RNA, 19 nt, Chlamydia trachomatis
aggucgcuugauucuugaa

SEQ ID NO: 460554 - RNA, 22 nt, Chlamydia trachomatis
agguaucgaaaguaaaauuccu

SEQ ID NO: 460555 - RNA, 22 nt, Chlamydia trachomatis
agguaaauggugaaacuuuccu

SEQ ID NO: 460556 - RNA, 13 nt, Chlamydia trachomatis
aguaauucuucuu

SEQ ID NO: 460557 - RNA, 13 nt, Chlamydia trachomatis
aguacaaaaauac

SEQ ID NO: 460558 - RNA, 12 nt, Chlamydia trachomatis
aguagcauaagc

SEQ ID NO: 460559 - RNA, 23 nt, Chlamydia trachomatis
agguucguuauucucaaguugag

SEQ ID NO: 460560 - RNA, 14 nt, Chlamydia trachomatis
aguuguaaagcauu

SEQ ID NO: 460561 - RNA, 13 nt, Chlamydia trachomatis
auaaaaauuccau

SEQ ID NO: 460562 - RNA, 21 nt, Chlamydia trachomatis
aguuauauugcuucauaaaaa

SEQ ID NO: 460563 - RNA, 19 nt, Chlamydia trachomatis
auaaucgaucacagaaacg

SEQ ID NO: 460564 - RNA, 14 nt, Chlamydia trachomatis
auaaaugauaaucc

SEQ ID NO: 460565 - RNA, 18 nt, Chlamydia trachomatis
auaauuccuaggaaugag

SEQ ID NO: 460566 - RNA, 20 nt, Chlamydia trachomatis
auagcuuaccucaauagcag

SEQ ID NO: 460567 - RNA, 20 nt, Chlamydia trachomatis
auagcuuaucguuuggagaa

SEQ ID NO: 460568 - RNA, 16 nt, Chlamydia trachomatis
auagcuacagcaauag

SEQ ID NO: 460569 - RNA, 18 nt, Chlamydia trachomatis
auagcuacagcaauagag

SEQ ID NO: 460570 - RNA, 16 nt, Chlamydia trachomatis
aucaaaccaaaaauau

SEQ ID NO: 460571 - RNA, 14 nt, Chlamydia trachomatis
auauuuuuucccuu

SEQ ID NO: 460572 - RNA, 17 nt, Chlamydia trachomatis
auaugcgacaguaccgu

SEQ ID NO: 460573 - RNA, 16 nt, Chlamydia trachomatis
auauuccaaagaaaug

SEQ ID NO: 460574 - RNA, 20 nt, Chlamydia trachomatis
auauucuucuucugcaagag

SEQ ID NO: 460575 - RNA, 14 nt, Chlamydia trachomatis
aucagaccuuuugu

SEQ ID NO: 460576 - RNA, 16 nt, Chlamydia trachomatis
aucagcuccuaucacu

SEQ ID NO: 460577 - RNA, 21 nt, Chlamydia trachomatis
aucauccauaaaaacugcugc

SEQ ID NO: 460578 - RNA, 17 nt, Chlamydia trachomatis
aucaucuucccaagacu

SEQ ID NO: 460579 - RNA, 20 nt, Chlamydia trachomatis
auccagauccguuaaagagu

SEQ ID NO: 460580 - RNA, 22 nt, Chlamydia trachomatis
auccagauccguuaaagagucu

SEQ ID NO: 460581 - RNA, 11 nt, Chlamydia trachomatis
aucauuuccaa

SEQ ID NO: 460582 - RNA, 20 nt, Chlamydia trachomatis
auccaaaaauugaaagagau

SEQ ID NO: 460583 - RNA, 16 nt, Chlamydia trachomatis
auccauguuucgccaa

SEQ ID NO: 460584 - RNA, 21 nt, Chlamydia trachomatis
auccauuggugguaacaccaa

SEQ ID NO: 460585 - RNA, 16 nt, Chlamydia trachomatis
aucccggaggaauuga

SEQ ID NO: 460586 - RNA, 21 nt, Chlamydia trachomatis
auccuucgcaggggaauacag

SEQ ID NO: 460587 - RNA, 20 nt, Chlamydia trachomatis
auccuugaaccaaacgauua

SEQ ID NO: 460588 - RNA, 16 nt, Chlamydia trachomatis
aucgaaaacaaagagu

SEQ ID NO: 460589 - RNA, 18 nt, Chlamydia trachomatis
auccuuuuggaagaucuc

SEQ ID NO: 460590 - RNA, 15 nt, Chlamydia trachomatis
aucguaaacaaccaa

SEQ ID NO: 460591 - RNA, 22 nt, Chlamydia trachomatis
aucugauguuccaucuuuucgg

SEQ ID NO: 460592 - RNA, 15 nt, Chlamydia trachomatis
aucucugaaagagcu

SEQ ID NO: 460593 - RNA, 24 nt, Chlamydia trachomatis
aucucugguaaaaauagaaaacgu

SEQ ID NO: 460594 - RNA, 18 nt, Chlamydia trachomatis
aucuugaucugaaaagag

SEQ ID NO: 460595 - RNA, 11 nt, Chlamydia trachomatis
aucuucuucua

SEQ ID NO: 460596 - RNA, 17 nt, Chlamydia trachomatis
aucuucuugagaaaacu

SEQ ID NO: 460597 - RNA, 22 nt, Chlamydia trachomatis
augaaacucuuuuuaaaucaau

SEQ ID NO: 460598 - RNA, 14 nt, Chlamydia trachomatis
augaacagcauuua

SEQ ID NO: 460599 - RNA, 14 nt, Chlamydia trachomatis
aucuugucguuccu

SEQ ID NO: 460600 - RNA, 17 nt, Chlamydia trachomatis
augaacggacgacugca

SEQ ID NO: 460601 - RNA, 14 nt, Chlamydia trachomatis
augcaaaaagagca

SEQ ID NO: 460602 - RNA, 21 nt, Chlamydia trachomatis
augcagacucaaagcuucccu

SEQ ID NO: 460603 - RNA, 16 nt, Chlamydia trachomatis
augcaguggaagauag

SEQ ID NO: 460604 - RNA, 17 nt, Chlamydia trachomatis
auggauaguuucuuucu

SEQ ID NO: 460605 - RNA, 23 nt, Chlamydia trachomatis
auggcaaucgcggaagaaagcau

SEQ ID NO: 460606 - RNA, 14 nt, Chlamydia trachomatis
auggcgguguuucu

SEQ ID NO: 460607 - RNA, 12 nt, Chlamydia trachomatis
auguaagaguuu

SEQ ID NO: 460608 - RNA, 18 nt, Chlamydia trachomatis
auuaucguucucuaaaga

SEQ ID NO: 460609 - RNA, 18 nt, Chlamydia trachomatis
auucacaucgaauaaaaa

SEQ ID NO: 460610 - RNA, 19 nt, Chlamydia trachomatis
auuccgcuucuauuuccag

SEQ ID NO: 460611 - RNA, 19 nt, Chlamydia trachomatis
auuuccguaaugaucagca

SEQ ID NO: 460612 - RNA, 17 nt, Chlamydia trachomatis
auuucuauagaagaauu

SEQ ID NO: 460613 - RNA, 18 nt, Chlamydia trachomatis
auuuacaaacgaagcugc

SEQ ID NO: 460614 - RNA, 15 nt, Chlamydia trachomatis
auuuuagagaaaaga

SEQ ID NO: 460615 - RNA, 21 nt, Chlamydia trachomatis
auuucucuaucuguuaagcgu

SEQ ID NO: 460616 - RNA, 22 nt, Chlamydia trachomatis
auuucucucgcugcgagagagc

SEQ ID NO: 460617 - RNA, 23 nt, Chlamydia trachomatis
auuucuuaaaagcacaauaacag

SEQ ID NO: 460618 - RNA, 13 nt, Chlamydia trachomatis
auuugaaaucaaa

SEQ ID NO: 460619 - RNA, 13 nt, Chlamydia trachomatis
caaaacauaaacg

SEQ ID NO: 460620 - RNA, 12 nt, Chlamydia trachomatis
caaaagcuaucu

SEQ ID NO: 460621 - RNA, 20 nt, Chlamydia trachomatis
caaaagaaugaccaguuugu

SEQ ID NO: 460622 - RNA, 18 nt, Chlamydia trachomatis
auuuuucaaaaauagcaa

SEQ ID NO: 460623 - RNA, 16 nt, Chlamydia trachomatis
caaaccaaaaccacac

SEQ ID NO: 460624 - RNA, 19 nt, Chlamydia trachomatis
caaacugcucuucuaacuu

SEQ ID NO: 460625 - RNA, 21 nt, Chlamydia trachomatis
caaacaaaaaagaaagcuucu

SEQ ID NO: 460626 - RNA, 22 nt, Chlamydia trachomatis
caaaggaacaucgagaaaauga

SEQ ID NO: 460627 - RNA, 22 nt, Chlamydia trachomatis
caaagaucgguucauaaaauuu

SEQ ID NO: 460628 - RNA, 23 nt, Chlamydia trachomatis
caaagaauuuuccguaaaagucu

SEQ ID NO: 460629 - RNA, 19 nt, Chlamydia trachomatis
caaagacauaaaagcugua

SEQ ID NO: 460630 - RNA, 16 nt, Chlamydia trachomatis
caaagagcuucuagaa

SEQ ID NO: 460631 - RNA, 20 nt, Chlamydia trachomatis
caaagaauucuugcuauccu

SEQ ID NO: 460632 - RNA, 20 nt, Chlamydia trachomatis
caaagucaggauuuucuagg

SEQ ID NO: 460633 - RNA, 14 nt, Chlamydia trachomatis
caaaucaaaccaaa

SEQ ID NO: 460634 - RNA, 18 nt, Chlamydia trachomatis
caaauccugcgcgcaaau

SEQ ID NO: 460635 - RNA, 22 nt, Chlamydia trachomatis
caaauucuacuccugcaacaag

SEQ ID NO: 460636 - RNA, 16 nt, Chlamydia trachomatis
caaauuucucuaggaa

SEQ ID NO: 460637 - RNA, 13 nt, Chlamydia trachomatis
caagcaaaacaua

SEQ ID NO: 460638 - RNA, 23 nt, Chlamydia trachomatis
caacuucaauagcaggaacuucu

SEQ ID NO: 460639 - RNA, 20 nt, Chlamydia trachomatis
caaugacucaaaaagcugua

SEQ ID NO: 460640 - RNA, 17 nt, Chlamydia trachomatis
caauugcgguaaacaau

SEQ ID NO: 460641 - RNA, 15 nt, Chlamydia trachomatis
caaugucaacauaca

SEQ ID NO: 460642 - RNA, 20 nt, Chlamydia trachomatis
cacagucauaguauaacgau

SEQ ID NO: 460643 - RNA, 18 nt, Chlamydia trachomatis
caccguagaauuucuucu

SEQ ID NO: 460644 - RNA, 16 nt, Chlamydia trachomatis
caccuguauugggaua

SEQ ID NO: 460645 - RNA, 18 nt, Chlamydia trachomatis
cagaauccuuuucagaau

SEQ ID NO: 460646 - RNA, 17 nt, Chlamydia trachomatis
aaagagaaucaucggcu

SEQ ID NO: 460647 - RNA, 17 nt, Chlamydia trachomatis
cagaucuuuuucauuuu

SEQ ID NO: 460648 - RNA, 23 nt, Chlamydia trachomatis
cagcaaaaccuuuugaaacaucu

SEQ ID NO: 460649 - RNA, 19 nt, Chlamydia trachomatis
cauagauucaugagaccgu

SEQ ID NO: 460650 - RNA, 20 nt, Chlamydia trachomatis
cauaauuucuaggcugacuu

SEQ ID NO: 460651 - RNA, 22 nt, Chlamydia trachomatis
caucuagagguauuuuauucaa

SEQ ID NO: 460652 - RNA, 15 nt, Chlamydia trachomatis
caugacauucaguuc

SEQ ID NO: 460653 - RNA, 19 nt, Chlamydia trachomatis
caugauauuuugaagauaa

SEQ ID NO: 460654 - RNA, 23 nt, Chlamydia trachomatis
ccaaagaaauagcuaucaauaaa

SEQ ID NO: 460655 - RNA, 11 nt, Chlamydia trachomatis
ccaaaucaaac

SEQ ID NO: 460656 - RNA, 20 nt, Chlamydia trachomatis
ccaagauguuggagaacauc

SEQ ID NO: 460657 - RNA, 13 nt, Chlamydia trachomatis
aaagcuagaagaa

SEQ ID NO: 460658 - RNA, 15 nt, Chlamydia trachomatis
aaagcuuucccguau

SEQ ID NO: 460659 - RNA, 22 nt, Chlamydia trachomatis
aaaggcggcuauuaaccgccau

SEQ ID NO: 460660 - RNA, 19 nt, Chlamydia trachomatis
aaaguacucagucaaucca

SEQ ID NO: 460661 - RNA, 15 nt, Chlamydia trachomatis
ccagccacauccuga

SEQ ID NO: 460662 - RNA, 19 nt, Chlamydia trachomatis
aaaucacuuuuaccguucc

SEQ ID NO: 460663 - RNA, 21 nt, Chlamydia trachomatis
aaaucagcuugauauucccuu

SEQ ID NO: 460664 - RNA, 15 nt, Chlamydia trachomatis
ccauuggaauuuuca

SEQ ID NO: 460665 - RNA, 20 nt, Chlamydia trachomatis
cccaugacauacauaagaac

SEQ ID NO: 460666 - RNA, 14 nt, Chlamydia trachomatis
cccaucccuugcaa

SEQ ID NO: 460667 - RNA, 14 nt, Chlamydia trachomatis
aaaucuucuucuaa

SEQ ID NO: 460668 - RNA, 23 nt, Chlamydia trachomatis
aaaucuuucgaggaguacuucua

SEQ ID NO: 460669 - RNA, 16 nt, Chlamydia trachomatis
cccuucuuucuucuaa

SEQ ID NO: 460670 - RNA, 11 nt, Chlamydia trachomatis
cccuagaaaau

SEQ ID NO: 460671 - RNA, 23 nt, Chlamydia trachomatis
ccgaauucuucuccuauagcagg

SEQ ID NO: 460672 - RNA, 18 nt, Chlamydia trachomatis
aaauuuggcaauggcaaa

SEQ ID NO: 460673 - RNA, 21 nt, Chlamydia trachomatis
ccuccaaagaugcuccuacaa

SEQ ID NO: 460674 - RNA, 19 nt, Chlamydia trachomatis
ccucuaagcaccuuuacaa

SEQ ID NO: 460675 - RNA, 14 nt, Chlamydia trachomatis
ccucuaucucuucu

SEQ ID NO: 460676 - RNA, 22 nt, Chlamydia trachomatis
ccugcauagcugaacccuucaa

SEQ ID NO: 460677 - RNA, 23 nt, Chlamydia trachomatis
ccuguaguuagguaaucuucuau

SEQ ID NO: 460678 - RNA, 16 nt, Chlamydia trachomatis
aacaacaguucuucau

SEQ ID NO: 460679 - RNA, 20 nt, Chlamydia trachomatis
cgacaguuucccguuguuuu

SEQ ID NO: 460680 - RNA, 21 nt, Chlamydia trachomatis
cgagcucauuuucuauuucag

SEQ ID NO: 460681 - RNA, 18 nt, Chlamydia trachomatis
cgaguuuuuuuguuucca

SEQ ID NO: 460682 - RNA, 14 nt, Chlamydia trachomatis
cgccuucuauagcu

SEQ ID NO: 460683 - RNA, 19 nt, Chlamydia trachomatis
cgccuugucuauaggaaua

SEQ ID NO: 460684 - RNA, 17 nt, Chlamydia trachomatis
cgcuaaaaacucuuuca

SEQ ID NO: 460685 - RNA, 19 nt, Chlamydia trachomatis
cgcuacagaguuaacuauu

SEQ ID NO: 460686 - RNA, 20 nt, Chlamydia trachomatis
cgcuuccuacagcuagaaua

SEQ ID NO: 460687 - RNA, 20 nt, Chlamydia trachomatis
cggaaaguuccaucuccuga

SEQ ID NO: 460688 - RNA, 20 nt, Chlamydia trachomatis
cggaaauguuaaagucauuc

SEQ ID NO: 460689 - RNA, 16 nt, Chlamydia trachomatis
cggaaggcgaauucuu

SEQ ID NO: 460690 - RNA, 20 nt, Chlamydia trachomatis
aacauaacaaggcuuuucca

SEQ ID NO: 460691 - RNA, 21 nt, Chlamydia trachomatis
aacauaacaaggcuuuuccau

SEQ ID NO: 460692 - RNA, 21 nt, Chlamydia trachomatis
aaccagaauccuuuucagaau

SEQ ID NO: 460693 - RNA, 23 nt, Chlamydia trachomatis
aaccacacuucucgaaaaaaugc

SEQ ID NO: 460694 - RNA, 20 nt, Chlamydia trachomatis
cgguauauguauaccgcgua

SEQ ID NO: 460695 - RNA, 18 nt, Chlamydia trachomatis
cgguaaucacgccuccga

SEQ ID NO: 460696 - RNA, 20 nt, Chlamydia trachomatis
cguauauuucacaacuaguu

SEQ ID NO: 460697 - RNA, 21 nt, Chlamydia trachomatis
cguauuuuuuacgcucuuucu

SEQ ID NO: 460698 - RNA, 19 nt, Chlamydia trachomatis
cgucuuuaacccuucagga

SEQ ID NO: 460699 - RNA, 13 nt, Chlamydia trachomatis
cgugauaaaaacu

SEQ ID NO: 460700 - RNA, 16 nt, Chlamydia trachomatis
cguggaauuugacucu

SEQ ID NO: 460701 - RNA, 15 nt, Chlamydia trachomatis
cuaugcaaaguuucu

SEQ ID NO: 460702 - RNA, 17 nt, Chlamydia trachomatis
cuauuguauagcuuuua

SEQ ID NO: 460703 - RNA, 19 nt, Chlamydia trachomatis
cucaaacaaucuaaaaaau

SEQ ID NO: 460704 - RNA, 22 nt, Chlamydia trachomatis
cuaucaguggcuauauucguga

SEQ ID NO: 460705 - RNA, 18 nt, Chlamydia trachomatis
cuauaugagccuugccua

SEQ ID NO: 460706 - RNA, 16 nt, Chlamydia trachomatis
cuauagaagaauucgc

SEQ ID NO: 460707 - RNA, 22 nt, Chlamydia trachomatis
cuagauacaauaguaccuucaa

SEQ ID NO: 460708 - RNA, 23 nt, Chlamydia trachomatis
cuauaaaugaaaccccucuuucu

SEQ ID NO: 460709 - RNA, 14 nt, Chlamydia trachomatis
cuacucaauccuuu

SEQ ID NO: 460710 - RNA, 16 nt, Chlamydia trachomatis
cuacucccaaaucaaa

SEQ ID NO: 460711 - RNA, 18 nt, Chlamydia trachomatis
cucauuauauaaagcccc

SEQ ID NO: 460712 - RNA, 21 nt, Chlamydia trachomatis
cuccaucaggaauagcuacag

SEQ ID NO: 460713 - RNA, 14 nt, Chlamydia trachomatis
cuccagcuaaaaau

SEQ ID NO: 460714 - RNA, 13 nt, Chlamydia trachomatis
cuccuacaaaaua

SEQ ID NO: 460715 - RNA, 23 nt, Chlamydia trachomatis
cuccuuagauccggcuuuuuggc

SEQ ID NO: 460716 - RNA, 17 nt, Chlamydia trachomatis
cucuccagaaacaggag

SEQ ID NO: 460717 - RNA, 21 nt, Chlamydia trachomatis
cucuaauaaacagaucuuuuu

SEQ ID NO: 460718 - RNA, 23 nt, Chlamydia trachomatis
cucuugauugaaccguuuuucua

SEQ ID NO: 460719 - RNA, 18 nt, Chlamydia trachomatis
cugaaaaaucaaggauau

SEQ ID NO: 460720 - RNA, 20 nt, Chlamydia trachomatis
cugaaaagagaagaaggcuu

SEQ ID NO: 460721 - RNA, 19 nt, Chlamydia trachomatis
cugagacuccagcuucucc

SEQ ID NO: 460722 - RNA, 23 nt, Chlamydia trachomatis
cugcaagcacacuugauaaauag

SEQ ID NO: 460723 - RNA, 14 nt, Chlamydia trachomatis
cugcauuaaacacu

SEQ ID NO: 460724 - RNA, 12 nt, Chlamydia trachomatis
cuggaguuuaug

SEQ ID NO: 460725 - RNA, 13 nt, Chlamydia trachomatis
cugggaaaacuuu

SEQ ID NO: 460726 - RNA, 17 nt, Chlamydia trachomatis
cuguaggagagaaucuu

SEQ ID NO: 460727 - RNA, 20 nt, Chlamydia trachomatis
cugucaggauuuaaagccuu

SEQ ID NO: 460728 - RNA, 21 nt, Chlamydia trachomatis
cuuauacaucagagcaauaga

SEQ ID NO: 460729 - RNA, 17 nt, Chlamydia trachomatis
cuguuucugggaauuca

SEQ ID NO: 460730 - RNA, 21 nt, Chlamydia trachomatis
cuguuuguuuguuuuuuucaa

SEQ ID NO: 460731 - RNA, 15 nt, Chlamydia trachomatis
cuguguuugauaacg

SEQ ID NO: 460732 - RNA, 21 nt, Chlamydia trachomatis
cuguuauuuguucucuuagaa

SEQ ID NO: 460733 - RNA, 15 nt, Chlamydia trachomatis
cuguguacaaacacu

SEQ ID NO: 460734 - RNA, 14 nt, Chlamydia trachomatis
cugugggauagaaa

SEQ ID NO: 460735 - RNA, 19 nt, Chlamydia trachomatis
cuguggaaaaauuagggaa

SEQ ID NO: 460736 - RNA, 16 nt, Chlamydia trachomatis
cuucauaagaaaauuc

SEQ ID NO: 460737 - RNA, 19 nt, Chlamydia trachomatis
cuuccuuaucuaauuccuu

SEQ ID NO: 460738 - RNA, 18 nt, Chlamydia trachomatis
cuucggcagaagcugcag

SEQ ID NO: 460739 - RNA, 21 nt, Chlamydia trachomatis
cuuucaaagagaucugcauuc

SEQ ID NO: 460740 - RNA, 12 nt, Chlamydia trachomatis
cuuuaacaucuu

SEQ ID NO: 460741 - RNA, 16 nt, Chlamydia trachomatis
cuuuaccgauaauuuu

SEQ ID NO: 460742 - RNA, 19 nt, Chlamydia trachomatis
cuuuaccguuacaggauag

SEQ ID NO: 460743 - RNA, 9 nt, Chlamydia trachomatis
cuuuccaua

SEQ ID NO: 460744 - RNA, 13 nt, Chlamydia trachomatis
cuuucccuauuuu

SEQ ID NO: 460745 - RNA, 20 nt, Chlamydia trachomatis
cuuucuuacgaccguauuuu

SEQ ID NO: 460746 - RNA, 17 nt, Chlamydia trachomatis
cuuucuucuaagaaguu

SEQ ID NO: 460747 - RNA, 17 nt, Chlamydia trachomatis
cuuuuaggcaacagcuc

SEQ ID NO: 460748 - RNA, 12 nt, Chlamydia trachomatis
cuuuuaucuucu

SEQ ID NO: 460749 - RNA, 20 nt, Chlamydia trachomatis
cuuuuaucuucuuaauugcc

SEQ ID NO: 460750 - RNA, 15 nt, Chlamydia trachomatis
cuuuugcaaaaauuu

SEQ ID NO: 460751 - RNA, 12 nt, Chlamydia trachomatis
cuuuucuauuuu

SEQ ID NO: 460752 - RNA, 23 nt, Chlamydia trachomatis
cuuuucuuccucaguauaaaaaa

SEQ ID NO: 460753 - RNA, 15 nt, Chlamydia trachomatis
cuuuuugcacaaaaa

SEQ ID NO: 460754 - RNA, 20 nt, Chlamydia trachomatis
cuuuuuguuagcggaacaag

SEQ ID NO: 460755 - RNA, 13 nt, Chlamydia trachomatis
gaaaaaucuccuc

SEQ ID NO: 460756 - RNA, 23 nt, Chlamydia trachomatis
gaaacccaacgcaucuccaaaga

SEQ ID NO: 460757 - RNA, 16 nt, Chlamydia trachomatis
gaaaaugcucuaaagg

SEQ ID NO: 460758 - RNA, 15 nt, Chlamydia trachomatis
gaaacaacaaagaac

SEQ ID NO: 460759 - RNA, 23 nt, Chlamydia trachomatis
gaaauagcuuaccucaauagcag

SEQ ID NO: 460760 - RNA, 15 nt, Chlamydia trachomatis
gaaauaaaaagccca

SEQ ID NO: 460761 - RNA, 14 nt, Chlamydia trachomatis
gaaauggucucuuc

SEQ ID NO: 460762 - RNA, 23 nt, Chlamydia trachomatis
gaacaauaucuguuuuuccccau

SEQ ID NO: 460763 - RNA, 17 nt, Chlamydia trachomatis
gaacacacuuuccccau

SEQ ID NO: 460764 - RNA, 20 nt, Chlamydia trachomatis
gaacgcuuccugaacgauaa

SEQ ID NO: 460765 - RNA, 14 nt, Chlamydia trachomatis
gaacgcuagaaaca

SEQ ID NO: 460766 - RNA, 13 nt, Chlamydia trachomatis
gaacugcuucccu

SEQ ID NO: 460767 - RNA, 16 nt, Chlamydia trachomatis
gaauaagcauuacaca

SEQ ID NO: 460768 - RNA, 22 nt, Chlamydia trachomatis
gaauaaucgagugaucuacagc

SEQ ID NO: 460769 - RNA, 17 nt, Chlamydia trachomatis
gaauccuagucuauaga

SEQ ID NO: 460770 - RNA, 18 nt, Chlamydia trachomatis
gaauugccgaaucaaaga

SEQ ID NO: 460771 - RNA, 23 nt, Chlamydia trachomatis
gacaaacuuucucgauucucuug

SEQ ID NO: 460772 - RNA, 15 nt, Chlamydia trachomatis
gaauuuuaucuaaaa

SEQ ID NO: 460773 - RNA, 18 nt, Chlamydia trachomatis
gacaaugucaacauacag

SEQ ID NO: 460774 - RNA, 19 nt, Chlamydia trachomatis
gacacugcgugaccguuaa

SEQ ID NO: 460775 - RNA, 14 nt, Chlamydia trachomatis
aacggauuucuuua

SEQ ID NO: 460776 - RNA, 21 nt, Chlamydia trachomatis
aacggcauaggcgugaagaga

SEQ ID NO: 460777 - RNA, 14 nt, Chlamydia trachomatis
gaccugugcagauc

SEQ ID NO: 460778 - RNA, 15 nt, Chlamydia trachomatis
gagccguucucucua

SEQ ID NO: 460779 - RNA, 18 nt, Chlamydia trachomatis
aacucgauccaucauaga

SEQ ID NO: 460780 - RNA, 19 nt, Chlamydia trachomatis
gagcuccaggaaaagcuuu

SEQ ID NO: 460781 - RNA, 21 nt, Chlamydia trachomatis
gagcuauuuaggcuaacucca

SEQ ID NO: 460782 - RNA, 15 nt, Chlamydia trachomatis
gaggaguucccguua

SEQ ID NO: 460783 - RNA, 23 nt, Chlamydia trachomatis
gagcuuugaggacugacagaagu

SEQ ID NO: 460784 - RNA, 21 nt, Chlamydia trachomatis
gagcuugagagcauucuucug

SEQ ID NO: 460785 - RNA, 14 nt, Chlamydia trachomatis
gaggcuucaaagaa

SEQ ID NO: 460786 - RNA, 18 nt, Chlamydia trachomatis
gauaaguccaucuaaagg

SEQ ID NO: 460787 - RNA, 18 nt, Chlamydia trachomatis
gauaucaaucguagaaaa

SEQ ID NO: 460788 - RNA, 21 nt, Chlamydia trachomatis
gaucaauaccuagcaauucau

SEQ ID NO: 460789 - RNA, 22 nt, Chlamydia trachomatis
gaucauaguuaacggaaauagg

SEQ ID NO: 460790 - RNA, 21 nt, Chlamydia trachomatis
gaucucuuagacccucuaaua

SEQ ID NO: 460791 - RNA, 14 nt, Chlamydia trachomatis
gaucuucaacaaga

SEQ ID NO: 460792 - RNA, 19 nt, Chlamydia trachomatis
gaucuuuguucucuaaaga

SEQ ID NO: 460793 - RNA, 14 nt, Chlamydia trachomatis
aacugcucuucuaa

SEQ ID NO: 460794 - RNA, 15 nt, Chlamydia trachomatis
aacugucuucuuuca

SEQ ID NO: 460795 - RNA, 17 nt, Chlamydia trachomatis
aacuucaauagcaggaa

SEQ ID NO: 460796 - RNA, 15 nt, Chlamydia trachomatis
gauucaaaauagcag

SEQ ID NO: 460797 - RNA, 19 nt, Chlamydia trachomatis
gauucaucaaaauauuuug

SEQ ID NO: 460798 - RNA, 21 nt, Chlamydia trachomatis
gauucaugagaccgucaaaaa

SEQ ID NO: 460799 - RNA, 18 nt, Chlamydia trachomatis
gauuuuucuuucaaagag

SEQ ID NO: 460800 - RNA, 14 nt, Chlamydia trachomatis
aacuuuaauagcca

SEQ ID NO: 460801 - RNA, 15 nt, Chlamydia trachomatis
gcagagguaugcaga

SEQ ID NO: 460802 - RNA, 19 nt, Chlamydia trachomatis
gcaguauguaggagcgaaa

SEQ ID NO: 460803 - RNA, 23 nt, Chlamydia trachomatis
gcaguauguaggagcgaaaucga

SEQ ID NO: 460804 - RNA, 23 nt, Chlamydia trachomatis
aagaaagucguacagaucuugau

SEQ ID NO: 460805 - RNA, 22 nt, Chlamydia trachomatis
gcaggucgauaucguuagcauc

SEQ ID NO: 460806 - RNA, 19 nt, Chlamydia trachomatis
aagauagugcagaagauaa

SEQ ID NO: 460807 - RNA, 13 nt, Chlamydia trachomatis
aagauaaucaaac

SEQ ID NO: 460808 - RNA, 17 nt, Chlamydia trachomatis
aagauuuucaucuucca

SEQ ID NO: 460809 - RNA, 17 nt, Chlamydia trachomatis
gccuccgguuuccaaau

SEQ ID NO: 460810 - RNA, 21 nt, Chlamydia trachomatis
aagccccuuacgaggcuucuc

SEQ ID NO: 460811 - RNA, 13 nt, Chlamydia trachomatis
aagcuaauagcuu

SEQ ID NO: 460812 - RNA, 21 nt, Chlamydia trachomatis
gcguuacagaugccuugagga

SEQ ID NO: 460813 - RNA, 17 nt, Chlamydia trachomatis
gcucuccaaagaauaga

SEQ ID NO: 460814 - RNA, 22 nt, Chlamydia trachomatis
gcucuuucagagaaaauuucuc

SEQ ID NO: 460815 - RNA, 20 nt, Chlamydia trachomatis
gcugaucuuucacaacccaa

SEQ ID NO: 460816 - RNA, 19 nt, Chlamydia trachomatis
gcuuaucaacaagauuuuu

SEQ ID NO: 460817 - RNA, 14 nt, Chlamydia trachomatis
gcuuagaaacuguc

SEQ ID NO: 460818 - RNA, 16 nt, Chlamydia trachomatis
gcuucuucauguucug

SEQ ID NO: 460819 - RNA, 14 nt, Chlamydia trachomatis
gcuucuucuaaaga

SEQ ID NO: 460820 - RNA, 14 nt, Chlamydia trachomatis
gcuuucaaaaagag

SEQ ID NO: 460821 - RNA, 13 nt, Chlamydia trachomatis
gcuuuacgaaaua

SEQ ID NO: 460822 - RNA, 20 nt, Chlamydia trachomatis
gcuugucgaacaaucggaaa

SEQ ID NO: 460823 - RNA, 12 nt, Chlamydia trachomatis
gcuuucuaaagc

SEQ ID NO: 460824 - RNA, 16 nt, Chlamydia trachomatis
gcuuugaucuuuguuc

SEQ ID NO: 460825 - RNA, 17 nt, Chlamydia trachomatis
gcuuugauuaaccaaaa

SEQ ID NO: 460826 - RNA, 19 nt, Chlamydia trachomatis
gcuuuuuuuuuagaacaga

SEQ ID NO: 460827 - RNA, 15 nt, Chlamydia trachomatis
ggaaaaaaaaccaaa

SEQ ID NO: 460828 - RNA, 15 nt, Chlamydia trachomatis
ggaugauucccugua

SEQ ID NO: 460829 - RNA, 20 nt, Chlamydia trachomatis
ggauuuuaugaagcaaauag

SEQ ID NO: 460830 - RNA, 21 nt, Chlamydia trachomatis
ggcucucuagcaaacgaaggu

SEQ ID NO: 460831 - RNA, 20 nt, Chlamydia trachomatis
ggcuuaugaacggcucuucu

SEQ ID NO: 460832 - RNA, 16 nt, Chlamydia trachomatis
ggcuucaaagaacaua

SEQ ID NO: 460833 - RNA, 14 nt, Chlamydia trachomatis
gguccauaacgucc

SEQ ID NO: 460834 - RNA, 13 nt, Chlamydia trachomatis
guaaacaaccaaa

SEQ ID NO: 460835 - RNA, 22 nt, Chlamydia trachomatis
guagacuucuuguauaaguucu

SEQ ID NO: 460836 - RNA, 14 nt, Chlamydia trachomatis
guagagaaacuccu

SEQ ID NO: 460837 - RNA, 17 nt, Chlamydia trachomatis
aagucucuuaagcguuu

SEQ ID NO: 460838 - RNA, 20 nt, Chlamydia trachomatis
gucaugacucggaauaagag

SEQ ID NO: 460839 - RNA, 19 nt, Chlamydia trachomatis
gucccacaacuugcguuuu

SEQ ID NO: 460840 - RNA, 18 nt, Chlamydia trachomatis
guccuucuuuaccgauaa

SEQ ID NO: 460841 - RNA, 21 nt, Chlamydia trachomatis
gucguuuucggagaagaagag

SEQ ID NO: 460842 - RNA, 17 nt, Chlamydia trachomatis
gucuguggagauaaugc

SEQ ID NO: 460843 - RNA, 20 nt, Chlamydia trachomatis
gucugugauaucccuuucca

SEQ ID NO: 460844 - RNA, 23 nt, Chlamydia trachomatis
gucuuuuugcuaccaagcuucuu

SEQ ID NO: 460845 - RNA, 19 nt, Chlamydia trachomatis
gugaaguucccuuuacaau

SEQ ID NO: 460846 - RNA, 19 nt, Chlamydia trachomatis
cguaccaaggauuuuuuuc

SEQ ID NO: 460847 - RNA, 16 nt, Chlamydia trachomatis
cguacuuuaggagaaa

SEQ ID NO: 460848 - RNA, 16 nt, Chlamydia trachomatis
cguaucccugcauaau

SEQ ID NO: 460849 - RNA, 16 nt, Chlamydia trachomatis
cguagagaucuucuga

SEQ ID NO: 460850 - RNA, 17 nt, Chlamydia trachomatis
cguagagaucuucugaa

SEQ ID NO: 460851 - RNA, 16 nt, Chlamydia trachomatis
cguagaauuucuucuu

SEQ ID NO: 460852 - RNA, 20 nt, Chlamydia trachomatis
cguauuuuuguuucuacuuu

SEQ ID NO: 460853 - RNA, 21 nt, Chlamydia trachomatis
cgucacgaguucgccccucuu

SEQ ID NO: 460854 - RNA, 13 nt, Chlamydia trachomatis
cguccaaaaagcg

SEQ ID NO: 460855 - RNA, 19 nt, Chlamydia trachomatis
cgucggcuccauaaaagag

SEQ ID NO: 460856 - RNA, 16 nt, Chlamydia trachomatis
cgucuguggagauaau

SEQ ID NO: 460857 - RNA, 13 nt, Chlamydia trachomatis
cgucuagcuuuuu

SEQ ID NO: 460858 - RNA, 13 nt, Chlamydia trachomatis
cgucuugucucuc

SEQ ID NO: 460859 - RNA, 23 nt, Chlamydia trachomatis
cgucuuuaacccuucaggaaagc

SEQ ID NO: 460860 - RNA, 19 nt, Chlamydia trachomatis
cgugaauguuaacaucuuc

SEQ ID NO: 460861 - RNA, 19 nt, Chlamydia trachomatis
cgugagcgucuuuucacaa

SEQ ID NO: 460862 - RNA, 17 nt, Chlamydia trachomatis
cgugaggaaguucugcu

SEQ ID NO: 460863 - RNA, 20 nt, Chlamydia trachomatis
cgugaggaaguucugcugcc

SEQ ID NO: 460864 - RNA, 14 nt, Chlamydia trachomatis
cgugcccaugagaa

SEQ ID NO: 460865 - RNA, 15 nt, Chlamydia trachomatis
cuaauuucuuucuca

SEQ ID NO: 460866 - RNA, 17 nt, Chlamydia trachomatis
cuaauuucuuucucaug

SEQ ID NO: 460867 - RNA, 15 nt, Chlamydia trachomatis
cuacaaaaccaaaau

SEQ ID NO: 460868 - RNA, 20 nt, Chlamydia trachomatis
cuacaaaacgcucuuuuucu

SEQ ID NO: 460869 - RNA, 20 nt, Chlamydia trachomatis
cuacaaauaguguaaggaga

SEQ ID NO: 460870 - RNA, 18 nt, Chlamydia trachomatis
cuaauguagaaauuuuaa

SEQ ID NO: 460871 - RNA, 20 nt, Chlamydia trachomatis
cuaauguagaaauuuuaaau

SEQ ID NO: 460872 - RNA, 17 nt, Chlamydia trachomatis
cuaauucaacauaauaa

SEQ ID NO: 460873 - RNA, 14 nt, Chlamydia trachomatis
cuaauugaaacagu

SEQ ID NO: 460874 - RNA, 14 nt, Chlamydia trachomatis
cuaauaaguucacu

SEQ ID NO: 460875 - RNA, 13 nt, Chlamydia trachomatis
cuaauagaucuac

SEQ ID NO: 460876 - RNA, 19 nt, Chlamydia trachomatis
cuaauaguucucugcauag

SEQ ID NO: 460877 - RNA, 23 nt, Chlamydia trachomatis
cuaauaucucaggauaaaacccu

SEQ ID NO: 460878 - RNA, 14 nt, Chlamydia trachomatis
cuaauaucugcucu

SEQ ID NO: 460879 - RNA, 16 nt, Chlamydia trachomatis
cuaauaucugcucuaa

SEQ ID NO: 460880 - RNA, 14 nt, Chlamydia trachomatis
cuaauaugcagggc

SEQ ID NO: 460881 - RNA, 21 nt, Chlamydia trachomatis
cuaauaugcagggcuugggau

SEQ ID NO: 460882 - RNA, 15 nt, Chlamydia trachomatis
cuaauccaugcaucu

SEQ ID NO: 460883 - RNA, 20 nt, Chlamydia trachomatis
cuaauccaugcaucuccucu

SEQ ID NO: 460884 - RNA, 16 nt, Chlamydia trachomatis
cuaaucgaauuacucu

SEQ ID NO: 460885 - RNA, 18 nt, Chlamydia trachomatis
cuaaucgaauuacucugc

SEQ ID NO: 460886 - RNA, 22 nt, Chlamydia trachomatis
cuaaucuuccagcguugccuua

SEQ ID NO: 460887 - RNA, 21 nt, Chlamydia trachomatis
cuaaucuuuuugauuuuucuu

SEQ ID NO: 460888 - RNA, 19 nt, Chlamydia trachomatis
cuaaugcuuuguagauacu

SEQ ID NO: 460889 - RNA, 16 nt, Chlamydia trachomatis
cuaagcgcaagaaacu

SEQ ID NO: 460890 - RNA, 19 nt, Chlamydia trachomatis
cuaagauuuucaucuucca

SEQ ID NO: 460891 - RNA, 20 nt, Chlamydia trachomatis
cuaagauuuucaucuuccaa

SEQ ID NO: 460892 - RNA, 13 nt, Chlamydia trachomatis
cuaacuugcagga

SEQ ID NO: 460893 - RNA, 14 nt, Chlamydia trachomatis
cuaacuuucuucca

SEQ ID NO: 460894 - RNA, 21 nt, Chlamydia trachomatis
cuaacuuuucaaguucuaacu

SEQ ID NO: 460895 - RNA, 19 nt, Chlamydia trachomatis
cuaagaaagguuuuucuua

SEQ ID NO: 460896 - RNA, 19 nt, Chlamydia trachomatis
cuaagaagcguucgcgucu

SEQ ID NO: 460897 - RNA, 14 nt, Chlamydia trachomatis
cuaagacuuucucu

SEQ ID NO: 460898 - RNA, 20 nt, Chlamydia trachomatis
cuaagacuuucucuaacaau

SEQ ID NO: 460899 - RNA, 22 nt, Chlamydia trachomatis
cuaagaucuccaugauccccua

SEQ ID NO: 460900 - RNA, 19 nt, Chlamydia trachomatis
cuaagaucucuuccuugua

SEQ ID NO: 460901 - RNA, 14 nt, Chlamydia trachomatis
cuaagcuucucaac

SEQ ID NO: 460902 - RNA, 22 nt, Chlamydia trachomatis
cuaagcuucucaacacugaaaa

SEQ ID NO: 460903 - RNA, 12 nt, Chlamydia trachomatis
cuaaggagaauu

SEQ ID NO: 460904 - RNA, 21 nt, Chlamydia trachomatis
cuaaggcaugagauauagucg

SEQ ID NO: 460905 - RNA, 16 nt, Chlamydia trachomatis
cuaaggccuuauccaa

SEQ ID NO: 460906 - RNA, 22 nt, Chlamydia trachomatis
cuaagguaacaaucacaggcug

SEQ ID NO: 460907 - RNA, 15 nt, Chlamydia trachomatis
cuaaguagcaaauua

SEQ ID NO: 460908 - RNA, 15 nt, Chlamydia trachomatis
cuaaguauagaagcc

SEQ ID NO: 460909 - RNA, 15 nt, Chlamydia trachomatis
cuaagugcaucauuu

SEQ ID NO: 460910 - RNA, 19 nt, Chlamydia trachomatis
cuaagugcaucauuuugua

SEQ ID NO: 460911 - RNA, 17 nt, Chlamydia trachomatis
cuaaguuggcauuuugg

SEQ ID NO: 460912 - RNA, 16 nt, Chlamydia trachomatis
cuaaguuguaaaacaa

SEQ ID NO: 460913 - RNA, 23 nt, Chlamydia trachomatis
cuaauaaaagggcucucuccuaa

SEQ ID NO: 460914 - RNA, 18 nt, Chlamydia trachomatis
cuaauaaacagaucuuuu

SEQ ID NO: 460915 - RNA, 22 nt, Chlamydia trachomatis
cuaauaaacagaucuuuuucau

SEQ ID NO: 460916 - RNA, 17 nt, Chlamydia trachomatis
cuaacuaaagucuuuuc

SEQ ID NO: 460917 - RNA, 15 nt, Chlamydia trachomatis
cuaacuaccauccgg

SEQ ID NO: 460918 - RNA, 19 nt, Chlamydia trachomatis
cuaacuacucccaaaucaa

SEQ ID NO: 460919 - RNA, 14 nt, Chlamydia trachomatis
cuaacucuucuuua

SEQ ID NO: 460920 - RNA, 15 nt, Chlamydia trachomatis
cuaacuuaauaaggg

SEQ ID NO: 460921 - RNA, 17 nt, Chlamydia trachomatis
cuaaccgguaaucaaag

SEQ ID NO: 460922 - RNA, 15 nt, Chlamydia trachomatis
cuaacgcuucuucug

SEQ ID NO: 460923 - RNA, 15 nt, Chlamydia trachomatis
cuaaacccucugcau

SEQ ID NO: 460924 - RNA, 18 nt, Chlamydia trachomatis
cuaacaaagaauuuuccg

SEQ ID NO: 460925 - RNA, 18 nt, Chlamydia trachomatis
cuaacaaagcucuagcaa

SEQ ID NO: 460926 - RNA, 18 nt, Chlamydia trachomatis
cuaacaaugacucaaaaa

SEQ ID NO: 460927 - RNA, 20 nt, Chlamydia trachomatis
cuaacacuuuuuuuucuuuc

SEQ ID NO: 460928 - RNA, 20 nt, Chlamydia trachomatis
cguuaugagcauuugccaau

SEQ ID NO: 460929 - RNA, 22 nt, Chlamydia trachomatis
cguuacuucuugcgaugccucu

SEQ ID NO: 460930 - RNA, 17 nt, Chlamydia trachomatis
cguuagcaucaucccca

SEQ ID NO: 460931 - RNA, 15 nt, Chlamydia trachomatis
cguuaggccauuuca

SEQ ID NO: 460932 - RNA, 16 nt, Chlamydia trachomatis
cguuaaugcuaaggag

SEQ ID NO: 460933 - RNA, 20 nt, Chlamydia trachomatis
cguuucguaguuuucuucgg

SEQ ID NO: 460934 - RNA, 19 nt, Chlamydia trachomatis
cguuguagagauaaaauca

SEQ ID NO: 460935 - RNA, 19 nt, Chlamydia trachomatis
cguuguguagguuuuaaag

SEQ ID NO: 460936 - RNA, 12 nt, Chlamydia trachomatis
cguuuuccccuu

SEQ ID NO: 460937 - RNA, 20 nt, Chlamydia trachomatis
cguuuuccgcacccaaucuu

SEQ ID NO: 460938 - RNA, 11 nt, Chlamydia trachomatis
cguuuucuagu

SEQ ID NO: 460939 - RNA, 14 nt, Chlamydia trachomatis
cguuuucucuugaa

SEQ ID NO: 460940 - RNA, 13 nt, Chlamydia trachomatis
cguuuugaagaag

SEQ ID NO: 460941 - RNA, 15 nt, Chlamydia trachomatis
cguuuuucuacaacu

SEQ ID NO: 460942 - RNA, 17 nt, Chlamydia trachomatis
cguuuuuuuagauaaga

SEQ ID NO: 460943 - RNA, 14 nt, Chlamydia trachomatis
cuaaaaaauuuuga

SEQ ID NO: 460944 - RNA, 15 nt, Chlamydia trachomatis
cuaaaaccuuagcuc

SEQ ID NO: 460945 - RNA, 12 nt, Chlamydia trachomatis
cuaaaagagcuu

SEQ ID NO: 460946 - RNA, 21 nt, Chlamydia trachomatis
cuaaaagagcuucuucuaaag

SEQ ID NO: 460947 - RNA, 12 nt, Chlamydia trachomatis
cuaaaagcccau

SEQ ID NO: 460948 - RNA, 14 nt, Chlamydia trachomatis
cuaaacaaaaacuc

SEQ ID NO: 460949 - RNA, 15 nt, Chlamydia trachomatis
cuaaacaaaaacucu

SEQ ID NO: 460950 - RNA, 19 nt, Chlamydia trachomatis
cuaaacaaaaacucucaaa

SEQ ID NO: 460951 - RNA, 13 nt, Chlamydia trachomatis
cuaaacaaauguc

SEQ ID NO: 460952 - RNA, 14 nt, Chlamydia trachomatis
cuaaacaaggauuu

SEQ ID NO: 460953 - RNA, 19 nt, Chlamydia trachomatis
cuaaacaagguucuucaac

SEQ ID NO: 460954 - RNA, 21 nt, Chlamydia trachomatis
cuaaacaagguucuucaacaa

SEQ ID NO: 460955 - RNA, 16 nt, Chlamydia trachomatis
cuaaacaagucucuga

SEQ ID NO: 460956 - RNA, 17 nt, Chlamydia trachomatis
cuacagccuccucuaca

SEQ ID NO: 460957 - RNA, 13 nt, Chlamydia trachomatis
cuacagcagacuu

SEQ ID NO: 460958 - RNA, 19 nt, Chlamydia trachomatis
cuacagcuguauuuacagc

SEQ ID NO: 460959 - RNA, 21 nt, Chlamydia trachomatis
cuacagaguuaacuauuucug

SEQ ID NO: 460960 - RNA, 19 nt, Chlamydia trachomatis
cuacagaguuaccaaucac

SEQ ID NO: 460961 - RNA, 15 nt, Chlamydia trachomatis
cuacagguuguuccu

SEQ ID NO: 460962 - RNA, 23 nt, Chlamydia trachomatis
cuacaggauccgcaccaaucacc

SEQ ID NO: 460963 - RNA, 22 nt, Chlamydia trachomatis
cuacauaagucucuugccuuua

SEQ ID NO: 460964 - RNA, 15 nt, Chlamydia trachomatis
cuacaucuaaaagag

SEQ ID NO: 460965 - RNA, 13 nt, Chlamydia trachomatis
cuacauggccaaa

SEQ ID NO: 460966 - RNA, 18 nt, Chlamydia trachomatis
cuacauguaguaaucugc

SEQ ID NO: 460967 - RNA, 16 nt, Chlamydia trachomatis
cuacacgauauaucca

SEQ ID NO: 460968 - RNA, 23 nt, Chlamydia trachomatis
cuacacgcugaaauucuugguau

SEQ ID NO: 460969 - RNA, 14 nt, Chlamydia trachomatis
cuacagagcccuuu

SEQ ID NO: 460970 - RNA, 16 nt, Chlamydia trachomatis
cuacacaucuguaucc

SEQ ID NO: 460971 - RNA, 23 nt, Chlamydia trachomatis
cuacacaucuguauccuaacuaa

SEQ ID NO: 460972 - RNA, 14 nt, Chlamydia trachomatis
cuacaccauaaaac

SEQ ID NO: 460973 - RNA, 14 nt, Chlamydia trachomatis
cuaccgcgagcucg

SEQ ID NO: 460974 - RNA, 21 nt, Chlamydia trachomatis
cuaccuagugauuuuaaacca

SEQ ID NO: 460975 - RNA, 22 nt, Chlamydia trachomatis
cuaccucuaaagauccucuuuc

SEQ ID NO: 460976 - RNA, 16 nt, Chlamydia trachomatis
cuacccccuucuccuu

SEQ ID NO: 460977 - RNA, 16 nt, Chlamydia trachomatis
cuacccgauucaaaaa

SEQ ID NO: 460978 - RNA, 20 nt, Chlamydia trachomatis
cuacauuguaaauagacuuc

SEQ ID NO: 460979 - RNA, 15 nt, Chlamydia trachomatis
cuaccaaaaauuuuu

SEQ ID NO: 460980 - RNA, 21 nt, Chlamydia trachomatis
cuaccaaaccuuaaaagcaag

SEQ ID NO: 460981 - RNA, 19 nt, Chlamydia trachomatis
cuaccacgagcauaagaau

SEQ ID NO: 460982 - RNA, 19 nt, Chlamydia trachomatis
cuagcgacugcugcagaaa

SEQ ID NO: 460983 - RNA, 20 nt, Chlamydia trachomatis
cuagccuggcugcagaagac

SEQ ID NO: 460984 - RNA, 20 nt, Chlamydia trachomatis
cuagagauaucacuaccagc

SEQ ID NO: 460985 - RNA, 21 nt, Chlamydia trachomatis
cuagagauaucacuaccagcc

SEQ ID NO: 460986 - RNA, 15 nt, Chlamydia trachomatis
cuagaaauaaaaugg

SEQ ID NO: 460987 - RNA, 10 nt, Chlamydia trachomatis
cuagaagaag

SEQ ID NO: 460988 - RNA, 12 nt, Chlamydia trachomatis
cuagaagaagag

SEQ ID NO: 460989 - RNA, 21 nt, Chlamydia trachomatis
cuagaagggaacagucucuua

SEQ ID NO: 460990 - RNA, 19 nt, Chlamydia trachomatis
cuagacaaacaccuauggg

SEQ ID NO: 460991 - RNA, 19 nt, Chlamydia trachomatis
cuagacguuuagccuccau

SEQ ID NO: 460992 - RNA, 15 nt, Chlamydia trachomatis
cuagaaaagagcagc

SEQ ID NO: 460993 - RNA, 16 nt, Chlamydia trachomatis
cuagaaaauagcaucu

SEQ ID NO: 460994 - RNA, 15 nt, Chlamydia trachomatis
cuagaaagaaccaca

SEQ ID NO: 460995 - RNA, 21 nt, Chlamydia trachomatis
cuagaaagaaccacaaaauca

SEQ ID NO: 460996 - RNA, 22 nt, Chlamydia trachomatis
cuagaaagaaccacaaaaucag

SEQ ID NO: 460997 - RNA, 15 nt, Chlamydia trachomatis
cuacgcuacagaguu

SEQ ID NO: 460998 - RNA, 15 nt, Chlamydia trachomatis
cuacgcuuccuacag

SEQ ID NO: 460999 - RNA, 19 nt, Chlamydia trachomatis
cuacggaaaaagaagaucc

SEQ ID NO: 461000 - RNA, 16 nt, Chlamydia trachomatis
cuauaagguucaagga

SEQ ID NO: 461001 - RNA, 21 nt, Chlamydia trachomatis
cuauaaaugaaaccccucuuu

SEQ ID NO: 461002 - RNA, 18 nt, Chlamydia trachomatis
cuaguuugguuuuuuuug

SEQ ID NO: 461003 - RNA, 18 nt, Chlamydia trachomatis
cuaguguuuguacacagg

SEQ ID NO: 461004 - RNA, 18 nt, Chlamydia trachomatis
cuaguuauauugcuucau

SEQ ID NO: 461005 - RNA, 17 nt, Chlamydia trachomatis
cuaguauuaaacuucaa

SEQ ID NO: 461006 - RNA, 17 nt, Chlamydia trachomatis
cuagucuacucauccua

SEQ ID NO: 461007 - RNA, 14 nt, Chlamydia trachomatis
cuagucgauucugg

SEQ ID NO: 461008 - RNA, 12 nt, Chlamydia trachomatis
cuagcuuuccuc

SEQ ID NO: 461009 - RNA, 17 nt, Chlamydia trachomatis
cuagcuuuccucacaca

SEQ ID NO: 461010 - RNA, 22 nt, Chlamydia trachomatis
cuaggacagacaggaaagcacu

SEQ ID NO: 461011 - RNA, 19 nt, Chlamydia trachomatis
cuaggagcauuccuucuau

SEQ ID NO: 461012 - RNA, 21 nt, Chlamydia trachomatis
cuaggaucccaaggaaauaaa

SEQ ID NO: 461013 - RNA, 14 nt, Chlamydia trachomatis
cuaguaaugugucu

SEQ ID NO: 461014 - RNA, 15 nt, Chlamydia trachomatis
cuaguacaaaaauac

SEQ ID NO: 461015 - RNA, 10 nt, Chlamydia trachomatis
cuaugagaau

SEQ ID NO: 461016 - RNA, 12 nt, Chlamydia trachomatis
cuauggcaaaag

SEQ ID NO: 461017 - RNA, 15 nt, Chlamydia trachomatis
cuauucacuaccaga

SEQ ID NO: 461018 - RNA, 17 nt, Chlamydia trachomatis
cuaugaacaaacagcug

SEQ ID NO: 461019 - RNA, 15 nt, Chlamydia trachomatis
cuaugaaaaauccuu

SEQ ID NO: 461020 - RNA, 21 nt, Chlamydia trachomatis
cuaugaaaaauccuuccauau

SEQ ID NO: 461021 - RNA, 17 nt, Chlamydia trachomatis
cuaucucgccaaccaua

SEQ ID NO: 461022 - RNA, 21 nt, Chlamydia trachomatis
cuauuucgaucuuaccaaaau

SEQ ID NO: 461023 - RNA, 20 nt, Chlamydia trachomatis
cuauuuguuuuccgauccaa

SEQ ID NO: 461024 - RNA, 19 nt, Chlamydia trachomatis
cuauuucuucgcauagugu

SEQ ID NO: 461025 - RNA, 16 nt, Chlamydia trachomatis
cuauuugcaagaacug

SEQ ID NO: 461026 - RNA, 17 nt, Chlamydia trachomatis
cuauuuuauacuucuua

SEQ ID NO: 461027 - RNA, 13 nt, Chlamydia trachomatis
cuauuuuccucuu

SEQ ID NO: 461028 - RNA, 11 nt, Chlamydia trachomatis
cuauuuucuuc

SEQ ID NO: 461029 - RNA, 18 nt, Chlamydia trachomatis
cuauuuucuuccugcuuc

SEQ ID NO: 461030 - RNA, 13 nt, Chlamydia trachomatis
cuauucgcaguau

SEQ ID NO: 461031 - RNA, 17 nt, Chlamydia trachomatis
cuauuguauagcuuuua

SEQ ID NO: 461032 - RNA, 14 nt, Chlamydia trachomatis
cuauuuacagaaua

SEQ ID NO: 461033 - RNA, 15 nt, Chlamydia trachomatis
cuauuuaggcuaacu

SEQ ID NO: 461034 - RNA, 17 nt, Chlamydia trachomatis
cuauuuaggcuaacucc

SEQ ID NO: 461035 - RNA, 12 nt, Chlamydia trachomatis
cuauuucauuua

SEQ ID NO: 461036 - RNA, 13 nt, Chlamydia trachomatis
cucaccagcuucc

SEQ ID NO: 461037 - RNA, 18 nt, Chlamydia trachomatis
cucaaaagaacuuccuau

SEQ ID NO: 461038 - RNA, 13 nt, Chlamydia trachomatis
cucaaacaaucua

SEQ ID NO: 461039 - RNA, 16 nt, Chlamydia trachomatis
cucaaacaaucuaaaa

SEQ ID NO: 461040 - RNA, 16 nt, Chlamydia trachomatis
cucaaugagcgcuuuu

SEQ ID NO: 461041 - RNA, 15 nt, Chlamydia trachomatis
cucagcuucaacugg

SEQ ID NO: 461042 - RNA, 15 nt, Chlamydia trachomatis
cucagcuaauaaccc

SEQ ID NO: 461043 - RNA, 14 nt, Chlamydia trachomatis
cucagcagaucauc

SEQ ID NO: 461044 - RNA, 14 nt, Chlamydia trachomatis
cucagaaaacuuag

SEQ ID NO: 461045 - RNA, 14 nt, Chlamydia trachomatis
cucauuagaaugau

SEQ ID NO: 461046 - RNA, 17 nt, Chlamydia trachomatis
cucauuagaaugauuga

SEQ ID NO: 461047 - RNA, 17 nt, Chlamydia trachomatis
cucauuaaugacuccca

SEQ ID NO: 461048 - RNA, 24 nt, Chlamydia trachomatis
cuccaagcauuaccauaucaaaaa

SEQ ID NO: 461049 - RNA, 17 nt, Chlamydia trachomatis
cuccaaagaauagaaua

SEQ ID NO: 461050 - RNA, 22 nt, Chlamydia trachomatis
cuccaaagaugcuccuacaaaa

SEQ ID NO: 461051 - RNA, 19 nt, Chlamydia trachomatis
cuccaacaauagcgcgaca

SEQ ID NO: 461052 - RNA, 19 nt, Chlamydia trachomatis
cuccaacacgaaugccugu

SEQ ID NO: 461053 - RNA, 15 nt, Chlamydia trachomatis
cucauugggagcucc

SEQ ID NO: 461054 - RNA, 21 nt, Chlamydia trachomatis
cuccaaaaaagagggaguucu

SEQ ID NO: 461055 - RNA, 21 nt, Chlamydia trachomatis
cuccacacaacauaacucugc

SEQ ID NO: 461056 - RNA, 16 nt, Chlamydia trachomatis
cuccaccuaauucccc

SEQ ID NO: 461057 - RNA, 23 nt, Chlamydia trachomatis
cuccaccauagcacuuagcaguu

SEQ ID NO: 461058 - RNA, 14 nt, Chlamydia trachomatis
cuccaccuucuuug

SEQ ID NO: 461059 - RNA, 23 nt, Chlamydia trachomatis
cuccagauacugcuccacaacac

SEQ ID NO: 461060 - RNA, 18 nt, Chlamydia trachomatis
cuccagaagggaaguuau

SEQ ID NO: 461061 - RNA, 16 nt, Chlamydia trachomatis
cuccagaaacaggaga

SEQ ID NO: 461062 - RNA, 23 nt, Chlamydia trachomatis
cucccauaggcucgccauuauua

SEQ ID NO: 461063 - RNA, 14 nt, Chlamydia trachomatis
cuccauuuuaagga

SEQ ID NO: 461064 - RNA, 22 nt, Chlamydia trachomatis
cucccucaccucuugccugcaa

SEQ ID NO: 461065 - RNA, 14 nt, Chlamydia trachomatis
cucccuagugcugu

SEQ ID NO: 461066 - RNA, 17 nt, Chlamydia trachomatis
cuccccucgaggacagu

SEQ ID NO: 461067 - RNA, 20 nt, Chlamydia trachomatis
cucccauuuuuaccaaaccu

SEQ ID NO: 461068 - RNA, 16 nt, Chlamydia trachomatis
cuccccagaaaaacca

SEQ ID NO: 461069 - RNA, 21 nt, Chlamydia trachomatis
cuccuauaauugcuaaggaaa

SEQ ID NO: 461070 - RNA, 19 nt, Chlamydia trachomatis
cuccuaucacucccugcaa

SEQ ID NO: 461071 - RNA, 14 nt, Chlamydia trachomatis
cuccucaagcgauu

SEQ ID NO: 461072 - RNA, 18 nt, Chlamydia trachomatis
cuccucaagcgauuauga

SEQ ID NO: 461073 - RNA, 21 nt, Chlamydia trachomatis
cuccuagugauaaacaggagc

SEQ ID NO: 461074 - RNA, 15 nt, Chlamydia trachomatis
cuccuaaauccuaua

SEQ ID NO: 461075 - RNA, 23 nt, Chlamydia trachomatis
cuccuaacccuuguacagcgaca

SEQ ID NO: 461076 - RNA, 19 nt, Chlamydia trachomatis
cuccuaaccgguaaucaaa

SEQ ID NO: 461077 - RNA, 15 nt, Chlamydia trachomatis
cuccuaagcagugaa

SEQ ID NO: 461078 - RNA, 16 nt, Chlamydia trachomatis
cuccuaaucuuucuaa

SEQ ID NO: 461079 - RNA, 15 nt, Chlamydia trachomatis
cuccuaauucaacau

SEQ ID NO: 461080 - RNA, 12 nt, Chlamydia trachomatis
cuccuacaaaau

SEQ ID NO: 461081 - RNA, 13 nt, Chlamydia trachomatis
cuccuacaaaaua

SEQ ID NO: 461082 - RNA, 23 nt, Chlamydia trachomatis
cuccuacaaaauaguucacucca

SEQ ID NO: 461083 - RNA, 20 nt, Chlamydia trachomatis
cuccgguucucuuggcuuuu

SEQ ID NO: 461084 - RNA, 16 nt, Chlamydia trachomatis
cuccgcugauuagaaa

SEQ ID NO: 461085 - RNA, 13 nt, Chlamydia trachomatis
cuccgcuuagaau

SEQ ID NO: 461086 - RNA, 22 nt, Chlamydia trachomatis
cuccggagaacaguguccuucc

SEQ ID NO: 461087 - RNA, 18 nt, Chlamydia trachomatis
cucccucauuuaaaaguc

SEQ ID NO: 461088 - RNA, 19 nt, Chlamydia trachomatis
cucgaacucagcuuccuug

SEQ ID NO: 461089 - RNA, 13 nt, Chlamydia trachomatis
cucgauggcaggg

SEQ ID NO: 461090 - RNA, 17 nt, Chlamydia trachomatis
cucgauggcagggaauc

SEQ ID NO: 461091 - RNA, 22 nt, Chlamydia trachomatis
cucgcagaugcuucugccuuuu

SEQ ID NO: 461092 - RNA, 13 nt, Chlamydia trachomatis
cucgcaaagaauc

SEQ ID NO: 461093 - RNA, 23 nt, Chlamydia trachomatis
cucgcaaagaaucaaaacgcuca

SEQ ID NO: 461094 - RNA, 17 nt, Chlamydia trachomatis
cucgccucuaucucuuc

SEQ ID NO: 461095 - RNA, 21 nt, Chlamydia trachomatis
cucuaagcaccuuuacaauca

SEQ ID NO: 461096 - RNA, 20 nt, Chlamydia trachomatis
cucuaaagucuuuccauuua

SEQ ID NO: 461097 - RNA, 20 nt, Chlamydia trachomatis
cucguuccucagcuaauaac

SEQ ID NO: 461098 - RNA, 20 nt, Chlamydia trachomatis
cucguuuagcagccugagga

SEQ ID NO: 461099 - RNA, 23 nt, Chlamydia trachomatis
cucuaaaggauaaggaagaagau

SEQ ID NO: 461100 - RNA, 22 nt, Chlamydia trachomatis
cucguuagcagaagcaagaauc

SEQ ID NO: 461101 - RNA, 14 nt, Chlamydia trachomatis
cucgucuacaccug

SEQ ID NO: 461102 - RNA, 21 nt, Chlamydia trachomatis
cugaaucuguguugcaaagag

SEQ ID NO: 461103 - RNA, 14 nt, Chlamydia trachomatis
cugaaucaaacaga

SEQ ID NO: 461104 - RNA, 17 nt, Chlamydia trachomatis
cugaauggucaauaauu

SEQ ID NO: 461105 - RNA, 19 nt, Chlamydia trachomatis
cucuaccauugugaacaau

SEQ ID NO: 461106 - RNA, 18 nt, Chlamydia trachomatis
cucuacaaaauaaaaaaa

SEQ ID NO: 461107 - RNA, 18 nt, Chlamydia trachomatis
cucuacgcuuccuacagc

SEQ ID NO: 461108 - RNA, 20 nt, Chlamydia trachomatis
cucuacgcuuccuacagcua

SEQ ID NO: 461109 - RNA, 21 nt, Chlamydia trachomatis
cucuacgcuuccuacagcuag

SEQ ID NO: 461110 - RNA, 23 nt, Chlamydia trachomatis
cucuagcaaccaauucucugccu

SEQ ID NO: 461111 - RNA, 15 nt, Chlamydia trachomatis
cucuagcauugcgag

SEQ ID NO: 461112 - RNA, 21 nt, Chlamydia trachomatis
cugacugguuccccaaggggg

SEQ ID NO: 461113 - RNA, 18 nt, Chlamydia trachomatis
cugaggcaauaaaagcug

SEQ ID NO: 461114 - RNA, 17 nt, Chlamydia trachomatis
cugagcuuuuuuucacu

SEQ ID NO: 461115 - RNA, 15 nt, Chlamydia trachomatis
cugauaaggaggcuu

SEQ ID NO: 461116 - RNA, 15 nt, Chlamydia trachomatis
cugauaggcaacuug

SEQ ID NO: 461117 - RNA, 21 nt, Chlamydia trachomatis
cugauaaaugucccugaacau

SEQ ID NO: 461118 - RNA, 21 nt, Chlamydia trachomatis
cugauaaccagaauccuuuuc

SEQ ID NO: 461119 - RNA, 18 nt, Chlamydia trachomatis
cugagggccuucuuuuuc

SEQ ID NO: 461120 - RNA, 20 nt, Chlamydia trachomatis
cugaguauuaaggaaaugaa

SEQ ID NO: 461121 - RNA, 23 nt, Chlamydia trachomatis
cugauuagaaagggcuuuauacu

SEQ ID NO: 461122 - RNA, 14 nt, Chlamydia trachomatis
cugauguuccaucu

SEQ ID NO: 461123 - RNA, 13 nt, Chlamydia trachomatis
cugcaacccaagc

SEQ ID NO: 461124 - RNA, 21 nt, Chlamydia trachomatis
cugcaacauuuccuaaggcuu

SEQ ID NO: 461125 - RNA, 18 nt, Chlamydia trachomatis
cugcaacaguaaauuuca

SEQ ID NO: 461126 - RNA, 17 nt, Chlamydia trachomatis
cugcaccucuuucagau

SEQ ID NO: 461127 - RNA, 21 nt, Chlamydia trachomatis
cugcaccggcaaagaacaguu

SEQ ID NO: 461128 - RNA, 13 nt, Chlamydia trachomatis
cugcagagauaua

SEQ ID NO: 461129 - RNA, 15 nt, Chlamydia trachomatis
cugcagaaaaauuua

SEQ ID NO: 461130 - RNA, 16 nt, Chlamydia trachomatis
cugcauauuuaauugc

SEQ ID NO: 461131 - RNA, 14 nt, Chlamydia trachomatis
cugcauacuuuuca

SEQ ID NO: 461132 - RNA, 16 nt, Chlamydia trachomatis
cugcagcuaaagaauc

SEQ ID NO: 461133 - RNA, 18 nt, Chlamydia trachomatis
cugcccuuuguacaugau

SEQ ID NO: 461134 - RNA, 19 nt, Chlamydia trachomatis
cugccgaacugcuuuccuu

SEQ ID NO: 461135 - RNA, 13 nt, Chlamydia trachomatis
cugccgacuccug

SEQ ID NO: 461136 - RNA, 15 nt, Chlamydia trachomatis
cugccuuuaggaaga

SEQ ID NO: 461137 - RNA, 20 nt, Chlamydia trachomatis
cugcgaaaaagaaauaaccu

SEQ ID NO: 461138 - RNA, 18 nt, Chlamydia trachomatis
cugcggcagcugcuugga

SEQ ID NO: 461139 - RNA, 21 nt, Chlamydia trachomatis
cugcggcagcugcuuggaaua

SEQ ID NO: 461140 - RNA, 14 nt, Chlamydia trachomatis
cugcgguauccaua

SEQ ID NO: 461141 - RNA, 20 nt, Chlamydia trachomatis
cugcuaauaguucucugcau

SEQ ID NO: 461142 - RNA, 21 nt, Chlamydia trachomatis
cugcuacaaacugcucaagga

SEQ ID NO: 461143 - RNA, 15 nt, Chlamydia trachomatis
cugcuccaaagauau

SEQ ID NO: 461144 - RNA, 16 nt, Chlamydia trachomatis
cugcucuugaagauau

SEQ ID NO: 461145 - RNA, 18 nt, Chlamydia trachomatis
aaacuaucuaaaaucccu

SEQ ID NO: 461146 - RNA, 17 nt, Chlamydia trachomatis
cugcuucccuccuagaa

SEQ ID NO: 461147 - RNA, 21 nt, Chlamydia trachomatis
cugcuuccuaucgcgagaaga

SEQ ID NO: 461148 - RNA, 14 nt, Chlamydia trachomatis
cugcugucagaaga

SEQ ID NO: 461149 - RNA, 22 nt, Chlamydia trachomatis
cuggaaccggaggauaaaucag

SEQ ID NO: 461150 - RNA, 12 nt, Chlamydia trachomatis
cugcuuggaaua

SEQ ID NO: 461151 - RNA, 13 nt, Chlamydia trachomatis
cugcuuggaauaa

SEQ ID NO: 461152 - RNA, 13 nt, Chlamydia trachomatis
cugcuuggaauag

SEQ ID NO: 461153 - RNA, 16 nt, Chlamydia trachomatis
cugcuuuaaaugcugc

SEQ ID NO: 461154 - RNA, 22 nt, Chlamydia trachomatis
cugcuugcgaauaacuaauaua

SEQ ID NO: 461155 - RNA, 20 nt, Chlamydia trachomatis
cugcuugaaguagcauugcg

SEQ ID NO: 461156 - RNA, 13 nt, Chlamydia trachomatis
cugcuucuuuuuc

SEQ ID NO: 461157 - RNA, 14 nt, Chlamydia trachomatis
cugcuucuuuuucc

SEQ ID NO: 461158 - RNA, 17 nt, Chlamydia trachomatis
cugcuucuauagaaaca

SEQ ID NO: 461159 - RNA, 16 nt, Chlamydia trachomatis
cuggaagguggcugcg

SEQ ID NO: 461160 - RNA, 17 nt, Chlamydia trachomatis
cuggaauagcuagagca

SEQ ID NO: 461161 - RNA, 21 nt, Chlamydia trachomatis
cuggaauaucugguugugaaa

SEQ ID NO: 461162 - RNA, 20 nt, Chlamydia trachomatis
cuggagcaacaaccaacucu

SEQ ID NO: 461163 - RNA, 15 nt, Chlamydia trachomatis
cuggagccgucugua

SEQ ID NO: 461164 - RNA, 22 nt, Chlamydia trachomatis
cuggcaauaaucuuuuuauuga

SEQ ID NO: 461165 - RNA, 11 nt, Chlamydia trachomatis
cuggcaccuuu

SEQ ID NO: 461166 - RNA, 22 nt, Chlamydia trachomatis
cuggcauagcagccaauuucuc

SEQ ID NO: 461167 - RNA, 16 nt, Chlamydia trachomatis
cuggcgauaguucuaa

SEQ ID NO: 461168 - RNA, 16 nt, Chlamydia trachomatis
aaacuccauugcugau

SEQ ID NO: 461169 - RNA, 14 nt, Chlamydia trachomatis
cugggaaaauuaaa

SEQ ID NO: 461170 - RNA, 22 nt, Chlamydia trachomatis
cugggcauacaccugcaagaga

SEQ ID NO: 461171 - RNA, 17 nt, Chlamydia trachomatis
cugggcgaucuccuucc

SEQ ID NO: 461172 - RNA, 14 nt, Chlamydia trachomatis
cugggucauagaaa

SEQ ID NO: 461173 - RNA, 19 nt, Chlamydia trachomatis
cuggguuuuaucaagagaa

SEQ ID NO: 461174 - RNA, 22 nt, Chlamydia trachomatis
cugguaaaaauagaaaacgucg

SEQ ID NO: 461175 - RNA, 21 nt, Chlamydia trachomatis
cugguagaaagcuacagucug

SEQ ID NO: 461176 - RNA, 20 nt, Chlamydia trachomatis
cugguacucaucuuuuuuaa

SEQ ID NO: 461177 - RNA, 16 nt, Chlamydia trachomatis
cugguccauggaacga

SEQ ID NO: 461178 - RNA, 20 nt, Chlamydia trachomatis
cugguguaggaaaauacaca

SEQ ID NO: 461179 - RNA, 17 nt, Chlamydia trachomatis
cugguuucuuaaacaaa

SEQ ID NO: 461180 - RNA, 16 nt, Chlamydia trachomatis
cugguugguuuucuug

SEQ ID NO: 461181 - RNA, 20 nt, Chlamydia trachomatis
cugguuuuuuuugaaaaggg

SEQ ID NO: 461182 - RNA, 13 nt, Chlamydia trachomatis
cuguaauaaacac

SEQ ID NO: 461183 - RNA, 11 nt, Chlamydia trachomatis
cuguaauaagu

SEQ ID NO: 461184 - RNA, 16 nt, Chlamydia trachomatis
cuguaacuaaacucca

SEQ ID NO: 461185 - RNA, 16 nt, Chlamydia trachomatis
cuguaacgaggccucc

SEQ ID NO: 461186 - RNA, 14 nt, Chlamydia trachomatis
cuguaauuuuaaau

SEQ ID NO: 461187 - RNA, 14 nt, Chlamydia trachomatis
cuguacaccaccgc

SEQ ID NO: 461188 - RNA, 14 nt, Chlamydia trachomatis
cuguaauguccucu

SEQ ID NO: 461189 - RNA, 16 nt, Chlamydia trachomatis
cuguaauguccucuuu

SEQ ID NO: 461190 - RNA, 19 nt, Chlamydia trachomatis
cuguaauguccucuuuauc

SEQ ID NO: 461191 - RNA, 23 nt, Chlamydia trachomatis
cuguaauguuaauggaaucuaga

SEQ ID NO: 461192 - RNA, 15 nt, Chlamydia trachomatis
cugucagucuucuuu

SEQ ID NO: 461193 - RNA, 17 nt, Chlamydia trachomatis
cugucaucacugaccga

SEQ ID NO: 461194 - RNA, 23 nt, Chlamydia trachomatis
cugucaucacugaccgaagaacu

SEQ ID NO: 461195 - RNA, 12 nt, Chlamydia trachomatis
cugucagaccua

SEQ ID NO: 461196 - RNA, 16 nt, Chlamydia trachomatis
cugucagaccuacaaa

SEQ ID NO: 461197 - RNA, 18 nt, Chlamydia trachomatis
cugucagaccuacaaaga

SEQ ID NO: 461198 - RNA, 22 nt, Chlamydia trachomatis
cugucagaucauuuuaauaaga

SEQ ID NO: 461199 - RNA, 16 nt, Chlamydia trachomatis
aaacucuuuuucagac

SEQ ID NO: 461200 - RNA, 20 nt, Chlamydia trachomatis
aaacucuuuuucagacaaaa

SEQ ID NO: 461201 - RNA, 16 nt, Chlamydia trachomatis
cugucccccagauaac

SEQ ID NO: 461202 - RNA, 18 nt, Chlamydia trachomatis
cuguauccuaacuaaaaa

SEQ ID NO: 461203 - RNA, 12 nt, Chlamydia trachomatis
cuguauaacaau

SEQ ID NO: 461204 - RNA, 22 nt, Chlamydia trachomatis
cuguauaacaauuuuaaaaucu

SEQ ID NO: 461205 - RNA, 14 nt, Chlamydia trachomatis
cuguauaagaaaaa

SEQ ID NO: 461206 - RNA, 17 nt, Chlamydia trachomatis
cuguauucgcuauuucg

SEQ ID NO: 461207 - RNA, 15 nt, Chlamydia trachomatis
cuguauugcucugca

SEQ ID NO: 461208 - RNA, 23 nt, Chlamydia trachomatis
cugucaacaucauaaccaaucga

SEQ ID NO: 461209 - RNA, 21 nt, Chlamydia trachomatis
aaacucucgggccaaaaagac

SEQ ID NO: 461210 - RNA, 23 nt, Chlamydia trachomatis
aaacucucgggccaaaaagacua

SEQ ID NO: 461211 - RNA, 13 nt, Chlamydia trachomatis
aaacucuuaaaag

SEQ ID NO: 461212 - RNA, 23 nt, Chlamydia trachomatis
cuguaggggagggacuucuucua

SEQ ID NO: 461213 - RNA, 18 nt, Chlamydia trachomatis
cuguagugaaauaagaaa

SEQ ID NO: 461214 - RNA, 21 nt, Chlamydia trachomatis
cuguaguuagguaaucuucua

SEQ ID NO: 461215 - RNA, 19 nt, Chlamydia trachomatis
cuguaguugccccuuauuu

SEQ ID NO: 461216 - RNA, 22 nt, Chlamydia trachomatis
cuguaguugccccuuauuuacc

SEQ ID NO: 461217 - RNA, 14 nt, Chlamydia trachomatis
cuguagagagcccc

SEQ ID NO: 461218 - RNA, 16 nt, Chlamydia trachomatis
cuguagauucuggagg

SEQ ID NO: 461219 - RNA, 20 nt, Chlamydia trachomatis
cuguagccccagucucuacg

SEQ ID NO: 461220 - RNA, 14 nt, Chlamydia trachomatis
cuguccuuuauuca

SEQ ID NO: 461221 - RNA, 18 nt, Chlamydia trachomatis
cugucgaacgcuucuucc

SEQ ID NO: 461222 - RNA, 22 nt, Chlamydia trachomatis
cugucuaagauuuucaucuucc

SEQ ID NO: 461223 - RNA, 17 nt, Chlamydia trachomatis
cugucuuggucgcauuu

SEQ ID NO: 461224 - RNA, 14 nt, Chlamydia trachomatis
cugucuugucuuug

SEQ ID NO: 461225 - RNA, 15 nt, Chlamydia trachomatis
cugugaaaugcguga

SEQ ID NO: 461226 - RNA, 23 nt, Chlamydia trachomatis
cugugaaaugcgugaacuguuca

SEQ ID NO: 461227 - RNA, 15 nt, Chlamydia trachomatis
cugugaagaaugaaa

SEQ ID NO: 461228 - RNA, 23 nt, Chlamydia trachomatis
cugugagagagccguuuucaggu

SEQ ID NO: 461229 - RNA, 18 nt, Chlamydia trachomatis
cugugauaucccuuucca

SEQ ID NO: 461230 - RNA, 17 nt, Chlamydia trachomatis
cugugauggaaauguuu

SEQ ID NO: 461231 - RNA, 17 nt, Chlamydia trachomatis
cugugcaaucagcucuc

SEQ ID NO: 461232 - RNA, 24 nt, Chlamydia trachomatis
cuguggacucgcuacauguaguaa

SEQ ID NO: 461233 - RNA, 23 nt, Chlamydia trachomatis
cuguggagauaaugccuuuugca

SEQ ID NO: 461234 - RNA, 20 nt, Chlamydia trachomatis
cugugcuugcauagauagau

SEQ ID NO: 461235 - RNA, 23 nt, Chlamydia trachomatis
cuguguagcaaauaggcgaauuu

SEQ ID NO: 461236 - RNA, 17 nt, Chlamydia trachomatis
cugugucauaagcucua

SEQ ID NO: 461237 - RNA, 18 nt, Chlamydia trachomatis
cuguguacaaacacuaga

SEQ ID NO: 461238 - RNA, 17 nt, Chlamydia trachomatis
cugugucucgguuuucu

SEQ ID NO: 461239 - RNA, 15 nt, Chlamydia trachomatis
cuguguuugcacaau

SEQ ID NO: 461240 - RNA, 21 nt, Chlamydia trachomatis
cuguucagcuucuacauccaa

SEQ ID NO: 461241 - RNA, 19 nt, Chlamydia trachomatis
cuguucaauuguuggacaa

SEQ ID NO: 461242 - RNA, 21 nt, Chlamydia trachomatis
cuguucagaacucaaaauaaa

SEQ ID NO: 461243 - RNA, 17 nt, Chlamydia trachomatis
cuguugcaacagacucu

SEQ ID NO: 461244 - RNA, 22 nt, Chlamydia trachomatis
cuguugaugauguccaaagcuc

SEQ ID NO: 461245 - RNA, 12 nt, Chlamydia trachomatis
cuuaaacaaaaa

SEQ ID NO: 461246 - RNA, 21 nt, Chlamydia trachomatis
aaacugguuggacaaacuagu

SEQ ID NO: 461247 - RNA, 16 nt, Chlamydia trachomatis
aaacugucgaagaaug

SEQ ID NO: 461248 - RNA, 16 nt, Chlamydia trachomatis
aaacugugaagaauga

SEQ ID NO: 461249 - RNA, 23 nt, Chlamydia trachomatis
cuuaacugcagcaucuauuuucu

SEQ ID NO: 461250 - RNA, 22 nt, Chlamydia trachomatis
cuuaucugucagucuucuuuuc

SEQ ID NO: 461251 - RNA, 23 nt, Chlamydia trachomatis
cuuaucuuggguaagaccaaaaa

SEQ ID NO: 461252 - RNA, 19 nt, Chlamydia trachomatis
cuuaugaacggcucuucuu

SEQ ID NO: 461253 - RNA, 18 nt, Chlamydia trachomatis
cuuauuaauuucuagaug

SEQ ID NO: 461254 - RNA, 18 nt, Chlamydia trachomatis
cuuauuaaccaacucucu

SEQ ID NO: 461255 - RNA, 21 nt, Chlamydia trachomatis
cuuauuauuacgaacagcaau

SEQ ID NO: 461256 - RNA, 19 nt, Chlamydia trachomatis
cuuagaaggaucuaugaau

SEQ ID NO: 461257 - RNA, 21 nt, Chlamydia trachomatis
cuuagugucuucgaauccuaa

SEQ ID NO: 461258 - RNA, 22 nt, Chlamydia trachomatis
cuuagugucuucgaauccuaaa

SEQ ID NO: 461259 - RNA, 19 nt, Chlamydia trachomatis
cuuaguuaaaacuccagaa

SEQ ID NO: 461260 - RNA, 22 nt, Chlamydia trachomatis
cuuauaaaguccggacuuuccu

SEQ ID NO: 461261 - RNA, 16 nt, Chlamydia trachomatis
cuuauaaucuggauag

SEQ ID NO: 461262 - RNA, 19 nt, Chlamydia trachomatis
cuuacaauguaaacaauau

SEQ ID NO: 461263 - RNA, 17 nt, Chlamydia trachomatis
cuuacagagagcuuuuu

SEQ ID NO: 461264 - RNA, 15 nt, Chlamydia trachomatis
cuuaacuuuguuauu

SEQ ID NO: 461265 - RNA, 20 nt, Chlamydia trachomatis
cuuaauaagggcuuuugcaa

SEQ ID NO: 461266 - RNA, 19 nt, Chlamydia trachomatis
cuuaauuggagauugccuu

SEQ ID NO: 461267 - RNA, 23 nt, Chlamydia trachomatis
cuuaauuggagauugccuuuucu

SEQ ID NO: 461268 - RNA, 23 nt, Chlamydia trachomatis
cuuaauugcagguacuuacccuu

SEQ ID NO: 461269 - RNA, 15 nt, Chlamydia trachomatis
cuucaugcaauugau

SEQ ID NO: 461270 - RNA, 18 nt, Chlamydia trachomatis
cuucaugucuucuuucuc

SEQ ID NO: 461271 - RNA, 14 nt, Chlamydia trachomatis
cuucauuuuugcua

SEQ ID NO: 461272 - RNA, 21 nt, Chlamydia trachomatis
cuucauacgagccuguuucuu

SEQ ID NO: 461273 - RNA, 17 nt, Chlamydia trachomatis
cuucaguuugaaucaca

SEQ ID NO: 461274 - RNA, 22 nt, Chlamydia trachomatis
cuucacuuccucucucucaccg

SEQ ID NO: 461275 - RNA, 17 nt, Chlamydia trachomatis
cuucagaaaucuucuua

SEQ ID NO: 461276 - RNA, 18 nt, Chlamydia trachomatis
cuucagaaaucuucuuau

SEQ ID NO: 461277 - RNA, 13 nt, Chlamydia trachomatis
cuucaaagaacaa

SEQ ID NO: 461278 - RNA, 20 nt, Chlamydia trachomatis
cuucaauaacgauaguacaa

SEQ ID NO: 461279 - RNA, 19 nt, Chlamydia trachomatis
cuucaauaauguugaaguc

SEQ ID NO: 461280 - RNA, 18 nt, Chlamydia trachomatis
cuucaauacgacagcaca

SEQ ID NO: 461281 - RNA, 21 nt, Chlamydia trachomatis
cuucacaccagcggacaaguc

SEQ ID NO: 461282 - RNA, 23 nt, Chlamydia trachomatis
cuucacaccagcggacaaguccu

SEQ ID NO: 461283 - RNA, 12 nt, Chlamydia trachomatis
cuucaauuucuu

SEQ ID NO: 461284 - RNA, 22 nt, Chlamydia trachomatis
cuuccacagaaguuguuggagu

SEQ ID NO: 461285 - RNA, 15 nt, Chlamydia trachomatis
aaacuuacuuuucuu

SEQ ID NO: 461286 - RNA, 15 nt, Chlamydia trachomatis
cuucccacucauccu

SEQ ID NO: 461287 - RNA, 15 nt, Chlamydia trachomatis
cuuccccaaagcagu

SEQ ID NO: 461288 - RNA, 13 nt, Chlamydia trachomatis
cuuccucuccuuc

SEQ ID NO: 461289 - RNA, 14 nt, Chlamydia trachomatis
cuuccucucucuca

SEQ ID NO: 461290 - RNA, 17 nt, Chlamydia trachomatis
cuucgcaggggaauaca

SEQ ID NO: 461291 - RNA, 15 nt, Chlamydia trachomatis
cuuuaccgacuucaa

SEQ ID NO: 461292 - RNA, 14 nt, Chlamydia trachomatis
cuuuaacaagacaa

SEQ ID NO: 461293 - RNA, 16 nt, Chlamydia trachomatis
cuuuaauaauaagagc

SEQ ID NO: 461294 - RNA, 13 nt, Chlamydia trachomatis
cuuuaauauuucc

SEQ ID NO: 461295 - RNA, 14 nt, Chlamydia trachomatis
cuuuaauauuuccc

SEQ ID NO: 461296 - RNA, 17 nt, Chlamydia trachomatis
cuucggcagaagcugca

SEQ ID NO: 461297 - RNA, 21 nt, Chlamydia trachomatis
cuucggcagaagcugcagaga

SEQ ID NO: 461298 - RNA, 16 nt, Chlamydia trachomatis
aaagaccauaguugca

SEQ ID NO: 461299 - RNA, 16 nt, Chlamydia trachomatis
cuuuauugaacccaua

SEQ ID NO: 461300 - RNA, 20 nt, Chlamydia trachomatis
cuuuauugaacccauagauu

SEQ ID NO: 461301 - RNA, 16 nt, Chlamydia trachomatis
cuuucaauagcauuuc

SEQ ID NO: 461302 - RNA, 23 nt, Chlamydia trachomatis
cuuucaauagcauuucugccaaa

SEQ ID NO: 461303 - RNA, 17 nt, Chlamydia trachomatis
cuuucacauuaucucga

SEQ ID NO: 461304 - RNA, 18 nt, Chlamydia trachomatis
cuuuagaauccaaagucu

SEQ ID NO: 461305 - RNA, 19 nt, Chlamydia trachomatis
cuuuagauagucuucuacc

SEQ ID NO: 461306 - RNA, 21 nt, Chlamydia trachomatis
cuuuagauagucuucuaccgc

SEQ ID NO: 461307 - RNA, 22 nt, Chlamydia trachomatis
cuuuagcaaacuuuuuguaggu

SEQ ID NO: 461308 - RNA, 21 nt, Chlamydia trachomatis
cuuuagcucgcuucaaaacua

SEQ ID NO: 461309 - RNA, 16 nt, Chlamydia trachomatis
cuuuaggagaaagaau

SEQ ID NO: 461310 - RNA, 23 nt, Chlamydia trachomatis
cuuuaucagcgucaucuuugaga

SEQ ID NO: 461311 - RNA, 16 nt, Chlamydia trachomatis
cuuuauccaaagauag

SEQ ID NO: 461312 - RNA, 15 nt, Chlamydia trachomatis
cuuuauuaaacuccc

SEQ ID NO: 461313 - RNA, 12 nt, Chlamydia trachomatis
cuuuauuauuga

SEQ ID NO: 461314 - RNA, 18 nt, Chlamydia trachomatis
cuuucauucguuucuucc

SEQ ID NO: 461315 - RNA, 12 nt, Chlamydia trachomatis
cuuucauucuuu

SEQ ID NO: 461316 - RNA, 15 nt, Chlamydia trachomatis
cuuucaugcgaagca

SEQ ID NO: 461317 - RNA, 18 nt, Chlamydia trachomatis
cuuucccguauuuaccaa

SEQ ID NO: 461318 - RNA, 14 nt, Chlamydia trachomatis
cuuucccuauuuuu

SEQ ID NO: 461319 - RNA, 21 nt, Chlamydia trachomatis
cuuuccgacugcaguugauca

SEQ ID NO: 461320 - RNA, 24 nt, Chlamydia trachomatis
cuuucuaaagcagcuaaccaugcu

SEQ ID NO: 461321 - RNA, 13 nt, Chlamydia trachomatis
cuuucuacauuuu

SEQ ID NO: 461322 - RNA, 15 nt, Chlamydia trachomatis
cuuucucaugcguua

SEQ ID NO: 461323 - RNA, 22 nt, Chlamydia trachomatis
cuuucucgcaauauauccaucu

SEQ ID NO: 461324 - RNA, 16 nt, Chlamydia trachomatis
cuuucuuucuaagaaa

SEQ ID NO: 461325 - RNA, 16 nt, Chlamydia trachomatis
cuuugugcauaaaagc

SEQ ID NO: 461326 - RNA, 20 nt, Chlamydia trachomatis
cuuugugcaaccucuauagc

SEQ ID NO: 461327 - RNA, 22 nt, Chlamydia trachomatis
cuuugugcaaccucuauagcca

SEQ ID NO: 461328 - RNA, 13 nt, Chlamydia trachomatis
cuuuguguaaagc

SEQ ID NO: 461329 - RNA, 13 nt, Chlamydia trachomatis
cuuuguucacaga

SEQ ID NO: 461330 - RNA, 19 nt, Chlamydia trachomatis
cuuuguucucuaaagauuc

SEQ ID NO: 461331 - RNA, 18 nt, Chlamydia trachomatis
cuuuguugcaaacgguag

SEQ ID NO: 461332 - RNA, 16 nt, Chlamydia trachomatis
cuuuguauuaacgauu

SEQ ID NO: 461333 - RNA, 15 nt, Chlamydia trachomatis
cuuugucauuaaagg

SEQ ID NO: 461334 - RNA, 21 nt, Chlamydia trachomatis
cuuugucacaaauuaccccaa

SEQ ID NO: 461335 - RNA, 21 nt, Chlamydia trachomatis
cuuuguauaaugcaaccccca

SEQ ID NO: 461336 - RNA, 20 nt, Chlamydia trachomatis
cuuugcuaucagcauacaga

SEQ ID NO: 461337 - RNA, 15 nt, Chlamydia trachomatis
cuuugcacaccugcu

SEQ ID NO: 461338 - RNA, 18 nt, Chlamydia trachomatis
cuuugauuucugcagaga

SEQ ID NO: 461339 - RNA, 22 nt, Chlamydia trachomatis
cuuugacgauagagaacaucuc

SEQ ID NO: 461340 - RNA, 14 nt, Chlamydia trachomatis
cuuugaucuuuguu

SEQ ID NO: 461341 - RNA, 16 nt, Chlamydia trachomatis
cuuugaucuuuguucu

SEQ ID NO: 461342 - RNA, 14 nt, Chlamydia trachomatis
cuuuugcauuucca

SEQ ID NO: 461343 - RNA, 22 nt, Chlamydia trachomatis
cuuuugccuauagagcaaucuc

SEQ ID NO: 461344 - RNA, 14 nt, Chlamydia trachomatis
aaagacuacagucu

SEQ ID NO: 461345 - RNA, 13 nt, Chlamydia trachomatis
aaagacuaucugu

SEQ ID NO: 461346 - RNA, 22 nt, Chlamydia trachomatis
cuuuucugaaacgcacuccaau

SEQ ID NO: 461347 - RNA, 17 nt, Chlamydia trachomatis
cuuuucugagacuccag

SEQ ID NO: 461348 - RNA, 23 nt, Chlamydia trachomatis
cuuuucugagacuccagcuucuc

SEQ ID NO: 461349 - RNA, 18 nt, Chlamydia trachomatis
cuuuucggugaggaaggc

SEQ ID NO: 461350 - RNA, 19 nt, Chlamydia trachomatis
cuuuucuaacguuccuccu

SEQ ID NO: 461351 - RNA, 15 nt, Chlamydia trachomatis
cuuuucuauuuagag

SEQ ID NO: 461352 - RNA, 17 nt, Chlamydia trachomatis
cuuuucuauuucauuua

SEQ ID NO: 461353 - RNA, 13 nt, Chlamydia trachomatis
cuuuucuauuuuu

SEQ ID NO: 461354 - RNA, 15 nt, Chlamydia trachomatis
cuuuucuauuuuuag

SEQ ID NO: 461355 - RNA, 14 nt, Chlamydia trachomatis
cuuuucuccuucuu

SEQ ID NO: 461356 - RNA, 23 nt, Chlamydia trachomatis
cuuuuccgaauuaaaucugcucc

SEQ ID NO: 461357 - RNA, 13 nt, Chlamydia trachomatis
cuuuuccuccaua

SEQ ID NO: 461358 - RNA, 22 nt, Chlamydia trachomatis
cuuuuccuccauaggaauacga

SEQ ID NO: 461359 - RNA, 10 nt, Chlamydia trachomatis
cuuuuccauu

SEQ ID NO: 461360 - RNA, 17 nt, Chlamydia trachomatis
cuuuuccauuccuccua

SEQ ID NO: 461361 - RNA, 14 nt, Chlamydia trachomatis
cuuuucagcaagaa

SEQ ID NO: 461362 - RNA, 13 nt, Chlamydia trachomatis
cuuuucaaaauga

SEQ ID NO: 461363 - RNA, 16 nt, Chlamydia trachomatis
cuuuucaacaauccac

SEQ ID NO: 461364 - RNA, 16 nt, Chlamydia trachomatis
cuuuucacaaagagaa

SEQ ID NO: 461365 - RNA, 16 nt, Chlamydia trachomatis
cuuuucacaagguguc

SEQ ID NO: 461366 - RNA, 21 nt, Chlamydia trachomatis
cuuuucacaagguguccugua

SEQ ID NO: 461367 - RNA, 17 nt, Chlamydia trachomatis
cuuuuacuuccguuucu

SEQ ID NO: 461368 - RNA, 12 nt, Chlamydia trachomatis
cuuuuucuucuc

SEQ ID NO: 461369 - RNA, 18 nt, Chlamydia trachomatis
cuuuuguuccagaaaaaa

SEQ ID NO: 461370 - RNA, 15 nt, Chlamydia trachomatis
cuuuuguuugcacaa

SEQ ID NO: 461371 - RNA, 14 nt, Chlamydia trachomatis
cuuuuguuuucaaa

SEQ ID NO: 461372 - RNA, 13 nt, Chlamydia trachomatis
cuuuuguuuucuu

SEQ ID NO: 461373 - RNA, 12 nt, Chlamydia trachomatis
gaaaaagucaag

SEQ ID NO: 461374 - RNA, 15 nt, Chlamydia trachomatis
gaaaaauaaaaauag

SEQ ID NO: 461375 - RNA, 23 nt, Chlamydia trachomatis
cuuuuuuugcucaaugauaguga

SEQ ID NO: 461376 - RNA, 12 nt, Chlamydia trachomatis
gaaaaaaaacca

SEQ ID NO: 461377 - RNA, 14 nt, Chlamydia trachomatis
gaaaaaaccacaga

SEQ ID NO: 461378 - RNA, 17 nt, Chlamydia trachomatis
gaaaagacucucccucu

SEQ ID NO: 461379 - RNA, 19 nt, Chlamydia trachomatis
gaaaagaguuugugauuua

SEQ ID NO: 461380 - RNA, 14 nt, Chlamydia trachomatis
gaaaauacacagca

SEQ ID NO: 461381 - RNA, 17 nt, Chlamydia trachomatis
gaaaauacacagcauca

SEQ ID NO: 461382 - RNA, 21 nt, Chlamydia trachomatis
gaaaauacacagcaucaagaa

SEQ ID NO: 461383 - RNA, 16 nt, Chlamydia trachomatis
gaaaaucauacauccu

SEQ ID NO: 461384 - RNA, 19 nt, Chlamydia trachomatis
gaaaaucauacauccuaca

SEQ ID NO: 461385 - RNA, 14 nt, Chlamydia trachomatis
gaaaacgauaaaaa

SEQ ID NO: 461386 - RNA, 17 nt, Chlamydia trachomatis
gaaaaugaugaaaaaga

SEQ ID NO: 461387 - RNA, 18 nt, Chlamydia trachomatis
gaaacuauugaucaaagu

SEQ ID NO: 461388 - RNA, 16 nt, Chlamydia trachomatis
gaaaaucuauuuucga

SEQ ID NO: 461389 - RNA, 21 nt, Chlamydia trachomatis
gaaagauuugaucuucuggaa

SEQ ID NO: 461390 - RNA, 22 nt, Chlamydia trachomatis
gaaagauuugaucuucuggaau

SEQ ID NO: 461391 - RNA, 14 nt, Chlamydia trachomatis
gaaacuuggucagc

SEQ ID NO: 461392 - RNA, 21 nt, Chlamydia trachomatis
gaaacuugguugcccuuccga

SEQ ID NO: 461393 - RNA, 12 nt, Chlamydia trachomatis
gaaacugaaaga

SEQ ID NO: 461394 - RNA, 18 nt, Chlamydia trachomatis
gaaacucaucuucggaca

SEQ ID NO: 461395 - RNA, 19 nt, Chlamydia trachomatis
gaaacucaucuucggacau

SEQ ID NO: 461396 - RNA, 20 nt, Chlamydia trachomatis
gaaacuguaauguccucuuu

SEQ ID NO: 461397 - RNA, 23 nt, Chlamydia trachomatis
gaaacugucggugaaagcuagaa

SEQ ID NO: 461398 - RNA, 19 nt, Chlamydia trachomatis
gaaauccuaaaaaaaacca

SEQ ID NO: 461399 - RNA, 20 nt, Chlamydia trachomatis
gaaaucaaaaggccaacgca

SEQ ID NO: 461400 - RNA, 20 nt, Chlamydia trachomatis
gaaauagcuaucaauaaaga

SEQ ID NO: 461401 - RNA, 21 nt, Chlamydia trachomatis
gaaagcuauuuucuuccugcu

SEQ ID NO: 461402 - RNA, 15 nt, Chlamydia trachomatis
gaaagguuuuucuua

SEQ ID NO: 461403 - RNA, 14 nt, Chlamydia trachomatis
gaaauaaagaucuu

SEQ ID NO: 461404 - RNA, 14 nt, Chlamydia trachomatis
gaaauaacaaagca

SEQ ID NO: 461405 - RNA, 21 nt, Chlamydia trachomatis
gaaauaaccuaggagcauucc

SEQ ID NO: 461406 - RNA, 14 nt, Chlamydia trachomatis
gaaaucuucuuaua

SEQ ID NO: 461407 - RNA, 16 nt, Chlamydia trachomatis
gaaaucuugugcuaag

SEQ ID NO: 461408 - RNA, 20 nt, Chlamydia trachomatis
gaaaucuuuuacuggagaac

SEQ ID NO: 461409 - RNA, 14 nt, Chlamydia trachomatis
gaaaugaaggccaa

SEQ ID NO: 461410 - RNA, 12 nt, Chlamydia trachomatis
gaaauuacagaa

SEQ ID NO: 461411 - RNA, 11 nt, Chlamydia trachomatis
aaagagaacac

SEQ ID NO: 461412 - RNA, 16 nt, Chlamydia trachomatis
aaagagaagaaggcuu

SEQ ID NO: 461413 - RNA, 12 nt, Chlamydia trachomatis
aaagagaaggcc

SEQ ID NO: 461414 - RNA, 20 nt, Chlamydia trachomatis
aaagagagaggagaaaaacu

SEQ ID NO: 461415 - RNA, 15 nt, Chlamydia trachomatis
gaaauuuuaaauccc

SEQ ID NO: 461416 - RNA, 23 nt, Chlamydia trachomatis
gaaauugauagugaaauaagucu

SEQ ID NO: 461417 - RNA, 23 nt, Chlamydia trachomatis
gaaauucucggccuuaacaugau

SEQ ID NO: 461418 - RNA, 19 nt, Chlamydia trachomatis
aaagagcauaauaucccca

SEQ ID NO: 461419 - RNA, 18 nt, Chlamydia trachomatis
gaaauucaucaugagaac

SEQ ID NO: 461420 - RNA, 22 nt, Chlamydia trachomatis
gaacaagugcagcguucugaga

SEQ ID NO: 461421 - RNA, 14 nt, Chlamydia trachomatis
gaacaauaucuguu

SEQ ID NO: 461422 - RNA, 16 nt, Chlamydia trachomatis
gaaauugcucaggaau

SEQ ID NO: 461423 - RNA, 19 nt, Chlamydia trachomatis
gaacaaaacuugucuaaaa

SEQ ID NO: 461424 - RNA, 23 nt, Chlamydia trachomatis
gaacaaacgaaggagcuuugauu

SEQ ID NO: 461425 - RNA, 17 nt, Chlamydia trachomatis
gaacaaucuggagcuaa

SEQ ID NO: 461426 - RNA, 22 nt, Chlamydia trachomatis
gaacauaacaaggcuuuuccau

SEQ ID NO: 461427 - RNA, 15 nt, Chlamydia trachomatis
gaacagcagcagugc

SEQ ID NO: 461428 - RNA, 14 nt, Chlamydia trachomatis
gaacauuuaucgua

SEQ ID NO: 461429 - RNA, 22 nt, Chlamydia trachomatis
gaaccaaacgauuauguucugu

SEQ ID NO: 461430 - RNA, 12 nt, Chlamydia trachomatis
gaaccacaaaau

SEQ ID NO: 461431 - RNA, 13 nt, Chlamydia trachomatis
gaaccgcaagcaa

SEQ ID NO: 461432 - RNA, 15 nt, Chlamydia trachomatis
gaaccgggauugcug

SEQ ID NO: 461433 - RNA, 20 nt, Chlamydia trachomatis
gaaccgggauugcugaaaca

SEQ ID NO: 461434 - RNA, 14 nt, Chlamydia trachomatis
gaaccuccauaaga

SEQ ID NO: 461435 - RNA, 16 nt, Chlamydia trachomatis
gaaccucaauagcuga

SEQ ID NO: 461436 - RNA, 13 nt, Chlamydia trachomatis
gaacgagaaaaag

SEQ ID NO: 461437 - RNA, 14 nt, Chlamydia trachomatis
gaacgggaaaugcu

SEQ ID NO: 461438 - RNA, 22 nt, Chlamydia trachomatis
gaacgugaaaacgucucccccu

SEQ ID NO: 461439 - RNA, 19 nt, Chlamydia trachomatis
gaacucaaaauaaagaaau

SEQ ID NO: 461440 - RNA, 14 nt, Chlamydia trachomatis
gaacucuacaaaau

SEQ ID NO: 461441 - RNA, 17 nt, Chlamydia trachomatis
gaacucuacaaaauaaa

SEQ ID NO: 461442 - RNA, 14 nt, Chlamydia trachomatis
gaacucuccucucc

SEQ ID NO: 461443 - RNA, 12 nt, Chlamydia trachomatis
gaacucuuuccu

SEQ ID NO: 461444 - RNA, 16 nt, Chlamydia trachomatis
gaacuuauuggugagu

SEQ ID NO: 461445 - RNA, 19 nt, Chlamydia trachomatis
gaacuuauuggugagugca

SEQ ID NO: 461446 - RNA, 20 nt, Chlamydia trachomatis
gaacuuuauuauugaaaaag

SEQ ID NO: 461447 - RNA, 19 nt, Chlamydia trachomatis
aaagaggcuucgauaagaa

SEQ ID NO: 461448 - RNA, 23 nt, Chlamydia trachomatis
aaagaggcuucgauaagaaaaaa

SEQ ID NO: 461449 - RNA, 17 nt, Chlamydia trachomatis
gaagacgcuuuagcuaa

SEQ ID NO: 461450 - RNA, 17 nt, Chlamydia trachomatis
gaagacuaaucuuccag

SEQ ID NO: 461451 - RNA, 23 nt, Chlamydia trachomatis
gaagaaauccccagucucuccau

SEQ ID NO: 461452 - RNA, 20 nt, Chlamydia trachomatis
gaagaacacacuuuccccau

SEQ ID NO: 461453 - RNA, 14 nt, Chlamydia trachomatis
gaagaacagcagca

SEQ ID NO: 461454 - RNA, 17 nt, Chlamydia trachomatis
gaagaacccucuucaua

SEQ ID NO: 461455 - RNA, 13 nt, Chlamydia trachomatis
gaagaaccgaauu

SEQ ID NO: 461456 - RNA, 20 nt, Chlamydia trachomatis
gaagaacucccccuuucaaa

SEQ ID NO: 461457 - RNA, 17 nt, Chlamydia trachomatis
gaagaacugcagugaca

SEQ ID NO: 461458 - RNA, 21 nt, Chlamydia trachomatis
aaagagggguucuauaaauga

SEQ ID NO: 461459 - RNA, 15 nt, Chlamydia trachomatis
aaagaguaagugcua

SEQ ID NO: 461460 - RNA, 19 nt, Chlamydia trachomatis
aaagagucgcuucuggcga

SEQ ID NO: 461461 - RNA, 18 nt, Chlamydia trachomatis
aaagagucuucaucaaua

SEQ ID NO: 461462 - RNA, 14 nt, Chlamydia trachomatis
aaagaguuucuuug

SEQ ID NO: 461463 - RNA, 17 nt, Chlamydia trachomatis
aaagaguuucuuuguuc

SEQ ID NO: 461464 - RNA, 14 nt, Chlamydia trachomatis
aaagauaacacucu

SEQ ID NO: 461465 - RNA, 22 nt, Chlamydia trachomatis
aaagauaacacucucaucuaaa

SEQ ID NO: 461466 - RNA, 18 nt, Chlamydia trachomatis
gaagauaauggcaaaaau

SEQ ID NO: 461467 - RNA, 21 nt, Chlamydia trachomatis
gaagauaguagagaauuagag

SEQ ID NO: 461468 - RNA, 21 nt, Chlamydia trachomatis
gaagaggcgcccacagaacau

SEQ ID NO: 461469 - RNA, 20 nt, Chlamydia trachomatis
gaagaggguuuggauggagg

SEQ ID NO: 461470 - RNA, 15 nt, Chlamydia trachomatis
gaagagguauguuug

SEQ ID NO: 461471 - RNA, 13 nt, Chlamydia trachomatis
gaagagucucuaa

SEQ ID NO: 461472 - RNA, 16 nt, Chlamydia trachomatis
gaagaguuuguagaug

SEQ ID NO: 461473 - RNA, 15 nt, Chlamydia trachomatis
gaagauaaccaagcu

SEQ ID NO: 461474 - RNA, 14 nt, Chlamydia trachomatis
gaagcgcucuccuc

SEQ ID NO: 461475 - RNA, 15 nt, Chlamydia trachomatis
gaagcggagcaucuu

SEQ ID NO: 461476 - RNA, 20 nt, Chlamydia trachomatis
gaagcggcauggaucuccag

SEQ ID NO: 461477 - RNA, 22 nt, Chlamydia trachomatis
gaaggaauggguaggauuacaa

SEQ ID NO: 461478 - RNA, 22 nt, Chlamydia trachomatis
gaaggaaugguuacuugccucu

SEQ ID NO: 461479 - RNA, 16 nt, Chlamydia trachomatis
gaaggagauguuaucu

SEQ ID NO: 461480 - RNA, 15 nt, Chlamydia trachomatis
gaaggagugugaucg

SEQ ID NO: 461481 - RNA, 19 nt, Chlamydia trachomatis
gaaggaaagcuaugcccag

SEQ ID NO: 461482 - RNA, 15 nt, Chlamydia trachomatis
gaaggaaaaagaaaa

SEQ ID NO: 461483 - RNA, 14 nt, Chlamydia trachomatis
gaaggaucuaugaa

SEQ ID NO: 461484 - RNA, 13 nt, Chlamydia trachomatis
gaagguaagaaag

SEQ ID NO: 461485 - RNA, 17 nt, Chlamydia trachomatis
gaaggguuuugaagcuu

SEQ ID NO: 461486 - RNA, 19 nt, Chlamydia trachomatis
gaagguauuuuagagaaaa

SEQ ID NO: 461487 - RNA, 20 nt, Chlamydia trachomatis
gaagguauuuuagagaaaag

SEQ ID NO: 461488 - RNA, 13 nt, Chlamydia trachomatis
gaaguuuucccag

SEQ ID NO: 461489 - RNA, 16 nt, Chlamydia trachomatis
gaaguucccuuuuguu

SEQ ID NO: 461490 - RNA, 20 nt, Chlamydia trachomatis
aaagaucgguucauaaaauu

SEQ ID NO: 461491 - RNA, 17 nt, Chlamydia trachomatis
gaagucuuguccuuccc

SEQ ID NO: 461492 - RNA, 18 nt, Chlamydia trachomatis
gaauaaaacauuuuauua

SEQ ID NO: 461493 - RNA, 17 nt, Chlamydia trachomatis
gaauaaaaucaaauaaa

SEQ ID NO: 461494 - RNA, 19 nt, Chlamydia trachomatis
gaauaaaaucaaauaaagc

SEQ ID NO: 461495 - RNA, 14 nt, Chlamydia trachomatis
gaauaaacaacaug

SEQ ID NO: 461496 - RNA, 17 nt, Chlamydia trachomatis
gaauaacguagauaucu

SEQ ID NO: 461497 - RNA, 20 nt, Chlamydia trachomatis
gaauaacguagauaucuuua

SEQ ID NO: 461498 - RNA, 21 nt, Chlamydia trachomatis
gaauaagcgaaaaaaaaagaa

SEQ ID NO: 461499 - RNA, 21 nt, Chlamydia trachomatis
gaauaagguauccaacaauau

SEQ ID NO: 461500 - RNA, 20 nt, Chlamydia trachomatis
gaauaaguccacaauggccg

SEQ ID NO: 461501 - RNA, 18 nt, Chlamydia trachomatis
gaauaaguuguaaagcau

SEQ ID NO: 461502 - RNA, 18 nt, Chlamydia trachomatis
gaauaauagaaaaacuau

SEQ ID NO: 461503 - RNA, 13 nt, Chlamydia trachomatis
gaauaauagagac

SEQ ID NO: 461504 - RNA, 15 nt, Chlamydia trachomatis
gaauaccaaaauccu

SEQ ID NO: 461505 - RNA, 14 nt, Chlamydia trachomatis
gaaucauaaggaag

SEQ ID NO: 461506 - RNA, 16 nt, Chlamydia trachomatis
gaaucauaaggaagau

SEQ ID NO: 461507 - RNA, 15 nt, Chlamydia trachomatis
gaaucauugggaaaa

SEQ ID NO: 461508 - RNA, 19 nt, Chlamydia trachomatis
gaaucaauauccacuuuua

SEQ ID NO: 461509 - RNA, 16 nt, Chlamydia trachomatis
gaaucaauuucuagaa

SEQ ID NO: 461510 - RNA, 16 nt, Chlamydia trachomatis
gaaucacagaaacuuc

SEQ ID NO: 461511 - RNA, 14 nt, Chlamydia trachomatis
gaaucacaugcuca

SEQ ID NO: 461512 - RNA, 12 nt, Chlamydia trachomatis
gaaucaaaaagu

SEQ ID NO: 461513 - RNA, 13 nt, Chlamydia trachomatis
gaaucaaaaaguu

SEQ ID NO: 461514 - RNA, 20 nt, Chlamydia trachomatis
gaaucaaaggaugucuaucu

SEQ ID NO: 461515 - RNA, 21 nt, Chlamydia trachomatis
gaaugacuuaacgugucgaaa

SEQ ID NO: 461516 - RNA, 22 nt, Chlamydia trachomatis
gaaugaauuuccccugcagccu

SEQ ID NO: 461517 - RNA, 19 nt, Chlamydia trachomatis
gaaucuucuucggaaagca

SEQ ID NO: 461518 - RNA, 14 nt, Chlamydia trachomatis
gaaucuuugaagcg

SEQ ID NO: 461519 - RNA, 18 nt, Chlamydia trachomatis
gaaucgcccuuauuggua

SEQ ID NO: 461520 - RNA, 20 nt, Chlamydia trachomatis
gaaucuguguugcaaagaga

SEQ ID NO: 461521 - RNA, 23 nt, Chlamydia trachomatis
gaauccuggaguauuuucaaaaa

SEQ ID NO: 461522 - RNA, 13 nt, Chlamydia trachomatis
gaauccuuuucag

SEQ ID NO: 461523 - RNA, 13 nt, Chlamydia trachomatis
gaaugagcuuaga

SEQ ID NO: 461524 - RNA, 15 nt, Chlamydia trachomatis
gaaugccuguggcaa

SEQ ID NO: 461525 - RNA, 20 nt, Chlamydia trachomatis
gaaugguucuuagcgcuugu

SEQ ID NO: 461526 - RNA, 23 nt, Chlamydia trachomatis
gaauuuuucucacuuagcuauug

SEQ ID NO: 461527 - RNA, 13 nt, Chlamydia trachomatis
gacaaaaagaaag

SEQ ID NO: 461528 - RNA, 20 nt, Chlamydia trachomatis
gaauuuauaauccaggagac

SEQ ID NO: 461529 - RNA, 14 nt, Chlamydia trachomatis
gaauuaauaauucc

SEQ ID NO: 461530 - RNA, 23 nt, Chlamydia trachomatis
gaauuacccugaaagacuuucca

SEQ ID NO: 461531 - RNA, 21 nt, Chlamydia trachomatis
gaauuacucugccuaggaaug

SEQ ID NO: 461532 - RNA, 10 nt, Chlamydia trachomatis
gaauuacuug

SEQ ID NO: 461533 - RNA, 11 nt, Chlamydia trachomatis
gaauuagguaa

SEQ ID NO: 461534 - RNA, 12 nt, Chlamydia trachomatis
gaauuauuugcc

SEQ ID NO: 461535 - RNA, 21 nt, Chlamydia trachomatis
gacaacgauauaaagaagacu

SEQ ID NO: 461536 - RNA, 21 nt, Chlamydia trachomatis
gacaauggucuccuaaauccu

SEQ ID NO: 461537 - RNA, 20 nt, Chlamydia trachomatis
gacagagcccuucuuuuccu

SEQ ID NO: 461538 - RNA, 16 nt, Chlamydia trachomatis
gacagcccaagaucuu

SEQ ID NO: 461539 - RNA, 17 nt, Chlamydia trachomatis
gacagcccaagaucuuc

SEQ ID NO: 461540 - RNA, 17 nt, Chlamydia trachomatis
gacagguuucaugacau

SEQ ID NO: 461541 - RNA, 13 nt, Chlamydia trachomatis
gacaggcuauuga

SEQ ID NO: 461542 - RNA, 12 nt, Chlamydia trachomatis
gacaggcagcag

SEQ ID NO: 461543 - RNA, 16 nt, Chlamydia trachomatis
gacaucgaaaaucacu

SEQ ID NO: 461544 - RNA, 19 nt, Chlamydia trachomatis
gaccaauaccuacacgaua

SEQ ID NO: 461545 - RNA, 22 nt, Chlamydia trachomatis
gaccaauaccuacacgauauau

SEQ ID NO: 461546 - RNA, 21 nt, Chlamydia trachomatis
gaccagcgcuuucuaaagcag

SEQ ID NO: 461547 - RNA, 12 nt, Chlamydia trachomatis
gaccaucuucac

SEQ ID NO: 461548 - RNA, 21 nt, Chlamydia trachomatis
gaccugcuucagcagcauaaa

SEQ ID NO: 461549 - RNA, 20 nt, Chlamydia trachomatis
gaccuugccaucauuaucuu

SEQ ID NO: 461550 - RNA, 21 nt, Chlamydia trachomatis
gaccuuucccucguaauaacu

SEQ ID NO: 461551 - RNA, 20 nt, Chlamydia trachomatis
gacgaaauagguccucuaau

SEQ ID NO: 461552 - RNA, 17 nt, Chlamydia trachomatis
gacggaacucuuuauua

SEQ ID NO: 461553 - RNA, 23 nt, Chlamydia trachomatis
gacggaauuuuucucacuuagcu

SEQ ID NO: 461554 - RNA, 15 nt, Chlamydia trachomatis
gacuaaguuguaaaa

SEQ ID NO: 461555 - RNA, 13 nt, Chlamydia trachomatis
gacuauuucuucu

SEQ ID NO: 461556 - RNA, 15 nt, Chlamydia trachomatis
gacuauuucuucuag

SEQ ID NO: 461557 - RNA, 17 nt, Chlamydia trachomatis
gacuauuuucaaaaccu

SEQ ID NO: 461558 - RNA, 17 nt, Chlamydia trachomatis
gagauugcaacucuugc

SEQ ID NO: 461559 - RNA, 19 nt, Chlamydia trachomatis
gagauuuccagcuucugaa

SEQ ID NO: 461560 - RNA, 21 nt, Chlamydia trachomatis
gagaucugacugaugucaauu

SEQ ID NO: 461561 - RNA, 17 nt, Chlamydia trachomatis
gagauguuuguguuucu

SEQ ID NO: 461562 - RNA, 13 nt, Chlamydia trachomatis
gagaggauuaagg

SEQ ID NO: 461563 - RNA, 11 nt, Chlamydia trachomatis
gagaggauucc

SEQ ID NO: 461564 - RNA, 21 nt, Chlamydia trachomatis
gacucaaacugugaagaauga

SEQ ID NO: 461565 - RNA, 21 nt, Chlamydia trachomatis
gacucaucaaaaugaucuaaa

SEQ ID NO: 461566 - RNA, 19 nt, Chlamydia trachomatis
gagcaauauguuauacgca

SEQ ID NO: 461567 - RNA, 15 nt, Chlamydia trachomatis
gagcaacuucuaaga

SEQ ID NO: 461568 - RNA, 19 nt, Chlamydia trachomatis
gagcaacuucuaagagccc

SEQ ID NO: 461569 - RNA, 13 nt, Chlamydia trachomatis
gagcaaagcuauu

SEQ ID NO: 461570 - RNA, 17 nt, Chlamydia trachomatis
gagcaaauagaauaaaa

SEQ ID NO: 461571 - RNA, 23 nt, Chlamydia trachomatis
gagcaaccuuuccuguauaagaa

SEQ ID NO: 461572 - RNA, 18 nt, Chlamydia trachomatis
gagcauuugccaaugaaa

SEQ ID NO: 461573 - RNA, 16 nt, Chlamydia trachomatis
gagccaaaaaguccgc

SEQ ID NO: 461574 - RNA, 14 nt, Chlamydia trachomatis
gagcauuccuucua

SEQ ID NO: 461575 - RNA, 13 nt, Chlamydia trachomatis
gagcauucugagc

SEQ ID NO: 461576 - RNA, 13 nt, Chlamydia trachomatis
aaagcacaauaac

SEQ ID NO: 461577 - RNA, 18 nt, Chlamydia trachomatis
aaagcacaauaacagcac

SEQ ID NO: 461578 - RNA, 16 nt, Chlamydia trachomatis
aaagcacgauaaaaga

SEQ ID NO: 461579 - RNA, 20 nt, Chlamydia trachomatis
aaagcacugcguauuugaaa

SEQ ID NO: 461580 - RNA, 15 nt, Chlamydia trachomatis
aaagcagaaacagcu

SEQ ID NO: 461581 - RNA, 22 nt, Chlamydia trachomatis
gagccuaugcaaccuucuccaa

SEQ ID NO: 461582 - RNA, 14 nt, Chlamydia trachomatis
gagcgaugagcuua

SEQ ID NO: 461583 - RNA, 20 nt, Chlamydia trachomatis
gagcgauaccugucccugcu

SEQ ID NO: 461584 - RNA, 15 nt, Chlamydia trachomatis
gagcgauagaauuuc

SEQ ID NO: 461585 - RNA, 15 nt, Chlamydia trachomatis
gagcgccuucaauac

SEQ ID NO: 461586 - RNA, 22 nt, Chlamydia trachomatis
gagcgucuuuucacaagguguc

SEQ ID NO: 461587 - RNA, 21 nt, Chlamydia trachomatis
gagcuaagaaaauaaacacaa

SEQ ID NO: 461588 - RNA, 12 nt, Chlamydia trachomatis
gagcuacaggaa

SEQ ID NO: 461589 - RNA, 21 nt, Chlamydia trachomatis
gagcuauaccgccucaaacaa

SEQ ID NO: 461590 - RNA, 19 nt, Chlamydia trachomatis
gagcuaucauuuccaaaau

SEQ ID NO: 461591 - RNA, 19 nt, Chlamydia trachomatis
gagcuccaggaaaagcuuu

SEQ ID NO: 461592 - RNA, 20 nt, Chlamydia trachomatis
gagcgguugcacaaauccag

SEQ ID NO: 461593 - RNA, 23 nt, Chlamydia trachomatis
gagcuuuuuuucacuguuuuugc

SEQ ID NO: 461594 - RNA, 17 nt, Chlamydia trachomatis
gaggaaauauugaucuc

SEQ ID NO: 461595 - RNA, 13 nt, Chlamydia trachomatis
gagcugagucuug

SEQ ID NO: 461596 - RNA, 17 nt, Chlamydia trachomatis
gaggcaugauuuccuga

SEQ ID NO: 461597 - RNA, 18 nt, Chlamydia trachomatis
gaggagcuugagagcauu

SEQ ID NO: 461598 - RNA, 13 nt, Chlamydia trachomatis
gaggagaacucuu

SEQ ID NO: 461599 - RNA, 15 nt, Chlamydia trachomatis
gaggacuuucuuuaa

SEQ ID NO: 461600 - RNA, 12 nt, Chlamydia trachomatis
gaggagaggcua

SEQ ID NO: 461601 - RNA, 15 nt, Chlamydia trachomatis
gaggagauauucagg

SEQ ID NO: 461602 - RNA, 15 nt, Chlamydia trachomatis
gaggcgaaaguuucc

SEQ ID NO: 461603 - RNA, 15 nt, Chlamydia trachomatis
gagguauguuuggau

SEQ ID NO: 461604 - RNA, 17 nt, Chlamydia trachomatis
gagguauuuagaguucc

SEQ ID NO: 461605 - RNA, 12 nt, Chlamydia trachomatis
gaggguuuggau

SEQ ID NO: 461606 - RNA, 20 nt, Chlamydia trachomatis
gaguaagccggauucugucg

SEQ ID NO: 461607 - RNA, 16 nt, Chlamydia trachomatis
gaguaaucaaaaaagg

SEQ ID NO: 461608 - RNA, 20 nt, Chlamydia trachomatis
gaguaaucggauagagaaga

SEQ ID NO: 461609 - RNA, 24 nt, Chlamydia trachomatis
gaguaaucggauagagaagaauug

SEQ ID NO: 461610 - RNA, 14 nt, Chlamydia trachomatis
gaguagagcucuuc

SEQ ID NO: 461611 - RNA, 16 nt, Chlamydia trachomatis
gaguguguaguuaucu

SEQ ID NO: 461612 - RNA, 20 nt, Chlamydia trachomatis
gaguguaggguagaacaggu

SEQ ID NO: 461613 - RNA, 16 nt, Chlamydia trachomatis
gagugcauagcuuguu

SEQ ID NO: 461614 - RNA, 20 nt, Chlamydia trachomatis
gagugacuagccaauacgaa

SEQ ID NO: 461615 - RNA, 24 nt, Chlamydia trachomatis
gauaaacucggguuuuaaaugcuu

SEQ ID NO: 461616 - RNA, 15 nt, Chlamydia trachomatis
gauaacgaagcaaaa

SEQ ID NO: 461617 - RNA, 10 nt, Chlamydia trachomatis
gaguucuccu

SEQ ID NO: 461618 - RNA, 20 nt, Chlamydia trachomatis
gaguucuccucccagauuuu

SEQ ID NO: 461619 - RNA, 16 nt, Chlamydia trachomatis
gaguucguuaggauuc

SEQ ID NO: 461620 - RNA, 20 nt, Chlamydia trachomatis
gaguuguuugggcugcugcu

SEQ ID NO: 461621 - RNA, 17 nt, Chlamydia trachomatis
gauaagaugcuugauuu

SEQ ID NO: 461622 - RNA, 19 nt, Chlamydia trachomatis
gauaagaagguugaauuuc

SEQ ID NO: 461623 - RNA, 18 nt, Chlamydia trachomatis
gauacgaaggaucuucca

SEQ ID NO: 461624 - RNA, 14 nt, Chlamydia trachomatis
gauaagcucuagga

SEQ ID NO: 461625 - RNA, 18 nt, Chlamydia trachomatis
gauaccugucccugcucc

SEQ ID NO: 461626 - RNA, 16 nt, Chlamydia trachomatis
gauagaauuucuuccu

SEQ ID NO: 461627 - RNA, 11 nt, Chlamydia trachomatis
gauagaaaaaa

SEQ ID NO: 461628 - RNA, 14 nt, Chlamydia trachomatis
gauacggacuucuu

SEQ ID NO: 461629 - RNA, 16 nt, Chlamydia trachomatis
gauaggaaaugagagc

SEQ ID NO: 461630 - RNA, 20 nt, Chlamydia trachomatis
gauaggaacuacauucgccu

SEQ ID NO: 461631 - RNA, 18 nt, Chlamydia trachomatis
gauaggagaggauuaagg

SEQ ID NO: 461632 - RNA, 20 nt, Chlamydia trachomatis
gauaggagaggauuaaggaa

SEQ ID NO: 461633 - RNA, 18 nt, Chlamydia trachomatis
gauagaggaaacacugua

SEQ ID NO: 461634 - RNA, 16 nt, Chlamydia trachomatis
gauagaguagggaaug

SEQ ID NO: 461635 - RNA, 22 nt, Chlamydia trachomatis
gauagaucuaaagcagaaacaa

SEQ ID NO: 461636 - RNA, 15 nt, Chlamydia trachomatis
gauagcaacaguuuu

SEQ ID NO: 461637 - RNA, 13 nt, Chlamydia trachomatis
gauagucugcauu

SEQ ID NO: 461638 - RNA, 20 nt, Chlamydia trachomatis
gauagucuggagcauaaaga

SEQ ID NO: 461639 - RNA, 22 nt, Chlamydia trachomatis
gauagucaguuaggaaaugagg

SEQ ID NO: 461640 - RNA, 22 nt, Chlamydia trachomatis
gauagguacggcuucauggaau

SEQ ID NO: 461641 - RNA, 20 nt, Chlamydia trachomatis
gauauauagaccagagucuc

SEQ ID NO: 461642 - RNA, 21 nt, Chlamydia trachomatis
gauauauagaccagagucucc

SEQ ID NO: 461643 - RNA, 15 nt, Chlamydia trachomatis
gauaucuucuugaau

SEQ ID NO: 461644 - RNA, 22 nt, Chlamydia trachomatis
gauaucuuuacucuuuucuuua

SEQ ID NO: 461645 - RNA, 17 nt, Chlamydia trachomatis
gauaugcaaguaaugac

SEQ ID NO: 461646 - RNA, 23 nt, Chlamydia trachomatis
gauaugcagcauccaauagaguu

SEQ ID NO: 461647 - RNA, 24 nt, Chlamydia trachomatis
gauaugcuacuccuaaaucgcaaa

SEQ ID NO: 461648 - RNA, 15 nt, Chlamydia trachomatis
gaucagcaaaaagag

SEQ ID NO: 461649 - RNA, 19 nt, Chlamydia trachomatis
gaucagcaaaaagaggaga

SEQ ID NO: 461650 - RNA, 19 nt, Chlamydia trachomatis
gaucagcuccuggagaaaa

SEQ ID NO: 461651 - RNA, 14 nt, Chlamydia trachomatis
gaucauagacuguu

SEQ ID NO: 461652 - RNA, 21 nt, Chlamydia trachomatis
gaucauagacuguugaggaga

SEQ ID NO: 461653 - RNA, 22 nt, Chlamydia trachomatis
gaucaugcagaugaagaaucuc

SEQ ID NO: 461654 - RNA, 16 nt, Chlamydia trachomatis
gauccaaggagcuccc

SEQ ID NO: 461655 - RNA, 13 nt, Chlamydia trachomatis
gaucauugaguuc

SEQ ID NO: 461656 - RNA, 16 nt, Chlamydia trachomatis
gauccaaaaaagaauc

SEQ ID NO: 461657 - RNA, 15 nt, Chlamydia trachomatis
gauccagaagcacac

SEQ ID NO: 461658 - RNA, 22 nt, Chlamydia trachomatis
gauccaucauagaagcaagcuu

SEQ ID NO: 461659 - RNA, 19 nt, Chlamydia trachomatis
gaucccaggaucccucugu

SEQ ID NO: 461660 - RNA, 23 nt, Chlamydia trachomatis
gaucccaggaucccucuguccau

SEQ ID NO: 461661 - RNA, 16 nt, Chlamydia trachomatis
gaucccauaaucucau

SEQ ID NO: 461662 - RNA, 17 nt, Chlamydia trachomatis
gauccccacgaccacaa

SEQ ID NO: 461663 - RNA, 20 nt, Chlamydia trachomatis
gauccccacgaccacaaaca

SEQ ID NO: 461664 - RNA, 16 nt, Chlamydia trachomatis
gauccgcuuccugcca

SEQ ID NO: 461665 - RNA, 17 nt, Chlamydia trachomatis
gauccguuuuucuacaa

SEQ ID NO: 461666 - RNA, 20 nt, Chlamydia trachomatis
gauccuccagauacugcucc

SEQ ID NO: 461667 - RNA, 22 nt, Chlamydia trachomatis
aaagcccagaacaacuucucuu

SEQ ID NO: 461668 - RNA, 23 nt, Chlamydia trachomatis
aaagccccuccgcugauuagaaa

SEQ ID NO: 461669 - RNA, 16 nt, Chlamydia trachomatis
gaucgaucccuuuuuc

SEQ ID NO: 461670 - RNA, 21 nt, Chlamydia trachomatis
gaucgagcuucugcauuggua

SEQ ID NO: 461671 - RNA, 18 nt, Chlamydia trachomatis
gaucggagucugcuccac

SEQ ID NO: 461672 - RNA, 18 nt, Chlamydia trachomatis
gaucgguucauaaaauuu

SEQ ID NO: 461673 - RNA, 12 nt, Chlamydia trachomatis
gaucuccuuccu

SEQ ID NO: 461674 - RNA, 21 nt, Chlamydia trachomatis
gaucucccucaccucuugccu

SEQ ID NO: 461675 - RNA, 14 nt, Chlamydia trachomatis
gaucucagcuggcc

SEQ ID NO: 461676 - RNA, 22 nt, Chlamydia trachomatis
gaucucagcuggccaagcaauu

SEQ ID NO: 461677 - RNA, 14 nt, Chlamydia trachomatis
gaucuaugaaaaaa

SEQ ID NO: 461678 - RNA, 19 nt, Chlamydia trachomatis
gaucuacagcaaaaccuuu

SEQ ID NO: 461679 - RNA, 18 nt, Chlamydia trachomatis
gaucuaaagcagaaacaa

SEQ ID NO: 461680 - RNA, 17 nt, Chlamydia trachomatis
gaucuaaaggaaaaauu

SEQ ID NO: 461681 - RNA, 21 nt, Chlamydia trachomatis
gaucuaaaggaaaaauuucuu

SEQ ID NO: 461682 - RNA, 20 nt, Chlamydia trachomatis
gaucugcaucuuuauagaau

SEQ ID NO: 461683 - RNA, 20 nt, Chlamydia trachomatis
gaucuguaacuacaucuaaa

SEQ ID NO: 461684 - RNA, 15 nt, Chlamydia trachomatis
gaucuguaccgaacu

SEQ ID NO: 461685 - RNA, 18 nt, Chlamydia trachomatis
gaucuuauguucagcauc

SEQ ID NO: 461686 - RNA, 17 nt, Chlamydia trachomatis
gaucuucagaaaucuuc

SEQ ID NO: 461687 - RNA, 19 nt, Chlamydia trachomatis
gaucuucagaaaucuucuu

SEQ ID NO: 461688 - RNA, 22 nt, Chlamydia trachomatis
gaucuuccagccuacaaauaaa

SEQ ID NO: 461689 - RNA, 15 nt, Chlamydia trachomatis
gaucuuuacuuucuu

SEQ ID NO: 461690 - RNA, 15 nt, Chlamydia trachomatis
gaucuuuugaagaug

SEQ ID NO: 461691 - RNA, 13 nt, Chlamydia trachomatis
gaugaaaaagaag

SEQ ID NO: 461692 - RNA, 13 nt, Chlamydia trachomatis
gaugaagcuaaaa

SEQ ID NO: 461693 - RNA, 21 nt, Chlamydia trachomatis
gaugaagcuaaaaaauccagg

SEQ ID NO: 461694 - RNA, 15 nt, Chlamydia trachomatis
gaugaccacuacucu

SEQ ID NO: 461695 - RNA, 23 nt, Chlamydia trachomatis
gaugagagcagcuacaaccuggg

SEQ ID NO: 461696 - RNA, 14 nt, Chlamydia trachomatis
gaugaggaauccuc

SEQ ID NO: 461697 - RNA, 19 nt, Chlamydia trachomatis
gaugaggaauccucuuccg

SEQ ID NO: 461698 - RNA, 18 nt, Chlamydia trachomatis
gaugaguuuaucucaucu

SEQ ID NO: 461699 - RNA, 17 nt, Chlamydia trachomatis
aaagccucuuguugaau

SEQ ID NO: 461700 - RNA, 17 nt, Chlamydia trachomatis
aaagccguucccaauaa

SEQ ID NO: 461701 - RNA, 22 nt, Chlamydia trachomatis
aaagccuaucgcacacaauaaa

SEQ ID NO: 461702 - RNA, 14 nt, Chlamydia trachomatis
aaagccuuucucua

SEQ ID NO: 461703 - RNA, 23 nt, Chlamydia trachomatis
aaagccuuucucuaaaagaagag

SEQ ID NO: 461704 - RNA, 13 nt, Chlamydia trachomatis
aaagccuucucuu

SEQ ID NO: 461705 - RNA, 21 nt, Chlamydia trachomatis
gaugauuaucaccuauuaaga

SEQ ID NO: 461706 - RNA, 17 nt, Chlamydia trachomatis
gaugauucccuguagaa

SEQ ID NO: 461707 - RNA, 17 nt, Chlamydia trachomatis
gaugcaauaaacgcuuc

SEQ ID NO: 461708 - RNA, 18 nt, Chlamydia trachomatis
gaugccauccagagcugu

SEQ ID NO: 461709 - RNA, 22 nt, Chlamydia trachomatis
gaugcauagcucgcauuuguag

SEQ ID NO: 461710 - RNA, 20 nt, Chlamydia trachomatis
gaugcgaaugaagaagucua

SEQ ID NO: 461711 - RNA, 14 nt, Chlamydia trachomatis
gaugcuauuuucag

SEQ ID NO: 461712 - RNA, 15 nt, Chlamydia trachomatis
gaugcuccuacaaaa

SEQ ID NO: 461713 - RNA, 16 nt, Chlamydia trachomatis
gaugcuccucucuuug

SEQ ID NO: 461714 - RNA, 14 nt, Chlamydia trachomatis
gaugcugagcauuu

SEQ ID NO: 461715 - RNA, 12 nt, Chlamydia trachomatis
gaugcugcgaug

SEQ ID NO: 461716 - RNA, 13 nt, Chlamydia trachomatis
gauguccaaagcu

SEQ ID NO: 461717 - RNA, 16 nt, Chlamydia trachomatis
gauguccaaagcucuu

SEQ ID NO: 461718 - RNA, 14 nt, Chlamydia trachomatis
gauguacucugcaa

SEQ ID NO: 461719 - RNA, 14 nt, Chlamydia trachomatis
gauguaauuuggau

SEQ ID NO: 461720 - RNA, 16 nt, Chlamydia trachomatis
gaugguuggaagggcu

SEQ ID NO: 461721 - RNA, 16 nt, Chlamydia trachomatis
gauguaaguaagcgcu

SEQ ID NO: 461722 - RNA, 23 nt, Chlamydia trachomatis
gauguaaguaagcgcuuccauuu

SEQ ID NO: 461723 - RNA, 15 nt, Chlamydia trachomatis
gauuacuuuuucuac

SEQ ID NO: 461724 - RNA, 17 nt, Chlamydia trachomatis
gauuagaagauaacaac

SEQ ID NO: 461725 - RNA, 20 nt, Chlamydia trachomatis
gauuacagcaagaagaagag

SEQ ID NO: 461726 - RNA, 21 nt, Chlamydia trachomatis
gauuacagcaagaagaagaga

SEQ ID NO: 461727 - RNA, 23 nt, Chlamydia trachomatis
gauuacagcaagaagaagagaga

SEQ ID NO: 461728 - RNA, 16 nt, Chlamydia trachomatis
gauuaggaagaagugu

SEQ ID NO: 461729 - RNA, 19 nt, Chlamydia trachomatis
gauuaucauucaaaaucca

SEQ ID NO: 461730 - RNA, 16 nt, Chlamydia trachomatis
gauuaucuaaagccau

SEQ ID NO: 461731 - RNA, 16 nt, Chlamydia trachomatis
gauguuccaucuuuuc

SEQ ID NO: 461732 - RNA, 18 nt, Chlamydia trachomatis
gauuaaaguuucuaauaa

SEQ ID NO: 461733 - RNA, 16 nt, Chlamydia trachomatis
gauuaaccaaaagagc

SEQ ID NO: 461734 - RNA, 17 nt, Chlamydia trachomatis
gauucccuuuaaagaaa

SEQ ID NO: 461735 - RNA, 20 nt, Chlamydia trachomatis
gauucccgccuaauaaugaa

SEQ ID NO: 461736 - RNA, 19 nt, Chlamydia trachomatis
gauucgcaucaaugaugua

SEQ ID NO: 461737 - RNA, 19 nt, Chlamydia trachomatis
gauucgguaucugagcuuu

SEQ ID NO: 461738 - RNA, 21 nt, Chlamydia trachomatis
gauuccaguuacccucuuuag

SEQ ID NO: 461739 - RNA, 21 nt, Chlamydia trachomatis
gauucauauuccaaagaaaug

SEQ ID NO: 461740 - RNA, 17 nt, Chlamydia trachomatis
gauucaucaaaauauuu

SEQ ID NO: 461741 - RNA, 23 nt, Chlamydia trachomatis
gauucaucaaaauauuuugcugu

SEQ ID NO: 461742 - RNA, 20 nt, Chlamydia trachomatis
gauugacaacuuucuuuugu

SEQ ID NO: 461743 - RNA, 20 nt, Chlamydia trachomatis
gauucuugaagauuugcaaa

SEQ ID NO: 461744 - RNA, 16 nt, Chlamydia trachomatis
gauucuugauaaauaa

SEQ ID NO: 461745 - RNA, 20 nt, Chlamydia trachomatis
gauucuccuuagauccggcu

SEQ ID NO: 461746 - RNA, 22 nt, Chlamydia trachomatis
gauucucugcacaauauuaucu

SEQ ID NO: 461747 - RNA, 17 nt, Chlamydia trachomatis
gauugagaauaaauaua

SEQ ID NO: 461748 - RNA, 17 nt, Chlamydia trachomatis
gauuggaaaauccaaag

SEQ ID NO: 461749 - RNA, 23 nt, Chlamydia trachomatis
gauuucauggggugugagguuuu

SEQ ID NO: 461750 - RNA, 20 nt, Chlamydia trachomatis
gauuuagacacauucccuaa

SEQ ID NO: 461751 - RNA, 13 nt, Chlamydia trachomatis
gauuuauaaagag

SEQ ID NO: 461752 - RNA, 21 nt, Chlamydia trachomatis
gauuguuguaugcucgccucu

SEQ ID NO: 461753 - RNA, 22 nt, Chlamydia trachomatis
gauuguuucuguaggagagaau

SEQ ID NO: 461754 - RNA, 22 nt, Chlamydia trachomatis
gauuugccuccagcgcacacuu

SEQ ID NO: 461755 - RNA, 17 nt, Chlamydia trachomatis
gauuucuuuaacaucuu

SEQ ID NO: 461756 - RNA, 16 nt, Chlamydia trachomatis
gauuucugaaucccuc

SEQ ID NO: 461757 - RNA, 13 nt, Chlamydia trachomatis
gauuucuucuguu

SEQ ID NO: 461758 - RNA, 21 nt, Chlamydia trachomatis
gauuucgauuaaugagguuuu

SEQ ID NO: 461759 - RNA, 16 nt, Chlamydia trachomatis
gauuuucaucuuccaa

SEQ ID NO: 461760 - RNA, 22 nt, Chlamydia trachomatis
gauuuucuuuaggcauuaaagg

SEQ ID NO: 461761 - RNA, 17 nt, Chlamydia trachomatis
gauuuugaauaauagaa

SEQ ID NO: 461762 - RNA, 23 nt, Chlamydia trachomatis
gauuugucccgugcuugcuuucu

SEQ ID NO: 461763 - RNA, 16 nt, Chlamydia trachomatis
gauuuguguagcuuuu

SEQ ID NO: 461764 - RNA, 17 nt, Chlamydia trachomatis
gauuuugucgauaagaa

SEQ ID NO: 461765 - RNA, 17 nt, Chlamydia trachomatis
gauuuuucuuucaaaga

SEQ ID NO: 461766 - RNA, 14 nt, Chlamydia trachomatis
gcaaaaagcaaucc

SEQ ID NO: 461767 - RNA, 23 nt, Chlamydia trachomatis
gcaaaacuucgggauaagaucuc

SEQ ID NO: 461768 - RNA, 14 nt, Chlamydia trachomatis
gcaaaagaaaaauc

SEQ ID NO: 461769 - RNA, 12 nt, Chlamydia trachomatis
gcaaaaaucucu

SEQ ID NO: 461770 - RNA, 22 nt, Chlamydia trachomatis
gcaaaagguucgaaaucaugaa

SEQ ID NO: 461771 - RNA, 14 nt, Chlamydia trachomatis
gcaaagaguaggga

SEQ ID NO: 461772 - RNA, 18 nt, Chlamydia trachomatis
gcaaacuucauauucccu

SEQ ID NO: 461773 - RNA, 16 nt, Chlamydia trachomatis
gcaaacugcucuucua

SEQ ID NO: 461774 - RNA, 23 nt, Chlamydia trachomatis
gcaaacugcucuucuaacuuuuc

SEQ ID NO: 461775 - RNA, 21 nt, Chlamydia trachomatis
gcaaagaaauagcuuaccuca

SEQ ID NO: 461776 - RNA, 16 nt, Chlamydia trachomatis
gcaaagaacaguucau

SEQ ID NO: 461777 - RNA, 17 nt, Chlamydia trachomatis
gcaaagugcuaauaacg

SEQ ID NO: 461778 - RNA, 14 nt, Chlamydia trachomatis
gcaaauaauaaacc

SEQ ID NO: 461779 - RNA, 14 nt, Chlamydia trachomatis
gcaaauagaauaaa

SEQ ID NO: 461780 - RNA, 19 nt, Chlamydia trachomatis
gcaaauagaauaaaaggcu

SEQ ID NO: 461781 - RNA, 20 nt, Chlamydia trachomatis
gcaaaucccugugcuaucuu

SEQ ID NO: 461782 - RNA, 15 nt, Chlamydia trachomatis
gcaaauuguaacagc

SEQ ID NO: 461783 - RNA, 15 nt, Chlamydia trachomatis
gcaacaacauaaucu

SEQ ID NO: 461784 - RNA, 18 nt, Chlamydia trachomatis
gcagcuagaacauacccu

SEQ ID NO: 461785 - RNA, 19 nt, Chlamydia trachomatis
gcagcuaaagaaucuccug

SEQ ID NO: 461786 - RNA, 22 nt, Chlamydia trachomatis
gcagcuuuucuaacguuccucc

SEQ ID NO: 461787 - RNA, 16 nt, Chlamydia trachomatis
gcaggaacuucuucau

SEQ ID NO: 461788 - RNA, 20 nt, Chlamydia trachomatis
gcagcuucggaaggagacaa

SEQ ID NO: 461789 - RNA, 19 nt, Chlamydia trachomatis
gcaggaucgcuaucaauaa

SEQ ID NO: 461790 - RNA, 21 nt, Chlamydia trachomatis
gcaggaucgcuaucaauaaaa

SEQ ID NO: 461791 - RNA, 18 nt, Chlamydia trachomatis
gcaggcgaacagugacag

SEQ ID NO: 461792 - RNA, 17 nt, Chlamydia trachomatis
gcaguaaagaaaagcuc

SEQ ID NO: 461793 - RNA, 22 nt, Chlamydia trachomatis
gcagugacauuauuuuuucgag

SEQ ID NO: 461794 - RNA, 20 nt, Chlamydia trachomatis
gcaguuguuuucuugcuacu

SEQ ID NO: 461795 - RNA, 23 nt, Chlamydia trachomatis
gcaguugaucauugauaaauucu

SEQ ID NO: 461796 - RNA, 15 nt, Chlamydia trachomatis
gcauaaaagagaaga

SEQ ID NO: 461797 - RNA, 17 nt, Chlamydia trachomatis
gcauaaaagagaagaac

SEQ ID NO: 461798 - RNA, 16 nt, Chlamydia trachomatis
gcauaacagcaagaca

SEQ ID NO: 461799 - RNA, 21 nt, Chlamydia trachomatis
gcagugguuaacaggcuuccu

SEQ ID NO: 461800 - RNA, 17 nt, Chlamydia trachomatis
gcauaagaauaaacaac

SEQ ID NO: 461801 - RNA, 19 nt, Chlamydia trachomatis
gcauaagaauaaacaacau

SEQ ID NO: 461802 - RNA, 23 nt, Chlamydia trachomatis
gcauaauagcuugcacagcaagc

SEQ ID NO: 461803 - RNA, 17 nt, Chlamydia trachomatis
gcauaugcgucuucccu

SEQ ID NO: 461804 - RNA, 20 nt, Chlamydia trachomatis
gcaucauccccagaagccau

SEQ ID NO: 461805 - RNA, 18 nt, Chlamydia trachomatis
gcaucugauguuccaucu

SEQ ID NO: 461806 - RNA, 13 nt, Chlamydia trachomatis
gcaucuccaaaga

SEQ ID NO: 461807 - RNA, 17 nt, Chlamydia trachomatis
gcaucuccaaagacaca

SEQ ID NO: 461808 - RNA, 20 nt, Chlamydia trachomatis
gcaucuuaggaucuaacgca

SEQ ID NO: 461809 - RNA, 20 nt, Chlamydia trachomatis
gcaucuggagauacagaauc

SEQ ID NO: 461810 - RNA, 18 nt, Chlamydia trachomatis
gcauguagccaaggaaga

SEQ ID NO: 461811 - RNA, 16 nt, Chlamydia trachomatis
gcauuaauauacucaa

SEQ ID NO: 461812 - RNA, 19 nt, Chlamydia trachomatis
gcauucaggggcaugacga

SEQ ID NO: 461813 - RNA, 22 nt, Chlamydia trachomatis
gcauuacacaacucuuuuccua

SEQ ID NO: 461814 - RNA, 15 nt, Chlamydia trachomatis
gcauuacgccccuuc

SEQ ID NO: 461815 - RNA, 16 nt, Chlamydia trachomatis
gcauuccaagaagaac

SEQ ID NO: 461816 - RNA, 17 nt, Chlamydia trachomatis
gcauuccaagaagaacu

SEQ ID NO: 461817 - RNA, 18 nt, Chlamydia trachomatis
gcauuccuaggcagagua

SEQ ID NO: 461818 - RNA, 13 nt, Chlamydia trachomatis
gcauuccuuucuu

SEQ ID NO: 461819 - RNA, 16 nt, Chlamydia trachomatis
gcauuccuuucuucca

SEQ ID NO: 461820 - RNA, 22 nt, Chlamydia trachomatis
gcauuugcucuuccaacaauuu

SEQ ID NO: 461821 - RNA, 22 nt, Chlamydia trachomatis
gcauuuccgguauuaauaauga

SEQ ID NO: 461822 - RNA, 13 nt, Chlamydia trachomatis
gccaaagaaaaac

SEQ ID NO: 461823 - RNA, 15 nt, Chlamydia trachomatis
gccaaagaaaaacgg

SEQ ID NO: 461824 - RNA, 15 nt, Chlamydia trachomatis
gccacaagaugccgc

SEQ ID NO: 461825 - RNA, 14 nt, Chlamydia trachomatis
gccaccaguuguua

SEQ ID NO: 461826 - RNA, 13 nt, Chlamydia trachomatis
gccagaaacuuca

SEQ ID NO: 461827 - RNA, 14 nt, Chlamydia trachomatis
gccagaagauccca

SEQ ID NO: 461828 - RNA, 15 nt, Chlamydia trachomatis
gccagcuuuaaagag

SEQ ID NO: 461829 - RNA, 20 nt, Chlamydia trachomatis
gccauaucaggaccuagaga

SEQ ID NO: 461830 - RNA, 14 nt, Chlamydia trachomatis
gcccaaacuccaug

SEQ ID NO: 461831 - RNA, 17 nt, Chlamydia trachomatis
gcccaggauaacaaaca

SEQ ID NO: 461832 - RNA, 20 nt, Chlamydia trachomatis
gcccaucaucgaugauaucu

SEQ ID NO: 461833 - RNA, 20 nt, Chlamydia trachomatis
gcccaugguauagaagaccu

SEQ ID NO: 461834 - RNA, 18 nt, Chlamydia trachomatis
gccgaacugcuuuccuua

SEQ ID NO: 461835 - RNA, 16 nt, Chlamydia trachomatis
gccgaacucuccucuc

SEQ ID NO: 461836 - RNA, 21 nt, Chlamydia trachomatis
gccgaacucuccucuccuaac

SEQ ID NO: 461837 - RNA, 18 nt, Chlamydia trachomatis
gccgaacuaauauaaguu

SEQ ID NO: 461838 - RNA, 20 nt, Chlamydia trachomatis
gccgaacuaauauaaguuca

SEQ ID NO: 461839 - RNA, 18 nt, Chlamydia trachomatis
gccgacuguuuaggaggu

SEQ ID NO: 461840 - RNA, 20 nt, Chlamydia trachomatis
gccgcagaaaaaaccacaga

SEQ ID NO: 461841 - RNA, 10 nt, Chlamydia trachomatis
aaagcugcuu

SEQ ID NO: 461842 - RNA, 20 nt, Chlamydia trachomatis
aaagcugcuuuacaucccuu

SEQ ID NO: 461843 - RNA, 20 nt, Chlamydia trachomatis
aaagcugcuuuauccaaaga

SEQ ID NO: 461844 - RNA, 16 nt, Chlamydia trachomatis
aaagcuauuugcaaga

SEQ ID NO: 461845 - RNA, 16 nt, Chlamydia trachomatis
gccgcuauucacuacc

SEQ ID NO: 461846 - RNA, 23 nt, Chlamydia trachomatis
gccguuacuaacaucaaagaucu

SEQ ID NO: 461847 - RNA, 15 nt, Chlamydia trachomatis
gccuacaaauaaagu

SEQ ID NO: 461848 - RNA, 14 nt, Chlamydia trachomatis
gccuacaagaccuc

SEQ ID NO: 461849 - RNA, 14 nt, Chlamydia trachomatis
gccguuuguucucu

SEQ ID NO: 461850 - RNA, 19 nt, Chlamydia trachomatis
gccguuuguucucuggucg

SEQ ID NO: 461851 - RNA, 20 nt, Chlamydia trachomatis
gccuauccaaggaaaccaag

SEQ ID NO: 461852 - RNA, 14 nt, Chlamydia trachomatis
gccuccaucucugc

SEQ ID NO: 461853 - RNA, 11 nt, Chlamydia trachomatis
gccucuaucuc

SEQ ID NO: 461854 - RNA, 15 nt, Chlamydia trachomatis
gccucuaucucuucu

SEQ ID NO: 461855 - RNA, 13 nt, Chlamydia trachomatis
gccucugaacacc

SEQ ID NO: 461856 - RNA, 23 nt, Chlamydia trachomatis
gccugggcgagcauaucuccuaa

SEQ ID NO: 461857 - RNA, 20 nt, Chlamydia trachomatis
gccuguuuugcuaugaaaaa

SEQ ID NO: 461858 - RNA, 17 nt, Chlamydia trachomatis
gccuuaacaugauucaa

SEQ ID NO: 461859 - RNA, 17 nt, Chlamydia trachomatis
gccuugagugaaaaaua

SEQ ID NO: 461860 - RNA, 15 nt, Chlamydia trachomatis
gccuuuuauucuuca

SEQ ID NO: 461861 - RNA, 21 nt, Chlamydia trachomatis
gccuuucucuaaaagaagagc

SEQ ID NO: 461862 - RNA, 11 nt, Chlamydia trachomatis
gcgaaagaaac

SEQ ID NO: 461863 - RNA, 16 nt, Chlamydia trachomatis
gcgaauaaauccucuu

SEQ ID NO: 461864 - RNA, 16 nt, Chlamydia trachomatis
gcgacuccaacacgaa

SEQ ID NO: 461865 - RNA, 14 nt, Chlamydia trachomatis
gcgagagagcuuua

SEQ ID NO: 461866 - RNA, 17 nt, Chlamydia trachomatis
gcgaguuuugauuagaa

SEQ ID NO: 461867 - RNA, 20 nt, Chlamydia trachomatis
gcgauaugcuuuuuaauauc

SEQ ID NO: 461868 - RNA, 19 nt, Chlamydia trachomatis
gcgaucuccucauccuuuu

SEQ ID NO: 461869 - RNA, 23 nt, Chlamydia trachomatis
gcgaugauuaucaccuauuaaga

SEQ ID NO: 461870 - RNA, 23 nt, Chlamydia trachomatis
gcgauguaagguuugucuucaga

SEQ ID NO: 461871 - RNA, 13 nt, Chlamydia trachomatis
gcgcaaaucagga

SEQ ID NO: 461872 - RNA, 20 nt, Chlamydia trachomatis
gcgcaaccccgcauaccaaa

SEQ ID NO: 461873 - RNA, 19 nt, Chlamydia trachomatis
gcgcaaucauaucaagaau

SEQ ID NO: 461874 - RNA, 23 nt, Chlamydia trachomatis
gcgcauccacuacugucagaccu

SEQ ID NO: 461875 - RNA, 14 nt, Chlamydia trachomatis
gcgccauaccuaaa

SEQ ID NO: 461876 - RNA, 21 nt, Chlamydia trachomatis
gcgcuuuuuuuuuagaacaga

SEQ ID NO: 461877 - RNA, 17 nt, Chlamydia trachomatis
gcgcuuuuucuucucua

SEQ ID NO: 461878 - RNA, 21 nt, Chlamydia trachomatis
gcggcuuuucuauuucauuua

SEQ ID NO: 461879 - RNA, 23 nt, Chlamydia trachomatis
gcgggagaaggauucgaaccucc

SEQ ID NO: 461880 - RNA, 23 nt, Chlamydia trachomatis
gcggguacgcucaucuugcauaa

SEQ ID NO: 461881 - RNA, 18 nt, Chlamydia trachomatis
gcucauagucugauccau

SEQ ID NO: 461882 - RNA, 18 nt, Chlamydia trachomatis
gcucauaaccaugagcuc

SEQ ID NO: 461883 - RNA, 18 nt, Chlamydia trachomatis
gcucaucaaacucuuuuu

SEQ ID NO: 461884 - RNA, 17 nt, Chlamydia trachomatis
gcucaugagccucuaac

SEQ ID NO: 461885 - RNA, 14 nt, Chlamydia trachomatis
gcuccaaagauaua

SEQ ID NO: 461886 - RNA, 17 nt, Chlamydia trachomatis
gcuccaaaguaaaaugc

SEQ ID NO: 461887 - RNA, 13 nt, Chlamydia trachomatis
gcuccacaagaag

SEQ ID NO: 461888 - RNA, 22 nt, Chlamydia trachomatis
gcuccacacaacauaacucugc

SEQ ID NO: 461889 - RNA, 13 nt, Chlamydia trachomatis
gcuccgaucauaa

SEQ ID NO: 461890 - RNA, 19 nt, Chlamydia trachomatis
gcuccguucaaagcaaacu

SEQ ID NO: 461891 - RNA, 13 nt, Chlamydia trachomatis
gcuccuaaagaag

SEQ ID NO: 461892 - RNA, 21 nt, Chlamydia trachomatis
gcuccguggcaagcaacgaaa

SEQ ID NO: 461893 - RNA, 13 nt, Chlamydia trachomatis
gcuccuaagcagu

SEQ ID NO: 461894 - RNA, 16 nt, Chlamydia trachomatis
gcuccuaaucuuucua

SEQ ID NO: 461895 - RNA, 23 nt, Chlamydia trachomatis
gcuccuaaucuuucuaauuuccc

SEQ ID NO: 461896 - RNA, 19 nt, Chlamydia trachomatis
gcuccuagugauaaacagg

SEQ ID NO: 461897 - RNA, 20 nt, Chlamydia trachomatis
gcuccuuauaaauccugcgc

SEQ ID NO: 461898 - RNA, 17 nt, Chlamydia trachomatis
gcuccuggagaaaaucc

SEQ ID NO: 461899 - RNA, 18 nt, Chlamydia trachomatis
gcucgaaaguugcuccca

SEQ ID NO: 461900 - RNA, 22 nt, Chlamydia trachomatis
gcucgcauuuguaguucuaaca

SEQ ID NO: 461901 - RNA, 15 nt, Chlamydia trachomatis
gcucgucuguucucc

SEQ ID NO: 461902 - RNA, 17 nt, Chlamydia trachomatis
gcucuagguagucucua

SEQ ID NO: 461903 - RNA, 20 nt, Chlamydia trachomatis
gcucucgcaguuucuccuaa

SEQ ID NO: 461904 - RNA, 15 nt, Chlamydia trachomatis
gcucucuagcaaacg

SEQ ID NO: 461905 - RNA, 18 nt, Chlamydia trachomatis
gcugaaauucuugguauu

SEQ ID NO: 461906 - RNA, 21 nt, Chlamydia trachomatis
gcugagaaucggauccuucga

SEQ ID NO: 461907 - RNA, 17 nt, Chlamydia trachomatis
gcugacaaagcuuccuu

SEQ ID NO: 461908 - RNA, 10 nt, Chlamydia trachomatis
gcugauuaga

SEQ ID NO: 461909 - RNA, 12 nt, Chlamydia trachomatis
gcugauuagaaa

SEQ ID NO: 461910 - RNA, 18 nt, Chlamydia trachomatis
gcugcgauaacaacaaua

SEQ ID NO: 461911 - RNA, 14 nt, Chlamydia trachomatis
gcugcguuaaacac

SEQ ID NO: 461912 - RNA, 14 nt, Chlamydia trachomatis
gcugcguuacccuu

SEQ ID NO: 461913 - RNA, 19 nt, Chlamydia trachomatis
gcugcggacugcaucaugu

SEQ ID NO: 461914 - RNA, 18 nt, Chlamydia trachomatis
aaaggauaaggaagaaga

SEQ ID NO: 461915 - RNA, 17 nt, Chlamydia trachomatis
aaaggauauacagaaca

SEQ ID NO: 461916 - RNA, 18 nt, Chlamydia trachomatis
aaaggauauacagaacau

SEQ ID NO: 461917 - RNA, 12 nt, Chlamydia trachomatis
aaaggaauccuu

SEQ ID NO: 461918 - RNA, 21 nt, Chlamydia trachomatis
aaaggaaucuguccaaagaga

SEQ ID NO: 461919 - RNA, 20 nt, Chlamydia trachomatis
gcuguauagaguaaguuucu

SEQ ID NO: 461920 - RNA, 17 nt, Chlamydia trachomatis
gcuguagugaucuuuuu

SEQ ID NO: 461921 - RNA, 17 nt, Chlamydia trachomatis
gcugucagaucauuuua

SEQ ID NO: 461922 - RNA, 22 nt, Chlamydia trachomatis
gcugucagaucauuuuaauaag

SEQ ID NO: 461923 - RNA, 20 nt, Chlamydia trachomatis
aaaggaacaucgagaaaaug

SEQ ID NO: 461924 - RNA, 14 nt, Chlamydia trachomatis
aaaggaaguugaga

SEQ ID NO: 461925 - RNA, 18 nt, Chlamydia trachomatis
aaaggaaguugagaagcg

SEQ ID NO: 461926 - RNA, 23 nt, Chlamydia trachomatis
gcuguuguaucccuaguacaaaa

SEQ ID NO: 461927 - RNA, 23 nt, Chlamydia trachomatis
gcuuaaagauaacacucucaucu

SEQ ID NO: 461928 - RNA, 12 nt, Chlamydia trachomatis
gcuguucuucca

SEQ ID NO: 461929 - RNA, 13 nt, Chlamydia trachomatis
gcuucaaaacuaa

SEQ ID NO: 461930 - RNA, 22 nt, Chlamydia trachomatis
gcuucaaaacuaaaaguugcuc

SEQ ID NO: 461931 - RNA, 19 nt, Chlamydia trachomatis
gcuuauucucuuuauagaa

SEQ ID NO: 461932 - RNA, 16 nt, Chlamydia trachomatis
gcuucaacgagcugcc

SEQ ID NO: 461933 - RNA, 16 nt, Chlamydia trachomatis
gcuucagcagcauaaa

SEQ ID NO: 461934 - RNA, 13 nt, Chlamydia trachomatis
gcuuagauuuagc

SEQ ID NO: 461935 - RNA, 23 nt, Chlamydia trachomatis
gcuuagauuucgauuugaugaga

SEQ ID NO: 461936 - RNA, 16 nt, Chlamydia trachomatis
gcuucaggggagaaaa

SEQ ID NO: 461937 - RNA, 18 nt, Chlamydia trachomatis
gcuucauaaaaaagaccc

SEQ ID NO: 461938 - RNA, 15 nt, Chlamydia trachomatis
gcuucaucauugaaa

SEQ ID NO: 461939 - RNA, 23 nt, Chlamydia trachomatis
gcuucaucgauaggcauagccau

SEQ ID NO: 461940 - RNA, 13 nt, Chlamydia trachomatis
gcuucgaaaagag

SEQ ID NO: 461941 - RNA, 21 nt, Chlamydia trachomatis
gcuuccugccaguucuucacu

SEQ ID NO: 461942 - RNA, 15 nt, Chlamydia trachomatis
gcuuccguaacaaua

SEQ ID NO: 461943 - RNA, 18 nt, Chlamydia trachomatis
gcuucgcaagcaugucga

SEQ ID NO: 461944 - RNA, 23 nt, Chlamydia trachomatis
gcuucgagcuguuuuugcaacaa

SEQ ID NO: 461945 - RNA, 24 nt, Chlamydia trachomatis
gcuucggcuauagcgucuugcuaa

SEQ ID NO: 461946 - RNA, 21 nt, Chlamydia trachomatis
gcuucugaacgagaaaaaggu

SEQ ID NO: 461947 - RNA, 19 nt, Chlamydia trachomatis
gcuucugccuuuugauucu

SEQ ID NO: 461948 - RNA, 22 nt, Chlamydia trachomatis
gcuucuggacuauuuucaaaac

SEQ ID NO: 461949 - RNA, 23 nt, Chlamydia trachomatis
gcuucuagaaauucuucaucuau

SEQ ID NO: 461950 - RNA, 14 nt, Chlamydia trachomatis
gcuucucaacacug

SEQ ID NO: 461951 - RNA, 15 nt, Chlamydia trachomatis
gcuucuuaacugcag

SEQ ID NO: 461952 - RNA, 22 nt, Chlamydia trachomatis
gcuucuuaacugcagcaucuau

SEQ ID NO: 461953 - RNA, 15 nt, Chlamydia trachomatis
gcuucuucuucucuu

SEQ ID NO: 461954 - RNA, 18 nt, Chlamydia trachomatis
gcuucuucuucucuuucg

SEQ ID NO: 461955 - RNA, 16 nt, Chlamydia trachomatis
gcuucuucuucuuuag

SEQ ID NO: 461956 - RNA, 21 nt, Chlamydia trachomatis
gcuucuugggauaugccucua

SEQ ID NO: 461957 - RNA, 20 nt, Chlamydia trachomatis
gcuugaaguagcauugcgca

SEQ ID NO: 461958 - RNA, 13 nt, Chlamydia trachomatis
gcuucuuuuucaa

SEQ ID NO: 461959 - RNA, 23 nt, Chlamydia trachomatis
gcuugaucaaagaaucuuugucu

SEQ ID NO: 461960 - RNA, 12 nt, Chlamydia trachomatis
gcuugagagcau

SEQ ID NO: 461961 - RNA, 19 nt, Chlamydia trachomatis
gcuugcagagggccuccca

SEQ ID NO: 461962 - RNA, 15 nt, Chlamydia trachomatis
gcuugcacaaucuca

SEQ ID NO: 461963 - RNA, 15 nt, Chlamydia trachomatis
gcuugcacagcaagc

SEQ ID NO: 461964 - RNA, 13 nt, Chlamydia trachomatis
gcuugcccaaacu

SEQ ID NO: 461965 - RNA, 20 nt, Chlamydia trachomatis
gcuuggcggauaucuucuug

SEQ ID NO: 461966 - RNA, 17 nt, Chlamydia trachomatis
aaaggcaacaaaggcga

SEQ ID NO: 461967 - RNA, 19 nt, Chlamydia trachomatis
aaaggcauaaaagagaaga

SEQ ID NO: 461968 - RNA, 12 nt, Chlamydia trachomatis
aaaggccaggcu

SEQ ID NO: 461969 - RNA, 18 nt, Chlamydia trachomatis
gcuuguaugguuuguccu

SEQ ID NO: 461970 - RNA, 23 nt, Chlamydia trachomatis
gcuuguaugguuuguccuuuucu

SEQ ID NO: 461971 - RNA, 15 nt, Chlamydia trachomatis
gcuugucuccuucuu

SEQ ID NO: 461972 - RNA, 14 nt, Chlamydia trachomatis
gcuuucaaaaagag

SEQ ID NO: 461973 - RNA, 23 nt, Chlamydia trachomatis
gcuuuacaucccuugaacuagaa

SEQ ID NO: 461974 - RNA, 14 nt, Chlamydia trachomatis
gcuuuaaagagcau

SEQ ID NO: 461975 - RNA, 19 nt, Chlamydia trachomatis
gcuuuaacugggauaagaa

SEQ ID NO: 461976 - RNA, 23 nt, Chlamydia trachomatis
gcuuuccucacacacaaaaaaaa

SEQ ID NO: 461977 - RNA, 14 nt, Chlamydia trachomatis
ggaacacagagucu

SEQ ID NO: 461978 - RNA, 20 nt, Chlamydia trachomatis
ggaacaggggaccaaaaaag

SEQ ID NO: 461979 - RNA, 17 nt, Chlamydia trachomatis
ggaacauacuucugaau

SEQ ID NO: 461980 - RNA, 22 nt, Chlamydia trachomatis
ggaacaucgagaaaaugaugaa

SEQ ID NO: 461981 - RNA, 14 nt, Chlamydia trachomatis
ggaagcuagaagaa

SEQ ID NO: 461982 - RNA, 18 nt, Chlamydia trachomatis
ggaagcuagaagaagagg

SEQ ID NO: 461983 - RNA, 19 nt, Chlamydia trachomatis
ggaauacaguuagagaugu

SEQ ID NO: 461984 - RNA, 19 nt, Chlamydia trachomatis
ggaauaauuuuccacaaau

SEQ ID NO: 461985 - RNA, 20 nt, Chlamydia trachomatis
ggaauaagcgaaaaaaaaag

SEQ ID NO: 461986 - RNA, 16 nt, Chlamydia trachomatis
ggaauggguaggauua

SEQ ID NO: 461987 - RNA, 16 nt, Chlamydia trachomatis
ggaauacaucacugca

SEQ ID NO: 461988 - RNA, 18 nt, Chlamydia trachomatis
ggaauacgggaugcgaau

SEQ ID NO: 461989 - RNA, 19 nt, Chlamydia trachomatis
ggaauuuucaucaaaauau

SEQ ID NO: 461990 - RNA, 12 nt, Chlamydia trachomatis
ggaauucauaga

SEQ ID NO: 461991 - RNA, 11 nt, Chlamydia trachomatis
ggaauucuucg

SEQ ID NO: 461992 - RNA, 12 nt, Chlamydia trachomatis
ggaauuuuucuc

SEQ ID NO: 461993 - RNA, 15 nt, Chlamydia trachomatis
ggacaaaaauacuuc

SEQ ID NO: 461994 - RNA, 17 nt, Chlamydia trachomatis
ggacaaacguccuccug

SEQ ID NO: 461995 - RNA, 23 nt, Chlamydia trachomatis
ggacaagcucgucuuuagaagaa

SEQ ID NO: 461996 - RNA, 16 nt, Chlamydia trachomatis
ggacaagcgacuccaa

SEQ ID NO: 461997 - RNA, 20 nt, Chlamydia trachomatis
ggacgagcgauaucucccga

SEQ ID NO: 461998 - RNA, 14 nt, Chlamydia trachomatis
aaaggggcuuuuuu

SEQ ID NO: 461999 - RNA, 19 nt, Chlamydia trachomatis
aaagggggacaaaaauacu

SEQ ID NO: 462000 - RNA, 14 nt, Chlamydia trachomatis
aaaggguagaaaaa

SEQ ID NO: 462001 - RNA, 19 nt, Chlamydia trachomatis
aaaggcuuugucuauaagg

SEQ ID NO: 462002 - RNA, 17 nt, Chlamydia trachomatis
aaagggaaaaaacuaga

SEQ ID NO: 462003 - RNA, 22 nt, Chlamydia trachomatis
aaaggcuuauucucuuuauaga

SEQ ID NO: 462004 - RNA, 21 nt, Chlamydia trachomatis
aaaggucucccaagaaacuuu

SEQ ID NO: 462005 - RNA, 13 nt, Chlamydia trachomatis
aaaggucucucuu

SEQ ID NO: 462006 - RNA, 20 nt, Chlamydia trachomatis
aaagguguguucccagagaa

SEQ ID NO: 462007 - RNA, 20 nt, Chlamydia trachomatis
aaaguaacuacggaaaaaga

SEQ ID NO: 462008 - RNA, 17 nt, Chlamydia trachomatis
ggacuuggguaagagca

SEQ ID NO: 462009 - RNA, 12 nt, Chlamydia trachomatis
ggagaaagaaug

SEQ ID NO: 462010 - RNA, 13 nt, Chlamydia trachomatis
ggagacuuuagcu

SEQ ID NO: 462011 - RNA, 15 nt, Chlamydia trachomatis
ggagcaaaaagugug

SEQ ID NO: 462012 - RNA, 19 nt, Chlamydia trachomatis
ggagcaagaauacaagaaa

SEQ ID NO: 462013 - RNA, 20 nt, Chlamydia trachomatis
ggagcaagaauacaagaaag

SEQ ID NO: 462014 - RNA, 13 nt, Chlamydia trachomatis
ggagcagcuaaca

SEQ ID NO: 462015 - RNA, 20 nt, Chlamydia trachomatis
ggagcauaaauaucuugagu

SEQ ID NO: 462016 - RNA, 21 nt, Chlamydia trachomatis
ggagagagccuugagugaaaa

SEQ ID NO: 462017 - RNA, 15 nt, Chlamydia trachomatis
ggaguguuuucuguu

SEQ ID NO: 462018 - RNA, 21 nt, Chlamydia trachomatis
ggagcauguagccaaggaaga

SEQ ID NO: 462019 - RNA, 13 nt, Chlamydia trachomatis
ggagcauuccuuc

SEQ ID NO: 462020 - RNA, 21 nt, Chlamydia trachomatis
ggagcaucuucucgaaagaga

SEQ ID NO: 462021 - RNA, 22 nt, Chlamydia trachomatis
ggagcaugaaucagcuuuucca

SEQ ID NO: 462022 - RNA, 12 nt, Chlamydia trachomatis
ggagccaaaaag

SEQ ID NO: 462023 - RNA, 17 nt, Chlamydia trachomatis
ggauaacaaacaacacu

SEQ ID NO: 462024 - RNA, 16 nt, Chlamydia trachomatis
ggauagaucaagaaaa

SEQ ID NO: 462025 - RNA, 13 nt, Chlamydia trachomatis
ggauagacuggca

SEQ ID NO: 462026 - RNA, 15 nt, Chlamydia trachomatis
ggauaagaaaucuuc

SEQ ID NO: 462027 - RNA, 23 nt, Chlamydia trachomatis
ggauaagaaaucuucucuugaau

SEQ ID NO: 462028 - RNA, 13 nt, Chlamydia trachomatis
ggauaaggaagaa

SEQ ID NO: 462029 - RNA, 15 nt, Chlamydia trachomatis
ggauaaggaagaaga

SEQ ID NO: 462030 - RNA, 17 nt, Chlamydia trachomatis
ggauaaggaagaagaua

SEQ ID NO: 462031 - RNA, 15 nt, Chlamydia trachomatis
ggaucaauccccaaa

SEQ ID NO: 462032 - RNA, 13 nt, Chlamydia trachomatis
ggaucggaggcau

SEQ ID NO: 462033 - RNA, 15 nt, Chlamydia trachomatis
ggauccagaagcaca

SEQ ID NO: 462034 - RNA, 17 nt, Chlamydia trachomatis
ggaucucuuagacccuc

SEQ ID NO: 462035 - RNA, 23 nt, Chlamydia trachomatis
ggaucuuccagccuacaaauaaa

SEQ ID NO: 462036 - RNA, 23 nt, Chlamydia trachomatis
ggaugaucuucaccccuuacaau

SEQ ID NO: 462037 - RNA, 15 nt, Chlamydia trachomatis
ggaugauucccugua

SEQ ID NO: 462038 - RNA, 17 nt, Chlamydia trachomatis
ggaugaagcuaaaaaau

SEQ ID NO: 462039 - RNA, 15 nt, Chlamydia trachomatis
aaaguacucagucaa

SEQ ID NO: 462040 - RNA, 13 nt, Chlamydia trachomatis
aaaguaaucucuu

SEQ ID NO: 462041 - RNA, 20 nt, Chlamydia trachomatis
aaaguaaucucuuaauccuu

SEQ ID NO: 462042 - RNA, 16 nt, Chlamydia trachomatis
ggauguaagucuauaa

SEQ ID NO: 462043 - RNA, 22 nt, Chlamydia trachomatis
ggcaacccucgcagagaaagag

SEQ ID NO: 462044 - RNA, 16 nt, Chlamydia trachomatis
ggauucaucaaaauau

SEQ ID NO: 462045 - RNA, 23 nt, Chlamydia trachomatis
ggauuccggaagauacagccugc

SEQ ID NO: 462046 - RNA, 19 nt, Chlamydia trachomatis
ggauuugugugcaaaucac

SEQ ID NO: 462047 - RNA, 17 nt, Chlamydia trachomatis
ggauuacagcaagaaga

SEQ ID NO: 462048 - RNA, 21 nt, Chlamydia trachomatis
ggauuacagcaagaagaagag

SEQ ID NO: 462049 - RNA, 20 nt, Chlamydia trachomatis
ggcaaggcuuucaaaaagag

SEQ ID NO: 462050 - RNA, 13 nt, Chlamydia trachomatis
ggcaauaaaagcu

SEQ ID NO: 462051 - RNA, 14 nt, Chlamydia trachomatis
ggcagcaagagaga

SEQ ID NO: 462052 - RNA, 15 nt, Chlamydia trachomatis
ggcagcugcuuggaa

SEQ ID NO: 462053 - RNA, 18 nt, Chlamydia trachomatis
aaaguagaccauuuagac

SEQ ID NO: 462054 - RNA, 21 nt, Chlamydia trachomatis
aaaguagaccauuuagaccag

SEQ ID NO: 462055 - RNA, 13 nt, Chlamydia trachomatis
aaagucaagacag

SEQ ID NO: 462056 - RNA, 18 nt, Chlamydia trachomatis
aaagucaagacagaugcc

SEQ ID NO: 462057 - RNA, 17 nt, Chlamydia trachomatis
aaagucaucgcuaaucu

SEQ ID NO: 462058 - RNA, 18 nt, Chlamydia trachomatis
aaaguccgcuaauccaug

SEQ ID NO: 462059 - RNA, 19 nt, Chlamydia trachomatis
ggcauuuccgguauuaaua

SEQ ID NO: 462060 - RNA, 22 nt, Chlamydia trachomatis
ggccauagaauggcgcucucug

SEQ ID NO: 462061 - RNA, 19 nt, Chlamydia trachomatis
ggcccacaguucccaucca

SEQ ID NO: 462062 - RNA, 19 nt, Chlamydia trachomatis
ggccccuggaauuucucca

SEQ ID NO: 462063 - RNA, 13 nt, Chlamydia trachomatis
aaaguccugcuuc

SEQ ID NO: 462064 - RNA, 18 nt, Chlamydia trachomatis
aaagucucuaaagcuuuu

SEQ ID NO: 462065 - RNA, 13 nt, Chlamydia trachomatis
aaagucuccauaa

SEQ ID NO: 462066 - RNA, 20 nt, Chlamydia trachomatis
aaagucuguuccuaauacua

SEQ ID NO: 462067 - RNA, 22 nt, Chlamydia trachomatis
aaagucuguuccuaauacuaaa

SEQ ID NO: 462068 - RNA, 23 nt, Chlamydia trachomatis
aaagucuuuuccuccauaggaau

SEQ ID NO: 462069 - RNA, 23 nt, Chlamydia trachomatis
aaagugagaugcuccucucuuug

SEQ ID NO: 462070 - RNA, 19 nt, Chlamydia trachomatis
aaauaacgauucuugauaa

SEQ ID NO: 462071 - RNA, 18 nt, Chlamydia trachomatis
aaauaaccggaacaauca

SEQ ID NO: 462072 - RNA, 20 nt, Chlamydia trachomatis
aaauaaugccaccuaauaug

SEQ ID NO: 462073 - RNA, 21 nt, Chlamydia trachomatis
aaauaaucggcaaaagaucuc

SEQ ID NO: 462074 - RNA, 14 nt, Chlamydia trachomatis
aaauaaucucguug

SEQ ID NO: 462075 - RNA, 17 nt, Chlamydia trachomatis
aaauaaguccuuaucuu

SEQ ID NO: 462076 - RNA, 19 nt, Chlamydia trachomatis
aaauaaguccuuaucuucu

SEQ ID NO: 462077 - RNA, 22 nt, Chlamydia trachomatis
aaauaagucuuuuacuuugaaa

SEQ ID NO: 462078 - RNA, 17 nt, Chlamydia trachomatis
aaauaaguuaccucuuu

SEQ ID NO: 462079 - RNA, 23 nt, Chlamydia trachomatis
aaauaauuuccugacucgaagga

SEQ ID NO: 462080 - RNA, 13 nt, Chlamydia trachomatis
ggcgauaguucua

SEQ ID NO: 462081 - RNA, 17 nt, Chlamydia trachomatis
aaauaccaaaauaucau

SEQ ID NO: 462082 - RNA, 22 nt, Chlamydia trachomatis
aaauacggacggacaaauuucu

SEQ ID NO: 462083 - RNA, 20 nt, Chlamydia trachomatis
ggcggagagaauaccaaaau

SEQ ID NO: 462084 - RNA, 17 nt, Chlamydia trachomatis
ggcucauuuuguaggag

SEQ ID NO: 462085 - RNA, 18 nt, Chlamydia trachomatis
ggcucguaaaaaagauaa

SEQ ID NO: 462086 - RNA, 15 nt, Chlamydia trachomatis
ggcucguagagaacg

SEQ ID NO: 462087 - RNA, 23 nt, Chlamydia trachomatis
ggcucuguuaacugacaauccag

SEQ ID NO: 462088 - RNA, 18 nt, Chlamydia trachomatis
ggcucuuuaauauuuccc

SEQ ID NO: 462089 - RNA, 17 nt, Chlamydia trachomatis
ggcugcagaagacuuug

SEQ ID NO: 462090 - RNA, 14 nt, Chlamydia trachomatis
ggcugcaucagcaa

SEQ ID NO: 462091 - RNA, 22 nt, Chlamydia trachomatis
ggcugcaucagcaagagucucg

SEQ ID NO: 462092 - RNA, 16 nt, Chlamydia trachomatis
ggcugcguuaaacaca

SEQ ID NO: 462093 - RNA, 15 nt, Chlamydia trachomatis
ggcugcuaucuucua

SEQ ID NO: 462094 - RNA, 22 nt, Chlamydia trachomatis
ggcugcuaucuucuagaggagu

SEQ ID NO: 462095 - RNA, 19 nt, Chlamydia trachomatis
ggcugcuuggcaaucugca

SEQ ID NO: 462096 - RNA, 15 nt, Chlamydia trachomatis
ggcugcugcuuggaa

SEQ ID NO: 462097 - RNA, 12 nt, Chlamydia trachomatis
ggcuucaaagaa

SEQ ID NO: 462098 - RNA, 17 nt, Chlamydia trachomatis
ggcuugcccaaacucca

SEQ ID NO: 462099 - RNA, 18 nt, Chlamydia trachomatis
ggcuugcacaaucucaaa

SEQ ID NO: 462100 - RNA, 22 nt, Chlamydia trachomatis
ggcuuuguccucggaugaccga

SEQ ID NO: 462101 - RNA, 16 nt, Chlamydia trachomatis
ggcuuuguccuggcca

SEQ ID NO: 462102 - RNA, 18 nt, Chlamydia trachomatis
gggaaaucuugugcuaag

SEQ ID NO: 462103 - RNA, 16 nt, Chlamydia trachomatis
gggaaaugcuggauug

SEQ ID NO: 462104 - RNA, 12 nt, Chlamydia trachomatis
gggaagaaucaa

SEQ ID NO: 462105 - RNA, 21 nt, Chlamydia trachomatis
gggaagacucgaagagcuucc

SEQ ID NO: 462106 - RNA, 13 nt, Chlamydia trachomatis
gggaauacaguua

SEQ ID NO: 462107 - RNA, 15 nt, Chlamydia trachomatis
gggaauacaguuaga

SEQ ID NO: 462108 - RNA, 21 nt, Chlamydia trachomatis
gggaaucauaaggaagauggg

SEQ ID NO: 462109 - RNA, 18 nt, Chlamydia trachomatis
gggaaucgguacgaaucc

SEQ ID NO: 462110 - RNA, 21 nt, Chlamydia trachomatis
gggaaugaaaucacucgcaca

SEQ ID NO: 462111 - RNA, 20 nt, Chlamydia trachomatis
gggaauucgcuaaugauucu

SEQ ID NO: 462112 - RNA, 19 nt, Chlamydia trachomatis
gggagaugaucgaguucua

SEQ ID NO: 462113 - RNA, 18 nt, Chlamydia trachomatis
gggagcauggucucugua

SEQ ID NO: 462114 - RNA, 14 nt, Chlamydia trachomatis
gggagaaggggaag

SEQ ID NO: 462115 - RNA, 19 nt, Chlamydia trachomatis
gggagcccaauuaaaacaa

SEQ ID NO: 462116 - RNA, 13 nt, Chlamydia trachomatis
gggauagaaacuc

SEQ ID NO: 462117 - RNA, 18 nt, Chlamydia trachomatis
gggauagaaacucacaaa

SEQ ID NO: 462118 - RNA, 18 nt, Chlamydia trachomatis
gggauauguuaaagccca

SEQ ID NO: 462119 - RNA, 20 nt, Chlamydia trachomatis
gggauauguuaaagcccagu

SEQ ID NO: 462120 - RNA, 18 nt, Chlamydia trachomatis
gggaucccacaaagaaag

SEQ ID NO: 462121 - RNA, 10 nt, Chlamydia trachomatis
gggauggaaa

SEQ ID NO: 462122 - RNA, 16 nt, Chlamydia trachomatis
gggcaaucaagcuaau

SEQ ID NO: 462123 - RNA, 16 nt, Chlamydia trachomatis
gggcacaacgcccagg

SEQ ID NO: 462124 - RNA, 22 nt, Chlamydia trachomatis
gggcaccguagaauuucuucuu

SEQ ID NO: 462125 - RNA, 14 nt, Chlamydia trachomatis
gggcauaacgagug

SEQ ID NO: 462126 - RNA, 20 nt, Chlamydia trachomatis
gggccuucuuuuuccucagc

SEQ ID NO: 462127 - RNA, 22 nt, Chlamydia trachomatis
ggggaucgaucccuuuuucagg

SEQ ID NO: 462128 - RNA, 15 nt, Chlamydia trachomatis
ggggaccaaaaaagc

SEQ ID NO: 462129 - RNA, 20 nt, Chlamydia trachomatis
ggggaaucgguacgaauccu

SEQ ID NO: 462130 - RNA, 18 nt, Chlamydia trachomatis
gggguagcugaugaagcg

SEQ ID NO: 462131 - RNA, 18 nt, Chlamydia trachomatis
ggguaucugaacaagaag

SEQ ID NO: 462132 - RNA, 15 nt, Chlamydia trachomatis
gggucauagaaaaug

SEQ ID NO: 462133 - RNA, 12 nt, Chlamydia trachomatis
gguaaacaaugc

SEQ ID NO: 462134 - RNA, 17 nt, Chlamydia trachomatis
ggguuuuaaaugcuucu

SEQ ID NO: 462135 - RNA, 18 nt, Chlamydia trachomatis
gguaacgaguacagaaua

SEQ ID NO: 462136 - RNA, 21 nt, Chlamydia trachomatis
gguaaagaaguuuaaaagccc

SEQ ID NO: 462137 - RNA, 16 nt, Chlamydia trachomatis
gguaaguccgcagaga

SEQ ID NO: 462138 - RNA, 17 nt, Chlamydia trachomatis
gguaauagaguucggga

SEQ ID NO: 462139 - RNA, 14 nt, Chlamydia trachomatis
gguauauguauacc

SEQ ID NO: 462140 - RNA, 22 nt, Chlamydia trachomatis
ggucaaaauuaucuaaaaaaau

SEQ ID NO: 462141 - RNA, 19 nt, Chlamydia trachomatis
gguauuuguguauggaagu

SEQ ID NO: 462142 - RNA, 17 nt, Chlamydia trachomatis
gguauuuuagagaaaag

SEQ ID NO: 462143 - RNA, 19 nt, Chlamydia trachomatis
gguauuaauaaugaaauug

SEQ ID NO: 462144 - RNA, 22 nt, Chlamydia trachomatis
gguaucucguucuacaggagua

SEQ ID NO: 462145 - RNA, 18 nt, Chlamydia trachomatis
gguaucugaaucuguguu

SEQ ID NO: 462146 - RNA, 23 nt, Chlamydia trachomatis
gguagcgauuuucugaaguucuu

SEQ ID NO: 462147 - RNA, 19 nt, Chlamydia trachomatis
gguagcaacgauaaacaga

SEQ ID NO: 462148 - RNA, 18 nt, Chlamydia trachomatis
gguacuuucucuucaaga

SEQ ID NO: 462149 - RNA, 15 nt, Chlamydia trachomatis
gguacacuucuuuaa

SEQ ID NO: 462150 - RNA, 21 nt, Chlamydia trachomatis
gguacaaggcucuugaaaagg

SEQ ID NO: 462151 - RNA, 13 nt, Chlamydia trachomatis
ggucgacagcguu

SEQ ID NO: 462152 - RNA, 23 nt, Chlamydia trachomatis
ggucucauuauauaaagccccuc

SEQ ID NO: 462153 - RNA, 21 nt, Chlamydia trachomatis
ggucuuuuugcuaccaagcuu

SEQ ID NO: 462154 - RNA, 18 nt, Chlamydia trachomatis
gguccaaggaauaaacag

SEQ ID NO: 462155 - RNA, 20 nt, Chlamydia trachomatis
ggucagcuguacgauggaaa

SEQ ID NO: 462156 - RNA, 21 nt, Chlamydia trachomatis
ggucagcuguacgauggaaau

SEQ ID NO: 462157 - RNA, 15 nt, Chlamydia trachomatis
ggucagcucauuaga

SEQ ID NO: 462158 - RNA, 13 nt, Chlamydia trachomatis
gucaagagcuucu

SEQ ID NO: 462159 - RNA, 22 nt, Chlamydia trachomatis
ggugaagaaggaggggauuuuc

SEQ ID NO: 462160 - RNA, 17 nt, Chlamydia trachomatis
ggugaaagcuagaagaa

SEQ ID NO: 462161 - RNA, 22 nt, Chlamydia trachomatis
ggugaaagcuagaagaaucaua

SEQ ID NO: 462162 - RNA, 11 nt, Chlamydia trachomatis
gucaauuucug

SEQ ID NO: 462163 - RNA, 14 nt, Chlamydia trachomatis
gucaaugagauucc

SEQ ID NO: 462164 - RNA, 15 nt, Chlamydia trachomatis
gucacuccuccagcu

SEQ ID NO: 462165 - RNA, 24 nt, Chlamydia trachomatis
gucacucuugauagucuugcaugg

SEQ ID NO: 462166 - RNA, 22 nt, Chlamydia trachomatis
gucagccaguccucccaaaaua

SEQ ID NO: 462167 - RNA, 23 nt, Chlamydia trachomatis
guccaaaaagcgugucaaugaga

SEQ ID NO: 462168 - RNA, 21 nt, Chlamydia trachomatis
gucaucacugaccgaagaacu

SEQ ID NO: 462169 - RNA, 17 nt, Chlamydia trachomatis
gucaucagugucucaug

SEQ ID NO: 462170 - RNA, 18 nt, Chlamydia trachomatis
guccacauucacuucaac

SEQ ID NO: 462171 - RNA, 19 nt, Chlamydia trachomatis
guccaucuaaagggagaau

SEQ ID NO: 462172 - RNA, 18 nt, Chlamydia trachomatis
guccuccugauuccugcu

SEQ ID NO: 462173 - RNA, 20 nt, Chlamydia trachomatis
guccuccugauuccugcuga

SEQ ID NO: 462174 - RNA, 21 nt, Chlamydia trachomatis
guccugcuucuuuuucccgca

SEQ ID NO: 462175 - RNA, 13 nt, Chlamydia trachomatis
guccuuuauucaa

SEQ ID NO: 462176 - RNA, 13 nt, Chlamydia trachomatis
guccuuuucuccc

SEQ ID NO: 462177 - RNA, 22 nt, Chlamydia trachomatis
gucgauaucguuagcaucaucc

SEQ ID NO: 462178 - RNA, 17 nt, Chlamydia trachomatis
gucgauuuuuaaaagac

SEQ ID NO: 462179 - RNA, 19 nt, Chlamydia trachomatis
gucggcaagacucuuucaa

SEQ ID NO: 462180 - RNA, 22 nt, Chlamydia trachomatis
gucguaaacgauuaacucugca

SEQ ID NO: 462181 - RNA, 20 nt, Chlamydia trachomatis
gucucgacgcucauaaccau

SEQ ID NO: 462182 - RNA, 15 nt, Chlamydia trachomatis
gucucgcagcaccug

SEQ ID NO: 462183 - RNA, 19 nt, Chlamydia trachomatis
gucucgcgcuaaaaccuua

SEQ ID NO: 462184 - RNA, 23 nt, Chlamydia trachomatis
gucucgaaggaauacccagaagu

SEQ ID NO: 462185 - RNA, 22 nt, Chlamydia trachomatis
gucucuuaagcguuuaagugac

SEQ ID NO: 462186 - RNA, 19 nt, Chlamydia trachomatis
gucucuuauaaucuggaua

SEQ ID NO: 462187 - RNA, 13 nt, Chlamydia trachomatis
gucucuucacaaa

SEQ ID NO: 462188 - RNA, 20 nt, Chlamydia trachomatis
gucucuucuccuagagaaac

SEQ ID NO: 462189 - RNA, 22 nt, Chlamydia trachomatis
gucucuucugugcaaucagcuc

SEQ ID NO: 462190 - RNA, 18 nt, Chlamydia trachomatis
gucucaugcggagcucca

SEQ ID NO: 462191 - RNA, 22 nt, Chlamydia trachomatis
gucucaugcggagcuccaggaa

SEQ ID NO: 462192 - RNA, 12 nt, Chlamydia trachomatis
gucguuccucua

SEQ ID NO: 462193 - RNA, 16 nt, Chlamydia trachomatis
gucugcauuaaacacu

SEQ ID NO: 462194 - RNA, 23 nt, Chlamydia trachomatis
gucugcaagaaaauagguaaaga

SEQ ID NO: 462195 - RNA, 22 nt, Chlamydia trachomatis
gucuucucugugcacaaucucu

SEQ ID NO: 462196 - RNA, 20 nt, Chlamydia trachomatis
gucuugcuaaacaagucucu

SEQ ID NO: 462197 - RNA, 16 nt, Chlamydia trachomatis
gucugugauaucccuu

SEQ ID NO: 462198 - RNA, 17 nt, Chlamydia trachomatis
gucuguuccuaauacua

SEQ ID NO: 462199 - RNA, 19 nt, Chlamydia trachomatis
gucuguucuacacaucugu

SEQ ID NO: 462200 - RNA, 13 nt, Chlamydia trachomatis
gucuguuucuguc

SEQ ID NO: 462201 - RNA, 21 nt, Chlamydia trachomatis
gucuuaaaaggguagaaaaag

SEQ ID NO: 462202 - RNA, 23 nt, Chlamydia trachomatis
gucuuaaaggucgagcucccauu

SEQ ID NO: 462203 - RNA, 15 nt, Chlamydia trachomatis
gucuuagaagauccu

SEQ ID NO: 462204 - RNA, 20 nt, Chlamydia trachomatis
gucuuguaacuaagcuucuc

SEQ ID NO: 462205 - RNA, 15 nt, Chlamydia trachomatis
gucuuguccuucccg

SEQ ID NO: 462206 - RNA, 20 nt, Chlamydia trachomatis
gucuuuaauaccuucuuaca

SEQ ID NO: 462207 - RNA, 21 nt, Chlamydia trachomatis
gucuuuaauaccuucuuacau

SEQ ID NO: 462208 - RNA, 18 nt, Chlamydia trachomatis
aaauagcacgcaaaacau

SEQ ID NO: 462209 - RNA, 20 nt, Chlamydia trachomatis
aaauagcacgcaaaacaucu

SEQ ID NO: 462210 - RNA, 23 nt, Chlamydia trachomatis
aaauagccauucccuaaagcagc

SEQ ID NO: 462211 - RNA, 19 nt, Chlamydia trachomatis
gugaacagagcuucaucuc

SEQ ID NO: 462212 - RNA, 12 nt, Chlamydia trachomatis
gugaaagaaaaa

SEQ ID NO: 462213 - RNA, 15 nt, Chlamydia trachomatis
gugaaaagggcaaaa

SEQ ID NO: 462214 - RNA, 20 nt, Chlamydia trachomatis
aaauaggcgaauuucucuau

SEQ ID NO: 462215 - RNA, 17 nt, Chlamydia trachomatis
aaauagguaaagaaguu

SEQ ID NO: 462216 - RNA, 21 nt, Chlamydia trachomatis
aaauagguaugugcucauuuc

SEQ ID NO: 462217 - RNA, 12 nt, Chlamydia trachomatis
aaauaggaugga

SEQ ID NO: 462218 - RNA, 21 nt, Chlamydia trachomatis
gugacauuuccaacaaaaagc

SEQ ID NO: 462219 - RNA, 21 nt, Chlamydia trachomatis
gugacagcauagauauugccu

SEQ ID NO: 462220 - RNA, 22 nt, Chlamydia trachomatis
gugaccucugcguagaucccag

SEQ ID NO: 462221 - RNA, 17 nt, Chlamydia trachomatis
gugaagaacugucuucu

SEQ ID NO: 462222 - RNA, 14 nt, Chlamydia trachomatis
gugaagagcagagg

SEQ ID NO: 462223 - RNA, 19 nt, Chlamydia trachomatis
aaauagcuucguagagcaa

SEQ ID NO: 462224 - RNA, 14 nt, Chlamydia trachomatis
gugaauaggaagaa

SEQ ID NO: 462225 - RNA, 20 nt, Chlamydia trachomatis
gugaaucuguucagaacuca

SEQ ID NO: 462226 - RNA, 15 nt, Chlamydia trachomatis
gugagcccuccugca

SEQ ID NO: 462227 - RNA, 22 nt, Chlamydia trachomatis
gugagccgcuuaagcuguucuu

SEQ ID NO: 462228 - RNA, 22 nt, Chlamydia trachomatis
gugacuguaaguuuauuccaac

SEQ ID NO: 462229 - RNA, 17 nt, Chlamydia trachomatis
gugagacagcacuucuu

SEQ ID NO: 462230 - RNA, 19 nt, Chlamydia trachomatis
gugagacagcacuucuucu

SEQ ID NO: 462231 - RNA, 16 nt, Chlamydia trachomatis
gugagcgucuuuucac

SEQ ID NO: 462232 - RNA, 15 nt, Chlamydia trachomatis
gugaggaaguucugc

SEQ ID NO: 462233 - RNA, 18 nt, Chlamydia trachomatis
gugaguccacaugguuca

SEQ ID NO: 462234 - RNA, 16 nt, Chlamydia trachomatis
gugaguguaccauggg

SEQ ID NO: 462235 - RNA, 13 nt, Chlamydia trachomatis
gugaguuauauuu

SEQ ID NO: 462236 - RNA, 19 nt, Chlamydia trachomatis
gugcagaagaauaggaauc

SEQ ID NO: 462237 - RNA, 20 nt, Chlamydia trachomatis
gugcagaggauuuauaaaga

SEQ ID NO: 462238 - RNA, 14 nt, Chlamydia trachomatis
aaauauacucagag

SEQ ID NO: 462239 - RNA, 15 nt, Chlamydia trachomatis
aaauauacucagaga

SEQ ID NO: 462240 - RNA, 17 nt, Chlamydia trachomatis
guggaagcuagaagaag

SEQ ID NO: 462241 - RNA, 14 nt, Chlamydia trachomatis
guggaacagcucua

SEQ ID NO: 462242 - RNA, 15 nt, Chlamydia trachomatis
guguagcaaauaggc

SEQ ID NO: 462243 - RNA, 19 nt, Chlamydia trachomatis
guguacacgcugaguuucc

SEQ ID NO: 462244 - RNA, 22 nt, Chlamydia trachomatis
guguacgcuuugguagcucguu

SEQ ID NO: 462245 - RNA, 13 nt, Chlamydia trachomatis
guguacauuagca

SEQ ID NO: 462246 - RNA, 19 nt, Chlamydia trachomatis
guguucuaaacccucugca

SEQ ID NO: 462247 - RNA, 19 nt, Chlamydia trachomatis
gugugguuguagaggagaa

SEQ ID NO: 462248 - RNA, 16 nt, Chlamydia trachomatis
guguugaaugucuuuu

SEQ ID NO: 462249 - RNA, 20 nt, Chlamydia trachomatis
guguugcauauuccagcucc

SEQ ID NO: 462250 - RNA, 17 nt, Chlamydia trachomatis
guuaaaacacaaaagca

SEQ ID NO: 462251 - RNA, 19 nt, Chlamydia trachomatis
guuaacacaauuuuuguuc

SEQ ID NO: 462252 - RNA, 16 nt, Chlamydia trachomatis
guuaacaggcuuccuu

SEQ ID NO: 462253 - RNA, 14 nt, Chlamydia trachomatis
guuaacugacaauc

SEQ ID NO: 462254 - RNA, 16 nt, Chlamydia trachomatis
guuaaugggucaagaa

SEQ ID NO: 462255 - RNA, 21 nt, Chlamydia trachomatis
guuaaugucucuucacaaaua

SEQ ID NO: 462256 - RNA, 14 nt, Chlamydia trachomatis
guuaauucuuuuac

SEQ ID NO: 462257 - RNA, 23 nt, Chlamydia trachomatis
guuaccucuuuacgcacaaagau

SEQ ID NO: 462258 - RNA, 21 nt, Chlamydia trachomatis
guuaccugugaagaaacuucu

SEQ ID NO: 462259 - RNA, 13 nt, Chlamydia trachomatis
guuacccucuuua

SEQ ID NO: 462260 - RNA, 19 nt, Chlamydia trachomatis
guuacuucaaguucuucuu

SEQ ID NO: 462261 - RNA, 22 nt, Chlamydia trachomatis
guuagaaauucaucaugagaac

SEQ ID NO: 462262 - RNA, 17 nt, Chlamydia trachomatis
guuaggcauuccuuucu

SEQ ID NO: 462263 - RNA, 20 nt, Chlamydia trachomatis
guuauauugcuucauaaaaa

SEQ ID NO: 462264 - RNA, 17 nt, Chlamydia trachomatis
guuccagaaaaaauaau

SEQ ID NO: 462265 - RNA, 19 nt, Chlamydia trachomatis
guucagccccuaaagccac

SEQ ID NO: 462266 - RNA, 16 nt, Chlamydia trachomatis
guuauuuuuuaagaag

SEQ ID NO: 462267 - RNA, 10 nt, Chlamydia trachomatis
guucaccaau

SEQ ID NO: 462268 - RNA, 21 nt, Chlamydia trachomatis
guuccgaauaagcauuacaca

SEQ ID NO: 462269 - RNA, 16 nt, Chlamydia trachomatis
guuccaucuaaaggca

SEQ ID NO: 462270 - RNA, 14 nt, Chlamydia trachomatis
guuccaucuccuga

SEQ ID NO: 462271 - RNA, 14 nt, Chlamydia trachomatis
guuccaucuuccaa

SEQ ID NO: 462272 - RNA, 11 nt, Chlamydia trachomatis
guuccaucuuu

SEQ ID NO: 462273 - RNA, 18 nt, Chlamydia trachomatis
guuccggaucaaucccca

SEQ ID NO: 462274 - RNA, 20 nt, Chlamydia trachomatis
guucgguaaguccgcagaga

SEQ ID NO: 462275 - RNA, 17 nt, Chlamydia trachomatis
guucuaaacccucugca

SEQ ID NO: 462276 - RNA, 19 nt, Chlamydia trachomatis
guucuauaccuaaaaguuu

SEQ ID NO: 462277 - RNA, 14 nt, Chlamydia trachomatis
guucuauauacauu

SEQ ID NO: 462278 - RNA, 19 nt, Chlamydia trachomatis
guucuacacaucuguaucc

SEQ ID NO: 462279 - RNA, 13 nt, Chlamydia trachomatis
guugcaggcaaau

SEQ ID NO: 462280 - RNA, 23 nt, Chlamydia trachomatis
guugcgauuugauaucccccuuc

SEQ ID NO: 462281 - RNA, 14 nt, Chlamydia trachomatis
guugcuuccaaacg

SEQ ID NO: 462282 - RNA, 19 nt, Chlamydia trachomatis
guugcugagcuuuuuuuca

SEQ ID NO: 462283 - RNA, 15 nt, Chlamydia trachomatis
guugcgccuucugcu

SEQ ID NO: 462284 - RNA, 15 nt, Chlamydia trachomatis
guuggcgaauuucuu

SEQ ID NO: 462285 - RNA, 21 nt, Chlamydia trachomatis
guugguuuguuaagaagggag

SEQ ID NO: 462286 - RNA, 22 nt, Chlamydia trachomatis
guuguaaagcauucguuaucaa

SEQ ID NO: 462287 - RNA, 14 nt, Chlamydia trachomatis
guugguagaggaga

SEQ ID NO: 462288 - RNA, 19 nt, Chlamydia trachomatis
guuuaucugcccaucaucg

SEQ ID NO: 462289 - RNA, 23 nt, Chlamydia trachomatis
guuuaaccuuugcauuuaaauga

SEQ ID NO: 462290 - RNA, 19 nt, Chlamydia trachomatis
guuucagcgguugccuuac

SEQ ID NO: 462291 - RNA, 17 nt, Chlamydia trachomatis
aaauaucuacuucuugu

SEQ ID NO: 462292 - RNA, 18 nt, Chlamydia trachomatis
aaauaucuacuucuuguu

SEQ ID NO: 462293 - RNA, 15 nt, Chlamydia trachomatis
aaaucaaaaggccaa

SEQ ID NO: 462294 - RNA, 13 nt, Chlamydia trachomatis
aaaucaaaccaaa

SEQ ID NO: 462295 - RNA, 16 nt, Chlamydia trachomatis
aaaucaaaccaaaaau

SEQ ID NO: 462296 - RNA, 18 nt, Chlamydia trachomatis
guuuccucucucugcaga

SEQ ID NO: 462297 - RNA, 16 nt, Chlamydia trachomatis
guuucccuucuuucuu

SEQ ID NO: 462298 - RNA, 23 nt, Chlamydia trachomatis
guuucccaaaauuuuucugcucc

SEQ ID NO: 462299 - RNA, 19 nt, Chlamydia trachomatis
aaauauugcucuaaagucu

SEQ ID NO: 462300 - RNA, 20 nt, Chlamydia trachomatis
guuuccauuaaacuaugcaa

SEQ ID NO: 462301 - RNA, 16 nt, Chlamydia trachomatis
guuucguaguuuucuu

SEQ ID NO: 462302 - RNA, 12 nt, Chlamydia trachomatis
guuucuaaaaaa

SEQ ID NO: 462303 - RNA, 15 nt, Chlamydia trachomatis
aaaucaauaaugucu

SEQ ID NO: 462304 - RNA, 23 nt, Chlamydia trachomatis
aaaucaauaaugucuccaggaga

SEQ ID NO: 462305 - RNA, 15 nt, Chlamydia trachomatis
aaaucacaaugcgcu

SEQ ID NO: 462306 - RNA, 17 nt, Chlamydia trachomatis
aaaucacaaugcgcucc

SEQ ID NO: 462307 - RNA, 15 nt, Chlamydia trachomatis
aaaucacaauuuuuc

SEQ ID NO: 462308 - RNA, 18 nt, Chlamydia trachomatis
aaaucaccauauccauaa

SEQ ID NO: 462309 - RNA, 23 nt, Chlamydia trachomatis
aaaucaccauauccauaacuuua

SEQ ID NO: 462310 - RNA, 20 nt, Chlamydia trachomatis
aaaucacgcacuuuuuguuu

SEQ ID NO: 462311 - RNA, 17 nt, Chlamydia trachomatis
aaaucacugagaggagu

SEQ ID NO: 462312 - RNA, 21 nt, Chlamydia trachomatis
guuucuacuuuuugacauucu

SEQ ID NO: 462313 - RNA, 17 nt, Chlamydia trachomatis
guuucuccagaggaaau

SEQ ID NO: 462314 - RNA, 15 nt, Chlamydia trachomatis
guuuugaagaagauc

SEQ ID NO: 462315 - RNA, 12 nt, Chlamydia trachomatis
guuuucaaaagc

SEQ ID NO: 462316 - RNA, 20 nt, Chlamydia trachomatis
aaaucauuuccacaagauuu

SEQ ID NO: 462317 - RNA, 18 nt, Chlamydia trachomatis
aaauccaauguaaaauga

SEQ ID NO: 462318 - RNA, 18 nt, Chlamydia trachomatis
guuuggauaagaacuucu

SEQ ID NO: 462319 - RNA, 13 nt, Chlamydia trachomatis
guuugucuucaga

SEQ ID NO: 462320 - RNA, 14 nt, Chlamydia trachomatis
guuuguguuucuaa

SEQ ID NO: 462321 - RNA, 22 nt, Chlamydia trachomatis
guuucuucuacaaguucucucu

SEQ ID NO: 462322 - RNA, 22 nt, Chlamydia trachomatis
guuucugaaucaaacagaaccu

SEQ ID NO: 462323 - RNA, 14 nt, Chlamydia trachomatis
guuucuguaggaga

SEQ ID NO: 462324 - RNA, 19 nt, Chlamydia trachomatis
guuucuguuacacagaccu

SEQ ID NO: 462325 - RNA, 20 nt, Chlamydia trachomatis
guuucuguuuucguuuaucu

SEQ ID NO: 462326 - RNA, 20 nt, Chlamydia trachomatis
guuucuuaggaacucccuca

SEQ ID NO: 462327 - RNA, 15 nt, Chlamydia trachomatis
uaaagcuuuuuccaa

SEQ ID NO: 462328 - RNA, 23 nt, Chlamydia trachomatis
uaaagcuuuuucuacuguagcac

SEQ ID NO: 462329 - RNA, 18 nt, Chlamydia trachomatis
uaaaggaaacaagcagau

SEQ ID NO: 462330 - RNA, 12 nt, Chlamydia trachomatis
uaaagcuagucg

SEQ ID NO: 462331 - RNA, 19 nt, Chlamydia trachomatis
uaaagcuaucccaaaagaa

SEQ ID NO: 462332 - RNA, 19 nt, Chlamydia trachomatis
uaaaggaagggagcuuaga

SEQ ID NO: 462333 - RNA, 19 nt, Chlamydia trachomatis
uaaagucucuuaagcguuu

SEQ ID NO: 462334 - RNA, 17 nt, Chlamydia trachomatis
uaaagucuuaaaagggu

SEQ ID NO: 462335 - RNA, 17 nt, Chlamydia trachomatis
uaaagucgggggagcug

SEQ ID NO: 462336 - RNA, 14 nt, Chlamydia trachomatis
uaaagucuuuuccu

SEQ ID NO: 462337 - RNA, 15 nt, Chlamydia trachomatis
uaaaguuugcugggu

SEQ ID NO: 462338 - RNA, 14 nt, Chlamydia trachomatis
uaaauaauacaaag

SEQ ID NO: 462339 - RNA, 13 nt, Chlamydia trachomatis
uaaauauuaucag

SEQ ID NO: 462340 - RNA, 18 nt, Chlamydia trachomatis
uaaaucaguggaacugcu

SEQ ID NO: 462341 - RNA, 20 nt, Chlamydia trachomatis
uaaaucaguggaacugcuuc

SEQ ID NO: 462342 - RNA, 15 nt, Chlamydia trachomatis
uaaacuaucuaaaau

SEQ ID NO: 462343 - RNA, 19 nt, Chlamydia trachomatis
uaaacuaucuaaaaucccu

SEQ ID NO: 462344 - RNA, 21 nt, Chlamydia trachomatis
uaaacucucgggccaaaaaga

SEQ ID NO: 462345 - RNA, 23 nt, Chlamydia trachomatis
uaaacucucgggccaaaaagacu

SEQ ID NO: 462346 - RNA, 14 nt, Chlamydia trachomatis
uaaagaaucuccug

SEQ ID NO: 462347 - RNA, 15 nt, Chlamydia trachomatis
uaaagacacuaucac

SEQ ID NO: 462348 - RNA, 17 nt, Chlamydia trachomatis
uaaagacagcauaauug

SEQ ID NO: 462349 - RNA, 20 nt, Chlamydia trachomatis
guuuuuagcguaauagcucu

SEQ ID NO: 462350 - RNA, 15 nt, Chlamydia trachomatis
uaaacaaaugucccc

SEQ ID NO: 462351 - RNA, 23 nt, Chlamydia trachomatis
uaaacaaccaaaugaccuuuccc

SEQ ID NO: 462352 - RNA, 11 nt, Chlamydia trachomatis
uaaacaagaau

SEQ ID NO: 462353 - RNA, 14 nt, Chlamydia trachomatis
uaaacaagaucuau

SEQ ID NO: 462354 - RNA, 22 nt, Chlamydia trachomatis
uaaacaagguucuucaacaacu

SEQ ID NO: 462355 - RNA, 17 nt, Chlamydia trachomatis
uaaacacuagcccuucc

SEQ ID NO: 462356 - RNA, 20 nt, Chlamydia trachomatis
uaaauccucuuugaauaucc

SEQ ID NO: 462357 - RNA, 22 nt, Chlamydia trachomatis
uaaauccugcuugaaguagcau

SEQ ID NO: 462358 - RNA, 19 nt, Chlamydia trachomatis
uaaaugcuucuuaacugca

SEQ ID NO: 462359 - RNA, 16 nt, Chlamydia trachomatis
uaaauggauacuaacg

SEQ ID NO: 462360 - RNA, 13 nt, Chlamydia trachomatis
uaacaaacaacac

SEQ ID NO: 462361 - RNA, 18 nt, Chlamydia trachomatis
uaacaaggcuuuuccauu

SEQ ID NO: 462362 - RNA, 17 nt, Chlamydia trachomatis
uaacacauaucuccaaa

SEQ ID NO: 462363 - RNA, 12 nt, Chlamydia trachomatis
uaacaccaaaaa

SEQ ID NO: 462364 - RNA, 13 nt, Chlamydia trachomatis
uaacaccaaaaaa

SEQ ID NO: 462365 - RNA, 14 nt, Chlamydia trachomatis
uaacaccaaaaaau

SEQ ID NO: 462366 - RNA, 15 nt, Chlamydia trachomatis
uaacacccucuuccu

SEQ ID NO: 462367 - RNA, 21 nt, Chlamydia trachomatis
uaacgcagcucaccagcuucc

SEQ ID NO: 462368 - RNA, 19 nt, Chlamydia trachomatis
uaacgcauuccaaucauuu

SEQ ID NO: 462369 - RNA, 20 nt, Chlamydia trachomatis
uaacgcccucuuuucaaaau

SEQ ID NO: 462370 - RNA, 15 nt, Chlamydia trachomatis
uaacgcuuccucucc

SEQ ID NO: 462371 - RNA, 19 nt, Chlamydia trachomatis
uaacgcuuccucuccuucu

SEQ ID NO: 462372 - RNA, 22 nt, Chlamydia trachomatis
uaacacucgcaucauccuugcc

SEQ ID NO: 462373 - RNA, 17 nt, Chlamydia trachomatis
uaacacucucaucuaaa

SEQ ID NO: 462374 - RNA, 17 nt, Chlamydia trachomatis
uaacacuuuuuuuucuu

SEQ ID NO: 462375 - RNA, 20 nt, Chlamydia trachomatis
uaacaugguugauuuguccc

SEQ ID NO: 462376 - RNA, 16 nt, Chlamydia trachomatis
uaaccagaauccuuuu

SEQ ID NO: 462377 - RNA, 17 nt, Chlamydia trachomatis
uaaccagaauccuuuuc

SEQ ID NO: 462378 - RNA, 13 nt, Chlamydia trachomatis
uaacccuaaaaaa

SEQ ID NO: 462379 - RNA, 14 nt, Chlamydia trachomatis
uaacccuccgaccc

SEQ ID NO: 462380 - RNA, 13 nt, Chlamydia trachomatis
uaacccuucagga

SEQ ID NO: 462381 - RNA, 16 nt, Chlamydia trachomatis
uaagccuucuccagaa

SEQ ID NO: 462382 - RNA, 17 nt, Chlamydia trachomatis
uaagcgaaaaaaaaaga

SEQ ID NO: 462383 - RNA, 15 nt, Chlamydia trachomatis
uaagcgagauaagga

SEQ ID NO: 462384 - RNA, 15 nt, Chlamydia trachomatis
uaagcgaugagcgag

SEQ ID NO: 462385 - RNA, 13 nt, Chlamydia trachomatis
uaagcgcaagaaa

SEQ ID NO: 462386 - RNA, 19 nt, Chlamydia trachomatis
uaagcauuacacaacucuu

SEQ ID NO: 462387 - RNA, 19 nt, Chlamydia trachomatis
uaagcaccuuuacaaucau

SEQ ID NO: 462388 - RNA, 19 nt, Chlamydia trachomatis
uaagcacuauaucuccaac

SEQ ID NO: 462389 - RNA, 20 nt, Chlamydia trachomatis
uaagcacuauaucuccaaca

SEQ ID NO: 462390 - RNA, 21 nt, Chlamydia trachomatis
uaagauugaugacaacuacaa

SEQ ID NO: 462391 - RNA, 19 nt, Chlamydia trachomatis
uaagauuuucaucuuccaa

SEQ ID NO: 462392 - RNA, 20 nt, Chlamydia trachomatis
uaagauuuuucagccugucu

SEQ ID NO: 462393 - RNA, 13 nt, Chlamydia trachomatis
uaagcaaauccug

SEQ ID NO: 462394 - RNA, 15 nt, Chlamydia trachomatis
uaagcaacaauaucc

SEQ ID NO: 462395 - RNA, 21 nt, Chlamydia trachomatis
uaagcaacaauauccuccaua

SEQ ID NO: 462396 - RNA, 14 nt, Chlamydia trachomatis
uaagcaacgacaaa

SEQ ID NO: 462397 - RNA, 21 nt, Chlamydia trachomatis
uaagcucuaacucuucuuuau

SEQ ID NO: 462398 - RNA, 18 nt, Chlamydia trachomatis
uaagcuguucuuccauau

SEQ ID NO: 462399 - RNA, 22 nt, Chlamydia trachomatis
uaagcguuccuauacaagaaaa

SEQ ID NO: 462400 - RNA, 18 nt, Chlamydia trachomatis
uaagcguuuucuagugca

SEQ ID NO: 462401 - RNA, 16 nt, Chlamydia trachomatis
uaagcuagaaaauagc

SEQ ID NO: 462402 - RNA, 23 nt, Chlamydia trachomatis
uaaggaaagagaggcgucugcau

SEQ ID NO: 462403 - RNA, 19 nt, Chlamydia trachomatis
uaaggaaauaccuuguuuu

SEQ ID NO: 462404 - RNA, 16 nt, Chlamydia trachomatis
uaaggaauguggagcu

SEQ ID NO: 462405 - RNA, 16 nt, Chlamydia trachomatis
uaaggacuucaacaaa

SEQ ID NO: 462406 - RNA, 13 nt, Chlamydia trachomatis
uaaggagagaaaa

SEQ ID NO: 462407 - RNA, 16 nt, Chlamydia trachomatis
uaaggagagaaaagag

SEQ ID NO: 462408 - RNA, 15 nt, Chlamydia trachomatis
uaaggaguuuaacag

SEQ ID NO: 462409 - RNA, 13 nt, Chlamydia trachomatis
uaaggcgagaaua

SEQ ID NO: 462410 - RNA, 23 nt, Chlamydia trachomatis
uaaggcaugagauauagucgagu

SEQ ID NO: 462411 - RNA, 15 nt, Chlamydia trachomatis
uaauaaacagaucuu

SEQ ID NO: 462412 - RNA, 18 nt, Chlamydia trachomatis
uaauaaagauagcaucuu

SEQ ID NO: 462413 - RNA, 14 nt, Chlamydia trachomatis
uaauaaauuaggga

SEQ ID NO: 462414 - RNA, 17 nt, Chlamydia trachomatis
uaaguguugaggaacau

SEQ ID NO: 462415 - RNA, 18 nt, Chlamydia trachomatis
uaagugcuccugcagaca

SEQ ID NO: 462416 - RNA, 15 nt, Chlamydia trachomatis
uaaguuaccucuuua

SEQ ID NO: 462417 - RNA, 22 nt, Chlamydia trachomatis
uaaguucacugacuguagaaaa

SEQ ID NO: 462418 - RNA, 21 nt, Chlamydia trachomatis
uaaguuggcucguagagaacg

SEQ ID NO: 462419 - RNA, 17 nt, Chlamydia trachomatis
uaaguuguaaagcauuc

SEQ ID NO: 462420 - RNA, 16 nt, Chlamydia trachomatis
uaaguuuauuccaacc

SEQ ID NO: 462421 - RNA, 20 nt, Chlamydia trachomatis
uaagguacuucuauccggag

SEQ ID NO: 462422 - RNA, 20 nt, Chlamydia trachomatis
uaagguggcacacuccaucu

SEQ ID NO: 462423 - RNA, 17 nt, Chlamydia trachomatis
uaagguuugucuucaga

SEQ ID NO: 462424 - RNA, 14 nt, Chlamydia trachomatis
uaaguaaaagcacu

SEQ ID NO: 462425 - RNA, 14 nt, Chlamydia trachomatis
uaaguaaggauguu

SEQ ID NO: 462426 - RNA, 21 nt, Chlamydia trachomatis
uaaguagcaaauuaacagaua

SEQ ID NO: 462427 - RNA, 15 nt, Chlamydia trachomatis
uaaguauagaagccu

SEQ ID NO: 462428 - RNA, 18 nt, Chlamydia trachomatis
uaaguaucguaaacaaaa

SEQ ID NO: 462429 - RNA, 19 nt, Chlamydia trachomatis
uaaguaucguaaacaaaag

SEQ ID NO: 462430 - RNA, 20 nt, Chlamydia trachomatis
uaaguccaucuaaagggaga

SEQ ID NO: 462431 - RNA, 13 nt, Chlamydia trachomatis
uaagucuguugcc

SEQ ID NO: 462432 - RNA, 17 nt, Chlamydia trachomatis
uaagaccuaguaagugc

SEQ ID NO: 462433 - RNA, 19 nt, Chlamydia trachomatis
uaagaccuaguaagugcau

SEQ ID NO: 462434 - RNA, 13 nt, Chlamydia trachomatis
uaagacucaaauu

SEQ ID NO: 462435 - RNA, 21 nt, Chlamydia trachomatis
uaagacuuucucuaacaauga

SEQ ID NO: 462436 - RNA, 16 nt, Chlamydia trachomatis
uaagagcuacaggaac

SEQ ID NO: 462437 - RNA, 15 nt, Chlamydia trachomatis
uaagaggacuuucuu

SEQ ID NO: 462438 - RNA, 15 nt, Chlamydia trachomatis
uaagaggaucuccag

SEQ ID NO: 462439 - RNA, 18 nt, Chlamydia trachomatis
uaagauauccauagccuu

SEQ ID NO: 462440 - RNA, 21 nt, Chlamydia trachomatis
uaagauauugccaaaaagaaa

SEQ ID NO: 462441 - RNA, 16 nt, Chlamydia trachomatis
uaagaucucuacauaa

SEQ ID NO: 462442 - RNA, 17 nt, Chlamydia trachomatis
uaagaucucuacauaag

SEQ ID NO: 462443 - RNA, 17 nt, Chlamydia trachomatis
uaagaucucuuccuugu

SEQ ID NO: 462444 - RNA, 15 nt, Chlamydia trachomatis
uaagaucuguagcaa

SEQ ID NO: 462445 - RNA, 21 nt, Chlamydia trachomatis
uaagaucuguagcaagaagcu

SEQ ID NO: 462446 - RNA, 17 nt, Chlamydia trachomatis
uaagauucgaaggaaau

SEQ ID NO: 462447 - RNA, 14 nt, Chlamydia trachomatis
uaacuuuaauagcc

SEQ ID NO: 462448 - RNA, 17 nt, Chlamydia trachomatis
uaacuuugaacaaauuu

SEQ ID NO: 462449 - RNA, 19 nt, Chlamydia trachomatis
uaacuuuugaucccuaaua

SEQ ID NO: 462450 - RNA, 22 nt, Chlamydia trachomatis
uaagaaaaaggucucccaagaa

SEQ ID NO: 462451 - RNA, 23 nt, Chlamydia trachomatis
uaagaaaguuuuuuucaggagaa

SEQ ID NO: 462452 - RNA, 13 nt, Chlamydia trachomatis
uaagaacaacgcu

SEQ ID NO: 462453 - RNA, 21 nt, Chlamydia trachomatis
uaagaagguugaauuucagga

SEQ ID NO: 462454 - RNA, 16 nt, Chlamydia trachomatis
uaagaauaaacaacau

SEQ ID NO: 462455 - RNA, 16 nt, Chlamydia trachomatis
uaagaauaaagaugaa

SEQ ID NO: 462456 - RNA, 19 nt, Chlamydia trachomatis
uaagaauacaaagcagcca

SEQ ID NO: 462457 - RNA, 22 nt, Chlamydia trachomatis
uaagaaucgugugugacaaaug

SEQ ID NO: 462458 - RNA, 15 nt, Chlamydia trachomatis
uaacguagauaucuu

SEQ ID NO: 462459 - RNA, 20 nt, Chlamydia trachomatis
uaacguccgcuccuucuuuc

SEQ ID NO: 462460 - RNA, 14 nt, Chlamydia trachomatis
uaacguuccuccuc

SEQ ID NO: 462461 - RNA, 14 nt, Chlamydia trachomatis
uaacuaaaugucuc

SEQ ID NO: 462462 - RNA, 18 nt, Chlamydia trachomatis
uaacuaagcuucucaaca

SEQ ID NO: 462463 - RNA, 15 nt, Chlamydia trachomatis
uaacuacaucuaaaa

SEQ ID NO: 462464 - RNA, 19 nt, Chlamydia trachomatis
uaacuacaucuaaaagagu

SEQ ID NO: 462465 - RNA, 22 nt, Chlamydia trachomatis
uaacuaccauccgggaaugauu

SEQ ID NO: 462466 - RNA, 18 nt, Chlamydia trachomatis
uaacuaucccuacugaag

SEQ ID NO: 462467 - RNA, 21 nt, Chlamydia trachomatis
uaacuccaagggaugaagcua

SEQ ID NO: 462468 - RNA, 17 nt, Chlamydia trachomatis
uaacuccaguccaucuu

SEQ ID NO: 462469 - RNA, 12 nt, Chlamydia trachomatis
uaacuccaucag

SEQ ID NO: 462470 - RNA, 12 nt, Chlamydia trachomatis
uaacucccauga

SEQ ID NO: 462471 - RNA, 13 nt, Chlamydia trachomatis
uaacucugcaccg

SEQ ID NO: 462472 - RNA, 22 nt, Chlamydia trachomatis
uaacugagccaagaacaaagca

SEQ ID NO: 462473 - RNA, 23 nt, Chlamydia trachomatis
uaacugagccaagaacaaagcau

SEQ ID NO: 462474 - RNA, 14 nt, Chlamydia trachomatis
aaauccauucccag

SEQ ID NO: 462475 - RNA, 23 nt, Chlamydia trachomatis
aaauccauuggugguaacaccaa

SEQ ID NO: 462476 - RNA, 23 nt, Chlamydia trachomatis
aaaucccaguacaucaaauaauu

SEQ ID NO: 462477 - RNA, 18 nt, Chlamydia trachomatis
aaauccccagucucucca

SEQ ID NO: 462478 - RNA, 14 nt, Chlamydia trachomatis
aaaucccuaacucu

SEQ ID NO: 462479 - RNA, 15 nt, Chlamydia trachomatis
aaaucccuaacucuu

SEQ ID NO: 462480 - RNA, 16 nt, Chlamydia trachomatis
uaacugggauaagaaa

SEQ ID NO: 462481 - RNA, 18 nt, Chlamydia trachomatis
uaacugggauaagaaauc

SEQ ID NO: 462482 - RNA, 20 nt, Chlamydia trachomatis
uaacugguguggguaagaau

SEQ ID NO: 462483 - RNA, 20 nt, Chlamydia trachomatis
uaacuguggguuuuuuuauu

SEQ ID NO: 462484 - RNA, 23 nt, Chlamydia trachomatis
uaacuguggguuuuuuuauugau

SEQ ID NO: 462485 - RNA, 22 nt, Chlamydia trachomatis
uaacuuaauaagggcuuuugca

SEQ ID NO: 462486 - RNA, 15 nt, Chlamydia trachomatis
uaacuuaugaaaacu

SEQ ID NO: 462487 - RNA, 17 nt, Chlamydia trachomatis
uaacuuaugaaaacuuu

SEQ ID NO: 462488 - RNA, 12 nt, Chlamydia trachomatis
uaauuccaucuu

SEQ ID NO: 462489 - RNA, 16 nt, Chlamydia trachomatis
uaauuccuucaaauau

SEQ ID NO: 462490 - RNA, 16 nt, Chlamydia trachomatis
uaauuagaauuuccag

SEQ ID NO: 462491 - RNA, 17 nt, Chlamydia trachomatis
uaauuagaauuuccagc

SEQ ID NO: 462492 - RNA, 16 nt, Chlamydia trachomatis
uaauuaugaucacuaa

SEQ ID NO: 462493 - RNA, 13 nt, Chlamydia trachomatis
uaauuaaaggcuc

SEQ ID NO: 462494 - RNA, 18 nt, Chlamydia trachomatis
uaauuaaagguuucccaa

SEQ ID NO: 462495 - RNA, 21 nt, Chlamydia trachomatis
uaaugccuuuugcacaaagga

SEQ ID NO: 462496 - RNA, 16 nt, Chlamydia trachomatis
uaaugauuuuuuuauu

SEQ ID NO: 462497 - RNA, 21 nt, Chlamydia trachomatis
uaaugauuuuuuuauuuugag

SEQ ID NO: 462498 - RNA, 16 nt, Chlamydia trachomatis
uaauguccucuuuauc

SEQ ID NO: 462499 - RNA, 17 nt, Chlamydia trachomatis
uaaugucucuucacaaa

SEQ ID NO: 462500 - RNA, 20 nt, Chlamydia trachomatis
uaaugucucuucacaaauau

SEQ ID NO: 462501 - RNA, 14 nt, Chlamydia trachomatis
uaaucgaucacaga

SEQ ID NO: 462502 - RNA, 17 nt, Chlamydia trachomatis
uaaucgaucacagaaac

SEQ ID NO: 462503 - RNA, 17 nt, Chlamydia trachomatis
uaaugagcagaauagau

SEQ ID NO: 462504 - RNA, 16 nt, Chlamydia trachomatis
uaaugaucagcaaaaa

SEQ ID NO: 462505 - RNA, 17 nt, Chlamydia trachomatis
uaaugaucagcaaaaag

SEQ ID NO: 462506 - RNA, 14 nt, Chlamydia trachomatis
uaauugcaguauag

SEQ ID NO: 462507 - RNA, 20 nt, Chlamydia trachomatis
uaauugcgaagguucaagau

SEQ ID NO: 462508 - RNA, 23 nt, Chlamydia trachomatis
uaauuugacuaggauuacagcaa

SEQ ID NO: 462509 - RNA, 17 nt, Chlamydia trachomatis
uaauuuggcucuuuaau

SEQ ID NO: 462510 - RNA, 21 nt, Chlamydia trachomatis
uaauuuggcuucuuuuuucuu

SEQ ID NO: 462511 - RNA, 18 nt, Chlamydia trachomatis
uaauuuuccuuuuuccca

SEQ ID NO: 462512 - RNA, 22 nt, Chlamydia trachomatis
uaauuuuugauacaauuccugc

SEQ ID NO: 462513 - RNA, 12 nt, Chlamydia trachomatis
uacaaaaauacu

SEQ ID NO: 462514 - RNA, 17 nt, Chlamydia trachomatis
uacaaaagauuucuucu

SEQ ID NO: 462515 - RNA, 23 nt, Chlamydia trachomatis
uacaaaccgaagagggaagagaa

SEQ ID NO: 462516 - RNA, 13 nt, Chlamydia trachomatis
uacaaagcagcca

SEQ ID NO: 462517 - RNA, 19 nt, Chlamydia trachomatis
uacaaagcagccacuccug

SEQ ID NO: 462518 - RNA, 20 nt, Chlamydia trachomatis
uacaaaguggcguuguuucu

SEQ ID NO: 462519 - RNA, 19 nt, Chlamydia trachomatis
uacaaauaguguaaggaga

SEQ ID NO: 462520 - RNA, 16 nt, Chlamydia trachomatis
uacaacuaaaggaaac

SEQ ID NO: 462521 - RNA, 20 nt, Chlamydia trachomatis
uacaacuaaaggaaacaagc

SEQ ID NO: 462522 - RNA, 17 nt, Chlamydia trachomatis
uacaacucugaacaacu

SEQ ID NO: 462523 - RNA, 13 nt, Chlamydia trachomatis
uacaagaaaacag

SEQ ID NO: 462524 - RNA, 14 nt, Chlamydia trachomatis
uacaagaaaacagc

SEQ ID NO: 462525 - RNA, 21 nt, Chlamydia trachomatis
uaaucccuuuuucaagaaauc

SEQ ID NO: 462526 - RNA, 13 nt, Chlamydia trachomatis
uaauccaggagac

SEQ ID NO: 462527 - RNA, 18 nt, Chlamydia trachomatis
uaauccaugcaucuccuc

SEQ ID NO: 462528 - RNA, 18 nt, Chlamydia trachomatis
uaaucaguugaaagacuu

SEQ ID NO: 462529 - RNA, 13 nt, Chlamydia trachomatis
uaaucauagccau

SEQ ID NO: 462530 - RNA, 14 nt, Chlamydia trachomatis
uaaucauagccauc

SEQ ID NO: 462531 - RNA, 15 nt, Chlamydia trachomatis
uaaucaauugaaagu

SEQ ID NO: 462532 - RNA, 14 nt, Chlamydia trachomatis
uaauauuuuuuccc

SEQ ID NO: 462533 - RNA, 18 nt, Chlamydia trachomatis
uaauauugagaaauaauc

SEQ ID NO: 462534 - RNA, 15 nt, Chlamydia trachomatis
uaauauacucccaua

SEQ ID NO: 462535 - RNA, 20 nt, Chlamydia trachomatis
uaauauccuccaaagaugcu

SEQ ID NO: 462536 - RNA, 18 nt, Chlamydia trachomatis
uaauauggacuucccuaa

SEQ ID NO: 462537 - RNA, 15 nt, Chlamydia trachomatis
uaauagcaaagaaga

SEQ ID NO: 462538 - RNA, 19 nt, Chlamydia trachomatis
uaauacuuguccccuacua

SEQ ID NO: 462539 - RNA, 15 nt, Chlamydia trachomatis
uaauagaaaaacuau

SEQ ID NO: 462540 - RNA, 14 nt, Chlamydia trachomatis
uaauacgagaacau

SEQ ID NO: 462541 - RNA, 22 nt, Chlamydia trachomatis
uaauacuaaacuaucuaaaauc

SEQ ID NO: 462542 - RNA, 15 nt, Chlamydia trachomatis
uaauagcauuaauau

SEQ ID NO: 462543 - RNA, 18 nt, Chlamydia trachomatis
uaauagccgcgaguauag

SEQ ID NO: 462544 - RNA, 22 nt, Chlamydia trachomatis
uaauagcgggaggccauagaau

SEQ ID NO: 462545 - RNA, 16 nt, Chlamydia trachomatis
uaauagcuugcacagc

SEQ ID NO: 462546 - RNA, 23 nt, Chlamydia trachomatis
uaauagcuugcacagcaagcgaa

SEQ ID NO: 462547 - RNA, 13 nt, Chlamydia trachomatis
uaauaggaagaua

SEQ ID NO: 462548 - RNA, 17 nt, Chlamydia trachomatis
uaauaggauaggaaaug

SEQ ID NO: 462549 - RNA, 21 nt, Chlamydia trachomatis
uaauaggcaggagaccacuca

SEQ ID NO: 462550 - RNA, 24 nt, Chlamydia trachomatis
uaauaggcaggagaccacucauca

SEQ ID NO: 462551 - RNA, 20 nt, Chlamydia trachomatis
uaauagugcguccuucuuua

SEQ ID NO: 462552 - RNA, 17 nt, Chlamydia trachomatis
uaauaguuaaaacacaa

SEQ ID NO: 462553 - RNA, 21 nt, Chlamydia trachomatis
uaauaacugagccaagaacaa

SEQ ID NO: 462554 - RNA, 16 nt, Chlamydia trachomatis
uaauaagaccucuuuu

SEQ ID NO: 462555 - RNA, 12 nt, Chlamydia trachomatis
uaauaagauuga

SEQ ID NO: 462556 - RNA, 15 nt, Chlamydia trachomatis
uaauaagcuuuuucc

SEQ ID NO: 462557 - RNA, 16 nt, Chlamydia trachomatis
uaauaaguuuuucaaa

SEQ ID NO: 462558 - RNA, 21 nt, Chlamydia trachomatis
uaauaaucugugccagcugcu

SEQ ID NO: 462559 - RNA, 14 nt, Chlamydia trachomatis
uacaaguucucucu

SEQ ID NO: 462560 - RNA, 23 nt, Chlamydia trachomatis
uacaaggcuccuuuucaagagcc

SEQ ID NO: 462561 - RNA, 22 nt, Chlamydia trachomatis
uacaagggugcuaacuuucuuc

SEQ ID NO: 462562 - RNA, 18 nt, Chlamydia trachomatis
uacaauugagugugaguc

SEQ ID NO: 462563 - RNA, 15 nt, Chlamydia trachomatis
uacagucuguguuug

SEQ ID NO: 462564 - RNA, 17 nt, Chlamydia trachomatis
uacagucuuccucugcu

SEQ ID NO: 462565 - RNA, 15 nt, Chlamydia trachomatis
uacauaaucuuccug

SEQ ID NO: 462566 - RNA, 17 nt, Chlamydia trachomatis
uacaucagagcaauaga

SEQ ID NO: 462567 - RNA, 13 nt, Chlamydia trachomatis
uacaucaucucuc

SEQ ID NO: 462568 - RNA, 21 nt, Chlamydia trachomatis
uacaucuaaaagaguuucuuu

SEQ ID NO: 462569 - RNA, 16 nt, Chlamydia trachomatis
uacauucagaauauag

SEQ ID NO: 462570 - RNA, 23 nt, Chlamydia trachomatis
uacauugagaugaucccaucggc

SEQ ID NO: 462571 - RNA, 17 nt, Chlamydia trachomatis
uaccagccccacaagug

SEQ ID NO: 462572 - RNA, 14 nt, Chlamydia trachomatis
uaccacauucucuu

SEQ ID NO: 462573 - RNA, 15 nt, Chlamydia trachomatis
uaccacauucucuuu

SEQ ID NO: 462574 - RNA, 22 nt, Chlamydia trachomatis
uaccaucaauccuggaaucaca

SEQ ID NO: 462575 - RNA, 15 nt, Chlamydia trachomatis
uaccauucacaccga

SEQ ID NO: 462576 - RNA, 17 nt, Chlamydia trachomatis
uaccauaucaaaaauag

SEQ ID NO: 462577 - RNA, 20 nt, Chlamydia trachomatis
uaccauaauccuaugcagua

SEQ ID NO: 462578 - RNA, 15 nt, Chlamydia trachomatis
uacccauaauucuug

SEQ ID NO: 462579 - RNA, 12 nt, Chlamydia trachomatis
uacccaaacauc

SEQ ID NO: 462580 - RNA, 14 nt, Chlamydia trachomatis
uaccccuaaagucu

SEQ ID NO: 462581 - RNA, 17 nt, Chlamydia trachomatis
uacccgauucaaaaauc

SEQ ID NO: 462582 - RNA, 14 nt, Chlamydia trachomatis
uacccugugcuaaa

SEQ ID NO: 462583 - RNA, 20 nt, Chlamydia trachomatis
uacccuaaauuccuuugcuu

SEQ ID NO: 462584 - RNA, 19 nt, Chlamydia trachomatis
uacccuacugcaauuagua

SEQ ID NO: 462585 - RNA, 21 nt, Chlamydia trachomatis
uaccgacaauauuccauaaua

SEQ ID NO: 462586 - RNA, 11 nt, Chlamydia trachomatis
uacgcacagca

SEQ ID NO: 462587 - RNA, 16 nt, Chlamydia trachomatis
uacgcacauagcgacu

SEQ ID NO: 462588 - RNA, 15 nt, Chlamydia trachomatis
uacgcaaacuguauu

SEQ ID NO: 462589 - RNA, 13 nt, Chlamydia trachomatis
uaccguuccaucu

SEQ ID NO: 462590 - RNA, 20 nt, Chlamydia trachomatis
uacgcuaaaaacucuuucau

SEQ ID NO: 462591 - RNA, 19 nt, Chlamydia trachomatis
uacuaacaucaaagaucuu

SEQ ID NO: 462592 - RNA, 13 nt, Chlamydia trachomatis
uacuaacaaauag

SEQ ID NO: 462593 - RNA, 20 nt, Chlamydia trachomatis
uacuaaggugaguuucccuu

SEQ ID NO: 462594 - RNA, 21 nt, Chlamydia trachomatis
uacuacaacaggaccagagau

SEQ ID NO: 462595 - RNA, 17 nt, Chlamydia trachomatis
uacuguuuguuaucuaa

SEQ ID NO: 462596 - RNA, 21 nt, Chlamydia trachomatis
uacuucuggaggaguauccag

SEQ ID NO: 462597 - RNA, 18 nt, Chlamydia trachomatis
uacuucuuacuuaaaaaa

SEQ ID NO: 462598 - RNA, 21 nt, Chlamydia trachomatis
uacuucuugcgaugccucuaa

SEQ ID NO: 462599 - RNA, 14 nt, Chlamydia trachomatis
uacuugagaacaaa

SEQ ID NO: 462600 - RNA, 15 nt, Chlamydia trachomatis
uacuugagaacaaac

SEQ ID NO: 462601 - RNA, 14 nt, Chlamydia trachomatis
uacuugccucuuca

SEQ ID NO: 462602 - RNA, 21 nt, Chlamydia trachomatis
uacuugccucuucaaccuaga

SEQ ID NO: 462603 - RNA, 17 nt, Chlamydia trachomatis
uacuugcuccguggcaa

SEQ ID NO: 462604 - RNA, 20 nt, Chlamydia trachomatis
uacuugcuccguggcaagca

SEQ ID NO: 462605 - RNA, 13 nt, Chlamydia trachomatis
uacuuuaggagaa

SEQ ID NO: 462606 - RNA, 17 nt, Chlamydia trachomatis
uacucggauaaucaaau

SEQ ID NO: 462607 - RNA, 21 nt, Chlamydia trachomatis
uacucuaaaaagcguucuccg

SEQ ID NO: 462608 - RNA, 18 nt, Chlamydia trachomatis
uacucuaaaaguuuucuu

SEQ ID NO: 462609 - RNA, 13 nt, Chlamydia trachomatis
uacucugauuaga

SEQ ID NO: 462610 - RNA, 17 nt, Chlamydia trachomatis
uacucugcaaaaucuuc

SEQ ID NO: 462611 - RNA, 13 nt, Chlamydia trachomatis
uacucuuuucuuu

SEQ ID NO: 462612 - RNA, 20 nt, Chlamydia trachomatis
uacugacccauccaaaacau

SEQ ID NO: 462613 - RNA, 13 nt, Chlamydia trachomatis
uacugcaauaagg

SEQ ID NO: 462614 - RNA, 22 nt, Chlamydia trachomatis
uacugcaauaaggggaagaaau

SEQ ID NO: 462615 - RNA, 14 nt, Chlamydia trachomatis
uagguuccaucuaa

SEQ ID NO: 462616 - RNA, 21 nt, Chlamydia trachomatis
uagucaucugcagccuacaua

SEQ ID NO: 462617 - RNA, 13 nt, Chlamydia trachomatis
uaguacaaaaaua

SEQ ID NO: 462618 - RNA, 14 nt, Chlamydia trachomatis
uaguacaaaaauac

SEQ ID NO: 462619 - RNA, 22 nt, Chlamydia trachomatis
uaguucguuacgcguaaagauu

SEQ ID NO: 462620 - RNA, 21 nt, Chlamydia trachomatis
uaguuauauugcuucauaaaa

SEQ ID NO: 462621 - RNA, 18 nt, Chlamydia trachomatis
uaguuagguaaucuucua

SEQ ID NO: 462622 - RNA, 13 nt, Chlamydia trachomatis
uaguuagugaagu

SEQ ID NO: 462623 - RNA, 15 nt, Chlamydia trachomatis
uagugauaaacagga

SEQ ID NO: 462624 - RNA, 17 nt, Chlamydia trachomatis
uaguggugaguagcaaa

SEQ ID NO: 462625 - RNA, 16 nt, Chlamydia trachomatis
uaguguaaggagagaa

SEQ ID NO: 462626 - RNA, 18 nt, Chlamydia trachomatis
uaguguaaggagagaaaa

SEQ ID NO: 462627 - RNA, 15 nt, Chlamydia trachomatis
uagucgcuuagauau

SEQ ID NO: 462628 - RNA, 14 nt, Chlamydia trachomatis
uagugaagagcaga

SEQ ID NO: 462629 - RNA, 15 nt, Chlamydia trachomatis
uagugaagagcagag

SEQ ID NO: 462630 - RNA, 14 nt, Chlamydia trachomatis
uaguugcaaaaaga

SEQ ID NO: 462631 - RNA, 15 nt, Chlamydia trachomatis
uaguugcaaaaagaa

SEQ ID NO: 462632 - RNA, 19 nt, Chlamydia trachomatis
uaguuggccagcucaaaga

SEQ ID NO: 462633 - RNA, 17 nt, Chlamydia trachomatis
uauaaagccccuccgcu

SEQ ID NO: 462634 - RNA, 14 nt, Chlamydia trachomatis
uauaagagaacccu

SEQ ID NO: 462635 - RNA, 22 nt, Chlamydia trachomatis
uauaagagaagguaacaaugcu

SEQ ID NO: 462636 - RNA, 16 nt, Chlamydia trachomatis
uauaagguucaaggaa

SEQ ID NO: 462637 - RNA, 18 nt, Chlamydia trachomatis
uauaagguucaaggaagu

SEQ ID NO: 462638 - RNA, 16 nt, Chlamydia trachomatis
uauaagucaaaagaau

SEQ ID NO: 462639 - RNA, 18 nt, Chlamydia trachomatis
uauaagucaaaagaaucc

SEQ ID NO: 462640 - RNA, 20 nt, Chlamydia trachomatis
uauaauccgagcauuuucca

SEQ ID NO: 462641 - RNA, 16 nt, Chlamydia trachomatis
uauaaucuauuuuaua

SEQ ID NO: 462642 - RNA, 22 nt, Chlamydia trachomatis
uauauggacaagcaauagcuua

SEQ ID NO: 462643 - RNA, 14 nt, Chlamydia trachomatis
uauauguaagaagc

SEQ ID NO: 462644 - RNA, 12 nt, Chlamydia trachomatis
uaucaacaucug

SEQ ID NO: 462645 - RNA, 17 nt, Chlamydia trachomatis
uaucaagaauuucuuga

SEQ ID NO: 462646 - RNA, 19 nt, Chlamydia trachomatis
uaucaagaauuucuugaau

SEQ ID NO: 462647 - RNA, 20 nt, Chlamydia trachomatis
uaucaagaauuucuugaauu

SEQ ID NO: 462648 - RNA, 14 nt, Chlamydia trachomatis
uaucaauaaagaag

SEQ ID NO: 462649 - RNA, 17 nt, Chlamydia trachomatis
uaucaauaaagaagccu

SEQ ID NO: 462650 - RNA, 12 nt, Chlamydia trachomatis
uaucaccuauua

SEQ ID NO: 462651 - RNA, 14 nt, Chlamydia trachomatis
uaucagaagauagu

SEQ ID NO: 462652 - RNA, 19 nt, Chlamydia trachomatis
uaucagcaaccauauauuu

SEQ ID NO: 462653 - RNA, 14 nt, Chlamydia trachomatis
uaucagcauacaga

SEQ ID NO: 462654 - RNA, 13 nt, Chlamydia trachomatis
uauacacuaucag

SEQ ID NO: 462655 - RNA, 11 nt, Chlamydia trachomatis
uauacagaaca

SEQ ID NO: 462656 - RNA, 15 nt, Chlamydia trachomatis
uauaggcugaaacuu

SEQ ID NO: 462657 - RNA, 15 nt, Chlamydia trachomatis
uauaggcuuccaaau

SEQ ID NO: 462658 - RNA, 21 nt, Chlamydia trachomatis
uauaguuuucgacggaacucu

SEQ ID NO: 462659 - RNA, 20 nt, Chlamydia trachomatis
uaucagcgcucauaggacaa

SEQ ID NO: 462660 - RNA, 24 nt, Chlamydia trachomatis
uaucagcgucaucuuugagaagca

SEQ ID NO: 462661 - RNA, 18 nt, Chlamydia trachomatis
uauccacuuuuaggauag

SEQ ID NO: 462662 - RNA, 16 nt, Chlamydia trachomatis
uauccagaaguuuuaa

SEQ ID NO: 462663 - RNA, 24 nt, Chlamydia trachomatis
uauccuagagacggucuacaaaua

SEQ ID NO: 462664 - RNA, 16 nt, Chlamydia trachomatis
uauccccaucucuuuu

SEQ ID NO: 462665 - RNA, 18 nt, Chlamydia trachomatis
uaucccuaguacaaaaau

SEQ ID NO: 462666 - RNA, 16 nt, Chlamydia trachomatis
uauccugcucaacaua

SEQ ID NO: 462667 - RNA, 14 nt, Chlamydia trachomatis
uauccuuuuuacua

SEQ ID NO: 462668 - RNA, 18 nt, Chlamydia trachomatis
uaugaaaaaaaaagccuc

SEQ ID NO: 462669 - RNA, 15 nt, Chlamydia trachomatis
uaugaaaguagacca

SEQ ID NO: 462670 - RNA, 22 nt, Chlamydia trachomatis
uaugaaaguagaccauuuagac

SEQ ID NO: 462671 - RNA, 23 nt, Chlamydia trachomatis
uaugaacaacauaaaauccuucu

SEQ ID NO: 462672 - RNA, 18 nt, Chlamydia trachomatis
uaucugucagucuucuuu

SEQ ID NO: 462673 - RNA, 17 nt, Chlamydia trachomatis
uaucuucaaagaacaag

SEQ ID NO: 462674 - RNA, 19 nt, Chlamydia trachomatis
uaucuucaacccuuuuaau

SEQ ID NO: 462675 - RNA, 21 nt, Chlamydia trachomatis
uaucuucagguuuauaagaga

SEQ ID NO: 462676 - RNA, 16 nt, Chlamydia trachomatis
uaucugcccaucaucg

SEQ ID NO: 462677 - RNA, 23 nt, Chlamydia trachomatis
uaucugcccaucaucgaugauau

SEQ ID NO: 462678 - RNA, 20 nt, Chlamydia trachomatis
uaucuccgcuaggcaaauau

SEQ ID NO: 462679 - RNA, 16 nt, Chlamydia trachomatis
uaucucaggauaaaac

SEQ ID NO: 462680 - RNA, 15 nt, Chlamydia trachomatis
uaucuccaacaguga

SEQ ID NO: 462681 - RNA, 12 nt, Chlamydia trachomatis
uaucuccuaaaa

SEQ ID NO: 462682 - RNA, 13 nt, Chlamydia trachomatis
uaucuaaaaaaau

SEQ ID NO: 462683 - RNA, 11 nt, Chlamydia trachomatis
uaucuaaaauc

SEQ ID NO: 462684 - RNA, 21 nt, Chlamydia trachomatis
uaucuaacaauacuacuaagg

SEQ ID NO: 462685 - RNA, 15 nt, Chlamydia trachomatis
uaucuaccuuuuucc

SEQ ID NO: 462686 - RNA, 14 nt, Chlamydia trachomatis
uaucuagaaaagag

SEQ ID NO: 462687 - RNA, 17 nt, Chlamydia trachomatis
uaucuagaaaagagcag

SEQ ID NO: 462688 - RNA, 20 nt, Chlamydia trachomatis
uaucuagacauagcuuguuc

SEQ ID NO: 462689 - RNA, 17 nt, Chlamydia trachomatis
uaugcaaccuucuccaa

SEQ ID NO: 462690 - RNA, 16 nt, Chlamydia trachomatis
uaugcaaaaagagcau

SEQ ID NO: 462691 - RNA, 22 nt, Chlamydia trachomatis
uaugcagacucaaagcuucccu

SEQ ID NO: 462692 - RNA, 22 nt, Chlamydia trachomatis
uaugauuccgcugcucuaacca

SEQ ID NO: 462693 - RNA, 16 nt, Chlamydia trachomatis
uaugauucuucuagcu

SEQ ID NO: 462694 - RNA, 22 nt, Chlamydia trachomatis
uaugaauccuugaaccaaacga

SEQ ID NO: 462695 - RNA, 20 nt, Chlamydia trachomatis
uaugacagagcccuucuuuu

SEQ ID NO: 462696 - RNA, 22 nt, Chlamydia trachomatis
uaugcgcaaagauguuucuuau

SEQ ID NO: 462697 - RNA, 14 nt, Chlamydia trachomatis
uaugcuacuccuaa

SEQ ID NO: 462698 - RNA, 13 nt, Chlamydia trachomatis
uaugcugaagcua

SEQ ID NO: 462699 - RNA, 17 nt, Chlamydia trachomatis
uaugcugaagcuacuaa

SEQ ID NO: 462700 - RNA, 21 nt, Chlamydia trachomatis
uauggcaaucgcggaagaaag

SEQ ID NO: 462701 - RNA, 21 nt, Chlamydia trachomatis
uaugcuuuuuaauauccucca

SEQ ID NO: 462702 - RNA, 14 nt, Chlamydia trachomatis
uauggacaagcaau

SEQ ID NO: 462703 - RNA, 18 nt, Chlamydia trachomatis
uauggucgucucagcuuc

SEQ ID NO: 462704 - RNA, 15 nt, Chlamydia trachomatis
uauggucucucauac

SEQ ID NO: 462705 - RNA, 17 nt, Chlamydia trachomatis
uauucuugcuaagaaca

SEQ ID NO: 462706 - RNA, 18 nt, Chlamydia trachomatis
uauucuucuucugcaaga

SEQ ID NO: 462707 - RNA, 14 nt, Chlamydia trachomatis
uauucuuucuuauc

SEQ ID NO: 462708 - RNA, 13 nt, Chlamydia trachomatis
uauucuaaagucu

SEQ ID NO: 462709 - RNA, 16 nt, Chlamydia trachomatis
uauuccgagagaagcu

SEQ ID NO: 462710 - RNA, 18 nt, Chlamydia trachomatis
uauuccgcuucuauuucc

SEQ ID NO: 462711 - RNA, 16 nt, Chlamydia trachomatis
uauucaaaucuucuuc

SEQ ID NO: 462712 - RNA, 15 nt, Chlamydia trachomatis
uauucccaaagcuag

SEQ ID NO: 462713 - RNA, 18 nt, Chlamydia trachomatis
uauuuaagaagcuaucua

SEQ ID NO: 462714 - RNA, 15 nt, Chlamydia trachomatis
aaauccuacacaagc

SEQ ID NO: 462715 - RNA, 22 nt, Chlamydia trachomatis
aaauccuauacccgacuaaaaa

SEQ ID NO: 462716 - RNA, 22 nt, Chlamydia trachomatis
aaauccuccugcaggaggcauu

SEQ ID NO: 462717 - RNA, 20 nt, Chlamydia trachomatis
aaauccucuuugaauauccg

SEQ ID NO: 462718 - RNA, 19 nt, Chlamydia trachomatis
aaauccugcgcgcaaauca

SEQ ID NO: 462719 - RNA, 11 nt, Chlamydia trachomatis
uauugauuuuu

SEQ ID NO: 462720 - RNA, 17 nt, Chlamydia trachomatis
uaugugaaaauaucuaa

SEQ ID NO: 462721 - RNA, 21 nt, Chlamydia trachomatis
uaugguuuuuucgauaguacc

SEQ ID NO: 462722 - RNA, 14 nt, Chlamydia trachomatis
uauguaaaaauucu

SEQ ID NO: 462723 - RNA, 19 nt, Chlamydia trachomatis
uauguaaacaagaauaaua

SEQ ID NO: 462724 - RNA, 13 nt, Chlamydia trachomatis
uauguaaggaaau

SEQ ID NO: 462725 - RNA, 20 nt, Chlamydia trachomatis
uauguauaccgcguaagcaa

SEQ ID NO: 462726 - RNA, 19 nt, Chlamydia trachomatis
uauguuggucaaugcugcu

SEQ ID NO: 462727 - RNA, 20 nt, Chlamydia trachomatis
uauuaaaaaggcuagagaua

SEQ ID NO: 462728 - RNA, 14 nt, Chlamydia trachomatis
uauuaauuucuaga

SEQ ID NO: 462729 - RNA, 18 nt, Chlamydia trachomatis
uauuaucuagaaaagagc

SEQ ID NO: 462730 - RNA, 17 nt, Chlamydia trachomatis
ucaaagcuaacucaccu

SEQ ID NO: 462731 - RNA, 17 nt, Chlamydia trachomatis
ucaaaucacugagagga

SEQ ID NO: 462732 - RNA, 20 nt, Chlamydia trachomatis
ucaaacugugaagaaugaaa

SEQ ID NO: 462733 - RNA, 20 nt, Chlamydia trachomatis
ucaaauuucucuaggaacau

SEQ ID NO: 462734 - RNA, 17 nt, Chlamydia trachomatis
ucaaauuuucaugaaaa

SEQ ID NO: 462735 - RNA, 13 nt, Chlamydia trachomatis
ucaaaccaaaaau

SEQ ID NO: 462736 - RNA, 15 nt, Chlamydia trachomatis
ucaaacauagaagga

SEQ ID NO: 462737 - RNA, 24 nt, Chlamydia trachomatis
ucaaacauagaaggaaugcagauc

SEQ ID NO: 462738 - RNA, 17 nt, Chlamydia trachomatis
ucaaacaaucuaaaaaa

SEQ ID NO: 462739 - RNA, 19 nt, Chlamydia trachomatis
ucaaacaaucuaaaaaauu

SEQ ID NO: 462740 - RNA, 19 nt, Chlamydia trachomatis
ucaaacacucgugaaauaa

SEQ ID NO: 462741 - RNA, 15 nt, Chlamydia trachomatis
ucaaaagcuuuuccg

SEQ ID NO: 462742 - RNA, 16 nt, Chlamydia trachomatis
ucaaaagcuaucuuug

SEQ ID NO: 462743 - RNA, 21 nt, Chlamydia trachomatis
ucaaaaggccaacgcauguaa

SEQ ID NO: 462744 - RNA, 18 nt, Chlamydia trachomatis
ucaaaaugaucgccucua

SEQ ID NO: 462745 - RNA, 23 nt, Chlamydia trachomatis
ucaaaaugaucuaaaggaaaaau

SEQ ID NO: 462746 - RNA, 15 nt, Chlamydia trachomatis
ucaacauaauaaaua

SEQ ID NO: 462747 - RNA, 23 nt, Chlamydia trachomatis
ucaacauaauaaauauuaucaga

SEQ ID NO: 462748 - RNA, 14 nt, Chlamydia trachomatis
ucaacaacuucaau

SEQ ID NO: 462749 - RNA, 23 nt, Chlamydia trachomatis
ucaacaagauuuuuuacaaugua

SEQ ID NO: 462750 - RNA, 13 nt, Chlamydia trachomatis
ucaacagaugacu

SEQ ID NO: 462751 - RNA, 22 nt, Chlamydia trachomatis
ucaacgaaagcauccccaaaag

SEQ ID NO: 462752 - RNA, 15 nt, Chlamydia trachomatis
ucaaccucucaucag

SEQ ID NO: 462753 - RNA, 16 nt, Chlamydia trachomatis
ucaaccucucaucagu

SEQ ID NO: 462754 - RNA, 15 nt, Chlamydia trachomatis
ucaacuccagagcaa

SEQ ID NO: 462755 - RNA, 23 nt, Chlamydia trachomatis
ucaacuucuccaguuaauccuuc

SEQ ID NO: 462756 - RNA, 19 nt, Chlamydia trachomatis
ucaauaccuagcaauucau

SEQ ID NO: 462757 - RNA, 19 nt, Chlamydia trachomatis
ucaauagcaggaacuucuu

SEQ ID NO: 462758 - RNA, 14 nt, Chlamydia trachomatis
ucaauagcauuucu

SEQ ID NO: 462759 - RNA, 21 nt, Chlamydia trachomatis
ucaauaucaacguuuucacua

SEQ ID NO: 462760 - RNA, 18 nt, Chlamydia trachomatis
ucaauaaacgaggaauau

SEQ ID NO: 462761 - RNA, 15 nt, Chlamydia trachomatis
ucaauaaugucucca

SEQ ID NO: 462762 - RNA, 17 nt, Chlamydia trachomatis
ucaauaauuucuacguu

SEQ ID NO: 462763 - RNA, 17 nt, Chlamydia trachomatis
ucaauguggcugauuaa

SEQ ID NO: 462764 - RNA, 20 nt, Chlamydia trachomatis
ucaauguggcugauuaauaa

SEQ ID NO: 462765 - RNA, 15 nt, Chlamydia trachomatis
ucaauucuugcuuca

SEQ ID NO: 462766 - RNA, 14 nt, Chlamydia trachomatis
ucaauuguuguaca

SEQ ID NO: 462767 - RNA, 16 nt, Chlamydia trachomatis
ucaaucacuccuccuc

SEQ ID NO: 462768 - RNA, 13 nt, Chlamydia trachomatis
ucaaugagauucc

SEQ ID NO: 462769 - RNA, 22 nt, Chlamydia trachomatis
ucacaggcugugauggaaaugu

SEQ ID NO: 462770 - RNA, 16 nt, Chlamydia trachomatis
ucacagcaauagccau

SEQ ID NO: 462771 - RNA, 19 nt, Chlamydia trachomatis
ucacaaaagcgaauaaguu

SEQ ID NO: 462772 - RNA, 16 nt, Chlamydia trachomatis
ucacaaaccaaaacca

SEQ ID NO: 462773 - RNA, 19 nt, Chlamydia trachomatis
ucacaaaccaaaaccacac

SEQ ID NO: 462774 - RNA, 16 nt, Chlamydia trachomatis
ucacaugcucaucaaa

SEQ ID NO: 462775 - RNA, 18 nt, Chlamydia trachomatis
ucacaugcucaucaaacu

SEQ ID NO: 462776 - RNA, 13 nt, Chlamydia trachomatis
ucacaugguuuuc

SEQ ID NO: 462777 - RNA, 18 nt, Chlamydia trachomatis
ucaccacgagaucugcau

SEQ ID NO: 462778 - RNA, 19 nt, Chlamydia trachomatis
ucaccauauccauaacuuu

SEQ ID NO: 462779 - RNA, 15 nt, Chlamydia trachomatis
ucacuaggcucauga

SEQ ID NO: 462780 - RNA, 22 nt, Chlamydia trachomatis
ucacuaggcucaugagccucua

SEQ ID NO: 462781 - RNA, 18 nt, Chlamydia trachomatis
ucacuaucauugagcaaa

SEQ ID NO: 462782 - RNA, 19 nt, Chlamydia trachomatis
ucacgcaucccaaaauagc

SEQ ID NO: 462783 - RNA, 14 nt, Chlamydia trachomatis
ucacggagagaaag

SEQ ID NO: 462784 - RNA, 15 nt, Chlamydia trachomatis
ucacggagagaaaga

SEQ ID NO: 462785 - RNA, 18 nt, Chlamydia trachomatis
ucacgccagcuaagagaa

SEQ ID NO: 462786 - RNA, 16 nt, Chlamydia trachomatis
ucagaacaagugcagc

SEQ ID NO: 462787 - RNA, 21 nt, Chlamydia trachomatis
ucagaaacuucccacggaaga

SEQ ID NO: 462788 - RNA, 22 nt, Chlamydia trachomatis
ucacuuucccccaccuuuucuc

SEQ ID NO: 462789 - RNA, 13 nt, Chlamydia trachomatis
ucacuuucugcuu

SEQ ID NO: 462790 - RNA, 23 nt, Chlamydia trachomatis
ucacuuuucuagcagccucucuu

SEQ ID NO: 462791 - RNA, 14 nt, Chlamydia trachomatis
ucagaaaacuuagc

SEQ ID NO: 462792 - RNA, 16 nt, Chlamydia trachomatis
ucacugcaacuaauau

SEQ ID NO: 462793 - RNA, 14 nt, Chlamydia trachomatis
ucacuugaaucaca

SEQ ID NO: 462794 - RNA, 19 nt, Chlamydia trachomatis
ucagagcuuugcagauccc

SEQ ID NO: 462795 - RNA, 18 nt, Chlamydia trachomatis
ucagagggacgagcagcc

SEQ ID NO: 462796 - RNA, 19 nt, Chlamydia trachomatis
ucagagguagccaaagaau

SEQ ID NO: 462797 - RNA, 17 nt, Chlamydia trachomatis
ucagaccuuuuguuuuu

SEQ ID NO: 462798 - RNA, 16 nt, Chlamydia trachomatis
ucagaacucaaaauaa

SEQ ID NO: 462799 - RNA, 18 nt, Chlamydia trachomatis
ucagaacucaaaauaaag

SEQ ID NO: 462800 - RNA, 20 nt, Chlamydia trachomatis
ucagaacucaaaauaaagaa

SEQ ID NO: 462801 - RNA, 23 nt, Chlamydia trachomatis
ucagaacucaaaauaaagaaauu

SEQ ID NO: 462802 - RNA, 12 nt, Chlamydia trachomatis
ucagaagaagag

SEQ ID NO: 462803 - RNA, 16 nt, Chlamydia trachomatis
ucagaagcuauuccau

SEQ ID NO: 462804 - RNA, 16 nt, Chlamydia trachomatis
ucagacacaaugaauu

SEQ ID NO: 462805 - RNA, 13 nt, Chlamydia trachomatis
ucagaaucugugc

SEQ ID NO: 462806 - RNA, 24 nt, Chlamydia trachomatis
ucagcaaauguggauagcaacgaa

SEQ ID NO: 462807 - RNA, 13 nt, Chlamydia trachomatis
ucagcaaaaagag

SEQ ID NO: 462808 - RNA, 15 nt, Chlamydia trachomatis
ucagcaaaaagagga

SEQ ID NO: 462809 - RNA, 21 nt, Chlamydia trachomatis
ucagcaaaaagaggagaacau

SEQ ID NO: 462810 - RNA, 13 nt, Chlamydia trachomatis
aaaucuaaaauau

SEQ ID NO: 462811 - RNA, 15 nt, Chlamydia trachomatis
ucagcaagauucucc

SEQ ID NO: 462812 - RNA, 20 nt, Chlamydia trachomatis
ucagcaagauucuccuuaga

SEQ ID NO: 462813 - RNA, 21 nt, Chlamydia trachomatis
ucagcaauaauaccuuaauaa

SEQ ID NO: 462814 - RNA, 18 nt, Chlamydia trachomatis
ucagcacccacauuacca

SEQ ID NO: 462815 - RNA, 21 nt, Chlamydia trachomatis
ucagcagauauggaagaacag

SEQ ID NO: 462816 - RNA, 16 nt, Chlamydia trachomatis
ucagcagaucauccau

SEQ ID NO: 462817 - RNA, 13 nt, Chlamydia trachomatis
ucagcauccugaa

SEQ ID NO: 462818 - RNA, 16 nt, Chlamydia trachomatis
ucagcaucaauaaugg

SEQ ID NO: 462819 - RNA, 17 nt, Chlamydia trachomatis
ucagcuccuaucacucc

SEQ ID NO: 462820 - RNA, 15 nt, Chlamydia trachomatis
ucagcgguugccuua

SEQ ID NO: 462821 - RNA, 20 nt, Chlamydia trachomatis
ucagcgguugccuuacucuu

SEQ ID NO: 462822 - RNA, 11 nt, Chlamydia trachomatis
ucagcucuccu

SEQ ID NO: 462823 - RNA, 18 nt, Chlamydia trachomatis
ucaggagaguguuugcau

SEQ ID NO: 462824 - RNA, 18 nt, Chlamydia trachomatis
ucaggagcaugaaucagc

SEQ ID NO: 462825 - RNA, 14 nt, Chlamydia trachomatis
aaaucuauccauaa

SEQ ID NO: 462826 - RNA, 18 nt, Chlamydia trachomatis
aaaucuccaaaauucugu

SEQ ID NO: 462827 - RNA, 17 nt, Chlamydia trachomatis
ucaguggaacugcuucc

SEQ ID NO: 462828 - RNA, 23 nt, Chlamydia trachomatis
ucaggcuaucacaaaagcgaaua

SEQ ID NO: 462829 - RNA, 14 nt, Chlamydia trachomatis
ucaggcucuuucag

SEQ ID NO: 462830 - RNA, 14 nt, Chlamydia trachomatis
ucauuuuguauaaa

SEQ ID NO: 462831 - RNA, 22 nt, Chlamydia trachomatis
uccaaauuucccucuucccgcc

SEQ ID NO: 462832 - RNA, 20 nt, Chlamydia trachomatis
uccaaauuuuguuuaaucag

SEQ ID NO: 462833 - RNA, 16 nt, Chlamydia trachomatis
uccaacaauuuucguu

SEQ ID NO: 462834 - RNA, 19 nt, Chlamydia trachomatis
ucauuuaauaaguuuuuca

SEQ ID NO: 462835 - RNA, 20 nt, Chlamydia trachomatis
ucauuuaauaaguuuuucaa

SEQ ID NO: 462836 - RNA, 11 nt, Chlamydia trachomatis
ucauugaucac

SEQ ID NO: 462837 - RNA, 16 nt, Chlamydia trachomatis
ucauugaaaucagaaa

SEQ ID NO: 462838 - RNA, 18 nt, Chlamydia trachomatis
ucauugagcaaaaaaaga

SEQ ID NO: 462839 - RNA, 19 nt, Chlamydia trachomatis
ucaguuugaaucacagaaa

SEQ ID NO: 462840 - RNA, 22 nt, Chlamydia trachomatis
uccaauaggggcaugacgaucu

SEQ ID NO: 462841 - RNA, 15 nt, Chlamydia trachomatis
uccaaucguauaaua

SEQ ID NO: 462842 - RNA, 19 nt, Chlamydia trachomatis
uccaaucguauaauaaugg

SEQ ID NO: 462843 - RNA, 23 nt, Chlamydia trachomatis
uccaauccuguggucacaagaac

SEQ ID NO: 462844 - RNA, 23 nt, Chlamydia trachomatis
uccaauccuuggcaagaagcugc

SEQ ID NO: 462845 - RNA, 20 nt, Chlamydia trachomatis
uccaaggaauaaacagguaa

SEQ ID NO: 462846 - RNA, 23 nt, Chlamydia trachomatis
uccaagggaugaagcuaaaaaau

SEQ ID NO: 462847 - RNA, 21 nt, Chlamydia trachomatis
uccaaguuuuguaaaguaacu

SEQ ID NO: 462848 - RNA, 23 nt, Chlamydia trachomatis
uccaaguuuuguaaaguaacuac

SEQ ID NO: 462849 - RNA, 13 nt, Chlamydia trachomatis
uccaagaaaaaua

SEQ ID NO: 462850 - RNA, 16 nt, Chlamydia trachomatis
uccaagaaaaauacag

SEQ ID NO: 462851 - RNA, 16 nt, Chlamydia trachomatis
uccacacaacauaacu

SEQ ID NO: 462852 - RNA, 19 nt, Chlamydia trachomatis
uccacacaacauaacucug

SEQ ID NO: 462853 - RNA, 20 nt, Chlamydia trachomatis
uccacagaucugguccucca

SEQ ID NO: 462854 - RNA, 21 nt, Chlamydia trachomatis
uccacagaucugguccuccag

SEQ ID NO: 462855 - RNA, 15 nt, Chlamydia trachomatis
uccacagcagugagc

SEQ ID NO: 462856 - RNA, 13 nt, Chlamydia trachomatis
uccacgcuauaga

SEQ ID NO: 462857 - RNA, 17 nt, Chlamydia trachomatis
uccagaaaaaauaaugg

SEQ ID NO: 462858 - RNA, 12 nt, Chlamydia trachomatis
uccagaacgaag

SEQ ID NO: 462859 - RNA, 14 nt, Chlamydia trachomatis
uccagaagggaagu

SEQ ID NO: 462860 - RNA, 21 nt, Chlamydia trachomatis
uccagcaucuuuucuuauaaa

SEQ ID NO: 462861 - RNA, 21 nt, Chlamydia trachomatis
uccaggagagucugcuacaaa

SEQ ID NO: 462862 - RNA, 22 nt, Chlamydia trachomatis
uccaggagagucugcuacaaac

SEQ ID NO: 462863 - RNA, 17 nt, Chlamydia trachomatis
uccagucuacagccucc

SEQ ID NO: 462864 - RNA, 15 nt, Chlamydia trachomatis
uccauauccaugaag

SEQ ID NO: 462865 - RNA, 13 nt, Chlamydia trachomatis
uccauaucuacag

SEQ ID NO: 462866 - RNA, 19 nt, Chlamydia trachomatis
uccauauucuugcuaagaa

SEQ ID NO: 462867 - RNA, 20 nt, Chlamydia trachomatis
uccauaguuacaacuucagc

SEQ ID NO: 462868 - RNA, 12 nt, Chlamydia trachomatis
uccauagugcca

SEQ ID NO: 462869 - RNA, 18 nt, Chlamydia trachomatis
uccauauauucagaagaa

SEQ ID NO: 462870 - RNA, 19 nt, Chlamydia trachomatis
uccauauauucagaagaag

SEQ ID NO: 462871 - RNA, 17 nt, Chlamydia trachomatis
uccaguucuggagcaac

SEQ ID NO: 462872 - RNA, 15 nt, Chlamydia trachomatis
uccaguuaauccuuc

SEQ ID NO: 462873 - RNA, 19 nt, Chlamydia trachomatis
uccauccugcguguacauu

SEQ ID NO: 462874 - RNA, 19 nt, Chlamydia trachomatis
uccaucacuccaagaagag

SEQ ID NO: 462875 - RNA, 15 nt, Chlamydia trachomatis
uccaucauaaaaaga

SEQ ID NO: 462876 - RNA, 16 nt, Chlamydia trachomatis
uccaucauaaaaagau

SEQ ID NO: 462877 - RNA, 15 nt, Chlamydia trachomatis
uccaucuaaagggag

SEQ ID NO: 462878 - RNA, 17 nt, Chlamydia trachomatis
uccaucuaaagggagaa

SEQ ID NO: 462879 - RNA, 20 nt, Chlamydia trachomatis
uccaucucuccggagaacag

SEQ ID NO: 462880 - RNA, 14 nt, Chlamydia trachomatis
uccaucuuuaaaga

SEQ ID NO: 462881 - RNA, 23 nt, Chlamydia trachomatis
uccaugaagacccguuuucucuu

SEQ ID NO: 462882 - RNA, 16 nt, Chlamydia trachomatis
uccaugaccaagguug

SEQ ID NO: 462883 - RNA, 16 nt, Chlamydia trachomatis
uccaugauuucuuuaa

SEQ ID NO: 462884 - RNA, 20 nt, Chlamydia trachomatis
uccaugauccccuacgcuac

SEQ ID NO: 462885 - RNA, 16 nt, Chlamydia trachomatis
uccaugaucucugcag

SEQ ID NO: 462886 - RNA, 22 nt, Chlamydia trachomatis
uccaugaucucugcagaagaag

SEQ ID NO: 462887 - RNA, 17 nt, Chlamydia trachomatis
uccaugugagaacgaag

SEQ ID NO: 462888 - RNA, 15 nt, Chlamydia trachomatis
uccauugcaggagau

SEQ ID NO: 462889 - RNA, 15 nt, Chlamydia trachomatis
uccauugauagguac

SEQ ID NO: 462890 - RNA, 14 nt, Chlamydia trachomatis
uccauucgcauuaa

SEQ ID NO: 462891 - RNA, 21 nt, Chlamydia trachomatis
uccauucgcauuaaauaauac

SEQ ID NO: 462892 - RNA, 14 nt, Chlamydia trachomatis
uccauuuccagaac

SEQ ID NO: 462893 - RNA, 17 nt, Chlamydia trachomatis
uccauuuucguaagcau

SEQ ID NO: 462894 - RNA, 20 nt, Chlamydia trachomatis
ucccaaaaacaaucaaagca

SEQ ID NO: 462895 - RNA, 14 nt, Chlamydia trachomatis
ucccaaaagaauga

SEQ ID NO: 462896 - RNA, 22 nt, Chlamydia trachomatis
ucccaaaagauuuucaacggga

SEQ ID NO: 462897 - RNA, 23 nt, Chlamydia trachomatis
ucccaacaggagaucccaaaaga

SEQ ID NO: 462898 - RNA, 16 nt, Chlamydia trachomatis
ucccaagaaacuuuuc

SEQ ID NO: 462899 - RNA, 18 nt, Chlamydia trachomatis
ucccaagaaacuuuucug

SEQ ID NO: 462900 - RNA, 19 nt, Chlamydia trachomatis
ucccacaaacaaaaaagaa

SEQ ID NO: 462901 - RNA, 16 nt, Chlamydia trachomatis
ucccacaacuugcguu

SEQ ID NO: 462902 - RNA, 15 nt, Chlamydia trachomatis
ucccaccuuaaaugc

SEQ ID NO: 462903 - RNA, 22 nt, Chlamydia trachomatis
ucccauuuuuaccaaaccuuuc

SEQ ID NO: 462904 - RNA, 23 nt, Chlamydia trachomatis
uccccaaaaggauugacagcugu

SEQ ID NO: 462905 - RNA, 13 nt, Chlamydia trachomatis
uccccaaagcagu

SEQ ID NO: 462906 - RNA, 20 nt, Chlamydia trachomatis
ucccauucugcguuuaauuc

SEQ ID NO: 462907 - RNA, 19 nt, Chlamydia trachomatis
uccccagaacgcaauguuu

SEQ ID NO: 462908 - RNA, 18 nt, Chlamydia trachomatis
uccccagaagccauaaua

SEQ ID NO: 462909 - RNA, 20 nt, Chlamydia trachomatis
uccccacgaccacaaacaau

SEQ ID NO: 462910 - RNA, 22 nt, Chlamydia trachomatis
uccccaagggggguuaagaaaa

SEQ ID NO: 462911 - RNA, 13 nt, Chlamydia trachomatis
uccccccgaccuu

SEQ ID NO: 462912 - RNA, 14 nt, Chlamydia trachomatis
uccccauucuucuc

SEQ ID NO: 462913 - RNA, 15 nt, Chlamydia trachomatis
uccccauucuucucg

SEQ ID NO: 462914 - RNA, 14 nt, Chlamydia trachomatis
ucccagugaugaaa

SEQ ID NO: 462915 - RNA, 15 nt, Chlamydia trachomatis
ucccagugaugaaau

SEQ ID NO: 462916 - RNA, 19 nt, Chlamydia trachomatis
ucccaguuaggcauuccuu

SEQ ID NO: 462917 - RNA, 20 nt, Chlamydia trachomatis
ucccaguuaggcauuccuuu

SEQ ID NO: 462918 - RNA, 23 nt, Chlamydia trachomatis
ucccaguuaggcauuccuuucuu

SEQ ID NO: 462919 - RNA, 13 nt, Chlamydia trachomatis
ucccauaaucuca

SEQ ID NO: 462920 - RNA, 15 nt, Chlamydia trachomatis
ucccauagcuucuua

SEQ ID NO: 462921 - RNA, 23 nt, Chlamydia trachomatis
ucccauaguaccucgagcaacga

SEQ ID NO: 462922 - RNA, 13 nt, Chlamydia trachomatis
ucccaucaaaagc

SEQ ID NO: 462923 - RNA, 19 nt, Chlamydia trachomatis
ucccaucuacaaaaccaaa

SEQ ID NO: 462924 - RNA, 21 nt, Chlamydia trachomatis
ucccaucuugcacauuuucuu

SEQ ID NO: 462925 - RNA, 18 nt, Chlamydia trachomatis
ucccagagaaucuuaaac

SEQ ID NO: 462926 - RNA, 19 nt, Chlamydia trachomatis
ucccagagaaucuuaaaca

SEQ ID NO: 462927 - RNA, 23 nt, Chlamydia trachomatis
ucccacucuuccccuucuuuaua

SEQ ID NO: 462928 - RNA, 12 nt, Chlamydia trachomatis
ucccacucuucu

SEQ ID NO: 462929 - RNA, 18 nt, Chlamydia trachomatis
ucccagaauaaaggauuc

SEQ ID NO: 462930 - RNA, 18 nt, Chlamydia trachomatis
uccccgauauaucuguaa

SEQ ID NO: 462931 - RNA, 15 nt, Chlamydia trachomatis
uccccuacaaacauc

SEQ ID NO: 462932 - RNA, 20 nt, Chlamydia trachomatis
ucccgaacuuuauuauugaa

SEQ ID NO: 462933 - RNA, 23 nt, Chlamydia trachomatis
ucccgcguaguguagucagaaga

SEQ ID NO: 462934 - RNA, 19 nt, Chlamydia trachomatis
ucccgcuauuuuccucuuc

SEQ ID NO: 462935 - RNA, 22 nt, Chlamydia trachomatis
ucccgcuauuuuccucuucaca

SEQ ID NO: 462936 - RNA, 17 nt, Chlamydia trachomatis
ucccggaggaauugauc

SEQ ID NO: 462937 - RNA, 19 nt, Chlamydia trachomatis
ucccguuaaugggucaaga

SEQ ID NO: 462938 - RNA, 16 nt, Chlamydia trachomatis
ucccuuagcaacaguc

SEQ ID NO: 462939 - RNA, 13 nt, Chlamydia trachomatis
ucccuucuuucuu

SEQ ID NO: 462940 - RNA, 19 nt, Chlamydia trachomatis
ucccuguaguuagguaauc

SEQ ID NO: 462941 - RNA, 17 nt, Chlamydia trachomatis
ucccugucauaccaaga

SEQ ID NO: 462942 - RNA, 19 nt, Chlamydia trachomatis
ucccugcaacauuuccuaa

SEQ ID NO: 462943 - RNA, 21 nt, Chlamydia trachomatis
ucccugcaacauuuccuaagg

SEQ ID NO: 462944 - RNA, 23 nt, Chlamydia trachomatis
ucccugcaauuuacuaucaggaa

SEQ ID NO: 462945 - RNA, 20 nt, Chlamydia trachomatis
ucccugcauaauagcuugca

SEQ ID NO: 462946 - RNA, 19 nt, Chlamydia trachomatis
ucccuaagaucucuuccuu

SEQ ID NO: 462947 - RNA, 17 nt, Chlamydia trachomatis
ucccuaauacaaucagu

SEQ ID NO: 462948 - RNA, 13 nt, Chlamydia trachomatis
ucccuagaaaauc

SEQ ID NO: 462949 - RNA, 16 nt, Chlamydia trachomatis
ucccuagaaaaucuau

SEQ ID NO: 462950 - RNA, 15 nt, Chlamydia trachomatis
ucccucauuuaaaag

SEQ ID NO: 462951 - RNA, 20 nt, Chlamydia trachomatis
ucccucuguccauucuaagg

SEQ ID NO: 462952 - RNA, 22 nt, Chlamydia trachomatis
ucccucuguccauucuaaggag

SEQ ID NO: 462953 - RNA, 18 nt, Chlamydia trachomatis
aaaucugggaggagaacu

SEQ ID NO: 462954 - RNA, 18 nt, Chlamydia trachomatis
aaaucucuuggagagaau

SEQ ID NO: 462955 - RNA, 18 nt, Chlamydia trachomatis
ucccuugcaaaaaucucu

SEQ ID NO: 462956 - RNA, 22 nt, Chlamydia trachomatis
ucccuugaacuagaaauaaaau

SEQ ID NO: 462957 - RNA, 16 nt, Chlamydia trachomatis
ucccuuuuucaagaaa

SEQ ID NO: 462958 - RNA, 16 nt, Chlamydia trachomatis
uccgacaccaggcaau

SEQ ID NO: 462959 - RNA, 22 nt, Chlamydia trachomatis
uccgaagauuauaccagcagac

SEQ ID NO: 462960 - RNA, 16 nt, Chlamydia trachomatis
uccgaauaaguccaca

SEQ ID NO: 462961 - RNA, 21 nt, Chlamydia trachomatis
uccgaguaaucaaaaaaggaa

SEQ ID NO: 462962 - RNA, 19 nt, Chlamydia trachomatis
uccgauaauuuuccuuuuu

SEQ ID NO: 462963 - RNA, 15 nt, Chlamydia trachomatis
uccgauagcaugcaa

SEQ ID NO: 462964 - RNA, 17 nt, Chlamydia trachomatis
uccgauagcaugcaaaa

SEQ ID NO: 462965 - RNA, 13 nt, Chlamydia trachomatis
uccgauaggaaaa

SEQ ID NO: 462966 - RNA, 18 nt, Chlamydia trachomatis
uccgcaaacaaaauaauc

SEQ ID NO: 462967 - RNA, 15 nt, Chlamydia trachomatis
uccgccaacuauuga

SEQ ID NO: 462968 - RNA, 21 nt, Chlamydia trachomatis
uccgcaguaaaaucuaaaaua

SEQ ID NO: 462969 - RNA, 22 nt, Chlamydia trachomatis
uccgcaguaaaaucuaaaauau

SEQ ID NO: 462970 - RNA, 11 nt, Chlamydia trachomatis
uccgcagagau

SEQ ID NO: 462971 - RNA, 22 nt, Chlamydia trachomatis
uccgcagagaugauauuuucau

SEQ ID NO: 462972 - RNA, 16 nt, Chlamydia trachomatis
uccgccuccggcuccc

SEQ ID NO: 462973 - RNA, 19 nt, Chlamydia trachomatis
uccgcuccccuuccuguuc

SEQ ID NO: 462974 - RNA, 17 nt, Chlamydia trachomatis
uccgcuagauccguuuu

SEQ ID NO: 462975 - RNA, 17 nt, Chlamydia trachomatis
uccggaagauacagccu

SEQ ID NO: 462976 - RNA, 22 nt, Chlamydia trachomatis
uccggagaacaguguccuucca

SEQ ID NO: 462977 - RNA, 16 nt, Chlamydia trachomatis
uccgcucgauauccug

SEQ ID NO: 462978 - RNA, 14 nt, Chlamydia trachomatis
uccgcuccuucuuu

SEQ ID NO: 462979 - RNA, 16 nt, Chlamydia trachomatis
uccgcugauuagaaag

SEQ ID NO: 462980 - RNA, 17 nt, Chlamydia trachomatis
uccgcugcaaucucuug

SEQ ID NO: 462981 - RNA, 20 nt, Chlamydia trachomatis
uccgcugcaaucucuuguuu

SEQ ID NO: 462982 - RNA, 17 nt, Chlamydia trachomatis
uccggcucucuucacaa

SEQ ID NO: 462983 - RNA, 17 nt, Chlamydia trachomatis
uccgguguauccucguc

SEQ ID NO: 462984 - RNA, 12 nt, Chlamydia trachomatis
uccgguucucuu

SEQ ID NO: 462985 - RNA, 16 nt, Chlamydia trachomatis
uccgguucucuuggcu

SEQ ID NO: 462986 - RNA, 15 nt, Chlamydia trachomatis
uccgguucuuuugua

SEQ ID NO: 462987 - RNA, 23 nt, Chlamydia trachomatis
uccguaaaagucucuaaagcuuu

SEQ ID NO: 462988 - RNA, 22 nt, Chlamydia trachomatis
uccgugacgaauaaucaauccg

SEQ ID NO: 462989 - RNA, 23 nt, Chlamydia trachomatis
uccguuguagagauaaaaucagc

SEQ ID NO: 462990 - RNA, 14 nt, Chlamydia trachomatis
uccguuucuagaag

SEQ ID NO: 462991 - RNA, 15 nt, Chlamydia trachomatis
uccucaagcgauuau

SEQ ID NO: 462992 - RNA, 19 nt, Chlamydia trachomatis
uccucaagcgauuaugaaa

SEQ ID NO: 462993 - RNA, 17 nt, Chlamydia trachomatis
uccucaaaagaacuucc

SEQ ID NO: 462994 - RNA, 20 nt, Chlamydia trachomatis
uccucaaaagaacuuccuau

SEQ ID NO: 462995 - RNA, 17 nt, Chlamydia trachomatis
uccuagcagcuaauacu

SEQ ID NO: 462996 - RNA, 21 nt, Chlamydia trachomatis
uccuaggauuacuuuuucuac

SEQ ID NO: 462997 - RNA, 22 nt, Chlamydia trachomatis
uccuaggggauuuuaugaagca

SEQ ID NO: 462998 - RNA, 16 nt, Chlamydia trachomatis
uccuauacaagaaaac

SEQ ID NO: 462999 - RNA, 20 nt, Chlamydia trachomatis
uccuauacccgacuaaaaaa

SEQ ID NO: 463000 - RNA, 18 nt, Chlamydia trachomatis
uccuaucaccacuaaucc

SEQ ID NO: 463001 - RNA, 13 nt, Chlamydia trachomatis
uccuaugacaggc

SEQ ID NO: 463002 - RNA, 22 nt, Chlamydia trachomatis
uccuacacaagcuuuuuucuga

SEQ ID NO: 463003 - RNA, 20 nt, Chlamydia trachomatis
uccuaccaauauucccugua

SEQ ID NO: 463004 - RNA, 14 nt, Chlamydia trachomatis
uccuagcgaagucu

SEQ ID NO: 463005 - RNA, 15 nt, Chlamydia trachomatis
uccuagcgaagucuu

SEQ ID NO: 463006 - RNA, 13 nt, Chlamydia trachomatis
uccuaacuaaaaa

SEQ ID NO: 463007 - RNA, 23 nt, Chlamydia trachomatis
uccuaagcagugaauaacguaga

SEQ ID NO: 463008 - RNA, 12 nt, Chlamydia trachomatis
uccuaaacaaau

SEQ ID NO: 463009 - RNA, 17 nt, Chlamydia trachomatis
uccuaaaccuccagaag

SEQ ID NO: 463010 - RNA, 21 nt, Chlamydia trachomatis
uccuaaaguaagauuuuucag

SEQ ID NO: 463011 - RNA, 13 nt, Chlamydia trachomatis
uccuaauacuaaa

SEQ ID NO: 463012 - RNA, 16 nt, Chlamydia trachomatis
uccuaauacuaaacua

SEQ ID NO: 463013 - RNA, 16 nt, Chlamydia trachomatis
uccuaaucuuucuaau

SEQ ID NO: 463014 - RNA, 20 nt, Chlamydia trachomatis
uccuaauguagaaauuuuaa

SEQ ID NO: 463015 - RNA, 14 nt, Chlamydia trachomatis
uccuacaaaauagu

SEQ ID NO: 463016 - RNA, 22 nt, Chlamydia trachomatis
uccucgggaaauucagguaauu

SEQ ID NO: 463017 - RNA, 22 nt, Chlamydia trachomatis
uccucuaaacaagguucuucaa

SEQ ID NO: 463018 - RNA, 13 nt, Chlamydia trachomatis
uccucuacaccau

SEQ ID NO: 463019 - RNA, 23 nt, Chlamydia trachomatis
uccucuacgcuuccuacagcuag

SEQ ID NO: 463020 - RNA, 13 nt, Chlamydia trachomatis
uccucgcaaucca

SEQ ID NO: 463021 - RNA, 17 nt, Chlamydia trachomatis
uccucgaagcuacugau

SEQ ID NO: 463022 - RNA, 18 nt, Chlamydia trachomatis
uccucagggcugacuaaa

SEQ ID NO: 463023 - RNA, 16 nt, Chlamydia trachomatis
uccucauaaaggaaag

SEQ ID NO: 463024 - RNA, 21 nt, Chlamydia trachomatis
uccucaguauaaaaaaagucu

SEQ ID NO: 463025 - RNA, 18 nt, Chlamydia trachomatis
uccuccaaagaugcuccu

SEQ ID NO: 463026 - RNA, 17 nt, Chlamydia trachomatis
uccuccagauacugcuc

SEQ ID NO: 463027 - RNA, 16 nt, Chlamydia trachomatis
uccucccaaaauaccu

SEQ ID NO: 463028 - RNA, 16 nt, Chlamydia trachomatis
uccuccucccuuucca

SEQ ID NO: 463029 - RNA, 13 nt, Chlamydia trachomatis
uccuccuccuaaa

SEQ ID NO: 463030 - RNA, 20 nt, Chlamydia trachomatis
uccuccugauuccugcugau

SEQ ID NO: 463031 - RNA, 19 nt, Chlamydia trachomatis
uccuccugcaggaggcauu

SEQ ID NO: 463032 - RNA, 15 nt, Chlamydia trachomatis
uccugagggccuucu

SEQ ID NO: 463033 - RNA, 21 nt, Chlamydia trachomatis
uccugagggccuucuuuuucc

SEQ ID NO: 463034 - RNA, 15 nt, Chlamydia trachomatis
uccucuccuucuaca

SEQ ID NO: 463035 - RNA, 16 nt, Chlamydia trachomatis
uccucucucugcagag

SEQ ID NO: 463036 - RNA, 16 nt, Chlamydia trachomatis
uccucucucuuuauga

SEQ ID NO: 463037 - RNA, 17 nt, Chlamydia trachomatis
uccucugaauccauucu

SEQ ID NO: 463038 - RNA, 23 nt, Chlamydia trachomatis
uccucuggcuuaucaacaagauu

SEQ ID NO: 463039 - RNA, 14 nt, Chlamydia trachomatis
uccucuucuucugu

SEQ ID NO: 463040 - RNA, 14 nt, Chlamydia trachomatis
uccucuugagcauu

SEQ ID NO: 463041 - RNA, 16 nt, Chlamydia trachomatis
uccucuuuuuccuacg

SEQ ID NO: 463042 - RNA, 17 nt, Chlamydia trachomatis
uccugaaacgaucagcu

SEQ ID NO: 463043 - RNA, 23 nt, Chlamydia trachomatis
uccugaaaguuccgguauauucu

SEQ ID NO: 463044 - RNA, 12 nt, Chlamydia trachomatis
uccugaagcaau

SEQ ID NO: 463045 - RNA, 19 nt, Chlamydia trachomatis
uccugcauacuuuucaauu

SEQ ID NO: 463046 - RNA, 17 nt, Chlamydia trachomatis
uccugcagacaagccuu

SEQ ID NO: 463047 - RNA, 20 nt, Chlamydia trachomatis
uccugcaggaggcauuccuu

SEQ ID NO: 463048 - RNA, 13 nt, Chlamydia trachomatis
uccugccaaaaac

SEQ ID NO: 463049 - RNA, 13 nt, Chlamydia trachomatis
uccugcugguggc

SEQ ID NO: 463050 - RNA, 17 nt, Chlamydia trachomatis
uccugcuucuuuuuccc

SEQ ID NO: 463051 - RNA, 14 nt, Chlamydia trachomatis
uccugcugaucaga

SEQ ID NO: 463052 - RNA, 15 nt, Chlamydia trachomatis
uccuucaaauauuuu

SEQ ID NO: 463053 - RNA, 14 nt, Chlamydia trachomatis
uccuuaucuaauuc

SEQ ID NO: 463054 - RNA, 13 nt, Chlamydia trachomatis
uccuuaucuucuu

SEQ ID NO: 463055 - RNA, 23 nt, Chlamydia trachomatis
uccuuaaacucucgggccaaaaa

SEQ ID NO: 463056 - RNA, 13 nt, Chlamydia trachomatis
uccuuaaaguuug

SEQ ID NO: 463057 - RNA, 16 nt, Chlamydia trachomatis
uccuuacauaaaaaag

SEQ ID NO: 463058 - RNA, 14 nt, Chlamydia trachomatis
uccuuagcuaaaag

SEQ ID NO: 463059 - RNA, 21 nt, Chlamydia trachomatis
uccuuaguuaaaacuccagaa

SEQ ID NO: 463060 - RNA, 22 nt, Chlamydia trachomatis
uccuuaguuaaaacuccagaaa

SEQ ID NO: 463061 - RNA, 20 nt, Chlamydia trachomatis
uccuuauacaucagagcaau

SEQ ID NO: 463062 - RNA, 20 nt, Chlamydia trachomatis
uccuuauaguuguuuuugau

SEQ ID NO: 463063 - RNA, 23 nt, Chlamydia trachomatis
uccuguagaaagacuuaccauag

SEQ ID NO: 463064 - RNA, 11 nt, Chlamydia trachomatis
uccuguucucc

SEQ ID NO: 463065 - RNA, 20 nt, Chlamydia trachomatis
uccuguucuucaaauucuac

SEQ ID NO: 463066 - RNA, 20 nt, Chlamydia trachomatis
uccuucuuucuggaaucauu

SEQ ID NO: 463067 - RNA, 14 nt, Chlamydia trachomatis
uccuucuugugaga

SEQ ID NO: 463068 - RNA, 17 nt, Chlamydia trachomatis
uccuucuugugagagaa

SEQ ID NO: 463069 - RNA, 13 nt, Chlamydia trachomatis
uccuugaaccaaa

SEQ ID NO: 463070 - RNA, 13 nt, Chlamydia trachomatis
uccuuccucuuua

SEQ ID NO: 463071 - RNA, 23 nt, Chlamydia trachomatis
uccuucgaagcggagcaucuucu

SEQ ID NO: 463072 - RNA, 16 nt, Chlamydia trachomatis
uccuucgauauggcaa

SEQ ID NO: 463073 - RNA, 18 nt, Chlamydia trachomatis
uccuucuacaaaaaauga

SEQ ID NO: 463074 - RNA, 16 nt, Chlamydia trachomatis
uccuucucgcaaaaga

SEQ ID NO: 463075 - RNA, 12 nt, Chlamydia trachomatis
uccuucugcuau

SEQ ID NO: 463076 - RNA, 16 nt, Chlamydia trachomatis
uccuuggcuuuuacaa

SEQ ID NO: 463077 - RNA, 23 nt, Chlamydia trachomatis
uccuuggcuuuuacaauagcauu

SEQ ID NO: 463078 - RNA, 20 nt, Chlamydia trachomatis
uccuuugcuuuuuauccuac

SEQ ID NO: 463079 - RNA, 13 nt, Chlamydia trachomatis
uccuuuucagaau

SEQ ID NO: 463080 - RNA, 15 nt, Chlamydia trachomatis
uccuuuugauucugc

SEQ ID NO: 463081 - RNA, 21 nt, Chlamydia trachomatis
uccuuuugauucugcuccaaa

SEQ ID NO: 463082 - RNA, 20 nt, Chlamydia trachomatis
uccuuuuggaagaucucuuu

SEQ ID NO: 463083 - RNA, 12 nt, Chlamydia trachomatis
uccuuuuuccuu

SEQ ID NO: 463084 - RNA, 14 nt, Chlamydia trachomatis
ucgaaaacaaagag

SEQ ID NO: 463085 - RNA, 12 nt, Chlamydia trachomatis
ucgaagcauagg

SEQ ID NO: 463086 - RNA, 19 nt, Chlamydia trachomatis
ucgaaggagcuaagaacca

SEQ ID NO: 463087 - RNA, 22 nt, Chlamydia trachomatis
ucgaaggagcuaagaaccacaa

SEQ ID NO: 463088 - RNA, 17 nt, Chlamydia trachomatis
ucgaagaaauccccagu

SEQ ID NO: 463089 - RNA, 22 nt, Chlamydia trachomatis
ucgaacucagcuuccuuggcuu

SEQ ID NO: 463090 - RNA, 17 nt, Chlamydia trachomatis
ucgaaccuuuaccaaag

SEQ ID NO: 463091 - RNA, 17 nt, Chlamydia trachomatis
ucgacaacgauauaaag

SEQ ID NO: 463092 - RNA, 15 nt, Chlamydia trachomatis
ucgaauuuuucugcu

SEQ ID NO: 463093 - RNA, 20 nt, Chlamydia trachomatis
ucgaauuuuuuucuuugcuu

SEQ ID NO: 463094 - RNA, 17 nt, Chlamydia trachomatis
ucgaauuacucugccua

SEQ ID NO: 463095 - RNA, 14 nt, Chlamydia trachomatis
ucgaauucuaucaa

SEQ ID NO: 463096 - RNA, 22 nt, Chlamydia trachomatis
ucgaauuaauaauuccaccuaa

SEQ ID NO: 463097 - RNA, 14 nt, Chlamydia trachomatis
ucgagaagaaaaac

SEQ ID NO: 463098 - RNA, 22 nt, Chlamydia trachomatis
ucgagaaaaugaugaaaaagaa

SEQ ID NO: 463099 - RNA, 12 nt, Chlamydia trachomatis
ucgagaaaugaa

SEQ ID NO: 463100 - RNA, 18 nt, Chlamydia trachomatis
ucgagagaugauuguuuu

SEQ ID NO: 463101 - RNA, 21 nt, Chlamydia trachomatis
ucgagauaauauugagaaaua

SEQ ID NO: 463102 - RNA, 23 nt, Chlamydia trachomatis
ucgacuugcuacggaaaccaaua

SEQ ID NO: 463103 - RNA, 15 nt, Chlamydia trachomatis
ucgagcuaagaaaau

SEQ ID NO: 463104 - RNA, 15 nt, Chlamydia trachomatis
ucgaguuuugaggaa

SEQ ID NO: 463105 - RNA, 18 nt, Chlamydia trachomatis
ucgaguuuuuuuguuucc

SEQ ID NO: 463106 - RNA, 12 nt, Chlamydia trachomatis
ucgauaagaagg

SEQ ID NO: 463107 - RNA, 16 nt, Chlamydia trachomatis
ucgaggcuucuucuuc

SEQ ID NO: 463108 - RNA, 17 nt, Chlamydia trachomatis
ucgaggugauuuucuuu

SEQ ID NO: 463109 - RNA, 18 nt, Chlamydia trachomatis
ucgauaucgcguccaaaa

SEQ ID NO: 463110 - RNA, 20 nt, Chlamydia trachomatis
ucgauaccuauuccaaaucc

SEQ ID NO: 463111 - RNA, 15 nt, Chlamydia trachomatis
ucgauagaaaaaaac

SEQ ID NO: 463112 - RNA, 16 nt, Chlamydia trachomatis
ucgauccaaagccucu

SEQ ID NO: 463113 - RNA, 23 nt, Chlamydia trachomatis
ucgcaagguugacuuucccugca

SEQ ID NO: 463114 - RNA, 18 nt, Chlamydia trachomatis
ucgcaaacugcucuucua

SEQ ID NO: 463115 - RNA, 21 nt, Chlamydia trachomatis
ucgcaaacugcucuucuaacu

SEQ ID NO: 463116 - RNA, 19 nt, Chlamydia trachomatis
ucgcaguacuuuaccugua

SEQ ID NO: 463117 - RNA, 21 nt, Chlamydia trachomatis
ucgcagcaccuguuuaucuuc

SEQ ID NO: 463118 - RNA, 13 nt, Chlamydia trachomatis
ucgcagagaaaga

SEQ ID NO: 463119 - RNA, 16 nt, Chlamydia trachomatis
ucgcaucauccuugcc

SEQ ID NO: 463120 - RNA, 21 nt, Chlamydia trachomatis
ucgcaugagccgauccaucaa

SEQ ID NO: 463121 - RNA, 16 nt, Chlamydia trachomatis
ucgcauuaaauaauac

SEQ ID NO: 463122 - RNA, 15 nt, Chlamydia trachomatis
ucgcauuccaagaag

SEQ ID NO: 463123 - RNA, 17 nt, Chlamydia trachomatis
ucgcauuuguaguucua

SEQ ID NO: 463124 - RNA, 22 nt, Chlamydia trachomatis
ucgcauuugaaagaaacguuuu

SEQ ID NO: 463125 - RNA, 20 nt, Chlamydia trachomatis
ucgccaaacacugcaacagu

SEQ ID NO: 463126 - RNA, 15 nt, Chlamydia trachomatis
ucucgguaauaucca

SEQ ID NO: 463127 - RNA, 14 nt, Chlamydia trachomatis
ucucgguuuucuuu

SEQ ID NO: 463128 - RNA, 18 nt, Chlamydia trachomatis
ucucuaauaguugcaaaa

SEQ ID NO: 463129 - RNA, 20 nt, Chlamydia trachomatis
ucucuaauaguugcaaaaag

SEQ ID NO: 463130 - RNA, 12 nt, Chlamydia trachomatis
ucucuaaguaag

SEQ ID NO: 463131 - RNA, 13 nt, Chlamydia trachomatis
ucucuaaguaagg

SEQ ID NO: 463132 - RNA, 18 nt, Chlamydia trachomatis
ucucuaccagggauaaau

SEQ ID NO: 463133 - RNA, 14 nt, Chlamydia trachomatis
ucucuagcaugccg

SEQ ID NO: 463134 - RNA, 21 nt, Chlamydia trachomatis
ucucuagguauuuagguagca

SEQ ID NO: 463135 - RNA, 16 nt, Chlamydia trachomatis
ucucuuagaagcucuc

SEQ ID NO: 463136 - RNA, 18 nt, Chlamydia trachomatis
ucucuuagaagcucucaa

SEQ ID NO: 463137 - RNA, 22 nt, Chlamydia trachomatis
ucucuucacaaauuuaucugcu

SEQ ID NO: 463138 - RNA, 22 nt, Chlamydia trachomatis
ucucuucaagaucaaagucagg

SEQ ID NO: 463139 - RNA, 21 nt, Chlamydia trachomatis
aaaugcguuaaacuuucuugc

SEQ ID NO: 463140 - RNA, 23 nt, Chlamydia trachomatis
aaaugcguuaaacuuucuugcau

SEQ ID NO: 463141 - RNA, 17 nt, Chlamydia trachomatis
aaaugcguuucuucugc

SEQ ID NO: 463142 - RNA, 21 nt, Chlamydia trachomatis
aaaugcguuucuucugcugau

SEQ ID NO: 463143 - RNA, 13 nt, Chlamydia trachomatis
ucugaacaacugc

SEQ ID NO: 463144 - RNA, 23 nt, Chlamydia trachomatis
ucugaagagaaaaauugcaaaga

SEQ ID NO: 463145 - RNA, 14 nt, Chlamydia trachomatis
ucugaagucuuuaa

SEQ ID NO: 463146 - RNA, 15 nt, Chlamydia trachomatis
aaaugcucucgcauu

SEQ ID NO: 463147 - RNA, 15 nt, Chlamydia trachomatis
ucucuuucucuagaa

SEQ ID NO: 463148 - RNA, 17 nt, Chlamydia trachomatis
ucucuuuuuaaaaggcu

SEQ ID NO: 463149 - RNA, 22 nt, Chlamydia trachomatis
ucugacggaauuuuucucacuu

SEQ ID NO: 463150 - RNA, 16 nt, Chlamydia trachomatis
ucugaauauacccauu

SEQ ID NO: 463151 - RNA, 14 nt, Chlamydia trachomatis
ucugaaucuguguu

SEQ ID NO: 463152 - RNA, 22 nt, Chlamydia trachomatis
ucugaaucuguguugcaaagag

SEQ ID NO: 463153 - RNA, 19 nt, Chlamydia trachomatis
ucugagaaagcuucuaaga

SEQ ID NO: 463154 - RNA, 19 nt, Chlamydia trachomatis
ucugcccuuuguacaugau

SEQ ID NO: 463155 - RNA, 14 nt, Chlamydia trachomatis
ucugccgcuguagc

SEQ ID NO: 463156 - RNA, 18 nt, Chlamydia trachomatis
ucugcgaugccaaagaaa

SEQ ID NO: 463157 - RNA, 14 nt, Chlamydia trachomatis
ucugcuacaaacug

SEQ ID NO: 463158 - RNA, 19 nt, Chlamydia trachomatis
ucugcuacaaacugcucaa

SEQ ID NO: 463159 - RNA, 15 nt, Chlamydia trachomatis
ucugcuaaaaaugcu

SEQ ID NO: 463160 - RNA, 15 nt, Chlamydia trachomatis
ucugcugcucgaaaa

SEQ ID NO: 463161 - RNA, 21 nt, Chlamydia trachomatis
ucugcuagauacaauaguacc

SEQ ID NO: 463162 - RNA, 14 nt, Chlamydia trachomatis
ucugggucauagaa

SEQ ID NO: 463163 - RNA, 18 nt, Chlamydia trachomatis
ucuggagauacagaaucu

SEQ ID NO: 463164 - RNA, 16 nt, Chlamydia trachomatis
ucuggagcaacaacca

SEQ ID NO: 463165 - RNA, 17 nt, Chlamydia trachomatis
ucuggaacauacuucug

SEQ ID NO: 463166 - RNA, 11 nt, Chlamydia trachomatis
ucuggaaucau

SEQ ID NO: 463167 - RNA, 20 nt, Chlamydia trachomatis
ucuucccugaggcuuuaccg

SEQ ID NO: 463168 - RNA, 17 nt, Chlamydia trachomatis
ucuucccuuuuuucugu

SEQ ID NO: 463169 - RNA, 23 nt, Chlamydia trachomatis
ucuuccgaagauucgcugcuguc

SEQ ID NO: 463170 - RNA, 18 nt, Chlamydia trachomatis
ucuuccccuucuuuauaa

SEQ ID NO: 463171 - RNA, 22 nt, Chlamydia trachomatis
ucuucaggaucuagacaaucug

SEQ ID NO: 463172 - RNA, 21 nt, Chlamydia trachomatis
ucuucaggauuggaaaaucca

SEQ ID NO: 463173 - RNA, 20 nt, Chlamydia trachomatis
ucuucagguuuauaagagaa

SEQ ID NO: 463174 - RNA, 13 nt, Chlamydia trachomatis
ucuucauaagaaa

SEQ ID NO: 463175 - RNA, 22 nt, Chlamydia trachomatis
ucuucaguuugaaucacagaaa

SEQ ID NO: 463176 - RNA, 18 nt, Chlamydia trachomatis
ucuucauagcuucuaauu

SEQ ID NO: 463177 - RNA, 13 nt, Chlamydia trachomatis
ucuucaaagaaca

SEQ ID NO: 463178 - RNA, 16 nt, Chlamydia trachomatis
ucuucaaauucuacuc

SEQ ID NO: 463179 - RNA, 12 nt, Chlamydia trachomatis
ucuucaacaaga

SEQ ID NO: 463180 - RNA, 20 nt, Chlamydia trachomatis
ucuuaaaaggguagaaaaag

SEQ ID NO: 463181 - RNA, 22 nt, Chlamydia trachomatis
ucuuaaaaggguagaaaaagag

SEQ ID NO: 463182 - RNA, 14 nt, Chlamydia trachomatis
ucuuaaacaaaaau

SEQ ID NO: 463183 - RNA, 21 nt, Chlamydia trachomatis
ucuuaaaggucgagcucccau

SEQ ID NO: 463184 - RNA, 14 nt, Chlamydia trachomatis
ucuuaauaaucugu

SEQ ID NO: 463185 - RNA, 14 nt, Chlamydia trachomatis
ucuuaauccuugca

SEQ ID NO: 463186 - RNA, 23 nt, Chlamydia trachomatis
ucuuaauccuugcacuaagaaua

SEQ ID NO: 463187 - RNA, 13 nt, Chlamydia trachomatis
ucuuacuccuucu

SEQ ID NO: 463188 - RNA, 17 nt, Chlamydia trachomatis
ucuuacuccuucucuga

SEQ ID NO: 463189 - RNA, 14 nt, Chlamydia trachomatis
ucuuagaagcucuc

SEQ ID NO: 463190 - RNA, 15 nt, Chlamydia trachomatis
ucuuagaaggaucua

SEQ ID NO: 463191 - RNA, 13 nt, Chlamydia trachomatis
ucuuagcgcuugu

SEQ ID NO: 463192 - RNA, 15 nt, Chlamydia trachomatis
ucuuauuaaccaacu

SEQ ID NO: 463193 - RNA, 21 nt, Chlamydia trachomatis
ucuucugugcaaucagcucuc

SEQ ID NO: 463194 - RNA, 16 nt, Chlamydia trachomatis
ucuucuguuuuuucag

SEQ ID NO: 463195 - RNA, 9 nt, Chlamydia trachomatis
ucuucuucg

SEQ ID NO: 463196 - RNA, 15 nt, Chlamydia trachomatis
ucuucuucggaaagc

SEQ ID NO: 463197 - RNA, 15 nt, Chlamydia trachomatis
ucuucuucucuuucg

SEQ ID NO: 463198 - RNA, 14 nt, Chlamydia trachomatis
ucuucuugagaaaa

SEQ ID NO: 463199 - RNA, 19 nt, Chlamydia trachomatis
ucuucugcugaucggaaca

SEQ ID NO: 463200 - RNA, 11 nt, Chlamydia trachomatis
ucuucuggaau

SEQ ID NO: 463201 - RNA, 18 nt, Chlamydia trachomatis
ucuucugauaaauguccc

SEQ ID NO: 463202 - RNA, 14 nt, Chlamydia trachomatis
ucuucugaaaaauc

SEQ ID NO: 463203 - RNA, 13 nt, Chlamydia trachomatis
ucuucugaacaac

SEQ ID NO: 463204 - RNA, 15 nt, Chlamydia trachomatis
ucuucugaacaacau

SEQ ID NO: 463205 - RNA, 18 nt, Chlamydia trachomatis
ucuucugaagagaaaaau

SEQ ID NO: 463206 - RNA, 13 nt, Chlamydia trachomatis
ucuucucucagau

SEQ ID NO: 463207 - RNA, 14 nt, Chlamydia trachomatis
ucuucucucauguc

SEQ ID NO: 463208 - RNA, 22 nt, Chlamydia trachomatis
ucuucuaaaugcuguaaaacau

SEQ ID NO: 463209 - RNA, 23 nt, Chlamydia trachomatis
ucuucuaaaugcuguaaaacauu

SEQ ID NO: 463210 - RNA, 18 nt, Chlamydia trachomatis
ucuucuaaguauucuucu

SEQ ID NO: 463211 - RNA, 19 nt, Chlamydia trachomatis
ucuucuaaguauucuucug

SEQ ID NO: 463212 - RNA, 23 nt, Chlamydia trachomatis
ucuucuaauugaaacaguagaaa

SEQ ID NO: 463213 - RNA, 22 nt, Chlamydia trachomatis
ucuucuagauagagauuccacu

SEQ ID NO: 463214 - RNA, 22 nt, Chlamydia trachomatis
ucuucuauaggcgauucguuga

SEQ ID NO: 463215 - RNA, 16 nt, Chlamydia trachomatis
ucuugaguagaagaau

SEQ ID NO: 463216 - RNA, 15 nt, Chlamydia trachomatis
ucuugaagauauuca

SEQ ID NO: 463217 - RNA, 15 nt, Chlamydia trachomatis
ucuucuuuugagaug

SEQ ID NO: 463218 - RNA, 21 nt, Chlamydia trachomatis
ucuucuuuagcucgcuucaaa

SEQ ID NO: 463219 - RNA, 14 nt, Chlamydia trachomatis
ucuucuuuggaaaa

SEQ ID NO: 463220 - RNA, 17 nt, Chlamydia trachomatis
ucuugcauaaggaagca

SEQ ID NO: 463221 - RNA, 22 nt, Chlamydia trachomatis
ucuugcauaaggaagcaaaaac

SEQ ID NO: 463222 - RNA, 21 nt, Chlamydia trachomatis
ucuugccuuuaccgcacuuug

SEQ ID NO: 463223 - RNA, 13 nt, Chlamydia trachomatis
ucuugaucugaaa

SEQ ID NO: 463224 - RNA, 17 nt, Chlamydia trachomatis
ucuugaucugaaaagag

SEQ ID NO: 463225 - RNA, 17 nt, Chlamydia trachomatis
ucuugaucggagucugc

SEQ ID NO: 463226 - RNA, 13 nt, Chlamydia trachomatis
ucuugauuccugg

SEQ ID NO: 463227 - RNA, 16 nt, Chlamydia trachomatis
ucuugcacauuuucuu

SEQ ID NO: 463228 - RNA, 14 nt, Chlamydia trachomatis
ucuugcuaauguag

SEQ ID NO: 463229 - RNA, 18 nt, Chlamydia trachomatis
ucuugcugguccauggaa

SEQ ID NO: 463230 - RNA, 23 nt, Chlamydia trachomatis
ucuugcuucaugucuucuuucuc

SEQ ID NO: 463231 - RNA, 14 nt, Chlamydia trachomatis
ucuuguagaaaaag

SEQ ID NO: 463232 - RNA, 15 nt, Chlamydia trachomatis
ucuuguagauagacu

SEQ ID NO: 463233 - RNA, 23 nt, Chlamydia trachomatis
ucuugucagaagaggcaaaaauc

SEQ ID NO: 463234 - RNA, 17 nt, Chlamydia trachomatis
ucuugucccauuaccua

SEQ ID NO: 463235 - RNA, 23 nt, Chlamydia trachomatis
ucuuggggaucgaucccuuuuuc

SEQ ID NO: 463236 - RNA, 14 nt, Chlamydia trachomatis
ucuugucucucgaa

SEQ ID NO: 463237 - RNA, 14 nt, Chlamydia trachomatis
ucuugugcucuguc

SEQ ID NO: 463238 - RNA, 19 nt, Chlamydia trachomatis
ucuuguuaaugacaaacuu

SEQ ID NO: 463239 - RNA, 14 nt, Chlamydia trachomatis
ucuuguuuauucuc

SEQ ID NO: 463240 - RNA, 15 nt, Chlamydia trachomatis
ucuuguuucaaagau

SEQ ID NO: 463241 - RNA, 21 nt, Chlamydia trachomatis
ucuuguuuuauacucuaaaag

SEQ ID NO: 463242 - RNA, 15 nt, Chlamydia trachomatis
ucuuuaacaucuuua

SEQ ID NO: 463243 - RNA, 19 nt, Chlamydia trachomatis
ucuuuaacaucuuuagaau

SEQ ID NO: 463244 - RNA, 21 nt, Chlamydia trachomatis
ucuuuaacaucuuuagaaucc

SEQ ID NO: 463245 - RNA, 22 nt, Chlamydia trachomatis
ucuuuaagcugggaaagcugca

SEQ ID NO: 463246 - RNA, 15 nt, Chlamydia trachomatis
ucuuuaauauuuccc

SEQ ID NO: 463247 - RNA, 15 nt, Chlamydia trachomatis
ucuuuaccauuucca

SEQ ID NO: 463248 - RNA, 21 nt, Chlamydia trachomatis
ucuuuaccgucuuuaacaaga

SEQ ID NO: 463249 - RNA, 16 nt, Chlamydia trachomatis
ucuuuacgcacaaaga

SEQ ID NO: 463250 - RNA, 16 nt, Chlamydia trachomatis
ucuuuacuaggagcaa

SEQ ID NO: 463251 - RNA, 15 nt, Chlamydia trachomatis
ucuuuacucuuuucu

SEQ ID NO: 463252 - RNA, 16 nt, Chlamydia trachomatis
ucuuuacucuuuucuu

SEQ ID NO: 463253 - RNA, 17 nt, Chlamydia trachomatis
ucuuuacuuucuuugcu

SEQ ID NO: 463254 - RNA, 16 nt, Chlamydia trachomatis
ucuuuagaauccaaag

SEQ ID NO: 463255 - RNA, 20 nt, Chlamydia trachomatis
ucuuuagaauccaaagucuc

SEQ ID NO: 463256 - RNA, 19 nt, Chlamydia trachomatis
ucuuuagcgcacuuaauaa

SEQ ID NO: 463257 - RNA, 22 nt, Chlamydia trachomatis
ucuuuauaaucgaucacagaaa

SEQ ID NO: 463258 - RNA, 22 nt, Chlamydia trachomatis
ucuuuauagaauuuuucuaaaa

SEQ ID NO: 463259 - RNA, 17 nt, Chlamydia trachomatis
ucuuuauguaaggaaau

SEQ ID NO: 463260 - RNA, 18 nt, Chlamydia trachomatis
ucuuuauuacgaugaugc

SEQ ID NO: 463261 - RNA, 15 nt, Chlamydia trachomatis
ucuuuauuuaaguag

SEQ ID NO: 463262 - RNA, 14 nt, Chlamydia trachomatis
ucuuuauuuuuucc

SEQ ID NO: 463263 - RNA, 22 nt, Chlamydia trachomatis
ucuuucaaaagaaggcuuuucu

SEQ ID NO: 463264 - RNA, 23 nt, Chlamydia trachomatis
ucuuucaaagaagcuccuuuacc

SEQ ID NO: 463265 - RNA, 19 nt, Chlamydia trachomatis
ucuuucaauagcauuucug

SEQ ID NO: 463266 - RNA, 11 nt, Chlamydia trachomatis
ucuuuuccaua

SEQ ID NO: 463267 - RNA, 23 nt, Chlamydia trachomatis
ucuuuuccauauucuugcuaaga

SEQ ID NO: 463268 - RNA, 15 nt, Chlamydia trachomatis
ucuuuguucacagaa

SEQ ID NO: 463269 - RNA, 20 nt, Chlamydia trachomatis
ucuuuguuccuacuaaaaug

SEQ ID NO: 463270 - RNA, 17 nt, Chlamydia trachomatis
ucuuuugcaaaaauuuu

SEQ ID NO: 463271 - RNA, 23 nt, Chlamydia trachomatis
ucuuuugcaaaaauuuucacaca

SEQ ID NO: 463272 - RNA, 13 nt, Chlamydia trachomatis
ucuuuuguuugca

SEQ ID NO: 463273 - RNA, 22 nt, Chlamydia trachomatis
ucuuuuuaggaggaauauuaaa

SEQ ID NO: 463274 - RNA, 19 nt, Chlamydia trachomatis
ucuuuuugcuaccaagcuu

SEQ ID NO: 463275 - RNA, 17 nt, Chlamydia trachomatis
ucuuuuuguugcucuau

SEQ ID NO: 463276 - RNA, 19 nt, Chlamydia trachomatis
ucuuuuuguugcucuauaa

SEQ ID NO: 463277 - RNA, 22 nt, Chlamydia trachomatis
ucuuuuuguugcucuauaacau

SEQ ID NO: 463278 - RNA, 17 nt, Chlamydia trachomatis
ucuuuuuuaaaaagcug

SEQ ID NO: 463279 - RNA, 22 nt, Chlamydia trachomatis
ucuuucagagaaaauuucucuu

SEQ ID NO: 463280 - RNA, 16 nt, Chlamydia trachomatis
ucuuucuaauuucccu

SEQ ID NO: 463281 - RNA, 22 nt, Chlamydia trachomatis
ucuuucucaugcguuaauuaau

SEQ ID NO: 463282 - RNA, 20 nt, Chlamydia trachomatis
ucuuucuggagcaucaguaa

SEQ ID NO: 463283 - RNA, 12 nt, Chlamydia trachomatis
ucuuucuuucua

SEQ ID NO: 463284 - RNA, 17 nt, Chlamydia trachomatis
ucuuugagaaaguuaaa

SEQ ID NO: 463285 - RNA, 17 nt, Chlamydia trachomatis
ucuuugagaagcaucuc

SEQ ID NO: 463286 - RNA, 18 nt, Chlamydia trachomatis
ucuuugauaugcagcauc

SEQ ID NO: 463287 - RNA, 21 nt, Chlamydia trachomatis
ucuuugcuccacaagaaguaa

SEQ ID NO: 463288 - RNA, 18 nt, Chlamydia trachomatis
ucuuugggauagauagcu

SEQ ID NO: 463289 - RNA, 17 nt, Chlamydia trachomatis
ugaaaacuuuguauuaa

SEQ ID NO: 463290 - RNA, 19 nt, Chlamydia trachomatis
ugaaaagaacccuaucccc

SEQ ID NO: 463291 - RNA, 21 nt, Chlamydia trachomatis
ugaaaaggagccuuguaucuu

SEQ ID NO: 463292 - RNA, 17 nt, Chlamydia trachomatis
ugaaaaagaagcuaaua

SEQ ID NO: 463293 - RNA, 16 nt, Chlamydia trachomatis
ugaaaaagccugugcc

SEQ ID NO: 463294 - RNA, 19 nt, Chlamydia trachomatis
ugaaaaagcuuucuucccc

SEQ ID NO: 463295 - RNA, 18 nt, Chlamydia trachomatis
ugaaacacgcucauagau

SEQ ID NO: 463296 - RNA, 16 nt, Chlamydia trachomatis
ugaaaaugcucuaaag

SEQ ID NO: 463297 - RNA, 19 nt, Chlamydia trachomatis
ugaaaucacucgcacacga

SEQ ID NO: 463298 - RNA, 12 nt, Chlamydia trachomatis
ugaaaucagaaa

SEQ ID NO: 463299 - RNA, 16 nt, Chlamydia trachomatis
ugaaauaccacucauu

SEQ ID NO: 463300 - RNA, 13 nt, Chlamydia trachomatis
ugaaauaagucuu

SEQ ID NO: 463301 - RNA, 15 nt, Chlamydia trachomatis
ugaaagcauguaaau

SEQ ID NO: 463302 - RNA, 18 nt, Chlamydia trachomatis
ugaaagcuauuuucuucc

SEQ ID NO: 463303 - RNA, 21 nt, Chlamydia trachomatis
ugaaagcuauuuucuuccugc

SEQ ID NO: 463304 - RNA, 22 nt, Chlamydia trachomatis
ugaaagcuauuuucuuccugcu

SEQ ID NO: 463305 - RNA, 21 nt, Chlamydia trachomatis
ugaacuagagaucccgaauac

SEQ ID NO: 463306 - RNA, 16 nt, Chlamydia trachomatis
ugaagaaugaaacuug

SEQ ID NO: 463307 - RNA, 20 nt, Chlamydia trachomatis
ugaagaaugaucacuugaau

SEQ ID NO: 463308 - RNA, 22 nt, Chlamydia trachomatis
ugaagaacugucuucuuucaaa

SEQ ID NO: 463309 - RNA, 10 nt, Chlamydia trachomatis
ugaagaagau

SEQ ID NO: 463310 - RNA, 18 nt, Chlamydia trachomatis
ugaacuguucauucucag

SEQ ID NO: 463311 - RNA, 19 nt, Chlamydia trachomatis
ugaagacccguuuucucuu

SEQ ID NO: 463312 - RNA, 23 nt, Chlamydia trachomatis
ugaagacccguuuucucuugaaa

SEQ ID NO: 463313 - RNA, 15 nt, Chlamydia trachomatis
ugaagcaaaucccug

SEQ ID NO: 463314 - RNA, 22 nt, Chlamydia trachomatis
ugaaguaugcucgagccuguuu

SEQ ID NO: 463315 - RNA, 18 nt, Chlamydia trachomatis
ugacccauaagauauugc

SEQ ID NO: 463316 - RNA, 23 nt, Chlamydia trachomatis
ugacauucaguucgaaguucccu

SEQ ID NO: 463317 - RNA, 13 nt, Chlamydia trachomatis
ugacgacaacaug

SEQ ID NO: 463318 - RNA, 18 nt, Chlamydia trachomatis
ugacgaaucgcaccauuu

SEQ ID NO: 463319 - RNA, 20 nt, Chlamydia trachomatis
ugacgagaagucgugucuuu

SEQ ID NO: 463320 - RNA, 20 nt, Chlamydia trachomatis
ugaccgaagguucuucuucg

SEQ ID NO: 463321 - RNA, 21 nt, Chlamydia trachomatis
ugaccguuaauaucccacucu

SEQ ID NO: 463322 - RNA, 14 nt, Chlamydia trachomatis
ugacgauagagaac

SEQ ID NO: 463323 - RNA, 14 nt, Chlamydia trachomatis
ugacuaguuuuuuc

SEQ ID NO: 463324 - RNA, 12 nt, Chlamydia trachomatis
ugacuaucugcu

SEQ ID NO: 463325 - RNA, 18 nt, Chlamydia trachomatis
ugacuauuccugaaggag

SEQ ID NO: 463326 - RNA, 14 nt, Chlamydia trachomatis
ugagaagcaucuca

SEQ ID NO: 463327 - RNA, 21 nt, Chlamydia trachomatis
ugagaccauuggaauuuucau

SEQ ID NO: 463328 - RNA, 19 nt, Chlamydia trachomatis
ugagaagaaaggucugcau

SEQ ID NO: 463329 - RNA, 19 nt, Chlamydia trachomatis
ugagaaagcuucuaagaac

SEQ ID NO: 463330 - RNA, 20 nt, Chlamydia trachomatis
ugagaaagcuucuaagaaca

SEQ ID NO: 463331 - RNA, 13 nt, Chlamydia trachomatis
ugagaacaaacca

SEQ ID NO: 463332 - RNA, 15 nt, Chlamydia trachomatis
ugagaccgucaaaaa

SEQ ID NO: 463333 - RNA, 18 nt, Chlamydia trachomatis
ugagaccgucaaaaagau

SEQ ID NO: 463334 - RNA, 20 nt, Chlamydia trachomatis
ugagagcuuccacagcagug

SEQ ID NO: 463335 - RNA, 23 nt, Chlamydia trachomatis
ugacuuaacgugucgaaaauggu

SEQ ID NO: 463336 - RNA, 14 nt, Chlamydia trachomatis
ugagcaagcucaac

SEQ ID NO: 463337 - RNA, 16 nt, Chlamydia trachomatis
ugagcaaccuuuccug

SEQ ID NO: 463338 - RNA, 22 nt, Chlamydia trachomatis
ugagcaagccccgaaacccaac

SEQ ID NO: 463339 - RNA, 16 nt, Chlamydia trachomatis
ugaggaaggcugagca

SEQ ID NO: 463340 - RNA, 16 nt, Chlamydia trachomatis
ugaggaagaaauguuu

SEQ ID NO: 463341 - RNA, 20 nt, Chlamydia trachomatis
ugaggaagagagaacaaacg

SEQ ID NO: 463342 - RNA, 14 nt, Chlamydia trachomatis
ugaggaagauaagu

SEQ ID NO: 463343 - RNA, 22 nt, Chlamydia trachomatis
ugaggaagcauuucucuccaaa

SEQ ID NO: 463344 - RNA, 16 nt, Chlamydia trachomatis
ugagcuccuaagcagu

SEQ ID NO: 463345 - RNA, 17 nt, Chlamydia trachomatis
ugagcucuuuccucuag

SEQ ID NO: 463346 - RNA, 17 nt, Chlamydia trachomatis
ugagcgucuuuucacaa

SEQ ID NO: 463347 - RNA, 14 nt, Chlamydia trachomatis
ugagcuagaaugug

SEQ ID NO: 463348 - RNA, 19 nt, Chlamydia trachomatis
ugagggagcaguuuaggac

SEQ ID NO: 463349 - RNA, 24 nt, Chlamydia trachomatis
ugagggacgcgucucccuagugcu

SEQ ID NO: 463350 - RNA, 15 nt, Chlamydia trachomatis
ugaggcuccgccuuc

SEQ ID NO: 463351 - RNA, 15 nt, Chlamydia trachomatis
ugagugaaaaauaga

SEQ ID NO: 463352 - RNA, 19 nt, Chlamydia trachomatis
ugagugaaaaauagaaucu

SEQ ID NO: 463353 - RNA, 14 nt, Chlamydia trachomatis
ugauaaaacucccc

SEQ ID NO: 463354 - RNA, 14 nt, Chlamydia trachomatis
ugaguggggcucga

SEQ ID NO: 463355 - RNA, 12 nt, Chlamydia trachomatis
ugaguguaccau

SEQ ID NO: 463356 - RNA, 15 nt, Chlamydia trachomatis
ugaguguagucuuug

SEQ ID NO: 463357 - RNA, 16 nt, Chlamydia trachomatis
ugaguguagucuuugu

SEQ ID NO: 463358 - RNA, 17 nt, Chlamydia trachomatis
ugauacggacuucuuua

SEQ ID NO: 463359 - RNA, 20 nt, Chlamydia trachomatis
ugauaggagaggauuaagga

SEQ ID NO: 463360 - RNA, 17 nt, Chlamydia trachomatis
ugauaguuuuuggccuu

SEQ ID NO: 463361 - RNA, 17 nt, Chlamydia trachomatis
ugauagcacccuuuuua

SEQ ID NO: 463362 - RNA, 15 nt, Chlamydia trachomatis
ugauaugcagcaucc

SEQ ID NO: 463363 - RNA, 14 nt, Chlamydia trachomatis
ugaucucugcagaa

SEQ ID NO: 463364 - RNA, 20 nt, Chlamydia trachomatis
ugaucucuuuuuacaacucu

SEQ ID NO: 463365 - RNA, 22 nt, Chlamydia trachomatis
ugaucucuuuuuacaacucuga

SEQ ID NO: 463366 - RNA, 15 nt, Chlamydia trachomatis
ugaucugaaaagaga

SEQ ID NO: 463367 - RNA, 22 nt, Chlamydia trachomatis
ugaucuuauuaaccaacucucu

SEQ ID NO: 463368 - RNA, 19 nt, Chlamydia trachomatis
ugauugaaccguuuuucua

SEQ ID NO: 463369 - RNA, 18 nt, Chlamydia trachomatis
ugauugacaacuuucuuu

SEQ ID NO: 463370 - RNA, 21 nt, Chlamydia trachomatis
ugauuguugguugcuccaaca

SEQ ID NO: 463371 - RNA, 14 nt, Chlamydia trachomatis
ugauuguuuugauu

SEQ ID NO: 463372 - RNA, 14 nt, Chlamydia trachomatis
ugauuuuaaaccaa

SEQ ID NO: 463373 - RNA, 15 nt, Chlamydia trachomatis
ugauuuuaaaccaau

SEQ ID NO: 463374 - RNA, 16 nt, Chlamydia trachomatis
ugauucccuguagaau

SEQ ID NO: 463375 - RNA, 18 nt, Chlamydia trachomatis
ugauuccgagggaaucau

SEQ ID NO: 463376 - RNA, 18 nt, Chlamydia trachomatis
ugcaaaggaguccgcgau

SEQ ID NO: 463377 - RNA, 18 nt, Chlamydia trachomatis
ugcaaaggauaaauauuu

SEQ ID NO: 463378 - RNA, 16 nt, Chlamydia trachomatis
ugcaaauaagaaaguu

SEQ ID NO: 463379 - RNA, 17 nt, Chlamydia trachomatis
ugcaaauaagaaaguuu

SEQ ID NO: 463380 - RNA, 12 nt, Chlamydia trachomatis
ugcaaauaauaa

SEQ ID NO: 463381 - RNA, 17 nt, Chlamydia trachomatis
ugcaaauaauaaaccaa

SEQ ID NO: 463382 - RNA, 12 nt, Chlamydia trachomatis
ugcaaacaaaag

SEQ ID NO: 463383 - RNA, 17 nt, Chlamydia trachomatis
ugcaaacaaaagagaug

SEQ ID NO: 463384 - RNA, 12 nt, Chlamydia trachomatis
ugauuuuucuuu

SEQ ID NO: 463385 - RNA, 13 nt, Chlamydia trachomatis
ugauuuuuucgcu

SEQ ID NO: 463386 - RNA, 18 nt, Chlamydia trachomatis
ugauuuuuuuauuuugag

SEQ ID NO: 463387 - RNA, 15 nt, Chlamydia trachomatis
ugcaaaaagagcaua

SEQ ID NO: 463388 - RNA, 13 nt, Chlamydia trachomatis
ugcaaaaaucucu

SEQ ID NO: 463389 - RNA, 14 nt, Chlamydia trachomatis
ugcaacaaauacca

SEQ ID NO: 463390 - RNA, 20 nt, Chlamydia trachomatis
ugcaacaaauaccaaaauau

SEQ ID NO: 463391 - RNA, 16 nt, Chlamydia trachomatis
ugcaaccuucuccaau

SEQ ID NO: 463392 - RNA, 23 nt, Chlamydia trachomatis
ugcaaccuucuccaauaggggca

SEQ ID NO: 463393 - RNA, 18 nt, Chlamydia trachomatis
ugcaacaguaaauuucau

SEQ ID NO: 463394 - RNA, 14 nt, Chlamydia trachomatis
ugcaacucuugcca

SEQ ID NO: 463395 - RNA, 19 nt, Chlamydia trachomatis
ugcaagaaaauagguaaag

SEQ ID NO: 463396 - RNA, 22 nt, Chlamydia trachomatis
ugcaagaaaauagguaaagaag

SEQ ID NO: 463397 - RNA, 23 nt, Chlamydia trachomatis
ugcaagaaaauagguaaagaagu

SEQ ID NO: 463398 - RNA, 11 nt, Chlamydia trachomatis
ugcaauaaacg

SEQ ID NO: 463399 - RNA, 23 nt, Chlamydia trachomatis
ugcaaguccuuugauuucugcag

SEQ ID NO: 463400 - RNA, 16 nt, Chlamydia trachomatis
ugcaaguaaugacacu

SEQ ID NO: 463401 - RNA, 16 nt, Chlamydia trachomatis
ugcacaaaaaaaaaga

SEQ ID NO: 463402 - RNA, 15 nt, Chlamydia trachomatis
ugcacaaaggaacau

SEQ ID NO: 463403 - RNA, 17 nt, Chlamydia trachomatis
ugcacaucacagaucuc

SEQ ID NO: 463404 - RNA, 23 nt, Chlamydia trachomatis
ugcacaucacagaucucaucagg

SEQ ID NO: 463405 - RNA, 15 nt, Chlamydia trachomatis
ugcacauuuucuuga

SEQ ID NO: 463406 - RNA, 23 nt, Chlamydia trachomatis
ugcacuaaagagcuucggcuaua

SEQ ID NO: 463407 - RNA, 16 nt, Chlamydia trachomatis
ugcacugucucaugga

SEQ ID NO: 463408 - RNA, 17 nt, Chlamydia trachomatis
ugcacugguauucugca

SEQ ID NO: 463409 - RNA, 21 nt, Chlamydia trachomatis
ugcacugguauucugcagaaa

SEQ ID NO: 463410 - RNA, 20 nt, Chlamydia trachomatis
ugcagauuuuguagcacagc

SEQ ID NO: 463411 - RNA, 20 nt, Chlamydia trachomatis
ugcagaucccagccugugca

SEQ ID NO: 463412 - RNA, 18 nt, Chlamydia trachomatis
ugcagcggcgaaaauuug

SEQ ID NO: 463413 - RNA, 20 nt, Chlamydia trachomatis
ugcagccuacauacaugcuu

SEQ ID NO: 463414 - RNA, 11 nt, Chlamydia trachomatis
ugcagugacau

SEQ ID NO: 463415 - RNA, 19 nt, Chlamydia trachomatis
ugcaguaccauuacuacaa

SEQ ID NO: 463416 - RNA, 15 nt, Chlamydia trachomatis
ugcaguaaagaaaag

SEQ ID NO: 463417 - RNA, 19 nt, Chlamydia trachomatis
ugcagguuuagauguugug

SEQ ID NO: 463418 - RNA, 14 nt, Chlamydia trachomatis
ugcagcuaaagaau

SEQ ID NO: 463419 - RNA, 15 nt, Chlamydia trachomatis
ugcagcuaaagaauc

SEQ ID NO: 463420 - RNA, 14 nt, Chlamydia trachomatis
ugcauaaaagccug

SEQ ID NO: 463421 - RNA, 19 nt, Chlamydia trachomatis
ugcauacuucccacauacu

SEQ ID NO: 463422 - RNA, 23 nt, Chlamydia trachomatis
ugcauagagaacucgugaauguu

SEQ ID NO: 463423 - RNA, 12 nt, Chlamydia trachomatis
ugcaucauguug

SEQ ID NO: 463424 - RNA, 13 nt, Chlamydia trachomatis
ugcaucauuuugu

SEQ ID NO: 463425 - RNA, 18 nt, Chlamydia trachomatis
ugcaucugauguuccauc

SEQ ID NO: 463426 - RNA, 15 nt, Chlamydia trachomatis
ugcauucuuuuaaga

SEQ ID NO: 463427 - RNA, 16 nt, Chlamydia trachomatis
ugcauuuauccacagg

SEQ ID NO: 463428 - RNA, 16 nt, Chlamydia trachomatis
ugccaaugaaauauca

SEQ ID NO: 463429 - RNA, 22 nt, Chlamydia trachomatis
ugccaaugaaauaucauucccu

SEQ ID NO: 463430 - RNA, 12 nt, Chlamydia trachomatis
ugccucuaacac

SEQ ID NO: 463431 - RNA, 15 nt, Chlamydia trachomatis
ugccucuauguucuu

SEQ ID NO: 463432 - RNA, 22 nt, Chlamydia trachomatis
ugccuugaggauaguauucuuu

SEQ ID NO: 463433 - RNA, 12 nt, Chlamydia trachomatis
ugccuuacucuu

SEQ ID NO: 463434 - RNA, 20 nt, Chlamydia trachomatis
ugccuguugcaacagacucu

SEQ ID NO: 463435 - RNA, 19 nt, Chlamydia trachomatis
ugccuuuugauucugcuuu

SEQ ID NO: 463436 - RNA, 17 nt, Chlamydia trachomatis
ugccuuucguuagaaag

SEQ ID NO: 463437 - RNA, 21 nt, Chlamydia trachomatis
ugccuuucguuagaaagguug

SEQ ID NO: 463438 - RNA, 21 nt, Chlamydia trachomatis
ugccuuuaggaagaaugacaa

SEQ ID NO: 463439 - RNA, 16 nt, Chlamydia trachomatis
ugcgaaaaagaaauaa

SEQ ID NO: 463440 - RNA, 16 nt, Chlamydia trachomatis
ugcgaagguucaagau

SEQ ID NO: 463441 - RNA, 18 nt, Chlamydia trachomatis
ugcgaggaauucuucuuc

SEQ ID NO: 463442 - RNA, 23 nt, Chlamydia trachomatis
ugcgaggcuuuuuuuuucauaaa

SEQ ID NO: 463443 - RNA, 14 nt, Chlamydia trachomatis
ugcgaucuccucau

SEQ ID NO: 463444 - RNA, 15 nt, Chlamydia trachomatis
ugcgugucacagacu

SEQ ID NO: 463445 - RNA, 20 nt, Chlamydia trachomatis
ugcgugaacuguucauucuc

SEQ ID NO: 463446 - RNA, 22 nt, Chlamydia trachomatis
ugcucaacauagaucccuuuca

SEQ ID NO: 463447 - RNA, 19 nt, Chlamydia trachomatis
ugcuaugguccccauaaga

SEQ ID NO: 463448 - RNA, 17 nt, Chlamydia trachomatis
ugcuaugaaaaauccuu

SEQ ID NO: 463449 - RNA, 20 nt, Chlamydia trachomatis
ugcuaugaaaaauccuucca

SEQ ID NO: 463450 - RNA, 17 nt, Chlamydia trachomatis
ugcuaguauuaaacuuc

SEQ ID NO: 463451 - RNA, 18 nt, Chlamydia trachomatis
ugcuaguauuaaacuuca

SEQ ID NO: 463452 - RNA, 20 nt, Chlamydia trachomatis
ugcuauauggccuuacucau

SEQ ID NO: 463453 - RNA, 15 nt, Chlamydia trachomatis
ugcuacaaaagaagc

SEQ ID NO: 463454 - RNA, 13 nt, Chlamydia trachomatis
ugcuaaggaaaga

SEQ ID NO: 463455 - RNA, 22 nt, Chlamydia trachomatis
ugcuaauguagacccugcauua

SEQ ID NO: 463456 - RNA, 16 nt, Chlamydia trachomatis
ugcuacaguaucugcu

SEQ ID NO: 463457 - RNA, 16 nt, Chlamydia trachomatis
ugcuacggaaaccaau

SEQ ID NO: 463458 - RNA, 19 nt, Chlamydia trachomatis
ugcuacggaaaccaauaaa

SEQ ID NO: 463459 - RNA, 14 nt, Chlamydia trachomatis
ugcucagggcuaua

SEQ ID NO: 463460 - RNA, 20 nt, Chlamydia trachomatis
ugcucaaggaaacucuuaaa

SEQ ID NO: 463461 - RNA, 19 nt, Chlamydia trachomatis
ugcuccaaaguaaaaugcc

SEQ ID NO: 463462 - RNA, 15 nt, Chlamydia trachomatis
ugcuccaacaauagc

SEQ ID NO: 463463 - RNA, 14 nt, Chlamydia trachomatis
ugcucauuuccuau

SEQ ID NO: 463464 - RNA, 22 nt, Chlamydia trachomatis
ugcuccacaacacgucuuaaag

SEQ ID NO: 463465 - RNA, 14 nt, Chlamydia trachomatis
ugcuccacaagaag

SEQ ID NO: 463466 - RNA, 23 nt, Chlamydia trachomatis
ugcucggauaggcugaggauucc

SEQ ID NO: 463467 - RNA, 15 nt, Chlamydia trachomatis
ugcucgagaaaugaa

SEQ ID NO: 463468 - RNA, 18 nt, Chlamydia trachomatis
ugcucuugagcuaagaag

SEQ ID NO: 463469 - RNA, 22 nt, Chlamydia trachomatis
ugcucuuucccgauauguucag

SEQ ID NO: 463470 - RNA, 20 nt, Chlamydia trachomatis
ugcucuaaagucuuuccauu

SEQ ID NO: 463471 - RNA, 22 nt, Chlamydia trachomatis
ugcucuauaggcaaaagaugau

SEQ ID NO: 463472 - RNA, 14 nt, Chlamydia trachomatis
ugcugaagcuacua

SEQ ID NO: 463473 - RNA, 21 nt, Chlamydia trachomatis
ugcugacaauccgaagauuau

SEQ ID NO: 463474 - RNA, 13 nt, Chlamydia trachomatis
ugcugaucagagg

SEQ ID NO: 463475 - RNA, 18 nt, Chlamydia trachomatis
ugcugagcuuuuuuucac

SEQ ID NO: 463476 - RNA, 17 nt, Chlamydia trachomatis
aaaugucccugaacauc

SEQ ID NO: 463477 - RNA, 14 nt, Chlamydia trachomatis
ugcugcuuggaaua

SEQ ID NO: 463478 - RNA, 22 nt, Chlamydia trachomatis
ugcugcguuacccuuccaauaa

SEQ ID NO: 463479 - RNA, 13 nt, Chlamydia trachomatis
ugcuguaaaacau

SEQ ID NO: 463480 - RNA, 14 nt, Chlamydia trachomatis
ugcugucagaagaa

SEQ ID NO: 463481 - RNA, 14 nt, Chlamydia trachomatis
ugcuguuucaggca

SEQ ID NO: 463482 - RNA, 18 nt, Chlamydia trachomatis
ugcuuaacacuucuuuag

SEQ ID NO: 463483 - RNA, 17 nt, Chlamydia trachomatis
ugcuugaugacgcagca

SEQ ID NO: 463484 - RNA, 22 nt, Chlamydia trachomatis
ugcuucuggacuauuuucaaaa

SEQ ID NO: 463485 - RNA, 23 nt, Chlamydia trachomatis
ugcuucuggacuauuuucaaaac

SEQ ID NO: 463486 - RNA, 17 nt, Chlamydia trachomatis
ugcuucaugucuucuuu

SEQ ID NO: 463487 - RNA, 23 nt, Chlamydia trachomatis
ugcuucccuccuagaaagaacca

SEQ ID NO: 463488 - RNA, 15 nt, Chlamydia trachomatis
ugcuucauaaaaaag

SEQ ID NO: 463489 - RNA, 16 nt, Chlamydia trachomatis
ugcuucaaaaaagauu

SEQ ID NO: 463490 - RNA, 21 nt, Chlamydia trachomatis
ugcuucaaaaaagauuucccc

SEQ ID NO: 463491 - RNA, 12 nt, Chlamydia trachomatis
ugcuucacagcu

SEQ ID NO: 463492 - RNA, 15 nt, Chlamydia trachomatis
ugcuuagaaacuguc

SEQ ID NO: 463493 - RNA, 22 nt, Chlamydia trachomatis
ugcuuggcaaucugcaugguaa

SEQ ID NO: 463494 - RNA, 14 nt, Chlamydia trachomatis
ugcuuuaaaugcug

SEQ ID NO: 463495 - RNA, 23 nt, Chlamydia trachomatis
ugcuuuaacugggauaagaaauc

SEQ ID NO: 463496 - RNA, 17 nt, Chlamydia trachomatis
ugcuuuacgaaauagga

SEQ ID NO: 463497 - RNA, 17 nt, Chlamydia trachomatis
ugcuuuguagauacugg

SEQ ID NO: 463498 - RNA, 17 nt, Chlamydia trachomatis
ugcuuucuugaggaaga

SEQ ID NO: 463499 - RNA, 18 nt, Chlamydia trachomatis
ugcuuuccuuaguuuuaa

SEQ ID NO: 463500 - RNA, 19 nt, Chlamydia trachomatis
ugcuuuccuuaguuuuaau

SEQ ID NO: 463501 - RNA, 20 nt, Chlamydia trachomatis
ugcuuuccuuaguuuuaauu

SEQ ID NO: 463502 - RNA, 17 nt, Chlamydia trachomatis
ugcuuuuuaauauccuc

SEQ ID NO: 463503 - RNA, 14 nt, Chlamydia trachomatis
uggaaauaaaaagc

SEQ ID NO: 463504 - RNA, 21 nt, Chlamydia trachomatis
uggaaauguuugaucugagaa

SEQ ID NO: 463505 - RNA, 22 nt, Chlamydia trachomatis
uggaaauguuugaucugagaaa

SEQ ID NO: 463506 - RNA, 13 nt, Chlamydia trachomatis
uggaacagcucua

SEQ ID NO: 463507 - RNA, 18 nt, Chlamydia trachomatis
uggaacauacuucugaau

SEQ ID NO: 463508 - RNA, 22 nt, Chlamydia trachomatis
uggaagaucuucagaaaucuuc

SEQ ID NO: 463509 - RNA, 14 nt, Chlamydia trachomatis
uggaagaacagcag

SEQ ID NO: 463510 - RNA, 16 nt, Chlamydia trachomatis
uggaagaacagcagca

SEQ ID NO: 463511 - RNA, 17 nt, Chlamydia trachomatis
uggaagauaacaauccu

SEQ ID NO: 463512 - RNA, 18 nt, Chlamydia trachomatis
uggaagauagaagauucg

SEQ ID NO: 463513 - RNA, 17 nt, Chlamydia trachomatis
uggaaguagcauaagcu

SEQ ID NO: 463514 - RNA, 18 nt, Chlamydia trachomatis
uggacaaaaaucucaaag

SEQ ID NO: 463515 - RNA, 19 nt, Chlamydia trachomatis
uggacaaagguguuuucua

SEQ ID NO: 463516 - RNA, 15 nt, Chlamydia trachomatis
uggacaagcaauagc

SEQ ID NO: 463517 - RNA, 17 nt, Chlamydia trachomatis
uggacacuuucaucaag

SEQ ID NO: 463518 - RNA, 15 nt, Chlamydia trachomatis
uggacuuuagauagu

SEQ ID NO: 463519 - RNA, 16 nt, Chlamydia trachomatis
uggagaauuggaaacu

SEQ ID NO: 463520 - RNA, 23 nt, Chlamydia trachomatis
uggagaacgcauaagcacuauau

SEQ ID NO: 463521 - RNA, 11 nt, Chlamydia trachomatis
uggagaaucca

SEQ ID NO: 463522 - RNA, 11 nt, Chlamydia trachomatis
uggacucagaa

SEQ ID NO: 463523 - RNA, 20 nt, Chlamydia trachomatis
uggagcauguagccaaggaa

SEQ ID NO: 463524 - RNA, 16 nt, Chlamydia trachomatis
uggagcaacaaccaac

SEQ ID NO: 463525 - RNA, 20 nt, Chlamydia trachomatis
uggagauugaauaaaucuau

SEQ ID NO: 463526 - RNA, 20 nt, Chlamydia trachomatis
uggagaggguucucuuuuua

SEQ ID NO: 463527 - RNA, 18 nt, Chlamydia trachomatis
uggaugcguuaauccuuu

SEQ ID NO: 463528 - RNA, 20 nt, Chlamydia trachomatis
uggaugcguuaauccuuuga

SEQ ID NO: 463529 - RNA, 13 nt, Chlamydia trachomatis
uggaucucuuaga

SEQ ID NO: 463530 - RNA, 12 nt, Chlamydia trachomatis
uggaucagcucc

SEQ ID NO: 463531 - RNA, 22 nt, Chlamydia trachomatis
uggaucaccgaacaaccuucug

SEQ ID NO: 463532 - RNA, 16 nt, Chlamydia trachomatis
uggaguguagagaaac

SEQ ID NO: 463533 - RNA, 23 nt, Chlamydia trachomatis
uggaguguggaagcuagaagaag

SEQ ID NO: 463534 - RNA, 13 nt, Chlamydia trachomatis
uggauaaaauucc

SEQ ID NO: 463535 - RNA, 23 nt, Chlamydia trachomatis
uggauaguccuucggagagcagu

SEQ ID NO: 463536 - RNA, 19 nt, Chlamydia trachomatis
uggauaguuucuuucuuag

SEQ ID NO: 463537 - RNA, 23 nt, Chlamydia trachomatis
uggauaugccugcaaaaaggcuu

SEQ ID NO: 463538 - RNA, 15 nt, Chlamydia trachomatis
uggauguacugcgca

SEQ ID NO: 463539 - RNA, 20 nt, Chlamydia trachomatis
uggauuugugugcaaaucac

SEQ ID NO: 463540 - RNA, 14 nt, Chlamydia trachomatis
uggcaauaaucuuu

SEQ ID NO: 463541 - RNA, 14 nt, Chlamydia trachomatis
uggcagaugcaucu

SEQ ID NO: 463542 - RNA, 16 nt, Chlamydia trachomatis
uggcagggauaguaaa

SEQ ID NO: 463543 - RNA, 22 nt, Chlamydia trachomatis
uggcagggauaguaaaaacuau

SEQ ID NO: 463544 - RNA, 21 nt, Chlamydia trachomatis
uggcauucaaccucucaucag

SEQ ID NO: 463545 - RNA, 21 nt, Chlamydia trachomatis
uggcuaagccauugcuaccga

SEQ ID NO: 463546 - RNA, 19 nt, Chlamydia trachomatis
uggcucuuuaauauuuccc

SEQ ID NO: 463547 - RNA, 14 nt, Chlamydia trachomatis
uggcugcagaagac

SEQ ID NO: 463548 - RNA, 21 nt, Chlamydia trachomatis
uggcugcaggauauccaucaa

SEQ ID NO: 463549 - RNA, 18 nt, Chlamydia trachomatis
ugggaaaauuaaaaggcg

SEQ ID NO: 463550 - RNA, 19 nt, Chlamydia trachomatis
uggcuguagcacaaguugg

SEQ ID NO: 463551 - RNA, 15 nt, Chlamydia trachomatis
ugggagauuccacaa

SEQ ID NO: 463552 - RNA, 16 nt, Chlamydia trachomatis
ugggagauuccacaac

SEQ ID NO: 463553 - RNA, 19 nt, Chlamydia trachomatis
ugggcucguggaggggaau

SEQ ID NO: 463554 - RNA, 18 nt, Chlamydia trachomatis
uggguaagagcagagcuu

SEQ ID NO: 463555 - RNA, 20 nt, Chlamydia trachomatis
uggguagcgauacaagacuc

SEQ ID NO: 463556 - RNA, 12 nt, Chlamydia trachomatis
uggguaggauua

SEQ ID NO: 463557 - RNA, 15 nt, Chlamydia trachomatis
uggucucacacaaca

SEQ ID NO: 463558 - RNA, 13 nt, Chlamydia trachomatis
ugguguaggaaaa

SEQ ID NO: 463559 - RNA, 23 nt, Chlamydia trachomatis
ugguuaccugugaagaaacuucu

SEQ ID NO: 463560 - RNA, 17 nt, Chlamydia trachomatis
ugguucaaacauagaag

SEQ ID NO: 463561 - RNA, 20 nt, Chlamydia trachomatis
uguaaggagagaaaagagga

SEQ ID NO: 463562 - RNA, 16 nt, Chlamydia trachomatis
uguaauguccucuuua

SEQ ID NO: 463563 - RNA, 14 nt, Chlamydia trachomatis
uguacagagaaaaa

SEQ ID NO: 463564 - RNA, 20 nt, Chlamydia trachomatis
uguacagcgacacguuuucc

SEQ ID NO: 463565 - RNA, 14 nt, Chlamydia trachomatis
uguacgcucuuucc

SEQ ID NO: 463566 - RNA, 13 nt, Chlamydia trachomatis
uguaaaguaacua

SEQ ID NO: 463567 - RNA, 18 nt, Chlamydia trachomatis
ugguucccugcaccucuu

SEQ ID NO: 463568 - RNA, 20 nt, Chlamydia trachomatis
ugguucccugcaccucuuuc

SEQ ID NO: 463569 - RNA, 19 nt, Chlamydia trachomatis
ugucaggauuuaaagccuu

SEQ ID NO: 463570 - RNA, 23 nt, Chlamydia trachomatis
ugucccugcuccgaucauaauua

SEQ ID NO: 463571 - RNA, 19 nt, Chlamydia trachomatis
ugucccccagauaacuggu

SEQ ID NO: 463572 - RNA, 15 nt, Chlamydia trachomatis
uguccugaccaauac

SEQ ID NO: 463573 - RNA, 20 nt, Chlamydia trachomatis
uguccuaccaauauucccug

SEQ ID NO: 463574 - RNA, 13 nt, Chlamydia trachomatis
uguauuuccuucg

SEQ ID NO: 463575 - RNA, 14 nt, Chlamydia trachomatis
uguagccuucuaua

SEQ ID NO: 463576 - RNA, 20 nt, Chlamydia trachomatis
uguagcaccaaguucuucuu

SEQ ID NO: 463577 - RNA, 18 nt, Chlamydia trachomatis
ugucgaacgcuucuuccc

SEQ ID NO: 463578 - RNA, 14 nt, Chlamydia trachomatis
uguccuggccaaaa

SEQ ID NO: 463579 - RNA, 18 nt, Chlamydia trachomatis
ugucgcagcuuucuuuuc

SEQ ID NO: 463580 - RNA, 22 nt, Chlamydia trachomatis
ugucgauaaaguaaaggaugau

SEQ ID NO: 463581 - RNA, 22 nt, Chlamydia trachomatis
ugucguuaaagaauuauuugcc

SEQ ID NO: 463582 - RNA, 17 nt, Chlamydia trachomatis
ugucguuuucggagaag

SEQ ID NO: 463583 - RNA, 18 nt, Chlamydia trachomatis
ugucuccuucuuugacaa

SEQ ID NO: 463584 - RNA, 16 nt, Chlamydia trachomatis
ugugccagcucuaauu

SEQ ID NO: 463585 - RNA, 21 nt, Chlamydia trachomatis
ugugauuuuucgcuaucccca

SEQ ID NO: 463586 - RNA, 17 nt, Chlamydia trachomatis
ugucuucgcaaacugcu

SEQ ID NO: 463587 - RNA, 22 nt, Chlamydia trachomatis
ugucuucgcaaacugcucuucu

SEQ ID NO: 463588 - RNA, 14 nt, Chlamydia trachomatis
ugucuucuuucaaa

SEQ ID NO: 463589 - RNA, 19 nt, Chlamydia trachomatis
ugucuucuuucaaagaagc

SEQ ID NO: 463590 - RNA, 15 nt, Chlamydia trachomatis
ugucuucuuucucuu

SEQ ID NO: 463591 - RNA, 12 nt, Chlamydia trachomatis
ugugaaaauaag

SEQ ID NO: 463592 - RNA, 14 nt, Chlamydia trachomatis
ugugaaagaaaaau

SEQ ID NO: 463593 - RNA, 16 nt, Chlamydia trachomatis
ugugauaggagaggau

SEQ ID NO: 463594 - RNA, 19 nt, Chlamydia trachomatis
uguggagcuaucauuucca

SEQ ID NO: 463595 - RNA, 20 nt, Chlamydia trachomatis
uguggagcuaucauuuccaa

SEQ ID NO: 463596 - RNA, 20 nt, Chlamydia trachomatis
uuaacccuucaggaaagccu

SEQ ID NO: 463597 - RNA, 23 nt, Chlamydia trachomatis
uuaaccgccauuuaugaagccuu

SEQ ID NO: 463598 - RNA, 17 nt, Chlamydia trachomatis
uuaacuacucaacaaau

SEQ ID NO: 463599 - RNA, 20 nt, Chlamydia trachomatis
uuaagaauuaacccaaaaga

SEQ ID NO: 463600 - RNA, 17 nt, Chlamydia trachomatis
uuaaggacuucaacaaa

SEQ ID NO: 463601 - RNA, 24 nt, Chlamydia trachomatis
uuaaguccagggaaaagagcuagg

SEQ ID NO: 463602 - RNA, 18 nt, Chlamydia trachomatis
uuaagugacuggcgagaa

SEQ ID NO: 463603 - RNA, 12 nt, Chlamydia trachomatis
uuaauaacugca

SEQ ID NO: 463604 - RNA, 16 nt, Chlamydia trachomatis
uuaauaagaccucuuu

SEQ ID NO: 463605 - RNA, 17 nt, Chlamydia trachomatis
uuaauaagaccucuuuu

SEQ ID NO: 463606 - RNA, 16 nt, Chlamydia trachomatis
uuaauaaguuuuucaa

SEQ ID NO: 463607 - RNA, 17 nt, Chlamydia trachomatis
uuaauaaguuuuucaaa

SEQ ID NO: 463608 - RNA, 16 nt, Chlamydia trachomatis
uuaauaauaaagauag

SEQ ID NO: 463609 - RNA, 16 nt, Chlamydia trachomatis
uuaauaaugaaauugc

SEQ ID NO: 463610 - RNA, 23 nt, Chlamydia trachomatis
uuaauccuugcacuaagaauaaa

SEQ ID NO: 463611 - RNA, 15 nt, Chlamydia trachomatis
uuacaagucugcuag

SEQ ID NO: 463612 - RNA, 18 nt, Chlamydia trachomatis
uuacaauagguuuaaaua

SEQ ID NO: 463613 - RNA, 15 nt, Chlamydia trachomatis
uuacagcaagaagaa

SEQ ID NO: 463614 - RNA, 22 nt, Chlamydia trachomatis
uuacagcaagaagaagagagaa

SEQ ID NO: 463615 - RNA, 17 nt, Chlamydia trachomatis
uuaaugucucuucacaa

SEQ ID NO: 463616 - RNA, 13 nt, Chlamydia trachomatis
uuaauuccaucuu

SEQ ID NO: 463617 - RNA, 14 nt, Chlamydia trachomatis
uuaauuccaucuuu

SEQ ID NO: 463618 - RNA, 17 nt, Chlamydia trachomatis
uuaauuccaucuuuucg

SEQ ID NO: 463619 - RNA, 13 nt, Chlamydia trachomatis
uuaauuccuugga

SEQ ID NO: 463620 - RNA, 21 nt, Chlamydia trachomatis
uuaauuccuuggauacguaca

SEQ ID NO: 463621 - RNA, 13 nt, Chlamydia trachomatis
uuaauugaaauau

SEQ ID NO: 463622 - RNA, 22 nt, Chlamydia trachomatis
uuaauugcagguacuuacccuu

SEQ ID NO: 463623 - RNA, 23 nt, Chlamydia trachomatis
uuaguauagucuuuauuuaagua

SEQ ID NO: 463624 - RNA, 14 nt, Chlamydia trachomatis
uuagugaagagcag

SEQ ID NO: 463625 - RNA, 17 nt, Chlamydia trachomatis
uuaguggacgcugauca

SEQ ID NO: 463626 - RNA, 21 nt, Chlamydia trachomatis
uuaguuaaaacuccagaaaau

SEQ ID NO: 463627 - RNA, 23 nt, Chlamydia trachomatis
uuaguuacaagacaauaaacaag

SEQ ID NO: 463628 - RNA, 18 nt, Chlamydia trachomatis
uuaguuaccaaaaaggaa

SEQ ID NO: 463629 - RNA, 17 nt, Chlamydia trachomatis
uuaguuuuaauuccauc

SEQ ID NO: 463630 - RNA, 19 nt, Chlamydia trachomatis
uuauaacgauauccuucug

SEQ ID NO: 463631 - RNA, 19 nt, Chlamydia trachomatis
uuauaagagaacccuaaua

SEQ ID NO: 463632 - RNA, 19 nt, Chlamydia trachomatis
uuauaaucgaucacagaaa

SEQ ID NO: 463633 - RNA, 12 nt, Chlamydia trachomatis
uuauaauuccaa

SEQ ID NO: 463634 - RNA, 22 nt, Chlamydia trachomatis
uuauacuucuuacuuaaaaaac

SEQ ID NO: 463635 - RNA, 23 nt, Chlamydia trachomatis
uuauacuucuuacuuaaaaaaca

SEQ ID NO: 463636 - RNA, 21 nt, Chlamydia trachomatis
uuagagaagucagaugaguuu

SEQ ID NO: 463637 - RNA, 15 nt, Chlamydia trachomatis
uuagagaaaagaaaa

SEQ ID NO: 463638 - RNA, 12 nt, Chlamydia trachomatis
uuagaagaaaag

SEQ ID NO: 463639 - RNA, 13 nt, Chlamydia trachomatis
uuagaagaaaaga

SEQ ID NO: 463640 - RNA, 21 nt, Chlamydia trachomatis
uuagaagaaaagagcuuuucu

SEQ ID NO: 463641 - RNA, 15 nt, Chlamydia trachomatis
uuagaaggaaagcua

SEQ ID NO: 463642 - RNA, 17 nt, Chlamydia trachomatis
uuagagcagcggaauca

SEQ ID NO: 463643 - RNA, 15 nt, Chlamydia trachomatis
uuagaggaguuccua

SEQ ID NO: 463644 - RNA, 14 nt, Chlamydia trachomatis
uuagcacucaaaca

SEQ ID NO: 463645 - RNA, 14 nt, Chlamydia trachomatis
uuagcauuucuuug

SEQ ID NO: 463646 - RNA, 14 nt, Chlamydia trachomatis
uuagcugcuuuaaa

SEQ ID NO: 463647 - RNA, 18 nt, Chlamydia trachomatis
uuacuaacuaaagucuuu

SEQ ID NO: 463648 - RNA, 14 nt, Chlamydia trachomatis
uuacugcaauaagg

SEQ ID NO: 463649 - RNA, 23 nt, Chlamydia trachomatis
uuaugcuagccuggcugcagaag

SEQ ID NO: 463650 - RNA, 17 nt, Chlamydia trachomatis
uuaugggugaagaagga

SEQ ID NO: 463651 - RNA, 16 nt, Chlamydia trachomatis
uuauuaaccaacucuc

SEQ ID NO: 463652 - RNA, 15 nt, Chlamydia trachomatis
uuaucguagagaucu

SEQ ID NO: 463653 - RNA, 21 nt, Chlamydia trachomatis
uuaucuaaagaaauggucucu

SEQ ID NO: 463654 - RNA, 15 nt, Chlamydia trachomatis
uuaucuccuaagaca

SEQ ID NO: 463655 - RNA, 15 nt, Chlamydia trachomatis
uuaucugcccaucau

SEQ ID NO: 463656 - RNA, 18 nt, Chlamydia trachomatis
uuaucugcuauagaaagc

SEQ ID NO: 463657 - RNA, 14 nt, Chlamydia trachomatis
uuaugaaaacuuug

SEQ ID NO: 463658 - RNA, 20 nt, Chlamydia trachomatis
uuaugaaccagggagagcuu

SEQ ID NO: 463659 - RNA, 13 nt, Chlamydia trachomatis
uuauccaaauaaa

SEQ ID NO: 463660 - RNA, 13 nt, Chlamydia trachomatis
uuauccaagcacu

SEQ ID NO: 463661 - RNA, 13 nt, Chlamydia trachomatis
uuauccuguucuc

SEQ ID NO: 463662 - RNA, 20 nt, Chlamydia trachomatis
uuauccuguucuccaaauug

SEQ ID NO: 463663 - RNA, 14 nt, Chlamydia trachomatis
uuaucacauucuua

SEQ ID NO: 463664 - RNA, 14 nt, Chlamydia trachomatis
uuaucaccuauuaa

SEQ ID NO: 463665 - RNA, 17 nt, Chlamydia trachomatis
uuaucaccuauuaagaa

SEQ ID NO: 463666 - RNA, 22 nt, Chlamydia trachomatis
uuaucauguagcccuaccucau

SEQ ID NO: 463667 - RNA, 13 nt, Chlamydia trachomatis
uuaucauucaaaa

SEQ ID NO: 463668 - RNA, 13 nt, Chlamydia trachomatis
uuauccaaaaaag

SEQ ID NO: 463669 - RNA, 16 nt, Chlamydia trachomatis
uuauccaaaaaagugu

SEQ ID NO: 463670 - RNA, 17 nt, Chlamydia trachomatis
uuauauaggcuuccaaa

SEQ ID NO: 463671 - RNA, 17 nt, Chlamydia trachomatis
uuauaggggugauaaca

SEQ ID NO: 463672 - RNA, 13 nt, Chlamydia trachomatis
uuauauugcuuca

SEQ ID NO: 463673 - RNA, 15 nt, Chlamydia trachomatis
uuauauugcuucaua

SEQ ID NO: 463674 - RNA, 19 nt, Chlamydia trachomatis
uuauauugcuucauaaaaa

SEQ ID NO: 463675 - RNA, 20 nt, Chlamydia trachomatis
uuauauugcuucauaaaaaa

SEQ ID NO: 463676 - RNA, 19 nt, Chlamydia trachomatis
uucaauaauguugaagucu

SEQ ID NO: 463677 - RNA, 12 nt, Chlamydia trachomatis
uucaaaagaagg

SEQ ID NO: 463678 - RNA, 22 nt, Chlamydia trachomatis
uucaaaagaaggcuuuucuauu

SEQ ID NO: 463679 - RNA, 16 nt, Chlamydia trachomatis
uucaaaagcucgucag

SEQ ID NO: 463680 - RNA, 21 nt, Chlamydia trachomatis
uucaaaauaauguuuuguagu

SEQ ID NO: 463681 - RNA, 14 nt, Chlamydia trachomatis
uucaaccucucauc

SEQ ID NO: 463682 - RNA, 12 nt, Chlamydia trachomatis
uuauucucaagu

SEQ ID NO: 463683 - RNA, 17 nt, Chlamydia trachomatis
uuauucucuuuauagaa

SEQ ID NO: 463684 - RNA, 14 nt, Chlamydia trachomatis
uuauucuucaguuu

SEQ ID NO: 463685 - RNA, 22 nt, Chlamydia trachomatis
uuauucuucaguuugaaucaca

SEQ ID NO: 463686 - RNA, 14 nt, Chlamydia trachomatis
uuauuguuuauaaa

SEQ ID NO: 463687 - RNA, 15 nt, Chlamydia trachomatis
uuauuuaaguagaac

SEQ ID NO: 463688 - RNA, 14 nt, Chlamydia trachomatis
uuauuuuuuaagaa

SEQ ID NO: 463689 - RNA, 21 nt, Chlamydia trachomatis
uucaaaaagagcuaaacuucu

SEQ ID NO: 463690 - RNA, 22 nt, Chlamydia trachomatis
uucacagcuaaucauagccauc

SEQ ID NO: 463691 - RNA, 22 nt, Chlamydia trachomatis
uucacagcacgacacuccucug

SEQ ID NO: 463692 - RNA, 19 nt, Chlamydia trachomatis
uucacagaaaguccugcuu

SEQ ID NO: 463693 - RNA, 21 nt, Chlamydia trachomatis
uucacagagcuucucuaaaug

SEQ ID NO: 463694 - RNA, 19 nt, Chlamydia trachomatis
uucacaucgaauaaaaauu

SEQ ID NO: 463695 - RNA, 20 nt, Chlamydia trachomatis
uucacccaaauauacucaac

SEQ ID NO: 463696 - RNA, 12 nt, Chlamydia trachomatis
uucagcaauaau

SEQ ID NO: 463697 - RNA, 18 nt, Chlamydia trachomatis
uucagagaaaauuucucu

SEQ ID NO: 463698 - RNA, 15 nt, Chlamydia trachomatis
uucagcaagauucuc

SEQ ID NO: 463699 - RNA, 12 nt, Chlamydia trachomatis
uucagacaaaaa

SEQ ID NO: 463700 - RNA, 16 nt, Chlamydia trachomatis
uucagacaaaaagccu

SEQ ID NO: 463701 - RNA, 19 nt, Chlamydia trachomatis
uucagcaggcgaacaguga

SEQ ID NO: 463702 - RNA, 14 nt, Chlamydia trachomatis
uucagcauccugaa

SEQ ID NO: 463703 - RNA, 14 nt, Chlamydia trachomatis
uucagcuuuucuuu

SEQ ID NO: 463704 - RNA, 17 nt, Chlamydia trachomatis
uucagcuuuucuuuccu

SEQ ID NO: 463705 - RNA, 17 nt, Chlamydia trachomatis
uucaggggagaaaacau

SEQ ID NO: 463706 - RNA, 13 nt, Chlamydia trachomatis
uuccacaaauauu

SEQ ID NO: 463707 - RNA, 22 nt, Chlamydia trachomatis
uuccaccuugcuuaacacuucu

SEQ ID NO: 463708 - RNA, 20 nt, Chlamydia trachomatis
uuccacgaagagcaaaauca

SEQ ID NO: 463709 - RNA, 18 nt, Chlamydia trachomatis
uuccagccuacaaauaaa

SEQ ID NO: 463710 - RNA, 18 nt, Chlamydia trachomatis
uuccagcauuuuaaaauc

SEQ ID NO: 463711 - RNA, 16 nt, Chlamydia trachomatis
uuccacuuuugugaaa

SEQ ID NO: 463712 - RNA, 20 nt, Chlamydia trachomatis
uuccagacaaaaagaaagcc

SEQ ID NO: 463713 - RNA, 19 nt, Chlamydia trachomatis
uuccagacgcccuccuccu

SEQ ID NO: 463714 - RNA, 23 nt, Chlamydia trachomatis
uuccagagcauguguuucuggaa

SEQ ID NO: 463715 - RNA, 22 nt, Chlamydia trachomatis
uuccaucguaagcaacaauauc

SEQ ID NO: 463716 - RNA, 19 nt, Chlamydia trachomatis
uuccaucguuuaugaagcc

SEQ ID NO: 463717 - RNA, 14 nt, Chlamydia trachomatis
uuccaucuuccaaa

SEQ ID NO: 463718 - RNA, 20 nt, Chlamydia trachomatis
uuccauacaucaucucucag

SEQ ID NO: 463719 - RNA, 22 nt, Chlamydia trachomatis
uuccauggauaaaauuccuacg

SEQ ID NO: 463720 - RNA, 14 nt, Chlamydia trachomatis
uuccauuaaacuau

SEQ ID NO: 463721 - RNA, 19 nt, Chlamydia trachomatis
uuccgaguaaucaaaaaag

SEQ ID NO: 463722 - RNA, 19 nt, Chlamydia trachomatis
uucccuuuuguuccagaaa

SEQ ID NO: 463723 - RNA, 13 nt, Chlamydia trachomatis
uuccgaaaagauu

SEQ ID NO: 463724 - RNA, 15 nt, Chlamydia trachomatis
uuccgaacaaaauga

SEQ ID NO: 463725 - RNA, 21 nt, Chlamydia trachomatis
uucccaugucuguugaaagcu

SEQ ID NO: 463726 - RNA, 12 nt, Chlamydia trachomatis
uucccauuuuua

SEQ ID NO: 463727 - RNA, 23 nt, Chlamydia trachomatis
uuccccaaagcagucuagagguu

SEQ ID NO: 463728 - RNA, 22 nt, Chlamydia trachomatis
uucccgauauguucagccauuu

SEQ ID NO: 463729 - RNA, 16 nt, Chlamydia trachomatis
uucccaaaauuuuucu

SEQ ID NO: 463730 - RNA, 22 nt, Chlamydia trachomatis
uucccaaaauuuuucugcucca

SEQ ID NO: 463731 - RNA, 22 nt, Chlamydia trachomatis
uucccaaauacugggaaaucau

SEQ ID NO: 463732 - RNA, 20 nt, Chlamydia trachomatis
uucccaaagcuagguaaagg

SEQ ID NO: 463733 - RNA, 18 nt, Chlamydia trachomatis
uucccaguuaggcauucc

SEQ ID NO: 463734 - RNA, 17 nt, Chlamydia trachomatis
uucccauccaaagguaa

SEQ ID NO: 463735 - RNA, 19 nt, Chlamydia trachomatis
uucccaucuacaaaaccaa

SEQ ID NO: 463736 - RNA, 15 nt, Chlamydia trachomatis
uuccucaguauaaaa

SEQ ID NO: 463737 - RNA, 21 nt, Chlamydia trachomatis
uuccuccuauguuuaacccuc

SEQ ID NO: 463738 - RNA, 13 nt, Chlamydia trachomatis
uuccucgaagcua

SEQ ID NO: 463739 - RNA, 16 nt, Chlamydia trachomatis
uuccuauacaagaaaa

SEQ ID NO: 463740 - RNA, 22 nt, Chlamydia trachomatis
uuccggaaggauguuucccuuu

SEQ ID NO: 463741 - RNA, 19 nt, Chlamydia trachomatis
uuccucuaaacaagguucu

SEQ ID NO: 463742 - RNA, 19 nt, Chlamydia trachomatis
uuccucuccuucuacaaaa

SEQ ID NO: 463743 - RNA, 18 nt, Chlamydia trachomatis
uuccucucucugcagaga

SEQ ID NO: 463744 - RNA, 16 nt, Chlamydia trachomatis
uuccugcuucaaaaaa

SEQ ID NO: 463745 - RNA, 19 nt, Chlamydia trachomatis
uuccugcuucaaaaaagau

SEQ ID NO: 463746 - RNA, 16 nt, Chlamydia trachomatis
uuccuguauaagaaaa

SEQ ID NO: 463747 - RNA, 23 nt, Chlamydia trachomatis
uuccuggauccaaaaaagaaucu

SEQ ID NO: 463748 - RNA, 23 nt, Chlamydia trachomatis
uucgaaaacaacgcguucuucug

SEQ ID NO: 463749 - RNA, 22 nt, Chlamydia trachomatis
uuccuuggcuuuuacaauagca

SEQ ID NO: 463750 - RNA, 18 nt, Chlamydia trachomatis
uuccuuguagaaagcugg

SEQ ID NO: 463751 - RNA, 18 nt, Chlamydia trachomatis
uucgcaggggaauacagu

SEQ ID NO: 463752 - RNA, 19 nt, Chlamydia trachomatis
uucgcaggggaauacaguu

SEQ ID NO: 463753 - RNA, 23 nt, Chlamydia trachomatis
uucgccgggggagccaaaaaguc

SEQ ID NO: 463754 - RNA, 14 nt, Chlamydia trachomatis
uucgcuaccaaaaa

SEQ ID NO: 463755 - RNA, 17 nt, Chlamydia trachomatis
uucguagacagagaaua

SEQ ID NO: 463756 - RNA, 13 nt, Chlamydia trachomatis
uucggagagcagu

SEQ ID NO: 463757 - RNA, 13 nt, Chlamydia trachomatis
uucgucaaagaag

SEQ ID NO: 463758 - RNA, 17 nt, Chlamydia trachomatis
uucgugugacuguaagu

SEQ ID NO: 463759 - RNA, 14 nt, Chlamydia trachomatis
uucuaacuuuucaa

SEQ ID NO: 463760 - RNA, 14 nt, Chlamydia trachomatis
uucuaagaaauugu

SEQ ID NO: 463761 - RNA, 10 nt, Chlamydia trachomatis
uucuaagaag

SEQ ID NO: 463762 - RNA, 15 nt, Chlamydia trachomatis
uucuauacgcacaua

SEQ ID NO: 463763 - RNA, 19 nt, Chlamydia trachomatis
uucuauguaaaaauucuaa

SEQ ID NO: 463764 - RNA, 21 nt, Chlamydia trachomatis
uucuacgaauaccccaaaugu

SEQ ID NO: 463765 - RNA, 19 nt, Chlamydia trachomatis
uucuacguaguaauuuuga

SEQ ID NO: 463766 - RNA, 14 nt, Chlamydia trachomatis
uucuaggagaagag

SEQ ID NO: 463767 - RNA, 15 nt, Chlamydia trachomatis
uucuauaagaaacac

SEQ ID NO: 463768 - RNA, 21 nt, Chlamydia trachomatis
uucuaauaauacagauuuuuc

SEQ ID NO: 463769 - RNA, 17 nt, Chlamydia trachomatis
uucuacaacuaucagaa

SEQ ID NO: 463770 - RNA, 21 nt, Chlamydia trachomatis
uucuacaaguucucucucagc

SEQ ID NO: 463771 - RNA, 21 nt, Chlamydia trachomatis
uucucgcagaugcuucugccu

SEQ ID NO: 463772 - RNA, 14 nt, Chlamydia trachomatis
uucucgagaagaaa

SEQ ID NO: 463773 - RNA, 17 nt, Chlamydia trachomatis
uucucgagaagaaaaac

SEQ ID NO: 463774 - RNA, 20 nt, Chlamydia trachomatis
uucucaggaucuaauucuag

SEQ ID NO: 463775 - RNA, 18 nt, Chlamydia trachomatis
uucucgcuacaaauccuu

SEQ ID NO: 463776 - RNA, 18 nt, Chlamydia trachomatis
uucucggaaaagauaucc

SEQ ID NO: 463777 - RNA, 15 nt, Chlamydia trachomatis
uucucggccuuuucu

SEQ ID NO: 463778 - RNA, 14 nt, Chlamydia trachomatis
uucucuaacaauga

SEQ ID NO: 463779 - RNA, 20 nt, Chlamydia trachomatis
uucucuaauaguugcaaaaa

SEQ ID NO: 463780 - RNA, 17 nt, Chlamydia trachomatis
uucucuagaauuucccu

SEQ ID NO: 463781 - RNA, 22 nt, Chlamydia trachomatis
uucucuagaauuucccuaagcc

SEQ ID NO: 463782 - RNA, 17 nt, Chlamydia trachomatis
uucucuuggcuuuuuau

SEQ ID NO: 463783 - RNA, 22 nt, Chlamydia trachomatis
uucucuuguagagaggcaaaca

SEQ ID NO: 463784 - RNA, 13 nt, Chlamydia trachomatis
uucugcaacucuc

SEQ ID NO: 463785 - RNA, 10 nt, Chlamydia trachomatis
uucucucaua

SEQ ID NO: 463786 - RNA, 17 nt, Chlamydia trachomatis
uucucucccuuccugag

SEQ ID NO: 463787 - RNA, 12 nt, Chlamydia trachomatis
uucucucuaaaa

SEQ ID NO: 463788 - RNA, 13 nt, Chlamydia trachomatis
uucucucuaaaau

SEQ ID NO: 463789 - RNA, 20 nt, Chlamydia trachomatis
uucucugagggugaggucca

SEQ ID NO: 463790 - RNA, 14 nt, Chlamydia trachomatis
uucucugccuauag

SEQ ID NO: 463791 - RNA, 15 nt, Chlamydia trachomatis
uucucugcuucgcca

SEQ ID NO: 463792 - RNA, 12 nt, Chlamydia trachomatis
uucucuuagaag

SEQ ID NO: 463793 - RNA, 15 nt, Chlamydia trachomatis
uucucuugaaaaaac

SEQ ID NO: 463794 - RNA, 16 nt, Chlamydia trachomatis
uucucuugaaaacucu

SEQ ID NO: 463795 - RNA, 16 nt, Chlamydia trachomatis
uucucuugaaucaaaa

SEQ ID NO: 463796 - RNA, 16 nt, Chlamydia trachomatis
uucucuugcagaacag

SEQ ID NO: 463797 - RNA, 14 nt, Chlamydia trachomatis
uucugccauuucua

SEQ ID NO: 463798 - RNA, 22 nt, Chlamydia trachomatis
uucugccucuuuuaccgagaga

SEQ ID NO: 463799 - RNA, 19 nt, Chlamydia trachomatis
uucugcauaacagcaagac

SEQ ID NO: 463800 - RNA, 21 nt, Chlamydia trachomatis
uucugcauaacagcaagacaa

SEQ ID NO: 463801 - RNA, 12 nt, Chlamydia trachomatis
uucugcauaacg

SEQ ID NO: 463802 - RNA, 20 nt, Chlamydia trachomatis
uucugcaggcucaugaacag

SEQ ID NO: 463803 - RNA, 18 nt, Chlamydia trachomatis
uucuugaaucagaaguug

SEQ ID NO: 463804 - RNA, 13 nt, Chlamydia trachomatis
uucuugagaaaac

SEQ ID NO: 463805 - RNA, 19 nt, Chlamydia trachomatis
uucuugcgaugccucuaac

SEQ ID NO: 463806 - RNA, 18 nt, Chlamydia trachomatis
uucuuuagccccuuguuc

SEQ ID NO: 463807 - RNA, 14 nt, Chlamydia trachomatis
uucuuucaaagaga

SEQ ID NO: 463808 - RNA, 18 nt, Chlamydia trachomatis
uucuuucauucguuucuu

SEQ ID NO: 463809 - RNA, 20 nt, Chlamydia trachomatis
uucuuugagaaaguuaaaga

SEQ ID NO: 463810 - RNA, 23 nt, Chlamydia trachomatis
uucuuugcguagcucagagauuu

SEQ ID NO: 463811 - RNA, 16 nt, Chlamydia trachomatis
uugaaaucaaaaggcc

SEQ ID NO: 463812 - RNA, 19 nt, Chlamydia trachomatis
uugaaaggggcuuuuuuua

SEQ ID NO: 463813 - RNA, 12 nt, Chlamydia trachomatis
uucuuuuuccuc

SEQ ID NO: 463814 - RNA, 15 nt, Chlamydia trachomatis
uucuuuuuccucagc

SEQ ID NO: 463815 - RNA, 16 nt, Chlamydia trachomatis
uugaaucaaaaaguuc

SEQ ID NO: 463816 - RNA, 22 nt, Chlamydia trachomatis
uugaaucaaaaaguucauagau

SEQ ID NO: 463817 - RNA, 19 nt, Chlamydia trachomatis
uugaaucacacgggucucu

SEQ ID NO: 463818 - RNA, 17 nt, Chlamydia trachomatis
uugaauaacguuuuaaa

SEQ ID NO: 463819 - RNA, 19 nt, Chlamydia trachomatis
uugaauaacguuuuaaaca

SEQ ID NO: 463820 - RNA, 21 nt, Chlamydia trachomatis
uugaauacgauccucuggaua

SEQ ID NO: 463821 - RNA, 20 nt, Chlamydia trachomatis
uugaauaucguaaacaacca

SEQ ID NO: 463822 - RNA, 15 nt, Chlamydia trachomatis
uugaagauucuaaaa

SEQ ID NO: 463823 - RNA, 23 nt, Chlamydia trachomatis
uugaacuuauuggugagugcaua

SEQ ID NO: 463824 - RNA, 14 nt, Chlamydia trachomatis
uugacaagcaguag

SEQ ID NO: 463825 - RNA, 15 nt, Chlamydia trachomatis
uugacuaucugcucg

SEQ ID NO: 463826 - RNA, 14 nt, Chlamydia trachomatis
uugacucaucaaaa

SEQ ID NO: 463827 - RNA, 15 nt, Chlamydia trachomatis
uugacucuaaagaau

SEQ ID NO: 463828 - RNA, 17 nt, Chlamydia trachomatis
uugacucuaaagaauag

SEQ ID NO: 463829 - RNA, 22 nt, Chlamydia trachomatis
uugacucucauaagaauacaaa

SEQ ID NO: 463830 - RNA, 23 nt, Chlamydia trachomatis
uugacucucauaagaauacaaag

SEQ ID NO: 463831 - RNA, 15 nt, Chlamydia trachomatis
uugaucaaagaaucu

SEQ ID NO: 463832 - RNA, 13 nt, Chlamydia trachomatis
uugauauucccuu

SEQ ID NO: 463833 - RNA, 20 nt, Chlamydia trachomatis
uugaguuguuugggcugcug

SEQ ID NO: 463834 - RNA, 21 nt, Chlamydia trachomatis
uugagaugaaucggaugagga

SEQ ID NO: 463835 - RNA, 16 nt, Chlamydia trachomatis
uugagaugaucccauc

SEQ ID NO: 463836 - RNA, 20 nt, Chlamydia trachomatis
uugagagaccugcuucagca

SEQ ID NO: 463837 - RNA, 22 nt, Chlamydia trachomatis
uugagagcauucuucugaacaa

SEQ ID NO: 463838 - RNA, 17 nt, Chlamydia trachomatis
uugaugauguccaaagc

SEQ ID NO: 463839 - RNA, 12 nt, Chlamydia trachomatis
uugauucugcuc

SEQ ID NO: 463840 - RNA, 12 nt, Chlamydia trachomatis
uugauucugcuu

SEQ ID NO: 463841 - RNA, 13 nt, Chlamydia trachomatis
uugauuuuuucgc

SEQ ID NO: 463842 - RNA, 15 nt, Chlamydia trachomatis
uugauuuuuucgcuu

SEQ ID NO: 463843 - RNA, 17 nt, Chlamydia trachomatis
uugauuuuuucgcuuuu

SEQ ID NO: 463844 - RNA, 23 nt, Chlamydia trachomatis
uugauuuuuuucgauagaaaaaa

SEQ ID NO: 463845 - RNA, 21 nt, Chlamydia trachomatis
uugcaaacgguagcgauuuuc

SEQ ID NO: 463846 - RNA, 23 nt, Chlamydia trachomatis
uugcaaagcgucgacuguagaug

SEQ ID NO: 463847 - RNA, 18 nt, Chlamydia trachomatis
uugcaauccuuuuuccuu

SEQ ID NO: 463848 - RNA, 13 nt, Chlamydia trachomatis
uugcacaaaucca

SEQ ID NO: 463849 - RNA, 12 nt, Chlamydia trachomatis
uugcacagcaag

SEQ ID NO: 463850 - RNA, 13 nt, Chlamydia trachomatis
uugcacuaagaau

SEQ ID NO: 463851 - RNA, 17 nt, Chlamydia trachomatis
uugcacuaagaauaaag

SEQ ID NO: 463852 - RNA, 18 nt, Chlamydia trachomatis
uugcacuaagaauaaaga

SEQ ID NO: 463853 - RNA, 15 nt, Chlamydia trachomatis
uugccaaugaaauau

SEQ ID NO: 463854 - RNA, 13 nt, Chlamydia trachomatis
uugccuuacucuu

SEQ ID NO: 463855 - RNA, 14 nt, Chlamydia trachomatis
uugcgcaucaaagg

SEQ ID NO: 463856 - RNA, 23 nt, Chlamydia trachomatis
uugcgcaucacgaagaguuugua

SEQ ID NO: 463857 - RNA, 12 nt, Chlamydia trachomatis
uugcucuuugaa

SEQ ID NO: 463858 - RNA, 23 nt, Chlamydia trachomatis
uugcucuaccaacugagcuauuu

SEQ ID NO: 463859 - RNA, 15 nt, Chlamydia trachomatis
uuuaaaucaauuucu

SEQ ID NO: 463860 - RNA, 20 nt, Chlamydia trachomatis
uuuaaagggggacaaaaaua

SEQ ID NO: 463861 - RNA, 22 nt, Chlamydia trachomatis
uuuaaaguauaauccgagcauu

SEQ ID NO: 463862 - RNA, 19 nt, Chlamydia trachomatis
uugcugagcuuuuuuucac

SEQ ID NO: 463863 - RNA, 21 nt, Chlamydia trachomatis
uugcugcguuacccuuccaau

SEQ ID NO: 463864 - RNA, 19 nt, Chlamydia trachomatis
uuguuguccacaugccauc

SEQ ID NO: 463865 - RNA, 22 nt, Chlamydia trachomatis
uuguuggacaaagguguuuucu

SEQ ID NO: 463866 - RNA, 15 nt, Chlamydia trachomatis
uuguugccuuggccc

SEQ ID NO: 463867 - RNA, 17 nt, Chlamydia trachomatis
uuguuauccaaaaggau

SEQ ID NO: 463868 - RNA, 13 nt, Chlamydia trachomatis
uuguuaucuaaau

SEQ ID NO: 463869 - RNA, 23 nt, Chlamydia trachomatis
uuguuaucuaaaucuaaaauuuc

SEQ ID NO: 463870 - RNA, 23 nt, Chlamydia trachomatis
uuguugccaaccaccuguugcuu

SEQ ID NO: 463871 - RNA, 13 nt, Chlamydia trachomatis
uuguuuaaucagu

SEQ ID NO: 463872 - RNA, 13 nt, Chlamydia trachomatis
uuguuuagaaaau

SEQ ID NO: 463873 - RNA, 15 nt, Chlamydia trachomatis
uuguuuagaaaauac

SEQ ID NO: 463874 - RNA, 16 nt, Chlamydia trachomatis
uuguuuagaaaauacg

SEQ ID NO: 463875 - RNA, 17 nt, Chlamydia trachomatis
uuguuuagcauuucuuu

SEQ ID NO: 463876 - RNA, 21 nt, Chlamydia trachomatis
uuguuuauuaucuagaaaaga

SEQ ID NO: 463877 - RNA, 20 nt, Chlamydia trachomatis
uuguuucuguaggagagaau

SEQ ID NO: 463878 - RNA, 18 nt, Chlamydia trachomatis
uuguuuuuuaagaguuuu

SEQ ID NO: 463879 - RNA, 15 nt, Chlamydia trachomatis
uuuacgcucuuucuu

SEQ ID NO: 463880 - RNA, 14 nt, Chlamydia trachomatis
uuuacucuuuucuu

SEQ ID NO: 463881 - RNA, 18 nt, Chlamydia trachomatis
uuuaaccucugcaagaaa

SEQ ID NO: 463882 - RNA, 22 nt, Chlamydia trachomatis
uuuaaccucugcaagaaaauaa

SEQ ID NO: 463883 - RNA, 20 nt, Chlamydia trachomatis
uuuaacugggauaagaaauc

SEQ ID NO: 463884 - RNA, 15 nt, Chlamydia trachomatis
uuuacaagucugcua

SEQ ID NO: 463885 - RNA, 21 nt, Chlamydia trachomatis
uuuacaauagguuuaaauaag

SEQ ID NO: 463886 - RNA, 14 nt, Chlamydia trachomatis
uuuaccaaaccuuu

SEQ ID NO: 463887 - RNA, 18 nt, Chlamydia trachomatis
uuuaccaaaccuuucaaa

SEQ ID NO: 463888 - RNA, 15 nt, Chlamydia trachomatis
uuuaccaaugaagca

SEQ ID NO: 463889 - RNA, 11 nt, Chlamydia trachomatis
uuucacaaccc

SEQ ID NO: 463890 - RNA, 18 nt, Chlamydia trachomatis
uuucaccgacaguuuccc

SEQ ID NO: 463891 - RNA, 20 nt, Chlamydia trachomatis
uuucaagacguucuuggcua

SEQ ID NO: 463892 - RNA, 15 nt, Chlamydia trachomatis
uuucaaguucuaacu

SEQ ID NO: 463893 - RNA, 22 nt, Chlamydia trachomatis
uuucaaagaugcgaucuccuca

SEQ ID NO: 463894 - RNA, 16 nt, Chlamydia trachomatis
uuucaaagagaucugc

SEQ ID NO: 463895 - RNA, 23 nt, Chlamydia trachomatis
uuucaacgggaacaaaaccaaaa

SEQ ID NO: 463896 - RNA, 13 nt, Chlamydia trachomatis
uuuauucaaaucu

SEQ ID NO: 463897 - RNA, 13 nt, Chlamydia trachomatis
uuuauaaauuucu

SEQ ID NO: 463898 - RNA, 16 nt, Chlamydia trachomatis
uuuauaaauuucuaaa

SEQ ID NO: 463899 - RNA, 21 nt, Chlamydia trachomatis
uuuauacuucuuacuuaaaaa

SEQ ID NO: 463900 - RNA, 14 nt, Chlamydia trachomatis
uuuauagaaccccu

SEQ ID NO: 463901 - RNA, 14 nt, Chlamydia trachomatis
uuucagcuuuucuu

SEQ ID NO: 463902 - RNA, 18 nt, Chlamydia trachomatis
uuucagggauagaaacuc

SEQ ID NO: 463903 - RNA, 14 nt, Chlamydia trachomatis
uuucagcaauaaua

SEQ ID NO: 463904 - RNA, 13 nt, Chlamydia trachomatis
uuucaugaaaagc

SEQ ID NO: 463905 - RNA, 14 nt, Chlamydia trachomatis
uuucaucaaaauau

SEQ ID NO: 463906 - RNA, 21 nt, Chlamydia trachomatis
uuucaucaaaauauagacugu

SEQ ID NO: 463907 - RNA, 23 nt, Chlamydia trachomatis
uuucaucccacaugcuaguuagu

SEQ ID NO: 463908 - RNA, 22 nt, Chlamydia trachomatis
uuucaucccgguuuugccaucu

SEQ ID NO: 463909 - RNA, 18 nt, Chlamydia trachomatis
uuucauccuaggggauuu

SEQ ID NO: 463910 - RNA, 16 nt, Chlamydia trachomatis
uuucaucuccuuugcu

SEQ ID NO: 463911 - RNA, 20 nt, Chlamydia trachomatis
uuucauuuuauguaaauauu

SEQ ID NO: 463912 - RNA, 16 nt, Chlamydia trachomatis
uuuccaagaaaaauac

SEQ ID NO: 463913 - RNA, 19 nt, Chlamydia trachomatis
uuuccacaaauauuuuugg

SEQ ID NO: 463914 - RNA, 17 nt, Chlamydia trachomatis
uuuccacagguugcauc

SEQ ID NO: 463915 - RNA, 17 nt, Chlamydia trachomatis
uuuccauuuccagaacg

SEQ ID NO: 463916 - RNA, 13 nt, Chlamydia trachomatis
uuucccaaaauuu

SEQ ID NO: 463917 - RNA, 19 nt, Chlamydia trachomatis
uuucccaucuacaaaacca

SEQ ID NO: 463918 - RNA, 21 nt, Chlamydia trachomatis
uuucccaucuacaaaaccaaa

SEQ ID NO: 463919 - RNA, 17 nt, Chlamydia trachomatis
uuucccccaccuuuucu

SEQ ID NO: 463920 - RNA, 19 nt, Chlamydia trachomatis
uuucccccaccuuuucucc

SEQ ID NO: 463921 - RNA, 19 nt, Chlamydia trachomatis
uuuccauaagagaggcuug

SEQ ID NO: 463922 - RNA, 17 nt, Chlamydia trachomatis
uuuccauagaaagauag

SEQ ID NO: 463923 - RNA, 16 nt, Chlamydia trachomatis
uuuccauauucuugcu

SEQ ID NO: 463924 - RNA, 21 nt, Chlamydia trachomatis
uuuccauacaucaucucucag

SEQ ID NO: 463925 - RNA, 13 nt, Chlamydia trachomatis
uuucccuauuuuu

SEQ ID NO: 463926 - RNA, 22 nt, Chlamydia trachomatis
uuucccgcaacuuuucagcaag

SEQ ID NO: 463927 - RNA, 20 nt, Chlamydia trachomatis
uuuccgaauuaaaucugcuc

SEQ ID NO: 463928 - RNA, 14 nt, Chlamydia trachomatis
uuuccgagagcgaa

SEQ ID NO: 463929 - RNA, 13 nt, Chlamydia trachomatis
uuucccuucuuuc

SEQ ID NO: 463930 - RNA, 17 nt, Chlamydia trachomatis
uuucccuucuuucuucu

SEQ ID NO: 463931 - RNA, 18 nt, Chlamydia trachomatis
uuuccgcugcaaucucuu

SEQ ID NO: 463932 - RNA, 17 nt, Chlamydia trachomatis
uuucgauuaaugagguu

SEQ ID NO: 463933 - RNA, 17 nt, Chlamydia trachomatis
uuucgaauuuuuuucuu

SEQ ID NO: 463934 - RNA, 22 nt, Chlamydia trachomatis
uuuccuuagaaagaauuugcuu

SEQ ID NO: 463935 - RNA, 12 nt, Chlamydia trachomatis
uuuccuuaguuu

SEQ ID NO: 463936 - RNA, 22 nt, Chlamydia trachomatis
uuuccucugguacucaucuuuu

SEQ ID NO: 463937 - RNA, 21 nt, Chlamydia trachomatis
uuuccucuucagacacaauga

SEQ ID NO: 463938 - RNA, 14 nt, Chlamydia trachomatis
uuuccucuucuucg

SEQ ID NO: 463939 - RNA, 20 nt, Chlamydia trachomatis
uuuccugaaacgaucagcuc

SEQ ID NO: 463940 - RNA, 12 nt, Chlamydia trachomatis
uuuccucacaca

SEQ ID NO: 463941 - RNA, 19 nt, Chlamydia trachomatis
uuuccucacacacaaaaaa

SEQ ID NO: 463942 - RNA, 19 nt, Chlamydia trachomatis
uuuccuccauaggaauacg

SEQ ID NO: 463943 - RNA, 23 nt, Chlamydia trachomatis
uuuccuccucccuuuccauacau

SEQ ID NO: 463944 - RNA, 18 nt, Chlamydia trachomatis
uuucuauacagcaucacg

SEQ ID NO: 463945 - RNA, 21 nt, Chlamydia trachomatis
uuucuauagccauuucaucau

SEQ ID NO: 463946 - RNA, 19 nt, Chlamydia trachomatis
uuucuagccaauccguaug

SEQ ID NO: 463947 - RNA, 22 nt, Chlamydia trachomatis
uuucuaauggaugaucuguaau

SEQ ID NO: 463948 - RNA, 13 nt, Chlamydia trachomatis
uuucuaauuuccc

SEQ ID NO: 463949 - RNA, 20 nt, Chlamydia trachomatis
uuucuacggaaagguuuguu

SEQ ID NO: 463950 - RNA, 20 nt, Chlamydia trachomatis
uuucuagaagaacucccccu

SEQ ID NO: 463951 - RNA, 14 nt, Chlamydia trachomatis
uuucuagaauuuug

SEQ ID NO: 463952 - RNA, 12 nt, Chlamydia trachomatis
uuucuaaaauuu

SEQ ID NO: 463953 - RNA, 21 nt, Chlamydia trachomatis
uuucugggucauagaaaaugg

SEQ ID NO: 463954 - RNA, 10 nt, Chlamydia trachomatis
uuucugcuaa

SEQ ID NO: 463955 - RNA, 16 nt, Chlamydia trachomatis
uuucugcuccaaagua

SEQ ID NO: 463956 - RNA, 13 nt, Chlamydia trachomatis
uuucugaaucaaa

SEQ ID NO: 463957 - RNA, 14 nt, Chlamydia trachomatis
uuucugacucagaa

SEQ ID NO: 463958 - RNA, 13 nt, Chlamydia trachomatis
uuucugcaacucu

SEQ ID NO: 463959 - RNA, 14 nt, Chlamydia trachomatis
uuucugcagagagc

SEQ ID NO: 463960 - RNA, 14 nt, Chlamydia trachomatis
uuucuccagaggaa

SEQ ID NO: 463961 - RNA, 17 nt, Chlamydia trachomatis
uuucuccagcaucuuuu

SEQ ID NO: 463962 - RNA, 12 nt, Chlamydia trachomatis
uuucuauuuuua

SEQ ID NO: 463963 - RNA, 22 nt, Chlamydia trachomatis
uuucuccucucucuuuaugaaa

SEQ ID NO: 463964 - RNA, 18 nt, Chlamydia trachomatis
uuucucgauucucuugca

SEQ ID NO: 463965 - RNA, 15 nt, Chlamydia trachomatis
uuucucuaacaauga

SEQ ID NO: 463966 - RNA, 21 nt, Chlamydia trachomatis
uuucucuacccaggcuuuucu

SEQ ID NO: 463967 - RNA, 14 nt, Chlamydia trachomatis
uuucucuagaauuu

SEQ ID NO: 463968 - RNA, 23 nt, Chlamydia trachomatis
uuugaauacgauccucuggauau

SEQ ID NO: 463969 - RNA, 21 nt, Chlamydia trachomatis
uuugaauagggggaguucuau

SEQ ID NO: 463970 - RNA, 19 nt, Chlamydia trachomatis
uuugaaacaucuuuuaaag

SEQ ID NO: 463971 - RNA, 21 nt, Chlamydia trachomatis
uuugaaucacagaaacuucuu

SEQ ID NO: 463972 - RNA, 20 nt, Chlamydia trachomatis
uuugaauuuaugucgcagcu

SEQ ID NO: 463973 - RNA, 16 nt, Chlamydia trachomatis
uuugacgacaacauga

SEQ ID NO: 463974 - RNA, 22 nt, Chlamydia trachomatis
uuugacucucauaagaauacaa

SEQ ID NO: 463975 - RNA, 19 nt, Chlamydia trachomatis
uuugagaaaguuaaagaau

SEQ ID NO: 463976 - RNA, 15 nt, Chlamydia trachomatis
uuucuuuuccaucgu

SEQ ID NO: 463977 - RNA, 14 nt, Chlamydia trachomatis
uuucuucgguuuga

SEQ ID NO: 463978 - RNA, 14 nt, Chlamydia trachomatis
uuucuucuagauag

SEQ ID NO: 463979 - RNA, 18 nt, Chlamydia trachomatis
uuucuucuguuuuuucag

SEQ ID NO: 463980 - RNA, 12 nt, Chlamydia trachomatis
uuucuucuguuu

SEQ ID NO: 463981 - RNA, 16 nt, Chlamydia trachomatis
uuucuguugcacuuuc

SEQ ID NO: 463982 - RNA, 14 nt, Chlamydia trachomatis
uuucuguuuucguu

SEQ ID NO: 463983 - RNA, 23 nt, Chlamydia trachomatis
uuucuguuuucguuuaucuaauu

SEQ ID NO: 463984 - RNA, 22 nt, Chlamydia trachomatis
uuucuuacgaccguauuuuuua

SEQ ID NO: 463985 - RNA, 17 nt, Chlamydia trachomatis
uuucuuaggaacucccu

SEQ ID NO: 463986 - RNA, 19 nt, Chlamydia trachomatis
uuucuuaggaacucccuca

SEQ ID NO: 463987 - RNA, 15 nt, Chlamydia trachomatis
uuucuuccagagcau

SEQ ID NO: 463988 - RNA, 21 nt, Chlamydia trachomatis
uuucuuccucaguauaaaaaa

SEQ ID NO: 463989 - RNA, 12 nt, Chlamydia trachomatis
uuucuuccugcu

SEQ ID NO: 463990 - RNA, 20 nt, Chlamydia trachomatis
uuucuuccugcuucaaaaaa

SEQ ID NO: 463991 - RNA, 21 nt, Chlamydia trachomatis
uuugcagcauccucaaaaaag

SEQ ID NO: 463992 - RNA, 13 nt, Chlamydia trachomatis
uuugcaaucauuu

SEQ ID NO: 463993 - RNA, 15 nt, Chlamydia trachomatis
uuugauuucugcaga

SEQ ID NO: 463994 - RNA, 15 nt, Chlamydia trachomatis
uuugaucuucuggaa

SEQ ID NO: 463995 - RNA, 18 nt, Chlamydia trachomatis
uuugauaucccccuucug

SEQ ID NO: 463996 - RNA, 17 nt, Chlamydia trachomatis
uuugaucuuuccagcag

SEQ ID NO: 463997 - RNA, 16 nt, Chlamydia trachomatis
uuugaugccacugacu

SEQ ID NO: 463998 - RNA, 19 nt, Chlamydia trachomatis
uuugaugccacugacucuc

SEQ ID NO: 463999 - RNA, 22 nt, Chlamydia trachomatis
uuugaguaggacucuaagagaa

SEQ ID NO: 464000 - RNA, 18 nt, Chlamydia trachomatis
uuugauaacgcuguuccu

SEQ ID NO: 464001 - RNA, 16 nt, Chlamydia trachomatis
uuugauagauuugccu

SEQ ID NO: 464002 - RNA, 12 nt, Chlamydia trachomatis
uuugauagcuuc

SEQ ID NO: 464003 - RNA, 19 nt, Chlamydia trachomatis
uuugcauucuuuuaagaau

SEQ ID NO: 464004 - RNA, 18 nt, Chlamydia trachomatis
uuugcauuuccauagaaa

SEQ ID NO: 464005 - RNA, 19 nt, Chlamydia trachomatis
uuuguaguuagacaaaaaa

SEQ ID NO: 464006 - RNA, 12 nt, Chlamydia trachomatis
uuugguuucuuc

SEQ ID NO: 464007 - RNA, 22 nt, Chlamydia trachomatis
uuugucccgugcuugcuuucuu

SEQ ID NO: 464008 - RNA, 17 nt, Chlamydia trachomatis
uuuguccuggccaaaaa

SEQ ID NO: 464009 - RNA, 21 nt, Chlamydia trachomatis
uuugcuggguuuuaucaagag

SEQ ID NO: 464010 - RNA, 15 nt, Chlamydia trachomatis
uuuggcguauuucuu

SEQ ID NO: 464011 - RNA, 17 nt, Chlamydia trachomatis
uuuggcguauuucuugu

SEQ ID NO: 464012 - RNA, 21 nt, Chlamydia trachomatis
uuuggcucuuuaauauuuccc

SEQ ID NO: 464013 - RNA, 14 nt, Chlamydia trachomatis
uuugggcauuccua

SEQ ID NO: 464014 - RNA, 19 nt, Chlamydia trachomatis
uuugguaagaucucuacau

SEQ ID NO: 464015 - RNA, 20 nt, Chlamydia trachomatis
uuuuaccguuccaucuucca

SEQ ID NO: 464016 - RNA, 22 nt, Chlamydia trachomatis
uuuuaagaccuaguaagugcau

SEQ ID NO: 464017 - RNA, 15 nt, Chlamydia trachomatis
uuuuaauaagaccuc

SEQ ID NO: 464018 - RNA, 19 nt, Chlamydia trachomatis
uuuguuagcggaacaagca

SEQ ID NO: 464019 - RNA, 23 nt, Chlamydia trachomatis
uuuguuccauguauucuccuuuu

SEQ ID NO: 464020 - RNA, 22 nt, Chlamydia trachomatis
uuuguuccuacuaaaaugacua

SEQ ID NO: 464021 - RNA, 13 nt, Chlamydia trachomatis
uuuguucguaaug

SEQ ID NO: 464022 - RNA, 23 nt, Chlamydia trachomatis
uuuguucucuaaagauucuguaa

SEQ ID NO: 464023 - RNA, 21 nt, Chlamydia trachomatis
uuuguuguccacaugccaucg

SEQ ID NO: 464024 - RNA, 14 nt, Chlamydia trachomatis
uuuguuuccucucu

SEQ ID NO: 464025 - RNA, 13 nt, Chlamydia trachomatis
uuuguuucuacuu

SEQ ID NO: 464026 - RNA, 13 nt, Chlamydia trachomatis
uuuuaaaaggcuu

SEQ ID NO: 464027 - RNA, 14 nt, Chlamydia trachomatis
uuuuaaaaucuccu

SEQ ID NO: 464028 - RNA, 20 nt, Chlamydia trachomatis
uuuuaaagggggacaaaaau

SEQ ID NO: 464029 - RNA, 12 nt, Chlamydia trachomatis
uuuuagcaucug

SEQ ID NO: 464030 - RNA, 19 nt, Chlamydia trachomatis
uuuuagcaaauaauagcuu

SEQ ID NO: 464031 - RNA, 15 nt, Chlamydia trachomatis
uuuuagagaaaagaa

SEQ ID NO: 464032 - RNA, 16 nt, Chlamydia trachomatis
uuuuagaaugguucuu

SEQ ID NO: 464033 - RNA, 16 nt, Chlamydia trachomatis
uuuuacgcucuuucuu

SEQ ID NO: 464034 - RNA, 19 nt, Chlamydia trachomatis
uuuuagcguaauagcucug

SEQ ID NO: 464035 - RNA, 14 nt, Chlamydia trachomatis
uuuuaggcaacagc

SEQ ID NO: 464036 - RNA, 15 nt, Chlamydia trachomatis
uuuuaggcguuccug

SEQ ID NO: 464037 - RNA, 20 nt, Chlamydia trachomatis
uuuuaggcguuccugcauac

SEQ ID NO: 464038 - RNA, 15 nt, Chlamydia trachomatis
uuuuauccaaaaaag

SEQ ID NO: 464039 - RNA, 13 nt, Chlamydia trachomatis
uuuuaucuaaaaa

SEQ ID NO: 464040 - RNA, 19 nt, Chlamydia trachomatis
uuuuaugggugaagaagga

SEQ ID NO: 464041 - RNA, 17 nt, Chlamydia trachomatis
uuuuauguaaauauuuu

SEQ ID NO: 464042 - RNA, 13 nt, Chlamydia trachomatis
uuuuauucaccca

SEQ ID NO: 464043 - RNA, 15 nt, Chlamydia trachomatis
uuuuauucacccaaa

SEQ ID NO: 464044 - RNA, 14 nt, Chlamydia trachomatis
uuuuccacaaauau

SEQ ID NO: 464045 - RNA, 18 nt, Chlamydia trachomatis
uuuuccaagaaaaauaca

SEQ ID NO: 464046 - RNA, 17 nt, Chlamydia trachomatis
uuuucccaucuacaaaa

SEQ ID NO: 464047 - RNA, 19 nt, Chlamydia trachomatis
uuuucccaucuacaaaacc

SEQ ID NO: 464048 - RNA, 14 nt, Chlamydia trachomatis
uuuucccuagaaaa

SEQ ID NO: 464049 - RNA, 17 nt, Chlamydia trachomatis
uuuuccgaauaaaauca

SEQ ID NO: 464050 - RNA, 23 nt, Chlamydia trachomatis
uuuuccgaauuaaaucugcuccu

SEQ ID NO: 464051 - RNA, 15 nt, Chlamydia trachomatis
uuuuccgaauucuuu

SEQ ID NO: 464052 - RNA, 20 nt, Chlamydia trachomatis
uuuuccgcacccaaucuucu

SEQ ID NO: 464053 - RNA, 18 nt, Chlamydia trachomatis
uuuuccuaaacaaaaacu

SEQ ID NO: 464054 - RNA, 23 nt, Chlamydia trachomatis
uuuuccugaaacgaucagcuccu

SEQ ID NO: 464055 - RNA, 17 nt, Chlamydia trachomatis
uuuucguagacagagaa

SEQ ID NO: 464056 - RNA, 20 nt, Chlamydia trachomatis
uuuucguaagcauagcuucu

SEQ ID NO: 464057 - RNA, 22 nt, Chlamydia trachomatis
uuuucguaagcauagcuucuug

SEQ ID NO: 464058 - RNA, 15 nt, Chlamydia trachomatis
uuuucggagaagaag

SEQ ID NO: 464059 - RNA, 12 nt, Chlamydia trachomatis
uuuucgcuuuug

SEQ ID NO: 464060 - RNA, 22 nt, Chlamydia trachomatis
uuuucggaaggcgaauucuuug

SEQ ID NO: 464061 - RNA, 20 nt, Chlamydia trachomatis
uuuucgcuauccccaucucu

SEQ ID NO: 464062 - RNA, 21 nt, Chlamydia trachomatis
uuuucgcuaucuucaauccac

SEQ ID NO: 464063 - RNA, 13 nt, Chlamydia trachomatis
uuuucaaaaauaa

SEQ ID NO: 464064 - RNA, 13 nt, Chlamydia trachomatis
uuuucaaaaauag

SEQ ID NO: 464065 - RNA, 17 nt, Chlamydia trachomatis
uuuucaaaaccuugaug

SEQ ID NO: 464066 - RNA, 18 nt, Chlamydia trachomatis
uuuucaauagcaaugaag

SEQ ID NO: 464067 - RNA, 23 nt, Chlamydia trachomatis
uuuucaccagcaaaagaaaaauc

SEQ ID NO: 464068 - RNA, 20 nt, Chlamydia trachomatis
uuuucagacaaaaagccuaa

SEQ ID NO: 464069 - RNA, 14 nt, Chlamydia trachomatis
uuuucagcuuuucu

SEQ ID NO: 464070 - RNA, 18 nt, Chlamydia trachomatis
uuuucaggagaaaggcuu

SEQ ID NO: 464071 - RNA, 16 nt, Chlamydia trachomatis
uuuucagggauagaaa

SEQ ID NO: 464072 - RNA, 13 nt, Chlamydia trachomatis
uuuucaguuucaa

SEQ ID NO: 464073 - RNA, 15 nt, Chlamydia trachomatis
uuuucauaaagagag

SEQ ID NO: 464074 - RNA, 14 nt, Chlamydia trachomatis
uuuucauauaguuu

SEQ ID NO: 464075 - RNA, 23 nt, Chlamydia trachomatis
uuuucauccuaggggauuuuaug

SEQ ID NO: 464076 - RNA, 22 nt, Chlamydia trachomatis
uuuuuccuacgcgaaucacaug

SEQ ID NO: 464077 - RNA, 13 nt, Chlamydia trachomatis
uuuuucagaaaaa

SEQ ID NO: 464078 - RNA, 14 nt, Chlamydia trachomatis
uuuuucagcaauaa

SEQ ID NO: 464079 - RNA, 22 nt, Chlamydia trachomatis
uuuuuacgcauuugcucuucca

SEQ ID NO: 464080 - RNA, 16 nt, Chlamydia trachomatis
uuuuuacgcucuuucu

SEQ ID NO: 464081 - RNA, 19 nt, Chlamydia trachomatis
uuuuuaguaccauaacauc

SEQ ID NO: 464082 - RNA, 18 nt, Chlamydia trachomatis
uuuuuaauaauaaagaua

SEQ ID NO: 464083 - RNA, 19 nt, Chlamydia trachomatis
uuuuuaauaauaaagauag

SEQ ID NO: 464084 - RNA, 18 nt, Chlamydia trachomatis
uuuugguguggaguaucu

SEQ ID NO: 464085 - RNA, 15 nt, Chlamydia trachomatis
uuuuguguaauagcu

SEQ ID NO: 464086 - RNA, 22 nt, Chlamydia trachomatis
uuuuguguuuccaaagcuuuaa

SEQ ID NO: 464087 - RNA, 14 nt, Chlamydia trachomatis
uuuucuauuucaga

SEQ ID NO: 464088 - RNA, 12 nt, Chlamydia trachomatis
uuuucuaaaauc

SEQ ID NO: 464089 - RNA, 18 nt, Chlamydia trachomatis
uuuucuaacguuccuccu

SEQ ID NO: 464090 - RNA, 20 nt, Chlamydia trachomatis
uuuucuacaacuaucagaag

SEQ ID NO: 464091 - RNA, 21 nt, Chlamydia trachomatis
uuuucuacaacuaucagaaga

SEQ ID NO: 464092 - RNA, 12 nt, Chlamydia trachomatis
uuuucugcucca

SEQ ID NO: 464093 - RNA, 15 nt, Chlamydia trachomatis
uuuucugcuccaaag

SEQ ID NO: 464094 - RNA, 12 nt, Chlamydia trachomatis
uuuucugagacu

SEQ ID NO: 464095 - RNA, 11 nt, Chlamydia trachomatis
uuuucucuuga

SEQ ID NO: 464096 - RNA, 15 nt, Chlamydia trachomatis
uuuucucuaauaguu

SEQ ID NO: 464097 - RNA, 12 nt, Chlamydia trachomatis
uuuucucucuag

SEQ ID NO: 464098 - RNA, 13 nt, Chlamydia trachomatis
uuuucucucuagc

SEQ ID NO: 464099 - RNA, 15 nt, Chlamydia trachomatis
uuuucuucuuuuucu

SEQ ID NO: 464100 - RNA, 22 nt, Chlamydia trachomatis
uuuucuucuuuuuuacauaauc

SEQ ID NO: 464101 - RNA, 14 nt, Chlamydia trachomatis
uuuucuucucuagc

SEQ ID NO: 464102 - RNA, 15 nt, Chlamydia trachomatis
uuuucuuucaaagag

SEQ ID NO: 464103 - RNA, 19 nt, Chlamydia trachomatis
uuuucuuucaaagagaucu

SEQ ID NO: 464104 - RNA, 15 nt, Chlamydia trachomatis
uuuugaaauuccguu

SEQ ID NO: 464105 - RNA, 16 nt, Chlamydia trachomatis
uuuugaagauaaaacu

SEQ ID NO: 464106 - RNA, 12 nt, Chlamydia trachomatis
uuuugaauacga

SEQ ID NO: 464107 - RNA, 15 nt, Chlamydia trachomatis
uuuugaucccuaaua

SEQ ID NO: 464108 - RNA, 18 nt, Chlamydia trachomatis
uuuugaucuuuccagcag

SEQ ID NO: 464109 - RNA, 23 nt, Chlamydia trachomatis
uuuugaugaggcuuguugccaac

SEQ ID NO: 464110 - RNA, 13 nt, Chlamydia trachomatis
uuuugauuauaaa

SEQ ID NO: 464111 - RNA, 14 nt, Chlamydia trachomatis
uuuugauuuuucuu

SEQ ID NO: 464112 - RNA, 14 nt, Chlamydia trachomatis
uuuugcacaaaaaa

SEQ ID NO: 464113 - RNA, 18 nt, Chlamydia trachomatis
uuuugcagccuuucccuu

SEQ ID NO: 464114 - RNA, 22 nt, Chlamydia trachomatis
uuuuggaagaucucuuucucua

SEQ ID NO: 464115 - RNA, 19 nt, Chlamydia trachomatis
aaauucauaacaccugcau

SEQ ID NO: 464116 - RNA, 16 nt, Chlamydia trachomatis
aaauucuaaaguaaga

SEQ ID NO: 464117 - RNA, 17 nt, Chlamydia trachomatis
aaauucgaggcuucuuc

SEQ ID NO: 464118 - RNA, 12 nt, Chlamydia trachomatis
aaauuacaauaa

SEQ ID NO: 464119 - RNA, 21 nt, Chlamydia trachomatis
aaauuacaauaauacaaagca

SEQ ID NO: 464120 - RNA, 13 nt, Chlamydia trachomatis
uuuuuucugcaau

SEQ ID NO: 464121 - RNA, 21 nt, Chlamydia trachomatis
uuuuuuguuuccauuaaacua

SEQ ID NO: 464122 - RNA, 11 nt, Chlamydia trachomatis
uuuuuuuauuc

SEQ ID NO: 464123 - RNA, 10 nt, Chlamydia trachomatis
uuuuuuucag

SEQ ID NO: 464124 - RNA, 19 nt, Chlamydia trachomatis
uuuuuuugugcaaaaagca

SEQ ID NO: 464125 - RNA, 16 nt, Chlamydia trachomatis
aaauuagggaaaaacu

SEQ ID NO: 464126 - RNA, 22 nt, Chlamydia trachomatis
aaauuagggaaaaacuuuucuu

SEQ ID NO: 464127 - RNA, 20 nt, Chlamydia trachomatis
aaauuaguaauaaaggaaac

SEQ ID NO: 464128 - RNA, 14 nt, Chlamydia trachomatis
uuuuuggauguacu

SEQ ID NO: 464129 - RNA, 15 nt, Chlamydia trachomatis
uuuuuguuauccaaa

SEQ ID NO: 464130 - RNA, 16 nt, Chlamydia trachomatis
uuuuuguuuuuuucaa

SEQ ID NO: 464131 - RNA, 22 nt, Chlamydia trachomatis
uuuuucgauagaaaaaaacagc

SEQ ID NO: 464132 - RNA, 19 nt, Chlamydia trachomatis
uuuuucguuuugaagaaga

SEQ ID NO: 464133 - RNA, 15 nt, Chlamydia trachomatis
uuuuucuguaauaag

SEQ ID NO: 464134 - RNA, 12 nt, Chlamydia trachomatis
uuuuucuucucu

SEQ ID NO: 464135 - RNA, 18 nt, Chlamydia trachomatis
uuuuucuucucuagcaug

SEQ ID NO: 464136 - RNA, 12 nt, Chlamydia trachomatis
uuuuucuucuuu

SEQ ID NO: 464137 - RNA, 15 nt, Chlamydia trachomatis
uuuuugacauucugc

SEQ ID NO: 464138 - RNA, 13 nt, Chlamydia trachomatis
aaauguuccucgu

SEQ ID NO: 464139 - RNA, 12 nt, Chlamydia trachomatis
aaauguuuuuga

SEQ ID NO: 464140 - RNA, 13 nt, Chlamydia trachomatis
aaauuaaaaggcg

SEQ ID NO: 464141 - RNA, 12 nt, Chlamydia trachomatis
aaauuaacaauc

SEQ ID NO: 464142 - RNA, 13 nt, Chlamydia trachomatis
aaauuaauguaau

SEQ ID NO: 464143 - RNA, 15 nt, Chlamydia trachomatis
aagaauuaacccaaa

SEQ ID NO: 464144 - RNA, 17 nt, Chlamydia trachomatis
aagaaucuaaaaagcca

SEQ ID NO: 464145 - RNA, 22 nt, Chlamydia trachomatis
aagaaugaaacuuggucagcuc

SEQ ID NO: 464146 - RNA, 15 nt, Chlamydia trachomatis
aagaaugaccaguuu

SEQ ID NO: 464147 - RNA, 17 nt, Chlamydia trachomatis
aagaaugcgguaauaga

SEQ ID NO: 464148 - RNA, 21 nt, Chlamydia trachomatis
aagaauagggagguuuuguuc

SEQ ID NO: 464149 - RNA, 23 nt, Chlamydia trachomatis
aagaauaucaucuucaagagcug

SEQ ID NO: 464150 - RNA, 12 nt, Chlamydia trachomatis
aagaaucaaaaa

SEQ ID NO: 464151 - RNA, 20 nt, Chlamydia trachomatis
aagaaucaaaggaugucuau

SEQ ID NO: 464152 - RNA, 19 nt, Chlamydia trachomatis
aagaaucauagaaacgagg

SEQ ID NO: 464153 - RNA, 23 nt, Chlamydia trachomatis
aaauucuucugauaaaugucccu

SEQ ID NO: 464154 - RNA, 15 nt, Chlamydia trachomatis
aaauucuucaucuau

SEQ ID NO: 464155 - RNA, 22 nt, Chlamydia trachomatis
aagaaguuuuuugucuuuagca

SEQ ID NO: 464156 - RNA, 15 nt, Chlamydia trachomatis
aagaauaaaacauuu

SEQ ID NO: 464157 - RNA, 16 nt, Chlamydia trachomatis
aagaauaaaacauuuu

SEQ ID NO: 464158 - RNA, 14 nt, Chlamydia trachomatis
aagaauaaacaaca

SEQ ID NO: 464159 - RNA, 15 nt, Chlamydia trachomatis
aagaauaaagaugaa

SEQ ID NO: 464160 - RNA, 15 nt, Chlamydia trachomatis
aagaauacaagaaag

SEQ ID NO: 464161 - RNA, 23 nt, Chlamydia trachomatis
aagacacuaucacuguugagaaa

SEQ ID NO: 464162 - RNA, 22 nt, Chlamydia trachomatis
aagaauugaaguaugcucgagc

SEQ ID NO: 464163 - RNA, 20 nt, Chlamydia trachomatis
aagaccaaaaaugaacauau

SEQ ID NO: 464164 - RNA, 15 nt, Chlamydia trachomatis
aagacccguuuucuc

SEQ ID NO: 464165 - RNA, 23 nt, Chlamydia trachomatis
aagacgaacgcuagaaacagccu

SEQ ID NO: 464166 - RNA, 19 nt, Chlamydia trachomatis
aagacgauucucaugcacu

SEQ ID NO: 464167 - RNA, 22 nt, Chlamydia trachomatis
aagacucacagcaaauaaagag

SEQ ID NO: 464168 - RNA, 23 nt, Chlamydia trachomatis
aagacucacagcaaauaaagagg

SEQ ID NO: 464169 - RNA, 12 nt, Chlamydia trachomatis
aagacucuuuca

SEQ ID NO: 464170 - RNA, 17 nt, Chlamydia trachomatis
aagagaucguacaauga

SEQ ID NO: 464171 - RNA, 12 nt, Chlamydia trachomatis
aagagauguuug

SEQ ID NO: 464172 - RNA, 17 nt, Chlamydia trachomatis
aagagauuuuuugagca

SEQ ID NO: 464173 - RNA, 19 nt, Chlamydia trachomatis
aagagaccgagccuccgcu

SEQ ID NO: 464174 - RNA, 16 nt, Chlamydia trachomatis
aagagagcaacgagca

SEQ ID NO: 464175 - RNA, 21 nt, Chlamydia trachomatis
aagagaggccuccauuuccau

SEQ ID NO: 464176 - RNA, 23 nt, Chlamydia trachomatis
aagacuuucucuaacaaugacuc

SEQ ID NO: 464177 - RNA, 17 nt, Chlamydia trachomatis
aagacuuugugcaaccu

SEQ ID NO: 464178 - RNA, 12 nt, Chlamydia trachomatis
aagagaaaaauu

SEQ ID NO: 464179 - RNA, 16 nt, Chlamydia trachomatis
aagagaaggccuuuuu

SEQ ID NO: 464180 - RNA, 20 nt, Chlamydia trachomatis
aagagaaucaucggcuugcc

SEQ ID NO: 464181 - RNA, 18 nt, Chlamydia trachomatis
aagagcugcugucagaag

SEQ ID NO: 464182 - RNA, 24 nt, Chlamydia trachomatis
aagagccaaaauauacucagagau

SEQ ID NO: 464183 - RNA, 20 nt, Chlamydia trachomatis
aagagcagcuauuucuuuuu

SEQ ID NO: 464184 - RNA, 13 nt, Chlamydia trachomatis
aagagcuuuucuu

SEQ ID NO: 464185 - RNA, 23 nt, Chlamydia trachomatis
aagaggacuuucuuuaagcaaca

SEQ ID NO: 464186 - RNA, 17 nt, Chlamydia trachomatis
aagaggcaccucuuuuu

SEQ ID NO: 464187 - RNA, 20 nt, Chlamydia trachomatis
aagaggcuucgauaagaaaa

SEQ ID NO: 464188 - RNA, 14 nt, Chlamydia trachomatis
aagagguauguuug

SEQ ID NO: 464189 - RNA, 16 nt, Chlamydia trachomatis
aagaguagggagcaaa

SEQ ID NO: 464190 - RNA, 14 nt, Chlamydia trachomatis
aagagucuucauca

SEQ ID NO: 464191 - RNA, 14 nt, Chlamydia trachomatis
aagagugugcuucu

SEQ ID NO: 464192 - RNA, 14 nt, Chlamydia trachomatis
aagauaacaauccu

SEQ ID NO: 464193 - RNA, 15 nt, Chlamydia trachomatis
aagauaagcagcaau

SEQ ID NO: 464194 - RNA, 21 nt, Chlamydia trachomatis
aagaucgguucauaaaauuuc

SEQ ID NO: 464195 - RNA, 23 nt, Chlamydia trachomatis
aagaucucuacauaagucucuug

SEQ ID NO: 464196 - RNA, 13 nt, Chlamydia trachomatis
aagaucucuuucu

SEQ ID NO: 464197 - RNA, 18 nt, Chlamydia trachomatis
aagaucucuuucucuaga

SEQ ID NO: 464198 - RNA, 13 nt, Chlamydia trachomatis
aagaucuucaaca

SEQ ID NO: 464199 - RNA, 18 nt, Chlamydia trachomatis
aagaucuucagaaaucuu

SEQ ID NO: 464200 - RNA, 12 nt, Chlamydia trachomatis
aagaucuuuacu

SEQ ID NO: 464201 - RNA, 15 nt, Chlamydia trachomatis
aagaucuuuacuuuc

SEQ ID NO: 464202 - RNA, 20 nt, Chlamydia trachomatis
aagaucuuuacuuucuuugc

SEQ ID NO: 464203 - RNA, 15 nt, Chlamydia trachomatis
aagaucaugggaaau

SEQ ID NO: 464204 - RNA, 18 nt, Chlamydia trachomatis
aagaucaaggauccagga

SEQ ID NO: 464205 - RNA, 22 nt, Chlamydia trachomatis
aagauaauggcaaaaauaccaa

SEQ ID NO: 464206 - RNA, 19 nt, Chlamydia trachomatis
aagauacaaggcuccuuuu

SEQ ID NO: 464207 - RNA, 17 nt, Chlamydia trachomatis
aagauagauaggcagga

SEQ ID NO: 464208 - RNA, 22 nt, Chlamydia trachomatis
aagauagauaggcaggaagaga

SEQ ID NO: 464209 - RNA, 12 nt, Chlamydia trachomatis
aagauaggagca

SEQ ID NO: 464210 - RNA, 14 nt, Chlamydia trachomatis
aagauaguagagaa

SEQ ID NO: 464211 - RNA, 15 nt, Chlamydia trachomatis
aagauauaaacaaua

SEQ ID NO: 464212 - RNA, 15 nt, Chlamydia trachomatis
aagauauagguucca

SEQ ID NO: 464213 - RNA, 13 nt, Chlamydia trachomatis
aagauauccauag

SEQ ID NO: 464214 - RNA, 14 nt, Chlamydia trachomatis
aagauugaugacaa

SEQ ID NO: 464215 - RNA, 18 nt, Chlamydia trachomatis
aagauugaugacaacuac

SEQ ID NO: 464216 - RNA, 22 nt, Chlamydia trachomatis
aagauuccucuugaaccaguuu

SEQ ID NO: 464217 - RNA, 17 nt, Chlamydia trachomatis
aagauucgcugcugucu

SEQ ID NO: 464218 - RNA, 21 nt, Chlamydia trachomatis
aagauuauaccagcagaccca

SEQ ID NO: 464219 - RNA, 16 nt, Chlamydia trachomatis
aagauuaucacauucu

SEQ ID NO: 464220 - RNA, 15 nt, Chlamydia trachomatis
aagauuuccccuuuu

SEQ ID NO: 464221 - RNA, 20 nt, Chlamydia trachomatis
aagauuuucaacgggaacaa

SEQ ID NO: 464222 - RNA, 21 nt, Chlamydia trachomatis
aagauuuuuagaaggaaagcu

SEQ ID NO: 464223 - RNA, 21 nt, Chlamydia trachomatis
aagauggacuggaguuagccg

SEQ ID NO: 464224 - RNA, 18 nt, Chlamydia trachomatis
aagaugggcauaacgagu

SEQ ID NO: 464225 - RNA, 18 nt, Chlamydia trachomatis
aagaugcuccuacaaaau

SEQ ID NO: 464226 - RNA, 17 nt, Chlamydia trachomatis
aagaugaauccaccgua

SEQ ID NO: 464227 - RNA, 12 nt, Chlamydia trachomatis
aagaugaagaag

SEQ ID NO: 464228 - RNA, 17 nt, Chlamydia trachomatis
aagcaagaaucaaagga

SEQ ID NO: 464229 - RNA, 22 nt, Chlamydia trachomatis
aagcaaguuccucaaaagaacu

SEQ ID NO: 464230 - RNA, 19 nt, Chlamydia trachomatis
aagcaauacgauugguuua

SEQ ID NO: 464231 - RNA, 20 nt, Chlamydia trachomatis
aagcaauagcgcaaaaggcu

SEQ ID NO: 464232 - RNA, 18 nt, Chlamydia trachomatis
aagcaauauaacuagaag

SEQ ID NO: 464233 - RNA, 13 nt, Chlamydia trachomatis
aagcaauccgcuu

SEQ ID NO: 464234 - RNA, 19 nt, Chlamydia trachomatis
aagcaaauagauaacuuug

SEQ ID NO: 464235 - RNA, 18 nt, Chlamydia trachomatis
aagcaaaucccugugcua

SEQ ID NO: 464236 - RNA, 19 nt, Chlamydia trachomatis
aagauuuuucagccugucu

SEQ ID NO: 464237 - RNA, 14 nt, Chlamydia trachomatis
aagcacaauaacag

SEQ ID NO: 464238 - RNA, 22 nt, Chlamydia trachomatis
aagcacaauaacagcacaaaca

SEQ ID NO: 464239 - RNA, 17 nt, Chlamydia trachomatis
aagcacgauaaaagaca

SEQ ID NO: 464240 - RNA, 15 nt, Chlamydia trachomatis
aagcacguuuaacuu

SEQ ID NO: 464241 - RNA, 19 nt, Chlamydia trachomatis
aagcacuauaucuccaaca

SEQ ID NO: 464242 - RNA, 16 nt, Chlamydia trachomatis
aagcacuccucagcau

SEQ ID NO: 464243 - RNA, 17 nt, Chlamydia trachomatis
aagcacuccucagcaua

SEQ ID NO: 464244 - RNA, 16 nt, Chlamydia trachomatis
aagcacuggauccuaa

SEQ ID NO: 464245 - RNA, 23 nt, Chlamydia trachomatis
aagcacuguccacauuauucaca

SEQ ID NO: 464246 - RNA, 19 nt, Chlamydia trachomatis
aagcaucuuuaccauuucc

SEQ ID NO: 464247 - RNA, 21 nt, Chlamydia trachomatis
aagcaucuuuaccauuuccac

SEQ ID NO: 464248 - RNA, 18 nt, Chlamydia trachomatis
aagcauagggcuaagaau

SEQ ID NO: 464249 - RNA, 19 nt, Chlamydia trachomatis
aagcaugcaauccuucuug

SEQ ID NO: 464250 - RNA, 12 nt, Chlamydia trachomatis
aagcauucguua

SEQ ID NO: 464251 - RNA, 15 nt, Chlamydia trachomatis
aagcauuucucucca

SEQ ID NO: 464252 - RNA, 14 nt, Chlamydia trachomatis
aagcagcagaaggu

SEQ ID NO: 464253 - RNA, 18 nt, Chlamydia trachomatis
aagcagaaacaauuucau

SEQ ID NO: 464254 - RNA, 14 nt, Chlamydia trachomatis
aagcagaaacagcu

SEQ ID NO: 464255 - RNA, 16 nt, Chlamydia trachomatis
aagcagaaagaaugcu

SEQ ID NO: 464256 - RNA, 14 nt, Chlamydia trachomatis
aagcagacaagcaa

SEQ ID NO: 464257 - RNA, 14 nt, Chlamydia trachomatis
aagcagcggcaaug

SEQ ID NO: 464258 - RNA, 11 nt, Chlamydia trachomatis
aagcuccaaag

SEQ ID NO: 464259 - RNA, 14 nt, Chlamydia trachomatis
aagcuccaaagaac

SEQ ID NO: 464260 - RNA, 21 nt, Chlamydia trachomatis
aagcuccacaggugaauucuc

SEQ ID NO: 464261 - RNA, 18 nt, Chlamydia trachomatis
aagcucggucucauuaua

SEQ ID NO: 464262 - RNA, 13 nt, Chlamydia trachomatis
aagcucgucuuua

SEQ ID NO: 464263 - RNA, 20 nt, Chlamydia trachomatis
aagcucuucgagucuucccu

SEQ ID NO: 464264 - RNA, 19 nt, Chlamydia trachomatis
aagcuaauagcuugaagaa

SEQ ID NO: 464265 - RNA, 21 nt, Chlamydia trachomatis
aagcuacugaugacuuucggc

SEQ ID NO: 464266 - RNA, 20 nt, Chlamydia trachomatis
aagcuagaaaauagcaucuc

SEQ ID NO: 464267 - RNA, 13 nt, Chlamydia trachomatis
aagcuagaagaau

SEQ ID NO: 464268 - RNA, 16 nt, Chlamydia trachomatis
aagcuagguaaagguu

SEQ ID NO: 464269 - RNA, 18 nt, Chlamydia trachomatis
aagcuaucaucgcacagc

SEQ ID NO: 464270 - RNA, 14 nt, Chlamydia trachomatis
aagcuaucccaaaa

SEQ ID NO: 464271 - RNA, 15 nt, Chlamydia trachomatis
aagcuguucuuccau

SEQ ID NO: 464272 - RNA, 22 nt, Chlamydia trachomatis
aagcuugucuccuucuuugaca

SEQ ID NO: 464273 - RNA, 19 nt, Chlamydia trachomatis
aaggaaucuguccaaagag

SEQ ID NO: 464274 - RNA, 19 nt, Chlamydia trachomatis
aaggaauaaacagguaaaa

SEQ ID NO: 464275 - RNA, 16 nt, Chlamydia trachomatis
aaggaagggagcuuag

SEQ ID NO: 464276 - RNA, 15 nt, Chlamydia trachomatis
aaggaaguagagaau

SEQ ID NO: 464277 - RNA, 15 nt, Chlamydia trachomatis
aagcuuuuuccaaag

SEQ ID NO: 464278 - RNA, 23 nt, Chlamydia trachomatis
aaggaagaggagggagaauuaau

SEQ ID NO: 464279 - RNA, 15 nt, Chlamydia trachomatis
aaggaagaucaagga

SEQ ID NO: 464280 - RNA, 23 nt, Chlamydia trachomatis
aaggaagaugggcauaacgagug

SEQ ID NO: 464281 - RNA, 19 nt, Chlamydia trachomatis
aaggagcuaagaaccacaa

SEQ ID NO: 464282 - RNA, 20 nt, Chlamydia trachomatis
aaggagugugaucgagaacg

SEQ ID NO: 464283 - RNA, 15 nt, Chlamydia trachomatis
aaggauaaauauuuu

SEQ ID NO: 464284 - RNA, 14 nt, Chlamydia trachomatis
aaggauaaggaaga

SEQ ID NO: 464285 - RNA, 15 nt, Chlamydia trachomatis
aaggcaacucucucu

SEQ ID NO: 464286 - RNA, 22 nt, Chlamydia trachomatis
aaggcaggaaaaggcaucaaca

SEQ ID NO: 464287 - RNA, 20 nt, Chlamydia trachomatis
aaggcauaaaagagaagaac

SEQ ID NO: 464288 - RNA, 16 nt, Chlamydia trachomatis
aaggcaucaacagccu

SEQ ID NO: 464289 - RNA, 21 nt, Chlamydia trachomatis
aaggccuauccaaggaaacca

SEQ ID NO: 464290 - RNA, 20 nt, Chlamydia trachomatis
aaggcgaguucgggaauaau

SEQ ID NO: 464291 - RNA, 19 nt, Chlamydia trachomatis
aaggcuuauucucuuuaua

SEQ ID NO: 464292 - RNA, 14 nt, Chlamydia trachomatis
aaggucugaacaac

SEQ ID NO: 464293 - RNA, 20 nt, Chlamydia trachomatis
aagguaaucuguagagagcc

SEQ ID NO: 464294 - RNA, 20 nt, Chlamydia trachomatis
aagguguguacgcuuuggua

SEQ ID NO: 464295 - RNA, 19 nt, Chlamydia trachomatis
aagguucgaaaucaugaau

SEQ ID NO: 464296 - RNA, 14 nt, Chlamydia trachomatis
aagguugaacuaga

SEQ ID NO: 464297 - RNA, 16 nt, Chlamydia trachomatis
aagguuucuggaaaau

SEQ ID NO: 464298 - RNA, 19 nt, Chlamydia trachomatis
aaguuucugaaaagucgcc

SEQ ID NO: 464299 - RNA, 20 nt, Chlamydia trachomatis
aaguuagcauguucagaauc

SEQ ID NO: 464300 - RNA, 19 nt, Chlamydia trachomatis
aaguuccuuagcuaaaagc

SEQ ID NO: 464301 - RNA, 18 nt, Chlamydia trachomatis
aaguucuuuuuccucuuc

SEQ ID NO: 464302 - RNA, 21 nt, Chlamydia trachomatis
aaguucuuuuuccucuucaga

SEQ ID NO: 464303 - RNA, 18 nt, Chlamydia trachomatis
aaguucuuuuuguugcuc

SEQ ID NO: 464304 - RNA, 16 nt, Chlamydia trachomatis
aaguuggucgcagaau

SEQ ID NO: 464305 - RNA, 13 nt, Chlamydia trachomatis
aauaaaaagccca

SEQ ID NO: 464306 - RNA, 20 nt, Chlamydia trachomatis
aauaaaagcuccuaaagaag

SEQ ID NO: 464307 - RNA, 18 nt, Chlamydia trachomatis
aauaaaagcugguuuuuu

SEQ ID NO: 464308 - RNA, 18 nt, Chlamydia trachomatis
aauaaaauggaaauaaaa

SEQ ID NO: 464309 - RNA, 12 nt, Chlamydia trachomatis
aauaaacaacau

SEQ ID NO: 464310 - RNA, 20 nt, Chlamydia trachomatis
aauaaacagaucuuuuucau

SEQ ID NO: 464311 - RNA, 19 nt, Chlamydia trachomatis
aauaaacccuggaugcaca

SEQ ID NO: 464312 - RNA, 18 nt, Chlamydia trachomatis
aagucuuuuacuuugaaa

SEQ ID NO: 464313 - RNA, 20 nt, Chlamydia trachomatis
aagugcaucauuuuguauaa

SEQ ID NO: 464314 - RNA, 16 nt, Chlamydia trachomatis
aaguccggacuuuccu

SEQ ID NO: 464315 - RNA, 21 nt, Chlamydia trachomatis
aagucguacagaucuugaucu

SEQ ID NO: 464316 - RNA, 14 nt, Chlamydia trachomatis
aagucgugucuuua

SEQ ID NO: 464317 - RNA, 21 nt, Chlamydia trachomatis
aagucuaccguauuaucugca

SEQ ID NO: 464318 - RNA, 22 nt, Chlamydia trachomatis
aagucuccacugguucucuuua

SEQ ID NO: 464319 - RNA, 15 nt, Chlamydia trachomatis
aagucagaugaguuu

SEQ ID NO: 464320 - RNA, 19 nt, Chlamydia trachomatis
aaguccaucuaaagggaga

SEQ ID NO: 464321 - RNA, 16 nt, Chlamydia trachomatis
aaguaacuacggaaaa

SEQ ID NO: 464322 - RNA, 18 nt, Chlamydia trachomatis
aaguaucguaaacaaaag

SEQ ID NO: 464323 - RNA, 21 nt, Chlamydia trachomatis
aagucacuacuucaucgagaa

SEQ ID NO: 464324 - RNA, 22 nt, Chlamydia trachomatis
aaucaguggaacugcuucccuc

SEQ ID NO: 464325 - RNA, 17 nt, Chlamydia trachomatis
aaucaguguacccucga

SEQ ID NO: 464326 - RNA, 13 nt, Chlamydia trachomatis
aaucacucuacca

SEQ ID NO: 464327 - RNA, 12 nt, Chlamydia trachomatis
aaucacuuucug

SEQ ID NO: 464328 - RNA, 14 nt, Chlamydia trachomatis
aaucacuaaaagua

SEQ ID NO: 464329 - RNA, 21 nt, Chlamydia trachomatis
aaucaccacgagaucugcauc

SEQ ID NO: 464330 - RNA, 18 nt, Chlamydia trachomatis
aaucacaugcucaucaaa

SEQ ID NO: 464331 - RNA, 19 nt, Chlamydia trachomatis
aaucacaugcucaucaaac

SEQ ID NO: 464332 - RNA, 20 nt, Chlamydia trachomatis
aaucacaugguuuucugggu

SEQ ID NO: 464333 - RNA, 22 nt, Chlamydia trachomatis
aaucaccccaucccuugcaaaa

SEQ ID NO: 464334 - RNA, 13 nt, Chlamydia trachomatis
aaucacaauuuuu

SEQ ID NO: 464335 - RNA, 16 nt, Chlamydia trachomatis
aaucacacgggucucu

SEQ ID NO: 464336 - RNA, 18 nt, Chlamydia trachomatis
aaucacacgggucucuau

SEQ ID NO: 464337 - RNA, 14 nt, Chlamydia trachomatis
aaucacagaaacuu

SEQ ID NO: 464338 - RNA, 18 nt, Chlamydia trachomatis
aaucacagcaauagccau

SEQ ID NO: 464339 - RNA, 19 nt, Chlamydia trachomatis
aaucacaguaauacucuua

SEQ ID NO: 464340 - RNA, 19 nt, Chlamydia trachomatis
aaucaacgcuucauaagcc

SEQ ID NO: 464341 - RNA, 23 nt, Chlamydia trachomatis
aaucaaaaacgcgauauccuuuu

SEQ ID NO: 464342 - RNA, 17 nt, Chlamydia trachomatis
aaucaaaacgcucagaa

SEQ ID NO: 464343 - RNA, 19 nt, Chlamydia trachomatis
aaucaaaacgcucagaaaa

SEQ ID NO: 464344 - RNA, 16 nt, Chlamydia trachomatis
aaucaaaccaaaaaua

SEQ ID NO: 464345 - RNA, 21 nt, Chlamydia trachomatis
aaucaaacgucgaaaagcuuc

SEQ ID NO: 464346 - RNA, 13 nt, Chlamydia trachomatis
aaucaaagacuuc

SEQ ID NO: 464347 - RNA, 17 nt, Chlamydia trachomatis
aauauuuuugggaaaaa

SEQ ID NO: 464348 - RNA, 14 nt, Chlamydia trachomatis
aauauucuuuucca

SEQ ID NO: 464349 - RNA, 19 nt, Chlamydia trachomatis
aauauuggugaucauuuuu

SEQ ID NO: 464350 - RNA, 21 nt, Chlamydia trachomatis
aauaugaagaacuuuagaaga

SEQ ID NO: 464351 - RNA, 16 nt, Chlamydia trachomatis
aauauuaagauccauu

SEQ ID NO: 464352 - RNA, 16 nt, Chlamydia trachomatis
aauaucuucugggcuu

SEQ ID NO: 464353 - RNA, 20 nt, Chlamydia trachomatis
aauaucuucagaagcggcau

SEQ ID NO: 464354 - RNA, 13 nt, Chlamydia trachomatis
aauauaacuagaa

SEQ ID NO: 464355 - RNA, 18 nt, Chlamydia trachomatis
aauaucaaagagugugcu

SEQ ID NO: 464356 - RNA, 20 nt, Chlamydia trachomatis
aauaucaaaguagcaaucac

SEQ ID NO: 464357 - RNA, 18 nt, Chlamydia trachomatis
aauaucaacguuuucacu

SEQ ID NO: 464358 - RNA, 14 nt, Chlamydia trachomatis
aauaguucucugca

SEQ ID NO: 464359 - RNA, 14 nt, Chlamydia trachomatis
aauaguugcaaaaa

SEQ ID NO: 464360 - RNA, 24 nt, Chlamydia trachomatis
aauaguaucuauaaucuauuuuau

SEQ ID NO: 464361 - RNA, 14 nt, Chlamydia trachomatis
aauaguaccuucaa

SEQ ID NO: 464362 - RNA, 18 nt, Chlamydia trachomatis
aauagcugacuuugaaga

SEQ ID NO: 464363 - RNA, 20 nt, Chlamydia trachomatis
aauagcuuaccucaauagca

SEQ ID NO: 464364 - RNA, 18 nt, Chlamydia trachomatis
aauagcuugcacagcaag

SEQ ID NO: 464365 - RNA, 20 nt, Chlamydia trachomatis
aauagcuugcacagcaagcg

SEQ ID NO: 464366 - RNA, 12 nt, Chlamydia trachomatis
aauaggaagaau

SEQ ID NO: 464367 - RNA, 22 nt, Chlamydia trachomatis
aauaggagcgauaacuccauca

SEQ ID NO: 464368 - RNA, 22 nt, Chlamydia trachomatis
aauagcucaguugguagagcaa

SEQ ID NO: 464369 - RNA, 14 nt, Chlamydia trachomatis
aauacaaaucuuuu

SEQ ID NO: 464370 - RNA, 21 nt, Chlamydia trachomatis
aauacaaaucuuuuaucuucu

SEQ ID NO: 464371 - RNA, 16 nt, Chlamydia trachomatis
aauacaagaaaggccu

SEQ ID NO: 464372 - RNA, 15 nt, Chlamydia trachomatis
aauacaaucaguaag

SEQ ID NO: 464373 - RNA, 13 nt, Chlamydia trachomatis
aauaaagaagccu

SEQ ID NO: 464374 - RNA, 11 nt, Chlamydia trachomatis
aauaaagauag

SEQ ID NO: 464375 - RNA, 19 nt, Chlamydia trachomatis
aauaaagcggcuaaagaag

SEQ ID NO: 464376 - RNA, 15 nt, Chlamydia trachomatis
aauaaaggaaacaaa

SEQ ID NO: 464377 - RNA, 20 nt, Chlamydia trachomatis
aauaaaggccaggcuugcuu

SEQ ID NO: 464378 - RNA, 21 nt, Chlamydia trachomatis
aauaaagucucuuaagcguuu

SEQ ID NO: 464379 - RNA, 16 nt, Chlamydia trachomatis
aauacaaaccgaagag

SEQ ID NO: 464380 - RNA, 22 nt, Chlamydia trachomatis
aauacagucaugcaucccuuaa

SEQ ID NO: 464381 - RNA, 18 nt, Chlamydia trachomatis
aauacaucacugcaacua

SEQ ID NO: 464382 - RNA, 13 nt, Chlamydia trachomatis
aauacgaacaugu

SEQ ID NO: 464383 - RNA, 13 nt, Chlamydia trachomatis
aauacuucuuuuu

SEQ ID NO: 464384 - RNA, 17 nt, Chlamydia trachomatis
aauacuugauuuuuuuc

SEQ ID NO: 464385 - RNA, 19 nt, Chlamydia trachomatis
aaugauucuugaagauuug

SEQ ID NO: 464386 - RNA, 18 nt, Chlamydia trachomatis
aaugaucacuugaaucac

SEQ ID NO: 464387 - RNA, 12 nt, Chlamydia trachomatis
aaugauagcacc

SEQ ID NO: 464388 - RNA, 23 nt, Chlamydia trachomatis
aaugaccaguuugucuuagaaga

SEQ ID NO: 464389 - RNA, 16 nt, Chlamydia trachomatis
aaugacucaaaaagcu

SEQ ID NO: 464390 - RNA, 18 nt, Chlamydia trachomatis
aaugaguuccgaacaaaa

SEQ ID NO: 464391 - RNA, 18 nt, Chlamydia trachomatis
aaucuuucuaauuucccu

SEQ ID NO: 464392 - RNA, 14 nt, Chlamydia trachomatis
aaucuugugcuaag

SEQ ID NO: 464393 - RNA, 23 nt, Chlamydia trachomatis
aaugaagcaaaucccugugcuau

SEQ ID NO: 464394 - RNA, 20 nt, Chlamydia trachomatis
aaugaaggccaaagaaauag

SEQ ID NO: 464395 - RNA, 22 nt, Chlamydia trachomatis
aaugaagguuucuaaaaaacuu

SEQ ID NO: 464396 - RNA, 13 nt, Chlamydia trachomatis
aaugaauuucccc

SEQ ID NO: 464397 - RNA, 22 nt, Chlamydia trachomatis
aaugaauuuccccugcagccuc

SEQ ID NO: 464398 - RNA, 16 nt, Chlamydia trachomatis
aaugacaaacuuucuc

SEQ ID NO: 464399 - RNA, 17 nt, Chlamydia trachomatis
aaugacacacaucuaga

SEQ ID NO: 464400 - RNA, 13 nt, Chlamydia trachomatis
aaugacacuggca

SEQ ID NO: 464401 - RNA, 12 nt, Chlamydia trachomatis
aaucuucuuaua

SEQ ID NO: 464402 - RNA, 15 nt, Chlamydia trachomatis
aaucuucuuauacag

SEQ ID NO: 464403 - RNA, 23 nt, Chlamydia trachomatis
aaucuucuucuaagcuagaaaau

SEQ ID NO: 464404 - RNA, 12 nt, Chlamydia trachomatis
aaucuggcugaa

SEQ ID NO: 464405 - RNA, 19 nt, Chlamydia trachomatis
aaucuggcugaagaaguug

SEQ ID NO: 464406 - RNA, 19 nt, Chlamydia trachomatis
aaucuucggcagaagcugc

SEQ ID NO: 464407 - RNA, 16 nt, Chlamydia trachomatis
aaucuucgugcaggga

SEQ ID NO: 464408 - RNA, 22 nt, Chlamydia trachomatis
aaucugcuccuagguuagaagu

SEQ ID NO: 464409 - RNA, 15 nt, Chlamydia trachomatis
aaucugcuuaucucc

SEQ ID NO: 464410 - RNA, 18 nt, Chlamydia trachomatis
aaucuggauagacagcca

SEQ ID NO: 464411 - RNA, 16 nt, Chlamydia trachomatis
aaucugcaacaaauac

SEQ ID NO: 464412 - RNA, 23 nt, Chlamydia trachomatis
aaucugcaacaaauaccaaaaua

SEQ ID NO: 464413 - RNA, 15 nt, Chlamydia trachomatis
aaucugcaagaacaa

SEQ ID NO: 464414 - RNA, 22 nt, Chlamydia trachomatis
aaucugcaugguaaauguguag

SEQ ID NO: 464415 - RNA, 14 nt, Chlamydia trachomatis
aaucuccuccuauu

SEQ ID NO: 464416 - RNA, 16 nt, Chlamydia trachomatis
aaucuccuguacacca

SEQ ID NO: 464417 - RNA, 19 nt, Chlamydia trachomatis
aaucucgagcuaagaaaau

SEQ ID NO: 464418 - RNA, 22 nt, Chlamydia trachomatis
aaucucguuucuguuacacaga

SEQ ID NO: 464419 - RNA, 17 nt, Chlamydia trachomatis
aaucucugaaagagcuu

SEQ ID NO: 464420 - RNA, 20 nt, Chlamydia trachomatis
aaucucugcaacaaagaguu

SEQ ID NO: 464421 - RNA, 22 nt, Chlamydia trachomatis
aaucucuuaauccuugcacuaa

SEQ ID NO: 464422 - RNA, 14 nt, Chlamydia trachomatis
aaucucuuggagag

SEQ ID NO: 464423 - RNA, 21 nt, Chlamydia trachomatis
aaucucuuggagagaaugaag

SEQ ID NO: 464424 - RNA, 13 nt, Chlamydia trachomatis
aaucucaaaaaca

SEQ ID NO: 464425 - RNA, 17 nt, Chlamydia trachomatis
aaucucaaaaacacuac

SEQ ID NO: 464426 - RNA, 17 nt, Chlamydia trachomatis
aaucuaaagacaaaacu

SEQ ID NO: 464427 - RNA, 16 nt, Chlamydia trachomatis
aaucgaggugauuuuc

SEQ ID NO: 464428 - RNA, 19 nt, Chlamydia trachomatis
aaucgaggugauuuucuuu

SEQ ID NO: 464429 - RNA, 22 nt, Chlamydia trachomatis
aauccuuuuaagauauccauag

SEQ ID NO: 464430 - RNA, 22 nt, Chlamydia trachomatis
aauccuuuucagaauuacccug

SEQ ID NO: 464431 - RNA, 15 nt, Chlamydia trachomatis
aauccuuuugauucu

SEQ ID NO: 464432 - RNA, 17 nt, Chlamydia trachomatis
aaucgugcuaugcauuu

SEQ ID NO: 464433 - RNA, 18 nt, Chlamydia trachomatis
aaucggcaaaagaucuca

SEQ ID NO: 464434 - RNA, 16 nt, Chlamydia trachomatis
aaucggauagagaaga

SEQ ID NO: 464435 - RNA, 20 nt, Chlamydia trachomatis
aaucggauagagaagaauug

SEQ ID NO: 464436 - RNA, 16 nt, Chlamydia trachomatis
aaucgaucacagaaac

SEQ ID NO: 464437 - RNA, 14 nt, Chlamydia trachomatis
aaucgcuucugcug

SEQ ID NO: 464438 - RNA, 20 nt, Chlamydia trachomatis
aaucgcuucugcugaauauu

SEQ ID NO: 464439 - RNA, 17 nt, Chlamydia trachomatis
aaugcugcgauaacaac

SEQ ID NO: 464440 - RNA, 13 nt, Chlamydia trachomatis
aaugcguugcucu

SEQ ID NO: 464441 - RNA, 14 nt, Chlamydia trachomatis
aaugcguuucuucu

SEQ ID NO: 464442 - RNA, 15 nt, Chlamydia trachomatis
aauggugaaacuuuc

SEQ ID NO: 464443 - RNA, 19 nt, Chlamydia trachomatis
aauguccucuuuaucuaaa

SEQ ID NO: 464444 - RNA, 20 nt, Chlamydia trachomatis
aauguugaugguuucuagcu

SEQ ID NO: 464445 - RNA, 22 nt, Chlamydia trachomatis
aauguuugaucugagaaagcuu

SEQ ID NO: 464446 - RNA, 19 nt, Chlamydia trachomatis
aauguuuggauaagaacuu

SEQ ID NO: 464447 - RNA, 17 nt, Chlamydia trachomatis
aauguuugggaagauau

SEQ ID NO: 464448 - RNA, 24 nt, Chlamydia trachomatis
aauguucaugaaacccaucucuau

SEQ ID NO: 464449 - RNA, 16 nt, Chlamydia trachomatis
aauuaauaauuccacc

SEQ ID NO: 464450 - RNA, 14 nt, Chlamydia trachomatis
aauuaaagagaugu

SEQ ID NO: 464451 - RNA, 22 nt, Chlamydia trachomatis
aauuuggcaauggcaaaaucuu

SEQ ID NO: 464452 - RNA, 17 nt, Chlamydia trachomatis
aauuuggcucuuuaaua

SEQ ID NO: 464453 - RNA, 16 nt, Chlamydia trachomatis
aauuugauucauugua

SEQ ID NO: 464454 - RNA, 19 nt, Chlamydia trachomatis
aauuuguguuaaaucauuc

SEQ ID NO: 464455 - RNA, 16 nt, Chlamydia trachomatis
aauuuuacguaauuca

SEQ ID NO: 464456 - RNA, 16 nt, Chlamydia trachomatis
aauuuuaucuaaaaag

SEQ ID NO: 464457 - RNA, 20 nt, Chlamydia trachomatis
aauuaguaaaucgaagggaa

SEQ ID NO: 464458 - RNA, 18 nt, Chlamydia trachomatis
aauuaguaauaaaggaaa

SEQ ID NO: 464459 - RNA, 17 nt, Chlamydia trachomatis
aauuauacaauuuauag

SEQ ID NO: 464460 - RNA, 18 nt, Chlamydia trachomatis
aauuauacaauuuauagc

SEQ ID NO: 464461 - RNA, 16 nt, Chlamydia trachomatis
aauuucaucacagaua

SEQ ID NO: 464462 - RNA, 20 nt, Chlamydia trachomatis
aauuuccccugcagccucug

SEQ ID NO: 464463 - RNA, 19 nt, Chlamydia trachomatis
aauuuccuuagaaagaauu

SEQ ID NO: 464464 - RNA, 14 nt, Chlamydia trachomatis
aauuucuaaauauu

SEQ ID NO: 464465 - RNA, 18 nt, Chlamydia trachomatis
aauuucuauagaagaauu

SEQ ID NO: 464466 - RNA, 14 nt, Chlamydia trachomatis
aauuucuuccucua

SEQ ID NO: 464467 - RNA, 13 nt, Chlamydia trachomatis
aauuucuucuuuu

SEQ ID NO: 464468 - RNA, 14 nt, Chlamydia trachomatis
aauuucuugaacaa

SEQ ID NO: 464469 - RNA, 16 nt, Chlamydia trachomatis
aauuuucaauagcaau

SEQ ID NO: 464470 - RNA, 13 nt, Chlamydia trachomatis
aauuuucaucaaa

SEQ ID NO: 464471 - RNA, 18 nt, Chlamydia trachomatis
aauuuuccacaaauauuu

SEQ ID NO: 464472 - RNA, 19 nt, Chlamydia trachomatis
aauuuucuagcuucuuguc

SEQ ID NO: 464473 - RNA, 21 nt, Chlamydia trachomatis
aauuuucuaggagaagaggua

SEQ ID NO: 464474 - RNA, 19 nt, Chlamydia trachomatis
aauuuucucucuagcgaua

SEQ ID NO: 464475 - RNA, 17 nt, Chlamydia trachomatis
aauuuuguuaagaauua

SEQ ID NO: 464476 - RNA, 14 nt, Chlamydia trachomatis
aauuuuuagggaau

SEQ ID NO: 464477 - RNA, 13 nt, Chlamydia trachomatis
aauuuuucagaaa

SEQ ID NO: 464478 - RNA, 14 nt, Chlamydia trachomatis
aauuuuucagaaaa

SEQ ID NO: 464479 - RNA, 19 nt, Chlamydia trachomatis
aauuuuucuuugagaaagu

SEQ ID NO: 464480 - RNA, 23 nt, Chlamydia trachomatis
aauuuuugauacaauuccugcuc

SEQ ID NO: 464481 - RNA, 15 nt, Chlamydia trachomatis
aauuuuuuucuuugc

SEQ ID NO: 464482 - RNA, 18 nt, Chlamydia trachomatis
aauuuuuuucuuugcuuu

SEQ ID NO: 464483 - RNA, 14 nt, Chlamydia trachomatis
acaaaaaaaaagag

SEQ ID NO: 464484 - RNA, 11 nt, Chlamydia trachomatis
acaaaaauacu

SEQ ID NO: 464485 - RNA, 12 nt, Chlamydia trachomatis
acaaaaccaaaa

SEQ ID NO: 464486 - RNA, 14 nt, Chlamydia trachomatis
acaaaaccaaaauc

SEQ ID NO: 464487 - RNA, 22 nt, Chlamydia trachomatis
acaaaacuugucuaaaagaaua

SEQ ID NO: 464488 - RNA, 15 nt, Chlamydia trachomatis
acaaacaaaaaagaa

SEQ ID NO: 464489 - RNA, 22 nt, Chlamydia trachomatis
acaaacaaauccuagaagagcu

SEQ ID NO: 464490 - RNA, 12 nt, Chlamydia trachomatis
acaaaucuuucu

SEQ ID NO: 464491 - RNA, 17 nt, Chlamydia trachomatis
acaaaucuuuuaucuuc

SEQ ID NO: 464492 - RNA, 17 nt, Chlamydia trachomatis
acaaauccagcugcugc

SEQ ID NO: 464493 - RNA, 20 nt, Chlamydia trachomatis
acaaauccagcugcugccca

SEQ ID NO: 464494 - RNA, 15 nt, Chlamydia trachomatis
acaaauaccaaaaua

SEQ ID NO: 464495 - RNA, 22 nt, Chlamydia trachomatis
acaaauauuuuugggaaaaaau

SEQ ID NO: 464496 - RNA, 19 nt, Chlamydia trachomatis
acaaauugcacuaaagagc

SEQ ID NO: 464497 - RNA, 21 nt, Chlamydia trachomatis
acaaauuuaucugcuaaagaa

SEQ ID NO: 464498 - RNA, 23 nt, Chlamydia trachomatis
acaaauuuaucugcuaaagaaaa

SEQ ID NO: 464499 - RNA, 20 nt, Chlamydia trachomatis
acaaauuucuauagaagaau

SEQ ID NO: 464500 - RNA, 22 nt, Chlamydia trachomatis
acaacaaguugauacaagagag

SEQ ID NO: 464501 - RNA, 23 nt, Chlamydia trachomatis
acaacaaguugauacaagagaga

SEQ ID NO: 464502 - RNA, 21 nt, Chlamydia trachomatis
acaacaaugucaacauaauag

SEQ ID NO: 464503 - RNA, 21 nt, Chlamydia trachomatis
acaaacgggagcccaauuaaa

SEQ ID NO: 464504 - RNA, 18 nt, Chlamydia trachomatis
acaaaccagcucaucaaa

SEQ ID NO: 464505 - RNA, 17 nt, Chlamydia trachomatis
acaaaccgaagagggaa

SEQ ID NO: 464506 - RNA, 16 nt, Chlamydia trachomatis
acaaagagaaggccuu

SEQ ID NO: 464507 - RNA, 17 nt, Chlamydia trachomatis
acaaagauaaucaaacc

SEQ ID NO: 464508 - RNA, 21 nt, Chlamydia trachomatis
acaaaggaacaucgagaaaau

SEQ ID NO: 464509 - RNA, 16 nt, Chlamydia trachomatis
acaaagguguuuucua

SEQ ID NO: 464510 - RNA, 22 nt, Chlamydia trachomatis
acaaagucagagauauugucua

SEQ ID NO: 464511 - RNA, 19 nt, Chlamydia trachomatis
acaagcgacuccaacacga

SEQ ID NO: 464512 - RNA, 12 nt, Chlamydia trachomatis
acaagccuuuaa

SEQ ID NO: 464513 - RNA, 18 nt, Chlamydia trachomatis
acaagccuuuaagguacu

SEQ ID NO: 464514 - RNA, 18 nt, Chlamydia trachomatis
acaagacuucuucuaaag

SEQ ID NO: 464515 - RNA, 19 nt, Chlamydia trachomatis
acaagaaguaacaccucuu

SEQ ID NO: 464516 - RNA, 12 nt, Chlamydia trachomatis
acaagaauaaua

SEQ ID NO: 464517 - RNA, 18 nt, Chlamydia trachomatis
acaagaauaauagagaca

SEQ ID NO: 464518 - RNA, 19 nt, Chlamydia trachomatis
acaagaauaauagagacaa

SEQ ID NO: 464519 - RNA, 12 nt, Chlamydia trachomatis
acaacugcugau

SEQ ID NO: 464520 - RNA, 20 nt, Chlamydia trachomatis
acaacugcugauaaauuucu

SEQ ID NO: 464521 - RNA, 20 nt, Chlamydia trachomatis
acaacuugaucuacagcaaa

SEQ ID NO: 464522 - RNA, 16 nt, Chlamydia trachomatis
acaacuugcguuuucu

SEQ ID NO: 464523 - RNA, 18 nt, Chlamydia trachomatis
acaacguuuaaugaauac

SEQ ID NO: 464524 - RNA, 20 nt, Chlamydia trachomatis
acaacuaaaggaaacaagca

SEQ ID NO: 464525 - RNA, 13 nt, Chlamydia trachomatis
acaacuacaacaa

SEQ ID NO: 464526 - RNA, 14 nt, Chlamydia trachomatis
acaacuacaacaag

SEQ ID NO: 464527 - RNA, 17 nt, Chlamydia trachomatis
acaacgaguugaucuuc

SEQ ID NO: 464528 - RNA, 20 nt, Chlamydia trachomatis
acaacgaguugaucuuccuc

SEQ ID NO: 464529 - RNA, 17 nt, Chlamydia trachomatis
acaacgauauaaagaag

SEQ ID NO: 464530 - RNA, 16 nt, Chlamydia trachomatis
acaaccaucaaagcag

SEQ ID NO: 464531 - RNA, 14 nt, Chlamydia trachomatis
acaacccaaguuug

SEQ ID NO: 464532 - RNA, 15 nt, Chlamydia trachomatis
acaacacgucuuaaa

SEQ ID NO: 464533 - RNA, 16 nt, Chlamydia trachomatis
acaacacgucuuaaag

SEQ ID NO: 464534 - RNA, 17 nt, Chlamydia trachomatis
acaacacgucuuaaagg

SEQ ID NO: 464535 - RNA, 13 nt, Chlamydia trachomatis
acaacaugaaccg

SEQ ID NO: 464536 - RNA, 22 nt, Chlamydia trachomatis
acaacaugaaccgcagcaacau

SEQ ID NO: 464537 - RNA, 23 nt, Chlamydia trachomatis
acacauaucuccaaaaauauggg

SEQ ID NO: 464538 - RNA, 13 nt, Chlamydia trachomatis
acacaucaaaaug

SEQ ID NO: 464539 - RNA, 16 nt, Chlamydia trachomatis
acacauccuucugcua

SEQ ID NO: 464540 - RNA, 13 nt, Chlamydia trachomatis
acacaucgaugcu

SEQ ID NO: 464541 - RNA, 21 nt, Chlamydia trachomatis
acacaauucggaauacuguuu

SEQ ID NO: 464542 - RNA, 13 nt, Chlamydia trachomatis
acacaacauaacu

SEQ ID NO: 464543 - RNA, 23 nt, Chlamydia trachomatis
acacaacuucugcuaaaaaugcu

SEQ ID NO: 464544 - RNA, 15 nt, Chlamydia trachomatis
acacaagcagacaag

SEQ ID NO: 464545 - RNA, 14 nt, Chlamydia trachomatis
acacaaguaugaga

SEQ ID NO: 464546 - RNA, 19 nt, Chlamydia trachomatis
acacaaguaugagaggaag

SEQ ID NO: 464547 - RNA, 21 nt, Chlamydia trachomatis
acaauggcgacguuagaacua

SEQ ID NO: 464548 - RNA, 14 nt, Chlamydia trachomatis
acaauguaaacaau

SEQ ID NO: 464549 - RNA, 15 nt, Chlamydia trachomatis
acaauguaaacaaua

SEQ ID NO: 464550 - RNA, 19 nt, Chlamydia trachomatis
acaauguacgcuaaaaacu

SEQ ID NO: 464551 - RNA, 13 nt, Chlamydia trachomatis
acaauuccugcuc

SEQ ID NO: 464552 - RNA, 24 nt, Chlamydia trachomatis
acaauugagugugagucuaucuuc

SEQ ID NO: 464553 - RNA, 22 nt, Chlamydia trachomatis
acaauugguuugauagcuucau

SEQ ID NO: 464554 - RNA, 19 nt, Chlamydia trachomatis
acaauuucaucacagauaa

SEQ ID NO: 464555 - RNA, 18 nt, Chlamydia trachomatis
acaauuuccuuagaaaga

SEQ ID NO: 464556 - RNA, 17 nt, Chlamydia trachomatis
acaauuuuuguuccuuu

SEQ ID NO: 464557 - RNA, 17 nt, Chlamydia trachomatis
acacaaaaaaaagagag

SEQ ID NO: 464558 - RNA, 16 nt, Chlamydia trachomatis
acacaaaagcauugaa

SEQ ID NO: 464559 - RNA, 21 nt, Chlamydia trachomatis
acaaugauauucuaauccuaa

SEQ ID NO: 464560 - RNA, 18 nt, Chlamydia trachomatis
acaauccuagacgauuaa

SEQ ID NO: 464561 - RNA, 19 nt, Chlamydia trachomatis
acaauccuagacgauuaau

SEQ ID NO: 464562 - RNA, 20 nt, Chlamydia trachomatis
acaaucggccggaauauccg

SEQ ID NO: 464563 - RNA, 16 nt, Chlamydia trachomatis
acaaucucaaaaacac

SEQ ID NO: 464564 - RNA, 17 nt, Chlamydia trachomatis
acaaucucaaaaacacu

SEQ ID NO: 464565 - RNA, 14 nt, Chlamydia trachomatis
acaauaguaucucc

SEQ ID NO: 464566 - RNA, 15 nt, Chlamydia trachomatis
acaauaguaucuccu

SEQ ID NO: 464567 - RNA, 13 nt, Chlamydia trachomatis
acaauauuacgaa

SEQ ID NO: 464568 - RNA, 20 nt, Chlamydia trachomatis
acaauccaguacugcuacaa

SEQ ID NO: 464569 - RNA, 22 nt, Chlamydia trachomatis
acaaucauuauccauaaaaaua

SEQ ID NO: 464570 - RNA, 13 nt, Chlamydia trachomatis
acaagugcagcgu

SEQ ID NO: 464571 - RNA, 14 nt, Chlamydia trachomatis
acaagguucuucaa

SEQ ID NO: 464572 - RNA, 16 nt, Chlamydia trachomatis
acaaguaugagaggaa

SEQ ID NO: 464573 - RNA, 19 nt, Chlamydia trachomatis
acaaguaugagaggaagau

SEQ ID NO: 464574 - RNA, 19 nt, Chlamydia trachomatis
acaagcugacaaagcuucc

SEQ ID NO: 464575 - RNA, 18 nt, Chlamydia trachomatis
acaaggauuuucuucuuu

SEQ ID NO: 464576 - RNA, 21 nt, Chlamydia trachomatis
acaaggauuuuuuucugcaau

SEQ ID NO: 464577 - RNA, 20 nt, Chlamydia trachomatis
acaaggcucuugaaaaggag

SEQ ID NO: 464578 - RNA, 23 nt, Chlamydia trachomatis
acaagggcacucgcgcuucucuu

SEQ ID NO: 464579 - RNA, 22 nt, Chlamydia trachomatis
acaaguuccuggauccaaaaaa

SEQ ID NO: 464580 - RNA, 19 nt, Chlamydia trachomatis
acaaguugauacaagagag

SEQ ID NO: 464581 - RNA, 20 nt, Chlamydia trachomatis
acaaguugauacaagagaga

SEQ ID NO: 464582 - RNA, 18 nt, Chlamydia trachomatis
acaaguuuauggaaaaga

SEQ ID NO: 464583 - RNA, 21 nt, Chlamydia trachomatis
acaaguuuauggaaaagaucu

SEQ ID NO: 464584 - RNA, 20 nt, Chlamydia trachomatis
acaaguuucuuccagacaaa

SEQ ID NO: 464585 - RNA, 21 nt, Chlamydia trachomatis
acaauaaacaugauuaauucu

SEQ ID NO: 464586 - RNA, 21 nt, Chlamydia trachomatis
acaauaacagcacaaacaaau

SEQ ID NO: 464587 - RNA, 18 nt, Chlamydia trachomatis
acaauaacgcaccuuuaa

SEQ ID NO: 464588 - RNA, 18 nt, Chlamydia trachomatis
acaauaauacaaagcacg

SEQ ID NO: 464589 - RNA, 19 nt, Chlamydia trachomatis
acaauacagccuuggauuu

SEQ ID NO: 464590 - RNA, 22 nt, Chlamydia trachomatis
acaauagcauuugucuucgcaa

SEQ ID NO: 464591 - RNA, 15 nt, Chlamydia trachomatis
acacgauauauccau

SEQ ID NO: 464592 - RNA, 16 nt, Chlamydia trachomatis
acacgauguuccccau

SEQ ID NO: 464593 - RNA, 17 nt, Chlamydia trachomatis
acacgauguuccccauu

SEQ ID NO: 464594 - RNA, 12 nt, Chlamydia trachomatis
acaccucuccuu

SEQ ID NO: 464595 - RNA, 20 nt, Chlamydia trachomatis
acaccauucguucuuuaaga

SEQ ID NO: 464596 - RNA, 14 nt, Chlamydia trachomatis
acaccaggcaaugc

SEQ ID NO: 464597 - RNA, 13 nt, Chlamydia trachomatis
acacaucuguauc

SEQ ID NO: 464598 - RNA, 16 nt, Chlamydia trachomatis
acacauucccuaaaua

SEQ ID NO: 464599 - RNA, 18 nt, Chlamydia trachomatis
acacauucccuaaauaua

SEQ ID NO: 464600 - RNA, 15 nt, Chlamydia trachomatis
acaccaaaaaaucca

SEQ ID NO: 464601 - RNA, 12 nt, Chlamydia trachomatis
acaccaaauccu

SEQ ID NO: 464602 - RNA, 15 nt, Chlamydia trachomatis
acagaaccuuuuuaa

SEQ ID NO: 464603 - RNA, 14 nt, Chlamydia trachomatis
acagaaacuucuuc

SEQ ID NO: 464604 - RNA, 15 nt, Chlamydia trachomatis
acacuacgcuacaga

SEQ ID NO: 464605 - RNA, 17 nt, Chlamydia trachomatis
acacuacgcuacagagu

SEQ ID NO: 464606 - RNA, 18 nt, Chlamydia trachomatis
acacuaucacuguugaga

SEQ ID NO: 464607 - RNA, 19 nt, Chlamydia trachomatis
acacuaucacuguugagaa

SEQ ID NO: 464608 - RNA, 23 nt, Chlamydia trachomatis
acacuaucacuguugagaaaaac

SEQ ID NO: 464609 - RNA, 12 nt, Chlamydia trachomatis
acacuccaucuc

SEQ ID NO: 464610 - RNA, 14 nt, Chlamydia trachomatis
acagaucauaggcu

SEQ ID NO: 464611 - RNA, 20 nt, Chlamydia trachomatis
acagaaggaguuuuucuccu

SEQ ID NO: 464612 - RNA, 17 nt, Chlamydia trachomatis
acagaaucguuuaagug

SEQ ID NO: 464613 - RNA, 21 nt, Chlamydia trachomatis
acagacuaaguuguaaaacaa

SEQ ID NO: 464614 - RNA, 22 nt, Chlamydia trachomatis
acagcauacguuagcaaagaca

SEQ ID NO: 464615 - RNA, 23 nt, Chlamydia trachomatis
acagcaaaaccuuuugaaacauc

SEQ ID NO: 464616 - RNA, 19 nt, Chlamydia trachomatis
acagcaagaagaagagaga

SEQ ID NO: 464617 - RNA, 15 nt, Chlamydia trachomatis
acagcaauagagaua

SEQ ID NO: 464618 - RNA, 22 nt, Chlamydia trachomatis
acagcaauagagauaucaaucg

SEQ ID NO: 464619 - RNA, 17 nt, Chlamydia trachomatis
acagcaauagcaacugc

SEQ ID NO: 464620 - RNA, 14 nt, Chlamydia trachomatis
acagcaauagccau

SEQ ID NO: 464621 - RNA, 23 nt, Chlamydia trachomatis
acagcaauagccauuaacaacaa

SEQ ID NO: 464622 - RNA, 20 nt, Chlamydia trachomatis
acauaagaggcaccucuuuu

SEQ ID NO: 464623 - RNA, 21 nt, Chlamydia trachomatis
acauaagaggcaccucuuuuu

SEQ ID NO: 464624 - RNA, 22 nt, Chlamydia trachomatis
acauaagaggcaccucuuuuug

SEQ ID NO: 464625 - RNA, 15 nt, Chlamydia trachomatis
acauaagauccaucu

SEQ ID NO: 464626 - RNA, 19 nt, Chlamydia trachomatis
acauaagauccaucucucc

SEQ ID NO: 464627 - RNA, 14 nt, Chlamydia trachomatis
acauaagucucuug

SEQ ID NO: 464628 - RNA, 18 nt, Chlamydia trachomatis
acauaauaaauauuauca

SEQ ID NO: 464629 - RNA, 13 nt, Chlamydia trachomatis
acagccaagcaag

SEQ ID NO: 464630 - RNA, 14 nt, Chlamydia trachomatis
acagccaagcaaga

SEQ ID NO: 464631 - RNA, 14 nt, Chlamydia trachomatis
acauaaaaaagccg

SEQ ID NO: 464632 - RNA, 15 nt, Chlamydia trachomatis
acauacuuuucuccc

SEQ ID NO: 464633 - RNA, 13 nt, Chlamydia trachomatis
acauacguuuucu

SEQ ID NO: 464634 - RNA, 14 nt, Chlamydia trachomatis
acaucccagcaaua

SEQ ID NO: 464635 - RNA, 21 nt, Chlamydia trachomatis
acaucccuugaacuagaaaua

SEQ ID NO: 464636 - RNA, 13 nt, Chlamydia trachomatis
acauccaguaauu

SEQ ID NO: 464637 - RNA, 13 nt, Chlamydia trachomatis
acaucaucucuca

SEQ ID NO: 464638 - RNA, 13 nt, Chlamydia trachomatis
acaucauaaccaa

SEQ ID NO: 464639 - RNA, 19 nt, Chlamydia trachomatis
acauauguccauacaaagg

SEQ ID NO: 464640 - RNA, 19 nt, Chlamydia trachomatis
acauucugccgacuccugu

SEQ ID NO: 464641 - RNA, 20 nt, Chlamydia trachomatis
acauucugccgacuccuguc

SEQ ID NO: 464642 - RNA, 12 nt, Chlamydia trachomatis
acauucucuuuu

SEQ ID NO: 464643 - RNA, 20 nt, Chlamydia trachomatis
acauucgccucuucucuuuu

SEQ ID NO: 464644 - RNA, 15 nt, Chlamydia trachomatis
acauucccuucuuua

SEQ ID NO: 464645 - RNA, 17 nt, Chlamydia trachomatis
acauuccugccaaaaac

SEQ ID NO: 464646 - RNA, 13 nt, Chlamydia trachomatis
acauuaccauuca

SEQ ID NO: 464647 - RNA, 15 nt, Chlamydia trachomatis
acauuaccauucaca

SEQ ID NO: 464648 - RNA, 22 nt, Chlamydia trachomatis
acauuaguauagucuuuauuua

SEQ ID NO: 464649 - RNA, 21 nt, Chlamydia trachomatis
acauuauuccgcuucuauuuc

SEQ ID NO: 464650 - RNA, 16 nt, Chlamydia trachomatis
acaucgaauaaaaauu

SEQ ID NO: 464651 - RNA, 18 nt, Chlamydia trachomatis
acaucuuuagaauccaaa

SEQ ID NO: 464652 - RNA, 19 nt, Chlamydia trachomatis
acaucuuuagaauccaaag

SEQ ID NO: 464653 - RNA, 21 nt, Chlamydia trachomatis
acaugccagaagcuaugagaa

SEQ ID NO: 464654 - RNA, 21 nt, Chlamydia trachomatis
accaaaauaucauaauuacau

SEQ ID NO: 464655 - RNA, 23 nt, Chlamydia trachomatis
acauuuuccguugauaguuacag

SEQ ID NO: 464656 - RNA, 23 nt, Chlamydia trachomatis
acauuuucugguuucuuaaacaa

SEQ ID NO: 464657 - RNA, 16 nt, Chlamydia trachomatis
acauuuugcuguaguu

SEQ ID NO: 464658 - RNA, 18 nt, Chlamydia trachomatis
accaaaccuuaaaagcaa

SEQ ID NO: 464659 - RNA, 19 nt, Chlamydia trachomatis
acauuucucgucaggggau

SEQ ID NO: 464660 - RNA, 16 nt, Chlamydia trachomatis
acauuugcgugauaaa

SEQ ID NO: 464661 - RNA, 17 nt, Chlamydia trachomatis
acauuugcgugauaaaa

SEQ ID NO: 464662 - RNA, 19 nt, Chlamydia trachomatis
accaaugaagcaaaucccu

SEQ ID NO: 464663 - RNA, 21 nt, Chlamydia trachomatis
accaauaccuacacgauauau

SEQ ID NO: 464664 - RNA, 22 nt, Chlamydia trachomatis
accaauagagaccgcucucuuu

SEQ ID NO: 464665 - RNA, 22 nt, Chlamydia trachomatis
accaauaaugacacacguucca

SEQ ID NO: 464666 - RNA, 21 nt, Chlamydia trachomatis
accaagauuagauacacagaa

SEQ ID NO: 464667 - RNA, 13 nt, Chlamydia trachomatis
accaccugggcau

SEQ ID NO: 464668 - RNA, 16 nt, Chlamydia trachomatis
accacuaaucccaccu

SEQ ID NO: 464669 - RNA, 17 nt, Chlamydia trachomatis
accacuaaucccaccuu

SEQ ID NO: 464670 - RNA, 18 nt, Chlamydia trachomatis
accacuaaucccaccuua

SEQ ID NO: 464671 - RNA, 22 nt, Chlamydia trachomatis
accacuaaucccaccuuaaaug

SEQ ID NO: 464672 - RNA, 14 nt, Chlamydia trachomatis
accagcaaaagaaa

SEQ ID NO: 464673 - RNA, 15 nt, Chlamydia trachomatis
accagcagacccaaa

SEQ ID NO: 464674 - RNA, 19 nt, Chlamydia trachomatis
accagcgcuuucuaaagca

SEQ ID NO: 464675 - RNA, 21 nt, Chlamydia trachomatis
accagcuaauaaguucacuga

SEQ ID NO: 464676 - RNA, 12 nt, Chlamydia trachomatis
accaucaaagca

SEQ ID NO: 464677 - RNA, 21 nt, Chlamydia trachomatis
accaucacaaugcguagucuc

SEQ ID NO: 464678 - RNA, 15 nt, Chlamydia trachomatis
accaggauuccccgu

SEQ ID NO: 464679 - RNA, 21 nt, Chlamydia trachomatis
accagcuucccaggcggagag

SEQ ID NO: 464680 - RNA, 21 nt, Chlamydia trachomatis
accaucuuacuugcugcagau

SEQ ID NO: 464681 - RNA, 23 nt, Chlamydia trachomatis
accaucuucaccaacuccaagca

SEQ ID NO: 464682 - RNA, 16 nt, Chlamydia trachomatis
accaucuguaaagcuu

SEQ ID NO: 464683 - RNA, 19 nt, Chlamydia trachomatis
accaugagcuccaaaguaa

SEQ ID NO: 464684 - RNA, 14 nt, Chlamydia trachomatis
accaugcuccuuuc

SEQ ID NO: 464685 - RNA, 17 nt, Chlamydia trachomatis
accaugcuccuuucacu

SEQ ID NO: 464686 - RNA, 15 nt, Chlamydia trachomatis
acccauaaaaaagag

SEQ ID NO: 464687 - RNA, 16 nt, Chlamydia trachomatis
acccaugaacagcauu

SEQ ID NO: 464688 - RNA, 14 nt, Chlamydia trachomatis
acccauuugccaua

SEQ ID NO: 464689 - RNA, 21 nt, Chlamydia trachomatis
acccauccaaaacaucccagc

SEQ ID NO: 464690 - RNA, 15 nt, Chlamydia trachomatis
acccgcggaucccaa

SEQ ID NO: 464691 - RNA, 12 nt, Chlamydia trachomatis
acccuuuguagu

SEQ ID NO: 464692 - RNA, 19 nt, Chlamydia trachomatis
acccuuucuuacuccuucu

SEQ ID NO: 464693 - RNA, 15 nt, Chlamydia trachomatis
accgaacaaccuucu

SEQ ID NO: 464694 - RNA, 14 nt, Chlamydia trachomatis
accgaagguucuuc

SEQ ID NO: 464695 - RNA, 18 nt, Chlamydia trachomatis
accgaagagggaagagaa

SEQ ID NO: 464696 - RNA, 12 nt, Chlamydia trachomatis
accgagcauucu

SEQ ID NO: 464697 - RNA, 15 nt, Chlamydia trachomatis
accgacuucaacuuc

SEQ ID NO: 464698 - RNA, 16 nt, Chlamydia trachomatis
acccuucaggaaagcc

SEQ ID NO: 464699 - RNA, 19 nt, Chlamydia trachomatis
acccucgauccagcaucuc

SEQ ID NO: 464700 - RNA, 18 nt, Chlamydia trachomatis
acccguuuucucuugaaa

SEQ ID NO: 464701 - RNA, 21 nt, Chlamydia trachomatis
acccuaaucgaauuacucugc

SEQ ID NO: 464702 - RNA, 24 nt, Chlamydia trachomatis
acccuaaucgaauuacucugccua

SEQ ID NO: 464703 - RNA, 16 nt, Chlamydia trachomatis
acccuaacgaggcaca

SEQ ID NO: 464704 - RNA, 20 nt, Chlamydia trachomatis
acccuaacgaggcacaaaau

SEQ ID NO: 464705 - RNA, 14 nt, Chlamydia trachomatis
accgauaauuuuac

SEQ ID NO: 464706 - RNA, 21 nt, Chlamydia trachomatis
accgauaccaauaaugacaca

SEQ ID NO: 464707 - RNA, 22 nt, Chlamydia trachomatis
accgcaucagccccaaaaacag

SEQ ID NO: 464708 - RNA, 17 nt, Chlamydia trachomatis
acgcacuuuuuguuuua

SEQ ID NO: 464709 - RNA, 18 nt, Chlamydia trachomatis
acgcacuuuuuguuuuag

SEQ ID NO: 464710 - RNA, 17 nt, Chlamydia trachomatis
acgcauaagcacuauau

SEQ ID NO: 464711 - RNA, 21 nt, Chlamydia trachomatis
acgccaagaauugacagcacc

SEQ ID NO: 464712 - RNA, 17 nt, Chlamydia trachomatis
acgcauuugcucuucca

SEQ ID NO: 464713 - RNA, 19 nt, Chlamydia trachomatis
acgcaucccgaaucccauc

SEQ ID NO: 464714 - RNA, 20 nt, Chlamydia trachomatis
acgccguaagcauucccaga

SEQ ID NO: 464715 - RNA, 16 nt, Chlamydia trachomatis
acgcgauauccuuuuu

SEQ ID NO: 464716 - RNA, 17 nt, Chlamydia trachomatis
acgcuagaaacagccug

SEQ ID NO: 464717 - RNA, 16 nt, Chlamydia trachomatis
acgcuuccuacagcua

SEQ ID NO: 464718 - RNA, 15 nt, Chlamydia trachomatis
acgcuuccucuccuu

SEQ ID NO: 464719 - RNA, 18 nt, Chlamydia trachomatis
acgcuuccucuccuucua

SEQ ID NO: 464720 - RNA, 22 nt, Chlamydia trachomatis
acgcuuccucuccuucuacaaa

SEQ ID NO: 464721 - RNA, 16 nt, Chlamydia trachomatis
acgcuuggugagggac

SEQ ID NO: 464722 - RNA, 17 nt, Chlamydia trachomatis
acggauaaagaaagccg

SEQ ID NO: 464723 - RNA, 12 nt, Chlamydia trachomatis
acggagagaaag

SEQ ID NO: 464724 - RNA, 15 nt, Chlamydia trachomatis
acggagagaaagagg

SEQ ID NO: 464725 - RNA, 14 nt, Chlamydia trachomatis
acggcaggaaagug

SEQ ID NO: 464726 - RNA, 18 nt, Chlamydia trachomatis
acggcuucauggaauagu

SEQ ID NO: 464727 - RNA, 15 nt, Chlamydia trachomatis
acggcuaacuccagu

SEQ ID NO: 464728 - RNA, 13 nt, Chlamydia trachomatis
acggcucuucuua

SEQ ID NO: 464729 - RNA, 23 nt, Chlamydia trachomatis
acguauagcaaugcgaucagaaa

SEQ ID NO: 464730 - RNA, 21 nt, Chlamydia trachomatis
acguaguaauuuugacagaau

SEQ ID NO: 464731 - RNA, 22 nt, Chlamydia trachomatis
acguagucauugauucuaugag

SEQ ID NO: 464732 - RNA, 12 nt, Chlamydia trachomatis
acgucaauuuuu

SEQ ID NO: 464733 - RNA, 21 nt, Chlamydia trachomatis
acgugcaacacaacuucugcu

SEQ ID NO: 464734 - RNA, 18 nt, Chlamydia trachomatis
acgugaggaaguucugcu

SEQ ID NO: 464735 - RNA, 13 nt, Chlamydia trachomatis
acguguuaucaaa

SEQ ID NO: 464736 - RNA, 20 nt, Chlamydia trachomatis
acguugaugagagaaaaggc

SEQ ID NO: 464737 - RNA, 20 nt, Chlamydia trachomatis
acuaaaucucuuggagagaa

SEQ ID NO: 464738 - RNA, 22 nt, Chlamydia trachomatis
acuaacaugcucaacauuagaa

SEQ ID NO: 464739 - RNA, 17 nt, Chlamydia trachomatis
acuaagaauaaagauga

SEQ ID NO: 464740 - RNA, 16 nt, Chlamydia trachomatis
acuaaguuguaaaaca

SEQ ID NO: 464741 - RNA, 22 nt, Chlamydia trachomatis
acuacaaaacgcucuuuuucuu

SEQ ID NO: 464742 - RNA, 16 nt, Chlamydia trachomatis
acuacaacaaguuccu

SEQ ID NO: 464743 - RNA, 16 nt, Chlamydia trachomatis
acuacucccaaaucaa

SEQ ID NO: 464744 - RNA, 17 nt, Chlamydia trachomatis
acuacugggucuuuuuu

SEQ ID NO: 464745 - RNA, 16 nt, Chlamydia trachomatis
acuagauagauggcau

SEQ ID NO: 464746 - RNA, 21 nt, Chlamydia trachomatis
acuagauuugugaguuauauu

SEQ ID NO: 464747 - RNA, 14 nt, Chlamydia trachomatis
acuaggcucaugag

SEQ ID NO: 464748 - RNA, 21 nt, Chlamydia trachomatis
acuaggcucaugagccucuaa

SEQ ID NO: 464749 - RNA, 20 nt, Chlamydia trachomatis
acuagggaauaaaaguacuu

SEQ ID NO: 464750 - RNA, 13 nt, Chlamydia trachomatis
acucuaaauaccu

SEQ ID NO: 464751 - RNA, 12 nt, Chlamydia trachomatis
acucuauuaaga

SEQ ID NO: 464752 - RNA, 14 nt, Chlamydia trachomatis
acucucauaagaau

SEQ ID NO: 464753 - RNA, 17 nt, Chlamydia trachomatis
acucucauaagaauaca

SEQ ID NO: 464754 - RNA, 19 nt, Chlamydia trachomatis
acucucagcgauuguucgu

SEQ ID NO: 464755 - RNA, 16 nt, Chlamydia trachomatis
acucuccaaacucuau

SEQ ID NO: 464756 - RNA, 18 nt, Chlamydia trachomatis
acucuaaaaguuuucuug

SEQ ID NO: 464757 - RNA, 12 nt, Chlamydia trachomatis
acucuaaagaau

SEQ ID NO: 464758 - RNA, 14 nt, Chlamydia trachomatis
acucuaaagaauag

SEQ ID NO: 464759 - RNA, 21 nt, Chlamydia trachomatis
acucgcuacauguaguaaucu

SEQ ID NO: 464760 - RNA, 16 nt, Chlamydia trachomatis
acucgcaucauccuug

SEQ ID NO: 464761 - RNA, 18 nt, Chlamydia trachomatis
acucuuucaauagcauuu

SEQ ID NO: 464762 - RNA, 19 nt, Chlamydia trachomatis
acucuuguaucauauucuu

SEQ ID NO: 464763 - RNA, 20 nt, Chlamydia trachomatis
acucuuuauuaaacucccaa

SEQ ID NO: 464764 - RNA, 17 nt, Chlamydia trachomatis
acucuuccuugauuaag

SEQ ID NO: 464765 - RNA, 14 nt, Chlamydia trachomatis
acucuucuauccau

SEQ ID NO: 464766 - RNA, 16 nt, Chlamydia trachomatis
acucuuaucguagaga

SEQ ID NO: 464767 - RNA, 23 nt, Chlamydia trachomatis
acucuucagguugcuugaauaag

SEQ ID NO: 464768 - RNA, 19 nt, Chlamydia trachomatis
acucucccuguagagacua

SEQ ID NO: 464769 - RNA, 22 nt, Chlamydia trachomatis
acucucccuguagagacuagau

SEQ ID NO: 464770 - RNA, 21 nt, Chlamydia trachomatis
acucuccuaauucaacauaau

SEQ ID NO: 464771 - RNA, 15 nt, Chlamydia trachomatis
acucuccucuccuaa

SEQ ID NO: 464772 - RNA, 24 nt, Chlamydia trachomatis
acugaccgaagaacucaaaagcuu

SEQ ID NO: 464773 - RNA, 19 nt, Chlamydia trachomatis
acugaaucaggaauauuaa

SEQ ID NO: 464774 - RNA, 13 nt, Chlamydia trachomatis
acuccauuuuaag

SEQ ID NO: 464775 - RNA, 14 nt, Chlamydia trachomatis
acucccaaaucaaa

SEQ ID NO: 464776 - RNA, 18 nt, Chlamydia trachomatis
acucccaaaucaaaccaa

SEQ ID NO: 464777 - RNA, 20 nt, Chlamydia trachomatis
acuccaucucgacaguuuga

SEQ ID NO: 464778 - RNA, 19 nt, Chlamydia trachomatis
acucaucuuuuuuaaaaag

SEQ ID NO: 464779 - RNA, 12 nt, Chlamydia trachomatis
acuccaagaaga

SEQ ID NO: 464780 - RNA, 14 nt, Chlamydia trachomatis
acuccaagaagagu

SEQ ID NO: 464781 - RNA, 19 nt, Chlamydia trachomatis
acucauccuagcagcuaau

SEQ ID NO: 464782 - RNA, 16 nt, Chlamydia trachomatis
acuaucugcaaaagca

SEQ ID NO: 464783 - RNA, 14 nt, Chlamydia trachomatis
acuaugaacaaaca

SEQ ID NO: 464784 - RNA, 15 nt, Chlamydia trachomatis
acuaugaacaaacag

SEQ ID NO: 464785 - RNA, 22 nt, Chlamydia trachomatis
acuaugcaaaguuucugaaaag

SEQ ID NO: 464786 - RNA, 24 nt, Chlamydia trachomatis
acucagaaucuuuggaagcagaaa

SEQ ID NO: 464787 - RNA, 20 nt, Chlamydia trachomatis
acucagcuuccuuggcuuuu

SEQ ID NO: 464788 - RNA, 17 nt, Chlamydia trachomatis
acucagguuauccaaau

SEQ ID NO: 464789 - RNA, 15 nt, Chlamydia trachomatis
acuucauauucccug

SEQ ID NO: 464790 - RNA, 21 nt, Chlamydia trachomatis
acuucaucgagaagaucuuuc

SEQ ID NO: 464791 - RNA, 16 nt, Chlamydia trachomatis
acuucauuuuugcuaa

SEQ ID NO: 464792 - RNA, 13 nt, Chlamydia trachomatis
acuuacuuuucuu

SEQ ID NO: 464793 - RNA, 14 nt, Chlamydia trachomatis
acuuacuuuucuua

SEQ ID NO: 464794 - RNA, 17 nt, Chlamydia trachomatis
acugugaagaaugaaac

SEQ ID NO: 464795 - RNA, 18 nt, Chlamydia trachomatis
acuguaauguccucuuua

SEQ ID NO: 464796 - RNA, 22 nt, Chlamydia trachomatis
acuguagaaaaucauagauaau

SEQ ID NO: 464797 - RNA, 14 nt, Chlamydia trachomatis
acuguauccaaaac

SEQ ID NO: 464798 - RNA, 14 nt, Chlamydia trachomatis
acuguauugcucug

SEQ ID NO: 464799 - RNA, 13 nt, Chlamydia trachomatis
acugucagaccua

SEQ ID NO: 464800 - RNA, 15 nt, Chlamydia trachomatis
acugucagaccuaca

SEQ ID NO: 464801 - RNA, 17 nt, Chlamydia trachomatis
acugucagaccuacaaa

SEQ ID NO: 464802 - RNA, 21 nt, Chlamydia trachomatis
acugucagaccuacaaagaua

SEQ ID NO: 464803 - RNA, 20 nt, Chlamydia trachomatis
acuucuuuuccaucuuuaaa

SEQ ID NO: 464804 - RNA, 20 nt, Chlamydia trachomatis
acuucuuuaaagccuuucuc

SEQ ID NO: 464805 - RNA, 20 nt, Chlamydia trachomatis
acuucuuuauguaaggaaau

SEQ ID NO: 464806 - RNA, 14 nt, Chlamydia trachomatis
acuucuucauccuu

SEQ ID NO: 464807 - RNA, 18 nt, Chlamydia trachomatis
acuucugcuaaaaaugcu

SEQ ID NO: 464808 - RNA, 20 nt, Chlamydia trachomatis
acuucuggagauugaauaaa

SEQ ID NO: 464809 - RNA, 13 nt, Chlamydia trachomatis
acuugagaacaaa

SEQ ID NO: 464810 - RNA, 15 nt, Chlamydia trachomatis
acuugaguaaucagu

SEQ ID NO: 464811 - RNA, 15 nt, Chlamydia trachomatis
acuugauaaauagca

SEQ ID NO: 464812 - RNA, 19 nt, Chlamydia trachomatis
acuugcuacggaaaccaau

SEQ ID NO: 464813 - RNA, 21 nt, Chlamydia trachomatis
acuugcuccguggcaagcaac

SEQ ID NO: 464814 - RNA, 12 nt, Chlamydia trachomatis
agaaacaaaacg

SEQ ID NO: 464815 - RNA, 16 nt, Chlamydia trachomatis
agaaaauagguaaaga

SEQ ID NO: 464816 - RNA, 18 nt, Chlamydia trachomatis
agaaaauagguaaagaag

SEQ ID NO: 464817 - RNA, 19 nt, Chlamydia trachomatis
agaaacaacaaagaacucu

SEQ ID NO: 464818 - RNA, 20 nt, Chlamydia trachomatis
agaaacaaauaacuuuuucu

SEQ ID NO: 464819 - RNA, 21 nt, Chlamydia trachomatis
agaaacaauuucaucacagau

SEQ ID NO: 464820 - RNA, 13 nt, Chlamydia trachomatis
agaaaauaaacac

SEQ ID NO: 464821 - RNA, 23 nt, Chlamydia trachomatis
agaaaacuuagcuaaauucaacu

SEQ ID NO: 464822 - RNA, 14 nt, Chlamydia trachomatis
agaaaagaggaguu

SEQ ID NO: 464823 - RNA, 10 nt, Chlamydia trachomatis
agaaaagagc

SEQ ID NO: 464824 - RNA, 16 nt, Chlamydia trachomatis
acuuuucaacaaucca

SEQ ID NO: 464825 - RNA, 14 nt, Chlamydia trachomatis
acuuuuuuuucuuu

SEQ ID NO: 464826 - RNA, 14 nt, Chlamydia trachomatis
agaaaaaaacagcu

SEQ ID NO: 464827 - RNA, 12 nt, Chlamydia trachomatis
agaaaaaaagag

SEQ ID NO: 464828 - RNA, 13 nt, Chlamydia trachomatis
agaaaaaauaaug

SEQ ID NO: 464829 - RNA, 18 nt, Chlamydia trachomatis
agaaaaaccuaagggccg

SEQ ID NO: 464830 - RNA, 21 nt, Chlamydia trachomatis
agaaaaacgguguuagaaaau

SEQ ID NO: 464831 - RNA, 17 nt, Chlamydia trachomatis
agaaaaagagaaauauu

SEQ ID NO: 464832 - RNA, 13 nt, Chlamydia trachomatis
agaaaaagaugga

SEQ ID NO: 464833 - RNA, 20 nt, Chlamydia trachomatis
agaaaacagccaagcaagau

SEQ ID NO: 464834 - RNA, 23 nt, Chlamydia trachomatis
agaaauagcuaucaauaaagaag

SEQ ID NO: 464835 - RNA, 19 nt, Chlamydia trachomatis
agaaauauucccaaagcua

SEQ ID NO: 464836 - RNA, 23 nt, Chlamydia trachomatis
agaaacuucuucuaaguauucuu

SEQ ID NO: 464837 - RNA, 13 nt, Chlamydia trachomatis
agaaacuuuucug

SEQ ID NO: 464838 - RNA, 21 nt, Chlamydia trachomatis
agaaagagcgaugauuaucac

SEQ ID NO: 464839 - RNA, 12 nt, Chlamydia trachomatis
agaaagaggcuu

SEQ ID NO: 464840 - RNA, 13 nt, Chlamydia trachomatis
agaaagagggguu

SEQ ID NO: 464841 - RNA, 17 nt, Chlamydia trachomatis
agaaaguucguucaauu

SEQ ID NO: 464842 - RNA, 19 nt, Chlamydia trachomatis
agaaaguuuuuuucaggag

SEQ ID NO: 464843 - RNA, 23 nt, Chlamydia trachomatis
agaaauaaaauggaaauaaaaag

SEQ ID NO: 464844 - RNA, 20 nt, Chlamydia trachomatis
agaaauaaccggaacaauca

SEQ ID NO: 464845 - RNA, 22 nt, Chlamydia trachomatis
agaaauaaccuaggagcauucc

SEQ ID NO: 464846 - RNA, 18 nt, Chlamydia trachomatis
acuuuaccgacuucaacu

SEQ ID NO: 464847 - RNA, 17 nt, Chlamydia trachomatis
acuuuagauagucuucu

SEQ ID NO: 464848 - RNA, 22 nt, Chlamydia trachomatis
acuuuagauuuguuuaaaagaa

SEQ ID NO: 464849 - RNA, 15 nt, Chlamydia trachomatis
acuuuaggagaaaga

SEQ ID NO: 464850 - RNA, 21 nt, Chlamydia trachomatis
acuuuauuauugaaaaagcuu

SEQ ID NO: 464851 - RNA, 16 nt, Chlamydia trachomatis
acuuucacauuaucuc

SEQ ID NO: 464852 - RNA, 11 nt, Chlamydia trachomatis
acuuugaaaug

SEQ ID NO: 464853 - RNA, 18 nt, Chlamydia trachomatis
acuuugaaauguccacaa

SEQ ID NO: 464854 - RNA, 13 nt, Chlamydia trachomatis
acuuugacaagca

SEQ ID NO: 464855 - RNA, 20 nt, Chlamydia trachomatis
acuuugauaauacucuucua

SEQ ID NO: 464856 - RNA, 23 nt, Chlamydia trachomatis
acuuuggcaugcccuaaagagau

SEQ ID NO: 464857 - RNA, 22 nt, Chlamydia trachomatis
acuuugugacguauauuucaca

SEQ ID NO: 464858 - RNA, 16 nt, Chlamydia trachomatis
acuuuuagcaaauaau

SEQ ID NO: 464859 - RNA, 17 nt, Chlamydia trachomatis
agaaugauugauaaagc

SEQ ID NO: 464860 - RNA, 22 nt, Chlamydia trachomatis
agaaucaucugguauucuaaau

SEQ ID NO: 464861 - RNA, 21 nt, Chlamydia trachomatis
agaauaagguauccaacaaua

SEQ ID NO: 464862 - RNA, 22 nt, Chlamydia trachomatis
agaauaagguauccaacaauau

SEQ ID NO: 464863 - RNA, 15 nt, Chlamydia trachomatis
agaauaauagagaca

SEQ ID NO: 464864 - RNA, 23 nt, Chlamydia trachomatis
agaauagcgacacgacuuagcac

SEQ ID NO: 464865 - RNA, 23 nt, Chlamydia trachomatis
agaauagcgcguacccgauucca

SEQ ID NO: 464866 - RNA, 19 nt, Chlamydia trachomatis
agaauagggagguuuuguu

SEQ ID NO: 464867 - RNA, 16 nt, Chlamydia trachomatis
agaaguuuaaaagccc

SEQ ID NO: 464868 - RNA, 13 nt, Chlamydia trachomatis
agaaguuuuaaca

SEQ ID NO: 464869 - RNA, 14 nt, Chlamydia trachomatis
agaauaaacaacau

SEQ ID NO: 464870 - RNA, 15 nt, Chlamydia trachomatis
agaauaaacaacaug

SEQ ID NO: 464871 - RNA, 16 nt, Chlamydia trachomatis
agaagauaagcaagga

SEQ ID NO: 464872 - RNA, 12 nt, Chlamydia trachomatis
agaagaggcaaa

SEQ ID NO: 464873 - RNA, 18 nt, Chlamydia trachomatis
agaagaggcaaaaaucug

SEQ ID NO: 464874 - RNA, 15 nt, Chlamydia trachomatis
agaagagguauguuu

SEQ ID NO: 464875 - RNA, 14 nt, Chlamydia trachomatis
agaagagucucuaa

SEQ ID NO: 464876 - RNA, 20 nt, Chlamydia trachomatis
agaagauccuucgcagggga

SEQ ID NO: 464877 - RNA, 18 nt, Chlamydia trachomatis
agaagaucuuuccuugug

SEQ ID NO: 464878 - RNA, 15 nt, Chlamydia trachomatis
agaagagcugcuguc

SEQ ID NO: 464879 - RNA, 18 nt, Chlamydia trachomatis
agaagacuuacucucuaa

SEQ ID NO: 464880 - RNA, 17 nt, Chlamydia trachomatis
agaagacuuuggaagag

SEQ ID NO: 464881 - RNA, 18 nt, Chlamydia trachomatis
agaaauucguaugcaacu

SEQ ID NO: 464882 - RNA, 16 nt, Chlamydia trachomatis
agaaaugcaaauuugc

SEQ ID NO: 464883 - RNA, 21 nt, Chlamydia trachomatis
agaaaugcaaauuugcagaag

SEQ ID NO: 464884 - RNA, 16 nt, Chlamydia trachomatis
agaaauggucucuucu

SEQ ID NO: 464885 - RNA, 17 nt, Chlamydia trachomatis
agaaauggucucuucuc

SEQ ID NO: 464886 - RNA, 22 nt, Chlamydia trachomatis
agaaauguuuggauaagaacuu

SEQ ID NO: 464887 - RNA, 15 nt, Chlamydia trachomatis
agaaauuaacaccaa

SEQ ID NO: 464888 - RNA, 18 nt, Chlamydia trachomatis
agaagcgaagcauucucu

SEQ ID NO: 464889 - RNA, 12 nt, Chlamydia trachomatis
agaaggaaugca

SEQ ID NO: 464890 - RNA, 13 nt, Chlamydia trachomatis
agaagccuugagc

SEQ ID NO: 464891 - RNA, 18 nt, Chlamydia trachomatis
agaagccuugagccuuca

SEQ ID NO: 464892 - RNA, 21 nt, Chlamydia trachomatis
agaagccuugagccuucaauu

SEQ ID NO: 464893 - RNA, 19 nt, Chlamydia trachomatis
agaagccauaauaaaaggc

SEQ ID NO: 464894 - RNA, 19 nt, Chlamydia trachomatis
agaagccauaguagaaauu

SEQ ID NO: 464895 - RNA, 15 nt, Chlamydia trachomatis
agaaggcuuuucuau

SEQ ID NO: 464896 - RNA, 18 nt, Chlamydia trachomatis
agaaggcccaguaaacua

SEQ ID NO: 464897 - RNA, 18 nt, Chlamydia trachomatis
agacagccauaucaggac

SEQ ID NO: 464898 - RNA, 12 nt, Chlamydia trachomatis
agacaucuauug

SEQ ID NO: 464899 - RNA, 13 nt, Chlamydia trachomatis
agaauuacccuga

SEQ ID NO: 464900 - RNA, 17 nt, Chlamydia trachomatis
agaauuuuucuaaaauc

SEQ ID NO: 464901 - RNA, 13 nt, Chlamydia trachomatis
agacaaaaaaugc

SEQ ID NO: 464902 - RNA, 21 nt, Chlamydia trachomatis
agacaaaaaaugcgcucuuua

SEQ ID NO: 464903 - RNA, 16 nt, Chlamydia trachomatis
agacaaaaagaaagcc

SEQ ID NO: 464904 - RNA, 15 nt, Chlamydia trachomatis
agacaaaacuucuuc

SEQ ID NO: 464905 - RNA, 13 nt, Chlamydia trachomatis
agacaaaacaagc

SEQ ID NO: 464906 - RNA, 21 nt, Chlamydia trachomatis
agacaaagaucguaaaauagc

SEQ ID NO: 464907 - RNA, 21 nt, Chlamydia trachomatis
agacaaagguguguucccaga

SEQ ID NO: 464908 - RNA, 18 nt, Chlamydia trachomatis
agaccgcucucuuuucug

SEQ ID NO: 464909 - RNA, 21 nt, Chlamydia trachomatis
agacgcaugcuucuuuaagac

SEQ ID NO: 464910 - RNA, 21 nt, Chlamydia trachomatis
agacccuuccaaauuucccuc

SEQ ID NO: 464911 - RNA, 19 nt, Chlamydia trachomatis
agaccgaaauuaguaauaa

SEQ ID NO: 464912 - RNA, 21 nt, Chlamydia trachomatis
agacgcuuuagcuaaguuggc

SEQ ID NO: 464913 - RNA, 16 nt, Chlamydia trachomatis
agacucagguuaucca

SEQ ID NO: 464914 - RNA, 19 nt, Chlamydia trachomatis
agacuccagcuucuccauc

SEQ ID NO: 464915 - RNA, 22 nt, Chlamydia trachomatis
agacuccagcuucuccaucuga

SEQ ID NO: 464916 - RNA, 18 nt, Chlamydia trachomatis
agacgcccuccuccucgc

SEQ ID NO: 464917 - RNA, 17 nt, Chlamydia trachomatis
agacuguggcaaggcuu

SEQ ID NO: 464918 - RNA, 21 nt, Chlamydia trachomatis
agacuguggcaaggcuuucaa

SEQ ID NO: 464919 - RNA, 14 nt, Chlamydia trachomatis
agacuuacucucua

SEQ ID NO: 464920 - RNA, 15 nt, Chlamydia trachomatis
agacugccuaccugc

SEQ ID NO: 464921 - RNA, 20 nt, Chlamydia trachomatis
agacucuaauaaaucugcua

SEQ ID NO: 464922 - RNA, 15 nt, Chlamydia trachomatis
agacucuuucaauag

SEQ ID NO: 464923 - RNA, 19 nt, Chlamydia trachomatis
agacuuugugcaaccucua

SEQ ID NO: 464924 - RNA, 11 nt, Chlamydia trachomatis
agagaaaaggc

SEQ ID NO: 464925 - RNA, 17 nt, Chlamydia trachomatis
agagaaaccaacgagug

SEQ ID NO: 464926 - RNA, 17 nt, Chlamydia trachomatis
agagaaaucagaugcca

SEQ ID NO: 464927 - RNA, 12 nt, Chlamydia trachomatis
agagaaccaaac

SEQ ID NO: 464928 - RNA, 14 nt, Chlamydia trachomatis
agagaagaauugaa

SEQ ID NO: 464929 - RNA, 18 nt, Chlamydia trachomatis
agagaagcuccucuucuu

SEQ ID NO: 464930 - RNA, 17 nt, Chlamydia trachomatis
agagaagguaacaaugc

SEQ ID NO: 464931 - RNA, 22 nt, Chlamydia trachomatis
agagaauaaucgagugaucuac

SEQ ID NO: 464932 - RNA, 15 nt, Chlamydia trachomatis
agagaccugcuucag

SEQ ID NO: 464933 - RNA, 22 nt, Chlamydia trachomatis
agagacgcaugcuucuuuaaga

SEQ ID NO: 464934 - RNA, 18 nt, Chlamydia trachomatis
agagaccgcucucuuuuc

SEQ ID NO: 464935 - RNA, 14 nt, Chlamydia trachomatis
agagcaguuguuuu

SEQ ID NO: 464936 - RNA, 22 nt, Chlamydia trachomatis
agagccaugaucaaagaaagcu

SEQ ID NO: 464937 - RNA, 23 nt, Chlamydia trachomatis
agagccccaccagagauaaagcu

SEQ ID NO: 464938 - RNA, 15 nt, Chlamydia trachomatis
agagccaaaacaaac

SEQ ID NO: 464939 - RNA, 16 nt, Chlamydia trachomatis
agaggcccuucuugag

SEQ ID NO: 464940 - RNA, 18 nt, Chlamydia trachomatis
agaggcgcccacagaaca

SEQ ID NO: 464941 - RNA, 17 nt, Chlamydia trachomatis
agaggaguuuuuuucac

SEQ ID NO: 464942 - RNA, 10 nt, Chlamydia trachomatis
agaggauaga

SEQ ID NO: 464943 - RNA, 18 nt, Chlamydia trachomatis
agaggauagaucaagaaa

SEQ ID NO: 464944 - RNA, 21 nt, Chlamydia trachomatis
agaggauuauuccgagagaag

SEQ ID NO: 464945 - RNA, 16 nt, Chlamydia trachomatis
agaggaauaagaggac

SEQ ID NO: 464946 - RNA, 14 nt, Chlamydia trachomatis
agaggagaaaaacu

SEQ ID NO: 464947 - RNA, 17 nt, Chlamydia trachomatis
agaggagaacaagauaa

SEQ ID NO: 464948 - RNA, 13 nt, Chlamydia trachomatis
agaggagggagau

SEQ ID NO: 464949 - RNA, 23 nt, Chlamydia trachomatis
agagcuuuuuuuuucagcaauaa

SEQ ID NO: 464950 - RNA, 21 nt, Chlamydia trachomatis
agagccguucucucuaaaauc

SEQ ID NO: 464951 - RNA, 23 nt, Chlamydia trachomatis
agagccguuuucagguugagcaa

SEQ ID NO: 464952 - RNA, 18 nt, Chlamydia trachomatis
agagcgguugcacaaauc

SEQ ID NO: 464953 - RNA, 20 nt, Chlamydia trachomatis
agagcgguugcacaaaucca

SEQ ID NO: 464954 - RNA, 17 nt, Chlamydia trachomatis
agaggugugauaggaga

SEQ ID NO: 464955 - RNA, 18 nt, Chlamydia trachomatis
agaggugugauaggagag

SEQ ID NO: 464956 - RNA, 15 nt, Chlamydia trachomatis
agaggcgaaaguuuc

SEQ ID NO: 464957 - RNA, 13 nt, Chlamydia trachomatis
agaggcuugagaa

SEQ ID NO: 464958 - RNA, 14 nt, Chlamydia trachomatis
agaguuaggcugcu

SEQ ID NO: 464959 - RNA, 20 nt, Chlamydia trachomatis
agauaaaacuaccugauaga

SEQ ID NO: 464960 - RNA, 22 nt, Chlamydia trachomatis
agauaaagcuuuuucuacugua

SEQ ID NO: 464961 - RNA, 20 nt, Chlamydia trachomatis
agauaacugguguggguaag

SEQ ID NO: 464962 - RNA, 18 nt, Chlamydia trachomatis
agauuguuguaugcucgc

SEQ ID NO: 464963 - RNA, 22 nt, Chlamydia trachomatis
agauaaugacagguuucaugac

SEQ ID NO: 464964 - RNA, 20 nt, Chlamydia trachomatis
agauuuagagaauaaucgag

SEQ ID NO: 464965 - RNA, 13 nt, Chlamydia trachomatis
agauuuccagcuu

SEQ ID NO: 464966 - RNA, 12 nt, Chlamydia trachomatis
agauuucuucug

SEQ ID NO: 464967 - RNA, 20 nt, Chlamydia trachomatis
agauuucuucuguagcccca

SEQ ID NO: 464968 - RNA, 22 nt, Chlamydia trachomatis
agauuucuucuguagccccagu

SEQ ID NO: 464969 - RNA, 12 nt, Chlamydia trachomatis
agauuucuucuu

SEQ ID NO: 464970 - RNA, 14 nt, Chlamydia trachomatis
agauuucuucuuug

SEQ ID NO: 464971 - RNA, 14 nt, Chlamydia trachomatis
agauuugcaaauuc

SEQ ID NO: 464972 - RNA, 20 nt, Chlamydia trachomatis
agauuuguuuaaaagaagcu

SEQ ID NO: 464973 - RNA, 19 nt, Chlamydia trachomatis
agcaaaagaaaaaucuccu

SEQ ID NO: 464974 - RNA, 15 nt, Chlamydia trachomatis
agcaaaaagaggaga

SEQ ID NO: 464975 - RNA, 19 nt, Chlamydia trachomatis
agcaaaaagaggagaacau

SEQ ID NO: 464976 - RNA, 14 nt, Chlamydia trachomatis
agcaaaacauccau

SEQ ID NO: 464977 - RNA, 23 nt, Chlamydia trachomatis
agcaaaaccuuuuacaguuccgc

SEQ ID NO: 464978 - RNA, 17 nt, Chlamydia trachomatis
agcaaaacgcccuccaa

SEQ ID NO: 464979 - RNA, 18 nt, Chlamydia trachomatis
agauuuuaugacccagaa

SEQ ID NO: 464980 - RNA, 13 nt, Chlamydia trachomatis
agauuuucaucuu

SEQ ID NO: 464981 - RNA, 23 nt, Chlamydia trachomatis
agauuuugaauaauagaaaaacu

SEQ ID NO: 464982 - RNA, 17 nt, Chlamydia trachomatis
agauuuuucaaaaauag

SEQ ID NO: 464983 - RNA, 12 nt, Chlamydia trachomatis
agauuuuucagc

SEQ ID NO: 464984 - RNA, 17 nt, Chlamydia trachomatis
agauuuuuuaauaauaa

SEQ ID NO: 464985 - RNA, 18 nt, Chlamydia trachomatis
agauuuuuugagcaaaau

SEQ ID NO: 464986 - RNA, 17 nt, Chlamydia trachomatis
agcaaauagaauaaaag

SEQ ID NO: 464987 - RNA, 14 nt, Chlamydia trachomatis
agcaaauaaagagg

SEQ ID NO: 464988 - RNA, 22 nt, Chlamydia trachomatis
agcaaauagauaacuuugaaca

SEQ ID NO: 464989 - RNA, 20 nt, Chlamydia trachomatis
agcaaauccuacacaagcuu

SEQ ID NO: 464990 - RNA, 20 nt, Chlamydia trachomatis
agcaaaucuggcugaagaag

SEQ ID NO: 464991 - RNA, 15 nt, Chlamydia trachomatis
agcaaauuaacagau

SEQ ID NO: 464992 - RNA, 17 nt, Chlamydia trachomatis
agcaaauuaacagauau

SEQ ID NO: 464993 - RNA, 20 nt, Chlamydia trachomatis
agcaaagcuauuugcaagaa

SEQ ID NO: 464994 - RNA, 19 nt, Chlamydia trachomatis
agcaaacuuuuuguaggua

SEQ ID NO: 464995 - RNA, 16 nt, Chlamydia trachomatis
agcaaacagauucuau

SEQ ID NO: 464996 - RNA, 20 nt, Chlamydia trachomatis
agcaaacagauucuauagga

SEQ ID NO: 464997 - RNA, 23 nt, Chlamydia trachomatis
agcaacauucacgugcgacugcc

SEQ ID NO: 464998 - RNA, 20 nt, Chlamydia trachomatis
agcaaccgauucuucacagc

SEQ ID NO: 464999 - RNA, 17 nt, Chlamydia trachomatis
agcaacaauauccucca

SEQ ID NO: 465000 - RNA, 19 nt, Chlamydia trachomatis
agcaacuucuggcaguaac

SEQ ID NO: 465001 - RNA, 12 nt, Chlamydia trachomatis
agcaagaacaga

SEQ ID NO: 465002 - RNA, 14 nt, Chlamydia trachomatis
agcaagaagcuauc

SEQ ID NO: 465003 - RNA, 14 nt, Chlamydia trachomatis
agcaagagagauug

SEQ ID NO: 465004 - RNA, 18 nt, Chlamydia trachomatis
agcaacucuuucauaaaa

SEQ ID NO: 465005 - RNA, 15 nt, Chlamydia trachomatis
agcaacugcuuucuu

SEQ ID NO: 465006 - RNA, 14 nt, Chlamydia trachomatis
agcaaccuuaucuu

SEQ ID NO: 465007 - RNA, 16 nt, Chlamydia trachomatis
agcaacgauaaacaga

SEQ ID NO: 465008 - RNA, 23 nt, Chlamydia trachomatis
agcaagccccgaaacccaacgca

SEQ ID NO: 465009 - RNA, 15 nt, Chlamydia trachomatis
agcaagcccuugaga

SEQ ID NO: 465010 - RNA, 12 nt, Chlamydia trachomatis
agcaagcucaac

SEQ ID NO: 465011 - RNA, 21 nt, Chlamydia trachomatis
agcaaugccgaaaccaacaag

SEQ ID NO: 465012 - RNA, 17 nt, Chlamydia trachomatis
agcaaugcgaucagaaa

SEQ ID NO: 465013 - RNA, 20 nt, Chlamydia trachomatis
agcaaugcgaucagaaacgu

SEQ ID NO: 465014 - RNA, 23 nt, Chlamydia trachomatis
agcaauagccauuaacaacaaug

SEQ ID NO: 465015 - RNA, 23 nt, Chlamydia trachomatis
agcacaaguugguagcagcuaga

SEQ ID NO: 465016 - RNA, 16 nt, Chlamydia trachomatis
agcaauucaucagcac

SEQ ID NO: 465017 - RNA, 13 nt, Chlamydia trachomatis
agcacacuugaua

SEQ ID NO: 465018 - RNA, 20 nt, Chlamydia trachomatis
agcacacuugauaaauagca

SEQ ID NO: 465019 - RNA, 18 nt, Chlamydia trachomatis
agcacagcggacaauagg

SEQ ID NO: 465020 - RNA, 14 nt, Chlamydia trachomatis
agcaccaaguucuu

SEQ ID NO: 465021 - RNA, 23 nt, Chlamydia trachomatis
agcaccaaguucuucuuuagaaa

SEQ ID NO: 465022 - RNA, 19 nt, Chlamydia trachomatis
agcacauuacuguacuccu

SEQ ID NO: 465023 - RNA, 23 nt, Chlamydia trachomatis
agcaccaagcuccacaggugaau

SEQ ID NO: 465024 - RNA, 17 nt, Chlamydia trachomatis
agcacgcaaaacaucua

SEQ ID NO: 465025 - RNA, 22 nt, Chlamydia trachomatis
agcaccuuuacaaucaucuucc

SEQ ID NO: 465026 - RNA, 23 nt, Chlamydia trachomatis
agcaccuuuacaaucaucuuccc

SEQ ID NO: 465027 - RNA, 15 nt, Chlamydia trachomatis
agcacuacagaucau

SEQ ID NO: 465028 - RNA, 15 nt, Chlamydia trachomatis
agcacuauaucucca

SEQ ID NO: 465029 - RNA, 14 nt, Chlamydia trachomatis
agcacucaaacacu

SEQ ID NO: 465030 - RNA, 20 nt, Chlamydia trachomatis
agcacuggauccuaaaucca

SEQ ID NO: 465031 - RNA, 19 nt, Chlamydia trachomatis
agcacucucaacgaaagcu

SEQ ID NO: 465032 - RNA, 21 nt, Chlamydia trachomatis
agcacuugaucuaucuuucuu

SEQ ID NO: 465033 - RNA, 20 nt, Chlamydia trachomatis
agcagaaacagcuucuucuu

SEQ ID NO: 465034 - RNA, 16 nt, Chlamydia trachomatis
agcagcagaaggugug

SEQ ID NO: 465035 - RNA, 15 nt, Chlamydia trachomatis
agcagaucauccaua

SEQ ID NO: 465036 - RNA, 20 nt, Chlamydia trachomatis
agcagaucauccauaaaaac

SEQ ID NO: 465037 - RNA, 23 nt, Chlamydia trachomatis
agcagauauggaagaacagcagc

SEQ ID NO: 465038 - RNA, 23 nt, Chlamydia trachomatis
agcagauaauucucgcaaagaau

SEQ ID NO: 465039 - RNA, 14 nt, Chlamydia trachomatis
agcagacuuuguuu

SEQ ID NO: 465040 - RNA, 16 nt, Chlamydia trachomatis
agcagagcuuuuacuu

SEQ ID NO: 465041 - RNA, 23 nt, Chlamydia trachomatis
agcagcauucguguguaggaaug

SEQ ID NO: 465042 - RNA, 23 nt, Chlamydia trachomatis
agcagccaauuucucuacccagg

SEQ ID NO: 465043 - RNA, 23 nt, Chlamydia trachomatis
agcagccccccuuuuuuuauucu

SEQ ID NO: 465044 - RNA, 11 nt, Chlamydia trachomatis
agcagcucuua

SEQ ID NO: 465045 - RNA, 16 nt, Chlamydia trachomatis
agcagcucuuacuccu

SEQ ID NO: 465046 - RNA, 17 nt, Chlamydia trachomatis
agcagcuaacagcucuu

SEQ ID NO: 465047 - RNA, 19 nt, Chlamydia trachomatis
agcagcuaauuccauaauc

SEQ ID NO: 465048 - RNA, 21 nt, Chlamydia trachomatis
agcagcgcuuaucagcuucac

SEQ ID NO: 465049 - RNA, 12 nt, Chlamydia trachomatis
agcaggaacuuc

SEQ ID NO: 465050 - RNA, 14 nt, Chlamydia trachomatis
agcaggccucuguu

SEQ ID NO: 465051 - RNA, 15 nt, Chlamydia trachomatis
agcaggccucuguuu

SEQ ID NO: 465052 - RNA, 13 nt, Chlamydia trachomatis
agcaggcgaacag

SEQ ID NO: 465053 - RNA, 17 nt, Chlamydia trachomatis
agcaggcgaacagugac

SEQ ID NO: 465054 - RNA, 21 nt, Chlamydia trachomatis
agcagggaacacagagucugu

SEQ ID NO: 465055 - RNA, 18 nt, Chlamydia trachomatis
agcaguagcuacuucagg

SEQ ID NO: 465056 - RNA, 15 nt, Chlamydia trachomatis
agcagugaagaauga

SEQ ID NO: 465057 - RNA, 21 nt, Chlamydia trachomatis
agcagugagcugguaauuggc

SEQ ID NO: 465058 - RNA, 15 nt, Chlamydia trachomatis
agcaguuguuuucuu

SEQ ID NO: 465059 - RNA, 20 nt, Chlamydia trachomatis
agcauacguuagcaaagaca

SEQ ID NO: 465060 - RNA, 16 nt, Chlamydia trachomatis
agcauagggaucccac

SEQ ID NO: 465061 - RNA, 22 nt, Chlamydia trachomatis
agcauagggaucccacaaagaa

SEQ ID NO: 465062 - RNA, 15 nt, Chlamydia trachomatis
agcauaucuccuaaa

SEQ ID NO: 465063 - RNA, 13 nt, Chlamydia trachomatis
agcaucaguaaaa

SEQ ID NO: 465064 - RNA, 15 nt, Chlamydia trachomatis
agcauccauauauuc

SEQ ID NO: 465065 - RNA, 19 nt, Chlamydia trachomatis
agcauccugaacccgcugc

SEQ ID NO: 465066 - RNA, 17 nt, Chlamydia trachomatis
agcauccccaaaaggau

SEQ ID NO: 465067 - RNA, 19 nt, Chlamydia trachomatis
agcaucuauuuucucuuua

SEQ ID NO: 465068 - RNA, 15 nt, Chlamydia trachomatis
agcaucuucacaguu

SEQ ID NO: 465069 - RNA, 21 nt, Chlamydia trachomatis
agcaucuucucgaaagagaac

SEQ ID NO: 465070 - RNA, 23 nt, Chlamydia trachomatis
agcaucuucucgaaagagaacac

SEQ ID NO: 465071 - RNA, 17 nt, Chlamydia trachomatis
agcaucuuuaccauuuc

SEQ ID NO: 465072 - RNA, 14 nt, Chlamydia trachomatis
agcaugcacaucua

SEQ ID NO: 465073 - RNA, 14 nt, Chlamydia trachomatis
agcaugccuucuuc

SEQ ID NO: 465074 - RNA, 12 nt, Chlamydia trachomatis
agcaucuuuucu

SEQ ID NO: 465075 - RNA, 19 nt, Chlamydia trachomatis
agcaucuuuucuuauaaag

SEQ ID NO: 465076 - RNA, 16 nt, Chlamydia trachomatis
agcauggaagacaaca

SEQ ID NO: 465077 - RNA, 21 nt, Chlamydia trachomatis
agcauguacuucgccuuuaac

SEQ ID NO: 465078 - RNA, 18 nt, Chlamydia trachomatis
agcauguagccaaggaag

SEQ ID NO: 465079 - RNA, 19 nt, Chlamydia trachomatis
agcauguagccaaggaaga

SEQ ID NO: 465080 - RNA, 19 nt, Chlamydia trachomatis
agcauugaacaccauaucc

SEQ ID NO: 465081 - RNA, 21 nt, Chlamydia trachomatis
agcauugaacaccauauccuu

SEQ ID NO: 465082 - RNA, 15 nt, Chlamydia trachomatis
agcauucguuaucaa

SEQ ID NO: 465083 - RNA, 19 nt, Chlamydia trachomatis
agcauucauaaacacagcu

SEQ ID NO: 465084 - RNA, 18 nt, Chlamydia trachomatis
agcauuacacaacucuuu

SEQ ID NO: 465085 - RNA, 16 nt, Chlamydia trachomatis
agcauguguuucugga

SEQ ID NO: 465086 - RNA, 17 nt, Chlamydia trachomatis
agcauguguuucuggaa

SEQ ID NO: 465087 - RNA, 19 nt, Chlamydia trachomatis
agcauuuuccaagaaaaau

SEQ ID NO: 465088 - RNA, 12 nt, Chlamydia trachomatis
agcauuucucuc

SEQ ID NO: 465089 - RNA, 15 nt, Chlamydia trachomatis
agccaagaacaaagc

SEQ ID NO: 465090 - RNA, 20 nt, Chlamydia trachomatis
agccaagcugaggcucuuca

SEQ ID NO: 465091 - RNA, 13 nt, Chlamydia trachomatis
agccaauguucua

SEQ ID NO: 465092 - RNA, 19 nt, Chlamydia trachomatis
agccagcgaggcuucaaua

SEQ ID NO: 465093 - RNA, 13 nt, Chlamydia trachomatis
agccauaauaaaa

SEQ ID NO: 465094 - RNA, 17 nt, Chlamydia trachomatis
agccauaauaaaaggcu

SEQ ID NO: 465095 - RNA, 14 nt, Chlamydia trachomatis
agccauacaaagau

SEQ ID NO: 465096 - RNA, 21 nt, Chlamydia trachomatis
agccaucgccuucuauagcua

SEQ ID NO: 465097 - RNA, 17 nt, Chlamydia trachomatis
agccaugaucaaagaaa

SEQ ID NO: 465098 - RNA, 14 nt, Chlamydia trachomatis
agcccaagcuuuca

SEQ ID NO: 465099 - RNA, 13 nt, Chlamydia trachomatis
agccauuuuguaa

SEQ ID NO: 465100 - RNA, 15 nt, Chlamydia trachomatis
agccauuucgauauu

SEQ ID NO: 465101 - RNA, 23 nt, Chlamydia trachomatis
agccauuuccagccucuccagaa

SEQ ID NO: 465102 - RNA, 20 nt, Chlamydia trachomatis
agcccagaacaacuucucuu

SEQ ID NO: 465103 - RNA, 21 nt, Chlamydia trachomatis
agcccaugguauagaagaccu

SEQ ID NO: 465104 - RNA, 22 nt, Chlamydia trachomatis
agcccaugguauagaagaccuu

SEQ ID NO: 465105 - RNA, 16 nt, Chlamydia trachomatis
agccccaauagcuaag

SEQ ID NO: 465106 - RNA, 17 nt, Chlamydia trachomatis
agcccugcuucacagcu

SEQ ID NO: 465107 - RNA, 19 nt, Chlamydia trachomatis
agcccugcuucacagcuaa

SEQ ID NO: 465108 - RNA, 14 nt, Chlamydia trachomatis
agccguucccaaua

SEQ ID NO: 465109 - RNA, 19 nt, Chlamydia trachomatis
agccuccgguuuccaaaua

SEQ ID NO: 465110 - RNA, 16 nt, Chlamydia trachomatis
agccuccaaacauuuu

SEQ ID NO: 465111 - RNA, 15 nt, Chlamydia trachomatis
agccuacaaauaaag

SEQ ID NO: 465112 - RNA, 14 nt, Chlamydia trachomatis
agccucuccagaaa

SEQ ID NO: 465113 - RNA, 19 nt, Chlamydia trachomatis
agccuucaauucuugcuuc

SEQ ID NO: 465114 - RNA, 15 nt, Chlamydia trachomatis
agccuguuucuuauc

SEQ ID NO: 465115 - RNA, 23 nt, Chlamydia trachomatis
agccuguuucuuaucagcauccc

SEQ ID NO: 465116 - RNA, 18 nt, Chlamydia trachomatis
agccuuacggccccugga

SEQ ID NO: 465117 - RNA, 16 nt, Chlamydia trachomatis
agccuggcugcagaag

SEQ ID NO: 465118 - RNA, 17 nt, Chlamydia trachomatis
agccuggcugcagaaga

SEQ ID NO: 465119 - RNA, 19 nt, Chlamydia trachomatis
agccuggcugcagaagacu

SEQ ID NO: 465120 - RNA, 14 nt, Chlamydia trachomatis
agccugcuuucuuc

SEQ ID NO: 465121 - RNA, 13 nt, Chlamydia trachomatis
agccuuuuauucu

SEQ ID NO: 465122 - RNA, 14 nt, Chlamydia trachomatis
agccuuuuauucuu

SEQ ID NO: 465123 - RNA, 21 nt, Chlamydia trachomatis
agccuuucucuaaaagaagag

SEQ ID NO: 465124 - RNA, 20 nt, Chlamydia trachomatis
agccuuugcuaucagcauac

SEQ ID NO: 465125 - RNA, 22 nt, Chlamydia trachomatis
agccuuuagauaguuacuucca

SEQ ID NO: 465126 - RNA, 21 nt, Chlamydia trachomatis
agcgaaaaaucacaauuuuuc

SEQ ID NO: 465127 - RNA, 19 nt, Chlamydia trachomatis
agcgaaaaaaaaagaacau

SEQ ID NO: 465128 - RNA, 20 nt, Chlamydia trachomatis
agccuuggguucuucugagc

SEQ ID NO: 465129 - RNA, 21 nt, Chlamydia trachomatis
agccuugagccuucaauucuu

SEQ ID NO: 465130 - RNA, 18 nt, Chlamydia trachomatis
agccuucuuucaaaagaa

SEQ ID NO: 465131 - RNA, 12 nt, Chlamydia trachomatis
agccuucuuccu

SEQ ID NO: 465132 - RNA, 18 nt, Chlamydia trachomatis
agcgaaguuuucuugaga

SEQ ID NO: 465133 - RNA, 22 nt, Chlamydia trachomatis
agcgaagucuucuaucacagcu

SEQ ID NO: 465134 - RNA, 19 nt, Chlamydia trachomatis
agcgaacgcuuccugaacg

SEQ ID NO: 465135 - RNA, 21 nt, Chlamydia trachomatis
agcgacacgacuuagcacuca

SEQ ID NO: 465136 - RNA, 17 nt, Chlamydia trachomatis
agcgaggcuucaaagaa

SEQ ID NO: 465137 - RNA, 16 nt, Chlamydia trachomatis
agcgacuucauacaua

SEQ ID NO: 465138 - RNA, 15 nt, Chlamydia trachomatis
agcgaucuuugaaca

SEQ ID NO: 465139 - RNA, 18 nt, Chlamydia trachomatis
agcgaguagagcucuucu

SEQ ID NO: 465140 - RNA, 22 nt, Chlamydia trachomatis
agcgauaucucccgaaacauuu

SEQ ID NO: 465141 - RNA, 23 nt, Chlamydia trachomatis
agcgauugaucuaucgcuugaaa

SEQ ID NO: 465142 - RNA, 17 nt, Chlamydia trachomatis
agcgauuuucaguguug

SEQ ID NO: 465143 - RNA, 13 nt, Chlamydia trachomatis
agcgcauaaguaa

SEQ ID NO: 465144 - RNA, 16 nt, Chlamydia trachomatis
agcgcuccuagugaua

SEQ ID NO: 465145 - RNA, 16 nt, Chlamydia trachomatis
agcgcuuaucagcuuc

SEQ ID NO: 465146 - RNA, 24 nt, Chlamydia trachomatis
agcgcuucccgcuauuuuccucuu

SEQ ID NO: 465147 - RNA, 22 nt, Chlamydia trachomatis
agcgcuuguaugguuuguccuu

SEQ ID NO: 465148 - RNA, 22 nt, Chlamydia trachomatis
agcgguugcucgauccaaagcc

SEQ ID NO: 465149 - RNA, 18 nt, Chlamydia trachomatis
agcguucgcgucuagcuu

SEQ ID NO: 465150 - RNA, 19 nt, Chlamydia trachomatis
agcgugcauggcagaugca

SEQ ID NO: 465151 - RNA, 17 nt, Chlamydia trachomatis
agcguuuuccccuugca

SEQ ID NO: 465152 - RNA, 20 nt, Chlamydia trachomatis
agcuacgguuucaagagcau

SEQ ID NO: 465153 - RNA, 17 nt, Chlamydia trachomatis
agcuacuagauagaugg

SEQ ID NO: 465154 - RNA, 14 nt, Chlamydia trachomatis
agcuagaagaagag

SEQ ID NO: 465155 - RNA, 21 nt, Chlamydia trachomatis
agcuagguaaagguuucugga

SEQ ID NO: 465156 - RNA, 19 nt, Chlamydia trachomatis
agcuaguucagacagagaa

SEQ ID NO: 465157 - RNA, 21 nt, Chlamydia trachomatis
agcuaguucagacagagaaga

SEQ ID NO: 465158 - RNA, 18 nt, Chlamydia trachomatis
agcucccugcucuugaag

SEQ ID NO: 465159 - RNA, 21 nt, Chlamydia trachomatis
agcuccaggaaaagcuuuguu

SEQ ID NO: 465160 - RNA, 12 nt, Chlamydia trachomatis
agcuccaaagaa

SEQ ID NO: 465161 - RNA, 22 nt, Chlamydia trachomatis
agcuccaaagaacagcgaagaa

SEQ ID NO: 465162 - RNA, 16 nt, Chlamydia trachomatis
agcuccuagagccaau

SEQ ID NO: 465163 - RNA, 16 nt, Chlamydia trachomatis
agcuccucuucuucug

SEQ ID NO: 465164 - RNA, 19 nt, Chlamydia trachomatis
agcucgaauacgaggagcu

SEQ ID NO: 465165 - RNA, 23 nt, Chlamydia trachomatis
agcugcugcccaagagauuuuuu

SEQ ID NO: 465166 - RNA, 23 nt, Chlamydia trachomatis
agcugagcuucucgcuacaaauc

SEQ ID NO: 465167 - RNA, 18 nt, Chlamydia trachomatis
agcugagucuugugcucu

SEQ ID NO: 465168 - RNA, 21 nt, Chlamydia trachomatis
agcugauguaagcgagauaag

SEQ ID NO: 465169 - RNA, 20 nt, Chlamydia trachomatis
agcucuuuccucuagcagag

SEQ ID NO: 465170 - RNA, 20 nt, Chlamydia trachomatis
agcucuucuucugaagagaa

SEQ ID NO: 465171 - RNA, 22 nt, Chlamydia trachomatis
agcucguucacuaugaacaaac

SEQ ID NO: 465172 - RNA, 18 nt, Chlamydia trachomatis
aguacguguuaucaaagu

SEQ ID NO: 465173 - RNA, 15 nt, Chlamydia trachomatis
aguacugcuacaaaa

SEQ ID NO: 465174 - RNA, 15 nt, Chlamydia trachomatis
aguacuucuaaaauu

SEQ ID NO: 465175 - RNA, 17 nt, Chlamydia trachomatis
aguacuuuaccuguagg

SEQ ID NO: 465176 - RNA, 16 nt, Chlamydia trachomatis
aguagacagcucuugc

SEQ ID NO: 465177 - RNA, 14 nt, Chlamydia trachomatis
aguagaccauuuag

SEQ ID NO: 465178 - RNA, 15 nt, Chlamydia trachomatis
aguagaccauuuaga

SEQ ID NO: 465179 - RNA, 16 nt, Chlamydia trachomatis
aguagacgaaguagga

SEQ ID NO: 465180 - RNA, 20 nt, Chlamydia trachomatis
aguagugguaagggguuuuc

SEQ ID NO: 465181 - RNA, 16 nt, Chlamydia trachomatis
aguauaaaaaaagucu

SEQ ID NO: 465182 - RNA, 15 nt, Chlamydia trachomatis
aguaggggaauuuau

SEQ ID NO: 465183 - RNA, 19 nt, Chlamydia trachomatis
aguagguaucugaaucugu

SEQ ID NO: 465184 - RNA, 22 nt, Chlamydia trachomatis
aguagguaucugaaucuguguu

SEQ ID NO: 465185 - RNA, 19 nt, Chlamydia trachomatis
aguaggacucuaagagaac

SEQ ID NO: 465186 - RNA, 21 nt, Chlamydia trachomatis
aguagcaaauuaacagauaua

SEQ ID NO: 465187 - RNA, 21 nt, Chlamydia trachomatis
aguagcauugcgcagaucucc

SEQ ID NO: 465188 - RNA, 13 nt, Chlamydia trachomatis
aguauuaaggaaa

SEQ ID NO: 465189 - RNA, 12 nt, Chlamydia trachomatis
aguauucuucug

SEQ ID NO: 465190 - RNA, 20 nt, Chlamydia trachomatis
aguauuggagacaacaaguu

SEQ ID NO: 465191 - RNA, 15 nt, Chlamydia trachomatis
aguauuuucaaaaau

SEQ ID NO: 465192 - RNA, 21 nt, Chlamydia trachomatis
aguauuuucaaaaauaaugcc

SEQ ID NO: 465193 - RNA, 22 nt, Chlamydia trachomatis
aguaucuuugauagcaacaguu

SEQ ID NO: 465194 - RNA, 18 nt, Chlamydia trachomatis
agucaagaagccuugagc

SEQ ID NO: 465195 - RNA, 14 nt, Chlamydia trachomatis
agucaccauuuucu

SEQ ID NO: 465196 - RNA, 19 nt, Chlamydia trachomatis
agucacggcaggaaagugc

SEQ ID NO: 465197 - RNA, 21 nt, Chlamydia trachomatis
agucagaugaguuuaucucau

SEQ ID NO: 465198 - RNA, 19 nt, Chlamydia trachomatis
aguccagggaaaagagcua

SEQ ID NO: 465199 - RNA, 13 nt, Chlamydia trachomatis
aguccaacgcugc

SEQ ID NO: 465200 - RNA, 14 nt, Chlamydia trachomatis
aguccaagauuauc

SEQ ID NO: 465201 - RNA, 15 nt, Chlamydia trachomatis
aguccgcgauuuucu

SEQ ID NO: 465202 - RNA, 19 nt, Chlamydia trachomatis
aguccugcuucuuuuuccc

SEQ ID NO: 465203 - RNA, 19 nt, Chlamydia trachomatis
aguccuggagggaaaacac

SEQ ID NO: 465204 - RNA, 14 nt, Chlamydia trachomatis
aguccgcaaacaaa

SEQ ID NO: 465205 - RNA, 19 nt, Chlamydia trachomatis
agucgaguuuugaggaaga

SEQ ID NO: 465206 - RNA, 20 nt, Chlamydia trachomatis
agugaaugcuccauacgcug

SEQ ID NO: 465207 - RNA, 17 nt, Chlamydia trachomatis
agugaucuacagcugua

SEQ ID NO: 465208 - RNA, 17 nt, Chlamydia trachomatis
agucucgacgcucauaa

SEQ ID NO: 465209 - RNA, 20 nt, Chlamydia trachomatis
agucucguccaugaccaagg

SEQ ID NO: 465210 - RNA, 20 nt, Chlamydia trachomatis
agucucuaacaacaguucuu

SEQ ID NO: 465211 - RNA, 19 nt, Chlamydia trachomatis
agucucgcgcuaaaaccuu

SEQ ID NO: 465212 - RNA, 20 nt, Chlamydia trachomatis
agucucgcgcuaaaaccuua

SEQ ID NO: 465213 - RNA, 13 nt, Chlamydia trachomatis
agugauguauucc

SEQ ID NO: 465214 - RNA, 16 nt, Chlamydia trachomatis
agugccaauugucaag

SEQ ID NO: 465215 - RNA, 20 nt, Chlamydia trachomatis
agugccagacccuuccaaau

SEQ ID NO: 465216 - RNA, 13 nt, Chlamydia trachomatis
aguggaacugcuu

SEQ ID NO: 465217 - RNA, 12 nt, Chlamydia trachomatis
auaaccugaccu

SEQ ID NO: 465218 - RNA, 13 nt, Chlamydia trachomatis
auaacgauaguac

SEQ ID NO: 465219 - RNA, 22 nt, Chlamydia trachomatis
auaacgauucuugauaaauaau

SEQ ID NO: 465220 - RNA, 13 nt, Chlamydia trachomatis
auaacgcauuucu

SEQ ID NO: 465221 - RNA, 19 nt, Chlamydia trachomatis
auaaccagaauccuuuuca

SEQ ID NO: 465222 - RNA, 17 nt, Chlamydia trachomatis
auaacaaggcuuuucca

SEQ ID NO: 465223 - RNA, 12 nt, Chlamydia trachomatis
auaacaauccua

SEQ ID NO: 465224 - RNA, 14 nt, Chlamydia trachomatis
auaacaauccuaga

SEQ ID NO: 465225 - RNA, 17 nt, Chlamydia trachomatis
auaaagacccucuaaau

SEQ ID NO: 465226 - RNA, 23 nt, Chlamydia trachomatis
auaaagagagaggagaaaaacuc

SEQ ID NO: 465227 - RNA, 21 nt, Chlamydia trachomatis
auaaaguccggacuuuccucu

SEQ ID NO: 465228 - RNA, 22 nt, Chlamydia trachomatis
auaaaguccggacuuuccucug

SEQ ID NO: 465229 - RNA, 14 nt, Chlamydia trachomatis
auaaaucacaaugc

SEQ ID NO: 465230 - RNA, 14 nt, Chlamydia trachomatis
auaaaucaguggaa

SEQ ID NO: 465231 - RNA, 15 nt, Chlamydia trachomatis
auaaaugauaauccu

SEQ ID NO: 465232 - RNA, 16 nt, Chlamydia trachomatis
auaaaacgaaaaacag

SEQ ID NO: 465233 - RNA, 21 nt, Chlamydia trachomatis
auaaaacucuccaaacucuau

SEQ ID NO: 465234 - RNA, 15 nt, Chlamydia trachomatis
auaaaacuuguuccu

SEQ ID NO: 465235 - RNA, 20 nt, Chlamydia trachomatis
auaaaacuuguuccuaauuu

SEQ ID NO: 465236 - RNA, 22 nt, Chlamydia trachomatis
auaaaagaagcagcgcuuauca

SEQ ID NO: 465237 - RNA, 17 nt, Chlamydia trachomatis
auaaaagacagaacaaa

SEQ ID NO: 465238 - RNA, 14 nt, Chlamydia trachomatis
auaaaagagaagaa

SEQ ID NO: 465239 - RNA, 22 nt, Chlamydia trachomatis
auaaaagcuccuaaagaaggca

SEQ ID NO: 465240 - RNA, 19 nt, Chlamydia trachomatis
auaaaagggcucucuccua

SEQ ID NO: 465241 - RNA, 16 nt, Chlamydia trachomatis
auaaaaucaaauaaag

SEQ ID NO: 465242 - RNA, 15 nt, Chlamydia trachomatis
auaaaauggaaauaa

SEQ ID NO: 465243 - RNA, 22 nt, Chlamydia trachomatis
auaaaauggaaauaaaaagccc

SEQ ID NO: 465244 - RNA, 14 nt, Chlamydia trachomatis
auaaaauuccuacg

SEQ ID NO: 465245 - RNA, 21 nt, Chlamydia trachomatis
auaaaccaaaggcaacaaagg

SEQ ID NO: 465246 - RNA, 23 nt, Chlamydia trachomatis
auaaacuuuaccgacuucaacuu

SEQ ID NO: 465247 - RNA, 14 nt, Chlamydia trachomatis
aguuaccaaucacg

SEQ ID NO: 465248 - RNA, 20 nt, Chlamydia trachomatis
aguuaccaaucacgcuacau

SEQ ID NO: 465249 - RNA, 15 nt, Chlamydia trachomatis
aguuauauugcuuca

SEQ ID NO: 465250 - RNA, 22 nt, Chlamydia trachomatis
aguuauauugcuucauaaaaaa

SEQ ID NO: 465251 - RNA, 24 nt, Chlamydia trachomatis
aguucacugacuguagaaaaucau

SEQ ID NO: 465252 - RNA, 17 nt, Chlamydia trachomatis
aguuccgguauauucuu

SEQ ID NO: 465253 - RNA, 20 nt, Chlamydia trachomatis
aguucccuuuacaaugauga

SEQ ID NO: 465254 - RNA, 23 nt, Chlamydia trachomatis
aguucccuuuacaaugaugagaa

SEQ ID NO: 465255 - RNA, 17 nt, Chlamydia trachomatis
aguuccgaauaagcauu

SEQ ID NO: 465256 - RNA, 17 nt, Chlamydia trachomatis
aguuccgcagagaucua

SEQ ID NO: 465257 - RNA, 14 nt, Chlamydia trachomatis
aguucuucuuccac

SEQ ID NO: 465258 - RNA, 20 nt, Chlamydia trachomatis
aguucuucuuccacagaagu

SEQ ID NO: 465259 - RNA, 13 nt, Chlamydia trachomatis
aguucuccuucuu

SEQ ID NO: 465260 - RNA, 20 nt, Chlamydia trachomatis
aguucuuuauaacucucagc

SEQ ID NO: 465261 - RNA, 17 nt, Chlamydia trachomatis
aguucuaacacuuuuuu

SEQ ID NO: 465262 - RNA, 23 nt, Chlamydia trachomatis
aguucgcuauaaucccaaaaaca

SEQ ID NO: 465263 - RNA, 11 nt, Chlamydia trachomatis
aguucuaacuu

SEQ ID NO: 465264 - RNA, 19 nt, Chlamydia trachomatis
aguuuauggaaaagaucuu

SEQ ID NO: 465265 - RNA, 19 nt, Chlamydia trachomatis
aguuguggggcuccuaaca

SEQ ID NO: 465266 - RNA, 18 nt, Chlamydia trachomatis
aguugguacacuucuuua

SEQ ID NO: 465267 - RNA, 21 nt, Chlamydia trachomatis
aguugguagagcaacgcauuc

SEQ ID NO: 465268 - RNA, 17 nt, Chlamydia trachomatis
aguugguagaggagaac

SEQ ID NO: 465269 - RNA, 17 nt, Chlamydia trachomatis
aguugccccuuauuuac

SEQ ID NO: 465270 - RNA, 13 nt, Chlamydia trachomatis
aguugcgccuucu

SEQ ID NO: 465271 - RNA, 17 nt, Chlamydia trachomatis
aguucuuuuuccucuuc

SEQ ID NO: 465272 - RNA, 19 nt, Chlamydia trachomatis
aguugaucuuccucuugaa

SEQ ID NO: 465273 - RNA, 14 nt, Chlamydia trachomatis
aguuuggagcagcu

SEQ ID NO: 465274 - RNA, 20 nt, Chlamydia trachomatis
aguuuuaggcguuccugcau

SEQ ID NO: 465275 - RNA, 19 nt, Chlamydia trachomatis
aguuuucgaauuuuuuucu

SEQ ID NO: 465276 - RNA, 20 nt, Chlamydia trachomatis
aguuuuuauggaugaucugc

SEQ ID NO: 465277 - RNA, 20 nt, Chlamydia trachomatis
aguuuuucuccucucucuuu

SEQ ID NO: 465278 - RNA, 22 nt, Chlamydia trachomatis
auaaaaaccuugauaagagucu

SEQ ID NO: 465279 - RNA, 20 nt, Chlamydia trachomatis
auaaugggccguuuuucucc

SEQ ID NO: 465280 - RNA, 16 nt, Chlamydia trachomatis
auaaugggcuccuuca

SEQ ID NO: 465281 - RNA, 21 nt, Chlamydia trachomatis
auaaugauucccagggagagu

SEQ ID NO: 465282 - RNA, 22 nt, Chlamydia trachomatis
auaauccuaugcaguaaagaaa

SEQ ID NO: 465283 - RNA, 21 nt, Chlamydia trachomatis
auaaucuauuuuauacuucuu

SEQ ID NO: 465284 - RNA, 13 nt, Chlamydia trachomatis
auaaucccaaaaa

SEQ ID NO: 465285 - RNA, 14 nt, Chlamydia trachomatis
auaaucccaaaaac

SEQ ID NO: 465286 - RNA, 13 nt, Chlamydia trachomatis
auaauuuccccua

SEQ ID NO: 465287 - RNA, 21 nt, Chlamydia trachomatis
auaauuuccggacacacucuc

SEQ ID NO: 465288 - RNA, 15 nt, Chlamydia trachomatis
auaauuucugagucc

SEQ ID NO: 465289 - RNA, 18 nt, Chlamydia trachomatis
auaauuugacuaggauua

SEQ ID NO: 465290 - RNA, 13 nt, Chlamydia trachomatis
auaauuuuccaca

SEQ ID NO: 465291 - RNA, 14 nt, Chlamydia trachomatis
auaauuuuccuuuu

SEQ ID NO: 465292 - RNA, 19 nt, Chlamydia trachomatis
auaauuuuccuuuuuccca

SEQ ID NO: 465293 - RNA, 23 nt, Chlamydia trachomatis
auacaaagcagccacuccugcag

SEQ ID NO: 465294 - RNA, 21 nt, Chlamydia trachomatis
auacaaaccgaagagggaaga

SEQ ID NO: 465295 - RNA, 21 nt, Chlamydia trachomatis
auacaccgcaucagccccaaa

SEQ ID NO: 465296 - RNA, 16 nt, Chlamydia trachomatis
auacaccugcaagaga

SEQ ID NO: 465297 - RNA, 22 nt, Chlamydia trachomatis
auacaugcuuuugaucuuucca

SEQ ID NO: 465298 - RNA, 19 nt, Chlamydia trachomatis
auacauuauguaagaguuu

SEQ ID NO: 465299 - RNA, 14 nt, Chlamydia trachomatis
auacaucagagcaa

SEQ ID NO: 465300 - RNA, 21 nt, Chlamydia trachomatis
auacaucagagcaauagacac

SEQ ID NO: 465301 - RNA, 15 nt, Chlamydia trachomatis
auacaucaucucuca

SEQ ID NO: 465302 - RNA, 16 nt, Chlamydia trachomatis
auacagccuuggauuu

SEQ ID NO: 465303 - RNA, 22 nt, Chlamydia trachomatis
auacagagccuuuuauucuuca

SEQ ID NO: 465304 - RNA, 23 nt, Chlamydia trachomatis
auaccccuaaaggaaguagagaa

SEQ ID NO: 465305 - RNA, 12 nt, Chlamydia trachomatis
auacccuaaauu

SEQ ID NO: 465306 - RNA, 23 nt, Chlamydia trachomatis
auacccgacuaaaaaauuuugag

SEQ ID NO: 465307 - RNA, 19 nt, Chlamydia trachomatis
auaccaaaaaacauuccug

SEQ ID NO: 465308 - RNA, 16 nt, Chlamydia trachomatis
auaccaaaauaucaua

SEQ ID NO: 465309 - RNA, 11 nt, Chlamydia trachomatis
auaccaaaauc

SEQ ID NO: 465310 - RNA, 18 nt, Chlamydia trachomatis
auaccaaagcauuuuuaa

SEQ ID NO: 465311 - RNA, 16 nt, Chlamydia trachomatis
auaccaagccauuucc

SEQ ID NO: 465312 - RNA, 18 nt, Chlamydia trachomatis
auaccaagccauuuccag

SEQ ID NO: 465313 - RNA, 20 nt, Chlamydia trachomatis
auaccacaauuuuucuugua

SEQ ID NO: 465314 - RNA, 17 nt, Chlamydia trachomatis
auaccuaaagaagccau

SEQ ID NO: 465315 - RNA, 20 nt, Chlamydia trachomatis
auaccuacacgauauaucca

SEQ ID NO: 465316 - RNA, 16 nt, Chlamydia trachomatis
auaccuagcaauucau

SEQ ID NO: 465317 - RNA, 14 nt, Chlamydia trachomatis
auaccuauuccaaa

SEQ ID NO: 465318 - RNA, 23 nt, Chlamydia trachomatis
auaccuuuugcaaucauuugugu

SEQ ID NO: 465319 - RNA, 17 nt, Chlamydia trachomatis
auacgaaauaacaaagc

SEQ ID NO: 465320 - RNA, 18 nt, Chlamydia trachomatis
auacgaaauaacaaagca

SEQ ID NO: 465321 - RNA, 15 nt, Chlamydia trachomatis
auacgaaaugacaca

SEQ ID NO: 465322 - RNA, 16 nt, Chlamydia trachomatis
auacgcugguauacca

SEQ ID NO: 465323 - RNA, 20 nt, Chlamydia trachomatis
auacggacggacaaauuucu

SEQ ID NO: 465324 - RNA, 17 nt, Chlamydia trachomatis
auacuaaacuaucuaaa

SEQ ID NO: 465325 - RNA, 18 nt, Chlamydia trachomatis
auacuaaacuaucuaaaa

SEQ ID NO: 465326 - RNA, 18 nt, Chlamydia trachomatis
auagacaacguuuaauga

SEQ ID NO: 465327 - RNA, 16 nt, Chlamydia trachomatis
auagacaagacuucuu

SEQ ID NO: 465328 - RNA, 21 nt, Chlamydia trachomatis
auagacaagacuucuucuaaa

SEQ ID NO: 465329 - RNA, 14 nt, Chlamydia trachomatis
auagaccagagucu

SEQ ID NO: 465330 - RNA, 17 nt, Chlamydia trachomatis
auagauaggcaggaaga

SEQ ID NO: 465331 - RNA, 13 nt, Chlamydia trachomatis
auagcaagcccuu

SEQ ID NO: 465332 - RNA, 16 nt, Chlamydia trachomatis
auagcaacucuuucau

SEQ ID NO: 465333 - RNA, 20 nt, Chlamydia trachomatis
auagcagugaaaucagagau

SEQ ID NO: 465334 - RNA, 22 nt, Chlamydia trachomatis
auagcaaagaagacauggcucu

SEQ ID NO: 465335 - RNA, 15 nt, Chlamydia trachomatis
auagcaucuggaaca

SEQ ID NO: 465336 - RNA, 17 nt, Chlamydia trachomatis
auagcaugcaaaacagc

SEQ ID NO: 465337 - RNA, 13 nt, Chlamydia trachomatis
auagccaaagguu

SEQ ID NO: 465338 - RNA, 12 nt, Chlamydia trachomatis
auagaaaaaaac

SEQ ID NO: 465339 - RNA, 19 nt, Chlamydia trachomatis
auagaaaccuuauauaccg

SEQ ID NO: 465340 - RNA, 20 nt, Chlamydia trachomatis
auagaaacacgcaacccuaa

SEQ ID NO: 465341 - RNA, 14 nt, Chlamydia trachomatis
auagaaagauagau

SEQ ID NO: 465342 - RNA, 18 nt, Chlamydia trachomatis
auagaaccccucuuuuuu

SEQ ID NO: 465343 - RNA, 18 nt, Chlamydia trachomatis
auagaaggaaugcagauc

SEQ ID NO: 465344 - RNA, 17 nt, Chlamydia trachomatis
auagaaggucugaacaa

SEQ ID NO: 465345 - RNA, 19 nt, Chlamydia trachomatis
auagaaguuacuuuucuca

SEQ ID NO: 465346 - RNA, 12 nt, Chlamydia trachomatis
auagaauggcgc

SEQ ID NO: 465347 - RNA, 13 nt, Chlamydia trachomatis
auagaauggcgcu

SEQ ID NO: 465348 - RNA, 15 nt, Chlamydia trachomatis
auagaauuucuuccu

SEQ ID NO: 465349 - RNA, 22 nt, Chlamydia trachomatis
auagaauuucuuccucuaauuu

SEQ ID NO: 465350 - RNA, 15 nt, Chlamydia trachomatis
auagaauuuuucuaa

SEQ ID NO: 465351 - RNA, 18 nt, Chlamydia trachomatis
auauaaagccccuccgcu

SEQ ID NO: 465352 - RNA, 20 nt, Chlamydia trachomatis
auaguccuucggagagcagu

SEQ ID NO: 465353 - RNA, 12 nt, Chlamydia trachomatis
auagucugcauu

SEQ ID NO: 465354 - RNA, 18 nt, Chlamydia trachomatis
auagccuuaauagugcgu

SEQ ID NO: 465355 - RNA, 17 nt, Chlamydia trachomatis
auagccuccuuaaucaa

SEQ ID NO: 465356 - RNA, 20 nt, Chlamydia trachomatis
auaguauuuuugaaaccaag

SEQ ID NO: 465357 - RNA, 14 nt, Chlamydia trachomatis
auaguccaugugag

SEQ ID NO: 465358 - RNA, 16 nt, Chlamydia trachomatis
auauaggcuuccaaau

SEQ ID NO: 465359 - RNA, 18 nt, Chlamydia trachomatis
auauagguuccaucuaaa

SEQ ID NO: 465360 - RNA, 23 nt, Chlamydia trachomatis
auauagguuccaucuaaaggcaa

SEQ ID NO: 465361 - RNA, 19 nt, Chlamydia trachomatis
auauagauuuuagaaggau

SEQ ID NO: 465362 - RNA, 20 nt, Chlamydia trachomatis
auauagcauggaagacaaca

SEQ ID NO: 465363 - RNA, 11 nt, Chlamydia trachomatis
auauaguuuuc

SEQ ID NO: 465364 - RNA, 22 nt, Chlamydia trachomatis
auauaagcuuggcgguuuuuuu

SEQ ID NO: 465365 - RNA, 19 nt, Chlamydia trachomatis
auauaaguucagccccuaa

SEQ ID NO: 465366 - RNA, 17 nt, Chlamydia trachomatis
auauccaucauaaaaag

SEQ ID NO: 465367 - RNA, 20 nt, Chlamydia trachomatis
auauccaucauaaaaagaua

SEQ ID NO: 465368 - RNA, 15 nt, Chlamydia trachomatis
auauccaucuacagc

SEQ ID NO: 465369 - RNA, 17 nt, Chlamydia trachomatis
auauccaugaucucugc

SEQ ID NO: 465370 - RNA, 18 nt, Chlamydia trachomatis
auauccaugaucucugca

SEQ ID NO: 465371 - RNA, 18 nt, Chlamydia trachomatis
auauccauaacuuuaaua

SEQ ID NO: 465372 - RNA, 13 nt, Chlamydia trachomatis
auauauccauuca

SEQ ID NO: 465373 - RNA, 13 nt, Chlamydia trachomatis
auauaucuguaac

SEQ ID NO: 465374 - RNA, 19 nt, Chlamydia trachomatis
auauccguaaggaagccag

SEQ ID NO: 465375 - RNA, 20 nt, Chlamydia trachomatis
auauccguaaggaagccagc

SEQ ID NO: 465376 - RNA, 22 nt, Chlamydia trachomatis
auaucccacucuuccccuucuu

SEQ ID NO: 465377 - RNA, 18 nt, Chlamydia trachomatis
auaucguaaccagcggca

SEQ ID NO: 465378 - RNA, 23 nt, Chlamydia trachomatis
auaucgcguccaaaaagcguguc

SEQ ID NO: 465379 - RNA, 23 nt, Chlamydia trachomatis
auaugccucuaagcaccuuuaca

SEQ ID NO: 465380 - RNA, 15 nt, Chlamydia trachomatis
auaugccugcaaaaa

SEQ ID NO: 465381 - RNA, 17 nt, Chlamydia trachomatis
auaugcagcauccaaua

SEQ ID NO: 465382 - RNA, 15 nt, Chlamydia trachomatis
auaugcgucuucccu

SEQ ID NO: 465383 - RNA, 18 nt, Chlamydia trachomatis
auaugcuuuuuaauaucc

SEQ ID NO: 465384 - RNA, 20 nt, Chlamydia trachomatis
auaugcuuuuuaauauccuc

SEQ ID NO: 465385 - RNA, 19 nt, Chlamydia trachomatis
auaucuccaccauagcacu

SEQ ID NO: 465386 - RNA, 22 nt, Chlamydia trachomatis
auaucugcagcggcgaaaauuu

SEQ ID NO: 465387 - RNA, 17 nt, Chlamydia trachomatis
auauggucgucucagcu

SEQ ID NO: 465388 - RNA, 16 nt, Chlamydia trachomatis
auaugguaauggcugu

SEQ ID NO: 465389 - RNA, 13 nt, Chlamydia trachomatis
auauguugccacu

SEQ ID NO: 465390 - RNA, 17 nt, Chlamydia trachomatis
auauuagauagcuucuu

SEQ ID NO: 465391 - RNA, 22 nt, Chlamydia trachomatis
auauucuuugucacaaauuacc

SEQ ID NO: 465392 - RNA, 19 nt, Chlamydia trachomatis
auauuccauaauaguuaaa

SEQ ID NO: 465393 - RNA, 17 nt, Chlamydia trachomatis
auauucccuucuauuuc

SEQ ID NO: 465394 - RNA, 15 nt, Chlamydia trachomatis
auauucauauguuac

SEQ ID NO: 465395 - RNA, 12 nt, Chlamydia trachomatis
auauugcuucau

SEQ ID NO: 465396 - RNA, 19 nt, Chlamydia trachomatis
auauugcuucauaaaaaag

SEQ ID NO: 465397 - RNA, 21 nt, Chlamydia trachomatis
auauugcuucauaaaaaagac

SEQ ID NO: 465398 - RNA, 21 nt, Chlamydia trachomatis
auauuggaagauaacaauccu

SEQ ID NO: 465399 - RNA, 22 nt, Chlamydia trachomatis
auauuggagccuacguccugau

SEQ ID NO: 465400 - RNA, 19 nt, Chlamydia trachomatis
auauuucuuguguugaaua

SEQ ID NO: 465401 - RNA, 19 nt, Chlamydia trachomatis
aucaaaaucaauaaugucu

SEQ ID NO: 465402 - RNA, 21 nt, Chlamydia trachomatis
aucaaagaaucuuugucuuug

SEQ ID NO: 465403 - RNA, 14 nt, Chlamydia trachomatis
aucaagaaucgcuu

SEQ ID NO: 465404 - RNA, 19 nt, Chlamydia trachomatis
aucaauaccuagcaauuca

SEQ ID NO: 465405 - RNA, 13 nt, Chlamydia trachomatis
aucaacuguucug

SEQ ID NO: 465406 - RNA, 15 nt, Chlamydia trachomatis
aucaacguuuucacu

SEQ ID NO: 465407 - RNA, 17 nt, Chlamydia trachomatis
aucaaauuuuucagaaa

SEQ ID NO: 465408 - RNA, 17 nt, Chlamydia trachomatis
aucaacagaagaaggca

SEQ ID NO: 465409 - RNA, 20 nt, Chlamydia trachomatis
aucaguggaacugcuucccu

SEQ ID NO: 465410 - RNA, 18 nt, Chlamydia trachomatis
aucauaaagucuaccagu

SEQ ID NO: 465411 - RNA, 20 nt, Chlamydia trachomatis
aucauaacaugguugauuug

SEQ ID NO: 465412 - RNA, 13 nt, Chlamydia trachomatis
aucauaccaauau

SEQ ID NO: 465413 - RNA, 19 nt, Chlamydia trachomatis
aucauagaaacgaggagau

SEQ ID NO: 465414 - RNA, 15 nt, Chlamydia trachomatis
aucauagccaucauc

SEQ ID NO: 465415 - RNA, 17 nt, Chlamydia trachomatis
aucauaggcuccugcaa

SEQ ID NO: 465416 - RNA, 22 nt, Chlamydia trachomatis
aucauaucaagaauuucuugaa

SEQ ID NO: 465417 - RNA, 16 nt, Chlamydia trachomatis
aucaauccgccuccgg

SEQ ID NO: 465418 - RNA, 19 nt, Chlamydia trachomatis
aucaggaauauuaagaucc

SEQ ID NO: 465419 - RNA, 19 nt, Chlamydia trachomatis
aucaggaucagcauguacu

SEQ ID NO: 465420 - RNA, 14 nt, Chlamydia trachomatis
aucaguaaaaauaa

SEQ ID NO: 465421 - RNA, 15 nt, Chlamydia trachomatis
aucaugggaaauaaa

SEQ ID NO: 465422 - RNA, 16 nt, Chlamydia trachomatis
aucaugguugcuguug

SEQ ID NO: 465423 - RNA, 14 nt, Chlamydia trachomatis
aucauguugcguuu

SEQ ID NO: 465424 - RNA, 15 nt, Chlamydia trachomatis
aucauguugcguuug

SEQ ID NO: 465425 - RNA, 18 nt, Chlamydia trachomatis
aucauuauccauaaaaau

SEQ ID NO: 465426 - RNA, 19 nt, Chlamydia trachomatis
aucauuauccauaaaaaua

SEQ ID NO: 465427 - RNA, 21 nt, Chlamydia trachomatis
aucauuauccauaaaaauaau

SEQ ID NO: 465428 - RNA, 19 nt, Chlamydia trachomatis
aucauggaaaauauggcuc

SEQ ID NO: 465429 - RNA, 15 nt, Chlamydia trachomatis
aucaugaugaugaga

SEQ ID NO: 465430 - RNA, 21 nt, Chlamydia trachomatis
aucaucaaccgcgacagccac

SEQ ID NO: 465431 - RNA, 11 nt, Chlamydia trachomatis
aucauuuccaa

SEQ ID NO: 465432 - RNA, 18 nt, Chlamydia trachomatis
aucauugggucugaucca

SEQ ID NO: 465433 - RNA, 22 nt, Chlamydia trachomatis
aucauucuuagugaaugcucca

SEQ ID NO: 465434 - RNA, 22 nt, Chlamydia trachomatis
auccaaaaaagaaucuaaaaag

SEQ ID NO: 465435 - RNA, 23 nt, Chlamydia trachomatis
auccaaaaaagaaucuaaaaagc

SEQ ID NO: 465436 - RNA, 13 nt, Chlamydia trachomatis
auccaaaaaagug

SEQ ID NO: 465437 - RNA, 19 nt, Chlamydia trachomatis
auccaaaaauugaaagaga

SEQ ID NO: 465438 - RNA, 14 nt, Chlamydia trachomatis
auccaaaacauaag

SEQ ID NO: 465439 - RNA, 22 nt, Chlamydia trachomatis
auccaaaacaucccagcaauac

SEQ ID NO: 465440 - RNA, 15 nt, Chlamydia trachomatis
auccaaaguacucag

SEQ ID NO: 465441 - RNA, 23 nt, Chlamydia trachomatis
auccaaauaaacacacuggguau

SEQ ID NO: 465442 - RNA, 15 nt, Chlamydia trachomatis
auccaaggaaaccaa

SEQ ID NO: 465443 - RNA, 15 nt, Chlamydia trachomatis
auccacgaauuuucu

SEQ ID NO: 465444 - RNA, 23 nt, Chlamydia trachomatis
auccaccguacgauauccaucau

SEQ ID NO: 465445 - RNA, 19 nt, Chlamydia trachomatis
auccacuggaauagcuaga

SEQ ID NO: 465446 - RNA, 17 nt, Chlamydia trachomatis
auccacuacugucagac

SEQ ID NO: 465447 - RNA, 17 nt, Chlamydia trachomatis
auccagaaguuuuaaca

SEQ ID NO: 465448 - RNA, 15 nt, Chlamydia trachomatis
auccaauccuuggca

SEQ ID NO: 465449 - RNA, 16 nt, Chlamydia trachomatis
auccaauguaaaauga

SEQ ID NO: 465450 - RNA, 14 nt, Chlamydia trachomatis
auccauaaaaacug

SEQ ID NO: 465451 - RNA, 15 nt, Chlamydia trachomatis
auccauaaaaacugc

SEQ ID NO: 465452 - RNA, 12 nt, Chlamydia trachomatis
auccauauauuc

SEQ ID NO: 465453 - RNA, 21 nt, Chlamydia trachomatis
auccauauauucagaagaaga

SEQ ID NO: 465454 - RNA, 15 nt, Chlamydia trachomatis
auccauauccaugaa

SEQ ID NO: 465455 - RNA, 22 nt, Chlamydia trachomatis
auccauaauuuucuucacuucc

SEQ ID NO: 465456 - RNA, 11 nt, Chlamydia trachomatis
auccaucucuc

SEQ ID NO: 465457 - RNA, 12 nt, Chlamydia trachomatis
auccaucucucc

SEQ ID NO: 465458 - RNA, 17 nt, Chlamydia trachomatis
auccaugaggcuccgcc

SEQ ID NO: 465459 - RNA, 18 nt, Chlamydia trachomatis
auccauucccagauuaca

SEQ ID NO: 465460 - RNA, 19 nt, Chlamydia trachomatis
auccauucgcauuaaauaa

SEQ ID NO: 465461 - RNA, 21 nt, Chlamydia trachomatis
auccauucgcauuaaauaaua

SEQ ID NO: 465462 - RNA, 23 nt, Chlamydia trachomatis
auccauguuucgccaaugaucuu

SEQ ID NO: 465463 - RNA, 14 nt, Chlamydia trachomatis
aucccacaaagaaa

SEQ ID NO: 465464 - RNA, 15 nt, Chlamydia trachomatis
aucccacaugcuagu

SEQ ID NO: 465465 - RNA, 19 nt, Chlamydia trachomatis
auccauuuggacuaugcuc

SEQ ID NO: 465466 - RNA, 18 nt, Chlamydia trachomatis
aucccaaaccuccuaaau

SEQ ID NO: 465467 - RNA, 16 nt, Chlamydia trachomatis
aucccaaagcuuuacu

SEQ ID NO: 465468 - RNA, 12 nt, Chlamydia trachomatis
aucccagcaaua

SEQ ID NO: 465469 - RNA, 19 nt, Chlamydia trachomatis
aucccagccugugcauuug

SEQ ID NO: 465470 - RNA, 14 nt, Chlamydia trachomatis
aucccauaaucuca

SEQ ID NO: 465471 - RNA, 17 nt, Chlamydia trachomatis
aucccauccuuuaucuu

SEQ ID NO: 465472 - RNA, 18 nt, Chlamydia trachomatis
aucccgcgguagaaaguc

SEQ ID NO: 465473 - RNA, 17 nt, Chlamydia trachomatis
aucccuaguacaaaaau

SEQ ID NO: 465474 - RNA, 22 nt, Chlamydia trachomatis
aucccuaguacaaaaauacuug

SEQ ID NO: 465475 - RNA, 15 nt, Chlamydia trachomatis
aucccgaauggaugc

SEQ ID NO: 465476 - RNA, 15 nt, Chlamydia trachomatis
aucccccuucuggau

SEQ ID NO: 465477 - RNA, 19 nt, Chlamydia trachomatis
auccccagaagccauaaua

SEQ ID NO: 465478 - RNA, 16 nt, Chlamydia trachomatis
auccccagucucucca

SEQ ID NO: 465479 - RNA, 15 nt, Chlamydia trachomatis
auccccaucucuuuu

SEQ ID NO: 465480 - RNA, 16 nt, Chlamydia trachomatis
auccccccgaccuuug

SEQ ID NO: 465481 - RNA, 19 nt, Chlamydia trachomatis
auccccccuacauuguaaa

SEQ ID NO: 465482 - RNA, 21 nt, Chlamydia trachomatis
auccccacgaccacaaacaau

SEQ ID NO: 465483 - RNA, 20 nt, Chlamydia trachomatis
auccccaaaccaguuucuuc

SEQ ID NO: 465484 - RNA, 16 nt, Chlamydia trachomatis
auccgcagagaugaua

SEQ ID NO: 465485 - RNA, 19 nt, Chlamydia trachomatis
auccgagcauuuuccaaga

SEQ ID NO: 465486 - RNA, 19 nt, Chlamydia trachomatis
aucccuugcaaaaaucucu

SEQ ID NO: 465487 - RNA, 14 nt, Chlamydia trachomatis
aucccuuucauucu

SEQ ID NO: 465488 - RNA, 12 nt, Chlamydia trachomatis
aucccuuuccaa

SEQ ID NO: 465489 - RNA, 22 nt, Chlamydia trachomatis
aucccuuuccaagaaucaaaaa

SEQ ID NO: 465490 - RNA, 18 nt, Chlamydia trachomatis
auccgcaguaaaaucuaa

SEQ ID NO: 465491 - RNA, 14 nt, Chlamydia trachomatis
auccgcuaaaggau

SEQ ID NO: 465492 - RNA, 14 nt, Chlamydia trachomatis
auccgcuucuucau

SEQ ID NO: 465493 - RNA, 18 nt, Chlamydia trachomatis
auccgggaaugauuagac

SEQ ID NO: 465494 - RNA, 20 nt, Chlamydia trachomatis
auccguaaggaagccagccc

SEQ ID NO: 465495 - RNA, 22 nt, Chlamydia trachomatis
auccguaaggaagccagccccu

SEQ ID NO: 465496 - RNA, 14 nt, Chlamydia trachomatis
auccgguucuuuug

SEQ ID NO: 465497 - RNA, 23 nt, Chlamydia trachomatis
auccgugauuuccguaaugauca

SEQ ID NO: 465498 - RNA, 20 nt, Chlamydia trachomatis
auccuaacuguacacagggu

SEQ ID NO: 465499 - RNA, 13 nt, Chlamydia trachomatis
auccuacagcaga

SEQ ID NO: 465500 - RNA, 22 nt, Chlamydia trachomatis
auccuagagacggucuacaaau

SEQ ID NO: 465501 - RNA, 19 nt, Chlamydia trachomatis
auccuauacccgacuaaaa

SEQ ID NO: 465502 - RNA, 13 nt, Chlamydia trachomatis
auccucagggcug

SEQ ID NO: 465503 - RNA, 18 nt, Chlamydia trachomatis
auccucaucuagcuaaag

SEQ ID NO: 465504 - RNA, 15 nt, Chlamydia trachomatis
auccugcucaacaua

SEQ ID NO: 465505 - RNA, 15 nt, Chlamydia trachomatis
auccugcuugaagua

SEQ ID NO: 465506 - RNA, 14 nt, Chlamydia trachomatis
auccuggaaucaca

SEQ ID NO: 465507 - RNA, 21 nt, Chlamydia trachomatis
auccuggaguauuuucaaaaa

SEQ ID NO: 465508 - RNA, 14 nt, Chlamydia trachomatis
auccuguagggaag

SEQ ID NO: 465509 - RNA, 23 nt, Chlamydia trachomatis
auccuugcuaggagguuucaggg

SEQ ID NO: 465510 - RNA, 22 nt, Chlamydia trachomatis
auccuucgccgggggagccaaa

SEQ ID NO: 465511 - RNA, 12 nt, Chlamydia trachomatis
auccuucugcua

SEQ ID NO: 465512 - RNA, 12 nt, Chlamydia trachomatis
auccuugcccaa

SEQ ID NO: 465513 - RNA, 14 nt, Chlamydia trachomatis
aucgaauuacucug

SEQ ID NO: 465514 - RNA, 20 nt, Chlamydia trachomatis
aucgccaaaaaucauuucca

SEQ ID NO: 465515 - RNA, 23 nt, Chlamydia trachomatis
aucgccuucuauagcuaaagcag

SEQ ID NO: 465516 - RNA, 16 nt, Chlamydia trachomatis
aucgcuaugacaggcc

SEQ ID NO: 465517 - RNA, 22 nt, Chlamydia trachomatis
aucgcuauuuccccuacaaaca

SEQ ID NO: 465518 - RNA, 16 nt, Chlamydia trachomatis
aucggacccaugaaca

SEQ ID NO: 465519 - RNA, 18 nt, Chlamydia trachomatis
aucgcuuuuccaauauua

SEQ ID NO: 465520 - RNA, 15 nt, Chlamydia trachomatis
aucgcuugaaaagaa

SEQ ID NO: 465521 - RNA, 17 nt, Chlamydia trachomatis
aucgcuugaaaagaacc

SEQ ID NO: 465522 - RNA, 16 nt, Chlamydia trachomatis
aucgguucauaaaauu

SEQ ID NO: 465523 - RNA, 15 nt, Chlamydia trachomatis
aucguaaccaagcuu

SEQ ID NO: 465524 - RNA, 14 nt, Chlamydia trachomatis
aucgugagcgucuu

SEQ ID NO: 465525 - RNA, 23 nt, Chlamydia trachomatis
aucuaaaaaaauucuugccaccg

SEQ ID NO: 465526 - RNA, 14 nt, Chlamydia trachomatis
aucuaaaaagccau

SEQ ID NO: 465527 - RNA, 19 nt, Chlamydia trachomatis
aucugcuuccguaacaaua

SEQ ID NO: 465528 - RNA, 16 nt, Chlamydia trachomatis
aucugcugagagauga

SEQ ID NO: 465529 - RNA, 20 nt, Chlamydia trachomatis
aucugcuaguccuccuguag

SEQ ID NO: 465530 - RNA, 16 nt, Chlamydia trachomatis
aucuaaggaaugugga

SEQ ID NO: 465531 - RNA, 17 nt, Chlamydia trachomatis
aucuaaggaauguggag

SEQ ID NO: 465532 - RNA, 17 nt, Chlamydia trachomatis
aucugucuaagauuuuc

SEQ ID NO: 465533 - RNA, 20 nt, Chlamydia trachomatis
aucugugccagcugcugcuu

SEQ ID NO: 465534 - RNA, 12 nt, Chlamydia trachomatis
aucugugauaac

SEQ ID NO: 465535 - RNA, 16 nt, Chlamydia trachomatis
aucuguaauaaacccu

SEQ ID NO: 465536 - RNA, 16 nt, Chlamydia trachomatis
aucuguaaugugaugc

SEQ ID NO: 465537 - RNA, 21 nt, Chlamydia trachomatis
aucuguaaugugaugcggagc

SEQ ID NO: 465538 - RNA, 16 nt, Chlamydia trachomatis
aucuguaggggaggga

SEQ ID NO: 465539 - RNA, 21 nt, Chlamydia trachomatis
aucuguucagaacucaaaaua

SEQ ID NO: 465540 - RNA, 23 nt, Chlamydia trachomatis
aucuguugucgauuuuuaaaaga

SEQ ID NO: 465541 - RNA, 17 nt, Chlamydia trachomatis
aucuuauguucagcauc

SEQ ID NO: 465542 - RNA, 15 nt, Chlamydia trachomatis
aucuucaaagaacaa

SEQ ID NO: 465543 - RNA, 18 nt, Chlamydia trachomatis
aucuucacggagagaaag

SEQ ID NO: 465544 - RNA, 19 nt, Chlamydia trachomatis
aucuucacggagagaaaga

SEQ ID NO: 465545 - RNA, 18 nt, Chlamydia trachomatis
aucuucagaaaucuucuu

SEQ ID NO: 465546 - RNA, 22 nt, Chlamydia trachomatis
aucuucauaagaaaauucuucu

SEQ ID NO: 465547 - RNA, 20 nt, Chlamydia trachomatis
aucuucggcagaagcugcag

SEQ ID NO: 465548 - RNA, 18 nt, Chlamydia trachomatis
aucuuccuguaagaggau

SEQ ID NO: 465549 - RNA, 15 nt, Chlamydia trachomatis
aucuuccucuugaaa

SEQ ID NO: 465550 - RNA, 19 nt, Chlamydia trachomatis
aucuucccaagacucaauc

SEQ ID NO: 465551 - RNA, 21 nt, Chlamydia trachomatis
aucuuccaaaggauauacaga

SEQ ID NO: 465552 - RNA, 14 nt, Chlamydia trachomatis
aucuucuaaaugcu

SEQ ID NO: 465553 - RNA, 15 nt, Chlamydia trachomatis
aucuucuagaggagu

SEQ ID NO: 465554 - RNA, 22 nt, Chlamydia trachomatis
aucuuggguaagaccaaaaaca

SEQ ID NO: 465555 - RNA, 18 nt, Chlamydia trachomatis
aucuuguaauaucaaaga

SEQ ID NO: 465556 - RNA, 16 nt, Chlamydia trachomatis
aucuugucguuccucu

SEQ ID NO: 465557 - RNA, 19 nt, Chlamydia trachomatis
aucuugugcaaacaaaaga

SEQ ID NO: 465558 - RNA, 16 nt, Chlamydia trachomatis
aucuuuauuuuuuccg

SEQ ID NO: 465559 - RNA, 20 nt, Chlamydia trachomatis
aucuuuacuaggagcaaaaa

SEQ ID NO: 465560 - RNA, 21 nt, Chlamydia trachomatis
aucuuuacuaggagcaaaaag

SEQ ID NO: 465561 - RNA, 21 nt, Chlamydia trachomatis
aucuuugaacauuuaucguac

SEQ ID NO: 465562 - RNA, 22 nt, Chlamydia trachomatis
aucuuugauagcaacaguuuug

SEQ ID NO: 465563 - RNA, 13 nt, Chlamydia trachomatis
augaaaaagaagc

SEQ ID NO: 465564 - RNA, 13 nt, Chlamydia trachomatis
augaaaaauccuu

SEQ ID NO: 465565 - RNA, 16 nt, Chlamydia trachomatis
augaaaaauccuucca

SEQ ID NO: 465566 - RNA, 17 nt, Chlamydia trachomatis
aucuuuuugauuuuucu

SEQ ID NO: 465567 - RNA, 19 nt, Chlamydia trachomatis
augaacccaucgauauuuu

SEQ ID NO: 465568 - RNA, 23 nt, Chlamydia trachomatis
augaacccaucgauauuuuugga

SEQ ID NO: 465569 - RNA, 17 nt, Chlamydia trachomatis
augaaccgcagcaacau

SEQ ID NO: 465570 - RNA, 18 nt, Chlamydia trachomatis
augaauuuuaucuaaaaa

SEQ ID NO: 465571 - RNA, 23 nt, Chlamydia trachomatis
augaauuuuaucuaaaaaggcac

SEQ ID NO: 465572 - RNA, 15 nt, Chlamydia trachomatis
augacaaacuuucuc

SEQ ID NO: 465573 - RNA, 16 nt, Chlamydia trachomatis
augacaggcagcagag

SEQ ID NO: 465574 - RNA, 18 nt, Chlamydia trachomatis
augacauaagcaaauccu

SEQ ID NO: 465575 - RNA, 12 nt, Chlamydia trachomatis
augagccuugcc

SEQ ID NO: 465576 - RNA, 13 nt, Chlamydia trachomatis
augagccucuaac

SEQ ID NO: 465577 - RNA, 16 nt, Chlamydia trachomatis
augagcgauaugcuuu

SEQ ID NO: 465578 - RNA, 16 nt, Chlamydia trachomatis
augagcgcuuuuucuu

SEQ ID NO: 465579 - RNA, 20 nt, Chlamydia trachomatis
augagcgcuuuuucuucucu

SEQ ID NO: 465580 - RNA, 17 nt, Chlamydia trachomatis
augaggauguggacgaa

SEQ ID NO: 465581 - RNA, 12 nt, Chlamydia trachomatis
augauaagggaa

SEQ ID NO: 465582 - RNA, 14 nt, Chlamydia trachomatis
augaugcugagcau

SEQ ID NO: 465583 - RNA, 13 nt, Chlamydia trachomatis
augauuaauucua

SEQ ID NO: 465584 - RNA, 16 nt, Chlamydia trachomatis
augauuaauucuagga

SEQ ID NO: 465585 - RNA, 18 nt, Chlamydia trachomatis
augaucuguaaugugaug

SEQ ID NO: 465586 - RNA, 19 nt, Chlamydia trachomatis
augaucgccucuaaagcuu

SEQ ID NO: 465587 - RNA, 22 nt, Chlamydia trachomatis
augaucuaaaggaaaaauuucu

SEQ ID NO: 465588 - RNA, 15 nt, Chlamydia trachomatis
augaucccuaagauu

SEQ ID NO: 465589 - RNA, 20 nt, Chlamydia trachomatis
augaucacuaauauagaauu

SEQ ID NO: 465590 - RNA, 13 nt, Chlamydia trachomatis
augaucagcaaaa

SEQ ID NO: 465591 - RNA, 18 nt, Chlamydia trachomatis
augaucagcaaaaagagg

SEQ ID NO: 465592 - RNA, 20 nt, Chlamydia trachomatis
augaucagcaaaaagaggag

SEQ ID NO: 465593 - RNA, 22 nt, Chlamydia trachomatis
augauauuuugaagauaaaacu

SEQ ID NO: 465594 - RNA, 15 nt, Chlamydia trachomatis
augauaucuucugaa

SEQ ID NO: 465595 - RNA, 21 nt, Chlamydia trachomatis
augauauuaguuagugaaguc

SEQ ID NO: 465596 - RNA, 13 nt, Chlamydia trachomatis
augcacaucuaau

SEQ ID NO: 465597 - RNA, 13 nt, Chlamydia trachomatis
augcaaaacauaa

SEQ ID NO: 465598 - RNA, 21 nt, Chlamydia trachomatis
augauugaaguucuuuuuccu

SEQ ID NO: 465599 - RNA, 13 nt, Chlamydia trachomatis
augauugauaaag

SEQ ID NO: 465600 - RNA, 14 nt, Chlamydia trachomatis
augcagaugaagaa

SEQ ID NO: 465601 - RNA, 12 nt, Chlamydia trachomatis
augcauacucag

SEQ ID NO: 465602 - RNA, 13 nt, Chlamydia trachomatis
augcauacucagc

SEQ ID NO: 465603 - RNA, 18 nt, Chlamydia trachomatis
augcauagucuucaggau

SEQ ID NO: 465604 - RNA, 20 nt, Chlamydia trachomatis
augcggauuaaagaaggaaa

SEQ ID NO: 465605 - RNA, 17 nt, Chlamydia trachomatis
augcguuaaacuuucuu

SEQ ID NO: 465606 - RNA, 23 nt, Chlamydia trachomatis
augcucagggcuauauguaagaa

SEQ ID NO: 465607 - RNA, 23 nt, Chlamydia trachomatis
augcuccauacgcugcugacaau

SEQ ID NO: 465608 - RNA, 22 nt, Chlamydia trachomatis
augcucuaaaggauaaggaaga

SEQ ID NO: 465609 - RNA, 23 nt, Chlamydia trachomatis
augcugcgauaacaacaauaaac

SEQ ID NO: 465610 - RNA, 19 nt, Chlamydia trachomatis
augcugcccuugagcaagu

SEQ ID NO: 465611 - RNA, 22 nt, Chlamydia trachomatis
augcugcccuugagcaaguaaa

SEQ ID NO: 465612 - RNA, 18 nt, Chlamydia trachomatis
augcuucuauucgcagua

SEQ ID NO: 465613 - RNA, 17 nt, Chlamydia trachomatis
augcugugacuccuucu

SEQ ID NO: 465614 - RNA, 13 nt, Chlamydia trachomatis
augcuuuguaaaa

SEQ ID NO: 465615 - RNA, 17 nt, Chlamydia trachomatis
auggaaauaaaaagccc

SEQ ID NO: 465616 - RNA, 14 nt, Chlamydia trachomatis
auggaauggggagg

SEQ ID NO: 465617 - RNA, 18 nt, Chlamydia trachomatis
auggagaauggccuguuu

SEQ ID NO: 465618 - RNA, 13 nt, Chlamydia trachomatis
auggagaggagua

SEQ ID NO: 465619 - RNA, 22 nt, Chlamydia trachomatis
auggaucucccucauuuaaaag

SEQ ID NO: 465620 - RNA, 15 nt, Chlamydia trachomatis
auggaguaggggaau

SEQ ID NO: 465621 - RNA, 18 nt, Chlamydia trachomatis
auggccuuaugugcuccu

SEQ ID NO: 465622 - RNA, 17 nt, Chlamydia trachomatis
augguccaugauuucuu

SEQ ID NO: 465623 - RNA, 21 nt, Chlamydia trachomatis
augguuauaagaccuaaucca

SEQ ID NO: 465624 - RNA, 21 nt, Chlamydia trachomatis
augguucaaacauagaaggaa

SEQ ID NO: 465625 - RNA, 20 nt, Chlamydia trachomatis
augguucuugugaggagcuc

SEQ ID NO: 465626 - RNA, 19 nt, Chlamydia trachomatis
augguugcucuuugaacuu

SEQ ID NO: 465627 - RNA, 21 nt, Chlamydia trachomatis
auguaaacaauauucuuuucc

SEQ ID NO: 465628 - RNA, 13 nt, Chlamydia trachomatis
auguaaauauuuu

SEQ ID NO: 465629 - RNA, 21 nt, Chlamydia trachomatis
auguucuauauacauuaugua

SEQ ID NO: 465630 - RNA, 12 nt, Chlamydia trachomatis
auguuaucucug

SEQ ID NO: 465631 - RNA, 15 nt, Chlamydia trachomatis
auguuccaucuuuuc

SEQ ID NO: 465632 - RNA, 15 nt, Chlamydia trachomatis
auguguugcuuccca

SEQ ID NO: 465633 - RNA, 20 nt, Chlamydia trachomatis
augugcuaguauuaaacuuc

SEQ ID NO: 465634 - RNA, 15 nt, Chlamydia trachomatis
augugcucauuuccu

SEQ ID NO: 465635 - RNA, 21 nt, Chlamydia trachomatis
auguguauuugguugugggcu

SEQ ID NO: 465636 - RNA, 20 nt, Chlamydia trachomatis
augucuaaggaugcaaauaa

SEQ ID NO: 465637 - RNA, 22 nt, Chlamydia trachomatis
augucuccaggagagucugcua

SEQ ID NO: 465638 - RNA, 18 nt, Chlamydia trachomatis
augucugcgguacaggca

SEQ ID NO: 465639 - RNA, 16 nt, Chlamydia trachomatis
augucuguugaaagcu

SEQ ID NO: 465640 - RNA, 15 nt, Chlamydia trachomatis
auguagccaaggaag

SEQ ID NO: 465641 - RNA, 21 nt, Chlamydia trachomatis
auguagaucuguuagugaaga

SEQ ID NO: 465642 - RNA, 12 nt, Chlamydia trachomatis
auguaaaugaug

SEQ ID NO: 465643 - RNA, 23 nt, Chlamydia trachomatis
auguaauugggggacuucauuaa

SEQ ID NO: 465644 - RNA, 24 nt, Chlamydia trachomatis
auucaugcuccgagauuuucauca

SEQ ID NO: 465645 - RNA, 15 nt, Chlamydia trachomatis
auucaucuauuuuua

SEQ ID NO: 465646 - RNA, 18 nt, Chlamydia trachomatis
auucaucuauuuuuauug

SEQ ID NO: 465647 - RNA, 13 nt, Chlamydia trachomatis
auucaucuuuacu

SEQ ID NO: 465648 - RNA, 10 nt, Chlamydia trachomatis
auucaucaaa

SEQ ID NO: 465649 - RNA, 17 nt, Chlamydia trachomatis
auucaucaaaauauuuu

SEQ ID NO: 465650 - RNA, 19 nt, Chlamydia trachomatis
auguucuuaauaaucugug

SEQ ID NO: 465651 - RNA, 15 nt, Chlamydia trachomatis
auguucugugaaaua

SEQ ID NO: 465652 - RNA, 16 nt, Chlamydia trachomatis
auguucugugaaauau

SEQ ID NO: 465653 - RNA, 23 nt, Chlamydia trachomatis
auuccaagcggauugcuuuuugc

SEQ ID NO: 465654 - RNA, 23 nt, Chlamydia trachomatis
auuccaaauccuccugcaggagg

SEQ ID NO: 465655 - RNA, 19 nt, Chlamydia trachomatis
auuccacaacggcccuucc

SEQ ID NO: 465656 - RNA, 16 nt, Chlamydia trachomatis
auuccaaacccaucca

SEQ ID NO: 465657 - RNA, 15 nt, Chlamydia trachomatis
auuccaaagaaaugu

SEQ ID NO: 465658 - RNA, 15 nt, Chlamydia trachomatis
auucaugugaacaga

SEQ ID NO: 465659 - RNA, 17 nt, Chlamydia trachomatis
auuccacgaagagcaaa

SEQ ID NO: 465660 - RNA, 19 nt, Chlamydia trachomatis
auuccacuaccccaccuau

SEQ ID NO: 465661 - RNA, 23 nt, Chlamydia trachomatis
auuccaguuacccucuuuagcca

SEQ ID NO: 465662 - RNA, 17 nt, Chlamydia trachomatis
auuccauaaucguggaa

SEQ ID NO: 465663 - RNA, 20 nt, Chlamydia trachomatis
auuccauaaucguggaacac

SEQ ID NO: 465664 - RNA, 13 nt, Chlamydia trachomatis
auuccaucuuuuc

SEQ ID NO: 465665 - RNA, 23 nt, Chlamydia trachomatis
auuccaucuuuucgcaaagguag

SEQ ID NO: 465666 - RNA, 18 nt, Chlamydia trachomatis
auuccauggcguuagaau

SEQ ID NO: 465667 - RNA, 14 nt, Chlamydia trachomatis
auucccuguagaau

SEQ ID NO: 465668 - RNA, 19 nt, Chlamydia trachomatis
auucccgccuaauaaugaa

SEQ ID NO: 465669 - RNA, 22 nt, Chlamydia trachomatis
auucccgccuaauaaugaaacc

SEQ ID NO: 465670 - RNA, 17 nt, Chlamydia trachomatis
auucccgccaauuuuuu

SEQ ID NO: 465671 - RNA, 16 nt, Chlamydia trachomatis
auucccacuacauucu

SEQ ID NO: 465672 - RNA, 19 nt, Chlamydia trachomatis
auuccuacgcagauauuca

SEQ ID NO: 465673 - RNA, 16 nt, Chlamydia trachomatis
auuccuaggcagagua

SEQ ID NO: 465674 - RNA, 19 nt, Chlamydia trachomatis
auuccguacucugauuaga

SEQ ID NO: 465675 - RNA, 19 nt, Chlamydia trachomatis
auuccgagagaagcuccuc

SEQ ID NO: 465676 - RNA, 23 nt, Chlamydia trachomatis
auuccgagggaaucauuugccaa

SEQ ID NO: 465677 - RNA, 16 nt, Chlamydia trachomatis
auuccuguuaauccca

SEQ ID NO: 465678 - RNA, 19 nt, Chlamydia trachomatis
auuccugaauggucaauaa

SEQ ID NO: 465679 - RNA, 22 nt, Chlamydia trachomatis
auuccugaauggucaauaauuu

SEQ ID NO: 465680 - RNA, 16 nt, Chlamydia trachomatis
auuccugcugaucaga

SEQ ID NO: 465681 - RNA, 20 nt, Chlamydia trachomatis
auuccugcugaucagaggga

SEQ ID NO: 465682 - RNA, 22 nt, Chlamydia trachomatis
auuccugggccugauuucucuu

SEQ ID NO: 465683 - RNA, 14 nt, Chlamydia trachomatis
auuccuuucuucca

SEQ ID NO: 465684 - RNA, 15 nt, Chlamydia trachomatis
auucgaaaagagcua

SEQ ID NO: 465685 - RNA, 18 nt, Chlamydia trachomatis
auucgaaucauugggaaa

SEQ ID NO: 465686 - RNA, 17 nt, Chlamydia trachomatis
auucgaggcuucuucuu

SEQ ID NO: 465687 - RNA, 18 nt, Chlamydia trachomatis
auucggagcaagaauaaa

SEQ ID NO: 465688 - RNA, 21 nt, Chlamydia trachomatis
auucgcauuaaauaauacaaa

SEQ ID NO: 465689 - RNA, 18 nt, Chlamydia trachomatis
auucgcuaaugauucuug

SEQ ID NO: 465690 - RNA, 23 nt, Chlamydia trachomatis
auucuuucauucguuucuucccu

SEQ ID NO: 465691 - RNA, 18 nt, Chlamydia trachomatis
auucuuugcguagcucag

SEQ ID NO: 465692 - RNA, 15 nt, Chlamydia trachomatis
auucuuuuacagagg

SEQ ID NO: 465693 - RNA, 15 nt, Chlamydia trachomatis
auucuucugaacaac

SEQ ID NO: 465694 - RNA, 22 nt, Chlamydia trachomatis
auucuucugaacaacauccuuu

SEQ ID NO: 465695 - RNA, 14 nt, Chlamydia trachomatis
auucuugaagauuu

SEQ ID NO: 465696 - RNA, 13 nt, Chlamydia trachomatis
auucugcagaaaa

SEQ ID NO: 465697 - RNA, 14 nt, Chlamydia trachomatis
auucugcagaaaaa

SEQ ID NO: 465698 - RNA, 15 nt, Chlamydia trachomatis
auucucaucuugcgc

SEQ ID NO: 465699 - RNA, 13 nt, Chlamydia trachomatis
auucguagauaau

SEQ ID NO: 465700 - RNA, 19 nt, Chlamydia trachomatis
auucguaggguuguuuuag

SEQ ID NO: 465701 - RNA, 12 nt, Chlamydia trachomatis
auucguuaucaa

SEQ ID NO: 465702 - RNA, 21 nt, Chlamydia trachomatis
auucguuugugcuaaaucucc

SEQ ID NO: 465703 - RNA, 21 nt, Chlamydia trachomatis
auucuaaacgagcuagcucuu

SEQ ID NO: 465704 - RNA, 23 nt, Chlamydia trachomatis
auucuaacgccauggaauagcuu

SEQ ID NO: 465705 - RNA, 19 nt, Chlamydia trachomatis
auugauaggguugugaaua

SEQ ID NO: 465706 - RNA, 20 nt, Chlamydia trachomatis
auugauagugaaauaagucu

SEQ ID NO: 465707 - RNA, 16 nt, Chlamydia trachomatis
auugacaacuuucuuu

SEQ ID NO: 465708 - RNA, 16 nt, Chlamydia trachomatis
auugaugacaacuaca

SEQ ID NO: 465709 - RNA, 17 nt, Chlamydia trachomatis
auugaugacaacuacaa

SEQ ID NO: 465710 - RNA, 20 nt, Chlamydia trachomatis
auugaugacaacuacaacaa

SEQ ID NO: 465711 - RNA, 22 nt, Chlamydia trachomatis
auugaugcugaaugguggcaua

SEQ ID NO: 465712 - RNA, 19 nt, Chlamydia trachomatis
auugauuccauuugcuaca

SEQ ID NO: 465713 - RNA, 16 nt, Chlamydia trachomatis
auugcaguauagagaa

SEQ ID NO: 465714 - RNA, 15 nt, Chlamydia trachomatis
auugccaaaaagaaa

SEQ ID NO: 465715 - RNA, 19 nt, Chlamydia trachomatis
auugcgcagaucuccuucu

SEQ ID NO: 465716 - RNA, 21 nt, Chlamydia trachomatis
auugcgccuugucuauaggaa

SEQ ID NO: 465717 - RNA, 14 nt, Chlamydia trachomatis
auuggcggcaguuu

SEQ ID NO: 465718 - RNA, 18 nt, Chlamydia trachomatis
auuuacgucaauuuuucc

SEQ ID NO: 465719 - RNA, 16 nt, Chlamydia trachomatis
auugguauagaaacua

SEQ ID NO: 465720 - RNA, 15 nt, Chlamydia trachomatis
auuggugaucauuuu

SEQ ID NO: 465721 - RNA, 17 nt, Chlamydia trachomatis
auuggugguaacaccaa

SEQ ID NO: 465722 - RNA, 23 nt, Chlamydia trachomatis
auuuaaaagugagaugcuccucu

SEQ ID NO: 465723 - RNA, 10 nt, Chlamydia trachomatis
auuucauuua

SEQ ID NO: 465724 - RNA, 18 nt, Chlamydia trachomatis
auuuccaacaaaaagcgc

SEQ ID NO: 465725 - RNA, 13 nt, Chlamydia trachomatis
auuuaucugcuau

SEQ ID NO: 465726 - RNA, 13 nt, Chlamydia trachomatis
auuuaugaagccu

SEQ ID NO: 465727 - RNA, 15 nt, Chlamydia trachomatis
auuuaugucgcagcu

SEQ ID NO: 465728 - RNA, 14 nt, Chlamydia trachomatis
auuuccccuacaaa

SEQ ID NO: 465729 - RNA, 16 nt, Chlamydia trachomatis
auuuccccuacaaaca

SEQ ID NO: 465730 - RNA, 13 nt, Chlamydia trachomatis
auuuccccuuuuc

SEQ ID NO: 465731 - RNA, 19 nt, Chlamydia trachomatis
auuuccagccucuccagaa

SEQ ID NO: 465732 - RNA, 11 nt, Chlamydia trachomatis
auuuccaugaa

SEQ ID NO: 465733 - RNA, 15 nt, Chlamydia trachomatis
auuuccauggagcuu

SEQ ID NO: 465734 - RNA, 21 nt, Chlamydia trachomatis
auuuccuacucggccagagcu

SEQ ID NO: 465735 - RNA, 13 nt, Chlamydia trachomatis
auuuccucuucua

SEQ ID NO: 465736 - RNA, 15 nt, Chlamydia trachomatis
auuuccucuucuaga

SEQ ID NO: 465737 - RNA, 14 nt, Chlamydia trachomatis
auuuccugcaagca

SEQ ID NO: 465738 - RNA, 15 nt, Chlamydia trachomatis
auuuuaucuaaaaag

SEQ ID NO: 465739 - RNA, 12 nt, Chlamydia trachomatis
auuuuccaagaa

SEQ ID NO: 465740 - RNA, 17 nt, Chlamydia trachomatis
auuuuccaagaaaaaua

SEQ ID NO: 465741 - RNA, 19 nt, Chlamydia trachomatis
auuuuccgaauaaaaucaa

SEQ ID NO: 465742 - RNA, 18 nt, Chlamydia trachomatis
auuuucguaagcauagcu

SEQ ID NO: 465743 - RNA, 17 nt, Chlamydia trachomatis
auuuucguuguuguaaa

SEQ ID NO: 465744 - RNA, 15 nt, Chlamydia trachomatis
auuuucuaggagaag

SEQ ID NO: 465745 - RNA, 14 nt, Chlamydia trachomatis
auuuucuuccugcu

SEQ ID NO: 465746 - RNA, 15 nt, Chlamydia trachomatis
auuuuuagaaggaaa

SEQ ID NO: 465747 - RNA, 20 nt, Chlamydia trachomatis
auuugcucuuccaacaauuu

SEQ ID NO: 465748 - RNA, 18 nt, Chlamydia trachomatis
auuugcccagucaagagc

SEQ ID NO: 465749 - RNA, 20 nt, Chlamydia trachomatis
auuugcauugacuaucugcu

SEQ ID NO: 465750 - RNA, 16 nt, Chlamydia trachomatis
auuugccaaugaaaua

SEQ ID NO: 465751 - RNA, 17 nt, Chlamydia trachomatis
auuugccaaugaaauau

SEQ ID NO: 465752 - RNA, 21 nt, Chlamydia trachomatis
auuugcuuguuuagcauuucu

SEQ ID NO: 465753 - RNA, 18 nt, Chlamydia trachomatis
auuuguagcaaaagauuu

SEQ ID NO: 465754 - RNA, 18 nt, Chlamydia trachomatis
auuuguuguggagaggcu

SEQ ID NO: 465755 - RNA, 16 nt, Chlamydia trachomatis
auuuguuuaaaagaag

SEQ ID NO: 465756 - RNA, 19 nt, Chlamydia trachomatis
auuucggauacaauacagc

SEQ ID NO: 465757 - RNA, 17 nt, Chlamydia trachomatis
auuucuauagaagaauu

SEQ ID NO: 465758 - RNA, 23 nt, Chlamydia trachomatis
auuucucuacccaggcuuuucuu

SEQ ID NO: 465759 - RNA, 13 nt, Chlamydia trachomatis
auuucucuccaaa

SEQ ID NO: 465760 - RNA, 17 nt, Chlamydia trachomatis
auuucugggaaaauuaa

SEQ ID NO: 465761 - RNA, 21 nt, Chlamydia trachomatis
auuucugggaaaauuaaaagg

SEQ ID NO: 465762 - RNA, 23 nt, Chlamydia trachomatis
auuucugucuuagcaaagaaaua

SEQ ID NO: 465763 - RNA, 14 nt, Chlamydia trachomatis
auuucuuuguucag

SEQ ID NO: 465764 - RNA, 23 nt, Chlamydia trachomatis
caaaauaaaaaaaaagaggaggu

SEQ ID NO: 465765 - RNA, 20 nt, Chlamydia trachomatis
caaaaguguuuagaagugcu

SEQ ID NO: 465766 - RNA, 22 nt, Chlamydia trachomatis
caaaaguguuuagaagugcugu

SEQ ID NO: 465767 - RNA, 22 nt, Chlamydia trachomatis
caaaagguuguugccaaucugu

SEQ ID NO: 465768 - RNA, 21 nt, Chlamydia trachomatis
caaaauaaucggcaaaagauc

SEQ ID NO: 465769 - RNA, 17 nt, Chlamydia trachomatis
caaaauagcagugaaau

SEQ ID NO: 465770 - RNA, 18 nt, Chlamydia trachomatis
caaaauaucauaauuaca

SEQ ID NO: 465771 - RNA, 17 nt, Chlamydia trachomatis
caaaauaucuacuucuu

SEQ ID NO: 465772 - RNA, 13 nt, Chlamydia trachomatis
caaaaucaauaau

SEQ ID NO: 465773 - RNA, 15 nt, Chlamydia trachomatis
caaaaucaauaaugu

SEQ ID NO: 465774 - RNA, 16 nt, Chlamydia trachomatis
caaaaucaauaauguc

SEQ ID NO: 465775 - RNA, 18 nt, Chlamydia trachomatis
caaaaucaauaaugucuc

SEQ ID NO: 465776 - RNA, 20 nt, Chlamydia trachomatis
caaaaucaauaaugucucca

SEQ ID NO: 465777 - RNA, 18 nt, Chlamydia trachomatis
caaaaucacggcuaucag

SEQ ID NO: 465778 - RNA, 13 nt, Chlamydia trachomatis
caaaaucagcaaa

SEQ ID NO: 465779 - RNA, 17 nt, Chlamydia trachomatis
caaaaucagcaaaugug

SEQ ID NO: 465780 - RNA, 18 nt, Chlamydia trachomatis
caaaaugauaaucgagca

SEQ ID NO: 465781 - RNA, 22 nt, Chlamydia trachomatis
caaaaugaucuaaaggaaaaau

SEQ ID NO: 465782 - RNA, 21 nt, Chlamydia trachomatis
caaaauccauucccagauuac

SEQ ID NO: 465783 - RNA, 15 nt, Chlamydia trachomatis
caaaaucuucauaag

SEQ ID NO: 465784 - RNA, 18 nt, Chlamydia trachomatis
caaaaucuucauaagaaa

SEQ ID NO: 465785 - RNA, 14 nt, Chlamydia trachomatis
caaacaaucuaaaa

SEQ ID NO: 465786 - RNA, 16 nt, Chlamydia trachomatis
caaacaaucuaaaaaa

SEQ ID NO: 465787 - RNA, 18 nt, Chlamydia trachomatis
caaacaaucuaaaaaauu

SEQ ID NO: 465788 - RNA, 21 nt, Chlamydia trachomatis
caaacaacacugacuauuccu

SEQ ID NO: 465789 - RNA, 13 nt, Chlamydia trachomatis
caaaauuuuucug

SEQ ID NO: 465790 - RNA, 18 nt, Chlamydia trachomatis
caaaauuuuucugcucca

SEQ ID NO: 465791 - RNA, 18 nt, Chlamydia trachomatis
caaaauuucagggaaacg

SEQ ID NO: 465792 - RNA, 17 nt, Chlamydia trachomatis
caaaauucuguacgucu

SEQ ID NO: 465793 - RNA, 17 nt, Chlamydia trachomatis
caaaauuaucuaaaaaa

SEQ ID NO: 465794 - RNA, 21 nt, Chlamydia trachomatis
caaacaucaugguugcuguug

SEQ ID NO: 465795 - RNA, 22 nt, Chlamydia trachomatis
caaaccagcucaucaaauagca

SEQ ID NO: 465796 - RNA, 14 nt, Chlamydia trachomatis
caaaccgaagaggg

SEQ ID NO: 465797 - RNA, 18 nt, Chlamydia trachomatis
caaaccgaagagggaaga

SEQ ID NO: 465798 - RNA, 22 nt, Chlamydia trachomatis
caaacacuagagucagaagcua

SEQ ID NO: 465799 - RNA, 14 nt, Chlamydia trachomatis
caaacacugcaaca

SEQ ID NO: 465800 - RNA, 12 nt, Chlamydia trachomatis
caaacauagaag

SEQ ID NO: 465801 - RNA, 23 nt, Chlamydia trachomatis
caaacggcacucaaauuucucua

SEQ ID NO: 465802 - RNA, 19 nt, Chlamydia trachomatis
caaacguccuccugauucc

SEQ ID NO: 465803 - RNA, 18 nt, Chlamydia trachomatis
caaaccuuaaaagcaagg

SEQ ID NO: 465804 - RNA, 14 nt, Chlamydia trachomatis
caaaccuccuaaau

SEQ ID NO: 465805 - RNA, 15 nt, Chlamydia trachomatis
caaaccuccuaaaua

SEQ ID NO: 465806 - RNA, 23 nt, Chlamydia trachomatis
caaagcgaucuuugaacauuuau

SEQ ID NO: 465807 - RNA, 22 nt, Chlamydia trachomatis
caaagaucguaaaauagcacgc

SEQ ID NO: 465808 - RNA, 13 nt, Chlamydia trachomatis
caaagaugcuccu

SEQ ID NO: 465809 - RNA, 20 nt, Chlamydia trachomatis
caaagaugcuccuacaaaau

SEQ ID NO: 465810 - RNA, 23 nt, Chlamydia trachomatis
caaagauauagguuccaucuaaa

SEQ ID NO: 465811 - RNA, 14 nt, Chlamydia trachomatis
caaagcuauuugca

SEQ ID NO: 465812 - RNA, 18 nt, Chlamydia trachomatis
caaagcuauuugcaagaa

SEQ ID NO: 465813 - RNA, 15 nt, Chlamydia trachomatis
caaagcuuccuuauc

SEQ ID NO: 465814 - RNA, 16 nt, Chlamydia trachomatis
caaacugcucaaggaa

SEQ ID NO: 465815 - RNA, 18 nt, Chlamydia trachomatis
caaacugcucaaggaaac

SEQ ID NO: 465816 - RNA, 19 nt, Chlamydia trachomatis
caaacugcucaaggaaacu

SEQ ID NO: 465817 - RNA, 15 nt, Chlamydia trachomatis
caaacugcucuucua

SEQ ID NO: 465818 - RNA, 19 nt, Chlamydia trachomatis
caaacugcucuucuaacuu

SEQ ID NO: 465819 - RNA, 20 nt, Chlamydia trachomatis
caaacugcucuucuaacuuu

SEQ ID NO: 465820 - RNA, 19 nt, Chlamydia trachomatis
caaacugugaagaaugaaa

SEQ ID NO: 465821 - RNA, 21 nt, Chlamydia trachomatis
caaacuuaccuuguuagaaau

SEQ ID NO: 465822 - RNA, 23 nt, Chlamydia trachomatis
caaagcuuuaauaauaagagcua

SEQ ID NO: 465823 - RNA, 16 nt, Chlamydia trachomatis
caaaggaacaucgaga

SEQ ID NO: 465824 - RNA, 18 nt, Chlamydia trachomatis
caaaggauaaauauuuua

SEQ ID NO: 465825 - RNA, 20 nt, Chlamydia trachomatis
caaaggauauacagaacauu

SEQ ID NO: 465826 - RNA, 16 nt, Chlamydia trachomatis
caaaggcaacaaaggc

SEQ ID NO: 465827 - RNA, 16 nt, Chlamydia trachomatis
caaauaacagaaacgu

SEQ ID NO: 465828 - RNA, 17 nt, Chlamydia trachomatis
caaauauccuaaauuau

SEQ ID NO: 465829 - RNA, 13 nt, Chlamydia trachomatis
caaauuuuguuua

SEQ ID NO: 465830 - RNA, 20 nt, Chlamydia trachomatis
caacaaauaccaaaauauca

SEQ ID NO: 465831 - RNA, 21 nt, Chlamydia trachomatis
caacaaauaccaaaauaucau

SEQ ID NO: 465832 - RNA, 20 nt, Chlamydia trachomatis
caaauucgaggcuucuucuu

SEQ ID NO: 465833 - RNA, 15 nt, Chlamydia trachomatis
caaauucgcuaccaa

SEQ ID NO: 465834 - RNA, 17 nt, Chlamydia trachomatis
caaauucgcuaccaaaa

SEQ ID NO: 465835 - RNA, 20 nt, Chlamydia trachomatis
caaauuuucaugaaaagcuu

SEQ ID NO: 465836 - RNA, 13 nt, Chlamydia trachomatis
caaauccuccaua

SEQ ID NO: 465837 - RNA, 16 nt, Chlamydia trachomatis
caaaucugcaagaaca

SEQ ID NO: 465838 - RNA, 20 nt, Chlamydia trachomatis
caacaagggaaugaaaucac

SEQ ID NO: 465839 - RNA, 18 nt, Chlamydia trachomatis
caacauaaaauccuucug

SEQ ID NO: 465840 - RNA, 12 nt, Chlamydia trachomatis
caacauaacucu

SEQ ID NO: 465841 - RNA, 14 nt, Chlamydia trachomatis
caacauaauaaaua

SEQ ID NO: 465842 - RNA, 15 nt, Chlamydia trachomatis
caaccuucugacuga

SEQ ID NO: 465843 - RNA, 20 nt, Chlamydia trachomatis
caaccuuuccuguauaagaa

SEQ ID NO: 465844 - RNA, 21 nt, Chlamydia trachomatis
caacauagaucccuuucauuc

SEQ ID NO: 465845 - RNA, 13 nt, Chlamydia trachomatis
caacaucaaaauu

SEQ ID NO: 465846 - RNA, 15 nt, Chlamydia trachomatis
caacaucaaaauucu

SEQ ID NO: 465847 - RNA, 18 nt, Chlamydia trachomatis
caacgaguugaucuuccu

SEQ ID NO: 465848 - RNA, 13 nt, Chlamydia trachomatis
caacgagaagucc

SEQ ID NO: 465849 - RNA, 22 nt, Chlamydia trachomatis
caacgagcugccgaaacuucuc

SEQ ID NO: 465850 - RNA, 17 nt, Chlamydia trachomatis
caacgaaaccaaaauau

SEQ ID NO: 465851 - RNA, 13 nt, Chlamydia trachomatis
caacgcaucucca

SEQ ID NO: 465852 - RNA, 19 nt, Chlamydia trachomatis
caacgcaucuccaaagaca

SEQ ID NO: 465853 - RNA, 17 nt, Chlamydia trachomatis
caacuaucagaagauag

SEQ ID NO: 465854 - RNA, 15 nt, Chlamydia trachomatis
caacuauugaaauac

SEQ ID NO: 465855 - RNA, 13 nt, Chlamydia trachomatis
caagaacaaagca

SEQ ID NO: 465856 - RNA, 12 nt, Chlamydia trachomatis
caagaaaauaag

SEQ ID NO: 465857 - RNA, 14 nt, Chlamydia trachomatis
caagaaacuguaau

SEQ ID NO: 465858 - RNA, 18 nt, Chlamydia trachomatis
caagaaacuuuucugcag

SEQ ID NO: 465859 - RNA, 12 nt, Chlamydia trachomatis
caagaagaacuc

SEQ ID NO: 465860 - RNA, 21 nt, Chlamydia trachomatis
caagaagcgaagcauucucuc

SEQ ID NO: 465861 - RNA, 15 nt, Chlamydia trachomatis
caagaagcugcaguu

SEQ ID NO: 465862 - RNA, 15 nt, Chlamydia trachomatis
caagaauacaagaaa

SEQ ID NO: 465863 - RNA, 18 nt, Chlamydia trachomatis
caagaauacaagaaaggc

SEQ ID NO: 465864 - RNA, 19 nt, Chlamydia trachomatis
caacucuccuaauucaaca

SEQ ID NO: 465865 - RNA, 13 nt, Chlamydia trachomatis
caacuuuacauaa

SEQ ID NO: 465866 - RNA, 14 nt, Chlamydia trachomatis
caacuuuucagcaa

SEQ ID NO: 465867 - RNA, 13 nt, Chlamydia trachomatis
caagacgauucuc

SEQ ID NO: 465868 - RNA, 14 nt, Chlamydia trachomatis
caagagagaacaaa

SEQ ID NO: 465869 - RNA, 15 nt, Chlamydia trachomatis
caagagagaacaaaa

SEQ ID NO: 465870 - RNA, 22 nt, Chlamydia trachomatis
caagagagaucuaugaaaaaag

SEQ ID NO: 465871 - RNA, 22 nt, Chlamydia trachomatis
caagagaggccuccauuuccau

SEQ ID NO: 465872 - RNA, 14 nt, Chlamydia trachomatis
caagacaucuauug

SEQ ID NO: 465873 - RNA, 22 nt, Chlamydia trachomatis
caagaccucuccauccugcgug

SEQ ID NO: 465874 - RNA, 22 nt, Chlamydia trachomatis
caagaaugcgguaauagaguuc

SEQ ID NO: 465875 - RNA, 22 nt, Chlamydia trachomatis
caagacaacuuggugcagaaga

SEQ ID NO: 465876 - RNA, 17 nt, Chlamydia trachomatis
caagagucucgaaggaa

SEQ ID NO: 465877 - RNA, 17 nt, Chlamydia trachomatis
caagagcuucuuguuua

SEQ ID NO: 465878 - RNA, 18 nt, Chlamydia trachomatis
caagaggcccuucuugag

SEQ ID NO: 465879 - RNA, 11 nt, Chlamydia trachomatis
caagaugacuu

SEQ ID NO: 465880 - RNA, 18 nt, Chlamydia trachomatis
caagaucuuccggaagga

SEQ ID NO: 465881 - RNA, 19 nt, Chlamydia trachomatis
caagcaauuucuacgagcu

SEQ ID NO: 465882 - RNA, 15 nt, Chlamydia trachomatis
caagcaaaacauaaa

SEQ ID NO: 465883 - RNA, 18 nt, Chlamydia trachomatis
caagcaaacggggcuagc

SEQ ID NO: 465884 - RNA, 14 nt, Chlamydia trachomatis
caagcaauagcuua

SEQ ID NO: 465885 - RNA, 14 nt, Chlamydia trachomatis
caagcucgucuuua

SEQ ID NO: 465886 - RNA, 22 nt, Chlamydia trachomatis
caagcugcacccgcggauccca

SEQ ID NO: 465887 - RNA, 13 nt, Chlamydia trachomatis
caagcuugucucc

SEQ ID NO: 465888 - RNA, 20 nt, Chlamydia trachomatis
caagcuugucuccuucuuug

SEQ ID NO: 465889 - RNA, 16 nt, Chlamydia trachomatis
caagcuuucaucuccu

SEQ ID NO: 465890 - RNA, 17 nt, Chlamydia trachomatis
caagcuuucaucuccuu

SEQ ID NO: 465891 - RNA, 23 nt, Chlamydia trachomatis
caaggauuuucuucuuuuuuaca

SEQ ID NO: 465892 - RNA, 17 nt, Chlamydia trachomatis
caaggauuuuuuuccca

SEQ ID NO: 465893 - RNA, 23 nt, Chlamydia trachomatis
caagugugcgaggaauucuucuu

SEQ ID NO: 465894 - RNA, 23 nt, Chlamydia trachomatis
caagugacauuuccaacaaaaag

SEQ ID NO: 465895 - RNA, 22 nt, Chlamydia trachomatis
caagggccacaccauucagcaa

SEQ ID NO: 465896 - RNA, 13 nt, Chlamydia trachomatis
caagggagauguu

SEQ ID NO: 465897 - RNA, 17 nt, Chlamydia trachomatis
caaggcucuugaaaagg

SEQ ID NO: 465898 - RNA, 14 nt, Chlamydia trachomatis
caaggcuuucaaaa

SEQ ID NO: 465899 - RNA, 18 nt, Chlamydia trachomatis
caaggcuuucaaaaagag

SEQ ID NO: 465900 - RNA, 14 nt, Chlamydia trachomatis
caaggcuuuuccau

SEQ ID NO: 465901 - RNA, 15 nt, Chlamydia trachomatis
caaggcuaagaaaaa

SEQ ID NO: 465902 - RNA, 19 nt, Chlamydia trachomatis
caaggcuccguucaaagca

SEQ ID NO: 465903 - RNA, 13 nt, Chlamydia trachomatis
caaggcuccuuuu

SEQ ID NO: 465904 - RNA, 14 nt, Chlamydia trachomatis
caauaaucuuuuua

SEQ ID NO: 465905 - RNA, 15 nt, Chlamydia trachomatis
caauaaucuuuuuau

SEQ ID NO: 465906 - RNA, 17 nt, Chlamydia trachomatis
caauaaucuuuuuauug

SEQ ID NO: 465907 - RNA, 20 nt, Chlamydia trachomatis
caauaaugggccguuuuucu

SEQ ID NO: 465908 - RNA, 16 nt, Chlamydia trachomatis
caauaauguugaaguc

SEQ ID NO: 465909 - RNA, 23 nt, Chlamydia trachomatis
caaguucuccuucuugugagaga

SEQ ID NO: 465910 - RNA, 15 nt, Chlamydia trachomatis
caaguucuucuucca

SEQ ID NO: 465911 - RNA, 20 nt, Chlamydia trachomatis
caaguugagugcagaggauu

SEQ ID NO: 465912 - RNA, 15 nt, Chlamydia trachomatis
caauaaccugaccuu

SEQ ID NO: 465913 - RNA, 22 nt, Chlamydia trachomatis
caauaaccugaccuugaacccc

SEQ ID NO: 465914 - RNA, 20 nt, Chlamydia trachomatis
caaucaccacgagaucugca

SEQ ID NO: 465915 - RNA, 14 nt, Chlamydia trachomatis
caaucacagcaaua

SEQ ID NO: 465916 - RNA, 23 nt, Chlamydia trachomatis
caaucaccgcugcuaaagcagca

SEQ ID NO: 465917 - RNA, 23 nt, Chlamydia trachomatis
caaucacuaaaaguaguccuauc

SEQ ID NO: 465918 - RNA, 15 nt, Chlamydia trachomatis
caaucacuccuccuc

SEQ ID NO: 465919 - RNA, 20 nt, Chlamydia trachomatis
caauauacaaguauuucuug

SEQ ID NO: 465920 - RNA, 17 nt, Chlamydia trachomatis
caauaccuagcaauuca

SEQ ID NO: 465921 - RNA, 18 nt, Chlamydia trachomatis
caauagagauaucaaucg

SEQ ID NO: 465922 - RNA, 17 nt, Chlamydia trachomatis
caauagauagucugcau

SEQ ID NO: 465923 - RNA, 11 nt, Chlamydia trachomatis
caaucagcucu

SEQ ID NO: 465924 - RNA, 20 nt, Chlamydia trachomatis
caaucaguugauacaccucu

SEQ ID NO: 465925 - RNA, 13 nt, Chlamydia trachomatis
caauucagaaaua

SEQ ID NO: 465926 - RNA, 21 nt, Chlamydia trachomatis
caauuccucuaaacaagguuc

SEQ ID NO: 465927 - RNA, 22 nt, Chlamydia trachomatis
caauuccucuaaacaagguucu

SEQ ID NO: 465928 - RNA, 13 nt, Chlamydia trachomatis
caauuccugcuca

SEQ ID NO: 465929 - RNA, 15 nt, Chlamydia trachomatis
caauucuugcuucau

SEQ ID NO: 465930 - RNA, 15 nt, Chlamydia trachomatis
caauuguugagcagc

SEQ ID NO: 465931 - RNA, 22 nt, Chlamydia trachomatis
caauuguugagcagcaaagauc

SEQ ID NO: 465932 - RNA, 11 nt, Chlamydia trachomatis
cacaagaacau

SEQ ID NO: 465933 - RNA, 23 nt, Chlamydia trachomatis
cacaagaaguaacaccucuucug

SEQ ID NO: 465934 - RNA, 15 nt, Chlamydia trachomatis
cacaacucuuuuccu

SEQ ID NO: 465935 - RNA, 17 nt, Chlamydia trachomatis
cacaacuugcguuuucu

SEQ ID NO: 465936 - RNA, 18 nt, Chlamydia trachomatis
cacaacuugcguuuucuu

SEQ ID NO: 465937 - RNA, 19 nt, Chlamydia trachomatis
cacaacuugcguuuucuug

SEQ ID NO: 465938 - RNA, 13 nt, Chlamydia trachomatis
cacaacuaguuua

SEQ ID NO: 465939 - RNA, 19 nt, Chlamydia trachomatis
cacaacuaguuuacgcacu

SEQ ID NO: 465940 - RNA, 23 nt, Chlamydia trachomatis
cacaacgcccaggucuuaauaau

SEQ ID NO: 465941 - RNA, 20 nt, Chlamydia trachomatis
cacaaaggaacaucgagaaa

SEQ ID NO: 465942 - RNA, 15 nt, Chlamydia trachomatis
cacaaauaacagaaa

SEQ ID NO: 465943 - RNA, 19 nt, Chlamydia trachomatis
cacaaauuuaucugcuaaa

SEQ ID NO: 465944 - RNA, 15 nt, Chlamydia trachomatis
cacaaaagcauugaa

SEQ ID NO: 465945 - RNA, 23 nt, Chlamydia trachomatis
caauuuuucuuugagaaaguuaa

SEQ ID NO: 465946 - RNA, 16 nt, Chlamydia trachomatis
caauuuuuguuccuuu

SEQ ID NO: 465947 - RNA, 23 nt, Chlamydia trachomatis
caauuuuuuuauccaaaaaagug

SEQ ID NO: 465948 - RNA, 17 nt, Chlamydia trachomatis
caauuuacuaucaggaa

SEQ ID NO: 465949 - RNA, 19 nt, Chlamydia trachomatis
caauuucaucacagauaau

SEQ ID NO: 465950 - RNA, 18 nt, Chlamydia trachomatis
caauuuccuuagaaagaa

SEQ ID NO: 465951 - RNA, 19 nt, Chlamydia trachomatis
caauuuccuuagaaagaau

SEQ ID NO: 465952 - RNA, 23 nt, Chlamydia trachomatis
caauuucuacgagcugaccuuuu

SEQ ID NO: 465953 - RNA, 15 nt, Chlamydia trachomatis
caauuucucuaccca

SEQ ID NO: 465954 - RNA, 16 nt, Chlamydia trachomatis
cacacaagcugacaaa

SEQ ID NO: 465955 - RNA, 20 nt, Chlamydia trachomatis
cacacaagcugacaaagcuu

SEQ ID NO: 465956 - RNA, 21 nt, Chlamydia trachomatis
cacaaugcguagucucuagca

SEQ ID NO: 465957 - RNA, 13 nt, Chlamydia trachomatis
cacaauuuuucuu

SEQ ID NO: 465958 - RNA, 14 nt, Chlamydia trachomatis
cacaauuuuucuug

SEQ ID NO: 465959 - RNA, 17 nt, Chlamydia trachomatis
cacaauuuuuguuccuu

SEQ ID NO: 465960 - RNA, 18 nt, Chlamydia trachomatis
cacaagauuuugaauacg

SEQ ID NO: 465961 - RNA, 14 nt, Chlamydia trachomatis
cacaaggagauauu

SEQ ID NO: 465962 - RNA, 19 nt, Chlamydia trachomatis
cacaaguaugagaggaaga

SEQ ID NO: 465963 - RNA, 17 nt, Chlamydia trachomatis
cacaagugccaacauca

SEQ ID NO: 465964 - RNA, 20 nt, Chlamydia trachomatis
cacaagugccaacaucaaaa

SEQ ID NO: 465965 - RNA, 13 nt, Chlamydia trachomatis
cacaauaacagca

SEQ ID NO: 465966 - RNA, 13 nt, Chlamydia trachomatis
cacaauauuaucu

SEQ ID NO: 465967 - RNA, 14 nt, Chlamydia trachomatis
cacaauauuaucua

SEQ ID NO: 465968 - RNA, 17 nt, Chlamydia trachomatis
cacaaucucuuuaagcu

SEQ ID NO: 465969 - RNA, 14 nt, Chlamydia trachomatis
cacacgauuaucua

SEQ ID NO: 465970 - RNA, 15 nt, Chlamydia trachomatis
cacacgauuaucuaa

SEQ ID NO: 465971 - RNA, 15 nt, Chlamydia trachomatis
cacaccauucagcaa

SEQ ID NO: 465972 - RNA, 23 nt, Chlamydia trachomatis
cacacuggguaucugaacaagaa

SEQ ID NO: 465973 - RNA, 14 nt, Chlamydia trachomatis
cacacuugauaaau

SEQ ID NO: 465974 - RNA, 19 nt, Chlamydia trachomatis
cacacuugauaaauagcaa

SEQ ID NO: 465975 - RNA, 16 nt, Chlamydia trachomatis
cacagaaacuucuucu

SEQ ID NO: 465976 - RNA, 16 nt, Chlamydia trachomatis
cacagagcuucucuaa

SEQ ID NO: 465977 - RNA, 16 nt, Chlamydia trachomatis
cacagcaugaacagcu

SEQ ID NO: 465978 - RNA, 15 nt, Chlamydia trachomatis
cacaggucauaucca

SEQ ID NO: 465979 - RNA, 15 nt, Chlamydia trachomatis
cacauccuucugcua

SEQ ID NO: 465980 - RNA, 21 nt, Chlamydia trachomatis
cacaugguuuucugggucaua

SEQ ID NO: 465981 - RNA, 22 nt, Chlamydia trachomatis
cacaugguucaaacauagaagg

SEQ ID NO: 465982 - RNA, 15 nt, Chlamydia trachomatis
cacauguccuaccaa

SEQ ID NO: 465983 - RNA, 14 nt, Chlamydia trachomatis
cacaugucauccuu

SEQ ID NO: 465984 - RNA, 16 nt, Chlamydia trachomatis
cacaugucauccuuag

SEQ ID NO: 465985 - RNA, 19 nt, Chlamydia trachomatis
cacauuaucucgacuugcu

SEQ ID NO: 465986 - RNA, 15 nt, Chlamydia trachomatis
cacauucccuaaaua

SEQ ID NO: 465987 - RNA, 19 nt, Chlamydia trachomatis
caccaaguucuucuuuaga

SEQ ID NO: 465988 - RNA, 12 nt, Chlamydia trachomatis
caccaaucaccg

SEQ ID NO: 465989 - RNA, 14 nt, Chlamydia trachomatis
caccaaucaccgcu

SEQ ID NO: 465990 - RNA, 17 nt, Chlamydia trachomatis
caccacgagaucugcau

SEQ ID NO: 465991 - RNA, 19 nt, Chlamydia trachomatis
caccagcggacaaguccuu

SEQ ID NO: 465992 - RNA, 16 nt, Chlamydia trachomatis
caccauagguagaaaa

SEQ ID NO: 465993 - RNA, 18 nt, Chlamydia trachomatis
caccauagguagaaaagg

SEQ ID NO: 465994 - RNA, 20 nt, Chlamydia trachomatis
caccauagguagaaaaggau

SEQ ID NO: 465995 - RNA, 22 nt, Chlamydia trachomatis
caccaggcaaugcuaaggcgau

SEQ ID NO: 465996 - RNA, 15 nt, Chlamydia trachomatis
caccauccaauccug

SEQ ID NO: 465997 - RNA, 18 nt, Chlamydia trachomatis
caccauuacgaggaagcu

SEQ ID NO: 465998 - RNA, 19 nt, Chlamydia trachomatis
caccauucagcaaaaaaau

SEQ ID NO: 465999 - RNA, 23 nt, Chlamydia trachomatis
caccauuuaauauggacuucccu

SEQ ID NO: 466000 - RNA, 14 nt, Chlamydia trachomatis
cacccaaucuucua

SEQ ID NO: 466001 - RNA, 20 nt, Chlamydia trachomatis
cacccuuucuuacuccuucu

SEQ ID NO: 466002 - RNA, 21 nt, Chlamydia trachomatis
cacccuuuuuauaaucuccua

SEQ ID NO: 466003 - RNA, 18 nt, Chlamydia trachomatis
caccgaacaaccuucuga

SEQ ID NO: 466004 - RNA, 14 nt, Chlamydia trachomatis
caccgagcauucug

SEQ ID NO: 466005 - RNA, 20 nt, Chlamydia trachomatis
caccgcaucagccccaaaaa

SEQ ID NO: 466006 - RNA, 19 nt, Chlamydia trachomatis
caccguagaauuucuucuu

SEQ ID NO: 466007 - RNA, 22 nt, Chlamydia trachomatis
caccuauggguaugugggcuuu

SEQ ID NO: 466008 - RNA, 15 nt, Chlamydia trachomatis
caccugcaagagauc

SEQ ID NO: 466009 - RNA, 13 nt, Chlamydia trachomatis
caccucgucucca

SEQ ID NO: 466010 - RNA, 11 nt, Chlamydia trachomatis
caccucuuccg

SEQ ID NO: 466011 - RNA, 22 nt, Chlamydia trachomatis
caccucuugccugcaaauaaua

SEQ ID NO: 466012 - RNA, 20 nt, Chlamydia trachomatis
cacgaacggaaguucuugcu

SEQ ID NO: 466013 - RNA, 18 nt, Chlamydia trachomatis
cacgacacuccucugaau

SEQ ID NO: 466014 - RNA, 23 nt, Chlamydia trachomatis
cacgaguucgccccucuuuuuca

SEQ ID NO: 466015 - RNA, 15 nt, Chlamydia trachomatis
cacgauauauccauu

SEQ ID NO: 466016 - RNA, 17 nt, Chlamydia trachomatis
cacgauaaaagacagaa

SEQ ID NO: 466017 - RNA, 13 nt, Chlamydia trachomatis
cacgcaaaacauc

SEQ ID NO: 466018 - RNA, 17 nt, Chlamydia trachomatis
cacgcaaaacaucuaga

SEQ ID NO: 466019 - RNA, 14 nt, Chlamydia trachomatis
cacgcuacuaacga

SEQ ID NO: 466020 - RNA, 15 nt, Chlamydia trachomatis
cacgcugaguuuccu

SEQ ID NO: 466021 - RNA, 18 nt, Chlamydia trachomatis
cacgcugaguuuccuuua

SEQ ID NO: 466022 - RNA, 14 nt, Chlamydia trachomatis
cacggucaccccua

SEQ ID NO: 466023 - RNA, 23 nt, Chlamydia trachomatis
cacguagucauugauucuaugag

SEQ ID NO: 466024 - RNA, 15 nt, Chlamydia trachomatis
cacgugcaacacaac

SEQ ID NO: 466025 - RNA, 13 nt, Chlamydia trachomatis
cacuaccagcccc

SEQ ID NO: 466026 - RNA, 14 nt, Chlamydia trachomatis
cacuaccccgccuc

SEQ ID NO: 466027 - RNA, 20 nt, Chlamydia trachomatis
cacuaaagagcuucggcuau

SEQ ID NO: 466028 - RNA, 13 nt, Chlamydia trachomatis
cacuaagaauaaa

SEQ ID NO: 466029 - RNA, 17 nt, Chlamydia trachomatis
cacuaagaauaaagaug

SEQ ID NO: 466030 - RNA, 21 nt, Chlamydia trachomatis
cacuauuagggagcccagcau

SEQ ID NO: 466031 - RNA, 21 nt, Chlamydia trachomatis
cacuaucuccuauugagcgca

SEQ ID NO: 466032 - RNA, 18 nt, Chlamydia trachomatis
cacuaugaacaaacagcu

SEQ ID NO: 466033 - RNA, 20 nt, Chlamydia trachomatis
cacuaucauugagcaaaaaa

SEQ ID NO: 466034 - RNA, 17 nt, Chlamydia trachomatis
cacucgagucaugcaaa

SEQ ID NO: 466035 - RNA, 13 nt, Chlamydia trachomatis
cacuccuccuccu

SEQ ID NO: 466036 - RNA, 14 nt, Chlamydia trachomatis
cacuccuccuccua

SEQ ID NO: 466037 - RNA, 18 nt, Chlamydia trachomatis
cacucgugaaauaaauca

SEQ ID NO: 466038 - RNA, 21 nt, Chlamydia trachomatis
cacucucucgaucucaucaaa

SEQ ID NO: 466039 - RNA, 16 nt, Chlamydia trachomatis
cacucuugauagucuu

SEQ ID NO: 466040 - RNA, 16 nt, Chlamydia trachomatis
cacugacuauuccuga

SEQ ID NO: 466041 - RNA, 21 nt, Chlamydia trachomatis
cacugacuguagaaaaucaua

SEQ ID NO: 466042 - RNA, 18 nt, Chlamydia trachomatis
cagcuaagggcuguguag

SEQ ID NO: 466043 - RNA, 16 nt, Chlamydia trachomatis
cagcucgaucaauaag

SEQ ID NO: 466044 - RNA, 13 nt, Chlamydia trachomatis
cagcucaccagcu

SEQ ID NO: 466045 - RNA, 16 nt, Chlamydia trachomatis
cagcucaccagcuucc

SEQ ID NO: 466046 - RNA, 18 nt, Chlamydia trachomatis
cagcucaccagcuuccca

SEQ ID NO: 466047 - RNA, 21 nt, Chlamydia trachomatis
cagcucuccucgugaggcaug

SEQ ID NO: 466048 - RNA, 14 nt, Chlamydia trachomatis
cagcucuuacuccu

SEQ ID NO: 466049 - RNA, 12 nt, Chlamydia trachomatis
caggaaaagcuu

SEQ ID NO: 466050 - RNA, 13 nt, Chlamydia trachomatis
cagcuuucguuga

SEQ ID NO: 466051 - RNA, 12 nt, Chlamydia trachomatis
cagcuuuaaaga

SEQ ID NO: 466052 - RNA, 17 nt, Chlamydia trachomatis
cagcuucugaacgagaa

SEQ ID NO: 466053 - RNA, 19 nt, Chlamydia trachomatis
cagcuucugaacgagaaaa

SEQ ID NO: 466054 - RNA, 18 nt, Chlamydia trachomatis
caggauaacaaacaacac

SEQ ID NO: 466055 - RNA, 22 nt, Chlamydia trachomatis
caggaucccucuguccauucua

SEQ ID NO: 466056 - RNA, 20 nt, Chlamydia trachomatis
caggauaggacuugaaccua

SEQ ID NO: 466057 - RNA, 15 nt, Chlamydia trachomatis
caggauauccaucaa

SEQ ID NO: 466058 - RNA, 14 nt, Chlamydia trachomatis
caggauuuucuaau

SEQ ID NO: 466059 - RNA, 14 nt, Chlamydia trachomatis
caggccuuccaccu

SEQ ID NO: 466060 - RNA, 23 nt, Chlamydia trachomatis
caggccucccuaucaauuccugg

SEQ ID NO: 466061 - RNA, 18 nt, Chlamydia trachomatis
caggcugaucaauaccua

SEQ ID NO: 466062 - RNA, 17 nt, Chlamydia trachomatis
cagggauaguaaaaacu

SEQ ID NO: 466063 - RNA, 21 nt, Chlamydia trachomatis
cagggauaguaaaaacuauaa

SEQ ID NO: 466064 - RNA, 20 nt, Chlamydia trachomatis
cagguauuuccugcaagcac

SEQ ID NO: 466065 - RNA, 13 nt, Chlamydia trachomatis
caggucuuaauaa

SEQ ID NO: 466066 - RNA, 21 nt, Chlamydia trachomatis
caggugaauucuccaggagau

SEQ ID NO: 466067 - RNA, 18 nt, Chlamydia trachomatis
cagguucguuauucucaa

SEQ ID NO: 466068 - RNA, 15 nt, Chlamydia trachomatis
caguaaucaaauuuc

SEQ ID NO: 466069 - RNA, 16 nt, Chlamydia trachomatis
caguaaucaaauuucu

SEQ ID NO: 466070 - RNA, 14 nt, Chlamydia trachomatis
cagugcucaaagau

SEQ ID NO: 466071 - RNA, 22 nt, Chlamydia trachomatis
cagugcgcuuagcacuugaguu

SEQ ID NO: 466072 - RNA, 16 nt, Chlamydia trachomatis
caguuaagccuucucc

SEQ ID NO: 466073 - RNA, 18 nt, Chlamydia trachomatis
caguuacauuuuucgcua

SEQ ID NO: 466074 - RNA, 16 nt, Chlamydia trachomatis
caguuacccucuuuag

SEQ ID NO: 466075 - RNA, 18 nt, Chlamydia trachomatis
caguuaggaaaugaggac

SEQ ID NO: 466076 - RNA, 15 nt, Chlamydia trachomatis
caguuaggcauuccu

SEQ ID NO: 466077 - RNA, 19 nt, Chlamydia trachomatis
caguuccgcagagaucuaa

SEQ ID NO: 466078 - RNA, 22 nt, Chlamydia trachomatis
cauaauagcuugcacagcaagc

SEQ ID NO: 466079 - RNA, 11 nt, Chlamydia trachomatis
cauaaggaaga

SEQ ID NO: 466080 - RNA, 19 nt, Chlamydia trachomatis
cauaaggaagaugggcaua

SEQ ID NO: 466081 - RNA, 19 nt, Chlamydia trachomatis
cauaaggaagcaaaaacug

SEQ ID NO: 466082 - RNA, 20 nt, Chlamydia trachomatis
cauaagaucuuuacuuucuu

SEQ ID NO: 466083 - RNA, 18 nt, Chlamydia trachomatis
cauaagcacuauaucucc

SEQ ID NO: 466084 - RNA, 12 nt, Chlamydia trachomatis
cauaaaggaaag

SEQ ID NO: 466085 - RNA, 17 nt, Chlamydia trachomatis
cauaacuuuaauagcca

SEQ ID NO: 466086 - RNA, 23 nt, Chlamydia trachomatis
cauaagaaaauucuucugauaaa

SEQ ID NO: 466087 - RNA, 14 nt, Chlamydia trachomatis
cauaagagcaucuu

SEQ ID NO: 466088 - RNA, 21 nt, Chlamydia trachomatis
caguuugaaucacagaaacuu

SEQ ID NO: 466089 - RNA, 23 nt, Chlamydia trachomatis
caguuucuccuaaaguugguaga

SEQ ID NO: 466090 - RNA, 18 nt, Chlamydia trachomatis
caguuucaaacauccagu

SEQ ID NO: 466091 - RNA, 20 nt, Chlamydia trachomatis
cauaaaacuauggagagggu

SEQ ID NO: 466092 - RNA, 21 nt, Chlamydia trachomatis
cauaaaacuauggagaggguu

SEQ ID NO: 466093 - RNA, 12 nt, Chlamydia trachomatis
cauaaaacugcg

SEQ ID NO: 466094 - RNA, 23 nt, Chlamydia trachomatis
cauaaaauuucauacgcacagca

SEQ ID NO: 466095 - RNA, 15 nt, Chlamydia trachomatis
cauagaaggaaugca

SEQ ID NO: 466096 - RNA, 20 nt, Chlamydia trachomatis
cauaauuacauugcaguaca

SEQ ID NO: 466097 - RNA, 12 nt, Chlamydia trachomatis
cauacaaaagcg

SEQ ID NO: 466098 - RNA, 21 nt, Chlamydia trachomatis
cauagauaaugacagguuuca

SEQ ID NO: 466099 - RNA, 17 nt, Chlamydia trachomatis
cauagauucaugagacc

SEQ ID NO: 466100 - RNA, 22 nt, Chlamydia trachomatis
cauagauugugguuagaaauuc

SEQ ID NO: 466101 - RNA, 22 nt, Chlamydia trachomatis
cauagccuuuagauaguuacuu

SEQ ID NO: 466102 - RNA, 20 nt, Chlamydia trachomatis
cauagcaugggcugcaucag

SEQ ID NO: 466103 - RNA, 16 nt, Chlamydia trachomatis
cauagccaucaguccu

SEQ ID NO: 466104 - RNA, 16 nt, Chlamydia trachomatis
cauauagcauggaaga

SEQ ID NO: 466105 - RNA, 20 nt, Chlamydia trachomatis
cauaucaggaccuagagagg

SEQ ID NO: 466106 - RNA, 17 nt, Chlamydia trachomatis
cauaguugcaggcaaau

SEQ ID NO: 466107 - RNA, 18 nt, Chlamydia trachomatis
cauaguugucuguauaga

SEQ ID NO: 466108 - RNA, 23 nt, Chlamydia trachomatis
cauaggaucuggaaccggaggau

SEQ ID NO: 466109 - RNA, 20 nt, Chlamydia trachomatis
cauaggaauacgaaaugaca

SEQ ID NO: 466110 - RNA, 20 nt, Chlamydia trachomatis
cauaggcuccugcaagggaa

SEQ ID NO: 466111 - RNA, 16 nt, Chlamydia trachomatis
cauauccuugagcuga

SEQ ID NO: 466112 - RNA, 21 nt, Chlamydia trachomatis
cauauccuuugaugagcuuua

SEQ ID NO: 466113 - RNA, 12 nt, Chlamydia trachomatis
cauauuccaaag

SEQ ID NO: 466114 - RNA, 19 nt, Chlamydia trachomatis
caucacugaccgaagaacu

SEQ ID NO: 466115 - RNA, 14 nt, Chlamydia trachomatis
caucaggaauagcu

SEQ ID NO: 466116 - RNA, 14 nt, Chlamydia trachomatis
cauccauaaaaacu

SEQ ID NO: 466117 - RNA, 15 nt, Chlamydia trachomatis
cauccauaacgaaga

SEQ ID NO: 466118 - RNA, 24 nt, Chlamydia trachomatis
cauccauggcaauggcuaagccau

SEQ ID NO: 466119 - RNA, 21 nt, Chlamydia trachomatis
cauccccagaacgcaauguuu

SEQ ID NO: 466120 - RNA, 23 nt, Chlamydia trachomatis
caucccuugaacuagaaauaaaa

SEQ ID NO: 466121 - RNA, 17 nt, Chlamydia trachomatis
caucgaucgucaucagu

SEQ ID NO: 466122 - RNA, 18 nt, Chlamydia trachomatis
caucgaugauaucuucug

SEQ ID NO: 466123 - RNA, 15 nt, Chlamydia trachomatis
caucgauuuuugcua

SEQ ID NO: 466124 - RNA, 16 nt, Chlamydia trachomatis
caucucaagucuccac

SEQ ID NO: 466125 - RNA, 18 nt, Chlamydia trachomatis
caucuauuuucucuuuaa

SEQ ID NO: 466126 - RNA, 12 nt, Chlamydia trachomatis
caucuaaaagag

SEQ ID NO: 466127 - RNA, 19 nt, Chlamydia trachomatis
caucuaaaagaguuucuuu

SEQ ID NO: 466128 - RNA, 24 nt, Chlamydia trachomatis
caucuaaaggcaacucucucuccc

SEQ ID NO: 466129 - RNA, 23 nt, Chlamydia trachomatis
caucuaaagggagaauuuuaaac

SEQ ID NO: 466130 - RNA, 18 nt, Chlamydia trachomatis
caugaacagcuucgugag

SEQ ID NO: 466131 - RNA, 21 nt, Chlamydia trachomatis
caugaacagcuucgugagaca

SEQ ID NO: 466132 - RNA, 22 nt, Chlamydia trachomatis
caugaacauggcugcaggauau

SEQ ID NO: 466133 - RNA, 19 nt, Chlamydia trachomatis
caucucuaccagggauaaa

SEQ ID NO: 466134 - RNA, 13 nt, Chlamydia trachomatis
caucucuauacgg

SEQ ID NO: 466135 - RNA, 18 nt, Chlamydia trachomatis
caugaagacccguuuucu

SEQ ID NO: 466136 - RNA, 15 nt, Chlamydia trachomatis
caugaauggaaagua

SEQ ID NO: 466137 - RNA, 21 nt, Chlamydia trachomatis
caugaccagguuuacggucac

SEQ ID NO: 466138 - RNA, 21 nt, Chlamydia trachomatis
caugacagcuucuugaaugcc

SEQ ID NO: 466139 - RNA, 18 nt, Chlamydia trachomatis
caugagcgauaugcuuuu

SEQ ID NO: 466140 - RNA, 22 nt, Chlamydia trachomatis
caugagaaaccaauuguugagc

SEQ ID NO: 466141 - RNA, 19 nt, Chlamydia trachomatis
caugagaccgucaaaaaga

SEQ ID NO: 466142 - RNA, 20 nt, Chlamydia trachomatis
caugagaccgucaaaaagau

SEQ ID NO: 466143 - RNA, 23 nt, Chlamydia trachomatis
caugauccccuacgcuacgagca

SEQ ID NO: 466144 - RNA, 14 nt, Chlamydia trachomatis
caugaucucugcag

SEQ ID NO: 466145 - RNA, 16 nt, Chlamydia trachomatis
caugaucucugcagaa

SEQ ID NO: 466146 - RNA, 20 nt, Chlamydia trachomatis
caugaucucugcagaagaag

SEQ ID NO: 466147 - RNA, 14 nt, Chlamydia trachomatis
caugauauuuugaa

SEQ ID NO: 466148 - RNA, 18 nt, Chlamydia trachomatis
caugauauuuugaagaua

SEQ ID NO: 466149 - RNA, 20 nt, Chlamydia trachomatis
caugauauuuugaagauaaa

SEQ ID NO: 466150 - RNA, 23 nt, Chlamydia trachomatis
caugaugcugcgauguggucaaa

SEQ ID NO: 466151 - RNA, 20 nt, Chlamydia trachomatis
caugccgcgaagcacuggau

SEQ ID NO: 466152 - RNA, 21 nt, Chlamydia trachomatis
cauguaaauuggcucgcagua

SEQ ID NO: 466153 - RNA, 20 nt, Chlamydia trachomatis
caugucgagauaaaaaccuc

SEQ ID NO: 466154 - RNA, 18 nt, Chlamydia trachomatis
cauguauucuccuuuuug

SEQ ID NO: 466155 - RNA, 18 nt, Chlamydia trachomatis
cauguacuucgccuuuaa

SEQ ID NO: 466156 - RNA, 15 nt, Chlamydia trachomatis
cauucaaaauccauu

SEQ ID NO: 466157 - RNA, 13 nt, Chlamydia trachomatis
cauucaaccucuc

SEQ ID NO: 466158 - RNA, 20 nt, Chlamydia trachomatis
cauuacucguuaucuaggaa

SEQ ID NO: 466159 - RNA, 16 nt, Chlamydia trachomatis
cauuacgaggaagcug

SEQ ID NO: 466160 - RNA, 15 nt, Chlamydia trachomatis
cauuacgccccuucu

SEQ ID NO: 466161 - RNA, 16 nt, Chlamydia trachomatis
cauuccacgcuauaga

SEQ ID NO: 466162 - RNA, 19 nt, Chlamydia trachomatis
cauugcaggagaucuuuug

SEQ ID NO: 466163 - RNA, 14 nt, Chlamydia trachomatis
cauugaaauagcca

SEQ ID NO: 466164 - RNA, 15 nt, Chlamydia trachomatis
cauugguauugccau

SEQ ID NO: 466165 - RNA, 22 nt, Chlamydia trachomatis
cauuggugguaacaccaaaaaa

SEQ ID NO: 466166 - RNA, 18 nt, Chlamydia trachomatis
cauuguaaauagacuucu

SEQ ID NO: 466167 - RNA, 24 nt, Chlamydia trachomatis
cauuguaaauagacuucuucgucc

SEQ ID NO: 466168 - RNA, 18 nt, Chlamydia trachomatis
cauuuagaccaggauucc

SEQ ID NO: 466169 - RNA, 20 nt, Chlamydia trachomatis
cauuuccacaagauuuugaa

SEQ ID NO: 466170 - RNA, 21 nt, Chlamydia trachomatis
cauuucacuauccaaagcugc

SEQ ID NO: 466171 - RNA, 22 nt, Chlamydia trachomatis
cauuuccagccucuccagaaaa

SEQ ID NO: 466172 - RNA, 19 nt, Chlamydia trachomatis
cauuuccauagaaagauag

SEQ ID NO: 466173 - RNA, 22 nt, Chlamydia trachomatis
cauuuccgguauuaauaaugaa

SEQ ID NO: 466174 - RNA, 17 nt, Chlamydia trachomatis
cauuuccuaaggcuugg

SEQ ID NO: 466175 - RNA, 15 nt, Chlamydia trachomatis
ccaaagguuguugcu

SEQ ID NO: 466176 - RNA, 12 nt, Chlamydia trachomatis
ccaaaguaaaau

SEQ ID NO: 466177 - RNA, 15 nt, Chlamydia trachomatis
ccaaauaaaacgaaa

SEQ ID NO: 466178 - RNA, 23 nt, Chlamydia trachomatis
ccaaauaaaacgaaaaacagaaa

SEQ ID NO: 466179 - RNA, 13 nt, Chlamydia trachomatis
ccaaauaaacaca

SEQ ID NO: 466180 - RNA, 20 nt, Chlamydia trachomatis
ccaaauaauacuccaccuag

SEQ ID NO: 466181 - RNA, 15 nt, Chlamydia trachomatis
ccaaauaaucccaca

SEQ ID NO: 466182 - RNA, 19 nt, Chlamydia trachomatis
ccaaaucugcaagaacaaa

SEQ ID NO: 466183 - RNA, 21 nt, Chlamydia trachomatis
ccaaagaugcuccuacaaaau

SEQ ID NO: 466184 - RNA, 22 nt, Chlamydia trachomatis
ccaaagagauuguaaucuaucu

SEQ ID NO: 466185 - RNA, 14 nt, Chlamydia trachomatis
ccaaagaauagaau

SEQ ID NO: 466186 - RNA, 14 nt, Chlamydia trachomatis
ccaaagaauuuuua

SEQ ID NO: 466187 - RNA, 21 nt, Chlamydia trachomatis
ccaaaaguguuuagaagugcu

SEQ ID NO: 466188 - RNA, 14 nt, Chlamydia trachomatis
ccaaaagaucuuga

SEQ ID NO: 466189 - RNA, 21 nt, Chlamydia trachomatis
ccaaaagaucuugaucugugg

SEQ ID NO: 466190 - RNA, 23 nt, Chlamydia trachomatis
ccaaaagaucuugaucuguggag

SEQ ID NO: 466191 - RNA, 21 nt, Chlamydia trachomatis
ccaaaaaagcgucuccaaaag

SEQ ID NO: 466192 - RNA, 19 nt, Chlamydia trachomatis
ccaaaaacaaucaaagcac

SEQ ID NO: 466193 - RNA, 20 nt, Chlamydia trachomatis
ccaaaaacagcagaacucaa

SEQ ID NO: 466194 - RNA, 20 nt, Chlamydia trachomatis
ccaaaauaucuacuucuugu

SEQ ID NO: 466195 - RNA, 22 nt, Chlamydia trachomatis
ccaaaauuuuucugcuccaaag

SEQ ID NO: 466196 - RNA, 13 nt, Chlamydia trachomatis
ccaaacauuuuga

SEQ ID NO: 466197 - RNA, 15 nt, Chlamydia trachomatis
ccaaaccaugaugcu

SEQ ID NO: 466198 - RNA, 17 nt, Chlamydia trachomatis
ccaacaagggaaugaaa

SEQ ID NO: 466199 - RNA, 16 nt, Chlamydia trachomatis
ccaaaugaccuuuccc

SEQ ID NO: 466200 - RNA, 11 nt, Chlamydia trachomatis
ccaacaaaaag

SEQ ID NO: 466201 - RNA, 12 nt, Chlamydia trachomatis
ccaacugagcua

SEQ ID NO: 466202 - RNA, 20 nt, Chlamydia trachomatis
ccaagaaacuuuucugcaga

SEQ ID NO: 466203 - RNA, 22 nt, Chlamydia trachomatis
ccaacuuacguccgacugcucc

SEQ ID NO: 466204 - RNA, 20 nt, Chlamydia trachomatis
ccaacgcauguaauucaugg

SEQ ID NO: 466205 - RNA, 23 nt, Chlamydia trachomatis
ccaacgagaugaccacuacucua

SEQ ID NO: 466206 - RNA, 13 nt, Chlamydia trachomatis
ccaagaacaaagc

SEQ ID NO: 466207 - RNA, 17 nt, Chlamydia trachomatis
ccaagaacaaagcaucu

SEQ ID NO: 466208 - RNA, 14 nt, Chlamydia trachomatis
ccaagcacuccuca

SEQ ID NO: 466209 - RNA, 18 nt, Chlamydia trachomatis
ccaagcacuccucagcau

SEQ ID NO: 466210 - RNA, 19 nt, Chlamydia trachomatis
ccaagcaagauauaaacaa

SEQ ID NO: 466211 - RNA, 21 nt, Chlamydia trachomatis
ccaagcaagauauaaacaaua

SEQ ID NO: 466212 - RNA, 18 nt, Chlamydia trachomatis
ccaagcucgagucucuug

SEQ ID NO: 466213 - RNA, 20 nt, Chlamydia trachomatis
ccaagggggguuaagaaaac

SEQ ID NO: 466214 - RNA, 18 nt, Chlamydia trachomatis
ccaaguuuuuuucauccu

SEQ ID NO: 466215 - RNA, 18 nt, Chlamydia trachomatis
ccaaucguauaauaaugg

SEQ ID NO: 466216 - RNA, 16 nt, Chlamydia trachomatis
ccaaucuucuaaaugc

SEQ ID NO: 466217 - RNA, 17 nt, Chlamydia trachomatis
ccaauauauuccugucu

SEQ ID NO: 466218 - RNA, 22 nt, Chlamydia trachomatis
ccaauauuauuuacgagagggu

SEQ ID NO: 466219 - RNA, 23 nt, Chlamydia trachomatis
ccaauauuauuuacgagaggguu

SEQ ID NO: 466220 - RNA, 15 nt, Chlamydia trachomatis
ccaauuaaguuccuu

SEQ ID NO: 466221 - RNA, 12 nt, Chlamydia trachomatis
ccacaagaagua

SEQ ID NO: 466222 - RNA, 19 nt, Chlamydia trachomatis
ccaauuuuuuuauccaaaa

SEQ ID NO: 466223 - RNA, 18 nt, Chlamydia trachomatis
ccacaaacaaaaaagaaa

SEQ ID NO: 466224 - RNA, 21 nt, Chlamydia trachomatis
ccacaaaccauccuucugauu

SEQ ID NO: 466225 - RNA, 16 nt, Chlamydia trachomatis
ccacaauuuuucuugu

SEQ ID NO: 466226 - RNA, 21 nt, Chlamydia trachomatis
ccacacauguccuaccaauau

SEQ ID NO: 466227 - RNA, 14 nt, Chlamydia trachomatis
ccacacuaccccgc

SEQ ID NO: 466228 - RNA, 21 nt, Chlamydia trachomatis
ccacagguugcaucaacaaua

SEQ ID NO: 466229 - RNA, 22 nt, Chlamydia trachomatis
ccacagguugcaucaacaauag

SEQ ID NO: 466230 - RNA, 20 nt, Chlamydia trachomatis
ccacacuuccccauucuucu

SEQ ID NO: 466231 - RNA, 17 nt, Chlamydia trachomatis
ccacauuauucacacuu

SEQ ID NO: 466232 - RNA, 15 nt, Chlamydia trachomatis
ccacauucacuucaa

SEQ ID NO: 466233 - RNA, 15 nt, Chlamydia trachomatis
ccacaguucccaucc

SEQ ID NO: 466234 - RNA, 12 nt, Chlamydia trachomatis
ccacauucuuuc

SEQ ID NO: 466235 - RNA, 19 nt, Chlamydia trachomatis
ccaccagacuauuucuucu

SEQ ID NO: 466236 - RNA, 14 nt, Chlamydia trachomatis
ccaccagccacauc

SEQ ID NO: 466237 - RNA, 18 nt, Chlamydia trachomatis
ccacgaaaagacucuccc

SEQ ID NO: 466238 - RNA, 23 nt, Chlamydia trachomatis
ccacuuuccgaaauaauugcgaa

SEQ ID NO: 466239 - RNA, 18 nt, Chlamydia trachomatis
ccacgugcaacacaacuu

SEQ ID NO: 466240 - RNA, 22 nt, Chlamydia trachomatis
ccagagcucauagucugaucca

SEQ ID NO: 466241 - RNA, 19 nt, Chlamydia trachomatis
ccagcaauaccgaaucuaa

SEQ ID NO: 466242 - RNA, 17 nt, Chlamydia trachomatis
ccagcauucauaaacac

SEQ ID NO: 466243 - RNA, 21 nt, Chlamydia trachomatis
ccagcgugucuaccaauuuca

SEQ ID NO: 466244 - RNA, 20 nt, Chlamydia trachomatis
ccaggaucccucuguccauu

SEQ ID NO: 466245 - RNA, 19 nt, Chlamydia trachomatis
ccaggauaacaaacaacac

SEQ ID NO: 466246 - RNA, 20 nt, Chlamydia trachomatis
ccaggauaacaaacaacacu

SEQ ID NO: 466247 - RNA, 19 nt, Chlamydia trachomatis
ccaggauaggacuugaacc

SEQ ID NO: 466248 - RNA, 13 nt, Chlamydia trachomatis
ccagcuucuccau

SEQ ID NO: 466249 - RNA, 13 nt, Chlamydia trachomatis
ccagcucuuccau

SEQ ID NO: 466250 - RNA, 18 nt, Chlamydia trachomatis
ccagguaaacucaagggc

SEQ ID NO: 466251 - RNA, 23 nt, Chlamydia trachomatis
ccagguuuacggucacuccucca

SEQ ID NO: 466252 - RNA, 18 nt, Chlamydia trachomatis
ccaguaaucaaauuucuu

SEQ ID NO: 466253 - RNA, 16 nt, Chlamydia trachomatis
ccagggagagcuuagg

SEQ ID NO: 466254 - RNA, 16 nt, Chlamydia trachomatis
ccagggauaaaugaua

SEQ ID NO: 466255 - RNA, 18 nt, Chlamydia trachomatis
ccaguuaggcauuccuuu

SEQ ID NO: 466256 - RNA, 17 nt, Chlamydia trachomatis
ccauaauacgaauaaga

SEQ ID NO: 466257 - RNA, 13 nt, Chlamydia trachomatis
ccauaauccuaug

SEQ ID NO: 466258 - RNA, 15 nt, Chlamydia trachomatis
ccauacuuacuucua

SEQ ID NO: 466259 - RNA, 16 nt, Chlamydia trachomatis
ccauccaguugguaca

SEQ ID NO: 466260 - RNA, 16 nt, Chlamydia trachomatis
ccauccugaacaauau

SEQ ID NO: 466261 - RNA, 18 nt, Chlamydia trachomatis
ccaucgccuucuauagcu

SEQ ID NO: 466262 - RNA, 23 nt, Chlamydia trachomatis
ccaucucggaucgagaagagcca

SEQ ID NO: 466263 - RNA, 14 nt, Chlamydia trachomatis
ccaucuccaaucac

SEQ ID NO: 466264 - RNA, 22 nt, Chlamydia trachomatis
ccaugacauaagcaaauccugc

SEQ ID NO: 466265 - RNA, 14 nt, Chlamydia trachomatis
ccaugaaugacugc

SEQ ID NO: 466266 - RNA, 19 nt, Chlamydia trachomatis
ccaucugcccuuugugcau

SEQ ID NO: 466267 - RNA, 18 nt, Chlamydia trachomatis
ccaucuucaccaacucca

SEQ ID NO: 466268 - RNA, 23 nt, Chlamydia trachomatis
ccaucuucaccaacuccaagcau

SEQ ID NO: 466269 - RNA, 19 nt, Chlamydia trachomatis
ccaugcaucuccucuggag

SEQ ID NO: 466270 - RNA, 20 nt, Chlamydia trachomatis
ccaugauuucuuuaacaucu

SEQ ID NO: 466271 - RNA, 13 nt, Chlamydia trachomatis
ccaugaucucugc

SEQ ID NO: 466272 - RNA, 19 nt, Chlamydia trachomatis
ccaugaucucugcagaaga

SEQ ID NO: 466273 - RNA, 14 nt, Chlamydia trachomatis
ccauggcaguuaag

SEQ ID NO: 466274 - RNA, 14 nt, Chlamydia trachomatis
ccaugcuccuuuca

SEQ ID NO: 466275 - RNA, 13 nt, Chlamydia trachomatis
ccauuccuccuau

SEQ ID NO: 466276 - RNA, 17 nt, Chlamydia trachomatis
ccauucgcauuaaauaa

SEQ ID NO: 466277 - RNA, 23 nt, Chlamydia trachomatis
ccauucuacguaguaauuuugac

SEQ ID NO: 466278 - RNA, 16 nt, Chlamydia trachomatis
ccauucuucucgaacu

SEQ ID NO: 466279 - RNA, 18 nt, Chlamydia trachomatis
ccauucuucucgaacuca

SEQ ID NO: 466280 - RNA, 14 nt, Chlamydia trachomatis
ccauugcugaugca

SEQ ID NO: 466281 - RNA, 17 nt, Chlamydia trachomatis
cccaagaaacuuuucug

SEQ ID NO: 466282 - RNA, 20 nt, Chlamydia trachomatis
cccaagaaacuuuucugcag

SEQ ID NO: 466283 - RNA, 22 nt, Chlamydia trachomatis
cccaagagugugguaugcugaa

SEQ ID NO: 466284 - RNA, 16 nt, Chlamydia trachomatis
ccauuguagaugcugu

SEQ ID NO: 466285 - RNA, 14 nt, Chlamydia trachomatis
cccaacgcaucucc

SEQ ID NO: 466286 - RNA, 12 nt, Chlamydia trachomatis
cccaagcuuuca

SEQ ID NO: 466287 - RNA, 19 nt, Chlamydia trachomatis
cccaagcuuucaucuccuu

SEQ ID NO: 466288 - RNA, 18 nt, Chlamydia trachomatis
cccaaggaaaagaugaag

SEQ ID NO: 466289 - RNA, 19 nt, Chlamydia trachomatis
cccaaggaaaagaugaaga

SEQ ID NO: 466290 - RNA, 20 nt, Chlamydia trachomatis
cccaaucgaguagcaauaac

SEQ ID NO: 466291 - RNA, 20 nt, Chlamydia trachomatis
cccacauuaccauucacacc

SEQ ID NO: 466292 - RNA, 18 nt, Chlamydia trachomatis
cccacaguucccauccaa

SEQ ID NO: 466293 - RNA, 16 nt, Chlamydia trachomatis
cccaauuaaaacaaua

SEQ ID NO: 466294 - RNA, 17 nt, Chlamydia trachomatis
cccagaacaacuucucu

SEQ ID NO: 466295 - RNA, 20 nt, Chlamydia trachomatis
cccagaaguaucuaacaaua

SEQ ID NO: 466296 - RNA, 15 nt, Chlamydia trachomatis
cccagaaucaucugg

SEQ ID NO: 466297 - RNA, 19 nt, Chlamydia trachomatis
cccagcaauaccgaaucua

SEQ ID NO: 466298 - RNA, 19 nt, Chlamydia trachomatis
cccagauuuuucaaaaaua

SEQ ID NO: 466299 - RNA, 17 nt, Chlamydia trachomatis
cccauagauucaugaga

SEQ ID NO: 466300 - RNA, 18 nt, Chlamydia trachomatis
cccauaaaagccauagcc

SEQ ID NO: 466301 - RNA, 17 nt, Chlamydia trachomatis
cccaucuugcacauuuu

SEQ ID NO: 466302 - RNA, 20 nt, Chlamydia trachomatis
cccaucuugcacauuuucuu

SEQ ID NO: 466303 - RNA, 21 nt, Chlamydia trachomatis
cccaucgauuuuugcuaagca

SEQ ID NO: 466304 - RNA, 20 nt, Chlamydia trachomatis
cccaucuacaaaaccaaaau

SEQ ID NO: 466305 - RNA, 14 nt, Chlamydia trachomatis
cccagugacuauuu

SEQ ID NO: 466306 - RNA, 17 nt, Chlamydia trachomatis
cccaggauaacaaacaa

SEQ ID NO: 466307 - RNA, 21 nt, Chlamydia trachomatis
cccagcuuauuaauuucuaga

SEQ ID NO: 466308 - RNA, 23 nt, Chlamydia trachomatis
ccccgaacaaucuacaccauuac

SEQ ID NO: 466309 - RNA, 13 nt, Chlamydia trachomatis
ccccuacaaacau

SEQ ID NO: 466310 - RNA, 19 nt, Chlamydia trachomatis
ccccuauguaaacaagaau

SEQ ID NO: 466311 - RNA, 23 nt, Chlamydia trachomatis
ccccuggaauuucuccagcaucu

SEQ ID NO: 466312 - RNA, 21 nt, Chlamydia trachomatis
ccccuuagggaaaccccaaug

SEQ ID NO: 466313 - RNA, 15 nt, Chlamydia trachomatis
ccccuuauuuaccuu

SEQ ID NO: 466314 - RNA, 18 nt, Chlamydia trachomatis
cccucguguaauugcugu

SEQ ID NO: 466315 - RNA, 17 nt, Chlamydia trachomatis
cccugcagccucugccg

SEQ ID NO: 466316 - RNA, 16 nt, Chlamydia trachomatis
cccugaacauccacca

SEQ ID NO: 466317 - RNA, 14 nt, Chlamydia trachomatis
cccugcucuugaag

SEQ ID NO: 466318 - RNA, 20 nt, Chlamydia trachomatis
cccugcuucacagcuaauca

SEQ ID NO: 466319 - RNA, 13 nt, Chlamydia trachomatis
cccuguauucuga

SEQ ID NO: 466320 - RNA, 19 nt, Chlamydia trachomatis
cccuuacaauguaaacaau

SEQ ID NO: 466321 - RNA, 21 nt, Chlamydia trachomatis
cccuuacaauguaaacaauau

SEQ ID NO: 466322 - RNA, 18 nt, Chlamydia trachomatis
cccuuccaaauuucccuc

SEQ ID NO: 466323 - RNA, 23 nt, Chlamydia trachomatis
cccuuccaaauuucccucuuccc

SEQ ID NO: 466324 - RNA, 23 nt, Chlamydia trachomatis
cccuuccaauaauuugcgcgucu

SEQ ID NO: 466325 - RNA, 22 nt, Chlamydia trachomatis
cccuucuuucuucuaagaaguu

SEQ ID NO: 466326 - RNA, 19 nt, Chlamydia trachomatis
ccgaagauucgcugcuguc

SEQ ID NO: 466327 - RNA, 16 nt, Chlamydia trachomatis
ccgaagguucuucuuc

SEQ ID NO: 466328 - RNA, 18 nt, Chlamydia trachomatis
ccgaagguucuucuucga

SEQ ID NO: 466329 - RNA, 19 nt, Chlamydia trachomatis
ccgagauuaucauucaaaa

SEQ ID NO: 466330 - RNA, 14 nt, Chlamydia trachomatis
ccgacuaaaaaauu

SEQ ID NO: 466331 - RNA, 20 nt, Chlamydia trachomatis
ccgauuacuugagaacaaac

SEQ ID NO: 466332 - RNA, 13 nt, Chlamydia trachomatis
ccgauucaaaaau

SEQ ID NO: 466333 - RNA, 18 nt, Chlamydia trachomatis
ccgaugcccaagaaacug

SEQ ID NO: 466334 - RNA, 13 nt, Chlamydia trachomatis
ccgcaaacaaaau

SEQ ID NO: 466335 - RNA, 18 nt, Chlamydia trachomatis
ccgcaguaaaaucuaaaa

SEQ ID NO: 466336 - RNA, 22 nt, Chlamydia trachomatis
ccgcaguaaaaucuaaaauauc

SEQ ID NO: 466337 - RNA, 14 nt, Chlamydia trachomatis
ccgcagcuucuuua

SEQ ID NO: 466338 - RNA, 20 nt, Chlamydia trachomatis
ccgccguuuguucucugguc

SEQ ID NO: 466339 - RNA, 16 nt, Chlamydia trachomatis
ccgcuuaagcuguucu

SEQ ID NO: 466340 - RNA, 21 nt, Chlamydia trachomatis
ccggagauacggcuaacucca

SEQ ID NO: 466341 - RNA, 19 nt, Chlamydia trachomatis
ccggacacacucucccugu

SEQ ID NO: 466342 - RNA, 19 nt, Chlamydia trachomatis
ccggcuuuuuggcagaacu

SEQ ID NO: 466343 - RNA, 21 nt, Chlamydia trachomatis
ccggcuuuuuggcagaacucg

SEQ ID NO: 466344 - RNA, 19 nt, Chlamydia trachomatis
ccguaacgcauuccaauca

SEQ ID NO: 466345 - RNA, 23 nt, Chlamydia trachomatis
ccgucuguauaacaauuuuaaaa

SEQ ID NO: 466346 - RNA, 16 nt, Chlamydia trachomatis
ccgugaacugcucccu

SEQ ID NO: 466347 - RNA, 16 nt, Chlamydia trachomatis
ccgugcuugcuuucuu

SEQ ID NO: 466348 - RNA, 22 nt, Chlamydia trachomatis
ccguucaaagcaaacuucauau

SEQ ID NO: 466349 - RNA, 17 nt, Chlamydia trachomatis
ccuacauacaugcuuuu

SEQ ID NO: 466350 - RNA, 22 nt, Chlamydia trachomatis
ccuaaucuuucuaauuucccuc

SEQ ID NO: 466351 - RNA, 16 nt, Chlamydia trachomatis
ccuaauaucugcucua

SEQ ID NO: 466352 - RNA, 13 nt, Chlamydia trachomatis
ccuaaccaaguuu

SEQ ID NO: 466353 - RNA, 22 nt, Chlamydia trachomatis
ccuaaccaaguuuuuuucaucc

SEQ ID NO: 466354 - RNA, 17 nt, Chlamydia trachomatis
ccuaacgaggcacaaaa

SEQ ID NO: 466355 - RNA, 16 nt, Chlamydia trachomatis
ccuaacgauuccccga

SEQ ID NO: 466356 - RNA, 22 nt, Chlamydia trachomatis
ccuaauacuaaacuaucuaaaa

SEQ ID NO: 466357 - RNA, 11 nt, Chlamydia trachomatis
ccuaauagaaa

SEQ ID NO: 466358 - RNA, 20 nt, Chlamydia trachomatis
ccuaauagaucuacagcaaa

SEQ ID NO: 466359 - RNA, 19 nt, Chlamydia trachomatis
ccuaccaucaauccuggaa

SEQ ID NO: 466360 - RNA, 15 nt, Chlamydia trachomatis
ccucauuuaaaaguc

SEQ ID NO: 466361 - RNA, 21 nt, Chlamydia trachomatis
ccuccagcgcacacuuuucag

SEQ ID NO: 466362 - RNA, 13 nt, Chlamydia trachomatis
ccuccauaggaau

SEQ ID NO: 466363 - RNA, 20 nt, Chlamydia trachomatis
ccuccagcuucuucuauaag

SEQ ID NO: 466364 - RNA, 14 nt, Chlamydia trachomatis
ccuccuaaacaaau

SEQ ID NO: 466365 - RNA, 15 nt, Chlamydia trachomatis
ccuccuagaaagaac

SEQ ID NO: 466366 - RNA, 13 nt, Chlamydia trachomatis
ccuccggcuccca

SEQ ID NO: 466367 - RNA, 14 nt, Chlamydia trachomatis
ccuccucuucuauc

SEQ ID NO: 466368 - RNA, 13 nt, Chlamydia trachomatis
ccucguaauaacu

SEQ ID NO: 466369 - RNA, 17 nt, Chlamydia trachomatis
ccucgguaaccccaugu

SEQ ID NO: 466370 - RNA, 18 nt, Chlamydia trachomatis
ccugaaacgaucagcucc

SEQ ID NO: 466371 - RNA, 19 nt, Chlamydia trachomatis
ccugaaacgaucagcuccu

SEQ ID NO: 466372 - RNA, 12 nt, Chlamydia trachomatis
ccucuuuuucac

SEQ ID NO: 466373 - RNA, 20 nt, Chlamydia trachomatis
ccucuuuacgcacaaagauu

SEQ ID NO: 466374 - RNA, 21 nt, Chlamydia trachomatis
ccucuuucagaugcacuuccu

SEQ ID NO: 466375 - RNA, 15 nt, Chlamydia trachomatis
ccucuuucgcuuucc

SEQ ID NO: 466376 - RNA, 16 nt, Chlamydia trachomatis
ccucuuugaauauccg

SEQ ID NO: 466377 - RNA, 18 nt, Chlamydia trachomatis
ccugaacauccaccagca

SEQ ID NO: 466378 - RNA, 21 nt, Chlamydia trachomatis
ccucuugccugcaaauaauaa

SEQ ID NO: 466379 - RNA, 20 nt, Chlamydia trachomatis
ccucuucucuuuuagcgauc

SEQ ID NO: 466380 - RNA, 11 nt, Chlamydia trachomatis
ccucuucuucg

SEQ ID NO: 466381 - RNA, 19 nt, Chlamydia trachomatis
ccucucuaaaaacucuuuu

SEQ ID NO: 466382 - RNA, 15 nt, Chlamydia trachomatis
ccucucucugcagag

SEQ ID NO: 466383 - RNA, 21 nt, Chlamydia trachomatis
ccucuaaacaagguucuucaa

SEQ ID NO: 466384 - RNA, 18 nt, Chlamydia trachomatis
ccucucaucaguaaacac

SEQ ID NO: 466385 - RNA, 13 nt, Chlamydia trachomatis
ccucgucuacacc

SEQ ID NO: 466386 - RNA, 19 nt, Chlamydia trachomatis
ccugcauuuauccacaggu

SEQ ID NO: 466387 - RNA, 14 nt, Chlamydia trachomatis
ccuggaugcacauc

SEQ ID NO: 466388 - RNA, 20 nt, Chlamydia trachomatis
ccuggauccaaaaaagaauc

SEQ ID NO: 466389 - RNA, 22 nt, Chlamydia trachomatis
ccuguaguuagguaaucuucua

SEQ ID NO: 466390 - RNA, 22 nt, Chlamydia trachomatis
ccugugccuuucguuagaaagg

SEQ ID NO: 466391 - RNA, 15 nt, Chlamydia trachomatis
ccugucccugcuccg

SEQ ID NO: 466392 - RNA, 13 nt, Chlamydia trachomatis
ccuucgaagcgga

SEQ ID NO: 466393 - RNA, 18 nt, Chlamydia trachomatis
ccuucgauaaguucuuua

SEQ ID NO: 466394 - RNA, 18 nt, Chlamydia trachomatis
ccuucgccgggggagcca

SEQ ID NO: 466395 - RNA, 20 nt, Chlamydia trachomatis
ccuucucccgcuaauuuuuu

SEQ ID NO: 466396 - RNA, 13 nt, Chlamydia trachomatis
ccuucugccucuu

SEQ ID NO: 466397 - RNA, 16 nt, Chlamydia trachomatis
ccuucuugaaagcuua

SEQ ID NO: 466398 - RNA, 12 nt, Chlamydia trachomatis
ccuucuuccuuc

SEQ ID NO: 466399 - RNA, 21 nt, Chlamydia trachomatis
ccuugaaccccuccuccacuu

SEQ ID NO: 466400 - RNA, 14 nt, Chlamydia trachomatis
ccuucuuucuucua

SEQ ID NO: 466401 - RNA, 19 nt, Chlamydia trachomatis
ccuucuuuuuccucagcau

SEQ ID NO: 466402 - RNA, 20 nt, Chlamydia trachomatis
ccuugaggauaguauucuuu

SEQ ID NO: 466403 - RNA, 21 nt, Chlamydia trachomatis
ccuugaguccgcaaacaaaau

SEQ ID NO: 466404 - RNA, 23 nt, Chlamydia trachomatis
ccuugaugaauuuuaucuaaaaa

SEQ ID NO: 466405 - RNA, 13 nt, Chlamydia trachomatis
ccuugauauccuu

SEQ ID NO: 466406 - RNA, 24 nt, Chlamydia trachomatis
ccuugucuauaggaauagccuccu

SEQ ID NO: 466407 - RNA, 14 nt, Chlamydia trachomatis
ccuugguaauagcc

SEQ ID NO: 466408 - RNA, 17 nt, Chlamydia trachomatis
ccuuggauuucuucugu

SEQ ID NO: 466409 - RNA, 22 nt, Chlamydia trachomatis
ccuuuaaagaaagcccuauuuc

SEQ ID NO: 466410 - RNA, 15 nt, Chlamydia trachomatis
ccuuuaaaguauaau

SEQ ID NO: 466411 - RNA, 17 nt, Chlamydia trachomatis
ccuuuaagguacuucua

SEQ ID NO: 466412 - RNA, 19 nt, Chlamydia trachomatis
ccuuuaauguuugggaaga

SEQ ID NO: 466413 - RNA, 18 nt, Chlamydia trachomatis
ccuuuuaagauauccaua

SEQ ID NO: 466414 - RNA, 22 nt, Chlamydia trachomatis
ccuuuuacaguuccgcagagau

SEQ ID NO: 466415 - RNA, 14 nt, Chlamydia trachomatis
ccuuuuagcccucc

SEQ ID NO: 466416 - RNA, 15 nt, Chlamydia trachomatis
ccuuuuagcccuccu

SEQ ID NO: 466417 - RNA, 18 nt, Chlamydia trachomatis
ccuuuuauucuucaguuu

SEQ ID NO: 466418 - RNA, 15 nt, Chlamydia trachomatis
ccuuucguuucucca

SEQ ID NO: 466419 - RNA, 14 nt, Chlamydia trachomatis
ccuuucuuacuccu

SEQ ID NO: 466420 - RNA, 17 nt, Chlamydia trachomatis
ccuuucuuacuccuucu

SEQ ID NO: 466421 - RNA, 22 nt, Chlamydia trachomatis
ccuuucccucguaauaacugag

SEQ ID NO: 466422 - RNA, 15 nt, Chlamydia trachomatis
ccuuuucuauuuaga

SEQ ID NO: 466423 - RNA, 19 nt, Chlamydia trachomatis
ccuuuucagaauuacccug

SEQ ID NO: 466424 - RNA, 19 nt, Chlamydia trachomatis
ccuuuugauucugcuccaa

SEQ ID NO: 466425 - RNA, 18 nt, Chlamydia trachomatis
ccuuuugauucugcuuug

SEQ ID NO: 466426 - RNA, 16 nt, Chlamydia trachomatis
ccuuuuguuuucaaaa

SEQ ID NO: 466427 - RNA, 17 nt, Chlamydia trachomatis
ccuuuuguuuuuuuaua

SEQ ID NO: 466428 - RNA, 12 nt, Chlamydia trachomatis
ccuuuuuaaaau

SEQ ID NO: 466429 - RNA, 11 nt, Chlamydia trachomatis
ccuuuuuucug

SEQ ID NO: 466430 - RNA, 15 nt, Chlamydia trachomatis
ccuuuuuucuguuug

SEQ ID NO: 466431 - RNA, 22 nt, Chlamydia trachomatis
ccuuuuuuuauucuuucuuauc

SEQ ID NO: 466432 - RNA, 15 nt, Chlamydia trachomatis
cgaaaaaaaaagaac

SEQ ID NO: 466433 - RNA, 11 nt, Chlamydia trachomatis
cgaaaagagcu

SEQ ID NO: 466434 - RNA, 23 nt, Chlamydia trachomatis
cgaaaaaucacaauuuuucuuug

SEQ ID NO: 466435 - RNA, 17 nt, Chlamydia trachomatis
cgaaaaaaugccuccau

SEQ ID NO: 466436 - RNA, 14 nt, Chlamydia trachomatis
cgaaaaacagaaag

SEQ ID NO: 466437 - RNA, 14 nt, Chlamydia trachomatis
cgaaaccaaaauau

SEQ ID NO: 466438 - RNA, 14 nt, Chlamydia trachomatis
cgaaaccaacaaga

SEQ ID NO: 466439 - RNA, 18 nt, Chlamydia trachomatis
cgaaacccaacgcaucuc

SEQ ID NO: 466440 - RNA, 15 nt, Chlamydia trachomatis
cgaacgcuuccugaa

SEQ ID NO: 466441 - RNA, 18 nt, Chlamydia trachomatis
cgaacgcuucuucccaac

SEQ ID NO: 466442 - RNA, 15 nt, Chlamydia trachomatis
cgaacgggaaaugcu

SEQ ID NO: 466443 - RNA, 14 nt, Chlamydia trachomatis
cgaacucagcuucc

SEQ ID NO: 466444 - RNA, 13 nt, Chlamydia trachomatis
cgaacucuccucu

SEQ ID NO: 466445 - RNA, 13 nt, Chlamydia trachomatis
cgaacuuuauuau

SEQ ID NO: 466446 - RNA, 22 nt, Chlamydia trachomatis
cgaagacagaaucguuuaagug

SEQ ID NO: 466447 - RNA, 20 nt, Chlamydia trachomatis
cgaagacgaacgcuagaaac

SEQ ID NO: 466448 - RNA, 22 nt, Chlamydia trachomatis
cgaagacgaacgcuagaaacag

SEQ ID NO: 466449 - RNA, 17 nt, Chlamydia trachomatis
cgaaggcaauuccucua

SEQ ID NO: 466450 - RNA, 14 nt, Chlamydia trachomatis
cgaagguugaacua

SEQ ID NO: 466451 - RNA, 21 nt, Chlamydia trachomatis
cgaauaagaguccuaauaguc

SEQ ID NO: 466452 - RNA, 17 nt, Chlamydia trachomatis
cgaauaaucagucgcuc

SEQ ID NO: 466453 - RNA, 23 nt, Chlamydia trachomatis
cgaaucauugggaaaacgauaaa

SEQ ID NO: 466454 - RNA, 20 nt, Chlamydia trachomatis
cgaauccuggaguauuuuca

SEQ ID NO: 466455 - RNA, 22 nt, Chlamydia trachomatis
cgaaucacaugucauccuuaga

SEQ ID NO: 466456 - RNA, 16 nt, Chlamydia trachomatis
cgaauuaauaauucca

SEQ ID NO: 466457 - RNA, 20 nt, Chlamydia trachomatis
cgaauuaauaauuccaccua

SEQ ID NO: 466458 - RNA, 15 nt, Chlamydia trachomatis
cgaauuacucugccu

SEQ ID NO: 466459 - RNA, 22 nt, Chlamydia trachomatis
cgaaucgcugacggauccugcu

SEQ ID NO: 466460 - RNA, 14 nt, Chlamydia trachomatis
cgaaugccuguggc

SEQ ID NO: 466461 - RNA, 20 nt, Chlamydia trachomatis
cgaauuuguagaucuuuucg

SEQ ID NO: 466462 - RNA, 14 nt, Chlamydia trachomatis
cgaauuucuugaac

SEQ ID NO: 466463 - RNA, 18 nt, Chlamydia trachomatis
cgacaguauauccucucu

SEQ ID NO: 466464 - RNA, 21 nt, Chlamydia trachomatis
cgacgagguuuuuucuucuuu

SEQ ID NO: 466465 - RNA, 18 nt, Chlamydia trachomatis
cgacuaaaaaauuuugag

SEQ ID NO: 466466 - RNA, 15 nt, Chlamydia trachomatis
cgacguuagaacuau

SEQ ID NO: 466467 - RNA, 15 nt, Chlamydia trachomatis
cgacuucaacuucuc

SEQ ID NO: 466468 - RNA, 14 nt, Chlamydia trachomatis
cgacugcugcagaa

SEQ ID NO: 466469 - RNA, 22 nt, Chlamydia trachomatis
cgagaaaucuuuuacuggagaa

SEQ ID NO: 466470 - RNA, 19 nt, Chlamydia trachomatis
cgagaaaugaauuccaagu

SEQ ID NO: 466471 - RNA, 12 nt, Chlamydia trachomatis
cgagaagagguu

SEQ ID NO: 466472 - RNA, 16 nt, Chlamydia trachomatis
cgagaacggcaauaaa

SEQ ID NO: 466473 - RNA, 14 nt, Chlamydia trachomatis
cgagauaaaaaccu

SEQ ID NO: 466474 - RNA, 20 nt, Chlamydia trachomatis
cgagagaagcuccucuucuu

SEQ ID NO: 466475 - RNA, 19 nt, Chlamydia trachomatis
cgagauuaucauucaaaau

SEQ ID NO: 466476 - RNA, 14 nt, Chlamydia trachomatis
cgagcaagcuuuuu

SEQ ID NO: 466477 - RNA, 12 nt, Chlamydia trachomatis
cgagccuccgcu

SEQ ID NO: 466478 - RNA, 18 nt, Chlamydia trachomatis
cgagcucccauuucuggc

SEQ ID NO: 466479 - RNA, 18 nt, Chlamydia trachomatis
cgaggagcuugagagcau

SEQ ID NO: 466480 - RNA, 15 nt, Chlamydia trachomatis
cgaggcuucaauaau

SEQ ID NO: 466481 - RNA, 19 nt, Chlamydia trachomatis
cgagucggacaguucuuua

SEQ ID NO: 466482 - RNA, 19 nt, Chlamydia trachomatis
cgagugaugauagacaaga

SEQ ID NO: 466483 - RNA, 18 nt, Chlamydia trachomatis
cgaguagacucuaauaaa

SEQ ID NO: 466484 - RNA, 22 nt, Chlamydia trachomatis
cgaguucuguuauuuguucucu

SEQ ID NO: 466485 - RNA, 15 nt, Chlamydia trachomatis
cgauaacuccaucag

SEQ ID NO: 466486 - RNA, 19 nt, Chlamydia trachomatis
cgauaacuccaucaggaau

SEQ ID NO: 466487 - RNA, 12 nt, Chlamydia trachomatis
cgaugccucuaa

SEQ ID NO: 466488 - RNA, 17 nt, Chlamydia trachomatis
cgauuccccgagacgca

SEQ ID NO: 466489 - RNA, 21 nt, Chlamydia trachomatis
cgauuguuucuguaggagaga

SEQ ID NO: 466490 - RNA, 23 nt, Chlamydia trachomatis
cgauuguucguacugcauuggca

SEQ ID NO: 466491 - RNA, 12 nt, Chlamydia trachomatis
cgauucuugaua

SEQ ID NO: 466492 - RNA, 17 nt, Chlamydia trachomatis
cgauucuugauaaauaa

SEQ ID NO: 466493 - RNA, 15 nt, Chlamydia trachomatis
cgauuuuuaaaagac

SEQ ID NO: 466494 - RNA, 18 nt, Chlamydia trachomatis
cgcaaccccgcauaccaa

SEQ ID NO: 466495 - RNA, 17 nt, Chlamydia trachomatis
cgcaaucauaucaagaa

SEQ ID NO: 466496 - RNA, 19 nt, Chlamydia trachomatis
cgcaaucauaucaagaauu

SEQ ID NO: 466497 - RNA, 23 nt, Chlamydia trachomatis
cgcaaucauaucaagaauuucuu

SEQ ID NO: 466498 - RNA, 12 nt, Chlamydia trachomatis
cgcaccaaucac

SEQ ID NO: 466499 - RNA, 22 nt, Chlamydia trachomatis
cgcagauauucacgcaucccaa

SEQ ID NO: 466500 - RNA, 18 nt, Chlamydia trachomatis
cgcagcucaccagcuucc

SEQ ID NO: 466501 - RNA, 21 nt, Chlamydia trachomatis
cgcaguucgcuauaaucccaa

SEQ ID NO: 466502 - RNA, 19 nt, Chlamydia trachomatis
cgcaucuccaaagacacac

SEQ ID NO: 466503 - RNA, 17 nt, Chlamydia trachomatis
cgcauuaaauaauacaa

SEQ ID NO: 466504 - RNA, 23 nt, Chlamydia trachomatis
cgcauucccgccaauuuuuuuau

SEQ ID NO: 466505 - RNA, 20 nt, Chlamydia trachomatis
cgcauuugcucuuccaacaa

SEQ ID NO: 466506 - RNA, 16 nt, Chlamydia trachomatis
cgcgcuccagcucuuc

SEQ ID NO: 466507 - RNA, 22 nt, Chlamydia trachomatis
cgcguaauuuucuagcuucuug

SEQ ID NO: 466508 - RNA, 19 nt, Chlamydia trachomatis
cgcuaccaaaaauuuuuug

SEQ ID NO: 466509 - RNA, 20 nt, Chlamydia trachomatis
cgcuacccauguuuuggcuc

SEQ ID NO: 466510 - RNA, 18 nt, Chlamydia trachomatis
cgcuaauccaugcaucuc

SEQ ID NO: 466511 - RNA, 15 nt, Chlamydia trachomatis
cgcuaucaauaaaaa

SEQ ID NO: 466512 - RNA, 16 nt, Chlamydia trachomatis
cgcuagggucuucucu

SEQ ID NO: 466513 - RNA, 14 nt, Chlamydia trachomatis
cgcuauagcaugau

SEQ ID NO: 466514 - RNA, 12 nt, Chlamydia trachomatis
cgcuccagaacg

SEQ ID NO: 466515 - RNA, 17 nt, Chlamydia trachomatis
cgcuccccuuccuguuc

SEQ ID NO: 466516 - RNA, 22 nt, Chlamydia trachomatis
cgcucccauuuuuaccaaaccu

SEQ ID NO: 466517 - RNA, 15 nt, Chlamydia trachomatis
cgcuccagcucuucc

SEQ ID NO: 466518 - RNA, 16 nt, Chlamydia trachomatis
cgcuccuagugauaaa

SEQ ID NO: 466519 - RNA, 13 nt, Chlamydia trachomatis
cgcucuuuuucuu

SEQ ID NO: 466520 - RNA, 16 nt, Chlamydia trachomatis
cgcuuccucuccuucu

SEQ ID NO: 466521 - RNA, 21 nt, Chlamydia trachomatis
cgcuuccugccaguucuucac

SEQ ID NO: 466522 - RNA, 22 nt, Chlamydia trachomatis
cgcuucuucauguucugugaaa

SEQ ID NO: 466523 - RNA, 12 nt, Chlamydia trachomatis
cgcuucuucaug

SEQ ID NO: 466524 - RNA, 13 nt, Chlamydia trachomatis
cgcuugaaaagaa

SEQ ID NO: 466525 - RNA, 19 nt, Chlamydia trachomatis
cgcuuguaugguuuguccu

SEQ ID NO: 466526 - RNA, 23 nt, Chlamydia trachomatis
cgcuuugguagcucguuuuuuug

SEQ ID NO: 466527 - RNA, 19 nt, Chlamydia trachomatis
cggaacaggggaccaaaaa

SEQ ID NO: 466528 - RNA, 20 nt, Chlamydia trachomatis
cggaacaggggaccaaaaaa

SEQ ID NO: 466529 - RNA, 14 nt, Chlamydia trachomatis
cggaaccagcgaca

SEQ ID NO: 466530 - RNA, 21 nt, Chlamydia trachomatis
cggaaggaaaaagaaaaaaag

SEQ ID NO: 466531 - RNA, 15 nt, Chlamydia trachomatis
cggaauagccuccaa

SEQ ID NO: 466532 - RNA, 20 nt, Chlamydia trachomatis
cggaaucucgguaauaucca

SEQ ID NO: 466533 - RNA, 18 nt, Chlamydia trachomatis
cggacaaacguccuccug

SEQ ID NO: 466534 - RNA, 23 nt, Chlamydia trachomatis
cggacaauaggagcgauaacucc

SEQ ID NO: 466535 - RNA, 18 nt, Chlamydia trachomatis
cggacauuucacuaucca

SEQ ID NO: 466536 - RNA, 23 nt, Chlamydia trachomatis
cggacuucuuuauguaaggaaau

SEQ ID NO: 466537 - RNA, 11 nt, Chlamydia trachomatis
cggagaagaag

SEQ ID NO: 466538 - RNA, 17 nt, Chlamydia trachomatis
cggagaagaagaggguu

SEQ ID NO: 466539 - RNA, 17 nt, Chlamydia trachomatis
cggagagaaagaggggu

SEQ ID NO: 466540 - RNA, 14 nt, Chlamydia trachomatis
cggagagaauacca

SEQ ID NO: 466541 - RNA, 19 nt, Chlamydia trachomatis
cggacugcaucauguugcg

SEQ ID NO: 466542 - RNA, 15 nt, Chlamydia trachomatis
cggagucugcuccac

SEQ ID NO: 466543 - RNA, 15 nt, Chlamydia trachomatis
cggaguaccaaaaaa

SEQ ID NO: 466544 - RNA, 19 nt, Chlamydia trachomatis
cggagauacggcuaacucc

SEQ ID NO: 466545 - RNA, 17 nt, Chlamydia trachomatis
cggauaggcugaggauu

SEQ ID NO: 466546 - RNA, 19 nt, Chlamydia trachomatis
cggauaggcugaggauucc

SEQ ID NO: 466547 - RNA, 17 nt, Chlamydia trachomatis
cggauaggaaaaagcua

SEQ ID NO: 466548 - RNA, 19 nt, Chlamydia trachomatis
cggauaggaaaaagcuauc

SEQ ID NO: 466549 - RNA, 22 nt, Chlamydia trachomatis
cggcaagccuuuuguuuucuug

SEQ ID NO: 466550 - RNA, 19 nt, Chlamydia trachomatis
cggcacucaaauuucucua

SEQ ID NO: 466551 - RNA, 21 nt, Chlamydia trachomatis
cggcuugcccaaacuccaugu

SEQ ID NO: 466552 - RNA, 19 nt, Chlamydia trachomatis
cgguaagggcuuuguaaag

SEQ ID NO: 466553 - RNA, 13 nt, Chlamydia trachomatis
cgguaaacaaugc

SEQ ID NO: 466554 - RNA, 14 nt, Chlamydia trachomatis
cgguaccugcuucu

SEQ ID NO: 466555 - RNA, 14 nt, Chlamydia trachomatis
cgguacaggcauuu

SEQ ID NO: 466556 - RNA, 13 nt, Chlamydia trachomatis
cgguagaaagucc

SEQ ID NO: 466557 - RNA, 19 nt, Chlamydia trachomatis
cgguauauucuucaccuuu

SEQ ID NO: 466558 - RNA, 12 nt, Chlamydia trachomatis
cgguauccauac

SEQ ID NO: 466559 - RNA, 14 nt, Chlamydia trachomatis
cguaaugaucagca

SEQ ID NO: 466560 - RNA, 13 nt, Chlamydia trachomatis
cguccgcuccuuc

SEQ ID NO: 466561 - RNA, 16 nt, Chlamydia trachomatis
cgucgucguacuccuc

SEQ ID NO: 466562 - RNA, 19 nt, Chlamydia trachomatis
cgucuccaaaaguguuuag

SEQ ID NO: 466563 - RNA, 19 nt, Chlamydia trachomatis
cgucuagcgcauaaguaaa

SEQ ID NO: 466564 - RNA, 18 nt, Chlamydia trachomatis
cgucgguucgaucccggc

SEQ ID NO: 466565 - RNA, 15 nt, Chlamydia trachomatis
cgucguacuccucgu

SEQ ID NO: 466566 - RNA, 22 nt, Chlamydia trachomatis
cgucuguauaacaauuuuaaaa

SEQ ID NO: 466567 - RNA, 18 nt, Chlamydia trachomatis
cgucuugcuaauguagac

SEQ ID NO: 466568 - RNA, 16 nt, Chlamydia trachomatis
cgugagcgucuuuuca

SEQ ID NO: 466569 - RNA, 22 nt, Chlamydia trachomatis
cgugugaccaucuucaccaacu

SEQ ID NO: 466570 - RNA, 17 nt, Chlamydia trachomatis
cguguccucuauuuccu

SEQ ID NO: 466571 - RNA, 16 nt, Chlamydia trachomatis
cgugucgauggcugcg

SEQ ID NO: 466572 - RNA, 21 nt, Chlamydia trachomatis
cguguaguuuagggugaucuu

SEQ ID NO: 466573 - RNA, 22 nt, Chlamydia trachomatis
cguguguguguguaaccuuccc

SEQ ID NO: 466574 - RNA, 22 nt, Chlamydia trachomatis
cguuaauuaauaagccuuugcu

SEQ ID NO: 466575 - RNA, 11 nt, Chlamydia trachomatis
cguuacagaug

SEQ ID NO: 466576 - RNA, 22 nt, Chlamydia trachomatis
cguuagaacuauucuugcggaa

SEQ ID NO: 466577 - RNA, 18 nt, Chlamydia trachomatis
cguuagcaaagacauaaa

SEQ ID NO: 466578 - RNA, 17 nt, Chlamydia trachomatis
cuaaagcacguuuaacu

SEQ ID NO: 466579 - RNA, 23 nt, Chlamydia trachomatis
cuaaagcagaaacagcuucuucu

SEQ ID NO: 466580 - RNA, 20 nt, Chlamydia trachomatis
cuaaagcagcuaauuccaua

SEQ ID NO: 466581 - RNA, 13 nt, Chlamydia trachomatis
cuaaagacagcau

SEQ ID NO: 466582 - RNA, 17 nt, Chlamydia trachomatis
cuaaagagaucucucca

SEQ ID NO: 466583 - RNA, 18 nt, Chlamydia trachomatis
cuaaagagccaaaauaua

SEQ ID NO: 466584 - RNA, 20 nt, Chlamydia trachomatis
cuaaagagccaaaauauacu

SEQ ID NO: 466585 - RNA, 20 nt, Chlamydia trachomatis
cuaaagaaucuccuguacac

SEQ ID NO: 466586 - RNA, 19 nt, Chlamydia trachomatis
cuaaaugcuguaaaacauu

SEQ ID NO: 466587 - RNA, 21 nt, Chlamydia trachomatis
cuaaauucaacuggucuucca

SEQ ID NO: 466588 - RNA, 12 nt, Chlamydia trachomatis
cuaaauuuuuaa

SEQ ID NO: 466589 - RNA, 23 nt, Chlamydia trachomatis
cuaaauuuuuaacgauguacucu

SEQ ID NO: 466590 - RNA, 19 nt, Chlamydia trachomatis
cuaacaacaguucuucaua

SEQ ID NO: 466591 - RNA, 23 nt, Chlamydia trachomatis
cuaacaaugacucaaaaagcugu

SEQ ID NO: 466592 - RNA, 13 nt, Chlamydia trachomatis
cuaacacaagcag

SEQ ID NO: 466593 - RNA, 15 nt, Chlamydia trachomatis
cuaacacaagcagac

SEQ ID NO: 466594 - RNA, 16 nt, Chlamydia trachomatis
cuaacacuuuuuuuuc

SEQ ID NO: 466595 - RNA, 21 nt, Chlamydia trachomatis
cuaacagcucuucuucugaag

SEQ ID NO: 466596 - RNA, 22 nt, Chlamydia trachomatis
cuaacagcucuucuucugaaga

SEQ ID NO: 466597 - RNA, 12 nt, Chlamydia trachomatis
cuaaccaaaaaa

SEQ ID NO: 466598 - RNA, 16 nt, Chlamydia trachomatis
cuaaccaaaaaaaggc

SEQ ID NO: 466599 - RNA, 15 nt, Chlamydia trachomatis
cuaaccaugcuccuu

SEQ ID NO: 466600 - RNA, 14 nt, Chlamydia trachomatis
cuaacccuaaaaaa

SEQ ID NO: 466601 - RNA, 20 nt, Chlamydia trachomatis
cuaacccuuguacagcgaca

SEQ ID NO: 466602 - RNA, 20 nt, Chlamydia trachomatis
cuaacgaacgggaaaugcug

SEQ ID NO: 466603 - RNA, 17 nt, Chlamydia trachomatis
cuaacgaggcacaaaau

SEQ ID NO: 466604 - RNA, 15 nt, Chlamydia trachomatis
cuaacgauuccccga

SEQ ID NO: 466605 - RNA, 20 nt, Chlamydia trachomatis
cuaacgcuuccucuccuucu

SEQ ID NO: 466606 - RNA, 13 nt, Chlamydia trachomatis
cuaacgcuucuuc

SEQ ID NO: 466607 - RNA, 14 nt, Chlamydia trachomatis
cuaacgguuccauu

SEQ ID NO: 466608 - RNA, 14 nt, Chlamydia trachomatis
cuaacuuaauaagg

SEQ ID NO: 466609 - RNA, 12 nt, Chlamydia trachomatis
cuaagaaaauaa

SEQ ID NO: 466610 - RNA, 13 nt, Chlamydia trachomatis
cuaagaaaauaaa

SEQ ID NO: 466611 - RNA, 14 nt, Chlamydia trachomatis
cuaagaaaauaaac

SEQ ID NO: 466612 - RNA, 14 nt, Chlamydia trachomatis
cuaagaaccacaac

SEQ ID NO: 466613 - RNA, 18 nt, Chlamydia trachomatis
cuaagcuagaaaauagca

SEQ ID NO: 466614 - RNA, 15 nt, Chlamydia trachomatis
cuaagcuucucaaca

SEQ ID NO: 466615 - RNA, 13 nt, Chlamydia trachomatis
cuaaguuggcauu

SEQ ID NO: 466616 - RNA, 13 nt, Chlamydia trachomatis
cuaaguuguaaaa

SEQ ID NO: 466617 - RNA, 14 nt, Chlamydia trachomatis
cuaaaagaagagcg

SEQ ID NO: 466618 - RNA, 17 nt, Chlamydia trachomatis
cuaaacccucugcauag

SEQ ID NO: 466619 - RNA, 21 nt, Chlamydia trachomatis
cuaaacccucugcauagcuau

SEQ ID NO: 466620 - RNA, 13 nt, Chlamydia trachomatis
cuaaaaacucuuu

SEQ ID NO: 466621 - RNA, 18 nt, Chlamydia trachomatis
cuaaaaacucuuuuucua

SEQ ID NO: 466622 - RNA, 12 nt, Chlamydia trachomatis
cuaaaaagccau

SEQ ID NO: 466623 - RNA, 17 nt, Chlamydia trachomatis
cguuuaccgcucuucca

SEQ ID NO: 466624 - RNA, 19 nt, Chlamydia trachomatis
cguuuagcuaacucuugaa

SEQ ID NO: 466625 - RNA, 15 nt, Chlamydia trachomatis
cguugcuuccaaacg

SEQ ID NO: 466626 - RNA, 14 nt, Chlamydia trachomatis
cguucugagaugaa

SEQ ID NO: 466627 - RNA, 15 nt, Chlamydia trachomatis
cguucucucuaaaau

SEQ ID NO: 466628 - RNA, 23 nt, Chlamydia trachomatis
cuaauaggguuaggaaagcacuu

SEQ ID NO: 466629 - RNA, 15 nt, Chlamydia trachomatis
cuaauaguucucugc

SEQ ID NO: 466630 - RNA, 18 nt, Chlamydia trachomatis
cuaauaguucucugcaua

SEQ ID NO: 466631 - RNA, 15 nt, Chlamydia trachomatis
cuaauaguugcaaaa

SEQ ID NO: 466632 - RNA, 11 nt, Chlamydia trachomatis
cuaauagcuug

SEQ ID NO: 466633 - RNA, 16 nt, Chlamydia trachomatis
cuaauacaaucaguaa

SEQ ID NO: 466634 - RNA, 23 nt, Chlamydia trachomatis
cuaauacuaaacuaucuaaaauc

SEQ ID NO: 466635 - RNA, 22 nt, Chlamydia trachomatis
cuaccuguuguguaucaaaauc

SEQ ID NO: 466636 - RNA, 20 nt, Chlamydia trachomatis
cuacuaaagacacuaucacu

SEQ ID NO: 466637 - RNA, 15 nt, Chlamydia trachomatis
cuagaagaccaaaaa

SEQ ID NO: 466638 - RNA, 16 nt, Chlamydia trachomatis
cuagaagaccaaaaau

SEQ ID NO: 466639 - RNA, 22 nt, Chlamydia trachomatis
cuagaaguagucuacuccauuu

SEQ ID NO: 466640 - RNA, 16 nt, Chlamydia trachomatis
cuagagguauuuuauu

SEQ ID NO: 466641 - RNA, 14 nt, Chlamydia trachomatis
cuagagguuuaagu

SEQ ID NO: 466642 - RNA, 21 nt, Chlamydia trachomatis
cuagauacaauaguaccuuca

SEQ ID NO: 466643 - RNA, 15 nt, Chlamydia trachomatis
cuagauauaaauuug

SEQ ID NO: 466644 - RNA, 17 nt, Chlamydia trachomatis
cuagcaaccaauucucu

SEQ ID NO: 466645 - RNA, 17 nt, Chlamydia trachomatis
cuagcaaccgauucuuc

SEQ ID NO: 466646 - RNA, 16 nt, Chlamydia trachomatis
cuagcagcucuuacuc

SEQ ID NO: 466647 - RNA, 19 nt, Chlamydia trachomatis
cuagcagcucuuacuccua

SEQ ID NO: 466648 - RNA, 20 nt, Chlamydia trachomatis
cuauccggaguaccaaaaaa

SEQ ID NO: 466649 - RNA, 18 nt, Chlamydia trachomatis
cuauaugcacuaacgaac

SEQ ID NO: 466650 - RNA, 19 nt, Chlamydia trachomatis
cuauauagucguaaaaacu

SEQ ID NO: 466651 - RNA, 12 nt, Chlamydia trachomatis
cuaucucuucug

SEQ ID NO: 466652 - RNA, 21 nt, Chlamydia trachomatis
cuaugaucacaugaucauagu

SEQ ID NO: 466653 - RNA, 17 nt, Chlamydia trachomatis
cuauggguaugugggcu

SEQ ID NO: 466654 - RNA, 11 nt, Chlamydia trachomatis
cuaucuucagg

SEQ ID NO: 466655 - RNA, 14 nt, Chlamydia trachomatis
cuaucuuucuuagu

SEQ ID NO: 466656 - RNA, 15 nt, Chlamydia trachomatis
cuaucuuugcgugcu

SEQ ID NO: 466657 - RNA, 14 nt, Chlamydia trachomatis
cuaugagaagaaag

SEQ ID NO: 466658 - RNA, 20 nt, Chlamydia trachomatis
cuaggcgacacgcuucuuca

SEQ ID NO: 466659 - RNA, 11 nt, Chlamydia trachomatis
cuauaacauuc

SEQ ID NO: 466660 - RNA, 14 nt, Chlamydia trachomatis
cuaggaauaucaaa

SEQ ID NO: 466661 - RNA, 17 nt, Chlamydia trachomatis
cuauaagucaaaagaau

SEQ ID NO: 466662 - RNA, 14 nt, Chlamydia trachomatis
cuauaaucccaaaa

SEQ ID NO: 466663 - RNA, 22 nt, Chlamydia trachomatis
cuauacaagugacauuuccaac

SEQ ID NO: 466664 - RNA, 20 nt, Chlamydia trachomatis
cuauacccgacuaaaaaauu

SEQ ID NO: 466665 - RNA, 14 nt, Chlamydia trachomatis
cuauaccuuccaua

SEQ ID NO: 466666 - RNA, 16 nt, Chlamydia trachomatis
cuauacgaaauaacaa

SEQ ID NO: 466667 - RNA, 20 nt, Chlamydia trachomatis
cuauacggagaucugacuga

SEQ ID NO: 466668 - RNA, 18 nt, Chlamydia trachomatis
cucaaugagcgcuuuuuc

SEQ ID NO: 466669 - RNA, 20 nt, Chlamydia trachomatis
cucaaugagcgcuuuuucuu

SEQ ID NO: 466670 - RNA, 22 nt, Chlamydia trachomatis
cucaauuguuguacaaucauua

SEQ ID NO: 466671 - RNA, 16 nt, Chlamydia trachomatis
cuauuuccccuacaaa

SEQ ID NO: 466672 - RNA, 16 nt, Chlamydia trachomatis
cuauuuccuaccauca

SEQ ID NO: 466673 - RNA, 15 nt, Chlamydia trachomatis
cuauuucgaucuuac

SEQ ID NO: 466674 - RNA, 13 nt, Chlamydia trachomatis
cuauuucugucuu

SEQ ID NO: 466675 - RNA, 15 nt, Chlamydia trachomatis
cuauuucuucgcaua

SEQ ID NO: 466676 - RNA, 21 nt, Chlamydia trachomatis
cuauuucuucuagauagagau

SEQ ID NO: 466677 - RNA, 22 nt, Chlamydia trachomatis
cuauuucuucuagauagagauu

SEQ ID NO: 466678 - RNA, 22 nt, Chlamydia trachomatis
cuauuucucuuccugaauacuc

SEQ ID NO: 466679 - RNA, 19 nt, Chlamydia trachomatis
cuauuuaggcuaacuccau

SEQ ID NO: 466680 - RNA, 20 nt, Chlamydia trachomatis
cuauuaagaauuguacacga

SEQ ID NO: 466681 - RNA, 19 nt, Chlamydia trachomatis
cuauuuucaaaaccuugau

SEQ ID NO: 466682 - RNA, 17 nt, Chlamydia trachomatis
cuauuuucuuccugcuu

SEQ ID NO: 466683 - RNA, 15 nt, Chlamydia trachomatis
cucaaacaaucuaaa

SEQ ID NO: 466684 - RNA, 17 nt, Chlamydia trachomatis
cucaaacaaucuaaaaa

SEQ ID NO: 466685 - RNA, 20 nt, Chlamydia trachomatis
cucaaacaaucuaaaaaauu

SEQ ID NO: 466686 - RNA, 16 nt, Chlamydia trachomatis
cucaaacacucgugaa

SEQ ID NO: 466687 - RNA, 16 nt, Chlamydia trachomatis
cucaaacugugaagaa

SEQ ID NO: 466688 - RNA, 19 nt, Chlamydia trachomatis
cucaaacugugaagaauga

SEQ ID NO: 466689 - RNA, 23 nt, Chlamydia trachomatis
cucaaaguuuuuguuuuuuucaa

SEQ ID NO: 466690 - RNA, 14 nt, Chlamydia trachomatis
cucaccucuugccu

SEQ ID NO: 466691 - RNA, 12 nt, Chlamydia trachomatis
cucacuuccuug

SEQ ID NO: 466692 - RNA, 18 nt, Chlamydia trachomatis
cucagauuuaucugcuau

SEQ ID NO: 466693 - RNA, 14 nt, Chlamydia trachomatis
cucagaaucugucu

SEQ ID NO: 466694 - RNA, 22 nt, Chlamydia trachomatis
cucagcuuccuuggcuuuuaca

SEQ ID NO: 466695 - RNA, 21 nt, Chlamydia trachomatis
cucagcauagcgcuucccgcu

SEQ ID NO: 466696 - RNA, 22 nt, Chlamydia trachomatis
cucagcauagcgcuucccgcua

SEQ ID NO: 466697 - RNA, 21 nt, Chlamydia trachomatis
cucauccuagcagcuaauacu

SEQ ID NO: 466698 - RNA, 21 nt, Chlamydia trachomatis
cucauccuuuuggaagaucuc

SEQ ID NO: 466699 - RNA, 21 nt, Chlamydia trachomatis
cucaugucuagcuagaagcca

SEQ ID NO: 466700 - RNA, 12 nt, Chlamydia trachomatis
cucauuaagaau

SEQ ID NO: 466701 - RNA, 16 nt, Chlamydia trachomatis
cucauuaaugacuccc

SEQ ID NO: 466702 - RNA, 18 nt, Chlamydia trachomatis
cucauuaaugacucccau

SEQ ID NO: 466703 - RNA, 21 nt, Chlamydia trachomatis
cucauuaccauacagacgcau

SEQ ID NO: 466704 - RNA, 15 nt, Chlamydia trachomatis
cuccaaaaaagaggg

SEQ ID NO: 466705 - RNA, 13 nt, Chlamydia trachomatis
cuccacuucuuuu

SEQ ID NO: 466706 - RNA, 12 nt, Chlamydia trachomatis
cuccagaaaauu

SEQ ID NO: 466707 - RNA, 18 nt, Chlamydia trachomatis
cuccagaguucauuuuuu

SEQ ID NO: 466708 - RNA, 20 nt, Chlamydia trachomatis
cuccagaguucauuuuuucu

SEQ ID NO: 466709 - RNA, 14 nt, Chlamydia trachomatis
cuccagauacugcu

SEQ ID NO: 466710 - RNA, 17 nt, Chlamydia trachomatis
cuccagcaucuuuucuu

SEQ ID NO: 466711 - RNA, 19 nt, Chlamydia trachomatis
cuccagcaucuuuucuuau

SEQ ID NO: 466712 - RNA, 23 nt, Chlamydia trachomatis
cuccagcaucuuuucuuauaaag

SEQ ID NO: 466713 - RNA, 19 nt, Chlamydia trachomatis
cuccaggaauucguccucc

SEQ ID NO: 466714 - RNA, 15 nt, Chlamydia trachomatis
cuccaggagagucug

SEQ ID NO: 466715 - RNA, 12 nt, Chlamydia trachomatis
cuccagcuucuc

SEQ ID NO: 466716 - RNA, 14 nt, Chlamydia trachomatis
cuccagcuucucca

SEQ ID NO: 466717 - RNA, 13 nt, Chlamydia trachomatis
cuccaggaaaagc

SEQ ID NO: 466718 - RNA, 15 nt, Chlamydia trachomatis
cuccaucugacuuuu

SEQ ID NO: 466719 - RNA, 20 nt, Chlamydia trachomatis
cuccaucccggaggaauuga

SEQ ID NO: 466720 - RNA, 19 nt, Chlamydia trachomatis
cuccauccaguugguacac

SEQ ID NO: 466721 - RNA, 18 nt, Chlamydia trachomatis
cuccauaacgauccucuu

SEQ ID NO: 466722 - RNA, 22 nt, Chlamydia trachomatis
cuccauaagaaauuaacaccaa

SEQ ID NO: 466723 - RNA, 14 nt, Chlamydia trachomatis
cuccauaagaaugu

SEQ ID NO: 466724 - RNA, 22 nt, Chlamydia trachomatis
cuccauaaaagagucccuuaac

SEQ ID NO: 466725 - RNA, 18 nt, Chlamydia trachomatis
cuccaugugcggcaagcc

SEQ ID NO: 466726 - RNA, 12 nt, Chlamydia trachomatis
cuccauuuccau

SEQ ID NO: 466727 - RNA, 16 nt, Chlamydia trachomatis
cuccauuuccaugaau

SEQ ID NO: 466728 - RNA, 19 nt, Chlamydia trachomatis
cucccaaaucaaaccaaaa

SEQ ID NO: 466729 - RNA, 21 nt, Chlamydia trachomatis
cucccaagaaacuuuucugca

SEQ ID NO: 466730 - RNA, 15 nt, Chlamydia trachomatis
cucccauacaaaagc

SEQ ID NO: 466731 - RNA, 18 nt, Chlamydia trachomatis
cucccugcucuugaagau

SEQ ID NO: 466732 - RNA, 21 nt, Chlamydia trachomatis
cucccuuuccauacaucaucu

SEQ ID NO: 466733 - RNA, 23 nt, Chlamydia trachomatis
cucccuuuccauacaucaucucu

SEQ ID NO: 466734 - RNA, 21 nt, Chlamydia trachomatis
cuccucggacaaacguccucc

SEQ ID NO: 466735 - RNA, 23 nt, Chlamydia trachomatis
cuccucggacaaacguccuccug

SEQ ID NO: 466736 - RNA, 12 nt, Chlamydia trachomatis
cuccucgcaagu

SEQ ID NO: 466737 - RNA, 15 nt, Chlamydia trachomatis
cuccuaaacaaaugu

SEQ ID NO: 466738 - RNA, 21 nt, Chlamydia trachomatis
cuccuaaaguaagauuuuuca

SEQ ID NO: 466739 - RNA, 20 nt, Chlamydia trachomatis
cuccuaaauaccacaauuuu

SEQ ID NO: 466740 - RNA, 12 nt, Chlamydia trachomatis
cuccuaagcagu

SEQ ID NO: 466741 - RNA, 14 nt, Chlamydia trachomatis
cuccuaacccuaaa

SEQ ID NO: 466742 - RNA, 15 nt, Chlamydia trachomatis
cuccuagaaagaacc

SEQ ID NO: 466743 - RNA, 21 nt, Chlamydia trachomatis
cuccuagagaaacaaccaucu

SEQ ID NO: 466744 - RNA, 14 nt, Chlamydia trachomatis
cucgacgcugucca

SEQ ID NO: 466745 - RNA, 14 nt, Chlamydia trachomatis
cucgagaaaugaau

SEQ ID NO: 466746 - RNA, 14 nt, Chlamydia trachomatis
cucgagaagaaaaa

SEQ ID NO: 466747 - RNA, 15 nt, Chlamydia trachomatis
cucgagaagaaaaac

SEQ ID NO: 466748 - RNA, 17 nt, Chlamydia trachomatis
cuccugcagacaagccu

SEQ ID NO: 466749 - RNA, 19 nt, Chlamydia trachomatis
cucgaguucuguuauuugu

SEQ ID NO: 466750 - RNA, 15 nt, Chlamydia trachomatis
cucgauggcagggaa

SEQ ID NO: 466751 - RNA, 15 nt, Chlamydia trachomatis
cucgcgcuaaaaccu

SEQ ID NO: 466752 - RNA, 22 nt, Chlamydia trachomatis
cucgcuacauguaguaaucugc

SEQ ID NO: 466753 - RNA, 22 nt, Chlamydia trachomatis
cucggacaaacguccuccugau

SEQ ID NO: 466754 - RNA, 19 nt, Chlamydia trachomatis
cucuaaaaacucuuuuucu

SEQ ID NO: 466755 - RNA, 15 nt, Chlamydia trachomatis
cucuaaaaguuuucu

SEQ ID NO: 466756 - RNA, 20 nt, Chlamydia trachomatis
cucuaaaaucacacaagcug

SEQ ID NO: 466757 - RNA, 20 nt, Chlamydia trachomatis
cucuaaacaagguucuucaa

SEQ ID NO: 466758 - RNA, 15 nt, Chlamydia trachomatis
cucuaaagacagcau

SEQ ID NO: 466759 - RNA, 18 nt, Chlamydia trachomatis
cucuaaaggauaaggaag

SEQ ID NO: 466760 - RNA, 16 nt, Chlamydia trachomatis
cucuaaaguauucugu

SEQ ID NO: 466761 - RNA, 17 nt, Chlamydia trachomatis
cucuaccagggauaaau

SEQ ID NO: 466762 - RNA, 19 nt, Chlamydia trachomatis
cucuaccagggauaaauga

SEQ ID NO: 466763 - RNA, 22 nt, Chlamydia trachomatis
cucuacgaaaaagucaagacag

SEQ ID NO: 466764 - RNA, 14 nt, Chlamydia trachomatis
cugagcuauuuagg

SEQ ID NO: 466765 - RNA, 23 nt, Chlamydia trachomatis
cugagcuauuuaggcuaacucca

SEQ ID NO: 466766 - RNA, 15 nt, Chlamydia trachomatis
cugagcucuuuccuc

SEQ ID NO: 466767 - RNA, 15 nt, Chlamydia trachomatis
cugaggcaauaaaag

SEQ ID NO: 466768 - RNA, 22 nt, Chlamydia trachomatis
cugagcuuugaggacugacaga

SEQ ID NO: 466769 - RNA, 16 nt, Chlamydia trachomatis
cucuauuaagaaucuu

SEQ ID NO: 466770 - RNA, 22 nt, Chlamydia trachomatis
cucuagagggagcgauagaauu

SEQ ID NO: 466771 - RNA, 16 nt, Chlamydia trachomatis
cugagggccuucuuuu

SEQ ID NO: 466772 - RNA, 14 nt, Chlamydia trachomatis
cugagggugagguc

SEQ ID NO: 466773 - RNA, 15 nt, Chlamydia trachomatis
cugagggugaggucc

SEQ ID NO: 466774 - RNA, 16 nt, Chlamydia trachomatis
cugaguauuaaggaaa

SEQ ID NO: 466775 - RNA, 14 nt, Chlamydia trachomatis
cugauaaaaauaau

SEQ ID NO: 466776 - RNA, 19 nt, Chlamydia trachomatis
cugauaaggaggcuucaca

SEQ ID NO: 466777 - RNA, 15 nt, Chlamydia trachomatis
cugauguuccaucuu

SEQ ID NO: 466778 - RNA, 19 nt, Chlamydia trachomatis
cugauguuccaucuuuucg

SEQ ID NO: 466779 - RNA, 15 nt, Chlamydia trachomatis
cugaucggaacaggg

SEQ ID NO: 466780 - RNA, 15 nt, Chlamydia trachomatis
cugcaaaaucuucca

SEQ ID NO: 466781 - RNA, 12 nt, Chlamydia trachomatis
cugauuucucuu

SEQ ID NO: 466782 - RNA, 11 nt, Chlamydia trachomatis
cugcaagaaaa

SEQ ID NO: 466783 - RNA, 17 nt, Chlamydia trachomatis
cugcaagaacaaagaau

SEQ ID NO: 466784 - RNA, 13 nt, Chlamydia trachomatis
cugcaaaggaguc

SEQ ID NO: 466785 - RNA, 12 nt, Chlamydia trachomatis
cugcagagaaag

SEQ ID NO: 466786 - RNA, 19 nt, Chlamydia trachomatis
cugcagagagccagcgagg

SEQ ID NO: 466787 - RNA, 15 nt, Chlamydia trachomatis
cugcagagcacaaau

SEQ ID NO: 466788 - RNA, 17 nt, Chlamydia trachomatis
cugccaguuaaucaauu

SEQ ID NO: 466789 - RNA, 15 nt, Chlamydia trachomatis
cugcauaacagcaag

SEQ ID NO: 466790 - RNA, 15 nt, Chlamydia trachomatis
cugccgagcauugua

SEQ ID NO: 466791 - RNA, 21 nt, Chlamydia trachomatis
cugcccuuuguacaugauaau

SEQ ID NO: 466792 - RNA, 15 nt, Chlamydia trachomatis
cugcgcggaauaagu

SEQ ID NO: 466793 - RNA, 21 nt, Chlamydia trachomatis
cugcgguauccauacgaaaga

SEQ ID NO: 466794 - RNA, 20 nt, Chlamydia trachomatis
cugcggaaggguauucguag

SEQ ID NO: 466795 - RNA, 14 nt, Chlamydia trachomatis
cugcguuuaauucc

SEQ ID NO: 466796 - RNA, 15 nt, Chlamydia trachomatis
cugcguuuaauuccu

SEQ ID NO: 466797 - RNA, 19 nt, Chlamydia trachomatis
cugcguuuaauuccuugga

SEQ ID NO: 466798 - RNA, 15 nt, Chlamydia trachomatis
cugcuagauacaaua

SEQ ID NO: 466799 - RNA, 13 nt, Chlamydia trachomatis
cugcuaucaucuu

SEQ ID NO: 466800 - RNA, 22 nt, Chlamydia trachomatis
cugcuauuacauauaggcugaa

SEQ ID NO: 466801 - RNA, 23 nt, Chlamydia trachomatis
cugcuuucuuuguuccuacuaaa

SEQ ID NO: 466802 - RNA, 21 nt, Chlamydia trachomatis
cugcuuggaauaaaucucuuc

SEQ ID NO: 466803 - RNA, 20 nt, Chlamydia trachomatis
cuggaaugcgcaauccuuuu

SEQ ID NO: 466804 - RNA, 11 nt, Chlamydia trachomatis
cuggaaucauu

SEQ ID NO: 466805 - RNA, 15 nt, Chlamydia trachomatis
cuggaacauacuucu

SEQ ID NO: 466806 - RNA, 22 nt, Chlamydia trachomatis
cuggagguuuaggagagagccc

SEQ ID NO: 466807 - RNA, 15 nt, Chlamydia trachomatis
cuggaguggcaucug

SEQ ID NO: 466808 - RNA, 23 nt, Chlamydia trachomatis
cuggaguuagccguaucuccggu

SEQ ID NO: 466809 - RNA, 16 nt, Chlamydia trachomatis
cuggauagacagccau

SEQ ID NO: 466810 - RNA, 15 nt, Chlamydia trachomatis
cuggccaccuugcca

SEQ ID NO: 466811 - RNA, 15 nt, Chlamydia trachomatis
cuggcgauaguucua

SEQ ID NO: 466812 - RNA, 19 nt, Chlamydia trachomatis
cuggcgagaagcaugcaau

SEQ ID NO: 466813 - RNA, 19 nt, Chlamydia trachomatis
cugggcgaucuccuuccuc

SEQ ID NO: 466814 - RNA, 16 nt, Chlamydia trachomatis
cugggucuuuuuuaug

SEQ ID NO: 466815 - RNA, 18 nt, Chlamydia trachomatis
cugggucuuuuuuaugaa

SEQ ID NO: 466816 - RNA, 15 nt, Chlamydia trachomatis
cugguccaaggaaua

SEQ ID NO: 466817 - RNA, 19 nt, Chlamydia trachomatis
cugguccaaggaauaaaca

SEQ ID NO: 466818 - RNA, 15 nt, Chlamydia trachomatis
cugguauucuaaaua

SEQ ID NO: 466819 - RNA, 17 nt, Chlamydia trachomatis
cugguauucugcagaaa

SEQ ID NO: 466820 - RNA, 22 nt, Chlamydia trachomatis
cugguauucugcagaaaaauuu

SEQ ID NO: 466821 - RNA, 15 nt, Chlamydia trachomatis
cuguacagacugccu

SEQ ID NO: 466822 - RNA, 20 nt, Chlamydia trachomatis
cuguaguugccccuuauuua

SEQ ID NO: 466823 - RNA, 23 nt, Chlamydia trachomatis
cuguaguugccccuuauuuaccu

SEQ ID NO: 466824 - RNA, 16 nt, Chlamydia trachomatis
cuguaaaaggcgcaga

SEQ ID NO: 466825 - RNA, 15 nt, Chlamydia trachomatis
cuguaaaacauuucu

SEQ ID NO: 466826 - RNA, 23 nt, Chlamydia trachomatis
cuguaacgaaguuagcauguuca

SEQ ID NO: 466827 - RNA, 17 nt, Chlamydia trachomatis
cuguaacgaggccucca

SEQ ID NO: 466828 - RNA, 19 nt, Chlamydia trachomatis
cuguaacgaggccuccagc

SEQ ID NO: 466829 - RNA, 19 nt, Chlamydia trachomatis
cugucagaccuacaaagau

SEQ ID NO: 466830 - RNA, 14 nt, Chlamydia trachomatis
cugucauaccaaga

SEQ ID NO: 466831 - RNA, 11 nt, Chlamydia trachomatis
cugucaauaaa

SEQ ID NO: 466832 - RNA, 19 nt, Chlamydia trachomatis
cugucaacaucauaaccaa

SEQ ID NO: 466833 - RNA, 11 nt, Chlamydia trachomatis
cuguauuuccu

SEQ ID NO: 466834 - RNA, 18 nt, Chlamydia trachomatis
cuguauaacaauuuuaaa

SEQ ID NO: 466835 - RNA, 17 nt, Chlamydia trachomatis
cuguugaggagacuuua

SEQ ID NO: 466836 - RNA, 15 nt, Chlamydia trachomatis
cuguugcacuuuccg

SEQ ID NO: 466837 - RNA, 22 nt, Chlamydia trachomatis
cuguugucgauuuuuaaaagac

SEQ ID NO: 466838 - RNA, 11 nt, Chlamydia trachomatis
cuguucuccaa

SEQ ID NO: 466839 - RNA, 15 nt, Chlamydia trachomatis
cuguugacuuuagca

SEQ ID NO: 466840 - RNA, 23 nt, Chlamydia trachomatis
cugucuaagauuuucaucuucca

SEQ ID NO: 466841 - RNA, 21 nt, Chlamydia trachomatis
cuguuuucuuguagaaaaaga

SEQ ID NO: 466842 - RNA, 21 nt, Chlamydia trachomatis
cuguuuaggaggucgcccucu

SEQ ID NO: 466843 - RNA, 16 nt, Chlamydia trachomatis
cuguuuaucuucauca

SEQ ID NO: 466844 - RNA, 21 nt, Chlamydia trachomatis
cuguuuuugcaacaaagcuuu

SEQ ID NO: 466845 - RNA, 15 nt, Chlamydia trachomatis
cuguuuuugcagccu

SEQ ID NO: 466846 - RNA, 14 nt, Chlamydia trachomatis
cuuaaaaaacaaaa

SEQ ID NO: 466847 - RNA, 14 nt, Chlamydia trachomatis
cuuaaacaaaaaua

SEQ ID NO: 466848 - RNA, 12 nt, Chlamydia trachomatis
cuuacuccuucu

SEQ ID NO: 466849 - RNA, 13 nt, Chlamydia trachomatis
cuuagcaaagaaa

SEQ ID NO: 466850 - RNA, 15 nt, Chlamydia trachomatis
cuuagcaaagaaaua

SEQ ID NO: 466851 - RNA, 15 nt, Chlamydia trachomatis
cuuagccacugcaca

SEQ ID NO: 466852 - RNA, 14 nt, Chlamydia trachomatis
cuuaaagauaacac

SEQ ID NO: 466853 - RNA, 22 nt, Chlamydia trachomatis
cuuacggaaaguuccaucuccu

SEQ ID NO: 466854 - RNA, 17 nt, Chlamydia trachomatis
cuuacgaccguauuuuu

SEQ ID NO: 466855 - RNA, 16 nt, Chlamydia trachomatis
cuucacagcuaaucau

SEQ ID NO: 466856 - RNA, 20 nt, Chlamydia trachomatis
cuucacagcuaaucauagcc

SEQ ID NO: 466857 - RNA, 19 nt, Chlamydia trachomatis
cuucacaaauauacucuuu

SEQ ID NO: 466858 - RNA, 20 nt, Chlamydia trachomatis
cuucacaaauuuaucugcua

SEQ ID NO: 466859 - RNA, 22 nt, Chlamydia trachomatis
cuuauuaaaagaccucuuuuuu

SEQ ID NO: 466860 - RNA, 16 nt, Chlamydia trachomatis
cuuauuaaccaacucu

SEQ ID NO: 466861 - RNA, 15 nt, Chlamydia trachomatis
cuucacggagagaaa

SEQ ID NO: 466862 - RNA, 15 nt, Chlamydia trachomatis
cuucagagguagcca

SEQ ID NO: 466863 - RNA, 16 nt, Chlamydia trachomatis
cuucagcaacauucac

SEQ ID NO: 466864 - RNA, 17 nt, Chlamydia trachomatis
cuucagcaacauucacg

SEQ ID NO: 466865 - RNA, 13 nt, Chlamydia trachomatis
cuucaggaaagcc

SEQ ID NO: 466866 - RNA, 20 nt, Chlamydia trachomatis
cuucaugucuucuuucucuu

SEQ ID NO: 466867 - RNA, 20 nt, Chlamydia trachomatis
cuucaucagcuguuccuuuu

SEQ ID NO: 466868 - RNA, 18 nt, Chlamydia trachomatis
cuucauaaaaaagaccca

SEQ ID NO: 466869 - RNA, 23 nt, Chlamydia trachomatis
cuucauaaaacuauggagagggu

SEQ ID NO: 466870 - RNA, 21 nt, Chlamydia trachomatis
cuucaucaauauucgcaauau

SEQ ID NO: 466871 - RNA, 20 nt, Chlamydia trachomatis
cuuccagguucguuauucuc

SEQ ID NO: 466872 - RNA, 15 nt, Chlamydia trachomatis
cuucccuuuuuucug

SEQ ID NO: 466873 - RNA, 18 nt, Chlamydia trachomatis
cuucccacauacuuggau

SEQ ID NO: 466874 - RNA, 20 nt, Chlamydia trachomatis
cuuccaucguaagcaacaau

SEQ ID NO: 466875 - RNA, 18 nt, Chlamydia trachomatis
cuuccgaguaaucaaaaa

SEQ ID NO: 466876 - RNA, 16 nt, Chlamydia trachomatis
cuuccucuccuucuac

SEQ ID NO: 466877 - RNA, 18 nt, Chlamydia trachomatis
cuuccucuccuucuacaa

SEQ ID NO: 466878 - RNA, 14 nt, Chlamydia trachomatis
cuuccucugcuucu

SEQ ID NO: 466879 - RNA, 16 nt, Chlamydia trachomatis
cuuccugagggccuuc

SEQ ID NO: 466880 - RNA, 17 nt, Chlamydia trachomatis
cuucucuaaaugagcga

SEQ ID NO: 466881 - RNA, 23 nt, Chlamydia trachomatis
cuucucugugcacaaucucuuua

SEQ ID NO: 466882 - RNA, 13 nt, Chlamydia trachomatis
cuucucgcuacaa

SEQ ID NO: 466883 - RNA, 15 nt, Chlamydia trachomatis
cuucucuuguucugg

SEQ ID NO: 466884 - RNA, 20 nt, Chlamydia trachomatis
cuucucuuuucgaacaaaac

SEQ ID NO: 466885 - RNA, 20 nt, Chlamydia trachomatis
cuucugaacaacauccuuua

SEQ ID NO: 466886 - RNA, 13 nt, Chlamydia trachomatis
cuucugauucugu

SEQ ID NO: 466887 - RNA, 13 nt, Chlamydia trachomatis
cuucugcaagaga

SEQ ID NO: 466888 - RNA, 23 nt, Chlamydia trachomatis
cuucugcaggcucaugaacagca

SEQ ID NO: 466889 - RNA, 15 nt, Chlamydia trachomatis
cuucugcauugguau

SEQ ID NO: 466890 - RNA, 19 nt, Chlamydia trachomatis
cuucuggaaugcgcaaucc

SEQ ID NO: 466891 - RNA, 22 nt, Chlamydia trachomatis
cuucuggaaugcgcaauccuuu

SEQ ID NO: 466892 - RNA, 21 nt, Chlamydia trachomatis
cuucuggagguuuaggagaga

SEQ ID NO: 466893 - RNA, 21 nt, Chlamydia trachomatis
cuucugccucuuuuaccgaga

SEQ ID NO: 466894 - RNA, 13 nt, Chlamydia trachomatis
cuucugcugaaua

SEQ ID NO: 466895 - RNA, 16 nt, Chlamydia trachomatis
cuucugcugaauauuc

SEQ ID NO: 466896 - RNA, 19 nt, Chlamydia trachomatis
cuucugugcaaucagcucu

SEQ ID NO: 466897 - RNA, 23 nt, Chlamydia trachomatis
cuucuuacauaagauccaucucu

SEQ ID NO: 466898 - RNA, 22 nt, Chlamydia trachomatis
cuucuucacccauaaaaaagag

SEQ ID NO: 466899 - RNA, 19 nt, Chlamydia trachomatis
cuucuucauguucugugaa

SEQ ID NO: 466900 - RNA, 16 nt, Chlamydia trachomatis
cuucuucgaaaucuuc

SEQ ID NO: 466901 - RNA, 15 nt, Chlamydia trachomatis
cuucuucggaaagca

SEQ ID NO: 466902 - RNA, 14 nt, Chlamydia trachomatis
cuucuucuaaagaa

SEQ ID NO: 466903 - RNA, 19 nt, Chlamydia trachomatis
cuucuucuaagcuagaaaa

SEQ ID NO: 466904 - RNA, 21 nt, Chlamydia trachomatis
cuucuucgucugugagagagc

SEQ ID NO: 466905 - RNA, 18 nt, Chlamydia trachomatis
cuucuugcgaugccucua

SEQ ID NO: 466906 - RNA, 23 nt, Chlamydia trachomatis
cuucuugcgaugccucuaacacu

SEQ ID NO: 466907 - RNA, 21 nt, Chlamydia trachomatis
cuucuugaauggcaaggacaa

SEQ ID NO: 466908 - RNA, 17 nt, Chlamydia trachomatis
cuucuugggauaugccu

SEQ ID NO: 466909 - RNA, 23 nt, Chlamydia trachomatis
cuucuuguauaaguucuuuuugu

SEQ ID NO: 466910 - RNA, 23 nt, Chlamydia trachomatis
cuucuugucggcaagacucuuuc

SEQ ID NO: 466911 - RNA, 15 nt, Chlamydia trachomatis
cuucuuguuuuauac

SEQ ID NO: 466912 - RNA, 17 nt, Chlamydia trachomatis
cuugagccuucaauucu

SEQ ID NO: 466913 - RNA, 20 nt, Chlamydia trachomatis
cuugaggaagagagaacaaa

SEQ ID NO: 466914 - RNA, 23 nt, Chlamydia trachomatis
cuugaaaaggagccuuguaucuu

SEQ ID NO: 466915 - RNA, 18 nt, Chlamydia trachomatis
cuucuuuaaagccuuucu

SEQ ID NO: 466916 - RNA, 15 nt, Chlamydia trachomatis
cuucuuucaaaagaa

SEQ ID NO: 466917 - RNA, 14 nt, Chlamydia trachomatis
cuucuuucaaagaa

SEQ ID NO: 466918 - RNA, 21 nt, Chlamydia trachomatis
cuucuuucaaagaagcuccuu

SEQ ID NO: 466919 - RNA, 21 nt, Chlamydia trachomatis
cuugaguccgcaaacaaaaua

SEQ ID NO: 466920 - RNA, 17 nt, Chlamydia trachomatis
cuugaugaauuuuaucu

SEQ ID NO: 466921 - RNA, 22 nt, Chlamydia trachomatis
cuugaugaauuuuaucuaaaaa

SEQ ID NO: 466922 - RNA, 13 nt, Chlamydia trachomatis
cuugauuggauaa

SEQ ID NO: 466923 - RNA, 17 nt, Chlamydia trachomatis
cuugcagaacagcucua

SEQ ID NO: 466924 - RNA, 18 nt, Chlamydia trachomatis
cuugcagagggccuccca

SEQ ID NO: 466925 - RNA, 12 nt, Chlamydia trachomatis
cuugccucuuca

SEQ ID NO: 466926 - RNA, 16 nt, Chlamydia trachomatis
cuugcgggcaaccauu

SEQ ID NO: 466927 - RNA, 16 nt, Chlamydia trachomatis
cuugcguuuucuugug

SEQ ID NO: 466928 - RNA, 17 nt, Chlamydia trachomatis
cuugcuccacacaacau

SEQ ID NO: 466929 - RNA, 22 nt, Chlamydia trachomatis
cuugcuccacacaacauaacuc

SEQ ID NO: 466930 - RNA, 21 nt, Chlamydia trachomatis
cuugcuuucuugaggaagaua

SEQ ID NO: 466931 - RNA, 15 nt, Chlamydia trachomatis
cuuguaauugcagua

SEQ ID NO: 466932 - RNA, 14 nt, Chlamydia trachomatis
cuuguacagcgaca

SEQ ID NO: 466933 - RNA, 23 nt, Chlamydia trachomatis
cuuguacagcgacacguuuuccu

SEQ ID NO: 466934 - RNA, 14 nt, Chlamydia trachomatis
cuuguagaaaaaga

SEQ ID NO: 466935 - RNA, 14 nt, Chlamydia trachomatis
cuuggaauacauca

SEQ ID NO: 466936 - RNA, 19 nt, Chlamydia trachomatis
cuuggaccauaaaacuugu

SEQ ID NO: 466937 - RNA, 19 nt, Chlamydia trachomatis
cuuggacguuggagaaaca

SEQ ID NO: 466938 - RNA, 18 nt, Chlamydia trachomatis
cuuguuagaaaugcaaau

SEQ ID NO: 466939 - RNA, 15 nt, Chlamydia trachomatis
cuugugagagaaauu

SEQ ID NO: 466940 - RNA, 14 nt, Chlamydia trachomatis
cuugugcaaacaaa

SEQ ID NO: 466941 - RNA, 14 nt, Chlamydia trachomatis
cuuuaaagaaagcc

SEQ ID NO: 466942 - RNA, 15 nt, Chlamydia trachomatis
cuuuaaccucugcaa

SEQ ID NO: 466943 - RNA, 15 nt, Chlamydia trachomatis
cuuuaauaaaagcuc

SEQ ID NO: 466944 - RNA, 22 nt, Chlamydia trachomatis
cuuuauagaaggucugaacaac

SEQ ID NO: 466945 - RNA, 16 nt, Chlamydia trachomatis
cuuuaccguuacagga

SEQ ID NO: 466946 - RNA, 17 nt, Chlamydia trachomatis
cuuuaccguuacaggau

SEQ ID NO: 466947 - RNA, 15 nt, Chlamydia trachomatis
cuuuaauauuuccca

SEQ ID NO: 466948 - RNA, 17 nt, Chlamydia trachomatis
cuuuaccauuuccacag

SEQ ID NO: 466949 - RNA, 20 nt, Chlamydia trachomatis
cuuuaccgacuucaacuucu

SEQ ID NO: 466950 - RNA, 12 nt, Chlamydia trachomatis
cuuuauucaaua

SEQ ID NO: 466951 - RNA, 13 nt, Chlamydia trachomatis
cuuuauuagaguu

SEQ ID NO: 466952 - RNA, 15 nt, Chlamydia trachomatis
cuuuauguaaggaaa

SEQ ID NO: 466953 - RNA, 11 nt, Chlamydia trachomatis
cuuuccauaca

SEQ ID NO: 466954 - RNA, 19 nt, Chlamydia trachomatis
cuuucccaguuauaacgau

SEQ ID NO: 466955 - RNA, 18 nt, Chlamydia trachomatis
cuuucccccaccuuuucu

SEQ ID NO: 466956 - RNA, 18 nt, Chlamydia trachomatis
cuuuccucacacacaaaa

SEQ ID NO: 466957 - RNA, 21 nt, Chlamydia trachomatis
cuuucucuaaaagaagagcgg

SEQ ID NO: 466958 - RNA, 19 nt, Chlamydia trachomatis
cuuucucuagaauuucccu

SEQ ID NO: 466959 - RNA, 19 nt, Chlamydia trachomatis
cuuuuaaagggggacaaaa

SEQ ID NO: 466960 - RNA, 20 nt, Chlamydia trachomatis
cuuuuaaagggggacaaaaa

SEQ ID NO: 466961 - RNA, 14 nt, Chlamydia trachomatis
cuuuuaaguagagc

SEQ ID NO: 466962 - RNA, 23 nt, Chlamydia trachomatis
cuuugucaugacucggaauaaga

SEQ ID NO: 466963 - RNA, 16 nt, Chlamydia trachomatis
cuuuguacaugauaau

SEQ ID NO: 466964 - RNA, 21 nt, Chlamydia trachomatis
cuuuguaguuagacaaaaaau

SEQ ID NO: 466965 - RNA, 14 nt, Chlamydia trachomatis
cuuugucuauaagg

SEQ ID NO: 466966 - RNA, 15 nt, Chlamydia trachomatis
cuuugugcaaccucu

SEQ ID NO: 466967 - RNA, 20 nt, Chlamydia trachomatis
cuuuguuauuuuuuaagaag

SEQ ID NO: 466968 - RNA, 21 nt, Chlamydia trachomatis
cuuuguuauuuuuuaagaagu

SEQ ID NO: 466969 - RNA, 18 nt, Chlamydia trachomatis
cuuuguucacagaaaguc

SEQ ID NO: 466970 - RNA, 19 nt, Chlamydia trachomatis
cuuuguucacagaaagucc

SEQ ID NO: 466971 - RNA, 16 nt, Chlamydia trachomatis
cuuucuuugcuauuug

SEQ ID NO: 466972 - RNA, 23 nt, Chlamydia trachomatis
cuuuuccaucuuuaaagaggauc

SEQ ID NO: 466973 - RNA, 16 nt, Chlamydia trachomatis
cuuuuccauuccuccu

SEQ ID NO: 466974 - RNA, 15 nt, Chlamydia trachomatis
cuuuuccuaaacaaa

SEQ ID NO: 466975 - RNA, 13 nt, Chlamydia trachomatis
cuuuuccacauua

SEQ ID NO: 466976 - RNA, 18 nt, Chlamydia trachomatis
cuuuuccauauucuugcu

SEQ ID NO: 466977 - RNA, 15 nt, Chlamydia trachomatis
cuuuucaacaaucca

SEQ ID NO: 466978 - RNA, 23 nt, Chlamydia trachomatis
cuuuucaacaauccacccacaac

SEQ ID NO: 466979 - RNA, 14 nt, Chlamydia trachomatis
cuuuucaaguucua

SEQ ID NO: 466980 - RNA, 23 nt, Chlamydia trachomatis
cuuuucaaguucuaacuuuugau

SEQ ID NO: 466981 - RNA, 15 nt, Chlamydia trachomatis
cuuuucaauauaagc

SEQ ID NO: 466982 - RNA, 15 nt, Chlamydia trachomatis
cuuuucagcuuuucu

SEQ ID NO: 466983 - RNA, 16 nt, Chlamydia trachomatis
cuuuucagcuuuucuu

SEQ ID NO: 466984 - RNA, 18 nt, Chlamydia trachomatis
cuuuuacuuugaaauguc

SEQ ID NO: 466985 - RNA, 20 nt, Chlamydia trachomatis
cuuuuagcccuccuacucca

SEQ ID NO: 466986 - RNA, 14 nt, Chlamydia trachomatis
cuuuuaucuucuua

SEQ ID NO: 466987 - RNA, 15 nt, Chlamydia trachomatis
cuuuuaucuucuuaa

SEQ ID NO: 466988 - RNA, 22 nt, Chlamydia trachomatis
cuuuuauuagggcucucuuuuu

SEQ ID NO: 466989 - RNA, 22 nt, Chlamydia trachomatis
cuuuucuagagaagagagcauc

SEQ ID NO: 466990 - RNA, 21 nt, Chlamydia trachomatis
cuuuuccugggaggacuucua

SEQ ID NO: 466991 - RNA, 23 nt, Chlamydia trachomatis
cuuuuccugggaggacuucuacg

SEQ ID NO: 466992 - RNA, 15 nt, Chlamydia trachomatis
cuuuucgaacaaaac

SEQ ID NO: 466993 - RNA, 21 nt, Chlamydia trachomatis
cuuuucgaacaaaacuugucu

SEQ ID NO: 466994 - RNA, 21 nt, Chlamydia trachomatis
cuuuucugaaacgcacuccaa

SEQ ID NO: 466995 - RNA, 22 nt, Chlamydia trachomatis
cuuuucugagacuccagcuucu

SEQ ID NO: 466996 - RNA, 14 nt, Chlamydia trachomatis
cuuuucuucccuga

SEQ ID NO: 466997 - RNA, 22 nt, Chlamydia trachomatis
cuuuucuuuuuuguguuucuug

SEQ ID NO: 466998 - RNA, 20 nt, Chlamydia trachomatis
cuuuugaaacaucuuuuaaa

SEQ ID NO: 466999 - RNA, 21 nt, Chlamydia trachomatis
cuuuugaaacaucuuuuaaag

SEQ ID NO: 467000 - RNA, 13 nt, Chlamydia trachomatis
cuuuugcugcuuc

SEQ ID NO: 467001 - RNA, 19 nt, Chlamydia trachomatis
cuuuugcuguggaaaaauu

SEQ ID NO: 467002 - RNA, 17 nt, Chlamydia trachomatis
cuuuugcaaaaauuuuc

SEQ ID NO: 467003 - RNA, 22 nt, Chlamydia trachomatis
cuuuugaagauggagauggagu

SEQ ID NO: 467004 - RNA, 13 nt, Chlamydia trachomatis
cuuuuguuuucaa

SEQ ID NO: 467005 - RNA, 17 nt, Chlamydia trachomatis
cuuuuguuuucaaaagc

SEQ ID NO: 467006 - RNA, 10 nt, Chlamydia trachomatis
cuuuuuagcg

SEQ ID NO: 467007 - RNA, 16 nt, Chlamydia trachomatis
cuuuuuaggauucaua

SEQ ID NO: 467008 - RNA, 15 nt, Chlamydia trachomatis
cuuuuuccucagcau

SEQ ID NO: 467009 - RNA, 16 nt, Chlamydia trachomatis
cuuuuucagacaaaaa

SEQ ID NO: 467010 - RNA, 16 nt, Chlamydia trachomatis
cuuuuucucuggaaca

SEQ ID NO: 467011 - RNA, 13 nt, Chlamydia trachomatis
cuuuuugcacaaa

SEQ ID NO: 467012 - RNA, 17 nt, Chlamydia trachomatis
gaaaaacagaaagaaau

SEQ ID NO: 467013 - RNA, 12 nt, Chlamydia trachomatis
gaaaaaaugccu

SEQ ID NO: 467014 - RNA, 14 nt, Chlamydia trachomatis
cuuuuuuuuuagaa

SEQ ID NO: 467015 - RNA, 22 nt, Chlamydia trachomatis
cuuuuuuuuugugcaaaaagca

SEQ ID NO: 467016 - RNA, 14 nt, Chlamydia trachomatis
gaaaaaaacagcuc

SEQ ID NO: 467017 - RNA, 24 nt, Chlamydia trachomatis
cuuuuuuucccuagaaaaucuauu

SEQ ID NO: 467018 - RNA, 15 nt, Chlamydia trachomatis
cuuuuuuacauaauc

SEQ ID NO: 467019 - RNA, 19 nt, Chlamydia trachomatis
gaaaaagggagaggauucc

SEQ ID NO: 467020 - RNA, 15 nt, Chlamydia trachomatis
gaaaaagaagauccc

SEQ ID NO: 467021 - RNA, 12 nt, Chlamydia trachomatis
gaaaaagagaaa

SEQ ID NO: 467022 - RNA, 13 nt, Chlamydia trachomatis
gaaaaagguauua

SEQ ID NO: 467023 - RNA, 14 nt, Chlamydia trachomatis
gaaaaauccuucca

SEQ ID NO: 467024 - RNA, 17 nt, Chlamydia trachomatis
gaaaagucgcccauauu

SEQ ID NO: 467025 - RNA, 18 nt, Chlamydia trachomatis
gaaaauacacagcaucaa

SEQ ID NO: 467026 - RNA, 16 nt, Chlamydia trachomatis
gaaaauacggaagagu

SEQ ID NO: 467027 - RNA, 23 nt, Chlamydia trachomatis
gaaaauacggaagagucuguuuc

SEQ ID NO: 467028 - RNA, 20 nt, Chlamydia trachomatis
gaaaauacgcgcgcuaagac

SEQ ID NO: 467029 - RNA, 16 nt, Chlamydia trachomatis
gaaaacgucucccccu

SEQ ID NO: 467030 - RNA, 13 nt, Chlamydia trachomatis
gaaaagaaaaggg

SEQ ID NO: 467031 - RNA, 14 nt, Chlamydia trachomatis
gaaaagaaaagggg

SEQ ID NO: 467032 - RNA, 14 nt, Chlamydia trachomatis
gaaaacuuucucgc

SEQ ID NO: 467033 - RNA, 21 nt, Chlamydia trachomatis
gaaaagaacccuauccccccu

SEQ ID NO: 467034 - RNA, 15 nt, Chlamydia trachomatis
gaaaagauuucagag

SEQ ID NO: 467035 - RNA, 21 nt, Chlamydia trachomatis
gaaaagacucucccucuugua

SEQ ID NO: 467036 - RNA, 11 nt, Chlamydia trachomatis
gaaaagagaag

SEQ ID NO: 467037 - RNA, 14 nt, Chlamydia trachomatis
gaaaagagaagaag

SEQ ID NO: 467038 - RNA, 18 nt, Chlamydia trachomatis
gaaaagcuccuagagcca

SEQ ID NO: 467039 - RNA, 16 nt, Chlamydia trachomatis
gaaaagcuuucaaagc

SEQ ID NO: 467040 - RNA, 12 nt, Chlamydia trachomatis
gaaaagcuucug

SEQ ID NO: 467041 - RNA, 20 nt, Chlamydia trachomatis
gaaacaaauaacuuuuucuc

SEQ ID NO: 467042 - RNA, 22 nt, Chlamydia trachomatis
gaaacaaauaacuuuuucucuu

SEQ ID NO: 467043 - RNA, 17 nt, Chlamydia trachomatis
gaaaauagguaaagaag

SEQ ID NO: 467044 - RNA, 18 nt, Chlamydia trachomatis
gaaaauccccuccuucuu

SEQ ID NO: 467045 - RNA, 18 nt, Chlamydia trachomatis
gaaaaucgcuauuucccc

SEQ ID NO: 467046 - RNA, 15 nt, Chlamydia trachomatis
gaaaaugaugaaaaa

SEQ ID NO: 467047 - RNA, 21 nt, Chlamydia trachomatis
gaaaaucugggauauauagac

SEQ ID NO: 467048 - RNA, 11 nt, Chlamydia trachomatis
gaaacauucca

SEQ ID NO: 467049 - RNA, 15 nt, Chlamydia trachomatis
gaaacauuccaaaua

SEQ ID NO: 467050 - RNA, 16 nt, Chlamydia trachomatis
gaaacauuccaaauau

SEQ ID NO: 467051 - RNA, 20 nt, Chlamydia trachomatis
gaaacauuugcgugauaaaa

SEQ ID NO: 467052 - RNA, 14 nt, Chlamydia trachomatis
gaaaccaaaauauc

SEQ ID NO: 467053 - RNA, 15 nt, Chlamydia trachomatis
gaaacaguagaaacu

SEQ ID NO: 467054 - RNA, 12 nt, Chlamydia trachomatis
gaaacaggagaa

SEQ ID NO: 467055 - RNA, 20 nt, Chlamydia trachomatis
gaaaccgcaagucucugcca

SEQ ID NO: 467056 - RNA, 22 nt, Chlamydia trachomatis
gaaacgacaggcuauugauacu

SEQ ID NO: 467057 - RNA, 16 nt, Chlamydia trachomatis
gaaacguguaauuucc

SEQ ID NO: 467058 - RNA, 18 nt, Chlamydia trachomatis
gaaacuaaaucucuugga

SEQ ID NO: 467059 - RNA, 22 nt, Chlamydia trachomatis
gaaacuaaaucucuuggagaga

SEQ ID NO: 467060 - RNA, 12 nt, Chlamydia trachomatis
gaaacucaucuu

SEQ ID NO: 467061 - RNA, 20 nt, Chlamydia trachomatis
gaaacucuuacgagcuuucu

SEQ ID NO: 467062 - RNA, 22 nt, Chlamydia trachomatis
gaaacucuuacgagcuuucuua

SEQ ID NO: 467063 - RNA, 13 nt, Chlamydia trachomatis
gaaacucuuuuua

SEQ ID NO: 467064 - RNA, 16 nt, Chlamydia trachomatis
gaaagaaugcuugaug

SEQ ID NO: 467065 - RNA, 13 nt, Chlamydia trachomatis
gaaagaauuugcu

SEQ ID NO: 467066 - RNA, 13 nt, Chlamydia trachomatis
gaaacuguaaugu

SEQ ID NO: 467067 - RNA, 15 nt, Chlamydia trachomatis
gaaacuguaaugucc

SEQ ID NO: 467068 - RNA, 19 nt, Chlamydia trachomatis
gaaacugucggugaaagcu

SEQ ID NO: 467069 - RNA, 15 nt, Chlamydia trachomatis
gaaacuucccacgga

SEQ ID NO: 467070 - RNA, 20 nt, Chlamydia trachomatis
gaaagaguucuccucccaga

SEQ ID NO: 467071 - RNA, 23 nt, Chlamydia trachomatis
gaaagaggauagaucaagaaaag

SEQ ID NO: 467072 - RNA, 16 nt, Chlamydia trachomatis
gaaagcauccccaaaa

SEQ ID NO: 467073 - RNA, 18 nt, Chlamydia trachomatis
gaaagcauccccaaaagg

SEQ ID NO: 467074 - RNA, 20 nt, Chlamydia trachomatis
gaaagcauccccaaaaggau

SEQ ID NO: 467075 - RNA, 14 nt, Chlamydia trachomatis
gaaagcacuuugug

SEQ ID NO: 467076 - RNA, 14 nt, Chlamydia trachomatis
gaaagccuucucuu

SEQ ID NO: 467077 - RNA, 17 nt, Chlamydia trachomatis
gaaagcgugcauuugag

SEQ ID NO: 467078 - RNA, 17 nt, Chlamydia trachomatis
gaaagcuagaagaauca

SEQ ID NO: 467079 - RNA, 17 nt, Chlamydia trachomatis
gaaagcuauuuucuucc

SEQ ID NO: 467080 - RNA, 22 nt, Chlamydia trachomatis
gaaagcuauuuucuuccugcuu

SEQ ID NO: 467081 - RNA, 22 nt, Chlamydia trachomatis
gaaagcuucuaagaacaacgcu

SEQ ID NO: 467082 - RNA, 17 nt, Chlamydia trachomatis
gaaagucguacagaucu

SEQ ID NO: 467083 - RNA, 22 nt, Chlamydia trachomatis
gaaaguacucgauggcagggaa

SEQ ID NO: 467084 - RNA, 14 nt, Chlamydia trachomatis
gaaaguagcuacuu

SEQ ID NO: 467085 - RNA, 17 nt, Chlamydia trachomatis
gaaaguaaaauuccuga

SEQ ID NO: 467086 - RNA, 20 nt, Chlamydia trachomatis
gaaauaagucuuuuacuuug

SEQ ID NO: 467087 - RNA, 15 nt, Chlamydia trachomatis
gaaauaagagaggcu

SEQ ID NO: 467088 - RNA, 15 nt, Chlamydia trachomatis
gaaauaaaaaccuug

SEQ ID NO: 467089 - RNA, 16 nt, Chlamydia trachomatis
gaaauaaaaaccuuga

SEQ ID NO: 467090 - RNA, 14 nt, Chlamydia trachomatis
gaaauaaaaagccc

SEQ ID NO: 467091 - RNA, 23 nt, Chlamydia trachomatis
gaaauaaaauggaaauaaaaagc

SEQ ID NO: 467092 - RNA, 15 nt, Chlamydia trachomatis
gaaaguccaagauua

SEQ ID NO: 467093 - RNA, 15 nt, Chlamydia trachomatis
gaaaguugcucccaa

SEQ ID NO: 467094 - RNA, 21 nt, Chlamydia trachomatis
gaaaguugcucccaauauaca

SEQ ID NO: 467095 - RNA, 18 nt, Chlamydia trachomatis
gaaauagccauucccuaa

SEQ ID NO: 467096 - RNA, 19 nt, Chlamydia trachomatis
gaaauacgguauacacuau

SEQ ID NO: 467097 - RNA, 19 nt, Chlamydia trachomatis
gaaauaugacagagcccuu

SEQ ID NO: 467098 - RNA, 22 nt, Chlamydia trachomatis
gaaauaggaccgacauuaguau

SEQ ID NO: 467099 - RNA, 14 nt, Chlamydia trachomatis
gaaauaggauuuaa

SEQ ID NO: 467100 - RNA, 15 nt, Chlamydia trachomatis
gaaauaucaauuccu

SEQ ID NO: 467101 - RNA, 18 nt, Chlamydia trachomatis
gaaaucuucuuauacagc

SEQ ID NO: 467102 - RNA, 16 nt, Chlamydia trachomatis
gaaaugaauuccaagu

SEQ ID NO: 467103 - RNA, 14 nt, Chlamydia trachomatis
gaaaugacacacau

SEQ ID NO: 467104 - RNA, 16 nt, Chlamydia trachomatis
gaaaugagagcuagca

SEQ ID NO: 467105 - RNA, 14 nt, Chlamydia trachomatis
gaaaugaggacaga

SEQ ID NO: 467106 - RNA, 16 nt, Chlamydia trachomatis
gaaaugcaaauuugca

SEQ ID NO: 467107 - RNA, 13 nt, Chlamydia trachomatis
gaaauggucucuu

SEQ ID NO: 467108 - RNA, 23 nt, Chlamydia trachomatis
gaaaugcgugaacuguucauucu

SEQ ID NO: 467109 - RNA, 13 nt, Chlamydia trachomatis
gaaaucgcaugag

SEQ ID NO: 467110 - RNA, 20 nt, Chlamydia trachomatis
gaaaucauuaccagcggcuu

SEQ ID NO: 467111 - RNA, 20 nt, Chlamydia trachomatis
gaaauccccagucucuccau

SEQ ID NO: 467112 - RNA, 16 nt, Chlamydia trachomatis
gaaaucagaugccauc

SEQ ID NO: 467113 - RNA, 16 nt, Chlamydia trachomatis
gaacaaaccaucugua

SEQ ID NO: 467114 - RNA, 19 nt, Chlamydia trachomatis
gaacaacagucguaauugc

SEQ ID NO: 467115 - RNA, 18 nt, Chlamydia trachomatis
gaaauguugugugaugaa

SEQ ID NO: 467116 - RNA, 19 nt, Chlamydia trachomatis
gaaauguugugugaugaac

SEQ ID NO: 467117 - RNA, 20 nt, Chlamydia trachomatis
gaaauuaucgccaaaaauca

SEQ ID NO: 467118 - RNA, 18 nt, Chlamydia trachomatis
gaaauucaauuaaagcca

SEQ ID NO: 467119 - RNA, 17 nt, Chlamydia trachomatis
gaaauucaucaugagaa

SEQ ID NO: 467120 - RNA, 16 nt, Chlamydia trachomatis
gaaauucuucaucuau

SEQ ID NO: 467121 - RNA, 14 nt, Chlamydia trachomatis
gaacaagauaaaga

SEQ ID NO: 467122 - RNA, 12 nt, Chlamydia trachomatis
gaacaagauccu

SEQ ID NO: 467123 - RNA, 13 nt, Chlamydia trachomatis
gaacaagcaaaac

SEQ ID NO: 467124 - RNA, 17 nt, Chlamydia trachomatis
gaacaaccuucugacug

SEQ ID NO: 467125 - RNA, 11 nt, Chlamydia trachomatis
gaacaacugcu

SEQ ID NO: 467126 - RNA, 21 nt, Chlamydia trachomatis
gaacaacuugaucuacagcaa

SEQ ID NO: 467127 - RNA, 12 nt, Chlamydia trachomatis
gaacaauauagu

SEQ ID NO: 467128 - RNA, 19 nt, Chlamydia trachomatis
gaacaauaucuguuuuucc

SEQ ID NO: 467129 - RNA, 13 nt, Chlamydia trachomatis
gaacaaucggaaa

SEQ ID NO: 467130 - RNA, 13 nt, Chlamydia trachomatis
gaacagagcuuca

SEQ ID NO: 467131 - RNA, 19 nt, Chlamydia trachomatis
gaacagcgacauucucgga

SEQ ID NO: 467132 - RNA, 19 nt, Chlamydia trachomatis
gaacagauuuagagaauaa

SEQ ID NO: 467133 - RNA, 20 nt, Chlamydia trachomatis
gaacagauuuagagaauaau

SEQ ID NO: 467134 - RNA, 21 nt, Chlamydia trachomatis
gaacagauugagaauaaauau

SEQ ID NO: 467135 - RNA, 16 nt, Chlamydia trachomatis
gaacagcagcagugcc

SEQ ID NO: 467136 - RNA, 21 nt, Chlamydia trachomatis
gaacagcucuagcuaaaccca

SEQ ID NO: 467137 - RNA, 14 nt, Chlamydia trachomatis
gaacagguuucuua

SEQ ID NO: 467138 - RNA, 18 nt, Chlamydia trachomatis
gaacaggggaccaaaaaa

SEQ ID NO: 467139 - RNA, 21 nt, Chlamydia trachomatis
gaacaggggaccaaaaaagcg

SEQ ID NO: 467140 - RNA, 23 nt, Chlamydia trachomatis
gaacagugacagcauagauauug

SEQ ID NO: 467141 - RNA, 18 nt, Chlamydia trachomatis
gaacauaccguagauccu

SEQ ID NO: 467142 - RNA, 15 nt, Chlamydia trachomatis
gaacauccaccagca

SEQ ID NO: 467143 - RNA, 16 nt, Chlamydia trachomatis
gaacaucgagaaaaug

SEQ ID NO: 467144 - RNA, 18 nt, Chlamydia trachomatis
gaacaucgagaaaaugau

SEQ ID NO: 467145 - RNA, 22 nt, Chlamydia trachomatis
gaacaucucggucuuagaagga

SEQ ID NO: 467146 - RNA, 23 nt, Chlamydia trachomatis
gaacaucucggucuuagaaggau

SEQ ID NO: 467147 - RNA, 16 nt, Chlamydia trachomatis
gaacauggcugcagga

SEQ ID NO: 467148 - RNA, 16 nt, Chlamydia trachomatis
gaaccacaaaaucagc

SEQ ID NO: 467149 - RNA, 21 nt, Chlamydia trachomatis
gaaccacaaaccauccuucug

SEQ ID NO: 467150 - RNA, 13 nt, Chlamydia trachomatis
gaacccauagauu

SEQ ID NO: 467151 - RNA, 22 nt, Chlamydia trachomatis
gaacccuaauaaaggccaggcu

SEQ ID NO: 467152 - RNA, 23 nt, Chlamydia trachomatis
gaacccuauccccccuacauugu

SEQ ID NO: 467153 - RNA, 15 nt, Chlamydia trachomatis
gaaccccucuuuuuu

SEQ ID NO: 467154 - RNA, 12 nt, Chlamydia trachomatis
gaacccucuuca

SEQ ID NO: 467155 - RNA, 15 nt, Chlamydia trachomatis
gaacccucuucauaa

SEQ ID NO: 467156 - RNA, 18 nt, Chlamydia trachomatis
gaaccgcagcaacaugca

SEQ ID NO: 467157 - RNA, 15 nt, Chlamydia trachomatis
gaaccgcaagcaaac

SEQ ID NO: 467158 - RNA, 21 nt, Chlamydia trachomatis
gaaccgggauugcugaaacac

SEQ ID NO: 467159 - RNA, 21 nt, Chlamydia trachomatis
gaacgagaaaaagguauuaga

SEQ ID NO: 467160 - RNA, 21 nt, Chlamydia trachomatis
gaaccuuuaccaaagaauucu

SEQ ID NO: 467161 - RNA, 19 nt, Chlamydia trachomatis
gaacgaucgcaagccacca

SEQ ID NO: 467162 - RNA, 23 nt, Chlamydia trachomatis
gaacgccuguuuucuuguagaaa

SEQ ID NO: 467163 - RNA, 19 nt, Chlamydia trachomatis
gaacgcuuuccgaagguug

SEQ ID NO: 467164 - RNA, 19 nt, Chlamydia trachomatis
gaacguacuuuaggagaaa

SEQ ID NO: 467165 - RNA, 20 nt, Chlamydia trachomatis
gaacuuauuggugagugcau

SEQ ID NO: 467166 - RNA, 21 nt, Chlamydia trachomatis
gaacucuuuauuaaacuccca

SEQ ID NO: 467167 - RNA, 15 nt, Chlamydia trachomatis
gaacucuuuccuccu

SEQ ID NO: 467168 - RNA, 16 nt, Chlamydia trachomatis
gaacucgcguauuuuu

SEQ ID NO: 467169 - RNA, 14 nt, Chlamydia trachomatis
gaacucccccuuuc

SEQ ID NO: 467170 - RNA, 18 nt, Chlamydia trachomatis
gaacuucuccuggaaggu

SEQ ID NO: 467171 - RNA, 23 nt, Chlamydia trachomatis
gaagaaaagagcuuuucuucccu

SEQ ID NO: 467172 - RNA, 23 nt, Chlamydia trachomatis
gaagaaauauucccaaagcuagg

SEQ ID NO: 467173 - RNA, 18 nt, Chlamydia trachomatis
gaagaacacacuuucccc

SEQ ID NO: 467174 - RNA, 12 nt, Chlamydia trachomatis
gaagaacagcag

SEQ ID NO: 467175 - RNA, 15 nt, Chlamydia trachomatis
gaagaagaggaggau

SEQ ID NO: 467176 - RNA, 15 nt, Chlamydia trachomatis
gaagaagaacugcag

SEQ ID NO: 467177 - RNA, 13 nt, Chlamydia trachomatis
gaagaagaagaac

SEQ ID NO: 467178 - RNA, 19 nt, Chlamydia trachomatis
gaagaacgccugaucaaau

SEQ ID NO: 467179 - RNA, 14 nt, Chlamydia trachomatis
gaagaacugcagug

SEQ ID NO: 467180 - RNA, 17 nt, Chlamydia trachomatis
gaagaaccgaauuugua

SEQ ID NO: 467181 - RNA, 17 nt, Chlamydia trachomatis
gaagaagauaguagaga

SEQ ID NO: 467182 - RNA, 20 nt, Chlamydia trachomatis
gaagaagauguuguuaaagc

SEQ ID NO: 467183 - RNA, 16 nt, Chlamydia trachomatis
gaagaaguuuuuuguc

SEQ ID NO: 467184 - RNA, 17 nt, Chlamydia trachomatis
gaagacuuuggaagagg

SEQ ID NO: 467185 - RNA, 18 nt, Chlamydia trachomatis
gaagagaaaaauugcaaa

SEQ ID NO: 467186 - RNA, 21 nt, Chlamydia trachomatis
gaagauccuucgcaggggaau

SEQ ID NO: 467187 - RNA, 20 nt, Chlamydia trachomatis
gaagaucuguaacuacaucu

SEQ ID NO: 467188 - RNA, 16 nt, Chlamydia trachomatis
gaagauaaguccuccu

SEQ ID NO: 467189 - RNA, 14 nt, Chlamydia trachomatis
gaagauaggagcau

SEQ ID NO: 467190 - RNA, 22 nt, Chlamydia trachomatis
gaagaucaaggauccaggagau

SEQ ID NO: 467191 - RNA, 15 nt, Chlamydia trachomatis
gaagagcuguuguua

SEQ ID NO: 467192 - RNA, 20 nt, Chlamydia trachomatis
gaagagucuguuucugucug

SEQ ID NO: 467193 - RNA, 14 nt, Chlamydia trachomatis
gaagagggaagaga

SEQ ID NO: 467194 - RNA, 16 nt, Chlamydia trachomatis
gaagagggaagagaaa

SEQ ID NO: 467195 - RNA, 20 nt, Chlamydia trachomatis
gaagaggcgcccacagaaca

SEQ ID NO: 467196 - RNA, 16 nt, Chlamydia trachomatis
gaagauucgauauacg

SEQ ID NO: 467197 - RNA, 21 nt, Chlamydia trachomatis
gaagauuauaccagcagaccc

SEQ ID NO: 467198 - RNA, 13 nt, Chlamydia trachomatis
gaagauggagaug

SEQ ID NO: 467199 - RNA, 20 nt, Chlamydia trachomatis
gaagauuugcaaauucuuca

SEQ ID NO: 467200 - RNA, 20 nt, Chlamydia trachomatis
gaagauuuuuagaaggaaag

SEQ ID NO: 467201 - RNA, 22 nt, Chlamydia trachomatis
gaagcaaaaacugucugagccu

SEQ ID NO: 467202 - RNA, 21 nt, Chlamydia trachomatis
gaagcaaaucccugugcuauc

SEQ ID NO: 467203 - RNA, 23 nt, Chlamydia trachomatis
gaagcaauacgauugguuuaaua

SEQ ID NO: 467204 - RNA, 16 nt, Chlamydia trachomatis
gaagccaaaagaucuu

SEQ ID NO: 467205 - RNA, 21 nt, Chlamydia trachomatis
gaagccaaaagaucuugaucu

SEQ ID NO: 467206 - RNA, 15 nt, Chlamydia trachomatis
gaagccacaaccacu

SEQ ID NO: 467207 - RNA, 19 nt, Chlamydia trachomatis
gaagcccaaacccuauuuc

SEQ ID NO: 467208 - RNA, 23 nt, Chlamydia trachomatis
gaagcgauuugauccaguucugg

SEQ ID NO: 467209 - RNA, 20 nt, Chlamydia trachomatis
gaagcuacugaugacuuucg

SEQ ID NO: 467210 - RNA, 22 nt, Chlamydia trachomatis
gaagcuagaagaagaggaggau

SEQ ID NO: 467211 - RNA, 15 nt, Chlamydia trachomatis
gaagcuccaaagaac

SEQ ID NO: 467212 - RNA, 14 nt, Chlamydia trachomatis
gaagcuaugagaau

SEQ ID NO: 467213 - RNA, 16 nt, Chlamydia trachomatis
gaagcucggucucauu

SEQ ID NO: 467214 - RNA, 14 nt, Chlamydia trachomatis
gaaggagcuaagaa

SEQ ID NO: 467215 - RNA, 21 nt, Chlamydia trachomatis
gaagcuuaguuacaagacaau

SEQ ID NO: 467216 - RNA, 16 nt, Chlamydia trachomatis
gaaggaaaaagaaaaa

SEQ ID NO: 467217 - RNA, 17 nt, Chlamydia trachomatis
gaaggaaaaagaaaaaa

SEQ ID NO: 467218 - RNA, 21 nt, Chlamydia trachomatis
gaaggaaaaagaaaaaaagag

SEQ ID NO: 467219 - RNA, 22 nt, Chlamydia trachomatis
gaaggaaagcuaugcccaggau

SEQ ID NO: 467220 - RNA, 22 nt, Chlamydia trachomatis
gaaggaguuuuucuccucucuc

SEQ ID NO: 467221 - RNA, 14 nt, Chlamydia trachomatis
gaaggaucuuccag

SEQ ID NO: 467222 - RNA, 17 nt, Chlamydia trachomatis
gaaggccaaagaaauag

SEQ ID NO: 467223 - RNA, 15 nt, Chlamydia trachomatis
gaauaucuucugggc

SEQ ID NO: 467224 - RNA, 16 nt, Chlamydia trachomatis
gaauaucguaaacaac

SEQ ID NO: 467225 - RNA, 19 nt, Chlamydia trachomatis
gaauaucaucuucaagagc

SEQ ID NO: 467226 - RNA, 19 nt, Chlamydia trachomatis
gaauauuuaagggaagcuc

SEQ ID NO: 467227 - RNA, 20 nt, Chlamydia trachomatis
gaauagguucuauccauaca

SEQ ID NO: 467228 - RNA, 20 nt, Chlamydia trachomatis
gaauagguugccuuuaucuc

SEQ ID NO: 467229 - RNA, 23 nt, Chlamydia trachomatis
gaauaguaugucguaucccugca

SEQ ID NO: 467230 - RNA, 13 nt, Chlamydia trachomatis
gaauaguugcagc

SEQ ID NO: 467231 - RNA, 14 nt, Chlamydia trachomatis
gaauauaagcaccc

SEQ ID NO: 467232 - RNA, 20 nt, Chlamydia trachomatis
gaauauaagcacccuuucuu

SEQ ID NO: 467233 - RNA, 23 nt, Chlamydia trachomatis
gaauagauucccuuuaaagaaag

SEQ ID NO: 467234 - RNA, 16 nt, Chlamydia trachomatis
gaauagcaacucuuuc

SEQ ID NO: 467235 - RNA, 23 nt, Chlamydia trachomatis
gaauagccuccaaacauuuugag

SEQ ID NO: 467236 - RNA, 18 nt, Chlamydia trachomatis
gaauagcuacuagauaga

SEQ ID NO: 467237 - RNA, 18 nt, Chlamydia trachomatis
gaauaaauccucuuugaa

SEQ ID NO: 467238 - RNA, 16 nt, Chlamydia trachomatis
gaauaacuaauauagc

SEQ ID NO: 467239 - RNA, 21 nt, Chlamydia trachomatis
gaauaagaggacuuucuuuaa

SEQ ID NO: 467240 - RNA, 15 nt, Chlamydia trachomatis
gaauaagcgaaaaaa

SEQ ID NO: 467241 - RNA, 17 nt, Chlamydia trachomatis
gaauaagcgaaaaaaaa

SEQ ID NO: 467242 - RNA, 20 nt, Chlamydia trachomatis
gaauaagcgaaaaaaaaaga

SEQ ID NO: 467243 - RNA, 14 nt, Chlamydia trachomatis
gaauaauuuuccac

SEQ ID NO: 467244 - RNA, 17 nt, Chlamydia trachomatis
gaauaauuuuccacaaa

SEQ ID NO: 467245 - RNA, 15 nt, Chlamydia trachomatis
gaauacaguuagaga

SEQ ID NO: 467246 - RNA, 21 nt, Chlamydia trachomatis
gaauacaucacugcaacuaau

SEQ ID NO: 467247 - RNA, 15 nt, Chlamydia trachomatis
gaauaccaacuugca

SEQ ID NO: 467248 - RNA, 14 nt, Chlamydia trachomatis
gaauacgaaaugac

SEQ ID NO: 467249 - RNA, 16 nt, Chlamydia trachomatis
gaauacgaaaugacac

SEQ ID NO: 467250 - RNA, 17 nt, Chlamydia trachomatis
gaauacgaaaugacaca

SEQ ID NO: 467251 - RNA, 22 nt, Chlamydia trachomatis
gaaggcuuuuuaauuuucugca

SEQ ID NO: 467252 - RNA, 17 nt, Chlamydia trachomatis
gaagggaacagucucuu

SEQ ID NO: 467253 - RNA, 18 nt, Chlamydia trachomatis
gaagggcugagccguucg

SEQ ID NO: 467254 - RNA, 12 nt, Chlamydia trachomatis
gaagguauuuua

SEQ ID NO: 467255 - RNA, 21 nt, Chlamydia trachomatis
gaagguauuuuagagaaaaga

SEQ ID NO: 467256 - RNA, 17 nt, Chlamydia trachomatis
gaaguagucuacuccau

SEQ ID NO: 467257 - RNA, 14 nt, Chlamydia trachomatis
gaaguaucuaugau

SEQ ID NO: 467258 - RNA, 19 nt, Chlamydia trachomatis
gaagucuaccguauuaucu

SEQ ID NO: 467259 - RNA, 17 nt, Chlamydia trachomatis
gaagucuucaggagcau

SEQ ID NO: 467260 - RNA, 20 nt, Chlamydia trachomatis
gaagucaugcggauuaaaga

SEQ ID NO: 467261 - RNA, 16 nt, Chlamydia trachomatis
gaagucgugucuuuau

SEQ ID NO: 467262 - RNA, 15 nt, Chlamydia trachomatis
gaaguguuagugagc

SEQ ID NO: 467263 - RNA, 18 nt, Chlamydia trachomatis
gaaguuacuuuucucaaa

SEQ ID NO: 467264 - RNA, 18 nt, Chlamydia trachomatis
gaaguucuuuuuccucuu

SEQ ID NO: 467265 - RNA, 23 nt, Chlamydia trachomatis
gaaguucuuuuuccucuucagac

SEQ ID NO: 467266 - RNA, 20 nt, Chlamydia trachomatis
gaaguugagcaacuauauuu

SEQ ID NO: 467267 - RNA, 22 nt, Chlamydia trachomatis
gaauaaaaacgcuccaaauaaa

SEQ ID NO: 467268 - RNA, 18 nt, Chlamydia trachomatis
gaauaaaaggcuacuaaa

SEQ ID NO: 467269 - RNA, 17 nt, Chlamydia trachomatis
gaauaaaaguacuucua

SEQ ID NO: 467270 - RNA, 13 nt, Chlamydia trachomatis
gaauaaaaucaaa

SEQ ID NO: 467271 - RNA, 15 nt, Chlamydia trachomatis
gaauaaaaucaaaua

SEQ ID NO: 467272 - RNA, 18 nt, Chlamydia trachomatis
gaauaaaaucaaauaaag

SEQ ID NO: 467273 - RNA, 14 nt, Chlamydia trachomatis
gaaucaaaaaguuc

SEQ ID NO: 467274 - RNA, 22 nt, Chlamydia trachomatis
gaaucaaaacgcucagaaaacu

SEQ ID NO: 467275 - RNA, 18 nt, Chlamydia trachomatis
gaaucaaacagaaccuuu

SEQ ID NO: 467276 - RNA, 15 nt, Chlamydia trachomatis
gaaucaaaggauguc

SEQ ID NO: 467277 - RNA, 19 nt, Chlamydia trachomatis
gaaucaaaggaugucuauc

SEQ ID NO: 467278 - RNA, 20 nt, Chlamydia trachomatis
gaaucacagaaacuucuucu

SEQ ID NO: 467279 - RNA, 22 nt, Chlamydia trachomatis
gaaucaggaauauuaagaucca

SEQ ID NO: 467280 - RNA, 16 nt, Chlamydia trachomatis
gaaucagguuugauaa

SEQ ID NO: 467281 - RNA, 19 nt, Chlamydia trachomatis
gaaucauuugccaaaaagg

SEQ ID NO: 467282 - RNA, 15 nt, Chlamydia trachomatis
gaauccucuuccgaa

SEQ ID NO: 467283 - RNA, 23 nt, Chlamydia trachomatis
gaauccuuaaccgugaacugcuc

SEQ ID NO: 467284 - RNA, 21 nt, Chlamydia trachomatis
gaaucucgagcuaagaaaaua

SEQ ID NO: 467285 - RNA, 18 nt, Chlamydia trachomatis
gaaucucgguaauaucca

SEQ ID NO: 467286 - RNA, 13 nt, Chlamydia trachomatis
gaaucuaaaaagc

SEQ ID NO: 467287 - RNA, 21 nt, Chlamydia trachomatis
gaaucgccuauagaagacuaa

SEQ ID NO: 467288 - RNA, 16 nt, Chlamydia trachomatis
gaaucggauccuucga

SEQ ID NO: 467289 - RNA, 20 nt, Chlamydia trachomatis
gaaucuguccaaagagauug

SEQ ID NO: 467290 - RNA, 15 nt, Chlamydia trachomatis
gaaucuguuuugauu

SEQ ID NO: 467291 - RNA, 12 nt, Chlamydia trachomatis
gaaugaauuucc

SEQ ID NO: 467292 - RNA, 15 nt, Chlamydia trachomatis
gaaugauaagggaau

SEQ ID NO: 467293 - RNA, 18 nt, Chlamydia trachomatis
gaaugacugcgcuaugag

SEQ ID NO: 467294 - RNA, 23 nt, Chlamydia trachomatis
gaaugcaccggccaccccaaacg

SEQ ID NO: 467295 - RNA, 19 nt, Chlamydia trachomatis
gaaugcagaucauaucugc

SEQ ID NO: 467296 - RNA, 21 nt, Chlamydia trachomatis
gaaugcagaucauaucugcag

SEQ ID NO: 467297 - RNA, 14 nt, Chlamydia trachomatis
gaauggaucucccu

SEQ ID NO: 467298 - RNA, 21 nt, Chlamydia trachomatis
gaauggguaaggggaagauug

SEQ ID NO: 467299 - RNA, 14 nt, Chlamydia trachomatis
gaauguauaaacac

SEQ ID NO: 467300 - RNA, 12 nt, Chlamydia trachomatis
gaaugguggcau

SEQ ID NO: 467301 - RNA, 22 nt, Chlamydia trachomatis
gaauguggagcuaucauuucca

SEQ ID NO: 467302 - RNA, 20 nt, Chlamydia trachomatis
gaauguggguguagguuuug

SEQ ID NO: 467303 - RNA, 22 nt, Chlamydia trachomatis
gaaugugugguuguagaggaga

SEQ ID NO: 467304 - RNA, 12 nt, Chlamydia trachomatis
gaauuaaaucug

SEQ ID NO: 467305 - RNA, 15 nt, Chlamydia trachomatis
gaauucuaucaacau

SEQ ID NO: 467306 - RNA, 18 nt, Chlamydia trachomatis
gaauucuaucaacaucug

SEQ ID NO: 467307 - RNA, 12 nt, Chlamydia trachomatis
gaauucuucuuc

SEQ ID NO: 467308 - RNA, 23 nt, Chlamydia trachomatis
gaauucuucuucuguaucaaauu

SEQ ID NO: 467309 - RNA, 18 nt, Chlamydia trachomatis
gaauucuugcuauccugc

SEQ ID NO: 467310 - RNA, 14 nt, Chlamydia trachomatis
gaauugacgaaucg

SEQ ID NO: 467311 - RNA, 16 nt, Chlamydia trachomatis
gaauuucuucuuuuag

SEQ ID NO: 467312 - RNA, 18 nt, Chlamydia trachomatis
gaauuugacucucauaag

SEQ ID NO: 467313 - RNA, 20 nt, Chlamydia trachomatis
gaauuugacucucauaagaa

SEQ ID NO: 467314 - RNA, 21 nt, Chlamydia trachomatis
gaauuugacucucauaagaau

SEQ ID NO: 467315 - RNA, 19 nt, Chlamydia trachomatis
gaguaucuagacauagcuu

SEQ ID NO: 467316 - RNA, 16 nt, Chlamydia trachomatis
gagugccgaauaauga

SEQ ID NO: 467317 - RNA, 18 nt, Chlamydia trachomatis
gagugccgaauaaugauu

SEQ ID NO: 467318 - RNA, 18 nt, Chlamydia trachomatis
gagucucuaacaacaguu

SEQ ID NO: 467319 - RNA, 14 nt, Chlamydia trachomatis
gagucucugcaguc

SEQ ID NO: 467320 - RNA, 16 nt, Chlamydia trachomatis
gagugaugauagacaa

SEQ ID NO: 467321 - RNA, 24 nt, Chlamydia trachomatis
gaguccaacgcugcgcuccacuuc

SEQ ID NO: 467322 - RNA, 17 nt, Chlamydia trachomatis
gaguccauugcaggaga

SEQ ID NO: 467323 - RNA, 14 nt, Chlamydia trachomatis
gaguuccgaacaaa

SEQ ID NO: 467324 - RNA, 15 nt, Chlamydia trachomatis
gaguuccgaacaaaa

SEQ ID NO: 467325 - RNA, 17 nt, Chlamydia trachomatis
gaguuccgaauaagcau

SEQ ID NO: 467326 - RNA, 13 nt, Chlamydia trachomatis
gauaaaacccuaa

SEQ ID NO: 467327 - RNA, 21 nt, Chlamydia trachomatis
gauaaucuuggacuuucuacc

SEQ ID NO: 467328 - RNA, 18 nt, Chlamydia trachomatis
gauaaugccuuuugcaca

SEQ ID NO: 467329 - RNA, 17 nt, Chlamydia trachomatis
gauaauugauagaguuu

SEQ ID NO: 467330 - RNA, 20 nt, Chlamydia trachomatis
gauaauuuuccuuuuuccca

SEQ ID NO: 467331 - RNA, 16 nt, Chlamydia trachomatis
gauaauacucuucuau

SEQ ID NO: 467332 - RNA, 16 nt, Chlamydia trachomatis
gauaaauaaucucguu

SEQ ID NO: 467333 - RNA, 18 nt, Chlamydia trachomatis
gauacaagacucacagca

SEQ ID NO: 467334 - RNA, 19 nt, Chlamydia trachomatis
gauacaagacucacagcaa

SEQ ID NO: 467335 - RNA, 12 nt, Chlamydia trachomatis
gauacaauuccu

SEQ ID NO: 467336 - RNA, 22 nt, Chlamydia trachomatis
gauacgcauaugcgucuucccu

SEQ ID NO: 467337 - RNA, 17 nt, Chlamydia trachomatis
gauacugauuaugccac

SEQ ID NO: 467338 - RNA, 19 nt, Chlamydia trachomatis
gauagaucuaaagcagaaa

SEQ ID NO: 467339 - RNA, 14 nt, Chlamydia trachomatis
gauagagauaaaga

SEQ ID NO: 467340 - RNA, 15 nt, Chlamydia trachomatis
gauagagauuccacu

SEQ ID NO: 467341 - RNA, 20 nt, Chlamydia trachomatis
gauagaaaaaaacagcucug

SEQ ID NO: 467342 - RNA, 17 nt, Chlamydia trachomatis
gauaucguuagcaucau

SEQ ID NO: 467343 - RNA, 19 nt, Chlamydia trachomatis
gauaucguuagcaucaucc

SEQ ID NO: 467344 - RNA, 14 nt, Chlamydia trachomatis
gauaucuccaccau

SEQ ID NO: 467345 - RNA, 15 nt, Chlamydia trachomatis
gauaucuugcggagc

SEQ ID NO: 467346 - RNA, 15 nt, Chlamydia trachomatis
gauauccaucauaaa

SEQ ID NO: 467347 - RNA, 20 nt, Chlamydia trachomatis
gauagcaacgaacuuuccau

SEQ ID NO: 467348 - RNA, 16 nt, Chlamydia trachomatis
gauaugcuacuccuaa

SEQ ID NO: 467349 - RNA, 18 nt, Chlamydia trachomatis
gauauggaagaacagcag

SEQ ID NO: 467350 - RNA, 17 nt, Chlamydia trachomatis
gauaugccucuaagcac

SEQ ID NO: 467351 - RNA, 16 nt, Chlamydia trachomatis
gauaugcagcauccaa

SEQ ID NO: 467352 - RNA, 17 nt, Chlamydia trachomatis
gauauugccaaaaagaa

SEQ ID NO: 467353 - RNA, 15 nt, Chlamydia trachomatis
gaucaagaaaagaua

SEQ ID NO: 467354 - RNA, 22 nt, Chlamydia trachomatis
gauccacuggaauagcuagagc

SEQ ID NO: 467355 - RNA, 17 nt, Chlamydia trachomatis
gauccgauagcaugcaa

SEQ ID NO: 467356 - RNA, 18 nt, Chlamydia trachomatis
gaucccucuguccauucu

SEQ ID NO: 467357 - RNA, 19 nt, Chlamydia trachomatis
gaucccuuucauucuuucg

SEQ ID NO: 467358 - RNA, 20 nt, Chlamydia trachomatis
gaucccuuuuucaggagagu

SEQ ID NO: 467359 - RNA, 19 nt, Chlamydia trachomatis
gaucgaaaauagauuuucu

SEQ ID NO: 467360 - RNA, 19 nt, Chlamydia trachomatis
gauccguuaaagagucuuc

SEQ ID NO: 467361 - RNA, 21 nt, Chlamydia trachomatis
gaucgagucccuucaaucaua

SEQ ID NO: 467362 - RNA, 16 nt, Chlamydia trachomatis
gaucgagaagagccau

SEQ ID NO: 467363 - RNA, 15 nt, Chlamydia trachomatis
gaucgcaagccacca

SEQ ID NO: 467364 - RNA, 15 nt, Chlamydia trachomatis
gaucggagucugcuc

SEQ ID NO: 467365 - RNA, 20 nt, Chlamydia trachomatis
gaugaauuuuaucuaaaaag

SEQ ID NO: 467366 - RNA, 10 nt, Chlamydia trachomatis
gaugccgcag

SEQ ID NO: 467367 - RNA, 16 nt, Chlamydia trachomatis
gaugccgcagaaaaaa

SEQ ID NO: 467368 - RNA, 13 nt, Chlamydia trachomatis
gaugcgaaugaag

SEQ ID NO: 467369 - RNA, 16 nt, Chlamydia trachomatis
gaugcgaucuccucau

SEQ ID NO: 467370 - RNA, 20 nt, Chlamydia trachomatis
gaugcuguacgaacgccugu

SEQ ID NO: 467371 - RNA, 17 nt, Chlamydia trachomatis
gauggagauggaguagg

SEQ ID NO: 467372 - RNA, 18 nt, Chlamydia trachomatis
gauggggguuacuucaag

SEQ ID NO: 467373 - RNA, 15 nt, Chlamydia trachomatis
gauguaggauucaga

SEQ ID NO: 467374 - RNA, 21 nt, Chlamydia trachomatis
gauguacucugcaaaaucuuc

SEQ ID NO: 467375 - RNA, 22 nt, Chlamydia trachomatis
gauguaagguuugucuucagau

SEQ ID NO: 467376 - RNA, 22 nt, Chlamydia trachomatis
gauuaugaaaaagccugugccu

SEQ ID NO: 467377 - RNA, 15 nt, Chlamydia trachomatis
gauuaucuaaagcca

SEQ ID NO: 467378 - RNA, 15 nt, Chlamydia trachomatis
gauuaagauuauaau

SEQ ID NO: 467379 - RNA, 20 nt, Chlamydia trachomatis
gauuaaggaaugauaaggga

SEQ ID NO: 467380 - RNA, 18 nt, Chlamydia trachomatis
gauguuuguguuucuaaa

SEQ ID NO: 467381 - RNA, 16 nt, Chlamydia trachomatis
gauuaaaguuucuaau

SEQ ID NO: 467382 - RNA, 13 nt, Chlamydia trachomatis
gauuuaaaccauc

SEQ ID NO: 467383 - RNA, 16 nt, Chlamydia trachomatis
gauugcguuacuucuu

SEQ ID NO: 467384 - RNA, 23 nt, Chlamydia trachomatis
gauugcuuuuugcacaaaaaaaa

SEQ ID NO: 467385 - RNA, 16 nt, Chlamydia trachomatis
gauuggaaaauccaaa

SEQ ID NO: 467386 - RNA, 15 nt, Chlamydia trachomatis
gauuggauaucuugc

SEQ ID NO: 467387 - RNA, 20 nt, Chlamydia trachomatis
gauuggauaucuugcggagc

SEQ ID NO: 467388 - RNA, 17 nt, Chlamydia trachomatis
gauuggaucagcuccua

SEQ ID NO: 467389 - RNA, 15 nt, Chlamydia trachomatis
gauugaugacaacua

SEQ ID NO: 467390 - RNA, 20 nt, Chlamydia trachomatis
gauugauaaagcuaucccaa

SEQ ID NO: 467391 - RNA, 14 nt, Chlamydia trachomatis
gauucugcuccaaa

SEQ ID NO: 467392 - RNA, 17 nt, Chlamydia trachomatis
gauugaauaaaucuauc

SEQ ID NO: 467393 - RNA, 20 nt, Chlamydia trachomatis
gauugaauaaaucuauccau

SEQ ID NO: 467394 - RNA, 19 nt, Chlamydia trachomatis
gauucuccgaauaaagcuc

SEQ ID NO: 467395 - RNA, 18 nt, Chlamydia trachomatis
gauuuuucuuucaaagag

SEQ ID NO: 467396 - RNA, 21 nt, Chlamydia trachomatis
gcaaaaagugugccagcucua

SEQ ID NO: 467397 - RNA, 20 nt, Chlamydia trachomatis
gcaaaaaucugcaacaaaua

SEQ ID NO: 467398 - RNA, 22 nt, Chlamydia trachomatis
gauuuuaugacccagaaucauc

SEQ ID NO: 467399 - RNA, 22 nt, Chlamydia trachomatis
gauuuuucaaaaauagcaauaa

SEQ ID NO: 467400 - RNA, 15 nt, Chlamydia trachomatis
gauuugcaaauucuu

SEQ ID NO: 467401 - RNA, 20 nt, Chlamydia trachomatis
gauuugccccuuuuguacag

SEQ ID NO: 467402 - RNA, 18 nt, Chlamydia trachomatis
gauuucauaaauuuccgu

SEQ ID NO: 467403 - RNA, 20 nt, Chlamydia trachomatis
gauuucuucuguuuuuucag

SEQ ID NO: 467404 - RNA, 23 nt, Chlamydia trachomatis
gauuucuucuuugucauuaaagg

SEQ ID NO: 467405 - RNA, 20 nt, Chlamydia trachomatis
gcaaacgguagcgauuuucu

SEQ ID NO: 467406 - RNA, 17 nt, Chlamydia trachomatis
gcaaacugcucuucuaa

SEQ ID NO: 467407 - RNA, 18 nt, Chlamydia trachomatis
gcaaacugcucuucuaac

SEQ ID NO: 467408 - RNA, 14 nt, Chlamydia trachomatis
gcaaagagagcaac

SEQ ID NO: 467409 - RNA, 21 nt, Chlamydia trachomatis
gcaaaagcgaggcuucaaaga

SEQ ID NO: 467410 - RNA, 18 nt, Chlamydia trachomatis
gcaaaaucuucauaagaa

SEQ ID NO: 467411 - RNA, 14 nt, Chlamydia trachomatis
gcaaagauguuucu

SEQ ID NO: 467412 - RNA, 16 nt, Chlamydia trachomatis
gcaaagauguuucuua

SEQ ID NO: 467413 - RNA, 23 nt, Chlamydia trachomatis
gcaaagguagauccgauaucagc

SEQ ID NO: 467414 - RNA, 15 nt, Chlamydia trachomatis
gcaaagugcuaauaa

SEQ ID NO: 467415 - RNA, 10 nt, Chlamydia trachomatis
gcaaauaaua

SEQ ID NO: 467416 - RNA, 16 nt, Chlamydia trachomatis
gcaaauaauaaaccaa

SEQ ID NO: 467417 - RNA, 17 nt, Chlamydia trachomatis
gcaaauuaacagauaua

SEQ ID NO: 467418 - RNA, 21 nt, Chlamydia trachomatis
gcaaauccugcgcgcaaauca

SEQ ID NO: 467419 - RNA, 22 nt, Chlamydia trachomatis
gcaaauccauucaagacaacuu

SEQ ID NO: 467420 - RNA, 18 nt, Chlamydia trachomatis
gcaagcaacgaaaccaaa

SEQ ID NO: 467421 - RNA, 20 nt, Chlamydia trachomatis
gcaagaucaugggaaauaaa

SEQ ID NO: 467422 - RNA, 17 nt, Chlamydia trachomatis
gcaacuugagcaucugg

SEQ ID NO: 467423 - RNA, 18 nt, Chlamydia trachomatis
gcaacuuuucagcaagaa

SEQ ID NO: 467424 - RNA, 21 nt, Chlamydia trachomatis
gcaagaaaauagguaaagaag

SEQ ID NO: 467425 - RNA, 15 nt, Chlamydia trachomatis
gcaauagcaacugcu

SEQ ID NO: 467426 - RNA, 20 nt, Chlamydia trachomatis
gcaauagccauuaacaacaa

SEQ ID NO: 467427 - RNA, 15 nt, Chlamydia trachomatis
gcaagucuaggagau

SEQ ID NO: 467428 - RNA, 14 nt, Chlamydia trachomatis
gcaaguaaugacac

SEQ ID NO: 467429 - RNA, 15 nt, Chlamydia trachomatis
gcaaguaaugacacu

SEQ ID NO: 467430 - RNA, 23 nt, Chlamydia trachomatis
gcaaguaaugacacuggcaccuu

SEQ ID NO: 467431 - RNA, 20 nt, Chlamydia trachomatis
gcaauggcaaaaucuucaua

SEQ ID NO: 467432 - RNA, 13 nt, Chlamydia trachomatis
gcaaugcgaucag

SEQ ID NO: 467433 - RNA, 16 nt, Chlamydia trachomatis
gcaauggcuaagccau

SEQ ID NO: 467434 - RNA, 17 nt, Chlamydia trachomatis
gcaauucaucagcaccc

SEQ ID NO: 467435 - RNA, 21 nt, Chlamydia trachomatis
gcaauuucuacgagcugaccu

SEQ ID NO: 467436 - RNA, 15 nt, Chlamydia trachomatis
gcacaaaaaaaaaga

SEQ ID NO: 467437 - RNA, 15 nt, Chlamydia trachomatis
gcacaagcuguuccu

SEQ ID NO: 467438 - RNA, 16 nt, Chlamydia trachomatis
gcacaagcuguuccua

SEQ ID NO: 467439 - RNA, 14 nt, Chlamydia trachomatis
gcacaauaacagca

SEQ ID NO: 467440 - RNA, 15 nt, Chlamydia trachomatis
gcacaauaacagcac

SEQ ID NO: 467441 - RNA, 21 nt, Chlamydia trachomatis
gcacaaucucuuuaagcuggg

SEQ ID NO: 467442 - RNA, 17 nt, Chlamydia trachomatis
gcacacuccaucucgac

SEQ ID NO: 467443 - RNA, 15 nt, Chlamydia trachomatis
gcacacuugauaaau

SEQ ID NO: 467444 - RNA, 13 nt, Chlamydia trachomatis
gcacaucacagau

SEQ ID NO: 467445 - RNA, 19 nt, Chlamydia trachomatis
gcaccagcuaauaaguuca

SEQ ID NO: 467446 - RNA, 15 nt, Chlamydia trachomatis
gcaccugacucaaug

SEQ ID NO: 467447 - RNA, 20 nt, Chlamydia trachomatis
gcaccucggauccagaagca

SEQ ID NO: 467448 - RNA, 18 nt, Chlamydia trachomatis
gcacgcuacuaacgaagc

SEQ ID NO: 467449 - RNA, 23 nt, Chlamydia trachomatis
gcacuaacgaacgggaaaugcug

SEQ ID NO: 467450 - RNA, 14 nt, Chlamydia trachomatis
gcacugucucaugg

SEQ ID NO: 467451 - RNA, 16 nt, Chlamydia trachomatis
gcacuuagcaguuaca

SEQ ID NO: 467452 - RNA, 18 nt, Chlamydia trachomatis
gcagcaucuauuuucucu

SEQ ID NO: 467453 - RNA, 19 nt, Chlamydia trachomatis
gcagcaucuauuuucucuu

SEQ ID NO: 467454 - RNA, 15 nt, Chlamydia trachomatis
gcagcucuuacuccu

SEQ ID NO: 467455 - RNA, 17 nt, Chlamydia trachomatis
gcaggcgaacagugaca

SEQ ID NO: 467456 - RNA, 19 nt, Chlamydia trachomatis
gcaggucuaggggaagaau

SEQ ID NO: 467457 - RNA, 23 nt, Chlamydia trachomatis
gcagucauauucggcuguaguga

SEQ ID NO: 467458 - RNA, 20 nt, Chlamydia trachomatis
gcaguaaaaucuaaaauauc

SEQ ID NO: 467459 - RNA, 18 nt, Chlamydia trachomatis
gcauaaggaagcaaaaac

SEQ ID NO: 467460 - RNA, 21 nt, Chlamydia trachomatis
gcauacucgguaacugaggga

SEQ ID NO: 467461 - RNA, 14 nt, Chlamydia trachomatis
gcauagucucccaa

SEQ ID NO: 467462 - RNA, 15 nt, Chlamydia trachomatis
gcauagucucccaaa

SEQ ID NO: 467463 - RNA, 19 nt, Chlamydia trachomatis
gcauauuacugacugguuc

SEQ ID NO: 467464 - RNA, 18 nt, Chlamydia trachomatis
gcaucaaaggauaugucu

SEQ ID NO: 467465 - RNA, 15 nt, Chlamydia trachomatis
gcaucaguaaaaaua

SEQ ID NO: 467466 - RNA, 18 nt, Chlamydia trachomatis
gcaucauccccagaagcc

SEQ ID NO: 467467 - RNA, 18 nt, Chlamydia trachomatis
gcaucccaaaauagcagg

SEQ ID NO: 467468 - RNA, 18 nt, Chlamydia trachomatis
gcaucgaagcguuuacaa

SEQ ID NO: 467469 - RNA, 14 nt, Chlamydia trachomatis
gcaucucaaugagc

SEQ ID NO: 467470 - RNA, 13 nt, Chlamydia trachomatis
gcaucuacagagu

SEQ ID NO: 467471 - RNA, 15 nt, Chlamydia trachomatis
gcaucuggaguggca

SEQ ID NO: 467472 - RNA, 11 nt, Chlamydia trachomatis
gcaucuuuucu

SEQ ID NO: 467473 - RNA, 14 nt, Chlamydia trachomatis
gcaucuuuucuuau

SEQ ID NO: 467474 - RNA, 16 nt, Chlamydia trachomatis
gcaucuuuucuuauaa

SEQ ID NO: 467475 - RNA, 17 nt, Chlamydia trachomatis
gcaucuuuucuuauaaa

SEQ ID NO: 467476 - RNA, 18 nt, Chlamydia trachomatis
gcaucuucucgaaagaga

SEQ ID NO: 467477 - RNA, 20 nt, Chlamydia trachomatis
gcaucuucucgaaagagaac

SEQ ID NO: 467478 - RNA, 17 nt, Chlamydia trachomatis
gcaugacuacacgcuga

SEQ ID NO: 467479 - RNA, 17 nt, Chlamydia trachomatis
gcaugaaugagcuuaga

SEQ ID NO: 467480 - RNA, 18 nt, Chlamydia trachomatis
gcaugccgcacauccgcu

SEQ ID NO: 467481 - RNA, 20 nt, Chlamydia trachomatis
gcaugcuucuuuaagacuca

SEQ ID NO: 467482 - RNA, 15 nt, Chlamydia trachomatis
gcaugguaaaugugu

SEQ ID NO: 467483 - RNA, 21 nt, Chlamydia trachomatis
gcauggucucuguagugggcu

SEQ ID NO: 467484 - RNA, 19 nt, Chlamydia trachomatis
gcauuacgccccuucuuca

SEQ ID NO: 467485 - RNA, 23 nt, Chlamydia trachomatis
gcauuaaagggaaaaaacuagaa

SEQ ID NO: 467486 - RNA, 18 nt, Chlamydia trachomatis
gcauguaaucccuuuuuc

SEQ ID NO: 467487 - RNA, 23 nt, Chlamydia trachomatis
gcauucguuaucaauaaccugaa

SEQ ID NO: 467488 - RNA, 16 nt, Chlamydia trachomatis
gcauugaacaccauau

SEQ ID NO: 467489 - RNA, 14 nt, Chlamydia trachomatis
gccaaccauaggau

SEQ ID NO: 467490 - RNA, 21 nt, Chlamydia trachomatis
gccaacuauugaaauaccacu

SEQ ID NO: 467491 - RNA, 12 nt, Chlamydia trachomatis
gccaagcaagau

SEQ ID NO: 467492 - RNA, 17 nt, Chlamydia trachomatis
gccaagcaagauauaaa

SEQ ID NO: 467493 - RNA, 13 nt, Chlamydia trachomatis
gccaaaggauccu

SEQ ID NO: 467494 - RNA, 14 nt, Chlamydia trachomatis
gcauuucucuccaa

SEQ ID NO: 467495 - RNA, 17 nt, Chlamydia trachomatis
gcauuucucuccaaacc

SEQ ID NO: 467496 - RNA, 16 nt, Chlamydia trachomatis
gcauuugaaagaaacg

SEQ ID NO: 467497 - RNA, 15 nt, Chlamydia trachomatis
gcauuuguaguucua

SEQ ID NO: 467498 - RNA, 15 nt, Chlamydia trachomatis
gccaaaaagaaaauc

SEQ ID NO: 467499 - RNA, 19 nt, Chlamydia trachomatis
gccaauccguaugauaaaa

SEQ ID NO: 467500 - RNA, 20 nt, Chlamydia trachomatis
gccaaucuguaauaaacccu

SEQ ID NO: 467501 - RNA, 21 nt, Chlamydia trachomatis
gccaauuuccauggagcuuca

SEQ ID NO: 467502 - RNA, 17 nt, Chlamydia trachomatis
gccacacuuccccauuc

SEQ ID NO: 467503 - RNA, 17 nt, Chlamydia trachomatis
gccacacauguccuacc

SEQ ID NO: 467504 - RNA, 16 nt, Chlamydia trachomatis
gccacugugaaaugcg

SEQ ID NO: 467505 - RNA, 18 nt, Chlamydia trachomatis
gccacuugcuccacacaa

SEQ ID NO: 467506 - RNA, 14 nt, Chlamydia trachomatis
gccagccccucccu

SEQ ID NO: 467507 - RNA, 17 nt, Chlamydia trachomatis
gccagcauauuacugac

SEQ ID NO: 467508 - RNA, 16 nt, Chlamydia trachomatis
gccagcuaagagaagc

SEQ ID NO: 467509 - RNA, 20 nt, Chlamydia trachomatis
gccaggcgcuucucuuugaa

SEQ ID NO: 467510 - RNA, 18 nt, Chlamydia trachomatis
gccaucauuaucuucuuc

SEQ ID NO: 467511 - RNA, 20 nt, Chlamydia trachomatis
gccaucauuaucuucuucua

SEQ ID NO: 467512 - RNA, 21 nt, Chlamydia trachomatis
gcccaagcuuucaucuccuuu

SEQ ID NO: 467513 - RNA, 19 nt, Chlamydia trachomatis
gcccaaggaaaagaugaag

SEQ ID NO: 467514 - RNA, 13 nt, Chlamydia trachomatis
gcccacagaacau

SEQ ID NO: 467515 - RNA, 19 nt, Chlamydia trachomatis
gcccaaaucucaacguguu

SEQ ID NO: 467516 - RNA, 14 nt, Chlamydia trachomatis
gcccagaacaacuu

SEQ ID NO: 467517 - RNA, 15 nt, Chlamydia trachomatis
gcccaggauaacaaa

SEQ ID NO: 467518 - RNA, 18 nt, Chlamydia trachomatis
gccccguguugaauuacu

SEQ ID NO: 467519 - RNA, 20 nt, Chlamydia trachomatis
gccccuaaagccacacaugu

SEQ ID NO: 467520 - RNA, 15 nt, Chlamydia trachomatis
gccccucuuuuucac

SEQ ID NO: 467521 - RNA, 20 nt, Chlamydia trachomatis
gcccuacggaaccagcgaca

SEQ ID NO: 467522 - RNA, 21 nt, Chlamydia trachomatis
gcccuugagaacguuuagcua

SEQ ID NO: 467523 - RNA, 13 nt, Chlamydia trachomatis
gcccuugagagca

SEQ ID NO: 467524 - RNA, 22 nt, Chlamydia trachomatis
gcccuuuuaaagggggacaaaa

SEQ ID NO: 467525 - RNA, 16 nt, Chlamydia trachomatis
gccgaauaaugauucc

SEQ ID NO: 467526 - RNA, 18 nt, Chlamydia trachomatis
gccgaacucuccucuccu

SEQ ID NO: 467527 - RNA, 11 nt, Chlamydia trachomatis
gccgagcauug

SEQ ID NO: 467528 - RNA, 20 nt, Chlamydia trachomatis
gccgagcgacuucauacaua

SEQ ID NO: 467529 - RNA, 20 nt, Chlamydia trachomatis
gccgguuaacacaauuuuug

SEQ ID NO: 467530 - RNA, 16 nt, Chlamydia trachomatis
gcgaaaauuggaguga

SEQ ID NO: 467531 - RNA, 23 nt, Chlamydia trachomatis
gcgaagacagaaucguuuaagug

SEQ ID NO: 467532 - RNA, 13 nt, Chlamydia trachomatis
gcgaacagugaca

SEQ ID NO: 467533 - RNA, 22 nt, Chlamydia trachomatis
gcgaacagugacagcauagaua

SEQ ID NO: 467534 - RNA, 14 nt, Chlamydia trachomatis
gcgaagcacuggau

SEQ ID NO: 467535 - RNA, 20 nt, Chlamydia trachomatis
gcgaaucacaugucauccuu

SEQ ID NO: 467536 - RNA, 17 nt, Chlamydia trachomatis
gcgacaugcuuguucuc

SEQ ID NO: 467537 - RNA, 16 nt, Chlamydia trachomatis
gcgacuaauucuaaug

SEQ ID NO: 467538 - RNA, 18 nt, Chlamydia trachomatis
gcgaugccucuaacacuu

SEQ ID NO: 467539 - RNA, 13 nt, Chlamydia trachomatis
gcgaucuccuucc

SEQ ID NO: 467540 - RNA, 16 nt, Chlamydia trachomatis
gcgaucuccuuccucu

SEQ ID NO: 467541 - RNA, 16 nt, Chlamydia trachomatis
gcgcagaucuccuucu

SEQ ID NO: 467542 - RNA, 16 nt, Chlamydia trachomatis
gcgcauccacuacugu

SEQ ID NO: 467543 - RNA, 13 nt, Chlamydia trachomatis
gcgccuucugcug

SEQ ID NO: 467544 - RNA, 16 nt, Chlamydia trachomatis
gcgcuggcuuuguccu

SEQ ID NO: 467545 - RNA, 16 nt, Chlamydia trachomatis
gcggaacaagcaaaac

SEQ ID NO: 467546 - RNA, 12 nt, Chlamydia trachomatis
gcgcuuuuucuu

SEQ ID NO: 467547 - RNA, 15 nt, Chlamydia trachomatis
gcgcuuuuucuucuc

SEQ ID NO: 467548 - RNA, 16 nt, Chlamydia trachomatis
gcggaaggaaaaagaa

SEQ ID NO: 467549 - RNA, 15 nt, Chlamydia trachomatis
gcggaauaagucugc

SEQ ID NO: 467550 - RNA, 13 nt, Chlamydia trachomatis
gcggcuaaagaag

SEQ ID NO: 467551 - RNA, 19 nt, Chlamydia trachomatis
gcggcugcguuaaacacag

SEQ ID NO: 467552 - RNA, 14 nt, Chlamydia trachomatis
gcgguagaaagucc

SEQ ID NO: 467553 - RNA, 19 nt, Chlamydia trachomatis
gcguauuuuuguuucuacu

SEQ ID NO: 467554 - RNA, 22 nt, Chlamydia trachomatis
gcguccagugacuugaguaauc

SEQ ID NO: 467555 - RNA, 12 nt, Chlamydia trachomatis
gcguccaaaaag

SEQ ID NO: 467556 - RNA, 21 nt, Chlamydia trachomatis
gcguccaaaaagcgugucaau

SEQ ID NO: 467557 - RNA, 20 nt, Chlamydia trachomatis
gcgugugaccaucuucacca

SEQ ID NO: 467558 - RNA, 16 nt, Chlamydia trachomatis
gcgugucguuuucgga

SEQ ID NO: 467559 - RNA, 22 nt, Chlamydia trachomatis
gcgugucguuuucggagaagaa

SEQ ID NO: 467560 - RNA, 13 nt, Chlamydia trachomatis
gcuaucuaauauu

SEQ ID NO: 467561 - RNA, 16 nt, Chlamydia trachomatis
gcuaugaaaaauccuu

SEQ ID NO: 467562 - RNA, 20 nt, Chlamydia trachomatis
gcuaucaguggcuauauucg

SEQ ID NO: 467563 - RNA, 15 nt, Chlamydia trachomatis
gcuaucauuuccaaa

SEQ ID NO: 467564 - RNA, 15 nt, Chlamydia trachomatis
gcuauauguaagaag

SEQ ID NO: 467565 - RNA, 14 nt, Chlamydia trachomatis
gcuaucaauaaaaa

SEQ ID NO: 467566 - RNA, 14 nt, Chlamydia trachomatis
gcuaucaauaaaga

SEQ ID NO: 467567 - RNA, 15 nt, Chlamydia trachomatis
gcuaucaauaaagaa

SEQ ID NO: 467568 - RNA, 14 nt, Chlamydia trachomatis
gcuagaagaagagg

SEQ ID NO: 467569 - RNA, 22 nt, Chlamydia trachomatis
gcuagaauguguauuugguugu

SEQ ID NO: 467570 - RNA, 14 nt, Chlamydia trachomatis
gcuagagcaugcaa

SEQ ID NO: 467571 - RNA, 23 nt, Chlamydia trachomatis
gcuagauacaauaguaccuucaa

SEQ ID NO: 467572 - RNA, 18 nt, Chlamydia trachomatis
gcuagccuggcugcagaa

SEQ ID NO: 467573 - RNA, 20 nt, Chlamydia trachomatis
gcuauucacuaccagaggag

SEQ ID NO: 467574 - RNA, 15 nt, Chlamydia trachomatis
gcuauuccauggcgu

SEQ ID NO: 467575 - RNA, 13 nt, Chlamydia trachomatis
gcuauugauuuuu

SEQ ID NO: 467576 - RNA, 23 nt, Chlamydia trachomatis
gcuauugauuuuuucgcuuuugg

SEQ ID NO: 467577 - RNA, 17 nt, Chlamydia trachomatis
gcuauuguauagcuuuu

SEQ ID NO: 467578 - RNA, 18 nt, Chlamydia trachomatis
gcuauuucgaucuuacca

SEQ ID NO: 467579 - RNA, 13 nt, Chlamydia trachomatis
gcuauuuggaucu

SEQ ID NO: 467580 - RNA, 17 nt, Chlamydia trachomatis
gcuauuuggaucucuua

SEQ ID NO: 467581 - RNA, 15 nt, Chlamydia trachomatis
gcucaaggaaacucu

SEQ ID NO: 467582 - RNA, 18 nt, Chlamydia trachomatis
gcuccacaagaaguaaca

SEQ ID NO: 467583 - RNA, 22 nt, Chlamydia trachomatis
gcucaucuugcauaaggaagca

SEQ ID NO: 467584 - RNA, 15 nt, Chlamydia trachomatis
gcucaugagccucua

SEQ ID NO: 467585 - RNA, 16 nt, Chlamydia trachomatis
gcuccacuucuuuucc

SEQ ID NO: 467586 - RNA, 14 nt, Chlamydia trachomatis
gcucccauuucugg

SEQ ID NO: 467587 - RNA, 19 nt, Chlamydia trachomatis
gcucccagagaaucuuaaa

SEQ ID NO: 467588 - RNA, 22 nt, Chlamydia trachomatis
gcucccaacaagggaaugaaau

SEQ ID NO: 467589 - RNA, 15 nt, Chlamydia trachomatis
gcuccggacauucca

SEQ ID NO: 467590 - RNA, 16 nt, Chlamydia trachomatis
gcuccggcaaauccug

SEQ ID NO: 467591 - RNA, 14 nt, Chlamydia trachomatis
gcuccgccuucugc

SEQ ID NO: 467592 - RNA, 18 nt, Chlamydia trachomatis
gcucgagagaugauuguu

SEQ ID NO: 467593 - RNA, 22 nt, Chlamydia trachomatis
gcucguuccucagcuaauaacc

SEQ ID NO: 467594 - RNA, 19 nt, Chlamydia trachomatis
gcucuaaagucuuuccauu

SEQ ID NO: 467595 - RNA, 15 nt, Chlamydia trachomatis
gcucuaacucuucuu

SEQ ID NO: 467596 - RNA, 15 nt, Chlamydia trachomatis
gcucucuucacaaau

SEQ ID NO: 467597 - RNA, 16 nt, Chlamydia trachomatis
gcucucuucacaaauu

SEQ ID NO: 467598 - RNA, 17 nt, Chlamydia trachomatis
gcucucuucacaaauuu

SEQ ID NO: 467599 - RNA, 22 nt, Chlamydia trachomatis
gcucucuucucuagaaaaggcc

SEQ ID NO: 467600 - RNA, 13 nt, Chlamydia trachomatis
gcucuuuccucua

SEQ ID NO: 467601 - RNA, 13 nt, Chlamydia trachomatis
gcucuuucuuacg

SEQ ID NO: 467602 - RNA, 15 nt, Chlamydia trachomatis
gcucuuuuucuucca

SEQ ID NO: 467603 - RNA, 13 nt, Chlamydia trachomatis
gcugaaacacgcu

SEQ ID NO: 467604 - RNA, 13 nt, Chlamydia trachomatis
gcucuuacuccua

SEQ ID NO: 467605 - RNA, 22 nt, Chlamydia trachomatis
gcucugcccccuacagagcccu

SEQ ID NO: 467606 - RNA, 16 nt, Chlamydia trachomatis
gcugaggauuccaagg

SEQ ID NO: 467607 - RNA, 16 nt, Chlamydia trachomatis
gcugacuaaauacaaa

SEQ ID NO: 467608 - RNA, 23 nt, Chlamydia trachomatis
gcugacuaaauacaaaucuuuua

SEQ ID NO: 467609 - RNA, 14 nt, Chlamydia trachomatis
gcugauaaggaggc

SEQ ID NO: 467610 - RNA, 17 nt, Chlamydia trachomatis
gcugcagaagacuuugg

SEQ ID NO: 467611 - RNA, 16 nt, Chlamydia trachomatis
gcugcaaucucuuguu

SEQ ID NO: 467612 - RNA, 14 nt, Chlamydia trachomatis
gcugcgagagagcu

SEQ ID NO: 467613 - RNA, 14 nt, Chlamydia trachomatis
gcugcgaugugguc

SEQ ID NO: 467614 - RNA, 18 nt, Chlamydia trachomatis
gcugcgauguggucaaaa

SEQ ID NO: 467615 - RNA, 14 nt, Chlamydia trachomatis
gcugcuaucaucuu

SEQ ID NO: 467616 - RNA, 21 nt, Chlamydia trachomatis
gcugcuaucuucuagaggagu

SEQ ID NO: 467617 - RNA, 16 nt, Chlamydia trachomatis
gcugcugauaaccaga

SEQ ID NO: 467618 - RNA, 15 nt, Chlamydia trachomatis
gcugcucgaaaaucu

SEQ ID NO: 467619 - RNA, 14 nt, Chlamydia trachomatis
gcugcucccucugg

SEQ ID NO: 467620 - RNA, 13 nt, Chlamydia trachomatis
gcugcugcuugga

SEQ ID NO: 467621 - RNA, 14 nt, Chlamydia trachomatis
gcugcuuuagcugc

SEQ ID NO: 467622 - RNA, 10 nt, Chlamydia trachomatis
gcugggagau

SEQ ID NO: 467623 - RNA, 22 nt, Chlamydia trachomatis
gcugguaauuggcggagaagcu

SEQ ID NO: 467624 - RNA, 16 nt, Chlamydia trachomatis
gcugguugguuuucuu

SEQ ID NO: 467625 - RNA, 21 nt, Chlamydia trachomatis
gcugguugguuuucuuguucu

SEQ ID NO: 467626 - RNA, 16 nt, Chlamydia trachomatis
gcugguuuuuuuugaa

SEQ ID NO: 467627 - RNA, 16 nt, Chlamydia trachomatis
gcuguacgauggaaau

SEQ ID NO: 467628 - RNA, 18 nt, Chlamydia trachomatis
gcuguaugccaagaccuc

SEQ ID NO: 467629 - RNA, 13 nt, Chlamydia trachomatis
gcuguaugccaau

SEQ ID NO: 467630 - RNA, 21 nt, Chlamydia trachomatis
gcuguagugaucuuuuuagga

SEQ ID NO: 467631 - RNA, 13 nt, Chlamydia trachomatis
gcuguagccccuu

SEQ ID NO: 467632 - RNA, 21 nt, Chlamydia trachomatis
gcuguagccccuuuagaaauu

SEQ ID NO: 467633 - RNA, 17 nt, Chlamydia trachomatis
gcuguauucaucucuac

SEQ ID NO: 467634 - RNA, 14 nt, Chlamydia trachomatis
gcuguauuuccuuc

SEQ ID NO: 467635 - RNA, 14 nt, Chlamydia trachomatis
gcugucagaagaau

SEQ ID NO: 467636 - RNA, 20 nt, Chlamydia trachomatis
gcugucaggauuuaaagccu

SEQ ID NO: 467637 - RNA, 15 nt, Chlamydia trachomatis
gcuguugaacggaau

SEQ ID NO: 467638 - RNA, 16 nt, Chlamydia trachomatis
gcuguuccuuuuacuu

SEQ ID NO: 467639 - RNA, 15 nt, Chlamydia trachomatis
gcuguucagcuucua

SEQ ID NO: 467640 - RNA, 19 nt, Chlamydia trachomatis
gcuguuuguaacgcagcuc

SEQ ID NO: 467641 - RNA, 22 nt, Chlamydia trachomatis
gcuuaacuuuguuauuuuuuaa

SEQ ID NO: 467642 - RNA, 20 nt, Chlamydia trachomatis
gcuuaugaacggcucuucuu

SEQ ID NO: 467643 - RNA, 22 nt, Chlamydia trachomatis
gcuuaugaacggcucuucuuac

SEQ ID NO: 467644 - RNA, 15 nt, Chlamydia trachomatis
gcuuauuaauuucua

SEQ ID NO: 467645 - RNA, 16 nt, Chlamydia trachomatis
gcuuaucaacaagauu

SEQ ID NO: 467646 - RNA, 16 nt, Chlamydia trachomatis
gcuuaguuacaagaca

SEQ ID NO: 467647 - RNA, 16 nt, Chlamydia trachomatis
gcuuauaacuaagauc

SEQ ID NO: 467648 - RNA, 23 nt, Chlamydia trachomatis
gcuuagccacugcacaucacaga

SEQ ID NO: 467649 - RNA, 20 nt, Chlamydia trachomatis
gcuuagauuuagcuguuaug

SEQ ID NO: 467650 - RNA, 13 nt, Chlamydia trachomatis
gcuucaauaaugu

SEQ ID NO: 467651 - RNA, 16 nt, Chlamydia trachomatis
gcuucaauaauguuga

SEQ ID NO: 467652 - RNA, 14 nt, Chlamydia trachomatis
gcuucaaaacuaaa

SEQ ID NO: 467653 - RNA, 17 nt, Chlamydia trachomatis
gcuucaggggagaaaac

SEQ ID NO: 467654 - RNA, 13 nt, Chlamydia trachomatis
gcuucauaaaaaa

SEQ ID NO: 467655 - RNA, 15 nt, Chlamydia trachomatis
gcuucauacacauga

SEQ ID NO: 467656 - RNA, 20 nt, Chlamydia trachomatis
gcuucauggaauaguugcac

SEQ ID NO: 467657 - RNA, 23 nt, Chlamydia trachomatis
gcuuccaaacgaucgauccuguu

SEQ ID NO: 467658 - RNA, 19 nt, Chlamydia trachomatis
gcuuccaaaucugcaagaa

SEQ ID NO: 467659 - RNA, 23 nt, Chlamydia trachomatis
gcuucccgcuauuuuccucuuca

SEQ ID NO: 467660 - RNA, 14 nt, Chlamydia trachomatis
gcuuccgaaagcau

SEQ ID NO: 467661 - RNA, 21 nt, Chlamydia trachomatis
gcuuccguccccuuacccaaa

SEQ ID NO: 467662 - RNA, 19 nt, Chlamydia trachomatis
gcuuccuguuuaucacuau

SEQ ID NO: 467663 - RNA, 19 nt, Chlamydia trachomatis
gcuuccuaucgcgagaaga

SEQ ID NO: 467664 - RNA, 14 nt, Chlamydia trachomatis
gcuuccucuccuuc

SEQ ID NO: 467665 - RNA, 16 nt, Chlamydia trachomatis
gcuuccucuccuucua

SEQ ID NO: 467666 - RNA, 18 nt, Chlamydia trachomatis
gcuuccugaacgauaaca

SEQ ID NO: 467667 - RNA, 21 nt, Chlamydia trachomatis
gcuucgaggagucucugcagu

SEQ ID NO: 467668 - RNA, 22 nt, Chlamydia trachomatis
gcuucgauaagaaaaaaaacca

SEQ ID NO: 467669 - RNA, 18 nt, Chlamydia trachomatis
gcuucggaaggagacaag

SEQ ID NO: 467670 - RNA, 16 nt, Chlamydia trachomatis
gcuucuccaucugacu

SEQ ID NO: 467671 - RNA, 23 nt, Chlamydia trachomatis
gcuucucgcuacaaauccuucag

SEQ ID NO: 467672 - RNA, 16 nt, Chlamydia trachomatis
gcuucugaacgagaaa

SEQ ID NO: 467673 - RNA, 20 nt, Chlamydia trachomatis
gcuucugaacgagaaaaagg

SEQ ID NO: 467674 - RNA, 18 nt, Chlamydia trachomatis
gcuucuggcgauaguucu

SEQ ID NO: 467675 - RNA, 16 nt, Chlamydia trachomatis
gcuucugccuuuugau

SEQ ID NO: 467676 - RNA, 16 nt, Chlamydia trachomatis
gcuucuagaaauucuu

SEQ ID NO: 467677 - RNA, 22 nt, Chlamydia trachomatis
gcuucgugagacagcacuucuu

SEQ ID NO: 467678 - RNA, 14 nt, Chlamydia trachomatis
gcuucuucuucucu

SEQ ID NO: 467679 - RNA, 13 nt, Chlamydia trachomatis
gcuucuucuucuu

SEQ ID NO: 467680 - RNA, 16 nt, Chlamydia trachomatis
gcuucuuuaggauucg

SEQ ID NO: 467681 - RNA, 16 nt, Chlamydia trachomatis
gcuucuucauguucug

SEQ ID NO: 467682 - RNA, 17 nt, Chlamydia trachomatis
gcuucuuuuuucuuuuu

SEQ ID NO: 467683 - RNA, 18 nt, Chlamydia trachomatis
gcuugauucuugaaucag

SEQ ID NO: 467684 - RNA, 23 nt, Chlamydia trachomatis
gcuugauauucccuucuauuucu

SEQ ID NO: 467685 - RNA, 16 nt, Chlamydia trachomatis
gcuugagaauccaaau

SEQ ID NO: 467686 - RNA, 16 nt, Chlamydia trachomatis
gcuugcccaaacucca

SEQ ID NO: 467687 - RNA, 17 nt, Chlamydia trachomatis
gcuugcaacacgguucu

SEQ ID NO: 467688 - RNA, 18 nt, Chlamydia trachomatis
gcuuguugcuguaacgaa

SEQ ID NO: 467689 - RNA, 12 nt, Chlamydia trachomatis
gcuuuagcagcc

SEQ ID NO: 467690 - RNA, 22 nt, Chlamydia trachomatis
gcuuuagcagccccccuuuuuu

SEQ ID NO: 467691 - RNA, 21 nt, Chlamydia trachomatis
gcuuucgcugcggaaaucuuc

SEQ ID NO: 467692 - RNA, 14 nt, Chlamydia trachomatis
gcuuucuaaagcag

SEQ ID NO: 467693 - RNA, 22 nt, Chlamydia trachomatis
gcuuucuaaagcagcuaaccau

SEQ ID NO: 467694 - RNA, 15 nt, Chlamydia trachomatis
gcuuucuuccccaaa

SEQ ID NO: 467695 - RNA, 16 nt, Chlamydia trachomatis
gcuuucuugaggaaga

SEQ ID NO: 467696 - RNA, 21 nt, Chlamydia trachomatis
gcuuucuuuguuccuacuaaa

SEQ ID NO: 467697 - RNA, 17 nt, Chlamydia trachomatis
gcuuucuuuuccaucgu

SEQ ID NO: 467698 - RNA, 21 nt, Chlamydia trachomatis
gcuuugaucuuuguucucuaa

SEQ ID NO: 467699 - RNA, 16 nt, Chlamydia trachomatis
gcuuugcacaccugcu

SEQ ID NO: 467700 - RNA, 14 nt, Chlamydia trachomatis
gcuuugucuauaag

SEQ ID NO: 467701 - RNA, 15 nt, Chlamydia trachomatis
gcuuuguugcaaacg

SEQ ID NO: 467702 - RNA, 18 nt, Chlamydia trachomatis
gcuuuuuaauauccucca

SEQ ID NO: 467703 - RNA, 21 nt, Chlamydia trachomatis
gcuuuucuuuuuuguguuucu

SEQ ID NO: 467704 - RNA, 16 nt, Chlamydia trachomatis
gcuuuugaucuuucca

SEQ ID NO: 467705 - RNA, 15 nt, Chlamydia trachomatis
gcuuuucuauuuuua

SEQ ID NO: 467706 - RNA, 19 nt, Chlamydia trachomatis
gcuuuucuccuucuuuaau

SEQ ID NO: 467707 - RNA, 15 nt, Chlamydia trachomatis
gcuuuuucuucucua

SEQ ID NO: 467708 - RNA, 12 nt, Chlamydia trachomatis
gcuuuuuauccu

SEQ ID NO: 467709 - RNA, 22 nt, Chlamydia trachomatis
gcuuuuuauccuacgguaucaa

SEQ ID NO: 467710 - RNA, 21 nt, Chlamydia trachomatis
gcuuuuuccggauaauuuccg

SEQ ID NO: 467711 - RNA, 17 nt, Chlamydia trachomatis
ggaaaagaugaagaagu

SEQ ID NO: 467712 - RNA, 14 nt, Chlamydia trachomatis
ggaaaaaguuugga

SEQ ID NO: 467713 - RNA, 21 nt, Chlamydia trachomatis
gcuuuuuuuacucgucuuuua

SEQ ID NO: 467714 - RNA, 10 nt, Chlamydia trachomatis
ggaaaaaaaa

SEQ ID NO: 467715 - RNA, 14 nt, Chlamydia trachomatis
gcuuuuuucagaaa

SEQ ID NO: 467716 - RNA, 18 nt, Chlamydia trachomatis
ggaaagcuaugcccagga

SEQ ID NO: 467717 - RNA, 19 nt, Chlamydia trachomatis
ggaaagagagaaagcgugu

SEQ ID NO: 467718 - RNA, 17 nt, Chlamydia trachomatis
ggaaacaaauuccucug

SEQ ID NO: 467719 - RNA, 17 nt, Chlamydia trachomatis
ggaaaugaggacagagu

SEQ ID NO: 467720 - RNA, 23 nt, Chlamydia trachomatis
ggaaaugcuggauuggauaucuu

SEQ ID NO: 467721 - RNA, 23 nt, Chlamydia trachomatis
ggaaauauugcucuaaagucuuu

SEQ ID NO: 467722 - RNA, 17 nt, Chlamydia trachomatis
ggaaaucuucgugcagg

SEQ ID NO: 467723 - RNA, 21 nt, Chlamydia trachomatis
ggaaaucuugugcuaaggcau

SEQ ID NO: 467724 - RNA, 23 nt, Chlamydia trachomatis
ggaaaguacucgauggcagggaa

SEQ ID NO: 467725 - RNA, 11 nt, Chlamydia trachomatis
ggaaagugcau

SEQ ID NO: 467726 - RNA, 11 nt, Chlamydia trachomatis
ggaaauaagag

SEQ ID NO: 467727 - RNA, 15 nt, Chlamydia trachomatis
ggaacaucgagaaaa

SEQ ID NO: 467728 - RNA, 16 nt, Chlamydia trachomatis
ggaacaucgagaaaau

SEQ ID NO: 467729 - RNA, 22 nt, Chlamydia trachomatis
ggaaccuagaucuaaggaaugu

SEQ ID NO: 467730 - RNA, 14 nt, Chlamydia trachomatis
ggaacgauuaucuu

SEQ ID NO: 467731 - RNA, 16 nt, Chlamydia trachomatis
ggaagaacagcagcag

SEQ ID NO: 467732 - RNA, 15 nt, Chlamydia trachomatis
ggaagaaagcauuga

SEQ ID NO: 467733 - RNA, 20 nt, Chlamydia trachomatis
ggaagagaaaccaacgagug

SEQ ID NO: 467734 - RNA, 23 nt, Chlamydia trachomatis
ggaagaauaucaucuucaagagc

SEQ ID NO: 467735 - RNA, 12 nt, Chlamydia trachomatis
ggaagaggaggg

SEQ ID NO: 467736 - RNA, 13 nt, Chlamydia trachomatis
ggaagauagaaga

SEQ ID NO: 467737 - RNA, 11 nt, Chlamydia trachomatis
ggaagcugaga

SEQ ID NO: 467738 - RNA, 17 nt, Chlamydia trachomatis
ggaaggaaaaagaaaaa

SEQ ID NO: 467739 - RNA, 16 nt, Chlamydia trachomatis
ggaagcuagaagaaga

SEQ ID NO: 467740 - RNA, 22 nt, Chlamydia trachomatis
ggaagcuagaagaagaggagga

SEQ ID NO: 467741 - RNA, 20 nt, Chlamydia trachomatis
ggaauagguugccuuuaucu

SEQ ID NO: 467742 - RNA, 16 nt, Chlamydia trachomatis
ggaauauuaagaucca

SEQ ID NO: 467743 - RNA, 22 nt, Chlamydia trachomatis
ggaauauuaagauccauuugau

SEQ ID NO: 467744 - RNA, 17 nt, Chlamydia trachomatis
ggaauaucaaaguagca

SEQ ID NO: 467745 - RNA, 16 nt, Chlamydia trachomatis
ggaaucauaaggaaga

SEQ ID NO: 467746 - RNA, 20 nt, Chlamydia trachomatis
ggaauguauaaacacugaga

SEQ ID NO: 467747 - RNA, 24 nt, Chlamydia trachomatis
ggaauguauaaacacugagacgaa

SEQ ID NO: 467748 - RNA, 17 nt, Chlamydia trachomatis
ggaauucgcuaaugauu

SEQ ID NO: 467749 - RNA, 22 nt, Chlamydia trachomatis
ggaauucgcuaaugauucuuga

SEQ ID NO: 467750 - RNA, 21 nt, Chlamydia trachomatis
ggaauugaucuuguguaguau

SEQ ID NO: 467751 - RNA, 19 nt, Chlamydia trachomatis
ggacaauuaucuccuaaga

SEQ ID NO: 467752 - RNA, 13 nt, Chlamydia trachomatis
ggacuaguccuga

SEQ ID NO: 467753 - RNA, 22 nt, Chlamydia trachomatis
ggacuaguccugaagcaaugcu

SEQ ID NO: 467754 - RNA, 18 nt, Chlamydia trachomatis
ggacaucccgaauggaug

SEQ ID NO: 467755 - RNA, 16 nt, Chlamydia trachomatis
ggacuauuuucaaaac

SEQ ID NO: 467756 - RNA, 22 nt, Chlamydia trachomatis
ggacuauuuucaaaaccuugau

SEQ ID NO: 467757 - RNA, 18 nt, Chlamydia trachomatis
ggagcaugguauucuaaa

SEQ ID NO: 467758 - RNA, 20 nt, Chlamydia trachomatis
ggagcauucaucuauuuuua

SEQ ID NO: 467759 - RNA, 17 nt, Chlamydia trachomatis
ggagcuccaggaaaagc

SEQ ID NO: 467760 - RNA, 17 nt, Chlamydia trachomatis
ggauaagaacuucuccu

SEQ ID NO: 467761 - RNA, 16 nt, Chlamydia trachomatis
ggauaaggaagaagau

SEQ ID NO: 467762 - RNA, 12 nt, Chlamydia trachomatis
ggauaaaucagu

SEQ ID NO: 467763 - RNA, 23 nt, Chlamydia trachomatis
ggaguugguuuguuaagaaggga

SEQ ID NO: 467764 - RNA, 16 nt, Chlamydia trachomatis
ggaguuguugcuagau

SEQ ID NO: 467765 - RNA, 14 nt, Chlamydia trachomatis
ggaguuuuucuccu

SEQ ID NO: 467766 - RNA, 12 nt, Chlamydia trachomatis
ggauaaagaaag

SEQ ID NO: 467767 - RNA, 22 nt, Chlamydia trachomatis
ggauaaagaaagccguucccaa

SEQ ID NO: 467768 - RNA, 17 nt, Chlamydia trachomatis
ggagcuugagagcauuc

SEQ ID NO: 467769 - RNA, 18 nt, Chlamydia trachomatis
ggagcuuuuugcaaugca

SEQ ID NO: 467770 - RNA, 20 nt, Chlamydia trachomatis
ggauaguaaaaacuauaagg

SEQ ID NO: 467771 - RNA, 17 nt, Chlamydia trachomatis
ggauaaucucugaaaga

SEQ ID NO: 467772 - RNA, 18 nt, Chlamydia trachomatis
ggauaaucucugaaagag

SEQ ID NO: 467773 - RNA, 14 nt, Chlamydia trachomatis
ggaucgagaagagc

SEQ ID NO: 467774 - RNA, 16 nt, Chlamydia trachomatis
ggaucgagucccuuca

SEQ ID NO: 467775 - RNA, 15 nt, Chlamydia trachomatis
ggauccaaaaaagaa

SEQ ID NO: 467776 - RNA, 15 nt, Chlamydia trachomatis
ggaugcgaaugaaga

SEQ ID NO: 467777 - RNA, 21 nt, Chlamydia trachomatis
ggaucuuccagccuacaaaua

SEQ ID NO: 467778 - RNA, 14 nt, Chlamydia trachomatis
ggauucucugcaca

SEQ ID NO: 467779 - RNA, 16 nt, Chlamydia trachomatis
ggauucgaaaagagcu

SEQ ID NO: 467780 - RNA, 21 nt, Chlamydia trachomatis
ggauuccauaaaggguguuuu

SEQ ID NO: 467781 - RNA, 13 nt, Chlamydia trachomatis
ggauugccaggcg

SEQ ID NO: 467782 - RNA, 13 nt, Chlamydia trachomatis
ggcacacuccauc

SEQ ID NO: 467783 - RNA, 13 nt, Chlamydia trachomatis
ggcagcugcuugg

SEQ ID NO: 467784 - RNA, 21 nt, Chlamydia trachomatis
ggcauaauaggauaggaaaug

SEQ ID NO: 467785 - RNA, 15 nt, Chlamydia trachomatis
ggcauggaucuccag

SEQ ID NO: 467786 - RNA, 15 nt, Chlamydia trachomatis
ggcccggaucugggc

SEQ ID NO: 467787 - RNA, 22 nt, Chlamydia trachomatis
ggcuucucgcgcuccagcucuu

SEQ ID NO: 467788 - RNA, 17 nt, Chlamydia trachomatis
ggcuuucaaaaagagcu

SEQ ID NO: 467789 - RNA, 12 nt, Chlamydia trachomatis
ggcuuuugcaaa

SEQ ID NO: 467790 - RNA, 13 nt, Chlamydia trachomatis
gggaagaaucaau

SEQ ID NO: 467791 - RNA, 20 nt, Chlamydia trachomatis
gggaaucuucuucggaaagc

SEQ ID NO: 467792 - RNA, 19 nt, Chlamydia trachomatis
gggacgcccuacaggaucc

SEQ ID NO: 467793 - RNA, 18 nt, Chlamydia trachomatis
gggacaucgaaaaucacu

SEQ ID NO: 467794 - RNA, 16 nt, Chlamydia trachomatis
gggacaaaaauacuuc

SEQ ID NO: 467795 - RNA, 20 nt, Chlamydia trachomatis
gggagauacagacaucuaaa

SEQ ID NO: 467796 - RNA, 15 nt, Chlamydia trachomatis
gggcagcaagagaga

SEQ ID NO: 467797 - RNA, 13 nt, Chlamydia trachomatis
gggcucguggagg

SEQ ID NO: 467798 - RNA, 16 nt, Chlamydia trachomatis
gggcucguggagggga

SEQ ID NO: 467799 - RNA, 19 nt, Chlamydia trachomatis
gggcuauauguaagaagcu

SEQ ID NO: 467800 - RNA, 21 nt, Chlamydia trachomatis
gggugcauacuucccacauac

SEQ ID NO: 467801 - RNA, 14 nt, Chlamydia trachomatis
gguauauucuucac

SEQ ID NO: 467802 - RNA, 13 nt, Chlamydia trachomatis
ggugaggaaggcu

SEQ ID NO: 467803 - RNA, 21 nt, Chlamydia trachomatis
ggugacagcuuucacagggac

SEQ ID NO: 467804 - RNA, 21 nt, Chlamydia trachomatis
gguggccauucuuacuaaagc

SEQ ID NO: 467805 - RNA, 14 nt, Chlamydia trachomatis
gguguaggaaaaua

SEQ ID NO: 467806 - RNA, 20 nt, Chlamydia trachomatis
gguucaaggaagucccuccu

SEQ ID NO: 467807 - RNA, 20 nt, Chlamydia trachomatis
gguuccauuuaagugaauuu

SEQ ID NO: 467808 - RNA, 20 nt, Chlamydia trachomatis
gguucaaacauagaaggaau

SEQ ID NO: 467809 - RNA, 17 nt, Chlamydia trachomatis
gguuaggaaagcacuuu

SEQ ID NO: 467810 - RNA, 18 nt, Chlamydia trachomatis
gguucuaaagaaaagcuu

SEQ ID NO: 467811 - RNA, 18 nt, Chlamydia trachomatis
gguucucuuuuuaaaagg

SEQ ID NO: 467812 - RNA, 18 nt, Chlamydia trachomatis
gguucugccaguuaauca

SEQ ID NO: 467813 - RNA, 20 nt, Chlamydia trachomatis
gguucuguguauuuauauag

SEQ ID NO: 467814 - RNA, 13 nt, Chlamydia trachomatis
gguucuucaacaa

SEQ ID NO: 467815 - RNA, 18 nt, Chlamydia trachomatis
gguucuucaacaacuuca

SEQ ID NO: 467816 - RNA, 23 nt, Chlamydia trachomatis
gguuuacaauagguuuaaauaag

SEQ ID NO: 467817 - RNA, 20 nt, Chlamydia trachomatis
gguugguuuucuuguucuuu

SEQ ID NO: 467818 - RNA, 19 nt, Chlamydia trachomatis
gguuuucuuguucuuuuag

SEQ ID NO: 467819 - RNA, 14 nt, Chlamydia trachomatis
guaaaaauucuaaa

SEQ ID NO: 467820 - RNA, 17 nt, Chlamydia trachomatis
guaaaacaaccauaaua

SEQ ID NO: 467821 - RNA, 13 nt, Chlamydia trachomatis
guaaaacauuucu

SEQ ID NO: 467822 - RNA, 13 nt, Chlamydia trachomatis
gguuucaagagca

SEQ ID NO: 467823 - RNA, 14 nt, Chlamydia trachomatis
gguuucaagagcau

SEQ ID NO: 467824 - RNA, 14 nt, Chlamydia trachomatis
gguuucuauacgca

SEQ ID NO: 467825 - RNA, 22 nt, Chlamydia trachomatis
guaaugaagguuucuaaaaaac

SEQ ID NO: 467826 - RNA, 21 nt, Chlamydia trachomatis
guaaugacacuggcaccuuuu

SEQ ID NO: 467827 - RNA, 22 nt, Chlamydia trachomatis
guaaugagaggugugaauagga

SEQ ID NO: 467828 - RNA, 23 nt, Chlamydia trachomatis
guaaugagaggugugaauaggaa

SEQ ID NO: 467829 - RNA, 21 nt, Chlamydia trachomatis
guaaugaucagcaaaaagagg

SEQ ID NO: 467830 - RNA, 21 nt, Chlamydia trachomatis
guacacgcugaguuuccuuua

SEQ ID NO: 467831 - RNA, 16 nt, Chlamydia trachomatis
guacagacugccuacc

SEQ ID NO: 467832 - RNA, 15 nt, Chlamydia trachomatis
guacagagaaaaaga

SEQ ID NO: 467833 - RNA, 18 nt, Chlamydia trachomatis
guaauuuucuagcuucuu

SEQ ID NO: 467834 - RNA, 15 nt, Chlamydia trachomatis
guaauuuugacagaa

SEQ ID NO: 467835 - RNA, 12 nt, Chlamydia trachomatis
guacaaaaauac

SEQ ID NO: 467836 - RNA, 15 nt, Chlamydia trachomatis
guacaaaaauacuug

SEQ ID NO: 467837 - RNA, 18 nt, Chlamydia trachomatis
guacaaaaauacuugauu

SEQ ID NO: 467838 - RNA, 13 nt, Chlamydia trachomatis
guacucgauggca

SEQ ID NO: 467839 - RNA, 17 nt, Chlamydia trachomatis
guacucgauggcaggga

SEQ ID NO: 467840 - RNA, 14 nt, Chlamydia trachomatis
guacucugauuaga

SEQ ID NO: 467841 - RNA, 23 nt, Chlamydia trachomatis
guacuuuaccuguaggaggacaa

SEQ ID NO: 467842 - RNA, 12 nt, Chlamydia trachomatis
guacuuucucuu

SEQ ID NO: 467843 - RNA, 17 nt, Chlamydia trachomatis
guacgauggaaauagga

SEQ ID NO: 467844 - RNA, 16 nt, Chlamydia trachomatis
guacgaauccucuaau

SEQ ID NO: 467845 - RNA, 23 nt, Chlamydia trachomatis
guaccugcuucuauagaaacacg

SEQ ID NO: 467846 - RNA, 19 nt, Chlamydia trachomatis
guagaaagcugggaaaucu

SEQ ID NO: 467847 - RNA, 13 nt, Chlamydia trachomatis
guagaaauuacag

SEQ ID NO: 467848 - RNA, 17 nt, Chlamydia trachomatis
guagacagcucuugcau

SEQ ID NO: 467849 - RNA, 22 nt, Chlamydia trachomatis
guagacagcucuugcauuuggg

SEQ ID NO: 467850 - RNA, 18 nt, Chlamydia trachomatis
guagcagaauaucuucug

SEQ ID NO: 467851 - RNA, 19 nt, Chlamydia trachomatis
guagcaaauuaacagauau

SEQ ID NO: 467852 - RNA, 14 nt, Chlamydia trachomatis
guagccauagcauc

SEQ ID NO: 467853 - RNA, 22 nt, Chlamydia trachomatis
guagccccuuuagaaauugucc

SEQ ID NO: 467854 - RNA, 20 nt, Chlamydia trachomatis
guauagcaaugcgaucagaa

SEQ ID NO: 467855 - RNA, 19 nt, Chlamydia trachomatis
guauagauacuaacaaaua

SEQ ID NO: 467856 - RNA, 17 nt, Chlamydia trachomatis
guauagcuucauacaca

SEQ ID NO: 467857 - RNA, 13 nt, Chlamydia trachomatis
guauagcuuuuaa

SEQ ID NO: 467858 - RNA, 21 nt, Chlamydia trachomatis
guaucaaauuuuucagaaaaa

SEQ ID NO: 467859 - RNA, 14 nt, Chlamydia trachomatis
guaucaacagauga

SEQ ID NO: 467860 - RNA, 11 nt, Chlamydia trachomatis
guaggaagggu

SEQ ID NO: 467861 - RNA, 12 nt, Chlamydia trachomatis
guaggaaugcug

SEQ ID NO: 467862 - RNA, 21 nt, Chlamydia trachomatis
guaucccuaguacaaaaauac

SEQ ID NO: 467863 - RNA, 22 nt, Chlamydia trachomatis
guauccauauccaugaagaccc

SEQ ID NO: 467864 - RNA, 15 nt, Chlamydia trachomatis
guauccgcuucuucu

SEQ ID NO: 467865 - RNA, 16 nt, Chlamydia trachomatis
guauccugcagcaaau

SEQ ID NO: 467866 - RNA, 20 nt, Chlamydia trachomatis
guaucuugguuauacagagc

SEQ ID NO: 467867 - RNA, 22 nt, Chlamydia trachomatis
guaucuguuaguagcuucucuu

SEQ ID NO: 467868 - RNA, 15 nt, Chlamydia trachomatis
guaucugggauggaa

SEQ ID NO: 467869 - RNA, 17 nt, Chlamydia trachomatis
guaugccaagaccucuu

SEQ ID NO: 467870 - RNA, 11 nt, Chlamydia trachomatis
guaugcaucug

SEQ ID NO: 467871 - RNA, 17 nt, Chlamydia trachomatis
guaugcaacaacauaau

SEQ ID NO: 467872 - RNA, 17 nt, Chlamydia trachomatis
guauguaagccuaaaac

SEQ ID NO: 467873 - RNA, 20 nt, Chlamydia trachomatis
guaugugcucauuuccuaua

SEQ ID NO: 467874 - RNA, 12 nt, Chlamydia trachomatis
guauggguuuuu

SEQ ID NO: 467875 - RNA, 16 nt, Chlamydia trachomatis
guauuuguguauggaa

SEQ ID NO: 467876 - RNA, 23 nt, Chlamydia trachomatis
guauuuaggaacucuaaauaccu

SEQ ID NO: 467877 - RNA, 12 nt, Chlamydia trachomatis
guauuuagguag

SEQ ID NO: 467878 - RNA, 16 nt, Chlamydia trachomatis
guauuccuguagaaag

SEQ ID NO: 467879 - RNA, 23 nt, Chlamydia trachomatis
guauucuaaagucuuaaaagggu

SEQ ID NO: 467880 - RNA, 20 nt, Chlamydia trachomatis
gucacgaaguuuuuuuaaaa

SEQ ID NO: 467881 - RNA, 22 nt, Chlamydia trachomatis
gucauauucggcuguagugauc

SEQ ID NO: 467882 - RNA, 21 nt, Chlamydia trachomatis
gucaucaggauacgaaggauc

SEQ ID NO: 467883 - RNA, 13 nt, Chlamydia trachomatis
guccacaugccau

SEQ ID NO: 467884 - RNA, 13 nt, Chlamydia trachomatis
guccaaagcucuu

SEQ ID NO: 467885 - RNA, 14 nt, Chlamydia trachomatis
guccagggaaaaga

SEQ ID NO: 467886 - RNA, 17 nt, Chlamydia trachomatis
guccauucuaaggagca

SEQ ID NO: 467887 - RNA, 16 nt, Chlamydia trachomatis
guccauugcaggagau

SEQ ID NO: 467888 - RNA, 20 nt, Chlamydia trachomatis
guccgacuaccgcuaucucc

SEQ ID NO: 467889 - RNA, 18 nt, Chlamydia trachomatis
gucggagguucgaauccu

SEQ ID NO: 467890 - RNA, 12 nt, Chlamydia trachomatis
gucgcgcagcuu

SEQ ID NO: 467891 - RNA, 21 nt, Chlamydia trachomatis
gucgggaaacauuccaaauau

SEQ ID NO: 467892 - RNA, 13 nt, Chlamydia trachomatis
gucguuaaagaau

SEQ ID NO: 467893 - RNA, 18 nt, Chlamydia trachomatis
gucuagcuagaagccaau

SEQ ID NO: 467894 - RNA, 15 nt, Chlamydia trachomatis
gucuagcuuuuuuca

SEQ ID NO: 467895 - RNA, 17 nt, Chlamydia trachomatis
gucuauaauaugaaagc

SEQ ID NO: 467896 - RNA, 23 nt, Chlamydia trachomatis
gucuacuccgaucaauucaucua

SEQ ID NO: 467897 - RNA, 23 nt, Chlamydia trachomatis
gucuacuuuuuguuuagacaauu

SEQ ID NO: 467898 - RNA, 20 nt, Chlamydia trachomatis
gucuaagauuuucaucuucc

SEQ ID NO: 467899 - RNA, 18 nt, Chlamydia trachomatis
gucguuuucggagaagaa

SEQ ID NO: 467900 - RNA, 17 nt, Chlamydia trachomatis
gucuaaaacaauugguu

SEQ ID NO: 467901 - RNA, 21 nt, Chlamydia trachomatis
gucuccaggagagucugcuac

SEQ ID NO: 467902 - RNA, 21 nt, Chlamydia trachomatis
gucuccaaaaguguuuagaag

SEQ ID NO: 467903 - RNA, 17 nt, Chlamydia trachomatis
gucuccacugguucucu

SEQ ID NO: 467904 - RNA, 17 nt, Chlamydia trachomatis
gucuaucuaccuuuuuc

SEQ ID NO: 467905 - RNA, 17 nt, Chlamydia trachomatis
gucucacuuccuuggua

SEQ ID NO: 467906 - RNA, 21 nt, Chlamydia trachomatis
gucuguauaacaauuuuaaaa

SEQ ID NO: 467907 - RNA, 20 nt, Chlamydia trachomatis
gucugggcgaucuccuuccu

SEQ ID NO: 467908 - RNA, 20 nt, Chlamydia trachomatis
gucuuagcaaagaaauagcu

SEQ ID NO: 467909 - RNA, 14 nt, Chlamydia trachomatis
gucuguugaaagcu

SEQ ID NO: 467910 - RNA, 15 nt, Chlamydia trachomatis
gucuuauuaaaagac

SEQ ID NO: 467911 - RNA, 14 nt, Chlamydia trachomatis
gucugcuacaaacu

SEQ ID NO: 467912 - RNA, 22 nt, Chlamydia trachomatis
gucugcgaaaaagaaauaaccu

SEQ ID NO: 467913 - RNA, 14 nt, Chlamydia trachomatis
gucugcaagaaaau

SEQ ID NO: 467914 - RNA, 22 nt, Chlamydia trachomatis
gucucucuuuaugaacaacaua

SEQ ID NO: 467915 - RNA, 21 nt, Chlamydia trachomatis
gucucuucuccuagagaaaca

SEQ ID NO: 467916 - RNA, 14 nt, Chlamydia trachomatis
gucucuugucagaa

SEQ ID NO: 467917 - RNA, 19 nt, Chlamydia trachomatis
gucucgacgcucauaacca

SEQ ID NO: 467918 - RNA, 23 nt, Chlamydia trachomatis
gucucgaauucuaucaacaucug

SEQ ID NO: 467919 - RNA, 21 nt, Chlamydia trachomatis
gucuucuaccgcgagcucguu

SEQ ID NO: 467920 - RNA, 15 nt, Chlamydia trachomatis
gucuucucgagaaga

SEQ ID NO: 467921 - RNA, 13 nt, Chlamydia trachomatis
gucuuccucugcu

SEQ ID NO: 467922 - RNA, 23 nt, Chlamydia trachomatis
gucuugcuaaacaagucucugau

SEQ ID NO: 467923 - RNA, 22 nt, Chlamydia trachomatis
gucuuguaacuaagcuucucaa

SEQ ID NO: 467924 - RNA, 18 nt, Chlamydia trachomatis
gucuucucugugcacaau

SEQ ID NO: 467925 - RNA, 13 nt, Chlamydia trachomatis
gucuucuuuucug

SEQ ID NO: 467926 - RNA, 14 nt, Chlamydia trachomatis
gucuucuuucucuu

SEQ ID NO: 467927 - RNA, 13 nt, Chlamydia trachomatis
gugaaagaaaaau

SEQ ID NO: 467928 - RNA, 15 nt, Chlamydia trachomatis
gucuuuaacaagaca

SEQ ID NO: 467929 - RNA, 19 nt, Chlamydia trachomatis
gucuuuaauaccuucuuac

SEQ ID NO: 467930 - RNA, 13 nt, Chlamydia trachomatis
gugaauaggaaga

SEQ ID NO: 467931 - RNA, 16 nt, Chlamydia trachomatis
gugaacggaggauagu

SEQ ID NO: 467932 - RNA, 19 nt, Chlamydia trachomatis
gugaagaaugaaacuuggu

SEQ ID NO: 467933 - RNA, 14 nt, Chlamydia trachomatis
gugacauuauuuuu

SEQ ID NO: 467934 - RNA, 16 nt, Chlamydia trachomatis
gugagaacgaagccca

SEQ ID NO: 467935 - RNA, 13 nt, Chlamydia trachomatis
gugagacagcacu

SEQ ID NO: 467936 - RNA, 14 nt, Chlamydia trachomatis
gugaggagcucucu

SEQ ID NO: 467937 - RNA, 15 nt, Chlamydia trachomatis
gugaguguuuguaua

SEQ ID NO: 467938 - RNA, 16 nt, Chlamydia trachomatis
gugcaaacaaaagaga

SEQ ID NO: 467939 - RNA, 18 nt, Chlamydia trachomatis
gugcaacacaacuucugc

SEQ ID NO: 467940 - RNA, 19 nt, Chlamydia trachomatis
gugcaacacaacuucugcu

SEQ ID NO: 467941 - RNA, 18 nt, Chlamydia trachomatis
gugcagcguucugagaug

SEQ ID NO: 467942 - RNA, 17 nt, Chlamydia trachomatis
gugcaucauuuuguaua

SEQ ID NO: 467943 - RNA, 15 nt, Chlamydia trachomatis
guggaacugcuuccc

SEQ ID NO: 467944 - RNA, 20 nt, Chlamydia trachomatis
guggaacagcucuaaagagc

SEQ ID NO: 467945 - RNA, 15 nt, Chlamydia trachomatis
guggacgaacaaaaa

SEQ ID NO: 467946 - RNA, 17 nt, Chlamydia trachomatis
guggaauuguauccagc

SEQ ID NO: 467947 - RNA, 14 nt, Chlamydia trachomatis
guggcacacuccau

SEQ ID NO: 467948 - RNA, 23 nt, Chlamydia trachomatis
guggauacgcugguauaccagga

SEQ ID NO: 467949 - RNA, 23 nt, Chlamydia trachomatis
guggcguuguuucuaauggauga

SEQ ID NO: 467950 - RNA, 24 nt, Chlamydia trachomatis
gugucauaagcucuaacucuucuu

SEQ ID NO: 467951 - RNA, 21 nt, Chlamydia trachomatis
gugucguaaacgauuaacucu

SEQ ID NO: 467952 - RNA, 21 nt, Chlamydia trachomatis
gugucucgguuuucuuuagcc

SEQ ID NO: 467953 - RNA, 18 nt, Chlamydia trachomatis
guuaagaauuaacccaaa

SEQ ID NO: 467954 - RNA, 17 nt, Chlamydia trachomatis
guuaacaucuucccaau

SEQ ID NO: 467955 - RNA, 19 nt, Chlamydia trachomatis
guuaaccuugggaaucuuc

SEQ ID NO: 467956 - RNA, 23 nt, Chlamydia trachomatis
guuaacggaguagagguuuccuu

SEQ ID NO: 467957 - RNA, 23 nt, Chlamydia trachomatis
guguucggaauaagcgaaaaaaa

SEQ ID NO: 467958 - RNA, 18 nt, Chlamydia trachomatis
guuaaaacuccagaaaau

SEQ ID NO: 467959 - RNA, 20 nt, Chlamydia trachomatis
guuauaacgauauccuucug

SEQ ID NO: 467960 - RNA, 22 nt, Chlamydia trachomatis
guuauagauaaguccaucuaaa

SEQ ID NO: 467961 - RNA, 16 nt, Chlamydia trachomatis
guuagccguaucuccg

SEQ ID NO: 467962 - RNA, 12 nt, Chlamydia trachomatis
guuagcuaucgc

SEQ ID NO: 467963 - RNA, 14 nt, Chlamydia trachomatis
guuagcugaaaugu

SEQ ID NO: 467964 - RNA, 15 nt, Chlamydia trachomatis
guuaggccauuucau

SEQ ID NO: 467965 - RNA, 22 nt, Chlamydia trachomatis
guuaguauaugcucuuuggugu

SEQ ID NO: 467966 - RNA, 16 nt, Chlamydia trachomatis
guuagugaagagcaga

SEQ ID NO: 467967 - RNA, 18 nt, Chlamydia trachomatis
guuagugaagagcagagg

SEQ ID NO: 467968 - RNA, 18 nt, Chlamydia trachomatis
guuaccaaaaaggaaauc

SEQ ID NO: 467969 - RNA, 19 nt, Chlamydia trachomatis
guuagcauguucagaaucu

SEQ ID NO: 467970 - RNA, 15 nt, Chlamydia trachomatis
guuaugaaccaggga

SEQ ID NO: 467971 - RNA, 20 nt, Chlamydia trachomatis
guuauucucaaguugagugc

SEQ ID NO: 467972 - RNA, 17 nt, Chlamydia trachomatis
guuauuuuuuaagaagu

SEQ ID NO: 467973 - RNA, 23 nt, Chlamydia trachomatis
guucaagagaggccuccauuucc

SEQ ID NO: 467974 - RNA, 13 nt, Chlamydia trachomatis
guuccagaaaaaa

SEQ ID NO: 467975 - RNA, 14 nt, Chlamydia trachomatis
guuccaucuuuucg

SEQ ID NO: 467976 - RNA, 20 nt, Chlamydia trachomatis
guucccugcaccucuuucag

SEQ ID NO: 467977 - RNA, 20 nt, Chlamydia trachomatis
guucgacaacgauauaaaga

SEQ ID NO: 467978 - RNA, 23 nt, Chlamydia trachomatis
guucgaauccuucucccgcuaau

SEQ ID NO: 467979 - RNA, 23 nt, Chlamydia trachomatis
guucucucucagcagcuuccuga

SEQ ID NO: 467980 - RNA, 18 nt, Chlamydia trachomatis
guucucuuagaagcucuc

SEQ ID NO: 467981 - RNA, 17 nt, Chlamydia trachomatis
guucucucccuuccuga

SEQ ID NO: 467982 - RNA, 19 nt, Chlamydia trachomatis
guucugagaugaaaauaug

SEQ ID NO: 467983 - RNA, 23 nt, Chlamydia trachomatis
guucuccuuugcuuuuuauccua

SEQ ID NO: 467984 - RNA, 21 nt, Chlamydia trachomatis
guucucgcaaguucuccuucu

SEQ ID NO: 467985 - RNA, 14 nt, Chlamydia trachomatis
guuuauuccaaccu

SEQ ID NO: 467986 - RNA, 13 nt, Chlamydia trachomatis
guuuagaggagaa

SEQ ID NO: 467987 - RNA, 18 nt, Chlamydia trachomatis
guuucagagaggcuguaa

SEQ ID NO: 467988 - RNA, 22 nt, Chlamydia trachomatis
guuucagagaggcuguaacuaa

SEQ ID NO: 467989 - RNA, 16 nt, Chlamydia trachomatis
guuucuaaaaaacuuu

SEQ ID NO: 467990 - RNA, 14 nt, Chlamydia trachomatis
guuucuaaaauuuu

SEQ ID NO: 467991 - RNA, 21 nt, Chlamydia trachomatis
guugugcucgaaaguugcucc

SEQ ID NO: 467992 - RNA, 19 nt, Chlamydia trachomatis
guugugggagauuccacaa

SEQ ID NO: 467993 - RNA, 13 nt, Chlamydia trachomatis
guuuaauuccuug

SEQ ID NO: 467994 - RNA, 15 nt, Chlamydia trachomatis
guuuacugcaauaag

SEQ ID NO: 467995 - RNA, 16 nt, Chlamydia trachomatis
guucuucauagcuucu

SEQ ID NO: 467996 - RNA, 12 nt, Chlamydia trachomatis
guucuucaaagc

SEQ ID NO: 467997 - RNA, 15 nt, Chlamydia trachomatis
guuuggagaauugga

SEQ ID NO: 467998 - RNA, 21 nt, Chlamydia trachomatis
guuugguuuuuuuuguuaucc

SEQ ID NO: 467999 - RNA, 20 nt, Chlamydia trachomatis
guuugcacaagauacaaggc

SEQ ID NO: 468000 - RNA, 17 nt, Chlamydia trachomatis
guuugccaguaaucaaa

SEQ ID NO: 468001 - RNA, 13 nt, Chlamydia trachomatis
guuucuaauaaua

SEQ ID NO: 468002 - RNA, 17 nt, Chlamydia trachomatis
guuucuggaaaaucuuu

SEQ ID NO: 468003 - RNA, 16 nt, Chlamydia trachomatis
guuucuggaaagagag

SEQ ID NO: 468004 - RNA, 20 nt, Chlamydia trachomatis
guuucuguaggagagaaucu

SEQ ID NO: 468005 - RNA, 19 nt, Chlamydia trachomatis
guuucuuaaacaaaaauaa

SEQ ID NO: 468006 - RNA, 16 nt, Chlamydia trachomatis
guuucuucccuuuuuu

SEQ ID NO: 468007 - RNA, 19 nt, Chlamydia trachomatis
guuucuucccuuuuuucug

SEQ ID NO: 468008 - RNA, 21 nt, Chlamydia trachomatis
guuucuucucauaaggaguuu

SEQ ID NO: 468009 - RNA, 18 nt, Chlamydia trachomatis
guuuuaaaugcuucuuaa

SEQ ID NO: 468010 - RNA, 15 nt, Chlamydia trachomatis
guuuuaacaugaguu

SEQ ID NO: 468011 - RNA, 16 nt, Chlamydia trachomatis
guuuuaauuccaucuu

SEQ ID NO: 468012 - RNA, 14 nt, Chlamydia trachomatis
guuuucacuagggu

SEQ ID NO: 468013 - RNA, 23 nt, Chlamydia trachomatis
guuuuccugaaacgaucagcucc

SEQ ID NO: 468014 - RNA, 20 nt, Chlamydia trachomatis
guuuuccgcacccaaucuuc

SEQ ID NO: 468015 - RNA, 18 nt, Chlamydia trachomatis
guuuucggagaagaagag

SEQ ID NO: 468016 - RNA, 19 nt, Chlamydia trachomatis
guuuugaggaagaaauguu

SEQ ID NO: 468017 - RNA, 21 nt, Chlamydia trachomatis
guuuucuguugcacuuuccgu

SEQ ID NO: 468018 - RNA, 15 nt, Chlamydia trachomatis
guuuucuugguuucu

SEQ ID NO: 468019 - RNA, 19 nt, Chlamydia trachomatis
guuuucuugugauaucucc

SEQ ID NO: 468020 - RNA, 17 nt, Chlamydia trachomatis
guuuucuuguucuuuua

SEQ ID NO: 468021 - RNA, 18 nt, Chlamydia trachomatis
guuuuguaaaguaacuac

SEQ ID NO: 468022 - RNA, 21 nt, Chlamydia trachomatis
guuuuucagauaucugcccgc

SEQ ID NO: 468023 - RNA, 19 nt, Chlamydia trachomatis
guuuuguguuuccaaagcu

SEQ ID NO: 468024 - RNA, 10 nt, Chlamydia trachomatis
guuuuuguuu

SEQ ID NO: 468025 - RNA, 16 nt, Chlamydia trachomatis
guuuuuuucaaguguu

SEQ ID NO: 468026 - RNA, 11 nt, Chlamydia trachomatis
guuuuuuucag

SEQ ID NO: 468027 - RNA, 20 nt, Chlamydia trachomatis
uaaaaaaauucuugccaccg

SEQ ID NO: 468028 - RNA, 15 nt, Chlamydia trachomatis
uaaaaaacaaaacua

SEQ ID NO: 468029 - RNA, 20 nt, Chlamydia trachomatis
uaaaaaagagguauuuagga

SEQ ID NO: 468030 - RNA, 23 nt, Chlamydia trachomatis
uaaaaaagagguauuuaggaacu

SEQ ID NO: 468031 - RNA, 19 nt, Chlamydia trachomatis
uaaaaaagugagcccugcu

SEQ ID NO: 468032 - RNA, 14 nt, Chlamydia trachomatis
uaaaaaauuuugag

SEQ ID NO: 468033 - RNA, 13 nt, Chlamydia trachomatis
uaaaacaauuucc

SEQ ID NO: 468034 - RNA, 16 nt, Chlamydia trachomatis
uaaaacaauuuccuua

SEQ ID NO: 468035 - RNA, 15 nt, Chlamydia trachomatis
uaaaacgaaaaacag

SEQ ID NO: 468036 - RNA, 20 nt, Chlamydia trachomatis
uaaaagcacaauaacagcac

SEQ ID NO: 468037 - RNA, 23 nt, Chlamydia trachomatis
uaaaagccauagccaucaguccu

SEQ ID NO: 468038 - RNA, 17 nt, Chlamydia trachomatis
uaaaagggcucucuccu

SEQ ID NO: 468039 - RNA, 16 nt, Chlamydia trachomatis
uaaaaggguagaaaaa

SEQ ID NO: 468040 - RNA, 18 nt, Chlamydia trachomatis
uaaaagucucuaaagcuu

SEQ ID NO: 468041 - RNA, 18 nt, Chlamydia trachomatis
uaaaaguaguccuaucac

SEQ ID NO: 468042 - RNA, 13 nt, Chlamydia trachomatis
uaaaauaccuaaa

SEQ ID NO: 468043 - RNA, 21 nt, Chlamydia trachomatis
uaaaauagcacgcaaaacauc

SEQ ID NO: 468044 - RNA, 19 nt, Chlamydia trachomatis
uaaaaucagcgaguagagc

SEQ ID NO: 468045 - RNA, 15 nt, Chlamydia trachomatis
uaaaaucacuuucug

SEQ ID NO: 468046 - RNA, 14 nt, Chlamydia trachomatis
uaaaaucuccucga

SEQ ID NO: 468047 - RNA, 17 nt, Chlamydia trachomatis
uaaaaucuccucgagau

SEQ ID NO: 468048 - RNA, 20 nt, Chlamydia trachomatis
uaaccgccauuuaugaagcc

SEQ ID NO: 468049 - RNA, 22 nt, Chlamydia trachomatis
uaaccuuugcauuuaaaugaau

SEQ ID NO: 468050 - RNA, 22 nt, Chlamydia trachomatis
uaacgaacgggaaaugcuggau

SEQ ID NO: 468051 - RNA, 14 nt, Chlamydia trachomatis
uaacgauucuugau

SEQ ID NO: 468052 - RNA, 15 nt, Chlamydia trachomatis
uaacgauuguuucug

SEQ ID NO: 468053 - RNA, 15 nt, Chlamydia trachomatis
uaacagcaagacaac

SEQ ID NO: 468054 - RNA, 16 nt, Chlamydia trachomatis
uaacagcacaaacaaa

SEQ ID NO: 468055 - RNA, 20 nt, Chlamydia trachomatis
uaacagcacaaacaaauccu

SEQ ID NO: 468056 - RNA, 20 nt, Chlamydia trachomatis
uaacauuauuccgcuucuau

SEQ ID NO: 468057 - RNA, 19 nt, Chlamydia trachomatis
uaaauugaaauucagcuaa

SEQ ID NO: 468058 - RNA, 21 nt, Chlamydia trachomatis
uaaauuucaucccacaugcua

SEQ ID NO: 468059 - RNA, 17 nt, Chlamydia trachomatis
uaacaaugacucaaaaa

SEQ ID NO: 468060 - RNA, 18 nt, Chlamydia trachomatis
uaacaaugacucaaaaag

SEQ ID NO: 468061 - RNA, 20 nt, Chlamydia trachomatis
uaacaaugcugauaaaaaua

SEQ ID NO: 468062 - RNA, 22 nt, Chlamydia trachomatis
uaacaaugcugauaaaaauaau

SEQ ID NO: 468063 - RNA, 15 nt, Chlamydia trachomatis
uaacaauuuuaaaau

SEQ ID NO: 468064 - RNA, 17 nt, Chlamydia trachomatis
uaacaauuuuaaaaucu

SEQ ID NO: 468065 - RNA, 14 nt, Chlamydia trachomatis
uaacacaagcagac

SEQ ID NO: 468066 - RNA, 17 nt, Chlamydia trachomatis
uaacacaagcagacaag

SEQ ID NO: 468067 - RNA, 22 nt, Chlamydia trachomatis
uaacacaagcagacaagcaaua

SEQ ID NO: 468068 - RNA, 21 nt, Chlamydia trachomatis
uaacacaauuuuuguuccuuu

SEQ ID NO: 468069 - RNA, 21 nt, Chlamydia trachomatis
uaacacauaucuccaaaaaua

SEQ ID NO: 468070 - RNA, 17 nt, Chlamydia trachomatis
uaacaccaaaaaaucca

SEQ ID NO: 468071 - RNA, 13 nt, Chlamydia trachomatis
uaaagguuuccca

SEQ ID NO: 468072 - RNA, 15 nt, Chlamydia trachomatis
uaaaguaaguaaaag

SEQ ID NO: 468073 - RNA, 23 nt, Chlamydia trachomatis
uaaaguugguagaggagaacaag

SEQ ID NO: 468074 - RNA, 22 nt, Chlamydia trachomatis
uaaauaaucucguugauuaaag

SEQ ID NO: 468075 - RNA, 14 nt, Chlamydia trachomatis
uaaauacaaaucuu

SEQ ID NO: 468076 - RNA, 17 nt, Chlamydia trachomatis
uaaauagcucaguuggu

SEQ ID NO: 468077 - RNA, 13 nt, Chlamydia trachomatis
uaaaucacaaugc

SEQ ID NO: 468078 - RNA, 22 nt, Chlamydia trachomatis
uaaaucuauccauaauuuucuu

SEQ ID NO: 468079 - RNA, 14 nt, Chlamydia trachomatis
uaaaucuccuccua

SEQ ID NO: 468080 - RNA, 17 nt, Chlamydia trachomatis
uaaaucuccuccuauua

SEQ ID NO: 468081 - RNA, 18 nt, Chlamydia trachomatis
uaaaucucuuggagagaa

SEQ ID NO: 468082 - RNA, 16 nt, Chlamydia trachomatis
uaaaucugcuaaggcc

SEQ ID NO: 468083 - RNA, 20 nt, Chlamydia trachomatis
uaaaugaaaccccucuuucu

SEQ ID NO: 468084 - RNA, 23 nt, Chlamydia trachomatis
uaaaugaaaccccucuuucucuc

SEQ ID NO: 468085 - RNA, 14 nt, Chlamydia trachomatis
uaaaugaauguggu

SEQ ID NO: 468086 - RNA, 15 nt, Chlamydia trachomatis
uaaaugaauguggug

SEQ ID NO: 468087 - RNA, 14 nt, Chlamydia trachomatis
uaaaugcuguaaaa

SEQ ID NO: 468088 - RNA, 20 nt, Chlamydia trachomatis
uaaaugcuucuuaacugcag

SEQ ID NO: 468089 - RNA, 22 nt, Chlamydia trachomatis
uaaacgaggaauauaucggaaa

SEQ ID NO: 468090 - RNA, 18 nt, Chlamydia trachomatis
uaaacgguggaacagcuc

SEQ ID NO: 468091 - RNA, 15 nt, Chlamydia trachomatis
uaaacgguugauaaa

SEQ ID NO: 468092 - RNA, 18 nt, Chlamydia trachomatis
uaaacguuuggaaauccu

SEQ ID NO: 468093 - RNA, 23 nt, Chlamydia trachomatis
uaaaaugagaaauaaaaaccuug

SEQ ID NO: 468094 - RNA, 20 nt, Chlamydia trachomatis
uaaaccaaaggcaacaaagg

SEQ ID NO: 468095 - RNA, 23 nt, Chlamydia trachomatis
uaaagccuuucucuaaaagaaga

SEQ ID NO: 468096 - RNA, 17 nt, Chlamydia trachomatis
uaaagccuuuuuacgca

SEQ ID NO: 468097 - RNA, 23 nt, Chlamydia trachomatis
uaaagccuuuuuacgcauuugcu

SEQ ID NO: 468098 - RNA, 11 nt, Chlamydia trachomatis
uaaagguaauc

SEQ ID NO: 468099 - RNA, 15 nt, Chlamydia trachomatis
uaaagagaucucucc

SEQ ID NO: 468100 - RNA, 17 nt, Chlamydia trachomatis
uaaagagaucucuccag

SEQ ID NO: 468101 - RNA, 19 nt, Chlamydia trachomatis
uaaagagaucucuccagag

SEQ ID NO: 468102 - RNA, 20 nt, Chlamydia trachomatis
uaaagagccguucucucuaa

SEQ ID NO: 468103 - RNA, 19 nt, Chlamydia trachomatis
uaaagcagaaacaauuuca

SEQ ID NO: 468104 - RNA, 15 nt, Chlamydia trachomatis
uaaagcagcuaacca

SEQ ID NO: 468105 - RNA, 19 nt, Chlamydia trachomatis
uaaagaagccuucuuccuu

SEQ ID NO: 468106 - RNA, 14 nt, Chlamydia trachomatis
uaaagaaggaaaau

SEQ ID NO: 468107 - RNA, 17 nt, Chlamydia trachomatis
uaaagaaggaaaaucca

SEQ ID NO: 468108 - RNA, 20 nt, Chlamydia trachomatis
uaaagaauccucuagagccu

SEQ ID NO: 468109 - RNA, 18 nt, Chlamydia trachomatis
uaaagacccucuaaauuc

SEQ ID NO: 468110 - RNA, 15 nt, Chlamydia trachomatis
uaaagacuacaaaac

SEQ ID NO: 468111 - RNA, 19 nt, Chlamydia trachomatis
uaaagagagaggagaaaaa

SEQ ID NO: 468112 - RNA, 17 nt, Chlamydia trachomatis
uaacgcuucuucugcag

SEQ ID NO: 468113 - RNA, 22 nt, Chlamydia trachomatis
uaauauaaguucagccccuaaa

SEQ ID NO: 468114 - RNA, 13 nt, Chlamydia trachomatis
uaauaucagcaga

SEQ ID NO: 468115 - RNA, 18 nt, Chlamydia trachomatis
uaauauccuccaaagaug

SEQ ID NO: 468116 - RNA, 22 nt, Chlamydia trachomatis
uaauaucucaggauaaaacccu

SEQ ID NO: 468117 - RNA, 13 nt, Chlamydia trachomatis
uaauaucugcucu

SEQ ID NO: 468118 - RNA, 23 nt, Chlamydia trachomatis
uaauaugaagaacuuuagaagac

SEQ ID NO: 468119 - RNA, 15 nt, Chlamydia trachomatis
uaaucauuuucugua

SEQ ID NO: 468120 - RNA, 22 nt, Chlamydia trachomatis
uaauccguaguuggccagcuca

SEQ ID NO: 468121 - RNA, 21 nt, Chlamydia trachomatis
uaauccuaauguagaaauuuu

SEQ ID NO: 468122 - RNA, 22 nt, Chlamydia trachomatis
uaauccuaugacaggcagcaga

SEQ ID NO: 468123 - RNA, 23 nt, Chlamydia trachomatis
uaauccuaugacaggcagcagag

SEQ ID NO: 468124 - RNA, 23 nt, Chlamydia trachomatis
uaauccuucgauaaguucuuuag

SEQ ID NO: 468125 - RNA, 19 nt, Chlamydia trachomatis
uaaugccuuuugcacaaag

SEQ ID NO: 468126 - RNA, 15 nt, Chlamydia trachomatis
uaaugaugagaauaa

SEQ ID NO: 468127 - RNA, 20 nt, Chlamydia trachomatis
uaaugauucaacgccaugua

SEQ ID NO: 468128 - RNA, 20 nt, Chlamydia trachomatis
uaaugaaacucuuuuuaaau

SEQ ID NO: 468129 - RNA, 14 nt, Chlamydia trachomatis
uaaugaaggaaauc

SEQ ID NO: 468130 - RNA, 15 nt, Chlamydia trachomatis
uaaugaauacgggga

SEQ ID NO: 468131 - RNA, 17 nt, Chlamydia trachomatis
uaaugacaaacuuucuc

SEQ ID NO: 468132 - RNA, 19 nt, Chlamydia trachomatis
uaaugaucagcaaaaagag

SEQ ID NO: 468133 - RNA, 21 nt, Chlamydia trachomatis
uaaugggccguuuuucuccau

SEQ ID NO: 468134 - RNA, 13 nt, Chlamydia trachomatis
uacaggaggucuc

SEQ ID NO: 468135 - RNA, 14 nt, Chlamydia trachomatis
uacagcuagaauag

SEQ ID NO: 468136 - RNA, 17 nt, Chlamydia trachomatis
uacagcuguauuuacag

SEQ ID NO: 468137 - RNA, 15 nt, Chlamydia trachomatis
uacaguaaggcucuc

SEQ ID NO: 468138 - RNA, 23 nt, Chlamydia trachomatis
uacagucuucucgagaagaaaaa

SEQ ID NO: 468139 - RNA, 13 nt, Chlamydia trachomatis
uacaguuagagau

SEQ ID NO: 468140 - RNA, 20 nt, Chlamydia trachomatis
uacacgauguuccccauuca

SEQ ID NO: 468141 - RNA, 19 nt, Chlamydia trachomatis
uacacgcugaguuuccuuu

SEQ ID NO: 468142 - RNA, 18 nt, Chlamydia trachomatis
uacagcaugccuucuucc

SEQ ID NO: 468143 - RNA, 23 nt, Chlamydia trachomatis
uacagcaugccuucuuccuucau

SEQ ID NO: 468144 - RNA, 18 nt, Chlamydia trachomatis
uacaaaccgaagagggaa

SEQ ID NO: 468145 - RNA, 14 nt, Chlamydia trachomatis
uacaaacugcucaa

SEQ ID NO: 468146 - RNA, 16 nt, Chlamydia trachomatis
uacaaagauaaucaaa

SEQ ID NO: 468147 - RNA, 21 nt, Chlamydia trachomatis
uacaaagauaaucaaaccuaa

SEQ ID NO: 468148 - RNA, 15 nt, Chlamydia trachomatis
uacaaagcagccacu

SEQ ID NO: 468149 - RNA, 12 nt, Chlamydia trachomatis
uacaaagcacga

SEQ ID NO: 468150 - RNA, 23 nt, Chlamydia trachomatis
uacaacucugaacaacugcugau

SEQ ID NO: 468151 - RNA, 22 nt, Chlamydia trachomatis
uacaacuucagcgcgaauaaau

SEQ ID NO: 468152 - RNA, 19 nt, Chlamydia trachomatis
uacaaggcucuugaaaagg

SEQ ID NO: 468153 - RNA, 18 nt, Chlamydia trachomatis
uacaagugacauuuccaa

SEQ ID NO: 468154 - RNA, 15 nt, Chlamydia trachomatis
uacaauuccugcuca

SEQ ID NO: 468155 - RNA, 22 nt, Chlamydia trachomatis
uacacaggggggaagucaagau

SEQ ID NO: 468156 - RNA, 13 nt, Chlamydia trachomatis
uacacaucaaaau

SEQ ID NO: 468157 - RNA, 12 nt, Chlamydia trachomatis
uacacaucugua

SEQ ID NO: 468158 - RNA, 21 nt, Chlamydia trachomatis
uacacaucuguauccuaacua

SEQ ID NO: 468159 - RNA, 20 nt, Chlamydia trachomatis
uacaccaccgcaugaaagua

SEQ ID NO: 468160 - RNA, 19 nt, Chlamydia trachomatis
uacaccgcaucagccccaa

SEQ ID NO: 468161 - RNA, 22 nt, Chlamydia trachomatis
uacaccugcaagagaucguaca

SEQ ID NO: 468162 - RNA, 15 nt, Chlamydia trachomatis
uacaccucuugugau

SEQ ID NO: 468163 - RNA, 14 nt, Chlamydia trachomatis
uaauucuaggaagc

SEQ ID NO: 468164 - RNA, 22 nt, Chlamydia trachomatis
uaauucucgcaaagaaucaaaa

SEQ ID NO: 468165 - RNA, 17 nt, Chlamydia trachomatis
uaauuuaauuaaagaga

SEQ ID NO: 468166 - RNA, 16 nt, Chlamydia trachomatis
uaauuuaucuagaaaa

SEQ ID NO: 468167 - RNA, 16 nt, Chlamydia trachomatis
uaauuugaauaggggg

SEQ ID NO: 468168 - RNA, 13 nt, Chlamydia trachomatis
uaauuuuccacaa

SEQ ID NO: 468169 - RNA, 17 nt, Chlamydia trachomatis
uaauuuucuagcuucuu

SEQ ID NO: 468170 - RNA, 14 nt, Chlamydia trachomatis
uaauuuucugacuc

SEQ ID NO: 468171 - RNA, 13 nt, Chlamydia trachomatis
uaauuuuucucua

SEQ ID NO: 468172 - RNA, 16 nt, Chlamydia trachomatis
uaauuuuuuagauugu

SEQ ID NO: 468173 - RNA, 21 nt, Chlamydia trachomatis
uacaaaagauuucuucuguag

SEQ ID NO: 468174 - RNA, 16 nt, Chlamydia trachomatis
uacccccuucuccuuu

SEQ ID NO: 468175 - RNA, 16 nt, Chlamydia trachomatis
uacccgacuaaaaaau

SEQ ID NO: 468176 - RNA, 23 nt, Chlamydia trachomatis
uacccucuuuagccaauuuccau

SEQ ID NO: 468177 - RNA, 20 nt, Chlamydia trachomatis
uacccuuauaagccgcucug

SEQ ID NO: 468178 - RNA, 14 nt, Chlamydia trachomatis
uacccaaacaucua

SEQ ID NO: 468179 - RNA, 17 nt, Chlamydia trachomatis
uaccagaggagggagau

SEQ ID NO: 468180 - RNA, 14 nt, Chlamydia trachomatis
uaccagcagaccca

SEQ ID NO: 468181 - RNA, 18 nt, Chlamydia trachomatis
uaccagcagacccaaaug

SEQ ID NO: 468182 - RNA, 13 nt, Chlamydia trachomatis
uaccagccccaca

SEQ ID NO: 468183 - RNA, 17 nt, Chlamydia trachomatis
uaccacggauaaagaaa

SEQ ID NO: 468184 - RNA, 19 nt, Chlamydia trachomatis
uaccacgagcauaagaaua

SEQ ID NO: 468185 - RNA, 16 nt, Chlamydia trachomatis
uaccacgccaagaauu

SEQ ID NO: 468186 - RNA, 19 nt, Chlamydia trachomatis
uacauaagauccaucucuc

SEQ ID NO: 468187 - RNA, 13 nt, Chlamydia trachomatis
uacgauggaaaua

SEQ ID NO: 468188 - RNA, 20 nt, Chlamydia trachomatis
uacgcacaaagauuucuucu

SEQ ID NO: 468189 - RNA, 15 nt, Chlamydia trachomatis
uacgcauuugcucuu

SEQ ID NO: 468190 - RNA, 19 nt, Chlamydia trachomatis
uacgcuaaaaacucuuuca

SEQ ID NO: 468191 - RNA, 15 nt, Chlamydia trachomatis
uacggaaaaagaaga

SEQ ID NO: 468192 - RNA, 14 nt, Chlamydia trachomatis
uacguacauaggca

SEQ ID NO: 468193 - RNA, 17 nt, Chlamydia trachomatis
uacggaguaucuaucaa

SEQ ID NO: 468194 - RNA, 20 nt, Chlamydia trachomatis
uacgauauccaucauaaaaa

SEQ ID NO: 468195 - RNA, 16 nt, Chlamydia trachomatis
uaccguauuaucugca

SEQ ID NO: 468196 - RNA, 15 nt, Chlamydia trachomatis
uaccuagugauuuua

SEQ ID NO: 468197 - RNA, 16 nt, Chlamydia trachomatis
uaccuagugauuuuaa

SEQ ID NO: 468198 - RNA, 22 nt, Chlamydia trachomatis
uaccuagugauuuuaaaccaau

SEQ ID NO: 468199 - RNA, 18 nt, Chlamydia trachomatis
uaccuagcaauucaucag

SEQ ID NO: 468200 - RNA, 20 nt, Chlamydia trachomatis
uaccuauuccaaauccuccu

SEQ ID NO: 468201 - RNA, 21 nt, Chlamydia trachomatis
uacuccaauggaaauaagaga

SEQ ID NO: 468202 - RNA, 18 nt, Chlamydia trachomatis
uacucauccuaacuguac

SEQ ID NO: 468203 - RNA, 22 nt, Chlamydia trachomatis
uacucaucgaauuaauaauucc

SEQ ID NO: 468204 - RNA, 16 nt, Chlamydia trachomatis
uacucaucuuuuuuaa

SEQ ID NO: 468205 - RNA, 18 nt, Chlamydia trachomatis
uacucaucuuuuuuaaaa

SEQ ID NO: 468206 - RNA, 20 nt, Chlamydia trachomatis
uacucaucuuuuuuaaaaag

SEQ ID NO: 468207 - RNA, 16 nt, Chlamydia trachomatis
uacucgauggcaggga

SEQ ID NO: 468208 - RNA, 14 nt, Chlamydia trachomatis
uacucgucuuuuac

SEQ ID NO: 468209 - RNA, 20 nt, Chlamydia trachomatis
uacucccaaaucaaaccaaa

SEQ ID NO: 468210 - RNA, 18 nt, Chlamydia trachomatis
uacguuuaccgcucuucc

SEQ ID NO: 468211 - RNA, 15 nt, Chlamydia trachomatis
uacuaaaaugacuag

SEQ ID NO: 468212 - RNA, 14 nt, Chlamydia trachomatis
uacuauucgagaau

SEQ ID NO: 468213 - RNA, 16 nt, Chlamydia trachomatis
uacuauucgagaauga

SEQ ID NO: 468214 - RNA, 21 nt, Chlamydia trachomatis
uacucaacuccagagcaaaua

SEQ ID NO: 468215 - RNA, 23 nt, Chlamydia trachomatis
uacucuaaaaagcguucuccgag

SEQ ID NO: 468216 - RNA, 24 nt, Chlamydia trachomatis
uacucugauuagaagguccgccaa

SEQ ID NO: 468217 - RNA, 13 nt, Chlamydia trachomatis
uacucuuccuuga

SEQ ID NO: 468218 - RNA, 15 nt, Chlamydia trachomatis
uacugacaaggcugc

SEQ ID NO: 468219 - RNA, 17 nt, Chlamydia trachomatis
uacugacaaggcugcua

SEQ ID NO: 468220 - RNA, 17 nt, Chlamydia trachomatis
uacuuuaccgcaaauau

SEQ ID NO: 468221 - RNA, 16 nt, Chlamydia trachomatis
uacuuuaccuguagga

SEQ ID NO: 468222 - RNA, 16 nt, Chlamydia trachomatis
uacuuuaggagaaaga

SEQ ID NO: 468223 - RNA, 15 nt, Chlamydia trachomatis
uacuucuagauagaa

SEQ ID NO: 468224 - RNA, 20 nt, Chlamydia trachomatis
uacuucuaguuauauugcuu

SEQ ID NO: 468225 - RNA, 22 nt, Chlamydia trachomatis
uacuucuaguuauauugcuuca

SEQ ID NO: 468226 - RNA, 23 nt, Chlamydia trachomatis
uacuucuauguaaaaauucuaaa

SEQ ID NO: 468227 - RNA, 20 nt, Chlamydia trachomatis
uacuucuuacuuaaaaaaca

SEQ ID NO: 468228 - RNA, 10 nt, Chlamydia trachomatis
uacuucuuuu

SEQ ID NO: 468229 - RNA, 13 nt, Chlamydia trachomatis
uacuuucucuuca

SEQ ID NO: 468230 - RNA, 18 nt, Chlamydia trachomatis
uacuuuuccgaauucuuu

SEQ ID NO: 468231 - RNA, 16 nt, Chlamydia trachomatis
uagaaaaaaacagcuc

SEQ ID NO: 468232 - RNA, 12 nt, Chlamydia trachomatis
uagaaaaacuau

SEQ ID NO: 468233 - RNA, 12 nt, Chlamydia trachomatis
uagaaaaagaga

SEQ ID NO: 468234 - RNA, 13 nt, Chlamydia trachomatis
uagaaaaagagaa

SEQ ID NO: 468235 - RNA, 15 nt, Chlamydia trachomatis
uagaaaaagagaaau

SEQ ID NO: 468236 - RNA, 13 nt, Chlamydia trachomatis
uacuucgccuuua

SEQ ID NO: 468237 - RNA, 17 nt, Chlamydia trachomatis
uacuucaaguucuucuu

SEQ ID NO: 468238 - RNA, 18 nt, Chlamydia trachomatis
uacuuacgagaucgccuu

SEQ ID NO: 468239 - RNA, 16 nt, Chlamydia trachomatis
uacuggagaacagucu

SEQ ID NO: 468240 - RNA, 21 nt, Chlamydia trachomatis
uacugucagaccuacaaagau

SEQ ID NO: 468241 - RNA, 22 nt, Chlamydia trachomatis
uacugucagaccuacaaagaua

SEQ ID NO: 468242 - RNA, 20 nt, Chlamydia trachomatis
uacugucgaacgcuucuucc

SEQ ID NO: 468243 - RNA, 18 nt, Chlamydia trachomatis
uagauuagaagauaacaa

SEQ ID NO: 468244 - RNA, 15 nt, Chlamydia trachomatis
uagauucagaacaag

SEQ ID NO: 468245 - RNA, 19 nt, Chlamydia trachomatis
uagauucagaacaagugca

SEQ ID NO: 468246 - RNA, 22 nt, Chlamydia trachomatis
uagauucuggaggaggaccucu

SEQ ID NO: 468247 - RNA, 18 nt, Chlamydia trachomatis
uagauuuguuuaaaagaa

SEQ ID NO: 468248 - RNA, 12 nt, Chlamydia trachomatis
uagauuuucaug

SEQ ID NO: 468249 - RNA, 23 nt, Chlamydia trachomatis
uagcagauaauucucgcaaagaa

SEQ ID NO: 468250 - RNA, 23 nt, Chlamydia trachomatis
uagcagcaguuuuuauggaugau

SEQ ID NO: 468251 - RNA, 18 nt, Chlamydia trachomatis
uagcagccaauuucucua

SEQ ID NO: 468252 - RNA, 15 nt, Chlamydia trachomatis
uagcagcuagaacau

SEQ ID NO: 468253 - RNA, 14 nt, Chlamydia trachomatis
uagcagcucuuacu

SEQ ID NO: 468254 - RNA, 18 nt, Chlamydia trachomatis
uagcaggaacuucuucau

SEQ ID NO: 468255 - RNA, 13 nt, Chlamydia trachomatis
uagcaagacaucu

SEQ ID NO: 468256 - RNA, 16 nt, Chlamydia trachomatis
uagcaagacaucuauu

SEQ ID NO: 468257 - RNA, 14 nt, Chlamydia trachomatis
uagcaaagaaauag

SEQ ID NO: 468258 - RNA, 20 nt, Chlamydia trachomatis
uagcaaagcgaucagcucuc

SEQ ID NO: 468259 - RNA, 13 nt, Chlamydia trachomatis
uagcaaauaauag

SEQ ID NO: 468260 - RNA, 17 nt, Chlamydia trachomatis
uagcaaauucgcuacca

SEQ ID NO: 468261 - RNA, 19 nt, Chlamydia trachomatis
uagcaaauucgcuaccaaa

SEQ ID NO: 468262 - RNA, 17 nt, Chlamydia trachomatis
uagcagggaacacagag

SEQ ID NO: 468263 - RNA, 13 nt, Chlamydia trachomatis
uagcaucucugua

SEQ ID NO: 468264 - RNA, 16 nt, Chlamydia trachomatis
uagcaugaucaugcag

SEQ ID NO: 468265 - RNA, 16 nt, Chlamydia trachomatis
uagcauggaagacaac

SEQ ID NO: 468266 - RNA, 14 nt, Chlamydia trachomatis
uagcuacagcaaua

SEQ ID NO: 468267 - RNA, 23 nt, Chlamydia trachomatis
uagcuaccacgagcauaagaaua

SEQ ID NO: 468268 - RNA, 20 nt, Chlamydia trachomatis
uagcggaacaagcaaaacau

SEQ ID NO: 468269 - RNA, 23 nt, Chlamydia trachomatis
uagcccuccuacuccaauggaaa

SEQ ID NO: 468270 - RNA, 20 nt, Chlamydia trachomatis
uaggcaacuugagcaucugg

SEQ ID NO: 468271 - RNA, 15 nt, Chlamydia trachomatis
uaggagagaaucuuu

SEQ ID NO: 468272 - RNA, 19 nt, Chlamydia trachomatis
uaggcauaauuaugaucac

SEQ ID NO: 468273 - RNA, 16 nt, Chlamydia trachomatis
uaggcauacaggagag

SEQ ID NO: 468274 - RNA, 18 nt, Chlamydia trachomatis
uaggcauuaaagggaaaa

SEQ ID NO: 468275 - RNA, 20 nt, Chlamydia trachomatis
uaggccauuucaugacagcu

SEQ ID NO: 468276 - RNA, 13 nt, Chlamydia trachomatis
uaggacucuaaga

SEQ ID NO: 468277 - RNA, 19 nt, Chlamydia trachomatis
uaggacucuaagagaacca

SEQ ID NO: 468278 - RNA, 22 nt, Chlamydia trachomatis
uaggacugccgaacugcuuucc

SEQ ID NO: 468279 - RNA, 11 nt, Chlamydia trachomatis
uaggagaaaga

SEQ ID NO: 468280 - RNA, 17 nt, Chlamydia trachomatis
uagcuguuaugaaccag

SEQ ID NO: 468281 - RNA, 20 nt, Chlamydia trachomatis
uagcuucauacacaugagca

SEQ ID NO: 468282 - RNA, 14 nt, Chlamydia trachomatis
uagcuacuagauag

SEQ ID NO: 468283 - RNA, 15 nt, Chlamydia trachomatis
uagcuacuuucgcuu

SEQ ID NO: 468284 - RNA, 20 nt, Chlamydia trachomatis
uagcuagaguagugccagca

SEQ ID NO: 468285 - RNA, 23 nt, Chlamydia trachomatis
uagcuaucgcggcuaucgucuuu

SEQ ID NO: 468286 - RNA, 17 nt, Chlamydia trachomatis
uagcuguaauaaacacu

SEQ ID NO: 468287 - RNA, 21 nt, Chlamydia trachomatis
uaggcugcucccucuggagug

SEQ ID NO: 468288 - RNA, 11 nt, Chlamydia trachomatis
uagggaaaaac

SEQ ID NO: 468289 - RNA, 19 nt, Chlamydia trachomatis
uagguccucuaaucuugau

SEQ ID NO: 468290 - RNA, 22 nt, Chlamydia trachomatis
uaggucucccuagcagcucuua

SEQ ID NO: 468291 - RNA, 16 nt, Chlamydia trachomatis
uaggucugaagaaaaa

SEQ ID NO: 468292 - RNA, 16 nt, Chlamydia trachomatis
uagguugaagaggcaa

SEQ ID NO: 468293 - RNA, 20 nt, Chlamydia trachomatis
uagguucuuugaucaaaucc

SEQ ID NO: 468294 - RNA, 14 nt, Chlamydia trachomatis
uagguuuaaauaag

SEQ ID NO: 468295 - RNA, 13 nt, Chlamydia trachomatis
uaguaauuuugac

SEQ ID NO: 468296 - RNA, 24 nt, Chlamydia trachomatis
uaguaauuuugacagaauugagca

SEQ ID NO: 468297 - RNA, 15 nt, Chlamydia trachomatis
uaguacaaaaauacu

SEQ ID NO: 468298 - RNA, 16 nt, Chlamydia trachomatis
uaguacaaaaauacuu

SEQ ID NO: 468299 - RNA, 17 nt, Chlamydia trachomatis
uaguacaaaaauacuug

SEQ ID NO: 468300 - RNA, 14 nt, Chlamydia trachomatis
uaguaauaaaggaa

SEQ ID NO: 468301 - RNA, 23 nt, Chlamydia trachomatis
uaguaaugugucuaaagaucggc

SEQ ID NO: 468302 - RNA, 13 nt, Chlamydia trachomatis
uagguuucugcua

SEQ ID NO: 468303 - RNA, 14 nt, Chlamydia trachomatis
uaguccaugugaga

SEQ ID NO: 468304 - RNA, 23 nt, Chlamydia trachomatis
uagucauugauucuaugagaaga

SEQ ID NO: 468305 - RNA, 22 nt, Chlamydia trachomatis
uagucaugaauggaaaguacuc

SEQ ID NO: 468306 - RNA, 18 nt, Chlamydia trachomatis
uaguagagaauuagagau

SEQ ID NO: 468307 - RNA, 22 nt, Chlamydia trachomatis
uaguaucuauaaucuauuuuau

SEQ ID NO: 468308 - RNA, 17 nt, Chlamydia trachomatis
uaguauuaaacuucaaa

SEQ ID NO: 468309 - RNA, 20 nt, Chlamydia trachomatis
uaguauuaaacuucaaacuc

SEQ ID NO: 468310 - RNA, 23 nt, Chlamydia trachomatis
uaguauucuuugcguagcucaga

SEQ ID NO: 468311 - RNA, 16 nt, Chlamydia trachomatis
uauaagaccuaaucca

SEQ ID NO: 468312 - RNA, 12 nt, Chlamydia trachomatis
uauaagaaaaag

SEQ ID NO: 468313 - RNA, 20 nt, Chlamydia trachomatis
uauaaguaucguaaacaaaa

SEQ ID NO: 468314 - RNA, 20 nt, Chlamydia trachomatis
uauaaguucuuuuuguugcu

SEQ ID NO: 468315 - RNA, 16 nt, Chlamydia trachomatis
uauaaguuuuaagaag

SEQ ID NO: 468316 - RNA, 22 nt, Chlamydia trachomatis
uauaaauuuggauuagaaaaag

SEQ ID NO: 468317 - RNA, 17 nt, Chlamydia trachomatis
uauaacauuauuccgcu

SEQ ID NO: 468318 - RNA, 22 nt, Chlamydia trachomatis
uauaacuaagaucuccaugauc

SEQ ID NO: 468319 - RNA, 14 nt, Chlamydia trachomatis
uaguuguuuuugau

SEQ ID NO: 468320 - RNA, 23 nt, Chlamydia trachomatis
uaguucuaacacuuuuuuuucuu

SEQ ID NO: 468321 - RNA, 17 nt, Chlamydia trachomatis
uaguucuaacaucaacu

SEQ ID NO: 468322 - RNA, 19 nt, Chlamydia trachomatis
uaucaaauuuuucagaaaa

SEQ ID NO: 468323 - RNA, 22 nt, Chlamydia trachomatis
uaucacuaccagccccacaagu

SEQ ID NO: 468324 - RNA, 20 nt, Chlamydia trachomatis
uaucacuaucugcaaaagca

SEQ ID NO: 468325 - RNA, 14 nt, Chlamydia trachomatis
uaucaaaaucaaua

SEQ ID NO: 468326 - RNA, 16 nt, Chlamydia trachomatis
uaucaaaaucaauaau

SEQ ID NO: 468327 - RNA, 12 nt, Chlamydia trachomatis
uauaauccagga

SEQ ID NO: 468328 - RNA, 19 nt, Chlamydia trachomatis
uauaaucccaaaaacaauc

SEQ ID NO: 468329 - RNA, 19 nt, Chlamydia trachomatis
uauaauccgagcauuuucc

SEQ ID NO: 468330 - RNA, 12 nt, Chlamydia trachomatis
uauaaucuggau

SEQ ID NO: 468331 - RNA, 17 nt, Chlamydia trachomatis
uauaguuguuuuugaug

SEQ ID NO: 468332 - RNA, 21 nt, Chlamydia trachomatis
uauauaaagccccuccgcuga

SEQ ID NO: 468333 - RNA, 21 nt, Chlamydia trachomatis
uaucagcaaaagugcuccuaa

SEQ ID NO: 468334 - RNA, 15 nt, Chlamydia trachomatis
uaucagcacagcgga

SEQ ID NO: 468335 - RNA, 11 nt, Chlamydia trachomatis
uaucagcaucc

SEQ ID NO: 468336 - RNA, 13 nt, Chlamydia trachomatis
uaucagcauccca

SEQ ID NO: 468337 - RNA, 11 nt, Chlamydia trachomatis
uaucauuucca

SEQ ID NO: 468338 - RNA, 14 nt, Chlamydia trachomatis
uauccaaaaaagug

SEQ ID NO: 468339 - RNA, 21 nt, Chlamydia trachomatis
uauccaaauaaacacacuggg

SEQ ID NO: 468340 - RNA, 19 nt, Chlamydia trachomatis
uauccaagcacuccucagc

SEQ ID NO: 468341 - RNA, 21 nt, Chlamydia trachomatis
uauccauacaugauagucaga

SEQ ID NO: 468342 - RNA, 14 nt, Chlamydia trachomatis
uauccauaaaaaua

SEQ ID NO: 468343 - RNA, 16 nt, Chlamydia trachomatis
uauccaucauaaaaag

SEQ ID NO: 468344 - RNA, 18 nt, Chlamydia trachomatis
uauccaugaucucugcag

SEQ ID NO: 468345 - RNA, 19 nt, Chlamydia trachomatis
uauccaugaucucugcaga

SEQ ID NO: 468346 - RNA, 22 nt, Chlamydia trachomatis
uauccaugaucucugcagaaga

SEQ ID NO: 468347 - RNA, 16 nt, Chlamydia trachomatis
uauccguaaggaagcc

SEQ ID NO: 468348 - RNA, 15 nt, Chlamydia trachomatis
uauccuaacuaaaaa

SEQ ID NO: 468349 - RNA, 18 nt, Chlamydia trachomatis
uauccuagagacggucua

SEQ ID NO: 468350 - RNA, 13 nt, Chlamydia trachomatis
uaucguaaacaaa

SEQ ID NO: 468351 - RNA, 17 nt, Chlamydia trachomatis
uaucguuagcaucaucc

SEQ ID NO: 468352 - RNA, 20 nt, Chlamydia trachomatis
uaucucaggauaaaacccua

SEQ ID NO: 468353 - RNA, 15 nt, Chlamydia trachomatis
uauccuguucuccaa

SEQ ID NO: 468354 - RNA, 21 nt, Chlamydia trachomatis
uaugcaucugauguuccaucu

SEQ ID NO: 468355 - RNA, 13 nt, Chlamydia trachomatis
uaugacagagccc

SEQ ID NO: 468356 - RNA, 15 nt, Chlamydia trachomatis
uaugacagagcccuu

SEQ ID NO: 468357 - RNA, 22 nt, Chlamydia trachomatis
uaugacaggcccaacuggcaag

SEQ ID NO: 468358 - RNA, 19 nt, Chlamydia trachomatis
uaugagccuugccuacaga

SEQ ID NO: 468359 - RNA, 13 nt, Chlamydia trachomatis
uaucuucuucuaa

SEQ ID NO: 468360 - RNA, 21 nt, Chlamydia trachomatis
uaucuugagagaccugcuuca

SEQ ID NO: 468361 - RNA, 21 nt, Chlamydia trachomatis
uaucuuggguaagaccaaaaa

SEQ ID NO: 468362 - RNA, 21 nt, Chlamydia trachomatis
uaucugcuaguccuccuguag

SEQ ID NO: 468363 - RNA, 23 nt, Chlamydia trachomatis
uaucugcucggauaggcugagga

SEQ ID NO: 468364 - RNA, 17 nt, Chlamydia trachomatis
uaucugcucuaaagcac

SEQ ID NO: 468365 - RNA, 21 nt, Chlamydia trachomatis
uaucugcuuccguaacaauau

SEQ ID NO: 468366 - RNA, 23 nt, Chlamydia trachomatis
uaucugggauggaaauaauuucu

SEQ ID NO: 468367 - RNA, 14 nt, Chlamydia trachomatis
uaucuucuuaauug

SEQ ID NO: 468368 - RNA, 17 nt, Chlamydia trachomatis
uaugaacggcucuucuu

SEQ ID NO: 468369 - RNA, 14 nt, Chlamydia trachomatis
uauguucagcaucc

SEQ ID NO: 468370 - RNA, 17 nt, Chlamydia trachomatis
uauguucagcauccuga

SEQ ID NO: 468371 - RNA, 19 nt, Chlamydia trachomatis
uauguucuuaauaaucugu

SEQ ID NO: 468372 - RNA, 12 nt, Chlamydia trachomatis
uauguaaaaauu

SEQ ID NO: 468373 - RNA, 18 nt, Chlamydia trachomatis
uauguaaacaagaauaau

SEQ ID NO: 468374 - RNA, 14 nt, Chlamydia trachomatis
uauguaaggaaaua

SEQ ID NO: 468375 - RNA, 17 nt, Chlamydia trachomatis
uauguaaggaaauaccu

SEQ ID NO: 468376 - RNA, 16 nt, Chlamydia trachomatis
uaugcgucuucccuga

SEQ ID NO: 468377 - RNA, 20 nt, Chlamydia trachomatis
uauggcauucaaccucucau

SEQ ID NO: 468378 - RNA, 15 nt, Chlamydia trachomatis
uauggaaguagcaua

SEQ ID NO: 468379 - RNA, 17 nt, Chlamydia trachomatis
uaugcuacuccuaaauc

SEQ ID NO: 468380 - RNA, 19 nt, Chlamydia trachomatis
uaugcucgccucuaucucu

SEQ ID NO: 468381 - RNA, 20 nt, Chlamydia trachomatis
uaugcucgccucuaucucuu

SEQ ID NO: 468382 - RNA, 19 nt, Chlamydia trachomatis
uaugcugguugguuuucuu

SEQ ID NO: 468383 - RNA, 13 nt, Chlamydia trachomatis
uauuccgagagaa

SEQ ID NO: 468384 - RNA, 23 nt, Chlamydia trachomatis
uauucccgaacuuuauuauugaa

SEQ ID NO: 468385 - RNA, 23 nt, Chlamydia trachomatis
uauuccauaauaguuaaaacaca

SEQ ID NO: 468386 - RNA, 18 nt, Chlamydia trachomatis
uauucacacuuaaaaaga

SEQ ID NO: 468387 - RNA, 16 nt, Chlamydia trachomatis
uauucacgcaucccaa

SEQ ID NO: 468388 - RNA, 17 nt, Chlamydia trachomatis
uauucguguccucuauu

SEQ ID NO: 468389 - RNA, 17 nt, Chlamydia trachomatis
uauucuccgauaauuuu

SEQ ID NO: 468390 - RNA, 18 nt, Chlamydia trachomatis
uauucuuucuuaucuguc

SEQ ID NO: 468391 - RNA, 12 nt, Chlamydia trachomatis
uauucuuuucca

SEQ ID NO: 468392 - RNA, 13 nt, Chlamydia trachomatis
uauucuuuuccau

SEQ ID NO: 468393 - RNA, 14 nt, Chlamydia trachomatis
uauucuuuuccaua

SEQ ID NO: 468394 - RNA, 12 nt, Chlamydia trachomatis
uauugaaagcau

SEQ ID NO: 468395 - RNA, 16 nt, Chlamydia trachomatis
uauucuguaaaaggaa

SEQ ID NO: 468396 - RNA, 14 nt, Chlamydia trachomatis
uauuaaacucccaa

SEQ ID NO: 468397 - RNA, 14 nt, Chlamydia trachomatis
uauuaaccaacucu

SEQ ID NO: 468398 - RNA, 15 nt, Chlamydia trachomatis
uauuaagauccauuu

SEQ ID NO: 468399 - RNA, 13 nt, Chlamydia trachomatis
uauuaauaaugaa

SEQ ID NO: 468400 - RNA, 14 nt, Chlamydia trachomatis
uauuagauagcuuc

SEQ ID NO: 468401 - RNA, 15 nt, Chlamydia trachomatis
uauuaucuagaaaag

SEQ ID NO: 468402 - RNA, 18 nt, Chlamydia trachomatis
uauuauugaaaaagcuuu

SEQ ID NO: 468403 - RNA, 15 nt, Chlamydia trachomatis
uauuauuuaaaacaa

SEQ ID NO: 468404 - RNA, 19 nt, Chlamydia trachomatis
uauugccaaaaagaaaauc

SEQ ID NO: 468405 - RNA, 15 nt, Chlamydia trachomatis
uauuggacucagaau

SEQ ID NO: 468406 - RNA, 20 nt, Chlamydia trachomatis
uauuguuuauaaauuucuaa

SEQ ID NO: 468407 - RNA, 14 nt, Chlamydia trachomatis
uauuuaaaacaaug

SEQ ID NO: 468408 - RNA, 14 nt, Chlamydia trachomatis
uauuuaagaagcua

SEQ ID NO: 468409 - RNA, 23 nt, Chlamydia trachomatis
uauuuacgagaggguuucuucuu

SEQ ID NO: 468410 - RNA, 17 nt, Chlamydia trachomatis
uauuucaccacuuuucc

SEQ ID NO: 468411 - RNA, 19 nt, Chlamydia trachomatis
uauuucaccacuuuuccga

SEQ ID NO: 468412 - RNA, 18 nt, Chlamydia trachomatis
uauuucauuuaauaaguu

SEQ ID NO: 468413 - RNA, 17 nt, Chlamydia trachomatis
uauuuccccuacaaaca

SEQ ID NO: 468414 - RNA, 16 nt, Chlamydia trachomatis
uauuucuuguguugaa

SEQ ID NO: 468415 - RNA, 17 nt, Chlamydia trachomatis
uauuuggaucucuuaga

SEQ ID NO: 468416 - RNA, 12 nt, Chlamydia trachomatis
uauuuuagagaa

SEQ ID NO: 468417 - RNA, 14 nt, Chlamydia trachomatis
uauuuuagagaaaa

SEQ ID NO: 468418 - RNA, 20 nt, Chlamydia trachomatis
ucaaaacuaaaaguugcucu

SEQ ID NO: 468419 - RNA, 23 nt, Chlamydia trachomatis
ucaaaagcuuuuccgcugcaauc

SEQ ID NO: 468420 - RNA, 15 nt, Chlamydia trachomatis
ucaaaauaaagaaau

SEQ ID NO: 468421 - RNA, 16 nt, Chlamydia trachomatis
ucaaaacgcucagaaa

SEQ ID NO: 468422 - RNA, 16 nt, Chlamydia trachomatis
ucaaaacgcucuccaa

SEQ ID NO: 468423 - RNA, 18 nt, Chlamydia trachomatis
ucaaaaaauguuuuugau

SEQ ID NO: 468424 - RNA, 19 nt, Chlamydia trachomatis
ucaaaaagcuguaaacgua

SEQ ID NO: 468425 - RNA, 11 nt, Chlamydia trachomatis
ucaaaaaagau

SEQ ID NO: 468426 - RNA, 18 nt, Chlamydia trachomatis
ucaaaaaaggcauaaaag

SEQ ID NO: 468427 - RNA, 22 nt, Chlamydia trachomatis
ucaaaaaaggcauaaaagagaa

SEQ ID NO: 468428 - RNA, 23 nt, Chlamydia trachomatis
uauuuuauucaaaucuucuucua

SEQ ID NO: 468429 - RNA, 14 nt, Chlamydia trachomatis
uauuuucaaaaccu

SEQ ID NO: 468430 - RNA, 20 nt, Chlamydia trachomatis
uauuuucagcaaaagaagaa

SEQ ID NO: 468431 - RNA, 16 nt, Chlamydia trachomatis
uauuuuuuaagaaguc

SEQ ID NO: 468432 - RNA, 11 nt, Chlamydia trachomatis
uauuuuuuccg

SEQ ID NO: 468433 - RNA, 18 nt, Chlamydia trachomatis
ucaaauaaagcggcuaaa

SEQ ID NO: 468434 - RNA, 15 nt, Chlamydia trachomatis
ucaaagaaagcuuau

SEQ ID NO: 468435 - RNA, 12 nt, Chlamydia trachomatis
ucaaagaaguaa

SEQ ID NO: 468436 - RNA, 18 nt, Chlamydia trachomatis
ucaaagaaguaaugaagg

SEQ ID NO: 468437 - RNA, 15 nt, Chlamydia trachomatis
ucaaagaucuuucua

SEQ ID NO: 468438 - RNA, 18 nt, Chlamydia trachomatis
ucaaagaucuuucuacau

SEQ ID NO: 468439 - RNA, 20 nt, Chlamydia trachomatis
ucaaagaucuuucuacauuu

SEQ ID NO: 468440 - RNA, 23 nt, Chlamydia trachomatis
ucaaagaucuuucuacauuuugc

SEQ ID NO: 468441 - RNA, 14 nt, Chlamydia trachomatis
ucaaagaugcgauc

SEQ ID NO: 468442 - RNA, 20 nt, Chlamydia trachomatis
ucaaagaugcgaucuccuca

SEQ ID NO: 468443 - RNA, 19 nt, Chlamydia trachomatis
ucaaagauuuuaugaccca

SEQ ID NO: 468444 - RNA, 21 nt, Chlamydia trachomatis
ucaaagcgaucuuugaacauu

SEQ ID NO: 468445 - RNA, 22 nt, Chlamydia trachomatis
ucaaagcgaucuuugaacauuu

SEQ ID NO: 468446 - RNA, 17 nt, Chlamydia trachomatis
ucaaacgaucugcgaug

SEQ ID NO: 468447 - RNA, 15 nt, Chlamydia trachomatis
ucaaacuaggcaauc

SEQ ID NO: 468448 - RNA, 21 nt, Chlamydia trachomatis
ucaaacagaaccuuuuuaaaa

SEQ ID NO: 468449 - RNA, 23 nt, Chlamydia trachomatis
ucaaacagaaccuuuuuaaaaua

SEQ ID NO: 468450 - RNA, 14 nt, Chlamydia trachomatis
ucaaaccaaaaaua

SEQ ID NO: 468451 - RNA, 20 nt, Chlamydia trachomatis
ucaaaauaauguuuuguagu

SEQ ID NO: 468452 - RNA, 15 nt, Chlamydia trachomatis
ucaaaauauuuugcu

SEQ ID NO: 468453 - RNA, 16 nt, Chlamydia trachomatis
ucaaaaucaauaaugu

SEQ ID NO: 468454 - RNA, 11 nt, Chlamydia trachomatis
ucaaaaugaua

SEQ ID NO: 468455 - RNA, 19 nt, Chlamydia trachomatis
ucaaaaugaucgccucuaa

SEQ ID NO: 468456 - RNA, 16 nt, Chlamydia trachomatis
ucaaaauguuugagua

SEQ ID NO: 468457 - RNA, 17 nt, Chlamydia trachomatis
ucaaaauuaucuaaaaa

SEQ ID NO: 468458 - RNA, 16 nt, Chlamydia trachomatis
ucaaaauucuaugaau

SEQ ID NO: 468459 - RNA, 13 nt, Chlamydia trachomatis
ucaaacaaucuaa

SEQ ID NO: 468460 - RNA, 17 nt, Chlamydia trachomatis
ucaagaucaaagucagg

SEQ ID NO: 468461 - RNA, 22 nt, Chlamydia trachomatis
ucaagagagaucuaugaaaaaa

SEQ ID NO: 468462 - RNA, 23 nt, Chlamydia trachomatis
ucaagagagaucuaugaaaaaag

SEQ ID NO: 468463 - RNA, 21 nt, Chlamydia trachomatis
ucaagaggcuuaaagauaaca

SEQ ID NO: 468464 - RNA, 15 nt, Chlamydia trachomatis
ucaagagggaaauau

SEQ ID NO: 468465 - RNA, 19 nt, Chlamydia trachomatis
ucaacgaaagcauccccaa

SEQ ID NO: 468466 - RNA, 21 nt, Chlamydia trachomatis
ucaacugauucguuugugcua

SEQ ID NO: 468467 - RNA, 19 nt, Chlamydia trachomatis
ucaacuccagagcaaauag

SEQ ID NO: 468468 - RNA, 21 nt, Chlamydia trachomatis
ucaacuccagagcaaauagaa

SEQ ID NO: 468469 - RNA, 18 nt, Chlamydia trachomatis
ucaacucgaaccuuuacc

SEQ ID NO: 468470 - RNA, 20 nt, Chlamydia trachomatis
ucaacucgcuccagaacgaa

SEQ ID NO: 468471 - RNA, 22 nt, Chlamydia trachomatis
ucaacggcguugggaucgguaa

SEQ ID NO: 468472 - RNA, 14 nt, Chlamydia trachomatis
ucaacguuuucacu

SEQ ID NO: 468473 - RNA, 22 nt, Chlamydia trachomatis
ucaacaagauuuuuuacaaugu

SEQ ID NO: 468474 - RNA, 16 nt, Chlamydia trachomatis
ucaaauuuuucagaaa

SEQ ID NO: 468475 - RNA, 12 nt, Chlamydia trachomatis
ucaaauuucucu

SEQ ID NO: 468476 - RNA, 13 nt, Chlamydia trachomatis
ucaaauuucucua

SEQ ID NO: 468477 - RNA, 14 nt, Chlamydia trachomatis
ucaaauuucucuag

SEQ ID NO: 468478 - RNA, 15 nt, Chlamydia trachomatis
ucaaauuuucaugaa

SEQ ID NO: 468479 - RNA, 13 nt, Chlamydia trachomatis
ucaaauccugcuu

SEQ ID NO: 468480 - RNA, 15 nt, Chlamydia trachomatis
ucaaaucuucuucua

SEQ ID NO: 468481 - RNA, 20 nt, Chlamydia trachomatis
ucaacagaaggaguuuuucu

SEQ ID NO: 468482 - RNA, 14 nt, Chlamydia trachomatis
ucaacauaauagcg

SEQ ID NO: 468483 - RNA, 14 nt, Chlamydia trachomatis
ucaacauagauccc

SEQ ID NO: 468484 - RNA, 13 nt, Chlamydia trachomatis
ucaacauuagaau

SEQ ID NO: 468485 - RNA, 19 nt, Chlamydia trachomatis
ucaaguucuaacuuuugau

SEQ ID NO: 468486 - RNA, 15 nt, Chlamydia trachomatis
ucaaguauugugcca

SEQ ID NO: 468487 - RNA, 18 nt, Chlamydia trachomatis
ucaaguauugugccaccg

SEQ ID NO: 468488 - RNA, 13 nt, Chlamydia trachomatis
ucaagucuccacu

SEQ ID NO: 468489 - RNA, 15 nt, Chlamydia trachomatis
ucaagccuacagcua

SEQ ID NO: 468490 - RNA, 16 nt, Chlamydia trachomatis
ucaagcgauuaugaaa

SEQ ID NO: 468491 - RNA, 17 nt, Chlamydia trachomatis
ucaauaagccuccugcg

SEQ ID NO: 468492 - RNA, 23 nt, Chlamydia trachomatis
ucaauaagccuccugcguuagca

SEQ ID NO: 468493 - RNA, 20 nt, Chlamydia trachomatis
ucaauaaccugaagauuuuu

SEQ ID NO: 468494 - RNA, 17 nt, Chlamydia trachomatis
ucaauaacgauaguaca

SEQ ID NO: 468495 - RNA, 15 nt, Chlamydia trachomatis
ucaauacgacagcac

SEQ ID NO: 468496 - RNA, 18 nt, Chlamydia trachomatis
ucaauaauguugaagucu

SEQ ID NO: 468497 - RNA, 12 nt, Chlamydia trachomatis
ucaauauaagcu

SEQ ID NO: 468498 - RNA, 16 nt, Chlamydia trachomatis
ucaauaucaacguuuu

SEQ ID NO: 468499 - RNA, 17 nt, Chlamydia trachomatis
ucacaaauuaccccaaa

SEQ ID NO: 468500 - RNA, 20 nt, Chlamydia trachomatis
ucacaaauuaccccaaauua

SEQ ID NO: 468501 - RNA, 15 nt, Chlamydia trachomatis
ucaauuacagcaucu

SEQ ID NO: 468502 - RNA, 16 nt, Chlamydia trachomatis
ucaauuaaagaaguug

SEQ ID NO: 468503 - RNA, 13 nt, Chlamydia trachomatis
ucaauuccuggag

SEQ ID NO: 468504 - RNA, 14 nt, Chlamydia trachomatis
ucaaucauaggaau

SEQ ID NO: 468505 - RNA, 19 nt, Chlamydia trachomatis
ucaauccagacucuuguag

SEQ ID NO: 468506 - RNA, 18 nt, Chlamydia trachomatis
ucaaugcggucaugcaaa

SEQ ID NO: 468507 - RNA, 13 nt, Chlamydia trachomatis
ucaaugcuucuau

SEQ ID NO: 468508 - RNA, 17 nt, Chlamydia trachomatis
ucacagcaauagccauu

SEQ ID NO: 468509 - RNA, 15 nt, Chlamydia trachomatis
ucacagaaacuucuu

SEQ ID NO: 468510 - RNA, 19 nt, Chlamydia trachomatis
ucacagaaacuucuucuaa

SEQ ID NO: 468511 - RNA, 12 nt, Chlamydia trachomatis
ucacacaagcug

SEQ ID NO: 468512 - RNA, 21 nt, Chlamydia trachomatis
ucacacaagcugacaaagcuu

SEQ ID NO: 468513 - RNA, 13 nt, Chlamydia trachomatis
ucacaauuuuucu

SEQ ID NO: 468514 - RNA, 18 nt, Chlamydia trachomatis
ucacacaacacuccugaa

SEQ ID NO: 468515 - RNA, 12 nt, Chlamydia trachomatis
ucacaagaacau

SEQ ID NO: 468516 - RNA, 19 nt, Chlamydia trachomatis
ucacauacaggccgucaau

SEQ ID NO: 468517 - RNA, 17 nt, Chlamydia trachomatis
ucacaucgaauaaaaau

SEQ ID NO: 468518 - RNA, 19 nt, Chlamydia trachomatis
ucaccacuaaucccaccuu

SEQ ID NO: 468519 - RNA, 13 nt, Chlamydia trachomatis
ucaccagcaaaag

SEQ ID NO: 468520 - RNA, 17 nt, Chlamydia trachomatis
ucaccccaucccuugca

SEQ ID NO: 468521 - RNA, 18 nt, Chlamydia trachomatis
ucacgaaguuuuuuuaaa

SEQ ID NO: 468522 - RNA, 21 nt, Chlamydia trachomatis
ucacgccagcuaagagaagca

SEQ ID NO: 468523 - RNA, 17 nt, Chlamydia trachomatis
ucacgccuccauccagu

SEQ ID NO: 468524 - RNA, 13 nt, Chlamydia trachomatis
ucacuugaaucac

SEQ ID NO: 468525 - RNA, 16 nt, Chlamydia trachomatis
ucacuguugagaaaaa

SEQ ID NO: 468526 - RNA, 19 nt, Chlamydia trachomatis
ucacugcaacuaauauuag

SEQ ID NO: 468527 - RNA, 22 nt, Chlamydia trachomatis
ucacugacuguagaaaaucaua

SEQ ID NO: 468528 - RNA, 20 nt, Chlamydia trachomatis
ucacuccaagaagagucucu

SEQ ID NO: 468529 - RNA, 15 nt, Chlamydia trachomatis
ucacuccuccuccua

SEQ ID NO: 468530 - RNA, 13 nt, Chlamydia trachomatis
ucacuauccaaag

SEQ ID NO: 468531 - RNA, 14 nt, Chlamydia trachomatis
ucacuaucugcaaa

SEQ ID NO: 468532 - RNA, 20 nt, Chlamydia trachomatis
ucacuaugaacaaacagcug

SEQ ID NO: 468533 - RNA, 17 nt, Chlamydia trachomatis
ucacuaaaaguaguccu

SEQ ID NO: 468534 - RNA, 18 nt, Chlamydia trachomatis
ucacguagacgauccgcu

SEQ ID NO: 468535 - RNA, 19 nt, Chlamydia trachomatis
ucagaaaagccuucuuuca

SEQ ID NO: 468536 - RNA, 14 nt, Chlamydia trachomatis
ucagaacaagugca

SEQ ID NO: 468537 - RNA, 17 nt, Chlamydia trachomatis
ucagaacaagugcagcg

SEQ ID NO: 468538 - RNA, 15 nt, Chlamydia trachomatis
ucagaacucaaaaua

SEQ ID NO: 468539 - RNA, 13 nt, Chlamydia trachomatis
ucagaagcuauuc

SEQ ID NO: 468540 - RNA, 13 nt, Chlamydia trachomatis
ucagaagaggcaa

SEQ ID NO: 468541 - RNA, 23 nt, Chlamydia trachomatis
ucagaagaggcaaaaaucugcaa

SEQ ID NO: 468542 - RNA, 15 nt, Chlamydia trachomatis
ucagaccuacaaaga

SEQ ID NO: 468543 - RNA, 16 nt, Chlamydia trachomatis
ucagaauuacccugaa

SEQ ID NO: 468544 - RNA, 16 nt, Chlamydia trachomatis
ucagcaaaagaagaau

SEQ ID NO: 468545 - RNA, 23 nt, Chlamydia trachomatis
ucagcaaaagaagaaucuucuuc

SEQ ID NO: 468546 - RNA, 13 nt, Chlamydia trachomatis
ucagaugccaucc

SEQ ID NO: 468547 - RNA, 15 nt, Chlamydia trachomatis
ucagagguagccaaa

SEQ ID NO: 468548 - RNA, 18 nt, Chlamydia trachomatis
ucagagguagccaaagaa

SEQ ID NO: 468549 - RNA, 19 nt, Chlamydia trachomatis
ucagagaaaauuucucuuc

SEQ ID NO: 468550 - RNA, 18 nt, Chlamydia trachomatis
ucagagauauugucuacu

SEQ ID NO: 468551 - RNA, 18 nt, Chlamydia trachomatis
ucagagaucccugucaua

SEQ ID NO: 468552 - RNA, 11 nt, Chlamydia trachomatis
ucagcaauaau

SEQ ID NO: 468553 - RNA, 13 nt, Chlamydia trachomatis
ucagcaauaauac

SEQ ID NO: 468554 - RNA, 21 nt, Chlamydia trachomatis
ucagcaggcgaacagugacag

SEQ ID NO: 468555 - RNA, 20 nt, Chlamydia trachomatis
ucagcagcauaaauccuuga

SEQ ID NO: 468556 - RNA, 18 nt, Chlamydia trachomatis
ucagcacguaguuucccg

SEQ ID NO: 468557 - RNA, 23 nt, Chlamydia trachomatis
ucagcauccugaacccgcugcug

SEQ ID NO: 468558 - RNA, 18 nt, Chlamydia trachomatis
ucagccaguccucccaaa

SEQ ID NO: 468559 - RNA, 13 nt, Chlamydia trachomatis
ucagccccaaaaa

SEQ ID NO: 468560 - RNA, 17 nt, Chlamydia trachomatis
uccugcauacuuuucaa

SEQ ID NO: 468561 - RNA, 15 nt, Chlamydia trachomatis
uccugcagcaaauaa

SEQ ID NO: 468562 - RNA, 19 nt, Chlamydia trachomatis
uccugcagcuaaagaaucu

SEQ ID NO: 468563 - RNA, 18 nt, Chlamydia trachomatis
uccugcugaucagaggga

SEQ ID NO: 468564 - RNA, 14 nt, Chlamydia trachomatis
uccugcuucuuuuu

SEQ ID NO: 468565 - RNA, 23 nt, Chlamydia trachomatis
uccuguaagaggaucuccagaaa

SEQ ID NO: 468566 - RNA, 16 nt, Chlamydia trachomatis
uccuguauaagaaaaa

SEQ ID NO: 468567 - RNA, 18 nt, Chlamydia trachomatis
uccuuaagguuuguuaau

SEQ ID NO: 468568 - RNA, 13 nt, Chlamydia trachomatis
uccuuacauaaaa

SEQ ID NO: 468569 - RNA, 22 nt, Chlamydia trachomatis
uccuuagaaggagugugaucga

SEQ ID NO: 468570 - RNA, 15 nt, Chlamydia trachomatis
uccuuagcuaaaagc

SEQ ID NO: 468571 - RNA, 21 nt, Chlamydia trachomatis
uccuuaguuagcugaaauguc

SEQ ID NO: 468572 - RNA, 18 nt, Chlamydia trachomatis
uccuuaucuucuugagaa

SEQ ID NO: 468573 - RNA, 14 nt, Chlamydia trachomatis
uccuugacucuaaa

SEQ ID NO: 468574 - RNA, 22 nt, Chlamydia trachomatis
uccuucuguguuugauaacgcu

SEQ ID NO: 468575 - RNA, 22 nt, Chlamydia trachomatis
uccuucuuuaauaaaagcuccu

SEQ ID NO: 468576 - RNA, 22 nt, Chlamydia trachomatis
uccuucuuucuggaaucauuca

SEQ ID NO: 468577 - RNA, 23 nt, Chlamydia trachomatis
uccuucgccgggggagccaaaaa

SEQ ID NO: 468578 - RNA, 15 nt, Chlamydia trachomatis
uccuucgauauggca

SEQ ID NO: 468579 - RNA, 14 nt, Chlamydia trachomatis
uccuucuacaaaaa

SEQ ID NO: 468580 - RNA, 19 nt, Chlamydia trachomatis
uccuucucccgcuaauuuu

SEQ ID NO: 468581 - RNA, 20 nt, Chlamydia trachomatis
uccuuuuaagauauccauag

SEQ ID NO: 468582 - RNA, 21 nt, Chlamydia trachomatis
uccuuuaaaagcugcuuuauc

SEQ ID NO: 468583 - RNA, 20 nt, Chlamydia trachomatis
ucgaaagacuaucuguuuug

SEQ ID NO: 468584 - RNA, 13 nt, Chlamydia trachomatis
uccuuuuugccuc

SEQ ID NO: 468585 - RNA, 13 nt, Chlamydia trachomatis
uccuuuuuacuaa

SEQ ID NO: 468586 - RNA, 16 nt, Chlamydia trachomatis
uccuuuugauucugcu

SEQ ID NO: 468587 - RNA, 21 nt, Chlamydia trachomatis
uccuuuucagaauuacccuga

SEQ ID NO: 468588 - RNA, 16 nt, Chlamydia trachomatis
ucgaacgcuucuuccc

SEQ ID NO: 468589 - RNA, 21 nt, Chlamydia trachomatis
ucgaaguucccuuuuguucca

SEQ ID NO: 468590 - RNA, 13 nt, Chlamydia trachomatis
ucgaauaaaaauu

SEQ ID NO: 468591 - RNA, 19 nt, Chlamydia trachomatis
ucgaauagcucccaacaag

SEQ ID NO: 468592 - RNA, 21 nt, Chlamydia trachomatis
ucgacagaaaaagaaaaggcu

SEQ ID NO: 468593 - RNA, 11 nt, Chlamydia trachomatis
ucgaggcuccc

SEQ ID NO: 468594 - RNA, 11 nt, Chlamydia trachomatis
ucgaggcuucu

SEQ ID NO: 468595 - RNA, 23 nt, Chlamydia trachomatis
ucgagcuguuuuugcaacaaagc

SEQ ID NO: 468596 - RNA, 19 nt, Chlamydia trachomatis
ucgagugaucuacagcugu

SEQ ID NO: 468597 - RNA, 17 nt, Chlamydia trachomatis
ucgagucaagaagccuu

SEQ ID NO: 468598 - RNA, 18 nt, Chlamydia trachomatis
ucgauaucguuagcauca

SEQ ID NO: 468599 - RNA, 15 nt, Chlamydia trachomatis
ucgauaguaccauaa

SEQ ID NO: 468600 - RNA, 23 nt, Chlamydia trachomatis
ucgauaguuuucccaucuacaaa

SEQ ID NO: 468601 - RNA, 17 nt, Chlamydia trachomatis
ucgaucggaaagaggag

SEQ ID NO: 468602 - RNA, 18 nt, Chlamydia trachomatis
ucgaucgucaucaguguc

SEQ ID NO: 468603 - RNA, 15 nt, Chlamydia trachomatis
ucgaucuuaccaaaa

SEQ ID NO: 468604 - RNA, 21 nt, Chlamydia trachomatis
ucgaucuuaccaaaaucuaaa

SEQ ID NO: 468605 - RNA, 12 nt, Chlamydia trachomatis
ucgcaagccacc

SEQ ID NO: 468606 - RNA, 15 nt, Chlamydia trachomatis
ucgcaagccaccagc

SEQ ID NO: 468607 - RNA, 14 nt, Chlamydia trachomatis
ucgauuugaugaga

SEQ ID NO: 468608 - RNA, 22 nt, Chlamydia trachomatis
ucgcccuuauugguauagaaac

SEQ ID NO: 468609 - RNA, 14 nt, Chlamydia trachomatis
ucgcgcagcuucug

SEQ ID NO: 468610 - RNA, 18 nt, Chlamydia trachomatis
ucgcugucaggauuuaaa

SEQ ID NO: 468611 - RNA, 14 nt, Chlamydia trachomatis
ucggauagagaaga

SEQ ID NO: 468612 - RNA, 13 nt, Chlamydia trachomatis
ucggauaggcuga

SEQ ID NO: 468613 - RNA, 16 nt, Chlamydia trachomatis
ucggauaggcugagga

SEQ ID NO: 468614 - RNA, 19 nt, Chlamydia trachomatis
ucggauaggcugaggauuc

SEQ ID NO: 468615 - RNA, 17 nt, Chlamydia trachomatis
ucggauccagaagcaca

SEQ ID NO: 468616 - RNA, 14 nt, Chlamydia trachomatis
ucggaucgagaaga

SEQ ID NO: 468617 - RNA, 23 nt, Chlamydia trachomatis
ucggcuuuaggagauuguuguau

SEQ ID NO: 468618 - RNA, 15 nt, Chlamydia trachomatis
ucguaaugaaggaaa

SEQ ID NO: 468619 - RNA, 14 nt, Chlamydia trachomatis
ucguacagaucuug

SEQ ID NO: 468620 - RNA, 14 nt, Chlamydia trachomatis
ucguauaaguuuua

SEQ ID NO: 468621 - RNA, 20 nt, Chlamydia trachomatis
ucguauaaguuuuaagaaga

SEQ ID NO: 468622 - RNA, 13 nt, Chlamydia trachomatis
ucguaucccugca

SEQ ID NO: 468623 - RNA, 23 nt, Chlamydia trachomatis
ucguaucccugcauaauagcuug

SEQ ID NO: 468624 - RNA, 20 nt, Chlamydia trachomatis
ucggugaaagcuagaagaau

SEQ ID NO: 468625 - RNA, 21 nt, Chlamydia trachomatis
ucguaaacaaccaaaugaccu

SEQ ID NO: 468626 - RNA, 20 nt, Chlamydia trachomatis
ucguaaacgauuaacucugc

SEQ ID NO: 468627 - RNA, 15 nt, Chlamydia trachomatis
ucguaaccaagcuua

SEQ ID NO: 468628 - RNA, 20 nt, Chlamydia trachomatis
ucguaaccaagcuuagcaga

SEQ ID NO: 468629 - RNA, 20 nt, Chlamydia trachomatis
ucguaaccagcggcaaaaau

SEQ ID NO: 468630 - RNA, 12 nt, Chlamydia trachomatis
ucggucuuagaa

SEQ ID NO: 468631 - RNA, 23 nt, Chlamydia trachomatis
ucuaagcuagaaaauagcaucuc

SEQ ID NO: 468632 - RNA, 19 nt, Chlamydia trachomatis
ucuaaggaauguggagcua

SEQ ID NO: 468633 - RNA, 20 nt, Chlamydia trachomatis
ucuaagugcaucauuuugua

SEQ ID NO: 468634 - RNA, 16 nt, Chlamydia trachomatis
ucuaauaaacagaucu

SEQ ID NO: 468635 - RNA, 23 nt, Chlamydia trachomatis
ucuaauaaacagaucuuuuucau

SEQ ID NO: 468636 - RNA, 13 nt, Chlamydia trachomatis
ucuaauuguuccc

SEQ ID NO: 468637 - RNA, 19 nt, Chlamydia trachomatis
ucuaauuucuuucucaugc

SEQ ID NO: 468638 - RNA, 22 nt, Chlamydia trachomatis
ucuacaggccucccuaucaauu

SEQ ID NO: 468639 - RNA, 13 nt, Chlamydia trachomatis
ucuacauaaugau

SEQ ID NO: 468640 - RNA, 16 nt, Chlamydia trachomatis
ucuacauccaaaaauu

SEQ ID NO: 468641 - RNA, 14 nt, Chlamydia trachomatis
ucguuuuuuuagau

SEQ ID NO: 468642 - RNA, 24 nt, Chlamydia trachomatis
ucuaaaggauaaggaagaagauag

SEQ ID NO: 468643 - RNA, 20 nt, Chlamydia trachomatis
ucuaaaugcuguaaaacauu

SEQ ID NO: 468644 - RNA, 16 nt, Chlamydia trachomatis
ucuaacucuucuggag

SEQ ID NO: 468645 - RNA, 12 nt, Chlamydia trachomatis
ucuaagaacaac

SEQ ID NO: 468646 - RNA, 21 nt, Chlamydia trachomatis
ucuaagauuuucaucuuccaa

SEQ ID NO: 468647 - RNA, 17 nt, Chlamydia trachomatis
ucuaagcaccuuuacaa

SEQ ID NO: 468648 - RNA, 22 nt, Chlamydia trachomatis
ucgugagacagcacuucuucuu

SEQ ID NO: 468649 - RNA, 18 nt, Chlamydia trachomatis
ucgugagcgucuuuucac

SEQ ID NO: 468650 - RNA, 13 nt, Chlamydia trachomatis
ucguuaggauucg

SEQ ID NO: 468651 - RNA, 18 nt, Chlamydia trachomatis
ucguuuaugaagccacaa

SEQ ID NO: 468652 - RNA, 15 nt, Chlamydia trachomatis
ucugaugcaccauaa

SEQ ID NO: 468653 - RNA, 16 nt, Chlamydia trachomatis
ucugcaaaaucuucca

SEQ ID NO: 468654 - RNA, 17 nt, Chlamydia trachomatis
ucugcaaaaucuuccau

SEQ ID NO: 468655 - RNA, 18 nt, Chlamydia trachomatis
ucugacuuuuuagcaucu

SEQ ID NO: 468656 - RNA, 12 nt, Chlamydia trachomatis
ucugagaaagcu

SEQ ID NO: 468657 - RNA, 17 nt, Chlamydia trachomatis
ucugagcagugacuaag

SEQ ID NO: 468658 - RNA, 21 nt, Chlamydia trachomatis
ucugauagagauaaagaaucc

SEQ ID NO: 468659 - RNA, 22 nt, Chlamydia trachomatis
ucucuuucucuagaauuucccu

SEQ ID NO: 468660 - RNA, 20 nt, Chlamydia trachomatis
ucucuuuucgaacaaaacuu

SEQ ID NO: 468661 - RNA, 23 nt, Chlamydia trachomatis
ucucuuuucgaacaaaacuuguc

SEQ ID NO: 468662 - RNA, 13 nt, Chlamydia trachomatis
ucucuuuucugca

SEQ ID NO: 468663 - RNA, 13 nt, Chlamydia trachomatis
ucucuuuuguuug

SEQ ID NO: 468664 - RNA, 20 nt, Chlamydia trachomatis
ucugaaaagagaagaaggcu

SEQ ID NO: 468665 - RNA, 12 nt, Chlamydia trachomatis
ucugaaguucuu

SEQ ID NO: 468666 - RNA, 21 nt, Chlamydia trachomatis
ucugaaucuguguugcaaaga

SEQ ID NO: 468667 - RNA, 18 nt, Chlamydia trachomatis
ucucuggaagagauguuu

SEQ ID NO: 468668 - RNA, 20 nt, Chlamydia trachomatis
ucucuggcaauaaucuuuuu

SEQ ID NO: 468669 - RNA, 20 nt, Chlamydia trachomatis
ucucugugcacaaucucuuu

SEQ ID NO: 468670 - RNA, 19 nt, Chlamydia trachomatis
ucucugaaagagcuucuuu

SEQ ID NO: 468671 - RNA, 17 nt, Chlamydia trachomatis
ucucucagauucgaaua

SEQ ID NO: 468672 - RNA, 11 nt, Chlamydia trachomatis
ucucucagcag

SEQ ID NO: 468673 - RNA, 12 nt, Chlamydia trachomatis
ucucucagcagc

SEQ ID NO: 468674 - RNA, 16 nt, Chlamydia trachomatis
ucucucagcagcuucc

SEQ ID NO: 468675 - RNA, 17 nt, Chlamydia trachomatis
ucucucagcagcuuccu

SEQ ID NO: 468676 - RNA, 17 nt, Chlamydia trachomatis
ucucucgaauagcuccc

SEQ ID NO: 468677 - RNA, 13 nt, Chlamydia trachomatis
ucucucuaaaauc

SEQ ID NO: 468678 - RNA, 19 nt, Chlamydia trachomatis
ucucucuggcaauaaucuu

SEQ ID NO: 468679 - RNA, 17 nt, Chlamydia trachomatis
ucucuuagacccucuaa

SEQ ID NO: 468680 - RNA, 12 nt, Chlamydia trachomatis
ucucuucacaaa

SEQ ID NO: 468681 - RNA, 14 nt, Chlamydia trachomatis
ucucuucacaaauu

SEQ ID NO: 468682 - RNA, 15 nt, Chlamydia trachomatis
ucucuucacuuugau

SEQ ID NO: 468683 - RNA, 17 nt, Chlamydia trachomatis
ucucuuccacgaugaga

SEQ ID NO: 468684 - RNA, 22 nt, Chlamydia trachomatis
ucucuuccgaguaaucaaaaaa

SEQ ID NO: 468685 - RNA, 23 nt, Chlamydia trachomatis
ucucuucugugcaaucagcucuc

SEQ ID NO: 468686 - RNA, 12 nt, Chlamydia trachomatis
ucucuugauuga

SEQ ID NO: 468687 - RNA, 19 nt, Chlamydia trachomatis
ucucuugcagaacagcucu

SEQ ID NO: 468688 - RNA, 11 nt, Chlamydia trachomatis
ucucuugcuuc

SEQ ID NO: 468689 - RNA, 19 nt, Chlamydia trachomatis
ucucuuguagagaggcaaa

SEQ ID NO: 468690 - RNA, 21 nt, Chlamydia trachomatis
ucucuuguagagaggcaaaca

SEQ ID NO: 468691 - RNA, 12 nt, Chlamydia trachomatis
ucucuugucaga

SEQ ID NO: 468692 - RNA, 16 nt, Chlamydia trachomatis
ucucuugucagaagag

SEQ ID NO: 468693 - RNA, 14 nt, Chlamydia trachomatis
ucucuuguuucaaa

SEQ ID NO: 468694 - RNA, 17 nt, Chlamydia trachomatis
ucucuuuauccuguucu

SEQ ID NO: 468695 - RNA, 21 nt, Chlamydia trachomatis
ucuccucgugaggcaugaaca

SEQ ID NO: 468696 - RNA, 15 nt, Chlamydia trachomatis
ucuccucauccuuuu

SEQ ID NO: 468697 - RNA, 13 nt, Chlamydia trachomatis
ucuccgcuuaaaa

SEQ ID NO: 468698 - RNA, 22 nt, Chlamydia trachomatis
ucuccgcuuaaaacuacagaaa

SEQ ID NO: 468699 - RNA, 17 nt, Chlamydia trachomatis
ucuccgaugccgcagaa

SEQ ID NO: 468700 - RNA, 20 nt, Chlamydia trachomatis
ucuccgaugccgcagaaaaa

SEQ ID NO: 468701 - RNA, 22 nt, Chlamydia trachomatis
ucuccagaaaaacguuucuguu

SEQ ID NO: 468702 - RNA, 13 nt, Chlamydia trachomatis
ucuccagcaucuu

SEQ ID NO: 468703 - RNA, 15 nt, Chlamydia trachomatis
ucuccagcaucuuuu

SEQ ID NO: 468704 - RNA, 18 nt, Chlamydia trachomatis
ucuccagcaucuuuucuu

SEQ ID NO: 468705 - RNA, 22 nt, Chlamydia trachomatis
ucucauggaucaccgaacaacc

SEQ ID NO: 468706 - RNA, 13 nt, Chlamydia trachomatis
ucucgguuuucuu

SEQ ID NO: 468707 - RNA, 16 nt, Chlamydia trachomatis
ucucuaaaagaagagc

SEQ ID NO: 468708 - RNA, 14 nt, Chlamydia trachomatis
ucucuaaaaucaca

SEQ ID NO: 468709 - RNA, 20 nt, Chlamydia trachomatis
ucucuaaagcuuuuguuaac

SEQ ID NO: 468710 - RNA, 16 nt, Chlamydia trachomatis
ucucuaacaacaguuc

SEQ ID NO: 468711 - RNA, 16 nt, Chlamydia trachomatis
ucucuaacuuaauaag

SEQ ID NO: 468712 - RNA, 15 nt, Chlamydia trachomatis
ucucuagaauuuccc

SEQ ID NO: 468713 - RNA, 15 nt, Chlamydia trachomatis
ucucggauaggaaaa

SEQ ID NO: 468714 - RNA, 16 nt, Chlamydia trachomatis
ucucgaauucuaucaa

SEQ ID NO: 468715 - RNA, 18 nt, Chlamydia trachomatis
ucucgaauucuaucaaca

SEQ ID NO: 468716 - RNA, 22 nt, Chlamydia trachomatis
ucucgaauucuaucaacaucug

SEQ ID NO: 468717 - RNA, 16 nt, Chlamydia trachomatis
ucucgagaagaaaaac

SEQ ID NO: 468718 - RNA, 15 nt, Chlamydia trachomatis
ucucgagucaagaag

SEQ ID NO: 468719 - RNA, 15 nt, Chlamydia trachomatis
ucugcagaagaagcc

SEQ ID NO: 468720 - RNA, 18 nt, Chlamydia trachomatis
ucugcaacucucuuggua

SEQ ID NO: 468721 - RNA, 23 nt, Chlamydia trachomatis
ucugcagauuuuguagcacagcu

SEQ ID NO: 468722 - RNA, 17 nt, Chlamydia trachomatis
ucugcagagcacaaauc

SEQ ID NO: 468723 - RNA, 17 nt, Chlamydia trachomatis
ucugcuaaaaaugcuug

SEQ ID NO: 468724 - RNA, 15 nt, Chlamydia trachomatis
ucugcuaaagaaaaa

SEQ ID NO: 468725 - RNA, 18 nt, Chlamydia trachomatis
ucugcuaauaguucucug

SEQ ID NO: 468726 - RNA, 22 nt, Chlamydia trachomatis
ucugcuacaaacugcucaagga

SEQ ID NO: 468727 - RNA, 13 nt, Chlamydia trachomatis
ucugcuauagaaa

SEQ ID NO: 468728 - RNA, 11 nt, Chlamydia trachomatis
ucugguuuaau

SEQ ID NO: 468729 - RNA, 21 nt, Chlamydia trachomatis
ucuggacuauuuucaaaaccu

SEQ ID NO: 468730 - RNA, 12 nt, Chlamydia trachomatis
ucuggaggagga

SEQ ID NO: 468731 - RNA, 20 nt, Chlamydia trachomatis
ucuggaggaguauccagaag

SEQ ID NO: 468732 - RNA, 22 nt, Chlamydia trachomatis
ucuggaguggcaucugguuggu

SEQ ID NO: 468733 - RNA, 20 nt, Chlamydia trachomatis
ucuguccauucuaaggagca

SEQ ID NO: 468734 - RNA, 17 nt, Chlamydia trachomatis
ucugucagucuucuuuu

SEQ ID NO: 468735 - RNA, 16 nt, Chlamydia trachomatis
ucugucguuaaagaau

SEQ ID NO: 468736 - RNA, 13 nt, Chlamydia trachomatis
ucuguaaaaggaa

SEQ ID NO: 468737 - RNA, 19 nt, Chlamydia trachomatis
ucuguaacuacaucuaaaa

SEQ ID NO: 468738 - RNA, 20 nt, Chlamydia trachomatis
ucuguaacuacaucuaaaag

SEQ ID NO: 468739 - RNA, 21 nt, Chlamydia trachomatis
ucuguaacuacaucuaaaaga

SEQ ID NO: 468740 - RNA, 22 nt, Chlamydia trachomatis
ucuguaacuacaucuaaaagag

SEQ ID NO: 468741 - RNA, 20 nt, Chlamydia trachomatis
ucuguaauuuuaaauccugu

SEQ ID NO: 468742 - RNA, 16 nt, Chlamydia trachomatis
ucuucacaaauauacu

SEQ ID NO: 468743 - RNA, 20 nt, Chlamydia trachomatis
ucuucacagagcuucucuaa

SEQ ID NO: 468744 - RNA, 21 nt, Chlamydia trachomatis
ucuucacagagcuucucuaaa

SEQ ID NO: 468745 - RNA, 22 nt, Chlamydia trachomatis
ucuucacagcacgacacuccuc

SEQ ID NO: 468746 - RNA, 13 nt, Chlamydia trachomatis
ucuucaagagcug

SEQ ID NO: 468747 - RNA, 18 nt, Chlamydia trachomatis
ucuucaauggcaaaacuu

SEQ ID NO: 468748 - RNA, 20 nt, Chlamydia trachomatis
ucuucaauggcaaaacuucg

SEQ ID NO: 468749 - RNA, 20 nt, Chlamydia trachomatis
ucuucaaagaacaagauccu

SEQ ID NO: 468750 - RNA, 18 nt, Chlamydia trachomatis
ucuucaacccuuuuaauc

SEQ ID NO: 468751 - RNA, 13 nt, Chlamydia trachomatis
ucuucagaaaucu

SEQ ID NO: 468752 - RNA, 15 nt, Chlamydia trachomatis
ucuucagaaaucuuc

SEQ ID NO: 468753 - RNA, 18 nt, Chlamydia trachomatis
ucuucagaaaucuucuua

SEQ ID NO: 468754 - RNA, 16 nt, Chlamydia trachomatis
ucuucaccccuuacaa

SEQ ID NO: 468755 - RNA, 19 nt, Chlamydia trachomatis
ucuucaucuauaggauggu

SEQ ID NO: 468756 - RNA, 15 nt, Chlamydia trachomatis
ucuuccacagaaguu

SEQ ID NO: 468757 - RNA, 16 nt, Chlamydia trachomatis
ucuuccacagaaguug

SEQ ID NO: 468758 - RNA, 22 nt, Chlamydia trachomatis
ucuuccacgaugagauacagua

SEQ ID NO: 468759 - RNA, 24 nt, Chlamydia trachomatis
ucuguuaagcguaguaagacccag

SEQ ID NO: 468760 - RNA, 16 nt, Chlamydia trachomatis
ucuguuaguagcuucu

SEQ ID NO: 468761 - RNA, 14 nt, Chlamydia trachomatis
ucuguuagugaaga

SEQ ID NO: 468762 - RNA, 18 nt, Chlamydia trachomatis
ucuguuagugaagagcag

SEQ ID NO: 468763 - RNA, 19 nt, Chlamydia trachomatis
ucuguuagugaagagcaga

SEQ ID NO: 468764 - RNA, 15 nt, Chlamydia trachomatis
ucuuaccaaaaucua

SEQ ID NO: 468765 - RNA, 16 nt, Chlamydia trachomatis
ucuuacgagcuuucuu

SEQ ID NO: 468766 - RNA, 16 nt, Chlamydia trachomatis
ucuuacuuaaaaaaca

SEQ ID NO: 468767 - RNA, 23 nt, Chlamydia trachomatis
ucuuagugaaugcuccauacgcu

SEQ ID NO: 468768 - RNA, 16 nt, Chlamydia trachomatis
ucuuaucagcauccca

SEQ ID NO: 468769 - RNA, 15 nt, Chlamydia trachomatis
ucuuuccuccucccu

SEQ ID NO: 468770 - RNA, 22 nt, Chlamydia trachomatis
ucuuuccuccucccuuuccaua

SEQ ID NO: 468771 - RNA, 21 nt, Chlamydia trachomatis
ucuuucgauaucgcguccaaa

SEQ ID NO: 468772 - RNA, 22 nt, Chlamydia trachomatis
ucuuucgauaucgcguccaaaa

SEQ ID NO: 468773 - RNA, 20 nt, Chlamydia trachomatis
ucuuucgugagccgcuuaag

SEQ ID NO: 468774 - RNA, 11 nt, Chlamydia trachomatis
ucuuucucuag

SEQ ID NO: 468775 - RNA, 21 nt, Chlamydia trachomatis
ucuuucuuaucugucagucuu

SEQ ID NO: 468776 - RNA, 15 nt, Chlamydia trachomatis
ucuuucuucuaagaa

SEQ ID NO: 468777 - RNA, 16 nt, Chlamydia trachomatis
ucuuucuucuaagaag

SEQ ID NO: 468778 - RNA, 18 nt, Chlamydia trachomatis
ucuuucuucuaagaaguu

SEQ ID NO: 468779 - RNA, 15 nt, Chlamydia trachomatis
ucuuuaauaacugca

SEQ ID NO: 468780 - RNA, 16 nt, Chlamydia trachomatis
ucuuuaauaccuucuu

SEQ ID NO: 468781 - RNA, 21 nt, Chlamydia trachomatis
ucuuuauuaaacucccaaaac

SEQ ID NO: 468782 - RNA, 22 nt, Chlamydia trachomatis
ucuuccaucacuccaagaagag

SEQ ID NO: 468783 - RNA, 15 nt, Chlamydia trachomatis
ucuuccaucguaagc

SEQ ID NO: 468784 - RNA, 22 nt, Chlamydia trachomatis
ucuucccaauauauuccugucu

SEQ ID NO: 468785 - RNA, 22 nt, Chlamydia trachomatis
ucuuccagacgcccuccuccuc

SEQ ID NO: 468786 - RNA, 18 nt, Chlamydia trachomatis
ucuuccagccuacaaaua

SEQ ID NO: 468787 - RNA, 19 nt, Chlamydia trachomatis
ucuuccagccuacaaauaa

SEQ ID NO: 468788 - RNA, 22 nt, Chlamydia trachomatis
ucuuccagccuacaaauaaagu

SEQ ID NO: 468789 - RNA, 14 nt, Chlamydia trachomatis
ucuugcuaagaaca

SEQ ID NO: 468790 - RNA, 14 nt, Chlamydia trachomatis
ucuugcugggagau

SEQ ID NO: 468791 - RNA, 18 nt, Chlamydia trachomatis
ucuugcugggagauagcu

SEQ ID NO: 468792 - RNA, 21 nt, Chlamydia trachomatis
ucuugggauaugccucuaagc

SEQ ID NO: 468793 - RNA, 22 nt, Chlamydia trachomatis
ucuugggauaugccucuaagca

SEQ ID NO: 468794 - RNA, 19 nt, Chlamydia trachomatis
ucuuggggaucgaucccuu

SEQ ID NO: 468795 - RNA, 22 nt, Chlamydia trachomatis
ucuugcuucaugucuucuuucu

SEQ ID NO: 468796 - RNA, 16 nt, Chlamydia trachomatis
ucuuguguagaagaag

SEQ ID NO: 468797 - RNA, 13 nt, Chlamydia trachomatis
ucuuguugaauau

SEQ ID NO: 468798 - RNA, 17 nt, Chlamydia trachomatis
ucuuguuuagaaaauac

SEQ ID NO: 468799 - RNA, 20 nt, Chlamydia trachomatis
ucuuguuuagaggagaaggu

SEQ ID NO: 468800 - RNA, 22 nt, Chlamydia trachomatis
ucuuuaaccagaauauaagcac

SEQ ID NO: 468801 - RNA, 21 nt, Chlamydia trachomatis
ucuuuaacccuucaggaaagc

SEQ ID NO: 468802 - RNA, 17 nt, Chlamydia trachomatis
ucuuugaagguaagaaa

SEQ ID NO: 468803 - RNA, 18 nt, Chlamydia trachomatis
ucuuugaguccaacgcug

SEQ ID NO: 468804 - RNA, 17 nt, Chlamydia trachomatis
ucuuugauaugcagcau

SEQ ID NO: 468805 - RNA, 20 nt, Chlamydia trachomatis
ucuuugauaugcagcaucca

SEQ ID NO: 468806 - RNA, 16 nt, Chlamydia trachomatis
ucuuugaucaaauccu

SEQ ID NO: 468807 - RNA, 16 nt, Chlamydia trachomatis
ucuuugaucuguaaaa

SEQ ID NO: 468808 - RNA, 21 nt, Chlamydia trachomatis
ucuuugggauagauagcucca

SEQ ID NO: 468809 - RNA, 15 nt, Chlamydia trachomatis
ucuuuggaaaaaaaa

SEQ ID NO: 468810 - RNA, 20 nt, Chlamydia trachomatis
ucuuugcuccacaagaagua

SEQ ID NO: 468811 - RNA, 13 nt, Chlamydia trachomatis
ucuuugucacaaa

SEQ ID NO: 468812 - RNA, 14 nt, Chlamydia trachomatis
ucuuuguucucuaa

SEQ ID NO: 468813 - RNA, 17 nt, Chlamydia trachomatis
ucuuuuacuuugaaaug

SEQ ID NO: 468814 - RNA, 19 nt, Chlamydia trachomatis
ucuuuuaggugcgcauaca

SEQ ID NO: 468815 - RNA, 15 nt, Chlamydia trachomatis
ucuuuuaucuucuua

SEQ ID NO: 468816 - RNA, 14 nt, Chlamydia trachomatis
ucuuuuuuuuugcu

SEQ ID NO: 468817 - RNA, 15 nt, Chlamydia trachomatis
ucuuuucgaacaaaa

SEQ ID NO: 468818 - RNA, 20 nt, Chlamydia trachomatis
ucuuuuuaaaucaauuucuc

SEQ ID NO: 468819 - RNA, 13 nt, Chlamydia trachomatis
ucuuuuucaagag

SEQ ID NO: 468820 - RNA, 16 nt, Chlamydia trachomatis
ucuuuuuccucagcau

SEQ ID NO: 468821 - RNA, 18 nt, Chlamydia trachomatis
ucuuuuuccucagcaugc

SEQ ID NO: 468822 - RNA, 18 nt, Chlamydia trachomatis
ugaaaagggcaaaacucc

SEQ ID NO: 468823 - RNA, 13 nt, Chlamydia trachomatis
ugaaaagagaaga

SEQ ID NO: 468824 - RNA, 19 nt, Chlamydia trachomatis
ugaaaaagaagcuaauagc

SEQ ID NO: 468825 - RNA, 22 nt, Chlamydia trachomatis
ugaaaauaugauuacuggauag

SEQ ID NO: 468826 - RNA, 23 nt, Chlamydia trachomatis
ugaaaauaugauuacuggauagu

SEQ ID NO: 468827 - RNA, 20 nt, Chlamydia trachomatis
ugaaaauaucuaagcgacua

SEQ ID NO: 468828 - RNA, 23 nt, Chlamydia trachomatis
ugaaaauaaguccauugauaggu

SEQ ID NO: 468829 - RNA, 19 nt, Chlamydia trachomatis
ugaaacaccucuccuugaa

SEQ ID NO: 468830 - RNA, 14 nt, Chlamydia trachomatis
ugaaacaucuuuua

SEQ ID NO: 468831 - RNA, 16 nt, Chlamydia trachomatis
ugaaagcuauuuucuu

SEQ ID NO: 468832 - RNA, 23 nt, Chlamydia trachomatis
ugaaagcuauuuucuuccugcuu

SEQ ID NO: 468833 - RNA, 14 nt, Chlamydia trachomatis
ugaaagagcuucuu

SEQ ID NO: 468834 - RNA, 13 nt, Chlamydia trachomatis
ugaaaguagacca

SEQ ID NO: 468835 - RNA, 17 nt, Chlamydia trachomatis
ugaaagucuuuauaucu

SEQ ID NO: 468836 - RNA, 18 nt, Chlamydia trachomatis
ugaaagucuuuauaucuu

SEQ ID NO: 468837 - RNA, 21 nt, Chlamydia trachomatis
ugaaaguuccgguauauucuu

SEQ ID NO: 468838 - RNA, 16 nt, Chlamydia trachomatis
ugaaaguuuuuucccc

SEQ ID NO: 468839 - RNA, 12 nt, Chlamydia trachomatis
ugaaagaaaaau

SEQ ID NO: 468840 - RNA, 14 nt, Chlamydia trachomatis
ugaaacucuuuuua

SEQ ID NO: 468841 - RNA, 17 nt, Chlamydia trachomatis
ugaaauguccacaagga

SEQ ID NO: 468842 - RNA, 23 nt, Chlamydia trachomatis
ugaacaacugcugauaaauuucu

SEQ ID NO: 468843 - RNA, 22 nt, Chlamydia trachomatis
ugaacaacuugaucuacagcaa

SEQ ID NO: 468844 - RNA, 20 nt, Chlamydia trachomatis
ugaacacccgguauauguau

SEQ ID NO: 468845 - RNA, 17 nt, Chlamydia trachomatis
ugaacauacaauuuaga

SEQ ID NO: 468846 - RNA, 22 nt, Chlamydia trachomatis
ugaacauacguuuucucuggaa

SEQ ID NO: 468847 - RNA, 12 nt, Chlamydia trachomatis
ugaacagcaaga

SEQ ID NO: 468848 - RNA, 13 nt, Chlamydia trachomatis
ugaacgagaaaaa

SEQ ID NO: 468849 - RNA, 22 nt, Chlamydia trachomatis
ugaacauuuucugguuucuuaa

SEQ ID NO: 468850 - RNA, 16 nt, Chlamydia trachomatis
ugaaccgcagcaacau

SEQ ID NO: 468851 - RNA, 15 nt, Chlamydia trachomatis
ugaagagaaaaauug

SEQ ID NO: 468852 - RNA, 23 nt, Chlamydia trachomatis
ugaagagcagagguaugcagacu

SEQ ID NO: 468853 - RNA, 20 nt, Chlamydia trachomatis
ugaagaacugucuucuuuca

SEQ ID NO: 468854 - RNA, 14 nt, Chlamydia trachomatis
ugaagaacuuuaga

SEQ ID NO: 468855 - RNA, 21 nt, Chlamydia trachomatis
ugaagaaggaggggauuuuca

SEQ ID NO: 468856 - RNA, 17 nt, Chlamydia trachomatis
ugaacuguucauucuca

SEQ ID NO: 468857 - RNA, 19 nt, Chlamydia trachomatis
ugaacuguucauucucagg

SEQ ID NO: 468858 - RNA, 21 nt, Chlamydia trachomatis
ugaagccauaggcauugugau

SEQ ID NO: 468859 - RNA, 12 nt, Chlamydia trachomatis
ugaagcaaauag

SEQ ID NO: 468860 - RNA, 14 nt, Chlamydia trachomatis
ugaagcaaauagau

SEQ ID NO: 468861 - RNA, 18 nt, Chlamydia trachomatis
ugaagauucuaaaaugca

SEQ ID NO: 468862 - RNA, 21 nt, Chlamydia trachomatis
ugaaggccaaagaaauagcua

SEQ ID NO: 468863 - RNA, 19 nt, Chlamydia trachomatis
ugaaggugugaaagaaaaa

SEQ ID NO: 468864 - RNA, 16 nt, Chlamydia trachomatis
ugaaguaacuuugaua

SEQ ID NO: 468865 - RNA, 11 nt, Chlamydia trachomatis
ugaauuacuug

SEQ ID NO: 468866 - RNA, 14 nt, Chlamydia trachomatis
ugaauuucuguaag

SEQ ID NO: 468867 - RNA, 18 nt, Chlamydia trachomatis
ugaauuuuaucuaaaaag

SEQ ID NO: 468868 - RNA, 19 nt, Chlamydia trachomatis
ugaauuuuaucuaaaaagg

SEQ ID NO: 468869 - RNA, 14 nt, Chlamydia trachomatis
ugacaaucacacga

SEQ ID NO: 468870 - RNA, 13 nt, Chlamydia trachomatis
ugaauggcaagga

SEQ ID NO: 468871 - RNA, 19 nt, Chlamydia trachomatis
ugaauccuugaaccaaacg

SEQ ID NO: 468872 - RNA, 22 nt, Chlamydia trachomatis
ugaauccuugaaccaaacgauu

SEQ ID NO: 468873 - RNA, 19 nt, Chlamydia trachomatis
ugaaucacagaaacuucuu

SEQ ID NO: 468874 - RNA, 13 nt, Chlamydia trachomatis
ugaauccauucua

SEQ ID NO: 468875 - RNA, 15 nt, Chlamydia trachomatis
ugaauaacguuuuaa

SEQ ID NO: 468876 - RNA, 17 nt, Chlamydia trachomatis
ugaauaggaagaauaau

SEQ ID NO: 468877 - RNA, 17 nt, Chlamydia trachomatis
ugaauagguucuaucca

SEQ ID NO: 468878 - RNA, 12 nt, Chlamydia trachomatis
ugaauauucccg

SEQ ID NO: 468879 - RNA, 20 nt, Chlamydia trachomatis
ugaauauucccgaacuuuau

SEQ ID NO: 468880 - RNA, 17 nt, Chlamydia trachomatis
ugacacacguuccaguc

SEQ ID NO: 468881 - RNA, 21 nt, Chlamydia trachomatis
ugacaucaccgagcauucuga

SEQ ID NO: 468882 - RNA, 13 nt, Chlamydia trachomatis
ugacauuccucga

SEQ ID NO: 468883 - RNA, 22 nt, Chlamydia trachomatis
ugaccgaagaacucaaaagcuu

SEQ ID NO: 468884 - RNA, 14 nt, Chlamydia trachomatis
ugaccgaaucucaa

SEQ ID NO: 468885 - RNA, 15 nt, Chlamydia trachomatis
ugacgaaucgcacca

SEQ ID NO: 468886 - RNA, 21 nt, Chlamydia trachomatis
ugagcacaagcuguuccuaau

SEQ ID NO: 468887 - RNA, 21 nt, Chlamydia trachomatis
ugagcaagccccgaaacccaa

SEQ ID NO: 468888 - RNA, 18 nt, Chlamydia trachomatis
ugagacuccagcuucucc

SEQ ID NO: 468889 - RNA, 14 nt, Chlamydia trachomatis
ugagagaccugcuu

SEQ ID NO: 468890 - RNA, 18 nt, Chlamydia trachomatis
ugagaaaguuaaagaaua

SEQ ID NO: 468891 - RNA, 13 nt, Chlamydia trachomatis
ugagaaaucuaaa

SEQ ID NO: 468892 - RNA, 15 nt, Chlamydia trachomatis
ugagaaaucuaaaac

SEQ ID NO: 468893 - RNA, 19 nt, Chlamydia trachomatis
ugagaaaucuaaaacaauu

SEQ ID NO: 468894 - RNA, 19 nt, Chlamydia trachomatis
ugagaacaaaccaucugua

SEQ ID NO: 468895 - RNA, 22 nt, Chlamydia trachomatis
ugagaccauuggaauuuucauc

SEQ ID NO: 468896 - RNA, 21 nt, Chlamydia trachomatis
ugacuacagucuuccucugcu

SEQ ID NO: 468897 - RNA, 13 nt, Chlamydia trachomatis
ugacuauuccuga

SEQ ID NO: 468898 - RNA, 23 nt, Chlamydia trachomatis
ugagcauuucucucgcugcgaga

SEQ ID NO: 468899 - RNA, 20 nt, Chlamydia trachomatis
ugaguguuuguauagaaccu

SEQ ID NO: 468900 - RNA, 16 nt, Chlamydia trachomatis
ugaguuccgaacaaaa

SEQ ID NO: 468901 - RNA, 22 nt, Chlamydia trachomatis
ugaguucugcuugcgaauaacu

SEQ ID NO: 468902 - RNA, 16 nt, Chlamydia trachomatis
ugaguugcucaauugu

SEQ ID NO: 468903 - RNA, 21 nt, Chlamydia trachomatis
ugaguuguuugggcugcugcu

SEQ ID NO: 468904 - RNA, 22 nt, Chlamydia trachomatis
ugaguuguuugggcugcugcuu

SEQ ID NO: 468905 - RNA, 12 nt, Chlamydia trachomatis
ugauaaaacucc

SEQ ID NO: 468906 - RNA, 14 nt, Chlamydia trachomatis
ugauaaauaaucuc

SEQ ID NO: 468907 - RNA, 22 nt, Chlamydia trachomatis
ugauacgcauaugcgucuuccc

SEQ ID NO: 468908 - RNA, 18 nt, Chlamydia trachomatis
ugauagucagaauaauau

SEQ ID NO: 468909 - RNA, 15 nt, Chlamydia trachomatis
ugauagugaaauaag

SEQ ID NO: 468910 - RNA, 15 nt, Chlamydia trachomatis
ugauaguuacagacu

SEQ ID NO: 468911 - RNA, 12 nt, Chlamydia trachomatis
ugaucaaagaau

SEQ ID NO: 468912 - RNA, 11 nt, Chlamydia trachomatis
ugauaucucca

SEQ ID NO: 468913 - RNA, 13 nt, Chlamydia trachomatis
ugaugaaaaagaa

SEQ ID NO: 468914 - RNA, 14 nt, Chlamydia trachomatis
ugaugaaaaagaag

SEQ ID NO: 468915 - RNA, 15 nt, Chlamydia trachomatis
ugaucuuuccagcag

SEQ ID NO: 468916 - RNA, 22 nt, Chlamydia trachomatis
ugaucuuuguucucuaaagauu

SEQ ID NO: 468917 - RNA, 13 nt, Chlamydia trachomatis
ugaucuuuuuagg

SEQ ID NO: 468918 - RNA, 20 nt, Chlamydia trachomatis
ugaucuuauuaaccaacucu

SEQ ID NO: 468919 - RNA, 18 nt, Chlamydia trachomatis
ugaugauagacaagacuu

SEQ ID NO: 468920 - RNA, 19 nt, Chlamydia trachomatis
ugaugauagucugcaaucc

SEQ ID NO: 468921 - RNA, 23 nt, Chlamydia trachomatis
ugaucucugcagaagaagcccca

SEQ ID NO: 468922 - RNA, 13 nt, Chlamydia trachomatis
ugaucucuuuuua

SEQ ID NO: 468923 - RNA, 14 nt, Chlamydia trachomatis
ugaucugaaaagag

SEQ ID NO: 468924 - RNA, 16 nt, Chlamydia trachomatis
ugaucugaaaagagaa

SEQ ID NO: 468925 - RNA, 19 nt, Chlamydia trachomatis
ugaucugaaaagagaagaa

SEQ ID NO: 468926 - RNA, 17 nt, Chlamydia trachomatis
ugaucuaaaggaaaaau

SEQ ID NO: 468927 - RNA, 15 nt, Chlamydia trachomatis
ugaucauaaauacuu

SEQ ID NO: 468928 - RNA, 13 nt, Chlamydia trachomatis
ugaucaugcagau

SEQ ID NO: 468929 - RNA, 14 nt, Chlamydia trachomatis
ugauuuagacacau

SEQ ID NO: 468930 - RNA, 15 nt, Chlamydia trachomatis
ugauuucauaaauuu

SEQ ID NO: 468931 - RNA, 13 nt, Chlamydia trachomatis
ugcaaaaauuuuc

SEQ ID NO: 468932 - RNA, 20 nt, Chlamydia trachomatis
ugcaaaaucuuccauaaaau

SEQ ID NO: 468933 - RNA, 15 nt, Chlamydia trachomatis
ugcaaauaagaaagu

SEQ ID NO: 468934 - RNA, 18 nt, Chlamydia trachomatis
ugcaaauaauaaaccaaa

SEQ ID NO: 468935 - RNA, 16 nt, Chlamydia trachomatis
ugauuaaccaaaagag

SEQ ID NO: 468936 - RNA, 17 nt, Chlamydia trachomatis
ugauuaaccaaaagagc

SEQ ID NO: 468937 - RNA, 20 nt, Chlamydia trachomatis
ugauuacuggagucucuuga

SEQ ID NO: 468938 - RNA, 14 nt, Chlamydia trachomatis
ugauucccagggag

SEQ ID NO: 468939 - RNA, 15 nt, Chlamydia trachomatis
ugauuccgcugcucu

SEQ ID NO: 468940 - RNA, 16 nt, Chlamydia trachomatis
ugauucuugaagauuu

SEQ ID NO: 468941 - RNA, 16 nt, Chlamydia trachomatis
ugcaaauuugcagaag

SEQ ID NO: 468942 - RNA, 15 nt, Chlamydia trachomatis
ugcaacaaagaguuu

SEQ ID NO: 468943 - RNA, 14 nt, Chlamydia trachomatis
ugcaaccuucucca

SEQ ID NO: 468944 - RNA, 21 nt, Chlamydia trachomatis
ugcaagcacacuugauaaaua

SEQ ID NO: 468945 - RNA, 23 nt, Chlamydia trachomatis
ugcaagcacacuugauaaauagc

SEQ ID NO: 468946 - RNA, 20 nt, Chlamydia trachomatis
ugcaauagaaaccuuauaua

SEQ ID NO: 468947 - RNA, 21 nt, Chlamydia trachomatis
ugcaagauauucccuaaaugc

SEQ ID NO: 468948 - RNA, 23 nt, Chlamydia trachomatis
ugcaagauauucccuaaaugcuc

SEQ ID NO: 468949 - RNA, 13 nt, Chlamydia trachomatis
ugcaagaaaauaa

SEQ ID NO: 468950 - RNA, 14 nt, Chlamydia trachomatis
ugcaagaaaauaag

SEQ ID NO: 468951 - RNA, 16 nt, Chlamydia trachomatis
ugcaagaacaaagaau

SEQ ID NO: 468952 - RNA, 18 nt, Chlamydia trachomatis
ugcaauuuacuaucagga

SEQ ID NO: 468953 - RNA, 18 nt, Chlamydia trachomatis
ugcacccgcggaucccaa

SEQ ID NO: 468954 - RNA, 18 nt, Chlamydia trachomatis
ugcaccgugcagaggggg

SEQ ID NO: 468955 - RNA, 15 nt, Chlamydia trachomatis
ugcacuaaagagcuu

SEQ ID NO: 468956 - RNA, 20 nt, Chlamydia trachomatis
ugcacuaagaauaaagauga

SEQ ID NO: 468957 - RNA, 19 nt, Chlamydia trachomatis
ugcauaaggaagcaaaaac

SEQ ID NO: 468958 - RNA, 22 nt, Chlamydia trachomatis
ugcauaauagcuugcacagcaa

SEQ ID NO: 468959 - RNA, 20 nt, Chlamydia trachomatis
ugcauacuucccacauacuu

SEQ ID NO: 468960 - RNA, 14 nt, Chlamydia trachomatis
ugcauagucuucag

SEQ ID NO: 468961 - RNA, 21 nt, Chlamydia trachomatis
ugcaucauguugcguuuguaa

SEQ ID NO: 468962 - RNA, 18 nt, Chlamydia trachomatis
ugcauggaaucauauccu

SEQ ID NO: 468963 - RNA, 21 nt, Chlamydia trachomatis
ugcauuuaaaugaauguggug

SEQ ID NO: 468964 - RNA, 22 nt, Chlamydia trachomatis
ugccaaagacaaauugcacuaa

SEQ ID NO: 468965 - RNA, 18 nt, Chlamydia trachomatis
ugccacacuuccccauuc

SEQ ID NO: 468966 - RNA, 20 nt, Chlamydia trachomatis
ugccaauugucaaggcuccg

SEQ ID NO: 468967 - RNA, 13 nt, Chlamydia trachomatis
ugccauccagagc

SEQ ID NO: 468968 - RNA, 20 nt, Chlamydia trachomatis
ugccaucauuaucuucuucu

SEQ ID NO: 468969 - RNA, 22 nt, Chlamydia trachomatis
ugccaucauuaucuucuucuaa

SEQ ID NO: 468970 - RNA, 14 nt, Chlamydia trachomatis
ugccauccauaacg

SEQ ID NO: 468971 - RNA, 21 nt, Chlamydia trachomatis
ugcccgacaguauauccucuc

SEQ ID NO: 468972 - RNA, 14 nt, Chlamydia trachomatis
ugccguuacuaaca

SEQ ID NO: 468973 - RNA, 15 nt, Chlamydia trachomatis
ugccucuaagcaccu

SEQ ID NO: 468974 - RNA, 21 nt, Chlamydia trachomatis
ugccuccagcgcacacuuuuc

SEQ ID NO: 468975 - RNA, 14 nt, Chlamydia trachomatis
ugccuggagcacuc

SEQ ID NO: 468976 - RNA, 22 nt, Chlamydia trachomatis
ugcggagccgauucaaaagcua

SEQ ID NO: 468977 - RNA, 20 nt, Chlamydia trachomatis
ugcggagcgaugagcuuauc

SEQ ID NO: 468978 - RNA, 22 nt, Chlamydia trachomatis
ugcguuucagaaaagccuucuu

SEQ ID NO: 468979 - RNA, 13 nt, Chlamydia trachomatis
ugcguuucuucug

SEQ ID NO: 468980 - RNA, 14 nt, Chlamydia trachomatis
ugcuccuacaaaau

SEQ ID NO: 468981 - RNA, 19 nt, Chlamydia trachomatis
ugcuccuacaaaauaguuc

SEQ ID NO: 468982 - RNA, 15 nt, Chlamydia trachomatis
ugcucuuucccgaua

SEQ ID NO: 468983 - RNA, 21 nt, Chlamydia trachomatis
ugcugagcauuucucucgcug

SEQ ID NO: 468984 - RNA, 13 nt, Chlamydia trachomatis
ugcugauaaaaau

SEQ ID NO: 468985 - RNA, 18 nt, Chlamydia trachomatis
ugcugauaaccagaaucc

SEQ ID NO: 468986 - RNA, 11 nt, Chlamydia trachomatis
ugcugcagauu

SEQ ID NO: 468987 - RNA, 12 nt, Chlamydia trachomatis
ugcuguacgaac

SEQ ID NO: 468988 - RNA, 20 nt, Chlamydia trachomatis
ugcuucaaaaaagauuuccc

SEQ ID NO: 468989 - RNA, 13 nt, Chlamydia trachomatis
ugcuuauuuacaa

SEQ ID NO: 468990 - RNA, 21 nt, Chlamydia trachomatis
ugcuucacuaggcucaugagc

SEQ ID NO: 468991 - RNA, 21 nt, Chlamydia trachomatis
ugcuucagaugggguuuacaa

SEQ ID NO: 468992 - RNA, 12 nt, Chlamydia trachomatis
ugcuugaacaac

SEQ ID NO: 468993 - RNA, 17 nt, Chlamydia trachomatis
ugcuugaacaacuccuc

SEQ ID NO: 468994 - RNA, 14 nt, Chlamydia trachomatis
uggaaaaaaaacca

SEQ ID NO: 468995 - RNA, 16 nt, Chlamydia trachomatis
uggaaaaaaaaccaaa

SEQ ID NO: 468996 - RNA, 13 nt, Chlamydia trachomatis
uggaaaagaucuu

SEQ ID NO: 468997 - RNA, 19 nt, Chlamydia trachomatis
uggcgguguuucuguuuuc

SEQ ID NO: 468998 - RNA, 20 nt, Chlamydia trachomatis
uggcucuuuaauauuuccca

SEQ ID NO: 468999 - RNA, 22 nt, Chlamydia trachomatis
uggcucgcaguacuuuaccugu

SEQ ID NO: 469000 - RNA, 17 nt, Chlamydia trachomatis
uggcugcagaagacuuu

SEQ ID NO: 469001 - RNA, 18 nt, Chlamydia trachomatis
uggcugcggauucagaag

SEQ ID NO: 469002 - RNA, 16 nt, Chlamydia trachomatis
uggcuguaauguuaau

SEQ ID NO: 469003 - RNA, 11 nt, Chlamydia trachomatis
uggcuucuuuu

SEQ ID NO: 469004 - RNA, 19 nt, Chlamydia trachomatis
uggcuugcgcaaucauauc

SEQ ID NO: 469005 - RNA, 12 nt, Chlamydia trachomatis
uggggaggaaua

SEQ ID NO: 469006 - RNA, 16 nt, Chlamydia trachomatis
uggggaggaauacuag

SEQ ID NO: 469007 - RNA, 14 nt, Chlamydia trachomatis
ugguagagcauacu

SEQ ID NO: 469008 - RNA, 16 nt, Chlamydia trachomatis
ugguagaggagaacaa

SEQ ID NO: 469009 - RNA, 19 nt, Chlamydia trachomatis
ugguagcagcuagaacaua

SEQ ID NO: 469010 - RNA, 23 nt, Chlamydia trachomatis
ugguaagggguuuucuuggcagg

SEQ ID NO: 469011 - RNA, 16 nt, Chlamydia trachomatis
ugguaauagcaaagaa

SEQ ID NO: 469012 - RNA, 14 nt, Chlamydia trachomatis
uggucacaagaaca

SEQ ID NO: 469013 - RNA, 18 nt, Chlamydia trachomatis
ugguuucuagcugauaag

SEQ ID NO: 469014 - RNA, 14 nt, Chlamydia trachomatis
ugguuucuuaaaca

SEQ ID NO: 469015 - RNA, 18 nt, Chlamydia trachomatis
ugguuucuuaaacaaaaa

SEQ ID NO: 469016 - RNA, 17 nt, Chlamydia trachomatis
ugguuguagaggagaag

SEQ ID NO: 469017 - RNA, 21 nt, Chlamydia trachomatis
ugguugugaaaagggcaaaac

SEQ ID NO: 469018 - RNA, 13 nt, Chlamydia trachomatis
ugguugugcucga

SEQ ID NO: 469019 - RNA, 17 nt, Chlamydia trachomatis
ugguguaggaaaauaca

SEQ ID NO: 469020 - RNA, 17 nt, Chlamydia trachomatis
ugguuaacaggcuuccu

SEQ ID NO: 469021 - RNA, 15 nt, Chlamydia trachomatis
ugguuacuugccucu

SEQ ID NO: 469022 - RNA, 12 nt, Chlamydia trachomatis
ugguuuucuugu

SEQ ID NO: 469023 - RNA, 23 nt, Chlamydia trachomatis
uguaaguccuuacauaaaaaagc

SEQ ID NO: 469024 - RNA, 16 nt, Chlamydia trachomatis
uguacagagaaaaaga

SEQ ID NO: 469025 - RNA, 18 nt, Chlamydia trachomatis
uguacagagaaaaagauu

SEQ ID NO: 469026 - RNA, 21 nt, Chlamydia trachomatis
uguacagcgacacguuuuccu

SEQ ID NO: 469027 - RNA, 14 nt, Chlamydia trachomatis
uguaucuugugcaa

SEQ ID NO: 469028 - RNA, 17 nt, Chlamydia trachomatis
uguauugguuauaugaa

SEQ ID NO: 469029 - RNA, 22 nt, Chlamydia trachomatis
ugucaggcgauaugcuacuccu

SEQ ID NO: 469030 - RNA, 15 nt, Chlamydia trachomatis
ugucaacauaauagc

SEQ ID NO: 469031 - RNA, 14 nt, Chlamydia trachomatis
uguccaaagcucuu

SEQ ID NO: 469032 - RNA, 15 nt, Chlamydia trachomatis
uguccaaagcucuuu

SEQ ID NO: 469033 - RNA, 23 nt, Chlamydia trachomatis
uguccaagcucgagucucuugug

SEQ ID NO: 469034 - RNA, 23 nt, Chlamydia trachomatis
ugucccccugguagaaagcuaca

SEQ ID NO: 469035 - RNA, 22 nt, Chlamydia trachomatis
ugucccugaacauccaccagca

SEQ ID NO: 469036 - RNA, 13 nt, Chlamydia trachomatis
ugucccugcuccg

SEQ ID NO: 469037 - RNA, 14 nt, Chlamydia trachomatis
uguccuuuauucaa

SEQ ID NO: 469038 - RNA, 13 nt, Chlamydia trachomatis
ugucgaacgcuuc

SEQ ID NO: 469039 - RNA, 17 nt, Chlamydia trachomatis
ugucgaacgcuucuucc

SEQ ID NO: 469040 - RNA, 15 nt, Chlamydia trachomatis
ugucuaagauuuuca

SEQ ID NO: 469041 - RNA, 20 nt, Chlamydia trachomatis
ugucuaaggaugcaaauaag

SEQ ID NO: 469042 - RNA, 16 nt, Chlamydia trachomatis
ugucguugguucaagu

SEQ ID NO: 469043 - RNA, 15 nt, Chlamydia trachomatis
ugucguuaaagaauu

SEQ ID NO: 469044 - RNA, 22 nt, Chlamydia trachomatis
ugucucaugcggagcuccagga

SEQ ID NO: 469045 - RNA, 21 nt, Chlamydia trachomatis
ugucuccaggagagucugcua

SEQ ID NO: 469046 - RNA, 14 nt, Chlamydia trachomatis
ugucuccuucuuug

SEQ ID NO: 469047 - RNA, 20 nt, Chlamydia trachomatis
ugucucucgaauagcuccca

SEQ ID NO: 469048 - RNA, 12 nt, Chlamydia trachomatis
ugucgcugaggc

SEQ ID NO: 469049 - RNA, 18 nt, Chlamydia trachomatis
ugugaaaauaaguccauu

SEQ ID NO: 469050 - RNA, 20 nt, Chlamydia trachomatis
ugugaauaggaagaauaaua

SEQ ID NO: 469051 - RNA, 16 nt, Chlamydia trachomatis
ugugaauggagcagca

SEQ ID NO: 469052 - RNA, 23 nt, Chlamydia trachomatis
ugugaugaaaccuaauagaaaua

SEQ ID NO: 469053 - RNA, 16 nt, Chlamydia trachomatis
ugucuguugaaagcua

SEQ ID NO: 469054 - RNA, 16 nt, Chlamydia trachomatis
ugucuucgcaaacugc

SEQ ID NO: 469055 - RNA, 18 nt, Chlamydia trachomatis
ugucuuguaacuaagcuu

SEQ ID NO: 469056 - RNA, 17 nt, Chlamydia trachomatis
ugucuugucuuugcucu

SEQ ID NO: 469057 - RNA, 20 nt, Chlamydia trachomatis
ugugaaaaaaaacuucuucc

SEQ ID NO: 469058 - RNA, 23 nt, Chlamydia trachomatis
ugugauucgcaucaaugauguag

SEQ ID NO: 469059 - RNA, 17 nt, Chlamydia trachomatis
uguguaauagcuaccac

SEQ ID NO: 469060 - RNA, 16 nt, Chlamydia trachomatis
uguguaaccuucccga

SEQ ID NO: 469061 - RNA, 16 nt, Chlamydia trachomatis
uguguacgcuuuggua

SEQ ID NO: 469062 - RNA, 17 nt, Chlamydia trachomatis
uguguacuuuugguucu

SEQ ID NO: 469063 - RNA, 15 nt, Chlamydia trachomatis
uguguuaaacaucaa

SEQ ID NO: 469064 - RNA, 14 nt, Chlamydia trachomatis
uguggaagcuagaa

SEQ ID NO: 469065 - RNA, 24 nt, Chlamydia trachomatis
uguggacgaacaaaaaguuugcca

SEQ ID NO: 469066 - RNA, 19 nt, Chlamydia trachomatis
uguucaagagaggccucca

SEQ ID NO: 469067 - RNA, 19 nt, Chlamydia trachomatis
uguucagguuugcauguaa

SEQ ID NO: 469068 - RNA, 22 nt, Chlamydia trachomatis
uguuauuuguucucuuagaagc

SEQ ID NO: 469069 - RNA, 17 nt, Chlamydia trachomatis
uguuauuuuuuaagaag

SEQ ID NO: 469070 - RNA, 16 nt, Chlamydia trachomatis
uguuagugaagagcag

SEQ ID NO: 469071 - RNA, 21 nt, Chlamydia trachomatis
uguguguaaccuucccgaagu

SEQ ID NO: 469072 - RNA, 21 nt, Chlamydia trachomatis
uguguugaauaacguuuuaaa

SEQ ID NO: 469073 - RNA, 18 nt, Chlamydia trachomatis
uguguugcuucccagagu

SEQ ID NO: 469074 - RNA, 16 nt, Chlamydia trachomatis
uguuacagucuguguu

SEQ ID NO: 469075 - RNA, 14 nt, Chlamydia trachomatis
uguuagaaaauacg

SEQ ID NO: 469076 - RNA, 15 nt, Chlamydia trachomatis
uguucguagacuucu

SEQ ID NO: 469077 - RNA, 20 nt, Chlamydia trachomatis
uguucguagacuucuuguau

SEQ ID NO: 469078 - RNA, 12 nt, Chlamydia trachomatis
uguucucuuaga

SEQ ID NO: 469079 - RNA, 17 nt, Chlamydia trachomatis
uguucugggcugacaga

SEQ ID NO: 469080 - RNA, 20 nt, Chlamydia trachomatis
uguucuuaauaaucugugcc

SEQ ID NO: 469081 - RNA, 16 nt, Chlamydia trachomatis
uguucuucgaaauauu

SEQ ID NO: 469082 - RNA, 14 nt, Chlamydia trachomatis
uguugaauaacguu

SEQ ID NO: 469083 - RNA, 20 nt, Chlamydia trachomatis
uguugaauaacguuuuaaac

SEQ ID NO: 469084 - RNA, 23 nt, Chlamydia trachomatis
uuacuuggggcgggcgacaugcu

SEQ ID NO: 469085 - RNA, 15 nt, Chlamydia trachomatis
uuacuuucuuugcua

SEQ ID NO: 469086 - RNA, 17 nt, Chlamydia trachomatis
uuacuuucuuugcuauu

SEQ ID NO: 469087 - RNA, 19 nt, Chlamydia trachomatis
uuacuuuucucaaaacgcu

SEQ ID NO: 469088 - RNA, 14 nt, Chlamydia trachomatis
uuagaauccaaagu

SEQ ID NO: 469089 - RNA, 14 nt, Chlamydia trachomatis
uuacgagaggguuu

SEQ ID NO: 469090 - RNA, 15 nt, Chlamydia trachomatis
uuacgagcuuucuua

SEQ ID NO: 469091 - RNA, 18 nt, Chlamydia trachomatis
uuacgcaaacuguauugu

SEQ ID NO: 469092 - RNA, 16 nt, Chlamydia trachomatis
uuacgccccuucuuca

SEQ ID NO: 469093 - RNA, 20 nt, Chlamydia trachomatis
uuacgcgucuaaaacaauug

SEQ ID NO: 469094 - RNA, 17 nt, Chlamydia trachomatis
uuacggaaaagcuuuuu

SEQ ID NO: 469095 - RNA, 15 nt, Chlamydia trachomatis
uuacgcucuuucuua

SEQ ID NO: 469096 - RNA, 22 nt, Chlamydia trachomatis
uuacggccccuggaauuucucc

SEQ ID NO: 469097 - RNA, 14 nt, Chlamydia trachomatis
uuaaugacucccau

SEQ ID NO: 469098 - RNA, 17 nt, Chlamydia trachomatis
uuaauuagaauuuccag

SEQ ID NO: 469099 - RNA, 19 nt, Chlamydia trachomatis
uuacaacuaaaggaaacaa

SEQ ID NO: 469100 - RNA, 22 nt, Chlamydia trachomatis
uuacagaagaaccuccauaaga

SEQ ID NO: 469101 - RNA, 13 nt, Chlamydia trachomatis
uuacauacuuuuc

SEQ ID NO: 469102 - RNA, 14 nt, Chlamydia trachomatis
uuacaucccuugaa

SEQ ID NO: 469103 - RNA, 23 nt, Chlamydia trachomatis
uuacaucccuugaacuagaaaua

SEQ ID NO: 469104 - RNA, 13 nt, Chlamydia trachomatis
uuaccaaaccuuu

SEQ ID NO: 469105 - RNA, 19 nt, Chlamydia trachomatis
uguugcuaaccguucuuga

SEQ ID NO: 469106 - RNA, 14 nt, Chlamydia trachomatis
uuaaacaaaaauaa

SEQ ID NO: 469107 - RNA, 20 nt, Chlamydia trachomatis
uuaaaccacccuucccaaca

SEQ ID NO: 469108 - RNA, 23 nt, Chlamydia trachomatis
uuaaagaaggaaaauccauugau

SEQ ID NO: 469109 - RNA, 17 nt, Chlamydia trachomatis
uuaaagcuuuuuccaaa

SEQ ID NO: 469110 - RNA, 19 nt, Chlamydia trachomatis
uuaaagcuuuuuccaaagc

SEQ ID NO: 469111 - RNA, 18 nt, Chlamydia trachomatis
uuaaagggggacaaaaau

SEQ ID NO: 469112 - RNA, 19 nt, Chlamydia trachomatis
uuaaagggggacaaaaaua

SEQ ID NO: 469113 - RNA, 22 nt, Chlamydia trachomatis
uuaaagggggacaaaaauacuu

SEQ ID NO: 469114 - RNA, 15 nt, Chlamydia trachomatis
uuaaaguauaauccg

SEQ ID NO: 469115 - RNA, 17 nt, Chlamydia trachomatis
uuaaauauucauauguu

SEQ ID NO: 469116 - RNA, 20 nt, Chlamydia trachomatis
uuaaaugcuucuuaacugca

SEQ ID NO: 469117 - RNA, 16 nt, Chlamydia trachomatis
uuaacaucuucccaau

SEQ ID NO: 469118 - RNA, 18 nt, Chlamydia trachomatis
uuaacaugauucaaaaua

SEQ ID NO: 469119 - RNA, 21 nt, Chlamydia trachomatis
uuaacccucgacgcuguccaa

SEQ ID NO: 469120 - RNA, 18 nt, Chlamydia trachomatis
uuaaccucugcaagaaaa

SEQ ID NO: 469121 - RNA, 20 nt, Chlamydia trachomatis
uuaacgauguacucugcaaa

SEQ ID NO: 469122 - RNA, 21 nt, Chlamydia trachomatis
uuaacuaggguugugaaaaaa

SEQ ID NO: 469123 - RNA, 23 nt, Chlamydia trachomatis
uuaacuuuguuauuuuuuaagaa

SEQ ID NO: 469124 - RNA, 14 nt, Chlamydia trachomatis
uuaagauccauuug

SEQ ID NO: 469125 - RNA, 13 nt, Chlamydia trachomatis
uuaagauuauaau

SEQ ID NO: 469126 - RNA, 23 nt, Chlamydia trachomatis
uuaauaacugcauaguccaugug

SEQ ID NO: 469127 - RNA, 22 nt, Chlamydia trachomatis
uuaauaauaaagauagcaucuu

SEQ ID NO: 469128 - RNA, 21 nt, Chlamydia trachomatis
uuaauaauaagagcuacagga

SEQ ID NO: 469129 - RNA, 18 nt, Chlamydia trachomatis
uuaugauauagauuuuag

SEQ ID NO: 469130 - RNA, 22 nt, Chlamydia trachomatis
uuaugagcauuugccaaugaaa

SEQ ID NO: 469131 - RNA, 19 nt, Chlamydia trachomatis
uuaugcugcccuugagcaa

SEQ ID NO: 469132 - RNA, 21 nt, Chlamydia trachomatis
uuauggguagcgauacaagac

SEQ ID NO: 469133 - RNA, 14 nt, Chlamydia trachomatis
uuauguaaauauuu

SEQ ID NO: 469134 - RNA, 16 nt, Chlamydia trachomatis
uuauuaaaagaccucu

SEQ ID NO: 469135 - RNA, 19 nt, Chlamydia trachomatis
uuaucguagagaucuucug

SEQ ID NO: 469136 - RNA, 13 nt, Chlamydia trachomatis
uuaucuaaaaaaa

SEQ ID NO: 469137 - RNA, 13 nt, Chlamydia trachomatis
uuaucuaaagaaa

SEQ ID NO: 469138 - RNA, 17 nt, Chlamydia trachomatis
uuaucuaaaucuaaaau

SEQ ID NO: 469139 - RNA, 19 nt, Chlamydia trachomatis
uuaucuccuaagacaagca

SEQ ID NO: 469140 - RNA, 15 nt, Chlamydia trachomatis
uuaucugcuauagaa

SEQ ID NO: 469141 - RNA, 22 nt, Chlamydia trachomatis
uuaucuugagagaccugcuuca

SEQ ID NO: 469142 - RNA, 22 nt, Chlamydia trachomatis
uuaucuuguguagaagaaggaa

SEQ ID NO: 469143 - RNA, 13 nt, Chlamydia trachomatis
uuagagaauaauc

SEQ ID NO: 469144 - RNA, 20 nt, Chlamydia trachomatis
uuauaagagaacccuaauaa

SEQ ID NO: 469145 - RNA, 13 nt, Chlamydia trachomatis
uuauaaugaaaga

SEQ ID NO: 469146 - RNA, 18 nt, Chlamydia trachomatis
uuauagaaggucugaaca

SEQ ID NO: 469147 - RNA, 14 nt, Chlamydia trachomatis
uuauagcaagcccu

SEQ ID NO: 469148 - RNA, 19 nt, Chlamydia trachomatis
uuauagcaagcccuugaga

SEQ ID NO: 469149 - RNA, 12 nt, Chlamydia trachomatis
uuauauaccgga

SEQ ID NO: 469150 - RNA, 15 nt, Chlamydia trachomatis
uuauauaggcuucca

SEQ ID NO: 469151 - RNA, 20 nt, Chlamydia trachomatis
uuaucauugggucugaucca

SEQ ID NO: 469152 - RNA, 18 nt, Chlamydia trachomatis
uuauccaaauaaacacac

SEQ ID NO: 469153 - RNA, 17 nt, Chlamydia trachomatis
uuauccgcaguaaaauc

SEQ ID NO: 469154 - RNA, 18 nt, Chlamydia trachomatis
uuauucaaaucuucuucu

SEQ ID NO: 469155 - RNA, 18 nt, Chlamydia trachomatis
uuauuaucuagaaaagag

SEQ ID NO: 469156 - RNA, 17 nt, Chlamydia trachomatis
uucaagaucaaagucag

SEQ ID NO: 469157 - RNA, 20 nt, Chlamydia trachomatis
uucaagaugcgcuugaggcu

SEQ ID NO: 469158 - RNA, 15 nt, Chlamydia trachomatis
uucaaccucucauca

SEQ ID NO: 469159 - RNA, 22 nt, Chlamydia trachomatis
uucaaaguuuuguguuuccaaa

SEQ ID NO: 469160 - RNA, 15 nt, Chlamydia trachomatis
uucaacauaauaaau

SEQ ID NO: 469161 - RNA, 15 nt, Chlamydia trachomatis
uucaacauaugcuca

SEQ ID NO: 469162 - RNA, 19 nt, Chlamydia trachomatis
uucaaaagcucgucagcca

SEQ ID NO: 469163 - RNA, 17 nt, Chlamydia trachomatis
uucaaaauccauuccca

SEQ ID NO: 469164 - RNA, 22 nt, Chlamydia trachomatis
uucaaagaucgguucauaaaau

SEQ ID NO: 469165 - RNA, 15 nt, Chlamydia trachomatis
uucaaagcaaacuuc

SEQ ID NO: 469166 - RNA, 13 nt, Chlamydia trachomatis
uucaaagaacaag

SEQ ID NO: 469167 - RNA, 11 nt, Chlamydia trachomatis
uucaaagaagc

SEQ ID NO: 469168 - RNA, 12 nt, Chlamydia trachomatis
uuauuuugaggg

SEQ ID NO: 469169 - RNA, 16 nt, Chlamydia trachomatis
uuauuuuuuaagaagu

SEQ ID NO: 469170 - RNA, 11 nt, Chlamydia trachomatis
uucaaaaagag

SEQ ID NO: 469171 - RNA, 16 nt, Chlamydia trachomatis
uucaaaaauaaugcca

SEQ ID NO: 469172 - RNA, 24 nt, Chlamydia trachomatis
uucaaaaauaaugccaccuaauau

SEQ ID NO: 469173 - RNA, 17 nt, Chlamydia trachomatis
uucacagagcuucucua

SEQ ID NO: 469174 - RNA, 20 nt, Chlamydia trachomatis
uucaccagcaaaagaaaaau

SEQ ID NO: 469175 - RNA, 13 nt, Chlamydia trachomatis
uucacaaagagaa

SEQ ID NO: 469176 - RNA, 18 nt, Chlamydia trachomatis
uucacaaauuuaucugcu

SEQ ID NO: 469177 - RNA, 18 nt, Chlamydia trachomatis
uucaaguucuaacuuuug

SEQ ID NO: 469178 - RNA, 17 nt, Chlamydia trachomatis
uucaaguucuucuucca

SEQ ID NO: 469179 - RNA, 20 nt, Chlamydia trachomatis
uucaauaauguugaagucuc

SEQ ID NO: 469180 - RNA, 20 nt, Chlamydia trachomatis
uucaauagcaggaacuucuu

SEQ ID NO: 469181 - RNA, 22 nt, Chlamydia trachomatis
uucaauagcaggaacuucuuca

SEQ ID NO: 469182 - RNA, 18 nt, Chlamydia trachomatis
uucaauaucaacguuuuc

SEQ ID NO: 469183 - RNA, 17 nt, Chlamydia trachomatis
uucaaucacuccuccuc

SEQ ID NO: 469184 - RNA, 21 nt, Chlamydia trachomatis
uucaaucacuccuccuccuaa

SEQ ID NO: 469185 - RNA, 18 nt, Chlamydia trachomatis
uucaaugcggucaugcaa

SEQ ID NO: 469186 - RNA, 17 nt, Chlamydia trachomatis
uucacugacuguagaaa

SEQ ID NO: 469187 - RNA, 20 nt, Chlamydia trachomatis
uucacugccuuuaggaagaa

SEQ ID NO: 469188 - RNA, 18 nt, Chlamydia trachomatis
uucacgucggcuuuagga

SEQ ID NO: 469189 - RNA, 13 nt, Chlamydia trachomatis
uucacuaggguaa

SEQ ID NO: 469190 - RNA, 17 nt, Chlamydia trachomatis
uucacuaccagaggagg

SEQ ID NO: 469191 - RNA, 11 nt, Chlamydia trachomatis
uucagcaauaa

SEQ ID NO: 469192 - RNA, 14 nt, Chlamydia trachomatis
uucagaaaagccuu

SEQ ID NO: 469193 - RNA, 16 nt, Chlamydia trachomatis
uucagaaagagaauca

SEQ ID NO: 469194 - RNA, 17 nt, Chlamydia trachomatis
uucagaacaagugcagc

SEQ ID NO: 469195 - RNA, 13 nt, Chlamydia trachomatis
uucagaacucaaa

SEQ ID NO: 469196 - RNA, 15 nt, Chlamydia trachomatis
uucagaacucaaaau

SEQ ID NO: 469197 - RNA, 15 nt, Chlamydia trachomatis
uucagaagaagagcu

SEQ ID NO: 469198 - RNA, 19 nt, Chlamydia trachomatis
uucacuuugauaauacucu

SEQ ID NO: 469199 - RNA, 22 nt, Chlamydia trachomatis
uucacuuugauaauacucuucu

SEQ ID NO: 469200 - RNA, 18 nt, Chlamydia trachomatis
uucacuuuuaggaagaac

SEQ ID NO: 469201 - RNA, 15 nt, Chlamydia trachomatis
uucagaauuacccug

SEQ ID NO: 469202 - RNA, 21 nt, Chlamydia trachomatis
uucagaauauagcuguaauaa

SEQ ID NO: 469203 - RNA, 10 nt, Chlamydia trachomatis
uucagagagg

SEQ ID NO: 469204 - RNA, 20 nt, Chlamydia trachomatis
uucagagaggcuguaacuaa

SEQ ID NO: 469205 - RNA, 20 nt, Chlamydia trachomatis
uucagccgaugcccaagaaa

SEQ ID NO: 469206 - RNA, 18 nt, Chlamydia trachomatis
uucaggagcaugaaucag

SEQ ID NO: 469207 - RNA, 22 nt, Chlamydia trachomatis
uucaggguguaugaugucauca

SEQ ID NO: 469208 - RNA, 21 nt, Chlamydia trachomatis
uucaguucgaaguucccuuuu

SEQ ID NO: 469209 - RNA, 17 nt, Chlamydia trachomatis
uucaguuuguucagaaa

SEQ ID NO: 469210 - RNA, 14 nt, Chlamydia trachomatis
uucauaagaaaauu

SEQ ID NO: 469211 - RNA, 13 nt, Chlamydia trachomatis
uucauacauaacu

SEQ ID NO: 469212 - RNA, 13 nt, Chlamydia trachomatis
uucaucaaaauau

SEQ ID NO: 469213 - RNA, 14 nt, Chlamydia trachomatis
uucaucaaguauug

SEQ ID NO: 469214 - RNA, 18 nt, Chlamydia trachomatis
uucauuuuauguaaauau

SEQ ID NO: 469215 - RNA, 15 nt, Chlamydia trachomatis
uucauucuuucgaua

SEQ ID NO: 469216 - RNA, 13 nt, Chlamydia trachomatis
uucaugugaacag

SEQ ID NO: 469217 - RNA, 22 nt, Chlamydia trachomatis
uucauguaaauuuucaauagca

SEQ ID NO: 469218 - RNA, 20 nt, Chlamydia trachomatis
uucaucaucauggaaaauau

SEQ ID NO: 469219 - RNA, 14 nt, Chlamydia trachomatis
uucauccuuggcuu

SEQ ID NO: 469220 - RNA, 16 nt, Chlamydia trachomatis
uucaucucaauaaucg

SEQ ID NO: 469221 - RNA, 18 nt, Chlamydia trachomatis
uucaucucaauaaucgcu

SEQ ID NO: 469222 - RNA, 14 nt, Chlamydia trachomatis
uucaucuuccaacg

SEQ ID NO: 469223 - RNA, 19 nt, Chlamydia trachomatis
uucaugaaaagcuuucaaa

SEQ ID NO: 469224 - RNA, 21 nt, Chlamydia trachomatis
uucaugaaaagcuuucaaagc

SEQ ID NO: 469225 - RNA, 15 nt, Chlamydia trachomatis
uucaugaaacccauc

SEQ ID NO: 469226 - RNA, 20 nt, Chlamydia trachomatis
uucaugacagcuucuugaau

SEQ ID NO: 469227 - RNA, 15 nt, Chlamydia trachomatis
uuccacgaagagcaa

SEQ ID NO: 469228 - RNA, 19 nt, Chlamydia trachomatis
uuccacgaagagcaaaauc

SEQ ID NO: 469229 - RNA, 15 nt, Chlamydia trachomatis
uuccacgaugagaua

SEQ ID NO: 469230 - RNA, 16 nt, Chlamydia trachomatis
uuccagaaaaaauaau

SEQ ID NO: 469231 - RNA, 12 nt, Chlamydia trachomatis
uuccaacaaaaa

SEQ ID NO: 469232 - RNA, 15 nt, Chlamydia trachomatis
uuccaacaaaaagcg

SEQ ID NO: 469233 - RNA, 13 nt, Chlamydia trachomatis
uuccaagaagaac

SEQ ID NO: 469234 - RNA, 21 nt, Chlamydia trachomatis
uuccaaauagggucuuaaaaa

SEQ ID NO: 469235 - RNA, 15 nt, Chlamydia trachomatis
uuccagacaaaaaga

SEQ ID NO: 469236 - RNA, 15 nt, Chlamydia trachomatis
uuccagccuacaaau

SEQ ID NO: 469237 - RNA, 19 nt, Chlamydia trachomatis
uuccagccuacaaauaaag

SEQ ID NO: 469238 - RNA, 20 nt, Chlamydia trachomatis
uuccaucacuccaagaagag

SEQ ID NO: 469239 - RNA, 19 nt, Chlamydia trachomatis
uuccauaauuaaaggcucu

SEQ ID NO: 469240 - RNA, 14 nt, Chlamydia trachomatis
uuccagucuuaaca

SEQ ID NO: 469241 - RNA, 14 nt, Chlamydia trachomatis
uuccaguuacccuc

SEQ ID NO: 469242 - RNA, 15 nt, Chlamydia trachomatis
uucccgauauguuca

SEQ ID NO: 469243 - RNA, 15 nt, Chlamydia trachomatis
uucccgacagaggau

SEQ ID NO: 469244 - RNA, 20 nt, Chlamydia trachomatis
uucccaucuacaaaaccaaa

SEQ ID NO: 469245 - RNA, 21 nt, Chlamydia trachomatis
uucccaucuacaaaaccaaaa

SEQ ID NO: 469246 - RNA, 19 nt, Chlamydia trachomatis
uuccccaaaccaugaugcu

SEQ ID NO: 469247 - RNA, 13 nt, Chlamydia trachomatis
uuccaucuccuga

SEQ ID NO: 469248 - RNA, 20 nt, Chlamydia trachomatis
uuccaucuccugauuccgag

SEQ ID NO: 469249 - RNA, 12 nt, Chlamydia trachomatis
uuccaucuucca

SEQ ID NO: 469250 - RNA, 15 nt, Chlamydia trachomatis
uuccaucuaaaggca

SEQ ID NO: 469251 - RNA, 18 nt, Chlamydia trachomatis
uuccauuaaacuaugcaa

SEQ ID NO: 469252 - RNA, 18 nt, Chlamydia trachomatis
uuccauuaauuuggcuuc

SEQ ID NO: 469253 - RNA, 14 nt, Chlamydia trachomatis
uuccauuccuccua

SEQ ID NO: 469254 - RNA, 12 nt, Chlamydia trachomatis
uucccaaaauuu

SEQ ID NO: 469255 - RNA, 21 nt, Chlamydia trachomatis
uucccaaaauuuuucugcucc

SEQ ID NO: 469256 - RNA, 20 nt, Chlamydia trachomatis
uucccacaaacaaaaaagaa

SEQ ID NO: 469257 - RNA, 18 nt, Chlamydia trachomatis
uucccuuaaacauacaca

SEQ ID NO: 469258 - RNA, 16 nt, Chlamydia trachomatis
uucccuucuuucuucu

SEQ ID NO: 469259 - RNA, 23 nt, Chlamydia trachomatis
uucccuucuuucuucuaagaagu

SEQ ID NO: 469260 - RNA, 15 nt, Chlamydia trachomatis
uucccuugaaagaca

SEQ ID NO: 469261 - RNA, 20 nt, Chlamydia trachomatis
uucccuuuaaagaaagcccu

SEQ ID NO: 469262 - RNA, 23 nt, Chlamydia trachomatis
uucccuagguaucgaaaguaaaa

SEQ ID NO: 469263 - RNA, 15 nt, Chlamydia trachomatis
uucccuccuagaaag

SEQ ID NO: 469264 - RNA, 18 nt, Chlamydia trachomatis
uucccugcaacauuuccu

SEQ ID NO: 469265 - RNA, 17 nt, Chlamydia trachomatis
uucccugcaccucuuuc

SEQ ID NO: 469266 - RNA, 22 nt, Chlamydia trachomatis
uucccguagcagguaccuauaa

SEQ ID NO: 469267 - RNA, 23 nt, Chlamydia trachomatis
uucccuaagccgaguagacucua

SEQ ID NO: 469268 - RNA, 17 nt, Chlamydia trachomatis
uucccgcuauuuuccuc

SEQ ID NO: 469269 - RNA, 16 nt, Chlamydia trachomatis
uuccgcagagaucuaa

SEQ ID NO: 469270 - RNA, 21 nt, Chlamydia trachomatis
uuccgcagagaucuaauugga

SEQ ID NO: 469271 - RNA, 14 nt, Chlamydia trachomatis
uuccgacugcaguu

SEQ ID NO: 469272 - RNA, 20 nt, Chlamydia trachomatis
uuccgagagaagcuccucuu

SEQ ID NO: 469273 - RNA, 22 nt, Chlamydia trachomatis
uuccgagagcgaagacagaauc

SEQ ID NO: 469274 - RNA, 15 nt, Chlamydia trachomatis
uuccgaauaagcauu

SEQ ID NO: 469275 - RNA, 17 nt, Chlamydia trachomatis
uuccgaauaagcauuac

SEQ ID NO: 469276 - RNA, 15 nt, Chlamydia trachomatis
uuccgcugcaaucuc

SEQ ID NO: 469277 - RNA, 15 nt, Chlamydia trachomatis
uuccguuucuuagga

SEQ ID NO: 469278 - RNA, 13 nt, Chlamydia trachomatis
uuccuaaauaccu

SEQ ID NO: 469279 - RNA, 23 nt, Chlamydia trachomatis
uuccuaauacuaaacuaucuaaa

SEQ ID NO: 469280 - RNA, 21 nt, Chlamydia trachomatis
uuccugaaacgaucagcuccu

SEQ ID NO: 469281 - RNA, 13 nt, Chlamydia trachomatis
uuccucuccuucu

SEQ ID NO: 469282 - RNA, 23 nt, Chlamydia trachomatis
uuccucucucucaccgaaaaauu

SEQ ID NO: 469283 - RNA, 22 nt, Chlamydia trachomatis
uuccucuucacagagcuucucu

SEQ ID NO: 469284 - RNA, 15 nt, Chlamydia trachomatis
uuccuccucccuuuc

SEQ ID NO: 469285 - RNA, 20 nt, Chlamydia trachomatis
uuccuccucccuuuccauac

SEQ ID NO: 469286 - RNA, 23 nt, Chlamydia trachomatis
uuccuccucccuuuccauacauc

SEQ ID NO: 469287 - RNA, 22 nt, Chlamydia trachomatis
uuccucguuuuuuuagauaaga

SEQ ID NO: 469288 - RNA, 15 nt, Chlamydia trachomatis
uuccucuagcagaga

SEQ ID NO: 469289 - RNA, 14 nt, Chlamydia trachomatis
uuccuacuaaaaug

SEQ ID NO: 469290 - RNA, 22 nt, Chlamydia trachomatis
uuccuagcgaagucuucuauca

SEQ ID NO: 469291 - RNA, 16 nt, Chlamydia trachomatis
uuccucauaaaggaaa

SEQ ID NO: 469292 - RNA, 17 nt, Chlamydia trachomatis
uuccugagacaucuccu

SEQ ID NO: 469293 - RNA, 21 nt, Chlamydia trachomatis
uuccugcuucaaaaaagauuu

SEQ ID NO: 469294 - RNA, 22 nt, Chlamydia trachomatis
uuccuuaguuuuaauuccaucu

SEQ ID NO: 469295 - RNA, 16 nt, Chlamydia trachomatis
uuccuuauaguuguuu

SEQ ID NO: 469296 - RNA, 12 nt, Chlamydia trachomatis
uuccuuuuacuu

SEQ ID NO: 469297 - RNA, 20 nt, Chlamydia trachomatis
uuccuucagagguagccaaa

SEQ ID NO: 469298 - RNA, 13 nt, Chlamydia trachomatis
uucgagcuguuuu

SEQ ID NO: 469299 - RNA, 20 nt, Chlamydia trachomatis
uucgagcuguuuuugcaaca

SEQ ID NO: 469300 - RNA, 19 nt, Chlamydia trachomatis
uucgaggagucucugcagu

SEQ ID NO: 469301 - RNA, 20 nt, Chlamydia trachomatis
uucgagucuucccuuaaaca

SEQ ID NO: 469302 - RNA, 16 nt, Chlamydia trachomatis
uucgacggaacucuuu

SEQ ID NO: 469303 - RNA, 14 nt, Chlamydia trachomatis
uucgaauccuaaaa

SEQ ID NO: 469304 - RNA, 22 nt, Chlamydia trachomatis
uucgcaaacugcucuucuaacu

SEQ ID NO: 469305 - RNA, 23 nt, Chlamydia trachomatis
uucgcaaacugcucuucuaacuu

SEQ ID NO: 469306 - RNA, 22 nt, Chlamydia trachomatis
uucgaugcauacucagcgauug

SEQ ID NO: 469307 - RNA, 20 nt, Chlamydia trachomatis
uucgauguuguaagaacccu

SEQ ID NO: 469308 - RNA, 12 nt, Chlamydia trachomatis
uucgccaaacac

SEQ ID NO: 469309 - RNA, 14 nt, Chlamydia trachomatis
uucgcauuaaauaa

SEQ ID NO: 469310 - RNA, 22 nt, Chlamydia trachomatis
uucgcauuaaauaauacaaagg

SEQ ID NO: 469311 - RNA, 16 nt, Chlamydia trachomatis
uucgcgucaguucgga

SEQ ID NO: 469312 - RNA, 17 nt, Chlamydia trachomatis
uucggaauacuguuugu

SEQ ID NO: 469313 - RNA, 13 nt, Chlamydia trachomatis
uucuccuaaaguu

SEQ ID NO: 469314 - RNA, 13 nt, Chlamydia trachomatis
uucuccucccaga

SEQ ID NO: 469315 - RNA, 19 nt, Chlamydia trachomatis
uucuccucccagauuuuau

SEQ ID NO: 469316 - RNA, 22 nt, Chlamydia trachomatis
uucuccucuggaacguuugucu

SEQ ID NO: 469317 - RNA, 13 nt, Chlamydia trachomatis
uucucgaaaaaau

SEQ ID NO: 469318 - RNA, 17 nt, Chlamydia trachomatis
uucuaacuggccaccuu

SEQ ID NO: 469319 - RNA, 15 nt, Chlamydia trachomatis
uucuaagaaauuguc

SEQ ID NO: 469320 - RNA, 16 nt, Chlamydia trachomatis
uucuaagcuagaaaau

SEQ ID NO: 469321 - RNA, 13 nt, Chlamydia trachomatis
uucuaaguauucu

SEQ ID NO: 469322 - RNA, 19 nt, Chlamydia trachomatis
uucuaaucccauucugcgu

SEQ ID NO: 469323 - RNA, 12 nt, Chlamydia trachomatis
uucuacuuuuug

SEQ ID NO: 469324 - RNA, 22 nt, Chlamydia trachomatis
uucuagauagaagagcuuugca

SEQ ID NO: 469325 - RNA, 15 nt, Chlamydia trachomatis
uucuagcagccucuc

SEQ ID NO: 469326 - RNA, 16 nt, Chlamydia trachomatis
uucuaggaagcugaga

SEQ ID NO: 469327 - RNA, 20 nt, Chlamydia trachomatis
uucuaggucugaagaaaaau

SEQ ID NO: 469328 - RNA, 14 nt, Chlamydia trachomatis
uucggcagaagcug

SEQ ID NO: 469329 - RNA, 15 nt, Chlamydia trachomatis
uucggagaagaagag

SEQ ID NO: 469330 - RNA, 19 nt, Chlamydia trachomatis
uucgguuuugcuaaccaaa

SEQ ID NO: 469331 - RNA, 12 nt, Chlamydia trachomatis
uucgugacaaau

SEQ ID NO: 469332 - RNA, 14 nt, Chlamydia trachomatis
uucgugagacagca

SEQ ID NO: 469333 - RNA, 22 nt, Chlamydia trachomatis
uucuaaaugcuguaaaacauuu

SEQ ID NO: 469334 - RNA, 14 nt, Chlamydia trachomatis
uucugaaaggccag

SEQ ID NO: 469335 - RNA, 22 nt, Chlamydia trachomatis
uucugaaacgcacuccaauaua

SEQ ID NO: 469336 - RNA, 19 nt, Chlamydia trachomatis
uucucuaauaguugcaaaa

SEQ ID NO: 469337 - RNA, 23 nt, Chlamydia trachomatis
uucugaaggugugaaagaaaaau

SEQ ID NO: 469338 - RNA, 13 nt, Chlamydia trachomatis
uucugaaucaaac

SEQ ID NO: 469339 - RNA, 13 nt, Chlamydia trachomatis
uucucgcaaaaga

SEQ ID NO: 469340 - RNA, 16 nt, Chlamydia trachomatis
uucucgagaagaaaaa

SEQ ID NO: 469341 - RNA, 22 nt, Chlamydia trachomatis
uucucgcaauauauccaucuac

SEQ ID NO: 469342 - RNA, 18 nt, Chlamydia trachomatis
uucucgcuaaauugaaau

SEQ ID NO: 469343 - RNA, 13 nt, Chlamydia trachomatis
uucucgcuacaaa

SEQ ID NO: 469344 - RNA, 13 nt, Chlamydia trachomatis
uucuggagcaaca

SEQ ID NO: 469345 - RNA, 13 nt, Chlamydia trachomatis
uucuggaggagga

SEQ ID NO: 469346 - RNA, 23 nt, Chlamydia trachomatis
uucuggaaugcgcaauccuuuua

SEQ ID NO: 469347 - RNA, 23 nt, Chlamydia trachomatis
uucuggcaguaacaagcacagaa

SEQ ID NO: 469348 - RNA, 16 nt, Chlamydia trachomatis
uucuggcgaaugcccu

SEQ ID NO: 469349 - RNA, 16 nt, Chlamydia trachomatis
uucuggcgauaguucu

SEQ ID NO: 469350 - RNA, 14 nt, Chlamydia trachomatis
uucugcuuugucuc

SEQ ID NO: 469351 - RNA, 12 nt, Chlamydia trachomatis
uucuggaaagag

SEQ ID NO: 469352 - RNA, 15 nt, Chlamydia trachomatis
uucuggaaagagaga

SEQ ID NO: 469353 - RNA, 17 nt, Chlamydia trachomatis
uucugagaugaaaauau

SEQ ID NO: 469354 - RNA, 18 nt, Chlamydia trachomatis
uucuugaaugccuaacga

SEQ ID NO: 469355 - RNA, 21 nt, Chlamydia trachomatis
uucuugaauggcaaggacaag

SEQ ID NO: 469356 - RNA, 12 nt, Chlamydia trachomatis
uucuugacaaaa

SEQ ID NO: 469357 - RNA, 13 nt, Chlamydia trachomatis
uucuugaacaacg

SEQ ID NO: 469358 - RNA, 15 nt, Chlamydia trachomatis
uucuucccuuuuuuc

SEQ ID NO: 469359 - RNA, 21 nt, Chlamydia trachomatis
uucuuccauacccauaauucu

SEQ ID NO: 469360 - RNA, 14 nt, Chlamydia trachomatis
uucuucgaaauauu

SEQ ID NO: 469361 - RNA, 13 nt, Chlamydia trachomatis
uucuugaaagcuu

SEQ ID NO: 469362 - RNA, 14 nt, Chlamydia trachomatis
uucuuccucuaauu

SEQ ID NO: 469363 - RNA, 20 nt, Chlamydia trachomatis
uucuuccugcuucaaaaaag

SEQ ID NO: 469364 - RNA, 13 nt, Chlamydia trachomatis
uucuucauagcuu

SEQ ID NO: 469365 - RNA, 20 nt, Chlamydia trachomatis
uucuucauagcuucuaauuu

SEQ ID NO: 469366 - RNA, 20 nt, Chlamydia trachomatis
uucuuacauaagauccaucu

SEQ ID NO: 469367 - RNA, 15 nt, Chlamydia trachomatis
uucuuacuaaagcca

SEQ ID NO: 469368 - RNA, 15 nt, Chlamydia trachomatis
uucuuacuccuucuc

SEQ ID NO: 469369 - RNA, 15 nt, Chlamydia trachomatis
uucuuagccuuguuu

SEQ ID NO: 469370 - RNA, 21 nt, Chlamydia trachomatis
uucuucaacaacuucaauagc

SEQ ID NO: 469371 - RNA, 19 nt, Chlamydia trachomatis
uucuucacagcacgacacu

SEQ ID NO: 469372 - RNA, 14 nt, Chlamydia trachomatis
uucuucaccuuuuc

SEQ ID NO: 469373 - RNA, 15 nt, Chlamydia trachomatis
uugaacuagaaauaa

SEQ ID NO: 469374 - RNA, 18 nt, Chlamydia trachomatis
uugaagaagaucuguaac

SEQ ID NO: 469375 - RNA, 14 nt, Chlamydia trachomatis
uugaauggcaagga

SEQ ID NO: 469376 - RNA, 18 nt, Chlamydia trachomatis
uugaauggcaaggacaag

SEQ ID NO: 469377 - RNA, 16 nt, Chlamydia trachomatis
uugaauuucaggagua

SEQ ID NO: 469378 - RNA, 11 nt, Chlamydia trachomatis
uugagaaaaac

SEQ ID NO: 469379 - RNA, 13 nt, Chlamydia trachomatis
uugacuuucccug

SEQ ID NO: 469380 - RNA, 13 nt, Chlamydia trachomatis
uugagaaaacuug

SEQ ID NO: 469381 - RNA, 19 nt, Chlamydia trachomatis
uugagaaaguuaaagaaua

SEQ ID NO: 469382 - RNA, 18 nt, Chlamydia trachomatis
uucuugcgaugccucuaa

SEQ ID NO: 469383 - RNA, 23 nt, Chlamydia trachomatis
uucuuggaaaaaaggucucucuu

SEQ ID NO: 469384 - RNA, 13 nt, Chlamydia trachomatis
uucuuggcaggcg

SEQ ID NO: 469385 - RNA, 18 nt, Chlamydia trachomatis
uucuugguauuccguacu

SEQ ID NO: 469386 - RNA, 23 nt, Chlamydia trachomatis
uucuuguagaaaaagauggagag

SEQ ID NO: 469387 - RNA, 12 nt, Chlamydia trachomatis
uucuuguauaag

SEQ ID NO: 469388 - RNA, 15 nt, Chlamydia trachomatis
uucuugugauaucuc

SEQ ID NO: 469389 - RNA, 23 nt, Chlamydia trachomatis
uucuuugacgauagagaacaucu

SEQ ID NO: 469390 - RNA, 17 nt, Chlamydia trachomatis
uucuuugcguagcucag

SEQ ID NO: 469391 - RNA, 11 nt, Chlamydia trachomatis
uucuuugcuuu

SEQ ID NO: 469392 - RNA, 14 nt, Chlamydia trachomatis
uucuuuuuccucag

SEQ ID NO: 469393 - RNA, 19 nt, Chlamydia trachomatis
uucuuuuuuguguuucuug

SEQ ID NO: 469394 - RNA, 16 nt, Chlamydia trachomatis
uugaaccaguuucuug

SEQ ID NO: 469395 - RNA, 23 nt, Chlamydia trachomatis
uugauauucccuucuauuucucu

SEQ ID NO: 469396 - RNA, 13 nt, Chlamydia trachomatis
uugaucaaauccu

SEQ ID NO: 469397 - RNA, 23 nt, Chlamydia trachomatis
uugauaaacucggguuuuaaaug

SEQ ID NO: 469398 - RNA, 18 nt, Chlamydia trachomatis
uugauaucuaggucuccc

SEQ ID NO: 469399 - RNA, 21 nt, Chlamydia trachomatis
uugauaucuaggucucccagg

SEQ ID NO: 469400 - RNA, 18 nt, Chlamydia trachomatis
uugaguccgcaaacaaaa

SEQ ID NO: 469401 - RNA, 23 nt, Chlamydia trachomatis
uugaguucugcuugcgaauaacu

SEQ ID NO: 469402 - RNA, 15 nt, Chlamydia trachomatis
uugaucuaucgcuug

SEQ ID NO: 469403 - RNA, 15 nt, Chlamydia trachomatis
uugaucuucuggaau

SEQ ID NO: 469404 - RNA, 20 nt, Chlamydia trachomatis
uugaugcccaggauaacaaa

SEQ ID NO: 469405 - RNA, 22 nt, Chlamydia trachomatis
uugaugcccaggauaacaaaca

SEQ ID NO: 469406 - RNA, 16 nt, Chlamydia trachomatis
uugauucuaugagaag

SEQ ID NO: 469407 - RNA, 13 nt, Chlamydia trachomatis
uugauucugcucc

SEQ ID NO: 469408 - RNA, 16 nt, Chlamydia trachomatis
uugcagccuuucccuu

SEQ ID NO: 469409 - RNA, 17 nt, Chlamydia trachomatis
uugcagccuuucccuug

SEQ ID NO: 469410 - RNA, 19 nt, Chlamydia trachomatis
uugcaauccuuuuuccuua

SEQ ID NO: 469411 - RNA, 13 nt, Chlamydia trachomatis
uugccuacagaau

SEQ ID NO: 469412 - RNA, 14 nt, Chlamydia trachomatis
uugcccaaacucca

SEQ ID NO: 469413 - RNA, 16 nt, Chlamydia trachomatis
uugccauguuuuucag

SEQ ID NO: 469414 - RNA, 20 nt, Chlamydia trachomatis
uugcaguaccauuacuacaa

SEQ ID NO: 469415 - RNA, 18 nt, Chlamydia trachomatis
uugcaggagauaauuuuc

SEQ ID NO: 469416 - RNA, 17 nt, Chlamydia trachomatis
uugccaguaaucaaauu

SEQ ID NO: 469417 - RNA, 16 nt, Chlamydia trachomatis
uugcgcaaucauauca

SEQ ID NO: 469418 - RNA, 14 nt, Chlamydia trachomatis
uugcuacaguaucu

SEQ ID NO: 469419 - RNA, 14 nt, Chlamydia trachomatis
uugcuaaccaaaca

SEQ ID NO: 469420 - RNA, 17 nt, Chlamydia trachomatis
uugcucgagaaaugaau

SEQ ID NO: 469421 - RNA, 14 nt, Chlamydia trachomatis
uugcucgauccaaa

SEQ ID NO: 469422 - RNA, 21 nt, Chlamydia trachomatis
uuggcaaagagcuucuagaaa

SEQ ID NO: 469423 - RNA, 13 nt, Chlamydia trachomatis
uuggcaagaagcu

SEQ ID NO: 469424 - RNA, 22 nt, Chlamydia trachomatis
uuggcaagaagcugcaguuucu

SEQ ID NO: 469425 - RNA, 16 nt, Chlamydia trachomatis
uuggcaauggcaaaau

SEQ ID NO: 469426 - RNA, 18 nt, Chlamydia trachomatis
uuggauaacgucauugcu

SEQ ID NO: 469427 - RNA, 13 nt, Chlamydia trachomatis
uuggaucucuuag

SEQ ID NO: 469428 - RNA, 21 nt, Chlamydia trachomatis
uugcuggguuuuaucaagaga

SEQ ID NO: 469429 - RNA, 17 nt, Chlamydia trachomatis
uugcuguauagaguaag

SEQ ID NO: 469430 - RNA, 13 nt, Chlamydia trachomatis
uuggcucuuuaau

SEQ ID NO: 469431 - RNA, 17 nt, Chlamydia trachomatis
uuggcuucuuuuuucuu

SEQ ID NO: 469432 - RNA, 21 nt, Chlamydia trachomatis
uuggugagugcauagagauag

SEQ ID NO: 469433 - RNA, 17 nt, Chlamydia trachomatis
uuggucgggaaacauuc

SEQ ID NO: 469434 - RNA, 13 nt, Chlamydia trachomatis
uugggugacugcg

SEQ ID NO: 469435 - RNA, 16 nt, Chlamydia trachomatis
uugucuuagaagaucc

SEQ ID NO: 469436 - RNA, 18 nt, Chlamydia trachomatis
uugugaaaagggcaaaac

SEQ ID NO: 469437 - RNA, 20 nt, Chlamydia trachomatis
uugugaaaagggcaaaacuc

SEQ ID NO: 469438 - RNA, 14 nt, Chlamydia trachomatis
uugucaaggcuccg

SEQ ID NO: 469439 - RNA, 22 nt, Chlamydia trachomatis
uugucaaggcuccguucaaagc

SEQ ID NO: 469440 - RNA, 18 nt, Chlamydia trachomatis
uuguccuggccaaaaaau

SEQ ID NO: 469441 - RNA, 21 nt, Chlamydia trachomatis
uugucgaauuuuucugcuaga

SEQ ID NO: 469442 - RNA, 21 nt, Chlamydia trachomatis
uugucgauaacgaagcaaaac

SEQ ID NO: 469443 - RNA, 23 nt, Chlamydia trachomatis
uuguagugaaguucccuuuacaa

SEQ ID NO: 469444 - RNA, 21 nt, Chlamydia trachomatis
uuguaguugcgccuucugcug

SEQ ID NO: 469445 - RNA, 23 nt, Chlamydia trachomatis
uuguaaagcauucguuaucaaua

SEQ ID NO: 469446 - RNA, 16 nt, Chlamydia trachomatis
uuguaaauagacuucu

SEQ ID NO: 469447 - RNA, 19 nt, Chlamydia trachomatis
uuguaaauagacuucuucg

SEQ ID NO: 469448 - RNA, 18 nt, Chlamydia trachomatis
uuguagaccuaagcuaug

SEQ ID NO: 469449 - RNA, 22 nt, Chlamydia trachomatis
uuguagaccuaagcuauguaaa

SEQ ID NO: 469450 - RNA, 22 nt, Chlamydia trachomatis
uuguagauacugguaacugugg

SEQ ID NO: 469451 - RNA, 18 nt, Chlamydia trachomatis
uuguugcuaaccguucuu

SEQ ID NO: 469452 - RNA, 16 nt, Chlamydia trachomatis
uuguuuagcauuucuu

SEQ ID NO: 469453 - RNA, 18 nt, Chlamydia trachomatis
uuguuuauuaucuagaaa

SEQ ID NO: 469454 - RNA, 16 nt, Chlamydia trachomatis
uuguggguuuggaaau

SEQ ID NO: 469455 - RNA, 15 nt, Chlamydia trachomatis
uugugugaugaaccc

SEQ ID NO: 469456 - RNA, 13 nt, Chlamydia trachomatis
uuguuuuuuucaa

SEQ ID NO: 469457 - RNA, 23 nt, Chlamydia trachomatis
uuuaaagggggacaaaaauacuu

SEQ ID NO: 469458 - RNA, 20 nt, Chlamydia trachomatis
uuuaacuucccacucauccu

SEQ ID NO: 469459 - RNA, 22 nt, Chlamydia trachomatis
uuuaagaccuaguaagugcaua

SEQ ID NO: 469460 - RNA, 15 nt, Chlamydia trachomatis
uuuaagaguuuuuug

SEQ ID NO: 469461 - RNA, 19 nt, Chlamydia trachomatis
uuuaagggaauagccuaug

SEQ ID NO: 469462 - RNA, 22 nt, Chlamydia trachomatis
uuuaagguuucuauacgcacau

SEQ ID NO: 469463 - RNA, 14 nt, Chlamydia trachomatis
uuuaauauuuuuug

SEQ ID NO: 469464 - RNA, 20 nt, Chlamydia trachomatis
uuuacaauagguuuaaauaa

SEQ ID NO: 469465 - RNA, 14 nt, Chlamydia trachomatis
uuuacaaucaucuu

SEQ ID NO: 469466 - RNA, 20 nt, Chlamydia trachomatis
uuuacaauguacgcuaaaaa

SEQ ID NO: 469467 - RNA, 21 nt, Chlamydia trachomatis
uuuacaauguacgcuaaaaac

SEQ ID NO: 469468 - RNA, 18 nt, Chlamydia trachomatis
uuuugagcaaaauaguca

SEQ ID NO: 469469 - RNA, 14 nt, Chlamydia trachomatis
uuuugcaaaaauuu

SEQ ID NO: 469470 - RNA, 16 nt, Chlamydia trachomatis
uuuugcaacaaagcuu

SEQ ID NO: 469471 - RNA, 21 nt, Chlamydia trachomatis
uuuugcaaucauuugugugcc

SEQ ID NO: 469472 - RNA, 18 nt, Chlamydia trachomatis
uuuugcacaaaggaacau

SEQ ID NO: 469473 - RNA, 17 nt, Chlamydia trachomatis
uuuucggagaagaagag

SEQ ID NO: 469474 - RNA, 21 nt, Chlamydia trachomatis
uuuucgaauuuuuuucuuugc

SEQ ID NO: 469475 - RNA, 19 nt, Chlamydia trachomatis
uuuucgauagaaaaaaaca

SEQ ID NO: 469476 - RNA, 11 nt, Chlamydia trachomatis
uuuucuucuuu

SEQ ID NO: 469477 - RNA, 23 nt, Chlamydia trachomatis
uuuucuugugauaucuccaccau

SEQ ID NO: 469478 - RNA, 17 nt, Chlamydia trachomatis
uuuucagaaaaaguaag

SEQ ID NO: 469479 - RNA, 16 nt, Chlamydia trachomatis
uuuucagcaagaacag

SEQ ID NO: 469480 - RNA, 17 nt, Chlamydia trachomatis
uuuucaguuucaaacau

SEQ ID NO: 469481 - RNA, 13 nt, Chlamydia trachomatis
uuuucauccacuu

SEQ ID NO: 469482 - RNA, 14 nt, Chlamydia trachomatis
uuuucaugcaagua

SEQ ID NO: 469483 - RNA, 13 nt, Chlamydia trachomatis
uuuuccucuucac

SEQ ID NO: 469484 - RNA, 22 nt, Chlamydia trachomatis
uuuugcuaaccaaacaggagau

SEQ ID NO: 469485 - RNA, 14 nt, Chlamydia trachomatis
uuuuguacgacaaa

SEQ ID NO: 469486 - RNA, 18 nt, Chlamydia trachomatis
uuuuguaguugcgccuuc

SEQ ID NO: 469487 - RNA, 16 nt, Chlamydia trachomatis
uuuuguguuuccaaag

SEQ ID NO: 469488 - RNA, 15 nt, Chlamydia trachomatis
uuuuguuauccaaaa

SEQ ID NO: 469489 - RNA, 22 nt, Chlamydia trachomatis
uuuuguuuaaucagugugugua

SEQ ID NO: 469490 - RNA, 16 nt, Chlamydia trachomatis
uuuuuaaaagaccaua

SEQ ID NO: 469491 - RNA, 22 nt, Chlamydia trachomatis
uuuuuaaaagagucgcuucugg

SEQ ID NO: 469492 - RNA, 12 nt, Chlamydia trachomatis
uuuuuaaaauaa

SEQ ID NO: 469493 - RNA, 15 nt, Chlamydia trachomatis
uuuuuaauauccucc

SEQ ID NO: 469494 - RNA, 13 nt, Chlamydia trachomatis
uuuuuaauuuucu

SEQ ID NO: 469495 - RNA, 13 nt, Chlamydia trachomatis
uuuuuacaaugua

SEQ ID NO: 469496 - RNA, 19 nt, Chlamydia trachomatis
uuuuuagcaaccuuaucuu

SEQ ID NO: 469497 - RNA, 20 nt, Chlamydia trachomatis
uuuuuagcaucugauacuga

SEQ ID NO: 469498 - RNA, 22 nt, Chlamydia trachomatis
uuuuuaggauucauauuccaaa

SEQ ID NO: 469499 - RNA, 14 nt, Chlamydia trachomatis
uuuuuauaaucucc

SEQ ID NO: 469500 - RNA, 13 nt, Chlamydia trachomatis
uuuuuauccaaaa

SEQ ID NO: 469501 - RNA, 22 nt, Chlamydia trachomatis
uuuuucaagaggcuuaaagaua

SEQ ID NO: 469502 - RNA, 15 nt, Chlamydia trachomatis
uuuuucagacaaaaa

SEQ ID NO: 469503 - RNA, 18 nt, Chlamydia trachomatis
uuuuucagcaauaauacc

SEQ ID NO: 469504 - RNA, 12 nt, Chlamydia trachomatis
uuuuuuucccac

SEQ ID NO: 469505 - RNA, 22 nt, Chlamydia trachomatis
uuuuucaggagaaaggcuuugu

SEQ ID NO: 469506 - RNA, 21 nt, Chlamydia trachomatis
uuuuucagggauagaaacucc

SEQ ID NO: 469507 - RNA, 11 nt, Chlamydia trachomatis
uuuuuucagga

SEQ ID NO: 469508 - RNA, 13 nt, Chlamydia trachomatis
uuuuuucuuugcu

SEQ ID NO: 469509 - RNA, 19 nt, Chlamydia trachomatis
uuuuuugagcaaaauaguc

SEQ ID NO: 469510 - RNA, 13 nt, Chlamydia trachomatis
aaauacacagcau

SEQ ID NO: 469511 - RNA, 15 nt, Chlamydia trachomatis
aaauacacagcauca

SEQ ID NO: 469512 - RNA, 16 nt, Chlamydia trachomatis
aaauacaaaucuuuua

SEQ ID NO: 469513 - RNA, 18 nt, Chlamydia trachomatis
aaauaauuuccugacucg

SEQ ID NO: 469514 - RNA, 14 nt, Chlamydia trachomatis
aaauaccaaaauau

SEQ ID NO: 469515 - RNA, 20 nt, Chlamydia trachomatis
aaauaccaaaauaucauaau

SEQ ID NO: 469516 - RNA, 14 nt, Chlamydia trachomatis
aaauaccacucauu

SEQ ID NO: 469517 - RNA, 15 nt, Chlamydia trachomatis
aaauaccacucauua

SEQ ID NO: 469518 - RNA, 18 nt, Chlamydia trachomatis
aaauauaggguccaaaca

SEQ ID NO: 469519 - RNA, 14 nt, Chlamydia trachomatis
aaauaucaauuccu

SEQ ID NO: 469520 - RNA, 15 nt, Chlamydia trachomatis
aaauauccagaguca

SEQ ID NO: 469521 - RNA, 14 nt, Chlamydia trachomatis
aaauaucuugaguc

SEQ ID NO: 469522 - RNA, 13 nt, Chlamydia trachomatis
aaaguguuuagaa

SEQ ID NO: 469523 - RNA, 17 nt, Chlamydia trachomatis
aaaguggcguuguuucu

SEQ ID NO: 469524 - RNA, 23 nt, Chlamydia trachomatis
aaagugcauaccuuuugcaauca

SEQ ID NO: 469525 - RNA, 19 nt, Chlamydia trachomatis
aaaguaagaccgagauuau

SEQ ID NO: 469526 - RNA, 13 nt, Chlamydia trachomatis
aaaguaaguaaaa

SEQ ID NO: 469527 - RNA, 15 nt, Chlamydia trachomatis
aaaguaaucucuuaa

SEQ ID NO: 469528 - RNA, 20 nt, Chlamydia trachomatis
aaaguagacgaaguaggaga

SEQ ID NO: 469529 - RNA, 15 nt, Chlamydia trachomatis
aaaguagcaaucacu

SEQ ID NO: 469530 - RNA, 19 nt, Chlamydia trachomatis
aaaguagcuacuuucgcuu

SEQ ID NO: 469531 - RNA, 18 nt, Chlamydia trachomatis
aaaguaguccuaucacca

SEQ ID NO: 469532 - RNA, 19 nt, Chlamydia trachomatis
aaagucuccauaagaaugu

SEQ ID NO: 469533 - RNA, 17 nt, Chlamydia trachomatis
aaagucucgaauucuau

SEQ ID NO: 469534 - RNA, 23 nt, Chlamydia trachomatis
aaagucuuaaaaggguagaaaaa

SEQ ID NO: 469535 - RNA, 20 nt, Chlamydia trachomatis
aaaguucucucccuuccuga

SEQ ID NO: 469536 - RNA, 17 nt, Chlamydia trachomatis
aaaguugguagaggaga

SEQ ID NO: 469537 - RNA, 22 nt, Chlamydia trachomatis
aaaguuuccuuaaaguuugcug

SEQ ID NO: 469538 - RNA, 18 nt, Chlamydia trachomatis
aaaguuugcuggguuuua

SEQ ID NO: 469539 - RNA, 18 nt, Chlamydia trachomatis
aaaguuuucuugguuucu

SEQ ID NO: 469540 - RNA, 14 nt, Chlamydia trachomatis
aaaguuuuuucccc

SEQ ID NO: 469541 - RNA, 12 nt, Chlamydia trachomatis
aaauaaagaaau

SEQ ID NO: 469542 - RNA, 19 nt, Chlamydia trachomatis
aaagaagccuucuuccuug

SEQ ID NO: 469543 - RNA, 12 nt, Chlamydia trachomatis
aaagaaucaaaa

SEQ ID NO: 469544 - RNA, 22 nt, Chlamydia trachomatis
aaagaaucccucuagcaaccaa

SEQ ID NO: 469545 - RNA, 18 nt, Chlamydia trachomatis
aaagaaucuaaaaagcca

SEQ ID NO: 469546 - RNA, 16 nt, Chlamydia trachomatis
aaagaaucuccuguac

SEQ ID NO: 469547 - RNA, 16 nt, Chlamydia trachomatis
aaagaaugaccaguuu

SEQ ID NO: 469548 - RNA, 13 nt, Chlamydia trachomatis
aaagaauuugcuu

SEQ ID NO: 469549 - RNA, 20 nt, Chlamydia trachomatis
aaagaaaugcguuucuucug

SEQ ID NO: 469550 - RNA, 17 nt, Chlamydia trachomatis
aaagaacaagauccuuc

SEQ ID NO: 469551 - RNA, 23 nt, Chlamydia trachomatis
aaagaaccucaauagcugacuuu

SEQ ID NO: 469552 - RNA, 20 nt, Chlamydia trachomatis
aaagaacguuucgucucuuu

SEQ ID NO: 469553 - RNA, 21 nt, Chlamydia trachomatis
aaagaacuuccuauuagggaa

SEQ ID NO: 469554 - RNA, 19 nt, Chlamydia trachomatis
aaaccuaauagaaauagcu

SEQ ID NO: 469555 - RNA, 16 nt, Chlamydia trachomatis
aaaccuccagaaggga

SEQ ID NO: 469556 - RNA, 11 nt, Chlamydia trachomatis
aaagaaaaauc

SEQ ID NO: 469557 - RNA, 13 nt, Chlamydia trachomatis
aaagaaaaggcug

SEQ ID NO: 469558 - RNA, 18 nt, Chlamydia trachomatis
aaagaaagccguucccaa

SEQ ID NO: 469559 - RNA, 17 nt, Chlamydia trachomatis
aaagaaagccuucucuu

SEQ ID NO: 469560 - RNA, 13 nt, Chlamydia trachomatis
aaagaaagcuuau

SEQ ID NO: 469561 - RNA, 13 nt, Chlamydia trachomatis
aaagaucuucaac

SEQ ID NO: 469562 - RNA, 21 nt, Chlamydia trachomatis
aaagaucuucaacaagauuuc

SEQ ID NO: 469563 - RNA, 19 nt, Chlamydia trachomatis
aaagaucgguucauaaaau

SEQ ID NO: 469564 - RNA, 15 nt, Chlamydia trachomatis
aaagaggucuuuuaa

SEQ ID NO: 469565 - RNA, 17 nt, Chlamydia trachomatis
aaagagucgcuucuggc

SEQ ID NO: 469566 - RNA, 15 nt, Chlamydia trachomatis
aaagaggacgagcga

SEQ ID NO: 469567 - RNA, 14 nt, Chlamydia trachomatis
aaagaggagaacau

SEQ ID NO: 469568 - RNA, 14 nt, Chlamydia trachomatis
aaagagcuuuucuu

SEQ ID NO: 469569 - RNA, 14 nt, Chlamydia trachomatis
aaagacaaaacuuc

SEQ ID NO: 469570 - RNA, 18 nt, Chlamydia trachomatis
aaagauccucuuucgcuu

SEQ ID NO: 469571 - RNA, 19 nt, Chlamydia trachomatis
aaaguaacuacggaaaaag

SEQ ID NO: 469572 - RNA, 15 nt, Chlamydia trachomatis
aaaguaagcgaagaa

SEQ ID NO: 469573 - RNA, 12 nt, Chlamydia trachomatis
aaagggaaaaaa

SEQ ID NO: 469574 - RNA, 21 nt, Chlamydia trachomatis
aaaggcucuaucggaauagca

SEQ ID NO: 469575 - RNA, 19 nt, Chlamydia trachomatis
aaaggcuguugugggagau

SEQ ID NO: 469576 - RNA, 15 nt, Chlamydia trachomatis
aaaggcuuauucucu

SEQ ID NO: 469577 - RNA, 15 nt, Chlamydia trachomatis
aaaggcgcagcuuuc

SEQ ID NO: 469578 - RNA, 19 nt, Chlamydia trachomatis
aaaggaugucuaucuagau

SEQ ID NO: 469579 - RNA, 18 nt, Chlamydia trachomatis
aaaggagcccaagcuuuc

SEQ ID NO: 469580 - RNA, 16 nt, Chlamydia trachomatis
aaaggauagacuggca

SEQ ID NO: 469581 - RNA, 20 nt, Chlamydia trachomatis
aaagcuuucccguauuuacc

SEQ ID NO: 469582 - RNA, 19 nt, Chlamydia trachomatis
aaagcuuuucuccuucuuu

SEQ ID NO: 469583 - RNA, 23 nt, Chlamydia trachomatis
aaagcuuuuuccaaagcuucuaa

SEQ ID NO: 469584 - RNA, 19 nt, Chlamydia trachomatis
aaagcuuuuucuacuguag

SEQ ID NO: 469585 - RNA, 20 nt, Chlamydia trachomatis
aaagcuuuuucuacuguagc

SEQ ID NO: 469586 - RNA, 13 nt, Chlamydia trachomatis
aaaggaaacaaau

SEQ ID NO: 469587 - RNA, 17 nt, Chlamydia trachomatis
aaaggaaacaagcagau

SEQ ID NO: 469588 - RNA, 19 nt, Chlamydia trachomatis
aaagcuucccuucucugcu

SEQ ID NO: 469589 - RNA, 21 nt, Chlamydia trachomatis
aaagcucugaguuaaaggaag

SEQ ID NO: 469590 - RNA, 17 nt, Chlamydia trachomatis
aaagcaucuuuaccauu

SEQ ID NO: 469591 - RNA, 21 nt, Chlamydia trachomatis
aaagcaucuuuaccauuucca

SEQ ID NO: 469592 - RNA, 14 nt, Chlamydia trachomatis
aaagcauccccaaa

SEQ ID NO: 469593 - RNA, 22 nt, Chlamydia trachomatis
aaagcauccccaaaaggauuga

SEQ ID NO: 469594 - RNA, 21 nt, Chlamydia trachomatis
aaagccuucucuuuucacaaa

SEQ ID NO: 469595 - RNA, 17 nt, Chlamydia trachomatis
aaagccgucaaucaguu

SEQ ID NO: 469596 - RNA, 13 nt, Chlamydia trachomatis
aaagccugugccu

SEQ ID NO: 469597 - RNA, 19 nt, Chlamydia trachomatis
aaagcuaucccaaaagaau

SEQ ID NO: 469598 - RNA, 16 nt, Chlamydia trachomatis
aaagcuauucccacua

SEQ ID NO: 469599 - RNA, 14 nt, Chlamydia trachomatis
aaagcuauuuucuu

SEQ ID NO: 469600 - RNA, 22 nt, Chlamydia trachomatis
aaagcuauuuucuuccugcuuc

SEQ ID NO: 469601 - RNA, 12 nt, Chlamydia trachomatis
aaagcuccuaaa

SEQ ID NO: 469602 - RNA, 20 nt, Chlamydia trachomatis
aaauccauucgcauuaaaua

SEQ ID NO: 469603 - RNA, 19 nt, Chlamydia trachomatis
aaauccagcgugucuacca

SEQ ID NO: 469604 - RNA, 20 nt, Chlamydia trachomatis
aaaucccaucaaaagcuauc

SEQ ID NO: 469605 - RNA, 18 nt, Chlamydia trachomatis
aaauauggggccagcaua

SEQ ID NO: 469606 - RNA, 15 nt, Chlamydia trachomatis
aaaucccuucccagc

SEQ ID NO: 469607 - RNA, 19 nt, Chlamydia trachomatis
aaauccuacacaagcuuuu

SEQ ID NO: 469608 - RNA, 23 nt, Chlamydia trachomatis
aaauccuauacccgacuaaaaaa

SEQ ID NO: 469609 - RNA, 22 nt, Chlamydia trachomatis
aaauccucuuugaauauccgaa

SEQ ID NO: 469610 - RNA, 11 nt, Chlamydia trachomatis
aaauccugcuu

SEQ ID NO: 469611 - RNA, 23 nt, Chlamydia trachomatis
aaaucgaaacuguugacaucacc

SEQ ID NO: 469612 - RNA, 17 nt, Chlamydia trachomatis
aaaucgaggugauuuuc

SEQ ID NO: 469613 - RNA, 12 nt, Chlamydia trachomatis
aaaucuucuucu

SEQ ID NO: 469614 - RNA, 21 nt, Chlamydia trachomatis
aaaucuucuucuaagcuagaa

SEQ ID NO: 469615 - RNA, 22 nt, Chlamydia trachomatis
aaaucuucuucuaagcuagaaa

SEQ ID NO: 469616 - RNA, 14 nt, Chlamydia trachomatis
aaaucugcaagaac

SEQ ID NO: 469617 - RNA, 21 nt, Chlamydia trachomatis
aaaucugcaagaacaaagaau

SEQ ID NO: 469618 - RNA, 17 nt, Chlamydia trachomatis
aaaucugcuaaggccuu

SEQ ID NO: 469619 - RNA, 12 nt, Chlamydia trachomatis
aaaucgugcuau

SEQ ID NO: 469620 - RNA, 19 nt, Chlamydia trachomatis
aaaucucuuuuaccucuaa

SEQ ID NO: 469621 - RNA, 21 nt, Chlamydia trachomatis
aaaucuuucuuucuaagaaau

SEQ ID NO: 469622 - RNA, 23 nt, Chlamydia trachomatis
aaaugaaggccaaagaaauagcu

SEQ ID NO: 469623 - RNA, 13 nt, Chlamydia trachomatis
aaaugaauuccaa

SEQ ID NO: 469624 - RNA, 21 nt, Chlamydia trachomatis
aaaugaggacagaguucucug

SEQ ID NO: 469625 - RNA, 13 nt, Chlamydia trachomatis
aaaugcaaauuug

SEQ ID NO: 469626 - RNA, 15 nt, Chlamydia trachomatis
aaaugcaaagcuuuu

SEQ ID NO: 469627 - RNA, 21 nt, Chlamydia trachomatis
aaaugcaaagcuuuucuccuu

SEQ ID NO: 469628 - RNA, 14 nt, Chlamydia trachomatis
aaauggucucuucu

SEQ ID NO: 469629 - RNA, 16 nt, Chlamydia trachomatis
aaauggucucuucucc

SEQ ID NO: 469630 - RNA, 21 nt, Chlamydia trachomatis
aaauguuugaucugagaaagc

SEQ ID NO: 469631 - RNA, 22 nt, Chlamydia trachomatis
aaauguuuuugaugaggcuugu

SEQ ID NO: 469632 - RNA, 17 nt, Chlamydia trachomatis
aaauuauaaugaaagag

SEQ ID NO: 469633 - RNA, 22 nt, Chlamydia trachomatis
aaauuagaacggcauucccauu

SEQ ID NO: 469634 - RNA, 12 nt, Chlamydia trachomatis
aaaaagaggaga

SEQ ID NO: 469635 - RNA, 21 nt, Chlamydia trachomatis
aaaaagaggucuuauuaaaag

SEQ ID NO: 469636 - RNA, 14 nt, Chlamydia trachomatis
aaaaagaucuucaa

SEQ ID NO: 469637 - RNA, 19 nt, Chlamydia trachomatis
aaaaagaucuucaacaaga

SEQ ID NO: 469638 - RNA, 23 nt, Chlamydia trachomatis
aaaaagaucuucaacaagauuuc

SEQ ID NO: 469639 - RNA, 18 nt, Chlamydia trachomatis
aaaaagauggagaggagu

SEQ ID NO: 469640 - RNA, 17 nt, Chlamydia trachomatis
aaaaagauuuccccuuu

SEQ ID NO: 469641 - RNA, 14 nt, Chlamydia trachomatis
aacaaauaacuuuu

SEQ ID NO: 469642 - RNA, 16 nt, Chlamydia trachomatis
aacaaauaccaaaaua

SEQ ID NO: 469643 - RNA, 17 nt, Chlamydia trachomatis
aacaaauaccaaaauau

SEQ ID NO: 469644 - RNA, 12 nt, Chlamydia trachomatis
aacaacaaucaa

SEQ ID NO: 469645 - RNA, 20 nt, Chlamydia trachomatis
aacaacacugacuauuccug

SEQ ID NO: 469646 - RNA, 19 nt, Chlamydia trachomatis
aacaacaugggcauagucu

SEQ ID NO: 469647 - RNA, 18 nt, Chlamydia trachomatis
aacaaccauaauacgaau

SEQ ID NO: 469648 - RNA, 15 nt, Chlamydia trachomatis
aacaaccaucaaagc

SEQ ID NO: 469649 - RNA, 16 nt, Chlamydia trachomatis
aacaagauuuuuuaca

SEQ ID NO: 469650 - RNA, 14 nt, Chlamydia trachomatis
aacaagccuuuaag

SEQ ID NO: 469651 - RNA, 12 nt, Chlamydia trachomatis
aacaagagccaa

SEQ ID NO: 469652 - RNA, 16 nt, Chlamydia trachomatis
aacaacuucaauagca

SEQ ID NO: 469653 - RNA, 13 nt, Chlamydia trachomatis
aacaacuucucuu

SEQ ID NO: 469654 - RNA, 15 nt, Chlamydia trachomatis
aacaacugcucugcc

SEQ ID NO: 469655 - RNA, 20 nt, Chlamydia trachomatis
aacaacuugaucuacagcaa

SEQ ID NO: 469656 - RNA, 11 nt, Chlamydia trachomatis
aaauuuucaca

SEQ ID NO: 469657 - RNA, 13 nt, Chlamydia trachomatis
aaauuuucaugaa

SEQ ID NO: 469658 - RNA, 19 nt, Chlamydia trachomatis
aaauuuucaugaaaagcuu

SEQ ID NO: 469659 - RNA, 22 nt, Chlamydia trachomatis
aaauuuuguuuaaucagugugu

SEQ ID NO: 469660 - RNA, 13 nt, Chlamydia trachomatis
aacaaaaacucuc

SEQ ID NO: 469661 - RNA, 15 nt, Chlamydia trachomatis
aacaaaaccaaaauc

SEQ ID NO: 469662 - RNA, 13 nt, Chlamydia trachomatis
aacaaaaccaaaa

SEQ ID NO: 469663 - RNA, 21 nt, Chlamydia trachomatis
aacaaaacgaagccaaaagau

SEQ ID NO: 469664 - RNA, 12 nt, Chlamydia trachomatis
aacaaacaacac

SEQ ID NO: 469665 - RNA, 11 nt, Chlamydia trachomatis
aacaaaccaau

SEQ ID NO: 469666 - RNA, 21 nt, Chlamydia trachomatis
aacaaagcacuguccacauua

SEQ ID NO: 469667 - RNA, 20 nt, Chlamydia trachomatis
aacaaagcucuagcaauaga

SEQ ID NO: 469668 - RNA, 22 nt, Chlamydia trachomatis
aacaaagcucuagcaauagaga

SEQ ID NO: 469669 - RNA, 15 nt, Chlamydia trachomatis
aaauugagaacauaa

SEQ ID NO: 469670 - RNA, 12 nt, Chlamydia trachomatis
aaauugcaaaga

SEQ ID NO: 469671 - RNA, 15 nt, Chlamydia trachomatis
aaauugucgaauuuu

SEQ ID NO: 469672 - RNA, 20 nt, Chlamydia trachomatis
aaauuuaucugcuaaagaaa

SEQ ID NO: 469673 - RNA, 20 nt, Chlamydia trachomatis
aaauuucuauagaagaauuc

SEQ ID NO: 469674 - RNA, 16 nt, Chlamydia trachomatis
aaauuucucuaggaac

SEQ ID NO: 469675 - RNA, 22 nt, Chlamydia trachomatis
aaauuuggcaauggcaaaaucu

SEQ ID NO: 469676 - RNA, 18 nt, Chlamydia trachomatis
aaaaugagaaauaaaaac

SEQ ID NO: 469677 - RNA, 21 nt, Chlamydia trachomatis
aaaauuacaauaauacaaagc

SEQ ID NO: 469678 - RNA, 23 nt, Chlamydia trachomatis
aaaauuacaauaauacaaagcac

SEQ ID NO: 469679 - RNA, 14 nt, Chlamydia trachomatis
aaaauucuacaaca

SEQ ID NO: 469680 - RNA, 20 nt, Chlamydia trachomatis
aaaauucuguacgucugcaa

SEQ ID NO: 469681 - RNA, 18 nt, Chlamydia trachomatis
aaaaucugccgagcauug

SEQ ID NO: 469682 - RNA, 15 nt, Chlamydia trachomatis
aaaaucuucaaugcu

SEQ ID NO: 469683 - RNA, 22 nt, Chlamydia trachomatis
aaaaucuucaaugcuguuucag

SEQ ID NO: 469684 - RNA, 18 nt, Chlamydia trachomatis
aaaaucuucauaagaaaa

SEQ ID NO: 469685 - RNA, 22 nt, Chlamydia trachomatis
aaaaucuucauaagaaaauucu

SEQ ID NO: 469686 - RNA, 20 nt, Chlamydia trachomatis
aaaaucuucuggagcaacuu

SEQ ID NO: 469687 - RNA, 19 nt, Chlamydia trachomatis
aaaaucuugucguuccucu

SEQ ID NO: 469688 - RNA, 23 nt, Chlamydia trachomatis
aaaaucacuuucugcuuggaccu

SEQ ID NO: 469689 - RNA, 14 nt, Chlamydia trachomatis
aaaaucagcaaaug

SEQ ID NO: 469690 - RNA, 18 nt, Chlamydia trachomatis
aaaaucagcaaaugugga

SEQ ID NO: 469691 - RNA, 20 nt, Chlamydia trachomatis
aaaauacagcggauuagucg

SEQ ID NO: 469692 - RNA, 15 nt, Chlamydia trachomatis
aaaauaugauuacug

SEQ ID NO: 469693 - RNA, 20 nt, Chlamydia trachomatis
aaaauauggggccagcauau

SEQ ID NO: 469694 - RNA, 16 nt, Chlamydia trachomatis
aaaagucuguuccuaa

SEQ ID NO: 469695 - RNA, 13 nt, Chlamydia trachomatis
aaaaguuuucgaa

SEQ ID NO: 469696 - RNA, 12 nt, Chlamydia trachomatis
aaaauaaaaaaa

SEQ ID NO: 469697 - RNA, 15 nt, Chlamydia trachomatis
aaaauaaaaaaaaag

SEQ ID NO: 469698 - RNA, 13 nt, Chlamydia trachomatis
aaaauaaagaaau

SEQ ID NO: 469699 - RNA, 17 nt, Chlamydia trachomatis
aaaauaaagaaauuauc

SEQ ID NO: 469700 - RNA, 20 nt, Chlamydia trachomatis
aaaauaacgauucuugauaa

SEQ ID NO: 469701 - RNA, 16 nt, Chlamydia trachomatis
aaaaggcguaaaccuu

SEQ ID NO: 469702 - RNA, 19 nt, Chlamydia trachomatis
aaaaggcguaaaccuucuu

SEQ ID NO: 469703 - RNA, 14 nt, Chlamydia trachomatis
aaaaggcuacuaaa

SEQ ID NO: 469704 - RNA, 16 nt, Chlamydia trachomatis
aaaaggcuacuaaaga

SEQ ID NO: 469705 - RNA, 16 nt, Chlamydia trachomatis
aaaagggcaaaacucc

SEQ ID NO: 469706 - RNA, 17 nt, Chlamydia trachomatis
aaaaggaaucuguccaa

SEQ ID NO: 469707 - RNA, 23 nt, Chlamydia trachomatis
aaaaggaaucuguccaaagagau

SEQ ID NO: 469708 - RNA, 11 nt, Chlamydia trachomatis
aaaaggauggc

SEQ ID NO: 469709 - RNA, 17 nt, Chlamydia trachomatis
aaaaggguagaaaaaga

SEQ ID NO: 469710 - RNA, 18 nt, Chlamydia trachomatis
aaaaggguagaaaaagag

SEQ ID NO: 469711 - RNA, 20 nt, Chlamydia trachomatis
aaaaggugguacuucauuuu

SEQ ID NO: 469712 - RNA, 16 nt, Chlamydia trachomatis
aaaacgcucagaaaac

SEQ ID NO: 469713 - RNA, 17 nt, Chlamydia trachomatis
aaaacgcucagaaaacu

SEQ ID NO: 469714 - RNA, 15 nt, Chlamydia trachomatis
aaaacgcuccaaaua

SEQ ID NO: 469715 - RNA, 17 nt, Chlamydia trachomatis
aaaacgcuccaaauaaa

SEQ ID NO: 469716 - RNA, 22 nt, Chlamydia trachomatis
aaaacgcuccaaauaaaacgaa

SEQ ID NO: 469717 - RNA, 17 nt, Chlamydia trachomatis
aaaacgcucuccaaaga

SEQ ID NO: 469718 - RNA, 17 nt, Chlamydia trachomatis
aaaagcgcuccuaguga

SEQ ID NO: 469719 - RNA, 14 nt, Chlamydia trachomatis
aaaaccuuuugaaa

SEQ ID NO: 469720 - RNA, 16 nt, Chlamydia trachomatis
aaaacgauaaaaagcu

SEQ ID NO: 469721 - RNA, 16 nt, Chlamydia trachomatis
aaaacgcccuccaaga

SEQ ID NO: 469722 - RNA, 21 nt, Chlamydia trachomatis
aaaagcuucugccauuucuaa

SEQ ID NO: 469723 - RNA, 13 nt, Chlamydia trachomatis
aaaagcuuucaaa

SEQ ID NO: 469724 - RNA, 12 nt, Chlamydia trachomatis
aaaagcuuuucc

SEQ ID NO: 469725 - RNA, 16 nt, Chlamydia trachomatis
aaaagcuuuuuaauca

SEQ ID NO: 469726 - RNA, 22 nt, Chlamydia trachomatis
aaaaagaacucccuccaaaaaa

SEQ ID NO: 469727 - RNA, 23 nt, Chlamydia trachomatis
aaaaagaagcuuuucccuaggua

SEQ ID NO: 469728 - RNA, 13 nt, Chlamydia trachomatis
aaaaagaaucuaa

SEQ ID NO: 469729 - RNA, 15 nt, Chlamydia trachomatis
aaaaagaaucuaaaa

SEQ ID NO: 469730 - RNA, 18 nt, Chlamydia trachomatis
aaaaagaaucuaaaaagc

SEQ ID NO: 469731 - RNA, 24 nt, Chlamydia trachomatis
aaaaagacccagcucauuagagau

SEQ ID NO: 469732 - RNA, 13 nt, Chlamydia trachomatis
aaaagcugggcag

SEQ ID NO: 469733 - RNA, 21 nt, Chlamydia trachomatis
aaaagcugggcagcaagagag

SEQ ID NO: 469734 - RNA, 14 nt, Chlamydia trachomatis
aaaagcucuugucg

SEQ ID NO: 469735 - RNA, 14 nt, Chlamydia trachomatis
aaaagcuaucuuug

SEQ ID NO: 469736 - RNA, 19 nt, Chlamydia trachomatis
aaaaacuucuuccaaauag

SEQ ID NO: 469737 - RNA, 16 nt, Chlamydia trachomatis
aaaaacuuuucuuccu

SEQ ID NO: 469738 - RNA, 11 nt, Chlamydia trachomatis
aaaaagaaaaa

SEQ ID NO: 469739 - RNA, 22 nt, Chlamydia trachomatis
aaacaccucaacgccuguuagu

SEQ ID NO: 469740 - RNA, 22 nt, Chlamydia trachomatis
aaacacgcaacccuaaaucucc

SEQ ID NO: 469741 - RNA, 17 nt, Chlamydia trachomatis
aaacacuacgcuacaga

SEQ ID NO: 469742 - RNA, 13 nt, Chlamydia trachomatis
aaacaauuuccuu

SEQ ID NO: 469743 - RNA, 15 nt, Chlamydia trachomatis
aaacacaaaagcauu

SEQ ID NO: 469744 - RNA, 23 nt, Chlamydia trachomatis
aaaauucuucugauaaauguccc

SEQ ID NO: 469745 - RNA, 22 nt, Chlamydia trachomatis
aaacaagguucuucaacaacuu

SEQ ID NO: 469746 - RNA, 18 nt, Chlamydia trachomatis
aaacaauauucuuuucca

SEQ ID NO: 469747 - RNA, 19 nt, Chlamydia trachomatis
aaacaauauucuuuuccau

SEQ ID NO: 469748 - RNA, 13 nt, Chlamydia trachomatis
aaacaaucuaaaa

SEQ ID NO: 469749 - RNA, 14 nt, Chlamydia trachomatis
aaacaaucuaaaaa

SEQ ID NO: 469750 - RNA, 14 nt, Chlamydia trachomatis
aaacagccaagcaa

SEQ ID NO: 469751 - RNA, 18 nt, Chlamydia trachomatis
aaacagcuucuucuucuc

SEQ ID NO: 469752 - RNA, 22 nt, Chlamydia trachomatis
aaacaggagaaagaaccucaau

SEQ ID NO: 469753 - RNA, 14 nt, Chlamydia trachomatis
aaacagaaagaaau

SEQ ID NO: 469754 - RNA, 20 nt, Chlamydia trachomatis
aaacagacuaaguuguaaaa

SEQ ID NO: 469755 - RNA, 20 nt, Chlamydia trachomatis
aaacagaucuuuuucauuuu

SEQ ID NO: 469756 - RNA, 21 nt, Chlamydia trachomatis
aaacagaucuuuuucauuuua

SEQ ID NO: 469757 - RNA, 11 nt, Chlamydia trachomatis
aaacaguucuu

SEQ ID NO: 469758 - RNA, 13 nt, Chlamydia trachomatis
aaacauaacaccc

SEQ ID NO: 469759 - RNA, 21 nt, Chlamydia trachomatis
aaacauauguccauacaaagg

SEQ ID NO: 469760 - RNA, 20 nt, Chlamydia trachomatis
aaacccucugcauagcuaua

SEQ ID NO: 469761 - RNA, 14 nt, Chlamydia trachomatis
aaaccgaagaggga

SEQ ID NO: 469762 - RNA, 12 nt, Chlamydia trachomatis
aaaccgaauaau

SEQ ID NO: 469763 - RNA, 14 nt, Chlamydia trachomatis
aaaccgaauguuag

SEQ ID NO: 469764 - RNA, 15 nt, Chlamydia trachomatis
aaaccgaauguuagu

SEQ ID NO: 469765 - RNA, 15 nt, Chlamydia trachomatis
aaaccccaauguuuc

SEQ ID NO: 469766 - RNA, 15 nt, Chlamydia trachomatis
aaaccaguuucuucu

SEQ ID NO: 469767 - RNA, 16 nt, Chlamydia trachomatis
aaaccagcucaucaaa

SEQ ID NO: 469768 - RNA, 20 nt, Chlamydia trachomatis
aaacauccaguaauuuaucu

SEQ ID NO: 469769 - RNA, 17 nt, Chlamydia trachomatis
aaacauccaugucuaag

SEQ ID NO: 469770 - RNA, 16 nt, Chlamydia trachomatis
aaacaucccagcaaua

SEQ ID NO: 469771 - RNA, 21 nt, Chlamydia trachomatis
aaacaucccagcaauaccgaa

SEQ ID NO: 469772 - RNA, 15 nt, Chlamydia trachomatis
aaacaucuuuuaaag

SEQ ID NO: 469773 - RNA, 16 nt, Chlamydia trachomatis
aaacaucuuuuaaagu

SEQ ID NO: 469774 - RNA, 18 nt, Chlamydia trachomatis
aaacaucuuuuaaaguaa

SEQ ID NO: 469775 - RNA, 16 nt, Chlamydia trachomatis
aaacaugauuaauucu

SEQ ID NO: 469776 - RNA, 15 nt, Chlamydia trachomatis
aaacauuccaaauau

SEQ ID NO: 469777 - RNA, 16 nt, Chlamydia trachomatis
aaacauucgaaucauu

SEQ ID NO: 469778 - RNA, 18 nt, Chlamydia trachomatis
aaacauuucugcaacucu

SEQ ID NO: 469779 - RNA, 17 nt, Chlamydia trachomatis
aaaccaacaagagccaa

SEQ ID NO: 469780 - RNA, 22 nt, Chlamydia trachomatis
aaacauuugcgugauaaaaacu

SEQ ID NO: 469781 - RNA, 12 nt, Chlamydia trachomatis
aaacauuuugag

SEQ ID NO: 469782 - RNA, 15 nt, Chlamydia trachomatis
aaaccaaaaauauca

SEQ ID NO: 469783 - RNA, 12 nt, Chlamydia trachomatis
aaaccaauuaag

SEQ ID NO: 469784 - RNA, 20 nt, Chlamydia trachomatis
aaaccaauuguugagcagca

SEQ ID NO: 469785 - RNA, 12 nt, Chlamydia trachomatis
aaaacaaagagu

SEQ ID NO: 469786 - RNA, 23 nt, Chlamydia trachomatis
aaaaccaccuucugcaugcaaau

SEQ ID NO: 469787 - RNA, 17 nt, Chlamydia trachomatis
aaaaaucugcaacaaau

SEQ ID NO: 469788 - RNA, 22 nt, Chlamydia trachomatis
aaaaaucugcaacaaauaccaa

SEQ ID NO: 469789 - RNA, 16 nt, Chlamydia trachomatis
aaaaauugaaagagau

SEQ ID NO: 469790 - RNA, 20 nt, Chlamydia trachomatis
aaaaaucgcugagcucuuuc

SEQ ID NO: 469791 - RNA, 12 nt, Chlamydia trachomatis
aaaaaucacaau

SEQ ID NO: 469792 - RNA, 20 nt, Chlamydia trachomatis
aaaaaucguccaaaaucauc

SEQ ID NO: 469793 - RNA, 13 nt, Chlamydia trachomatis
aaaaaucucuuua

SEQ ID NO: 469794 - RNA, 20 nt, Chlamydia trachomatis
aaaaagugugccagcucuaa

SEQ ID NO: 469795 - RNA, 20 nt, Chlamydia trachomatis
aaaaaguuugccaguaauca

SEQ ID NO: 469796 - RNA, 18 nt, Chlamydia trachomatis
aaaaacgcuccaaauaaa

SEQ ID NO: 469797 - RNA, 16 nt, Chlamydia trachomatis
aaaaaccuuucuuagc

SEQ ID NO: 469798 - RNA, 13 nt, Chlamydia trachomatis
aaaaacaaucaaa

SEQ ID NO: 469799 - RNA, 20 nt, Chlamydia trachomatis
aaaaacaaugauauucuaau

SEQ ID NO: 469800 - RNA, 19 nt, Chlamydia trachomatis
aaaaacgguguuagaaaau

SEQ ID NO: 469801 - RNA, 20 nt, Chlamydia trachomatis
aaaaacgguguuagaaaaua

SEQ ID NO: 469802 - RNA, 17 nt, Chlamydia trachomatis
aaaaacuauaaggaauc

SEQ ID NO: 469803 - RNA, 12 nt, Chlamydia trachomatis
aaaaacucuaaa

SEQ ID NO: 469804 - RNA, 17 nt, Chlamydia trachomatis
aaaaacucucaaaucgu

SEQ ID NO: 469805 - RNA, 22 nt, Chlamydia trachomatis
aaaaacgcuccaaauaaaacga

SEQ ID NO: 469806 - RNA, 22 nt, Chlamydia trachomatis
aaaaacgguccguugauuucau

SEQ ID NO: 469807 - RNA, 22 nt, Chlamydia trachomatis
aaaaacgguguuagaaaauacg

SEQ ID NO: 469808 - RNA, 16 nt, Chlamydia trachomatis
aaaaacucuaaaucgu

SEQ ID NO: 469809 - RNA, 21 nt, Chlamydia trachomatis
aaaaacucuuuuucuaacugg

SEQ ID NO: 469810 - RNA, 20 nt, Chlamydia trachomatis
aaaaacugcugcuaucaucu

SEQ ID NO: 469811 - RNA, 15 nt, Chlamydia trachomatis
aaaaaggcuuacaga

SEQ ID NO: 469812 - RNA, 23 nt, Chlamydia trachomatis
aaaaaggaaaucacugaaucagg

SEQ ID NO: 469813 - RNA, 21 nt, Chlamydia trachomatis
aaaaaggaaucuguccaaaga

SEQ ID NO: 469814 - RNA, 17 nt, Chlamydia trachomatis
aaaaaggcauaaaagag

SEQ ID NO: 469815 - RNA, 21 nt, Chlamydia trachomatis
aaaaaggucucucuuuaugaa

SEQ ID NO: 469816 - RNA, 17 nt, Chlamydia trachomatis
aaaaaguaagcgaagaa

SEQ ID NO: 469817 - RNA, 15 nt, Chlamydia trachomatis
aaaaagccauacaaa

SEQ ID NO: 469818 - RNA, 20 nt, Chlamydia trachomatis
aaaaagccauacaaagauug

SEQ ID NO: 469819 - RNA, 17 nt, Chlamydia trachomatis
aaaaagcgucuccaaaa

SEQ ID NO: 469820 - RNA, 13 nt, Chlamydia trachomatis
aaaaagcguucuc

SEQ ID NO: 469821 - RNA, 21 nt, Chlamydia trachomatis
aaaaagcugggcagcaagaga

SEQ ID NO: 469822 - RNA, 11 nt, Chlamydia trachomatis
aaaaagcuggu

SEQ ID NO: 469823 - RNA, 17 nt, Chlamydia trachomatis
aaaaacuuugacaagca

SEQ ID NO: 469824 - RNA, 17 nt, Chlamydia trachomatis
aaaaacuuuucuuccuc

SEQ ID NO: 469825 - RNA, 14 nt, Chlamydia trachomatis
aaaaagaaaaaaag

SEQ ID NO: 469826 - RNA, 13 nt, Chlamydia trachomatis
aaaaagaaaaaaa

SEQ ID NO: 469827 - RNA, 10 nt, Chlamydia trachomatis
aaaaagaaac

SEQ ID NO: 469828 - RNA, 15 nt, Chlamydia trachomatis
aaaaagaaacaaaac

SEQ ID NO: 469829 - RNA, 14 nt, Chlamydia trachomatis
aaaaagaaauaacc

SEQ ID NO: 469830 - RNA, 14 nt, Chlamydia trachomatis
aaaaagaagcuuuu

SEQ ID NO: 469831 - RNA, 18 nt, Chlamydia trachomatis
aaaaagagcauaauaucc

SEQ ID NO: 469832 - RNA, 16 nt, Chlamydia trachomatis
aaaaagaggagaacau

SEQ ID NO: 469833 - RNA, 20 nt, Chlamydia trachomatis
aaaaagaggaggucucccuc

SEQ ID NO: 469834 - RNA, 13 nt, Chlamydia trachomatis
aaaaagaucuuca

SEQ ID NO: 469835 - RNA, 14 nt, Chlamydia trachomatis
aaaaacaacaauca

SEQ ID NO: 469836 - RNA, 17 nt, Chlamydia trachomatis
aaaaacaacaaucaaac

SEQ ID NO: 469837 - RNA, 13 nt, Chlamydia trachomatis
aaaaacaaaacua

SEQ ID NO: 469838 - RNA, 23 nt, Chlamydia trachomatis
aaaaaagagaccgagccuccgcu

SEQ ID NO: 469839 - RNA, 23 nt, Chlamydia trachomatis
aaaaaagcuaugcgcggaaggaa

SEQ ID NO: 469840 - RNA, 16 nt, Chlamydia trachomatis
aaaaaauguuuuugau

SEQ ID NO: 469841 - RNA, 14 nt, Chlamydia trachomatis
aaaaaaaagaacau

SEQ ID NO: 469842 - RNA, 18 nt, Chlamydia trachomatis
aaaaaaagagagcccuaa

SEQ ID NO: 469843 - RNA, 21 nt, Chlamydia trachomatis
aaaaaaagagggguucuauaa

SEQ ID NO: 469844 - RNA, 19 nt, Chlamydia trachomatis
aaaaaaagagguauuuaga

SEQ ID NO: 469845 - RNA, 21 nt, Chlamydia trachomatis
aaaaaaagaggucuuauuaaa

SEQ ID NO: 469846 - RNA, 12 nt, Chlamydia trachomatis
aaaaaaagauac

SEQ ID NO: 469847 - RNA, 16 nt, Chlamydia trachomatis
aaaaaacuucuuccaa

SEQ ID NO: 469848 - RNA, 21 nt, Chlamydia trachomatis
aaaaaagaggucuuauuaaaa

SEQ ID NO: 469849 - RNA, 22 nt, Chlamydia trachomatis
aacagucucuuauaaucuggau

SEQ ID NO: 469850 - RNA, 14 nt, Chlamydia trachomatis
aacaucaaccaggu

SEQ ID NO: 469851 - RNA, 19 nt, Chlamydia trachomatis
aacauaagaggcaccucuu

SEQ ID NO: 469852 - RNA, 14 nt, Chlamydia trachomatis
aacauaauaaauau

SEQ ID NO: 469853 - RNA, 15 nt, Chlamydia trachomatis
aacauaauaaauauu

SEQ ID NO: 469854 - RNA, 13 nt, Chlamydia trachomatis
aacauaauagcgg

SEQ ID NO: 469855 - RNA, 22 nt, Chlamydia trachomatis
aacagggauggucucacacaac

SEQ ID NO: 469856 - RNA, 13 nt, Chlamydia trachomatis
aacaguagaaacu

SEQ ID NO: 469857 - RNA, 14 nt, Chlamydia trachomatis
aacagcucuucuuc

SEQ ID NO: 469858 - RNA, 18 nt, Chlamydia trachomatis
aacagcucuucuucugaa

SEQ ID NO: 469859 - RNA, 23 nt, Chlamydia trachomatis
aacagcucgccggaaaccuguuu

SEQ ID NO: 469860 - RNA, 17 nt, Chlamydia trachomatis
aacagcucuaaagagcc

SEQ ID NO: 469861 - RNA, 18 nt, Chlamydia trachomatis
aacaaggcuaagaaaaac

SEQ ID NO: 469862 - RNA, 21 nt, Chlamydia trachomatis
aaccaccuguugcuuuucgaa

SEQ ID NO: 469863 - RNA, 12 nt, Chlamydia trachomatis
aaccacuuuucu

SEQ ID NO: 469864 - RNA, 15 nt, Chlamydia trachomatis
aaccacuuuucugua

SEQ ID NO: 469865 - RNA, 14 nt, Chlamydia trachomatis
aaccacccuuccca

SEQ ID NO: 469866 - RNA, 17 nt, Chlamydia trachomatis
aaccaaaaaaaggcucu

SEQ ID NO: 469867 - RNA, 14 nt, Chlamydia trachomatis
aaccaaaaccacac

SEQ ID NO: 469868 - RNA, 12 nt, Chlamydia trachomatis
aaccaaaagagc

SEQ ID NO: 469869 - RNA, 13 nt, Chlamydia trachomatis
aaccaaaagagcg

SEQ ID NO: 469870 - RNA, 20 nt, Chlamydia trachomatis
aaccaaaauaucuacuucuu

SEQ ID NO: 469871 - RNA, 11 nt, Chlamydia trachomatis
aaccaaaccag

SEQ ID NO: 469872 - RNA, 16 nt, Chlamydia trachomatis
aaccaaacgauuaugu

SEQ ID NO: 469873 - RNA, 16 nt, Chlamydia trachomatis
aaccaaaggcaacaaa

SEQ ID NO: 469874 - RNA, 18 nt, Chlamydia trachomatis
aaccacacuucucgaaaa

SEQ ID NO: 469875 - RNA, 21 nt, Chlamydia trachomatis
aaccacagacucagguuaucc

SEQ ID NO: 469876 - RNA, 16 nt, Chlamydia trachomatis
aacaugauucaaaaua

SEQ ID NO: 469877 - RNA, 20 nt, Chlamydia trachomatis
aacaucuacacgcucaggcu

SEQ ID NO: 469878 - RNA, 14 nt, Chlamydia trachomatis
aaccagcgcauuaa

SEQ ID NO: 469879 - RNA, 15 nt, Chlamydia trachomatis
aaccaggucacauuu

SEQ ID NO: 469880 - RNA, 21 nt, Chlamydia trachomatis
aaccaggucacauuuuccguu

SEQ ID NO: 469881 - RNA, 19 nt, Chlamydia trachomatis
aaccaguuucuucuacaag

SEQ ID NO: 469882 - RNA, 21 nt, Chlamydia trachomatis
aaccccaucgauuuuugcuaa

SEQ ID NO: 469883 - RNA, 17 nt, Chlamydia trachomatis
aaccccgcauaccaaag

SEQ ID NO: 469884 - RNA, 13 nt, Chlamydia trachomatis
aaccccucagguu

SEQ ID NO: 469885 - RNA, 14 nt, Chlamydia trachomatis
aaccccucuuuuuu

SEQ ID NO: 469886 - RNA, 20 nt, Chlamydia trachomatis
aaccuaagcgcaagaaacug

SEQ ID NO: 469887 - RNA, 20 nt, Chlamydia trachomatis
aaccuacaugccgcgaagca

SEQ ID NO: 469888 - RNA, 17 nt, Chlamydia trachomatis
aaccuuuuuaaaauaau

SEQ ID NO: 469889 - RNA, 16 nt, Chlamydia trachomatis
aaccuuugacucauca

SEQ ID NO: 469890 - RNA, 18 nt, Chlamydia trachomatis
aaccuuucaaauacccaa

SEQ ID NO: 469891 - RNA, 16 nt, Chlamydia trachomatis
aacgaaaaacagaaag

SEQ ID NO: 469892 - RNA, 17 nt, Chlamydia trachomatis
aacgaaaaacagaaaga

SEQ ID NO: 469893 - RNA, 16 nt, Chlamydia trachomatis
aacgaaaccaaaauau

SEQ ID NO: 469894 - RNA, 19 nt, Chlamydia trachomatis
aacgaaagcauccccaaaa

SEQ ID NO: 469895 - RNA, 20 nt, Chlamydia trachomatis
aacgaacuuuccauagcaug

SEQ ID NO: 469896 - RNA, 16 nt, Chlamydia trachomatis
aaccuugggaaucuuc

SEQ ID NO: 469897 - RNA, 19 nt, Chlamydia trachomatis
aaccuuuaccaaagaauuc

SEQ ID NO: 469898 - RNA, 11 nt, Chlamydia trachomatis
aaccuucugac

SEQ ID NO: 469899 - RNA, 14 nt, Chlamydia trachomatis
aacgcaucuccaaa

SEQ ID NO: 469900 - RNA, 19 nt, Chlamydia trachomatis
aacgcaucccgaaucccau

SEQ ID NO: 469901 - RNA, 16 nt, Chlamydia trachomatis
aacgcauuacauauag

SEQ ID NO: 469902 - RNA, 15 nt, Chlamydia trachomatis
aacgaggcacaaaau

SEQ ID NO: 469903 - RNA, 17 nt, Chlamydia trachomatis
aacgauauaaagaagac

SEQ ID NO: 469904 - RNA, 12 nt, Chlamydia trachomatis
aacgaagauuaa

SEQ ID NO: 469905 - RNA, 14 nt, Chlamydia trachomatis
aacgaagauuaaga

SEQ ID NO: 469906 - RNA, 20 nt, Chlamydia trachomatis
aacgaaguuagcauguucag

SEQ ID NO: 469907 - RNA, 22 nt, Chlamydia trachomatis
aacgccuguuuucuuguagaaa

SEQ ID NO: 469908 - RNA, 21 nt, Chlamydia trachomatis
aacggcacucaaauuucucua

SEQ ID NO: 469909 - RNA, 16 nt, Chlamydia trachomatis
aagaaaauagguaaag

SEQ ID NO: 469910 - RNA, 19 nt, Chlamydia trachomatis
aagaaaauagguaaagaag

SEQ ID NO: 469911 - RNA, 20 nt, Chlamydia trachomatis
aacuuuguuauuuuuuaaga

SEQ ID NO: 469912 - RNA, 12 nt, Chlamydia trachomatis
aacuuuucugca

SEQ ID NO: 469913 - RNA, 13 nt, Chlamydia trachomatis
aacuuuucuuccu

SEQ ID NO: 469914 - RNA, 16 nt, Chlamydia trachomatis
aacuucuccaguuaau

SEQ ID NO: 469915 - RNA, 15 nt, Chlamydia trachomatis
aacuuuaauagccac

SEQ ID NO: 469916 - RNA, 12 nt, Chlamydia trachomatis
aacuuucuucca

SEQ ID NO: 469917 - RNA, 15 nt, Chlamydia trachomatis
aacuuugaacaaauu

SEQ ID NO: 469918 - RNA, 16 nt, Chlamydia trachomatis
aacuuugaacaaauuu

SEQ ID NO: 469919 - RNA, 17 nt, Chlamydia trachomatis
aacuuugacaagcagua

SEQ ID NO: 469920 - RNA, 15 nt, Chlamydia trachomatis
aacuucccacucauc

SEQ ID NO: 469921 - RNA, 16 nt, Chlamydia trachomatis
aacuucaguuuguuca

SEQ ID NO: 469922 - RNA, 21 nt, Chlamydia trachomatis
aacugucuauuggacucagaa

SEQ ID NO: 469923 - RNA, 13 nt, Chlamydia trachomatis
aacugugaagaau

SEQ ID NO: 469924 - RNA, 19 nt, Chlamydia trachomatis
aacugcgacguaacaccaa

SEQ ID NO: 469925 - RNA, 16 nt, Chlamydia trachomatis
aacucgcguauuuuug

SEQ ID NO: 469926 - RNA, 11 nt, Chlamydia trachomatis
aacuccagaaa

SEQ ID NO: 469927 - RNA, 18 nt, Chlamydia trachomatis
aacuccauaaaaagccaa

SEQ ID NO: 469928 - RNA, 15 nt, Chlamydia trachomatis
aacucccccuuucaa

SEQ ID NO: 469929 - RNA, 17 nt, Chlamydia trachomatis
aacucccucauuaagaa

SEQ ID NO: 469930 - RNA, 18 nt, Chlamydia trachomatis
aacucccucauuaagaau

SEQ ID NO: 469931 - RNA, 14 nt, Chlamydia trachomatis
aacucccuccaaaa

SEQ ID NO: 469932 - RNA, 15 nt, Chlamydia trachomatis
aacucuauuaagaau

SEQ ID NO: 469933 - RNA, 15 nt, Chlamydia trachomatis
aacucuccaaacucu

SEQ ID NO: 469934 - RNA, 20 nt, Chlamydia trachomatis
aacucuccuaauucaacaua

SEQ ID NO: 469935 - RNA, 21 nt, Chlamydia trachomatis
aacucucgggccaaaaagacu

SEQ ID NO: 469936 - RNA, 13 nt, Chlamydia trachomatis
aacucucucuccc

SEQ ID NO: 469937 - RNA, 11 nt, Chlamydia trachomatis
aacucucuguu

SEQ ID NO: 469938 - RNA, 18 nt, Chlamydia trachomatis
aacucugcggcuccuucu

SEQ ID NO: 469939 - RNA, 19 nt, Chlamydia trachomatis
aacucuuauaacauuauuc

SEQ ID NO: 469940 - RNA, 18 nt, Chlamydia trachomatis
aagaauugaaguaugcuc

SEQ ID NO: 469941 - RNA, 20 nt, Chlamydia trachomatis
aagaaugaaacuuggucagc

SEQ ID NO: 469942 - RNA, 20 nt, Chlamydia trachomatis
aagaaugagguaaugcccac

SEQ ID NO: 469943 - RNA, 21 nt, Chlamydia trachomatis
aagaaugaucacuugaaucac

SEQ ID NO: 469944 - RNA, 12 nt, Chlamydia trachomatis
aagaaauaaccu

SEQ ID NO: 469945 - RNA, 12 nt, Chlamydia trachomatis
aagaaauagcuu

SEQ ID NO: 469946 - RNA, 14 nt, Chlamydia trachomatis
aagaaaucuucucu

SEQ ID NO: 469947 - RNA, 20 nt, Chlamydia trachomatis
aagaaaucuucucuugaauc

SEQ ID NO: 469948 - RNA, 23 nt, Chlamydia trachomatis
aagacauggcucuacauucagaa

SEQ ID NO: 469949 - RNA, 23 nt, Chlamydia trachomatis
aagacaaauugcacuaaagagcu

SEQ ID NO: 469950 - RNA, 17 nt, Chlamydia trachomatis
aagacccguuuucucuu

SEQ ID NO: 469951 - RNA, 13 nt, Chlamydia trachomatis
aagaccucuucaa

SEQ ID NO: 469952 - RNA, 22 nt, Chlamydia trachomatis
aagacuuguucugcugcucgaa

SEQ ID NO: 469953 - RNA, 18 nt, Chlamydia trachomatis
aagacuuucucuaacaau

SEQ ID NO: 469954 - RNA, 15 nt, Chlamydia trachomatis
aagagaaaaauugca

SEQ ID NO: 469955 - RNA, 19 nt, Chlamydia trachomatis
aagagaaaaauugcaaaga

SEQ ID NO: 469956 - RNA, 17 nt, Chlamydia trachomatis
aagagaaaccaacgagu

SEQ ID NO: 469957 - RNA, 13 nt, Chlamydia trachomatis
aagacuaaucuuc

SEQ ID NO: 469958 - RNA, 18 nt, Chlamydia trachomatis
aagacuacaaaacgcucu

SEQ ID NO: 469959 - RNA, 19 nt, Chlamydia trachomatis
aagacucaaauuuucauga

SEQ ID NO: 469960 - RNA, 16 nt, Chlamydia trachomatis
aagacucaaucaccac

SEQ ID NO: 469961 - RNA, 17 nt, Chlamydia trachomatis
aagauaaccaagcugca

SEQ ID NO: 469962 - RNA, 18 nt, Chlamydia trachomatis
aagaguucuccucccaga

SEQ ID NO: 469963 - RNA, 14 nt, Chlamydia trachomatis
aagaguuucuuugu

SEQ ID NO: 469964 - RNA, 19 nt, Chlamydia trachomatis
aagauaaaacuaccugaua

SEQ ID NO: 469965 - RNA, 17 nt, Chlamydia trachomatis
aagauaguagagaauua

SEQ ID NO: 469966 - RNA, 17 nt, Chlamydia trachomatis
aagauauaaacaauaag

SEQ ID NO: 469967 - RNA, 22 nt, Chlamydia trachomatis
aagauauagguuccaucuaaag

SEQ ID NO: 469968 - RNA, 12 nt, Chlamydia trachomatis
aagauauucaug

SEQ ID NO: 469969 - RNA, 14 nt, Chlamydia trachomatis
aagauauucccuaa

SEQ ID NO: 469970 - RNA, 15 nt, Chlamydia trachomatis
aagaucaaggaucca

SEQ ID NO: 469971 - RNA, 21 nt, Chlamydia trachomatis
aagagcuuugcacaccugcuu

SEQ ID NO: 469972 - RNA, 21 nt, Chlamydia trachomatis
aagagcuguauugaccuccaa

SEQ ID NO: 469973 - RNA, 13 nt, Chlamydia trachomatis
aagagcuucuucu

SEQ ID NO: 469974 - RNA, 20 nt, Chlamydia trachomatis
aagagcuucuucuaaagaau

SEQ ID NO: 469975 - RNA, 23 nt, Chlamydia trachomatis
aagagcuucuuguuuagaggaga

SEQ ID NO: 469976 - RNA, 16 nt, Chlamydia trachomatis
aagagcugaggaggga

SEQ ID NO: 469977 - RNA, 23 nt, Chlamydia trachomatis
aagagccguucucucuaaaauca

SEQ ID NO: 469978 - RNA, 15 nt, Chlamydia trachomatis
aagaggcccuucuug

SEQ ID NO: 469979 - RNA, 18 nt, Chlamydia trachomatis
aagaggcccuucuugagg

SEQ ID NO: 469980 - RNA, 11 nt, Chlamydia trachomatis
aagaggaucuc

SEQ ID NO: 469981 - RNA, 15 nt, Chlamydia trachomatis
aagaggcaaaaaucu

SEQ ID NO: 469982 - RNA, 16 nt, Chlamydia trachomatis
aagaggcaccucuuuu

SEQ ID NO: 469983 - RNA, 19 nt, Chlamydia trachomatis
aagaggcgcccacagaaca

SEQ ID NO: 469984 - RNA, 14 nt, Chlamydia trachomatis
aagagggaagagaa

SEQ ID NO: 469985 - RNA, 17 nt, Chlamydia trachomatis
aagaggguuuggaugga

SEQ ID NO: 469986 - RNA, 22 nt, Chlamydia trachomatis
aagaggucuuauuaaaagaccu

SEQ ID NO: 469987 - RNA, 23 nt, Chlamydia trachomatis
aagaggucuuauuaaaagaccuc

SEQ ID NO: 469988 - RNA, 20 nt, Chlamydia trachomatis
aagaguaaucggauagagaa

SEQ ID NO: 469989 - RNA, 17 nt, Chlamydia trachomatis
aagaguagggagcaaag

SEQ ID NO: 469990 - RNA, 18 nt, Chlamydia trachomatis
aagagaagguaacaaugc

SEQ ID NO: 469991 - RNA, 15 nt, Chlamydia trachomatis
aagagagaacaaaag

SEQ ID NO: 469992 - RNA, 19 nt, Chlamydia trachomatis
aagagagacacuauuaaaa

SEQ ID NO: 469993 - RNA, 13 nt, Chlamydia trachomatis
aagagagaucuau

SEQ ID NO: 469994 - RNA, 21 nt, Chlamydia trachomatis
aagagagaucuaugaaaaaag

SEQ ID NO: 469995 - RNA, 20 nt, Chlamydia trachomatis
aagagagcuuugaucuuugu

SEQ ID NO: 469996 - RNA, 21 nt, Chlamydia trachomatis
aagagaucguacaaugaccga

SEQ ID NO: 469997 - RNA, 21 nt, Chlamydia trachomatis
aagagauguuuguguuucuaa

SEQ ID NO: 469998 - RNA, 23 nt, Chlamydia trachomatis
aagagauguuuguguuucuaaaa

SEQ ID NO: 469999 - RNA, 18 nt, Chlamydia trachomatis
aagagcagagcuuuuacu

SEQ ID NO: 470000 - RNA, 23 nt, Chlamydia trachomatis
aagagcauccauauauucagaag

SEQ ID NO: 470001 - RNA, 22 nt, Chlamydia trachomatis
aagagcaugaccucagauuuau

SEQ ID NO: 470002 - RNA, 11 nt, Chlamydia trachomatis
aagauccaucu

SEQ ID NO: 470003 - RNA, 14 nt, Chlamydia trachomatis
aagauccauuugau

SEQ ID NO: 470004 - RNA, 18 nt, Chlamydia trachomatis
aagaucaugggaaauaaa

SEQ ID NO: 470005 - RNA, 23 nt, Chlamydia trachomatis
aagauccacuggaauagcuagag

SEQ ID NO: 470006 - RNA, 13 nt, Chlamydia trachomatis
aagcgaagcauuc

SEQ ID NO: 470007 - RNA, 13 nt, Chlamydia trachomatis
aagcgaaaaaaaa

SEQ ID NO: 470008 - RNA, 15 nt, Chlamydia trachomatis
aagcgaaaaaaaaag

SEQ ID NO: 470009 - RNA, 19 nt, Chlamydia trachomatis
aagcgaaaaaaaaagaaca

SEQ ID NO: 470010 - RNA, 20 nt, Chlamydia trachomatis
aagccuuggguucuucugag

SEQ ID NO: 470011 - RNA, 20 nt, Chlamydia trachomatis
aagccuuucucuaaaagaag

SEQ ID NO: 470012 - RNA, 21 nt, Chlamydia trachomatis
aagccuuucucuaaaagaaga

SEQ ID NO: 470013 - RNA, 13 nt, Chlamydia trachomatis
aagcgagauaagg

SEQ ID NO: 470014 - RNA, 22 nt, Chlamydia trachomatis
aagccuguuuugcuaugaaaaa

SEQ ID NO: 470015 - RNA, 23 nt, Chlamydia trachomatis
aagccuucuccagaaguggcugu

SEQ ID NO: 470016 - RNA, 15 nt, Chlamydia trachomatis
aagccuucuuccuug

SEQ ID NO: 470017 - RNA, 15 nt, Chlamydia trachomatis
aagccuucuuucaaa

SEQ ID NO: 470018 - RNA, 15 nt, Chlamydia trachomatis
aagccuacagcuagc

SEQ ID NO: 470019 - RNA, 13 nt, Chlamydia trachomatis
aagcuaauuuuuc

SEQ ID NO: 470020 - RNA, 15 nt, Chlamydia trachomatis
aagcuacagucuguc

SEQ ID NO: 470021 - RNA, 16 nt, Chlamydia trachomatis
aagcggcuaaagaaga

SEQ ID NO: 470022 - RNA, 16 nt, Chlamydia trachomatis
aagcuagaagaagagg

SEQ ID NO: 470023 - RNA, 17 nt, Chlamydia trachomatis
aagcuagaagaagagga

SEQ ID NO: 470024 - RNA, 19 nt, Chlamydia trachomatis
aagcuagaagaagaggagg

SEQ ID NO: 470025 - RNA, 14 nt, Chlamydia trachomatis
aagcuagaagaauc

SEQ ID NO: 470026 - RNA, 18 nt, Chlamydia trachomatis
aagcuagguaaagguuuc

SEQ ID NO: 470027 - RNA, 16 nt, Chlamydia trachomatis
aagcuauccauguuuc

SEQ ID NO: 470028 - RNA, 20 nt, Chlamydia trachomatis
aagcuauuuucuuccugcuu

SEQ ID NO: 470029 - RNA, 21 nt, Chlamydia trachomatis
aagcuauuuucuuccugcuuc

SEQ ID NO: 470030 - RNA, 22 nt, Chlamydia trachomatis
aaggaauggguaggauuacaaa

SEQ ID NO: 470031 - RNA, 19 nt, Chlamydia trachomatis
aaggaaugguuacuugccu

SEQ ID NO: 470032 - RNA, 19 nt, Chlamydia trachomatis
aaggaauacccagaaguau

SEQ ID NO: 470033 - RNA, 21 nt, Chlamydia trachomatis
aaggaaucuguccaaagagau

SEQ ID NO: 470034 - RNA, 14 nt, Chlamydia trachomatis
aaggaauaauuuuc

SEQ ID NO: 470035 - RNA, 12 nt, Chlamydia trachomatis
aaggaagaagau

SEQ ID NO: 470036 - RNA, 15 nt, Chlamydia trachomatis
aaggaagcaaaaacu

SEQ ID NO: 470037 - RNA, 12 nt, Chlamydia trachomatis
aaggaagccagc

SEQ ID NO: 470038 - RNA, 13 nt, Chlamydia trachomatis
aaggaagccagcc

SEQ ID NO: 470039 - RNA, 18 nt, Chlamydia trachomatis
aaggacaagcucgucuuu

SEQ ID NO: 470040 - RNA, 17 nt, Chlamydia trachomatis
aaggacguuuggagcau

SEQ ID NO: 470041 - RNA, 20 nt, Chlamydia trachomatis
aaggacuaguccugaagcaa

SEQ ID NO: 470042 - RNA, 18 nt, Chlamydia trachomatis
aaggaugcaaauaagaaa

SEQ ID NO: 470043 - RNA, 17 nt, Chlamydia trachomatis
aagcugggaaagcugca

SEQ ID NO: 470044 - RNA, 11 nt, Chlamydia trachomatis
aagcugggcag

SEQ ID NO: 470045 - RNA, 21 nt, Chlamydia trachomatis
aagcugcuuuacaucccuuga

SEQ ID NO: 470046 - RNA, 14 nt, Chlamydia trachomatis
aagcuucccuucuc

SEQ ID NO: 470047 - RNA, 15 nt, Chlamydia trachomatis
aagcuucuaacgcuu

SEQ ID NO: 470048 - RNA, 15 nt, Chlamydia trachomatis
aagcuucucaacacu

SEQ ID NO: 470049 - RNA, 23 nt, Chlamydia trachomatis
aagcuucucaacacugaaaaucg

SEQ ID NO: 470050 - RNA, 20 nt, Chlamydia trachomatis
aagcuucuugggauaugccu

SEQ ID NO: 470051 - RNA, 17 nt, Chlamydia trachomatis
aagcuugaucaaagaau

SEQ ID NO: 470052 - RNA, 18 nt, Chlamydia trachomatis
aagcuugucuccuucuuu

SEQ ID NO: 470053 - RNA, 16 nt, Chlamydia trachomatis
aagcuuucaucuccuu

SEQ ID NO: 470054 - RNA, 16 nt, Chlamydia trachomatis
aaggaaauaaagaucu

SEQ ID NO: 470055 - RNA, 15 nt, Chlamydia trachomatis
aaggaaaugaaggcc

SEQ ID NO: 470056 - RNA, 18 nt, Chlamydia trachomatis
aaggaacaucgagaaaau

SEQ ID NO: 470057 - RNA, 17 nt, Chlamydia trachomatis
aaggcauaaaagagaag

SEQ ID NO: 470058 - RNA, 22 nt, Chlamydia trachomatis
aaggccuauccaaggaaaccaa

SEQ ID NO: 470059 - RNA, 16 nt, Chlamydia trachomatis
aaggcucucgcaguuu

SEQ ID NO: 470060 - RNA, 20 nt, Chlamydia trachomatis
aaggcucuauacagagccuu

SEQ ID NO: 470061 - RNA, 17 nt, Chlamydia trachomatis
aaggcuuucaaaaagag

SEQ ID NO: 470062 - RNA, 18 nt, Chlamydia trachomatis
aaggcuuucaaaaagagc

SEQ ID NO: 470063 - RNA, 15 nt, Chlamydia trachomatis
aaggcuuacagagag

SEQ ID NO: 470064 - RNA, 20 nt, Chlamydia trachomatis
aagggaauguuucccuucuu

SEQ ID NO: 470065 - RNA, 15 nt, Chlamydia trachomatis
aaggcuuugucuaua

SEQ ID NO: 470066 - RNA, 17 nt, Chlamydia trachomatis
aagggaaaaaacuagaa

SEQ ID NO: 470067 - RNA, 12 nt, Chlamydia trachomatis
aaggggaagaaa

SEQ ID NO: 470068 - RNA, 18 nt, Chlamydia trachomatis
aagggggcuuuagcagcc

SEQ ID NO: 470069 - RNA, 21 nt, Chlamydia trachomatis
aagggguuuucuuggcaggcg

SEQ ID NO: 470070 - RNA, 14 nt, Chlamydia trachomatis
aaguagcaaucacu

SEQ ID NO: 470071 - RNA, 21 nt, Chlamydia trachomatis
aagucagagauauugucuacu

SEQ ID NO: 470072 - RNA, 12 nt, Chlamydia trachomatis
aagucaccauuu

SEQ ID NO: 470073 - RNA, 16 nt, Chlamydia trachomatis
aagucaccauuuucuc

SEQ ID NO: 470074 - RNA, 14 nt, Chlamydia trachomatis
aaguauuucuuguu

SEQ ID NO: 470075 - RNA, 14 nt, Chlamydia trachomatis
aaguauaauccgag

SEQ ID NO: 470076 - RNA, 17 nt, Chlamydia trachomatis
aaguaucguaaacaaaa

SEQ ID NO: 470077 - RNA, 15 nt, Chlamydia trachomatis
aagucgugucaggcg

SEQ ID NO: 470078 - RNA, 18 nt, Chlamydia trachomatis
aagucuaggagauaagca

SEQ ID NO: 470079 - RNA, 16 nt, Chlamydia trachomatis
aagucgguuuacaaua

SEQ ID NO: 470080 - RNA, 16 nt, Chlamydia trachomatis
aagucuccauaagaau

SEQ ID NO: 470081 - RNA, 21 nt, Chlamydia trachomatis
aagucuccauaagaauguuuc

SEQ ID NO: 470082 - RNA, 23 nt, Chlamydia trachomatis
aagucuccauaagaauguuuccu

SEQ ID NO: 470083 - RNA, 18 nt, Chlamydia trachomatis
aagucuccacugguucuc

SEQ ID NO: 470084 - RNA, 12 nt, Chlamydia trachomatis
aagucucugcca

SEQ ID NO: 470085 - RNA, 23 nt, Chlamydia trachomatis
aagucuuuuccuccauaggaaua

SEQ ID NO: 470086 - RNA, 15 nt, Chlamydia trachomatis
aagugaauuugaaca

SEQ ID NO: 470087 - RNA, 14 nt, Chlamydia trachomatis
aaguccuuaucuuc

SEQ ID NO: 470088 - RNA, 22 nt, Chlamydia trachomatis
aaguccuucuccaccuaauucc

SEQ ID NO: 470089 - RNA, 11 nt, Chlamydia trachomatis
aaguccugcuu

SEQ ID NO: 470090 - RNA, 22 nt, Chlamydia trachomatis
aaguccugcuucuuuuucccgc

SEQ ID NO: 470091 - RNA, 21 nt, Chlamydia trachomatis
aagucaugcggauuaaagaag

SEQ ID NO: 470092 - RNA, 22 nt, Chlamydia trachomatis
aagucaugcggauuaaagaagg

SEQ ID NO: 470093 - RNA, 23 nt, Chlamydia trachomatis
aaguccaagauuaucacauucuu

SEQ ID NO: 470094 - RNA, 17 nt, Chlamydia trachomatis
aagugcuaacgcuucuu

SEQ ID NO: 470095 - RNA, 18 nt, Chlamydia trachomatis
aagugcuaacgcuucuuc

SEQ ID NO: 470096 - RNA, 21 nt, Chlamydia trachomatis
aagugacuuuuagcaaauaau

SEQ ID NO: 470097 - RNA, 19 nt, Chlamydia trachomatis
aagugacuggcgagaagca

SEQ ID NO: 470098 - RNA, 16 nt, Chlamydia trachomatis
aagugccaacaucaaa

SEQ ID NO: 470099 - RNA, 21 nt, Chlamydia trachomatis
aaguucacugacuguagaaaa

SEQ ID NO: 470100 - RNA, 21 nt, Chlamydia trachomatis
aaguucccuuuacaaugauga

SEQ ID NO: 470101 - RNA, 23 nt, Chlamydia trachomatis
aaguucccuuuuguuccagaaaa

SEQ ID NO: 470102 - RNA, 23 nt, Chlamydia trachomatis
aauacccaggguagcuguagcaa

SEQ ID NO: 470103 - RNA, 17 nt, Chlamydia trachomatis
aauacacagcaucaaga

SEQ ID NO: 470104 - RNA, 22 nt, Chlamydia trachomatis
aauacaccgcaucagccccaaa

SEQ ID NO: 470105 - RNA, 13 nt, Chlamydia trachomatis
aauaccaaaauau

SEQ ID NO: 470106 - RNA, 14 nt, Chlamydia trachomatis
aauaccaaaauccu

SEQ ID NO: 470107 - RNA, 20 nt, Chlamydia trachomatis
aauaccaccauagguagaaa

SEQ ID NO: 470108 - RNA, 21 nt, Chlamydia trachomatis
aauaauggacugguuguuccc

SEQ ID NO: 470109 - RNA, 14 nt, Chlamydia trachomatis
aauaaugggcuccu

SEQ ID NO: 470110 - RNA, 13 nt, Chlamydia trachomatis
aauaauacaaagg

SEQ ID NO: 470111 - RNA, 13 nt, Chlamydia trachomatis
aauaauacagauu

SEQ ID NO: 470112 - RNA, 23 nt, Chlamydia trachomatis
aauaauacagauuuuucgaaaau

SEQ ID NO: 470113 - RNA, 13 nt, Chlamydia trachomatis
aaaaauagaaaac

SEQ ID NO: 470114 - RNA, 14 nt, Chlamydia trachomatis
aaaaauagaaaacg

SEQ ID NO: 470115 - RNA, 18 nt, Chlamydia trachomatis
aaaaauaguaucuauaau

SEQ ID NO: 470116 - RNA, 15 nt, Chlamydia trachomatis
aauaaugaaacccca

SEQ ID NO: 470117 - RNA, 23 nt, Chlamydia trachomatis
aaaaaucgcugagcucuuuccuc

SEQ ID NO: 470118 - RNA, 16 nt, Chlamydia trachomatis
aaaaaucguccaaaau

SEQ ID NO: 470119 - RNA, 20 nt, Chlamydia trachomatis
aaaaaucucuuuagcaugca

SEQ ID NO: 470120 - RNA, 21 nt, Chlamydia trachomatis
aaaaaugaacauaugcucuuu

SEQ ID NO: 470121 - RNA, 13 nt, Chlamydia trachomatis
aauaauuuuccac

SEQ ID NO: 470122 - RNA, 21 nt, Chlamydia trachomatis
aauaauuuuccacaaauauuu

SEQ ID NO: 470123 - RNA, 17 nt, Chlamydia trachomatis
aauaagcuuuuuccgga

SEQ ID NO: 470124 - RNA, 19 nt, Chlamydia trachomatis
aauaagguauccaacaaua

SEQ ID NO: 470125 - RNA, 23 nt, Chlamydia trachomatis
aauaagugcuccugcagacaagc

SEQ ID NO: 470126 - RNA, 14 nt, Chlamydia trachomatis
aauaaguuguaaag

SEQ ID NO: 470127 - RNA, 17 nt, Chlamydia trachomatis
aauaaguuguaaagcau

SEQ ID NO: 470128 - RNA, 15 nt, Chlamydia trachomatis
aauaaguuuuucaaa

SEQ ID NO: 470129 - RNA, 19 nt, Chlamydia trachomatis
aauaagcuugaucaaagaa

SEQ ID NO: 470130 - RNA, 14 nt, Chlamydia trachomatis
aauaagcgaaaaaa

SEQ ID NO: 470131 - RNA, 15 nt, Chlamydia trachomatis
aauaagcgaaaaaaa

SEQ ID NO: 470132 - RNA, 19 nt, Chlamydia trachomatis
aauaagcgaaaaaaaaaga

SEQ ID NO: 470133 - RNA, 23 nt, Chlamydia trachomatis
aauaagcgaaaaaaaaagaacau

SEQ ID NO: 470134 - RNA, 17 nt, Chlamydia trachomatis
aaaaaguuuggagcagc

SEQ ID NO: 470135 - RNA, 14 nt, Chlamydia trachomatis
aaaaauaaaaauag

SEQ ID NO: 470136 - RNA, 21 nt, Chlamydia trachomatis
aaaaauaaagaaauaaaaagc

SEQ ID NO: 470137 - RNA, 18 nt, Chlamydia trachomatis
aaguuggucgcagaauaa

SEQ ID NO: 470138 - RNA, 15 nt, Chlamydia trachomatis
aaguuguuggaguua

SEQ ID NO: 470139 - RNA, 15 nt, Chlamydia trachomatis
aauaaaucuauccau

SEQ ID NO: 470140 - RNA, 23 nt, Chlamydia trachomatis
aauaacugagccaagaacaaagc

SEQ ID NO: 470141 - RNA, 18 nt, Chlamydia trachomatis
aauaacuggaguuuuccu

SEQ ID NO: 470142 - RNA, 23 nt, Chlamydia trachomatis
aauaagaaaguuuuuuucaggag

SEQ ID NO: 470143 - RNA, 18 nt, Chlamydia trachomatis
aauaagaaauuaacccaa

SEQ ID NO: 470144 - RNA, 14 nt, Chlamydia trachomatis
aauaagaccucuuu

SEQ ID NO: 470145 - RNA, 21 nt, Chlamydia trachomatis
aauaagagcaucgaagcguuu

SEQ ID NO: 470146 - RNA, 19 nt, Chlamydia trachomatis
aauagcuucguagagcaag

SEQ ID NO: 470147 - RNA, 20 nt, Chlamydia trachomatis
aauagcuucguagagcaaga

SEQ ID NO: 470148 - RNA, 16 nt, Chlamydia trachomatis
aauagcuugaagaaua

SEQ ID NO: 470149 - RNA, 21 nt, Chlamydia trachomatis
aauagcuuuuaacuucccacu

SEQ ID NO: 470150 - RNA, 13 nt, Chlamydia trachomatis
aauaggaggaacc

SEQ ID NO: 470151 - RNA, 20 nt, Chlamydia trachomatis
aauaggauaggaaaugagag

SEQ ID NO: 470152 - RNA, 16 nt, Chlamydia trachomatis
aauaggcaggagacca

SEQ ID NO: 470153 - RNA, 15 nt, Chlamydia trachomatis
aauagggauuuuaaa

SEQ ID NO: 470154 - RNA, 21 nt, Chlamydia trachomatis
aauaggguuaggaaagcacuu

SEQ ID NO: 470155 - RNA, 14 nt, Chlamydia trachomatis
aauagguaaagaag

SEQ ID NO: 470156 - RNA, 20 nt, Chlamydia trachomatis
aauagguaugugcucauuuc

SEQ ID NO: 470157 - RNA, 22 nt, Chlamydia trachomatis
aauagcggguucuuuugcaaaa

SEQ ID NO: 470158 - RNA, 22 nt, Chlamydia trachomatis
aauagcacgcaaaacaucuaga

SEQ ID NO: 470159 - RNA, 22 nt, Chlamydia trachomatis
aauagccgcgaguauaggcaua

SEQ ID NO: 470160 - RNA, 19 nt, Chlamydia trachomatis
aauagccuaugguuuuuuc

SEQ ID NO: 470161 - RNA, 19 nt, Chlamydia trachomatis
aauagccuccuuaaucaaa

SEQ ID NO: 470162 - RNA, 19 nt, Chlamydia trachomatis
aauagcuaagguaacaauc

SEQ ID NO: 470163 - RNA, 17 nt, Chlamydia trachomatis
aauagcuacagcaauag

SEQ ID NO: 470164 - RNA, 18 nt, Chlamydia trachomatis
aauagcuacuagauagau

SEQ ID NO: 470165 - RNA, 11 nt, Chlamydia trachomatis
aauagcucugc

SEQ ID NO: 470166 - RNA, 20 nt, Chlamydia trachomatis
aauagcugccagugcucaaa

SEQ ID NO: 470167 - RNA, 19 nt, Chlamydia trachomatis
aauagcaaagcgaucagcu

SEQ ID NO: 470168 - RNA, 14 nt, Chlamydia trachomatis
aauagcaaagaaga

SEQ ID NO: 470169 - RNA, 20 nt, Chlamydia trachomatis
aauagauagucugcauuaaa

SEQ ID NO: 470170 - RNA, 17 nt, Chlamydia trachomatis
aauaccuucuuacauaa

SEQ ID NO: 470171 - RNA, 18 nt, Chlamydia trachomatis
aauaccuucuuacauaag

SEQ ID NO: 470172 - RNA, 21 nt, Chlamydia trachomatis
aauagaaguuacuuuucucaa

SEQ ID NO: 470173 - RNA, 16 nt, Chlamydia trachomatis
aauagaauaaaaggcu

SEQ ID NO: 470174 - RNA, 14 nt, Chlamydia trachomatis
aauaccuagcaauu

SEQ ID NO: 470175 - RNA, 17 nt, Chlamydia trachomatis
aauauaccccgaacaau

SEQ ID NO: 470176 - RNA, 18 nt, Chlamydia trachomatis
aauauacucaacuccaga

SEQ ID NO: 470177 - RNA, 13 nt, Chlamydia trachomatis
aauauacucccau

SEQ ID NO: 470178 - RNA, 12 nt, Chlamydia trachomatis
aauauagaauug

SEQ ID NO: 470179 - RNA, 12 nt, Chlamydia trachomatis
aauauagagcau

SEQ ID NO: 470180 - RNA, 16 nt, Chlamydia trachomatis
aauauauccaucuaca

SEQ ID NO: 470181 - RNA, 19 nt, Chlamydia trachomatis
aauauauggacaagcaaua

SEQ ID NO: 470182 - RNA, 17 nt, Chlamydia trachomatis
aauaucauccgcuaaag

SEQ ID NO: 470183 - RNA, 13 nt, Chlamydia trachomatis
aauauccacuuuu

SEQ ID NO: 470184 - RNA, 17 nt, Chlamydia trachomatis
aauauccccauccugaa

SEQ ID NO: 470185 - RNA, 18 nt, Chlamydia trachomatis
aauauccgcuagauccgu

SEQ ID NO: 470186 - RNA, 24 nt, Chlamydia trachomatis
aauaucgagcucauuuucuauuuc

SEQ ID NO: 470187 - RNA, 16 nt, Chlamydia trachomatis
aauaucguaaacaacc

SEQ ID NO: 470188 - RNA, 22 nt, Chlamydia trachomatis
aauaucuagguugaagaggcaa

SEQ ID NO: 470189 - RNA, 12 nt, Chlamydia trachomatis
aauaucugguug

SEQ ID NO: 470190 - RNA, 21 nt, Chlamydia trachomatis
aauaucuguuuuuccccauaa

SEQ ID NO: 470191 - RNA, 16 nt, Chlamydia trachomatis
aauaucuucacgauau

SEQ ID NO: 470192 - RNA, 15 nt, Chlamydia trachomatis
aauaucuucagaagc

SEQ ID NO: 470193 - RNA, 13 nt, Chlamydia trachomatis
aaucaggaaucac

SEQ ID NO: 470194 - RNA, 17 nt, Chlamydia trachomatis
aaucaguaagucaccau

SEQ ID NO: 470195 - RNA, 17 nt, Chlamydia trachomatis
aaucaguggaacugcuu

SEQ ID NO: 470196 - RNA, 21 nt, Chlamydia trachomatis
aauaugacagagcccuucuuu

SEQ ID NO: 470197 - RNA, 23 nt, Chlamydia trachomatis
aauaugacagagcccuucuuuuc

SEQ ID NO: 470198 - RNA, 17 nt, Chlamydia trachomatis
aaucaguugaaagacuu

SEQ ID NO: 470199 - RNA, 15 nt, Chlamydia trachomatis
aaucauaucaagaau

SEQ ID NO: 470200 - RNA, 18 nt, Chlamydia trachomatis
aaaaauuagggaaaaacu

SEQ ID NO: 470201 - RNA, 14 nt, Chlamydia trachomatis
aaaaauuccauguu

SEQ ID NO: 470202 - RNA, 14 nt, Chlamydia trachomatis
aaaaauuccucauu

SEQ ID NO: 470203 - RNA, 19 nt, Chlamydia trachomatis
aaucauuauccauaaaaau

SEQ ID NO: 470204 - RNA, 14 nt, Chlamydia trachomatis
aaucauucaucuuu

SEQ ID NO: 470205 - RNA, 15 nt, Chlamydia trachomatis
aauccaaaguacuca

SEQ ID NO: 470206 - RNA, 18 nt, Chlamydia trachomatis
aauccaaucacugcguca

SEQ ID NO: 470207 - RNA, 19 nt, Chlamydia trachomatis
aaucggauagagaagaauu

SEQ ID NO: 470208 - RNA, 19 nt, Chlamydia trachomatis
aaucgcugagcucuuuccu

SEQ ID NO: 470209 - RNA, 21 nt, Chlamydia trachomatis
aaucguauaaguuuuaagaag

SEQ ID NO: 470210 - RNA, 16 nt, Chlamydia trachomatis
aaucguauaauaaugg

SEQ ID NO: 470211 - RNA, 15 nt, Chlamydia trachomatis
aaucuaaaaagccau

SEQ ID NO: 470212 - RNA, 18 nt, Chlamydia trachomatis
aaucuaaaauuuccuuau

SEQ ID NO: 470213 - RNA, 20 nt, Chlamydia trachomatis
aaucuagacaagcacguaca

SEQ ID NO: 470214 - RNA, 21 nt, Chlamydia trachomatis
aaucuccuuaauuggagauug

SEQ ID NO: 470215 - RNA, 18 nt, Chlamydia trachomatis
aaucucgagcuaagaaaa

SEQ ID NO: 470216 - RNA, 12 nt, Chlamydia trachomatis
aaaaauuuugag

SEQ ID NO: 470217 - RNA, 16 nt, Chlamydia trachomatis
aauccuuuuuccuuaa

SEQ ID NO: 470218 - RNA, 20 nt, Chlamydia trachomatis
aaucgaagggaaaucuguuu

SEQ ID NO: 470219 - RNA, 17 nt, Chlamydia trachomatis
aaucccaucuccaauca

SEQ ID NO: 470220 - RNA, 15 nt, Chlamydia trachomatis
aauccccagucucuc

SEQ ID NO: 470221 - RNA, 20 nt, Chlamydia trachomatis
aauccucuagagccugcaag

SEQ ID NO: 470222 - RNA, 14 nt, Chlamydia trachomatis
aauccugcauuuau

SEQ ID NO: 470223 - RNA, 21 nt, Chlamydia trachomatis
aauccugcauuuauccacagg

SEQ ID NO: 470224 - RNA, 18 nt, Chlamydia trachomatis
aauccugcgcgcaaauca

SEQ ID NO: 470225 - RNA, 22 nt, Chlamydia trachomatis
aauccugcgcgcaaaucaggaa

SEQ ID NO: 470226 - RNA, 21 nt, Chlamydia trachomatis
aauccuggaaucacaugcuca

SEQ ID NO: 470227 - RNA, 21 nt, Chlamydia trachomatis
aauccuggaguauuuucaaaa

SEQ ID NO: 470228 - RNA, 19 nt, Chlamydia trachomatis
aauccuguagggaagauag

SEQ ID NO: 470229 - RNA, 21 nt, Chlamydia trachomatis
aauccuuuuaagauauccaua

SEQ ID NO: 470230 - RNA, 16 nt, Chlamydia trachomatis
aaugaagguuucuaaa

SEQ ID NO: 470231 - RNA, 21 nt, Chlamydia trachomatis
aaucucguugauuaaaguuuc

SEQ ID NO: 470232 - RNA, 18 nt, Chlamydia trachomatis
aaucuugucguuccucua

SEQ ID NO: 470233 - RNA, 20 nt, Chlamydia trachomatis
aaucuuucuuucuaagaaau

SEQ ID NO: 470234 - RNA, 22 nt, Chlamydia trachomatis
aaucuuucuuucuaagaaauug

SEQ ID NO: 470235 - RNA, 21 nt, Chlamydia trachomatis
aaucuuuuacuggagaacagu

SEQ ID NO: 470236 - RNA, 14 nt, Chlamydia trachomatis
aaugaaacaccucu

SEQ ID NO: 470237 - RNA, 13 nt, Chlamydia trachomatis
aaugacaaacuuu

SEQ ID NO: 470238 - RNA, 18 nt, Chlamydia trachomatis
aaugacacacguuccagu

SEQ ID NO: 470239 - RNA, 17 nt, Chlamydia trachomatis
aaugacagguuucauga

SEQ ID NO: 470240 - RNA, 13 nt, Chlamydia trachomatis
aaugaccuuuccc

SEQ ID NO: 470241 - RNA, 16 nt, Chlamydia trachomatis
aaugaccuuucccucg

SEQ ID NO: 470242 - RNA, 21 nt, Chlamydia trachomatis
aaugaccuuucccucguaaua

SEQ ID NO: 470243 - RNA, 17 nt, Chlamydia trachomatis
aaugagaggugugaaua

SEQ ID NO: 470244 - RNA, 23 nt, Chlamydia trachomatis
aaugaggauguggacgaacaaaa

SEQ ID NO: 470245 - RNA, 18 nt, Chlamydia trachomatis
aaugauaagggaaucaua

SEQ ID NO: 470246 - RNA, 21 nt, Chlamydia trachomatis
aaugauagcacccuuuuuaua

SEQ ID NO: 470247 - RNA, 18 nt, Chlamydia trachomatis
aaugauucuugaagauuu

SEQ ID NO: 470248 - RNA, 12 nt, Chlamydia trachomatis
aaugaugagaau

SEQ ID NO: 470249 - RNA, 21 nt, Chlamydia trachomatis
aaugauagugaucucaacgcu

SEQ ID NO: 470250 - RNA, 22 nt, Chlamydia trachomatis
aaugaucagcaaaaagaggaga

SEQ ID NO: 470251 - RNA, 15 nt, Chlamydia trachomatis
aaugaugaaaaagaa

SEQ ID NO: 470252 - RNA, 21 nt, Chlamydia trachomatis
aaugcgugaacuguucauucu

SEQ ID NO: 470253 - RNA, 15 nt, Chlamydia trachomatis
aaugcguucuucuau

SEQ ID NO: 470254 - RNA, 20 nt, Chlamydia trachomatis
aaugcguugcucuaccaacu

SEQ ID NO: 470255 - RNA, 22 nt, Chlamydia trachomatis
aaugcguugcucuaccaacuga

SEQ ID NO: 470256 - RNA, 21 nt, Chlamydia trachomatis
aaugccguuacuaacaucaaa

SEQ ID NO: 470257 - RNA, 13 nt, Chlamydia trachomatis
aaugccgaaacca

SEQ ID NO: 470258 - RNA, 18 nt, Chlamydia trachomatis
aaugcuaaggaguuuaac

SEQ ID NO: 470259 - RNA, 23 nt, Chlamydia trachomatis
aaugcucuaaaggauaaggaaga

SEQ ID NO: 470260 - RNA, 13 nt, Chlamydia trachomatis
aaugcugauaaaa

SEQ ID NO: 470261 - RNA, 18 nt, Chlamydia trachomatis
aaugcugauaaaaauaau

SEQ ID NO: 470262 - RNA, 14 nt, Chlamydia trachomatis
aaugcuggauugga

SEQ ID NO: 470263 - RNA, 23 nt, Chlamydia trachomatis
aaugcugcuguugcgauuugaua

SEQ ID NO: 470264 - RNA, 15 nt, Chlamydia trachomatis
aaugcugcuguuuau

SEQ ID NO: 470265 - RNA, 13 nt, Chlamydia trachomatis
aauggcaaaacuu

SEQ ID NO: 470266 - RNA, 15 nt, Chlamydia trachomatis
aauggcaaaacuucg

SEQ ID NO: 470267 - RNA, 18 nt, Chlamydia trachomatis
aauggcaaaaucuucaua

SEQ ID NO: 470268 - RNA, 12 nt, Chlamydia trachomatis
aauuuguagcaa

SEQ ID NO: 470269 - RNA, 19 nt, Chlamydia trachomatis
aauuuguagcaaaagauuu

SEQ ID NO: 470270 - RNA, 16 nt, Chlamydia trachomatis
aauuuuaaaucccagu

SEQ ID NO: 470271 - RNA, 23 nt, Chlamydia trachomatis
aauuuuaagaccgaaauuaguaa

SEQ ID NO: 470272 - RNA, 20 nt, Chlamydia trachomatis
aauuuuacacagauaggaac

SEQ ID NO: 470273 - RNA, 22 nt, Chlamydia trachomatis
aauuugcgcgucuagcgcauaa

SEQ ID NO: 470274 - RNA, 15 nt, Chlamydia trachomatis
aauuuggauaugccu

SEQ ID NO: 470275 - RNA, 11 nt, Chlamydia trachomatis
aauuuggauua

SEQ ID NO: 470276 - RNA, 17 nt, Chlamydia trachomatis
aauuuuaucuaaaaagg

SEQ ID NO: 470277 - RNA, 13 nt, Chlamydia trachomatis
aauuuucaugaaa

SEQ ID NO: 470278 - RNA, 16 nt, Chlamydia trachomatis
aauuuuccacaaauau

SEQ ID NO: 470279 - RNA, 22 nt, Chlamydia trachomatis
aauuuuccacaaauauuuuugg

SEQ ID NO: 470280 - RNA, 20 nt, Chlamydia trachomatis
aauuuucuucacuuccucuc

SEQ ID NO: 470281 - RNA, 18 nt, Chlamydia trachomatis
aauuuuguuuaaucagug

SEQ ID NO: 470282 - RNA, 16 nt, Chlamydia trachomatis
aauuuuguuaagaauu

SEQ ID NO: 470283 - RNA, 22 nt, Chlamydia trachomatis
aauuuuucucuaauaguugcaa

SEQ ID NO: 470284 - RNA, 15 nt, Chlamydia trachomatis
aauuuacgaaguauu

SEQ ID NO: 470285 - RNA, 21 nt, Chlamydia trachomatis
aauuuagacucggaaucucug

SEQ ID NO: 470286 - RNA, 21 nt, Chlamydia trachomatis
aauuuaucggcuaacgaguuu

SEQ ID NO: 470287 - RNA, 20 nt, Chlamydia trachomatis
aauuucaggaguaggaaggu

SEQ ID NO: 470288 - RNA, 17 nt, Chlamydia trachomatis
aauuucagggaaacgua

SEQ ID NO: 470289 - RNA, 18 nt, Chlamydia trachomatis
aauuucaucacagauaau

SEQ ID NO: 470290 - RNA, 23 nt, Chlamydia trachomatis
aauuucaucccacaugcuaguua

SEQ ID NO: 470291 - RNA, 16 nt, Chlamydia trachomatis
aauuucccucuucccg

SEQ ID NO: 470292 - RNA, 18 nt, Chlamydia trachomatis
aauuuccggacacacucu

SEQ ID NO: 470293 - RNA, 15 nt, Chlamydia trachomatis
aauuuccuuagaaag

SEQ ID NO: 470294 - RNA, 19 nt, Chlamydia trachomatis
aauuucuccagcaucuuuu

SEQ ID NO: 470295 - RNA, 20 nt, Chlamydia trachomatis
aauuucuuaaaagcacaaua

SEQ ID NO: 470296 - RNA, 12 nt, Chlamydia trachomatis
aauuucuugaac

SEQ ID NO: 470297 - RNA, 16 nt, Chlamydia trachomatis
aauguacgcuaaaaac

SEQ ID NO: 470298 - RNA, 16 nt, Chlamydia trachomatis
aauuacaauaauacaa

SEQ ID NO: 470299 - RNA, 21 nt, Chlamydia trachomatis
aauuacaacuaaaggaaacaa

SEQ ID NO: 470300 - RNA, 19 nt, Chlamydia trachomatis
aauuacgcgucuaaaacaa

SEQ ID NO: 470301 - RNA, 21 nt, Chlamydia trachomatis
aauuagaacggcauucccauu

SEQ ID NO: 470302 - RNA, 23 nt, Chlamydia trachomatis
aauuagcuacugucgaacgcuuc

SEQ ID NO: 470303 - RNA, 21 nt, Chlamydia trachomatis
aauuagggaaaaacuuuucuu

SEQ ID NO: 470304 - RNA, 23 nt, Chlamydia trachomatis
aauuaguaauaaaggaaacaaau

SEQ ID NO: 470305 - RNA, 19 nt, Chlamydia trachomatis
aauugagaacauaacacau

SEQ ID NO: 470306 - RNA, 15 nt, Chlamydia trachomatis
aauucuugccaccgc

SEQ ID NO: 470307 - RNA, 17 nt, Chlamydia trachomatis
aauucuuugaucuguaa

SEQ ID NO: 470308 - RNA, 18 nt, Chlamydia trachomatis
aauucuuuuacagaggua

SEQ ID NO: 470309 - RNA, 13 nt, Chlamydia trachomatis
aaaacaaaacuac

SEQ ID NO: 470310 - RNA, 15 nt, Chlamydia trachomatis
aauucaacauaauaa

SEQ ID NO: 470311 - RNA, 15 nt, Chlamydia trachomatis
aauucgcuaccaaaa

SEQ ID NO: 470312 - RNA, 21 nt, Chlamydia trachomatis
aauucguaugcaacuuguaua

SEQ ID NO: 470313 - RNA, 15 nt, Chlamydia trachomatis
acaagagagaacaaa

SEQ ID NO: 470314 - RNA, 19 nt, Chlamydia trachomatis
acaagaucuaucuauguuu

SEQ ID NO: 470315 - RNA, 16 nt, Chlamydia trachomatis
acaagaauaauagaga

SEQ ID NO: 470316 - RNA, 21 nt, Chlamydia trachomatis
acaagauuuugaauacgaucc

SEQ ID NO: 470317 - RNA, 14 nt, Chlamydia trachomatis
acaagcaauagcgc

SEQ ID NO: 470318 - RNA, 22 nt, Chlamydia trachomatis
acaagcacguacaauauguugc

SEQ ID NO: 470319 - RNA, 14 nt, Chlamydia trachomatis
acaaguauauaccc

SEQ ID NO: 470320 - RNA, 18 nt, Chlamydia trachomatis
acaaguaugagaggaaga

SEQ ID NO: 470321 - RNA, 21 nt, Chlamydia trachomatis
acaagucugcuaggucucccu

SEQ ID NO: 470322 - RNA, 16 nt, Chlamydia trachomatis
acaagugacauuucca

SEQ ID NO: 470323 - RNA, 19 nt, Chlamydia trachomatis
acaagugccaacaucaaaa

SEQ ID NO: 470324 - RNA, 20 nt, Chlamydia trachomatis
acaagugccaacaucaaaau

SEQ ID NO: 470325 - RNA, 16 nt, Chlamydia trachomatis
acaauaauacaaagca

SEQ ID NO: 470326 - RNA, 19 nt, Chlamydia trachomatis
acaauaauacaaagcacga

SEQ ID NO: 470327 - RNA, 17 nt, Chlamydia trachomatis
acaauagcauuugucuu

SEQ ID NO: 470328 - RNA, 15 nt, Chlamydia trachomatis
acaauaguaccuuca

SEQ ID NO: 470329 - RNA, 23 nt, Chlamydia trachomatis
acaacggcccuuccuaaccaagu

SEQ ID NO: 470330 - RNA, 14 nt, Chlamydia trachomatis
aauuuuugauacaa

SEQ ID NO: 470331 - RNA, 22 nt, Chlamydia trachomatis
aauuuuuugucgaauaggcaag

SEQ ID NO: 470332 - RNA, 14 nt, Chlamydia trachomatis
acaacguuacuacc

SEQ ID NO: 470333 - RNA, 16 nt, Chlamydia trachomatis
acaacguuacuaccga

SEQ ID NO: 470334 - RNA, 17 nt, Chlamydia trachomatis
acaacguuuaaugaaua

SEQ ID NO: 470335 - RNA, 18 nt, Chlamydia trachomatis
acaacuaaaggaaacaag

SEQ ID NO: 470336 - RNA, 23 nt, Chlamydia trachomatis
acaacuaaaggaaacaagcagau

SEQ ID NO: 470337 - RNA, 18 nt, Chlamydia trachomatis
acaacuaguuuacgcacu

SEQ ID NO: 470338 - RNA, 22 nt, Chlamydia trachomatis
acaacucuccuaauucaacaua

SEQ ID NO: 470339 - RNA, 16 nt, Chlamydia trachomatis
acaacugcucugccau

SEQ ID NO: 470340 - RNA, 21 nt, Chlamydia trachomatis
acaacuucaauagcaggaacu

SEQ ID NO: 470341 - RNA, 14 nt, Chlamydia trachomatis
acaacuucucuugu

SEQ ID NO: 470342 - RNA, 13 nt, Chlamydia trachomatis
acaacuugcguuu

SEQ ID NO: 470343 - RNA, 20 nt, Chlamydia trachomatis
acaacuuggugcagaagaau

SEQ ID NO: 470344 - RNA, 18 nt, Chlamydia trachomatis
acacaaguaugagaggaa

SEQ ID NO: 470345 - RNA, 20 nt, Chlamydia trachomatis
acacaaguaugagaggaaga

SEQ ID NO: 470346 - RNA, 14 nt, Chlamydia trachomatis
acaauguacgcuaa

SEQ ID NO: 470347 - RNA, 18 nt, Chlamydia trachomatis
acaauguacgcuaaaaac

SEQ ID NO: 470348 - RNA, 16 nt, Chlamydia trachomatis
acaauauguugccacu

SEQ ID NO: 470349 - RNA, 15 nt, Chlamydia trachomatis
acaaucucuuuaagc

SEQ ID NO: 470350 - RNA, 19 nt, Chlamydia trachomatis
acacaucuguauccuaacu

SEQ ID NO: 470351 - RNA, 17 nt, Chlamydia trachomatis
acaccagcggacaaguc

SEQ ID NO: 470352 - RNA, 13 nt, Chlamydia trachomatis
acacacucucccu

SEQ ID NO: 470353 - RNA, 21 nt, Chlamydia trachomatis
acacacucucccuguagagac

SEQ ID NO: 470354 - RNA, 18 nt, Chlamydia trachomatis
acacacuggguaucugaa

SEQ ID NO: 470355 - RNA, 16 nt, Chlamydia trachomatis
acacagcaucaagaau

SEQ ID NO: 470356 - RNA, 18 nt, Chlamydia trachomatis
acaccauuacgaggaagc

SEQ ID NO: 470357 - RNA, 18 nt, Chlamydia trachomatis
acaccauucagcaaaaaa

SEQ ID NO: 470358 - RNA, 20 nt, Chlamydia trachomatis
acacuagagucagaagcuau

SEQ ID NO: 470359 - RNA, 14 nt, Chlamydia trachomatis
acacuccucugaau

SEQ ID NO: 470360 - RNA, 23 nt, Chlamydia trachomatis
acacuccugaaaguuuuuucccc

SEQ ID NO: 470361 - RNA, 21 nt, Chlamydia trachomatis
acacugcgugaccguuaauau

SEQ ID NO: 470362 - RNA, 22 nt, Chlamydia trachomatis
acacuggguaucugaacaagaa

SEQ ID NO: 470363 - RNA, 21 nt, Chlamydia trachomatis
acacuuaaaaagaaacaaaac

SEQ ID NO: 470364 - RNA, 13 nt, Chlamydia trachomatis
acagagaaaaaga

SEQ ID NO: 470365 - RNA, 14 nt, Chlamydia trachomatis
acagagaaaaagau

SEQ ID NO: 470366 - RNA, 20 nt, Chlamydia trachomatis
acagaagaaggcauuuuugc

SEQ ID NO: 470367 - RNA, 14 nt, Chlamydia trachomatis
acagaagcugucag

SEQ ID NO: 470368 - RNA, 19 nt, Chlamydia trachomatis
acagaagcugucagaucau

SEQ ID NO: 470369 - RNA, 15 nt, Chlamydia trachomatis
acagaaucagguuug

SEQ ID NO: 470370 - RNA, 18 nt, Chlamydia trachomatis
acacuuccccauucuucu

SEQ ID NO: 470371 - RNA, 22 nt, Chlamydia trachomatis
acacuucucgaaaaaaugccuc

SEQ ID NO: 470372 - RNA, 17 nt, Chlamydia trachomatis
acacuucuuuaaagccu

SEQ ID NO: 470373 - RNA, 13 nt, Chlamydia trachomatis
acacuuuccccau

SEQ ID NO: 470374 - RNA, 21 nt, Chlamydia trachomatis
acagaaagaaaugcguuucuu

SEQ ID NO: 470375 - RNA, 13 nt, Chlamydia trachomatis
acagaaacguuua

SEQ ID NO: 470376 - RNA, 23 nt, Chlamydia trachomatis
acagaucuugaucugaaaagaga

SEQ ID NO: 470377 - RNA, 21 nt, Chlamydia trachomatis
acagaugacucaaacugugaa

SEQ ID NO: 470378 - RNA, 17 nt, Chlamydia trachomatis
acagaucauaggcuccu

SEQ ID NO: 470379 - RNA, 20 nt, Chlamydia trachomatis
acagaucauaggcuccugca

SEQ ID NO: 470380 - RNA, 22 nt, Chlamydia trachomatis
acagagccuuuuauucuucagu

SEQ ID NO: 470381 - RNA, 16 nt, Chlamydia trachomatis
acagaguuaccaauca

SEQ ID NO: 470382 - RNA, 20 nt, Chlamydia trachomatis
acagaguuaccaaucacgcu

SEQ ID NO: 470383 - RNA, 14 nt, Chlamydia trachomatis
acagcaucaagaau

SEQ ID NO: 470384 - RNA, 20 nt, Chlamydia trachomatis
acagcauacguuagcaaaga

SEQ ID NO: 470385 - RNA, 14 nt, Chlamydia trachomatis
acagauuugaguuu

SEQ ID NO: 470386 - RNA, 13 nt, Chlamydia trachomatis
acagcucuucuuc

SEQ ID NO: 470387 - RNA, 14 nt, Chlamydia trachomatis
acagcucuugcauu

SEQ ID NO: 470388 - RNA, 12 nt, Chlamydia trachomatis
acaggagaaaga

SEQ ID NO: 470389 - RNA, 18 nt, Chlamydia trachomatis
acauccaugucuaaggau

SEQ ID NO: 470390 - RNA, 21 nt, Chlamydia trachomatis
acauccaugucuaaggaugca

SEQ ID NO: 470391 - RNA, 14 nt, Chlamydia trachomatis
acaucaaaaugaua

SEQ ID NO: 470392 - RNA, 14 nt, Chlamydia trachomatis
acaucaacagaaga

SEQ ID NO: 470393 - RNA, 12 nt, Chlamydia trachomatis
acaucagagcaa

SEQ ID NO: 470394 - RNA, 15 nt, Chlamydia trachomatis
acauaugcucuuucc

SEQ ID NO: 470395 - RNA, 17 nt, Chlamydia trachomatis
acauauguccauacaaa

SEQ ID NO: 470396 - RNA, 15 nt, Chlamydia trachomatis
acauauagcauggaa

SEQ ID NO: 470397 - RNA, 13 nt, Chlamydia trachomatis
acauaucuccaaa

SEQ ID NO: 470398 - RNA, 20 nt, Chlamydia trachomatis
acauagcgacuaauacugac

SEQ ID NO: 470399 - RNA, 14 nt, Chlamydia trachomatis
acaggcagcagagc

SEQ ID NO: 470400 - RNA, 17 nt, Chlamydia trachomatis
acaggcagcagagccaa

SEQ ID NO: 470401 - RNA, 22 nt, Chlamydia trachomatis
acauacaggucaagccuacagc

SEQ ID NO: 470402 - RNA, 22 nt, Chlamydia trachomatis
acaucuuuagaauccaaagucu

SEQ ID NO: 470403 - RNA, 21 nt, Chlamydia trachomatis
acaucuuuuaaaguaaguaaa

SEQ ID NO: 470404 - RNA, 13 nt, Chlamydia trachomatis
acaucccagcaau

SEQ ID NO: 470405 - RNA, 15 nt, Chlamydia trachomatis
acauccuucugcuau

SEQ ID NO: 470406 - RNA, 13 nt, Chlamydia trachomatis
acaucgagaaaau

SEQ ID NO: 470407 - RNA, 16 nt, Chlamydia trachomatis
acaugauucaaaauaa

SEQ ID NO: 470408 - RNA, 17 nt, Chlamydia trachomatis
acaugauucaaaauaau

SEQ ID NO: 470409 - RNA, 13 nt, Chlamydia trachomatis
acauggccaaaca

SEQ ID NO: 470410 - RNA, 16 nt, Chlamydia trachomatis
acaugggcgucucuuu

SEQ ID NO: 470411 - RNA, 18 nt, Chlamydia trachomatis
acaugggcgucucuuuuu

SEQ ID NO: 470412 - RNA, 23 nt, Chlamydia trachomatis
acaugggcacgcuacuaacgaag

SEQ ID NO: 470413 - RNA, 17 nt, Chlamydia trachomatis
acauucgccucuucucu

SEQ ID NO: 470414 - RNA, 18 nt, Chlamydia trachomatis
acauucgccucuucucuu

SEQ ID NO: 470415 - RNA, 16 nt, Chlamydia trachomatis
acauucucggaaaaga

SEQ ID NO: 470416 - RNA, 17 nt, Chlamydia trachomatis
acauucucggaaaagau

SEQ ID NO: 470417 - RNA, 14 nt, Chlamydia trachomatis
acauucucuuuugc

SEQ ID NO: 470418 - RNA, 15 nt, Chlamydia trachomatis
acauucccuaaauau

SEQ ID NO: 470419 - RNA, 18 nt, Chlamydia trachomatis
acauuccucgauaaugcu

SEQ ID NO: 470420 - RNA, 22 nt, Chlamydia trachomatis
acauuauucacacuuaaaaaga

SEQ ID NO: 470421 - RNA, 16 nt, Chlamydia trachomatis
acauucagaauauagc

SEQ ID NO: 470422 - RNA, 15 nt, Chlamydia trachomatis
acauuccaaacccau

SEQ ID NO: 470423 - RNA, 21 nt, Chlamydia trachomatis
acauuccaaacccauccaugg

SEQ ID NO: 470424 - RNA, 13 nt, Chlamydia trachomatis
acauuccaaauau

SEQ ID NO: 470425 - RNA, 14 nt, Chlamydia trachomatis
accacagacucagg

SEQ ID NO: 470426 - RNA, 12 nt, Chlamydia trachomatis
accaauucucug

SEQ ID NO: 470427 - RNA, 20 nt, Chlamydia trachomatis
accaauuguugagcagcaaa

SEQ ID NO: 470428 - RNA, 16 nt, Chlamydia trachomatis
accacaaacaauucca

SEQ ID NO: 470429 - RNA, 14 nt, Chlamydia trachomatis
accacaaccucucu

SEQ ID NO: 470430 - RNA, 15 nt, Chlamydia trachomatis
accacaauuuuucuu

SEQ ID NO: 470431 - RNA, 14 nt, Chlamydia trachomatis
accaaucacgcuac

SEQ ID NO: 470432 - RNA, 20 nt, Chlamydia trachomatis
accaaucgagagguccaguc

SEQ ID NO: 470433 - RNA, 14 nt, Chlamydia trachomatis
accaaugaaacgga

SEQ ID NO: 470434 - RNA, 11 nt, Chlamydia trachomatis
accaagcuucu

SEQ ID NO: 470435 - RNA, 19 nt, Chlamydia trachomatis
accaaggauuuuuuuccca

SEQ ID NO: 470436 - RNA, 17 nt, Chlamydia trachomatis
accaaguucuucuuuag

SEQ ID NO: 470437 - RNA, 15 nt, Chlamydia trachomatis
acauuuccaacaaaa

SEQ ID NO: 470438 - RNA, 21 nt, Chlamydia trachomatis
accaccuucugcaugcaaaua

SEQ ID NO: 470439 - RNA, 23 nt, Chlamydia trachomatis
accaccuguugcuuuucgaauga

SEQ ID NO: 470440 - RNA, 16 nt, Chlamydia trachomatis
accacgagcauaagaa

SEQ ID NO: 470441 - RNA, 20 nt, Chlamydia trachomatis
accacgagcauaagaauaaa

SEQ ID NO: 470442 - RNA, 14 nt, Chlamydia trachomatis
accacucauuacca

SEQ ID NO: 470443 - RNA, 21 nt, Chlamydia trachomatis
accacgugcaacacaacuucu

SEQ ID NO: 470444 - RNA, 20 nt, Chlamydia trachomatis
accauaacaucuaacagaac

SEQ ID NO: 470445 - RNA, 12 nt, Chlamydia trachomatis
acccaagacacg

SEQ ID NO: 470446 - RNA, 12 nt, Chlamydia trachomatis
acccaaucuucu

SEQ ID NO: 470447 - RNA, 14 nt, Chlamydia trachomatis
accauuuccacagg

SEQ ID NO: 470448 - RNA, 14 nt, Chlamydia trachomatis
acccaugaacagca

SEQ ID NO: 470449 - RNA, 22 nt, Chlamydia trachomatis
accccaucccuugcaaaaaucu

SEQ ID NO: 470450 - RNA, 13 nt, Chlamydia trachomatis
accccccucugca

SEQ ID NO: 470451 - RNA, 13 nt, Chlamydia trachomatis
accccgccuccaa

SEQ ID NO: 470452 - RNA, 17 nt, Chlamydia trachomatis
accccuuacaauguaaa

SEQ ID NO: 470453 - RNA, 15 nt, Chlamydia trachomatis
accccucuuucucuc

SEQ ID NO: 470454 - RNA, 17 nt, Chlamydia trachomatis
acccuaaaucuccuccu

SEQ ID NO: 470455 - RNA, 21 nt, Chlamydia trachomatis
acccucuuuagccaauuucca

SEQ ID NO: 470456 - RNA, 20 nt, Chlamydia trachomatis
acccuccgacccaagacacg

SEQ ID NO: 470457 - RNA, 14 nt, Chlamydia trachomatis
accgagccuccgcu

SEQ ID NO: 470458 - RNA, 18 nt, Chlamydia trachomatis
accgaugaaauaucguaa

SEQ ID NO: 470459 - RNA, 15 nt, Chlamydia trachomatis
accgccucaaacaau

SEQ ID NO: 470460 - RNA, 12 nt, Chlamydia trachomatis
accuccuaaaua

SEQ ID NO: 470461 - RNA, 21 nt, Chlamydia trachomatis
accuccuuuauauucuucuuc

SEQ ID NO: 470462 - RNA, 12 nt, Chlamydia trachomatis
accuauggcauu

SEQ ID NO: 470463 - RNA, 18 nt, Chlamydia trachomatis
accucagauuuaucugcu

SEQ ID NO: 470464 - RNA, 20 nt, Chlamydia trachomatis
accuaggagcauuccuucua

SEQ ID NO: 470465 - RNA, 14 nt, Chlamydia trachomatis
accugaccuugaac

SEQ ID NO: 470466 - RNA, 15 nt, Chlamydia trachomatis
accugaagauuuuuu

SEQ ID NO: 470467 - RNA, 23 nt, Chlamydia trachomatis
accucuuuuuuaugggugaagaa

SEQ ID NO: 470468 - RNA, 21 nt, Chlamydia trachomatis
accucuuuuuuucccuagaaa

SEQ ID NO: 470469 - RNA, 17 nt, Chlamydia trachomatis
accucuuuuuuugcuca

SEQ ID NO: 470470 - RNA, 19 nt, Chlamydia trachomatis
accucuccauccugcgugu

SEQ ID NO: 470471 - RNA, 15 nt, Chlamydia trachomatis
accucucaucaguaa

SEQ ID NO: 470472 - RNA, 11 nt, Chlamydia trachomatis
accucuccuug

SEQ ID NO: 470473 - RNA, 17 nt, Chlamydia trachomatis
accucugcaagaaaaua

SEQ ID NO: 470474 - RNA, 22 nt, Chlamydia trachomatis
accucuggggggaaguaugcau

SEQ ID NO: 470475 - RNA, 21 nt, Chlamydia trachomatis
accucuuccguauggguuuuu

SEQ ID NO: 470476 - RNA, 18 nt, Chlamydia trachomatis
accucuucuggaauaucu

SEQ ID NO: 470477 - RNA, 18 nt, Chlamydia trachomatis
accucuugccugcaaaua

SEQ ID NO: 470478 - RNA, 19 nt, Chlamydia trachomatis
accucuugccugcaaauaa

SEQ ID NO: 470479 - RNA, 20 nt, Chlamydia trachomatis
accuugaguccgcaaacaaa

SEQ ID NO: 470480 - RNA, 21 nt, Chlamydia trachomatis
accuugaguccgcaaacaaaa

SEQ ID NO: 470481 - RNA, 19 nt, Chlamydia trachomatis
accuugcuuaacacuucuu

SEQ ID NO: 470482 - RNA, 20 nt, Chlamydia trachomatis
accuugcuuaacacuucuuu

SEQ ID NO: 470483 - RNA, 16 nt, Chlamydia trachomatis
accuuuaccaaagaau

SEQ ID NO: 470484 - RNA, 17 nt, Chlamydia trachomatis
accuuuuguuuuuuuau

SEQ ID NO: 470485 - RNA, 22 nt, Chlamydia trachomatis
accuguuguguaucaaaaucaa

SEQ ID NO: 470486 - RNA, 23 nt, Chlamydia trachomatis
accuguuguguaucaaaaucaau

SEQ ID NO: 470487 - RNA, 16 nt, Chlamydia trachomatis
accuguuucugaauca

SEQ ID NO: 470488 - RNA, 22 nt, Chlamydia trachomatis
accugggcauacaccugcaaga

SEQ ID NO: 470489 - RNA, 18 nt, Chlamydia trachomatis
accuuaaaagcaaggcuu

SEQ ID NO: 470490 - RNA, 12 nt, Chlamydia trachomatis
accuuauuauua

SEQ ID NO: 470491 - RNA, 13 nt, Chlamydia trachomatis
accuuauuauuac

SEQ ID NO: 470492 - RNA, 21 nt, Chlamydia trachomatis
accuucaaucuguaggggagg

SEQ ID NO: 470493 - RNA, 13 nt, Chlamydia trachomatis
acgaacuuuccau

SEQ ID NO: 470494 - RNA, 22 nt, Chlamydia trachomatis
acgaaggaaugguuacuugccu

SEQ ID NO: 470495 - RNA, 16 nt, Chlamydia trachomatis
acgaggcuucucuuuu

SEQ ID NO: 470496 - RNA, 14 nt, Chlamydia trachomatis
acgaguacagaaua

SEQ ID NO: 470497 - RNA, 24 nt, Chlamydia trachomatis
acgaguaucuguuaguagcuucuc

SEQ ID NO: 470498 - RNA, 15 nt, Chlamydia trachomatis
acgaugccauccaua

SEQ ID NO: 470499 - RNA, 17 nt, Chlamydia trachomatis
acgauguacucugcaaa

SEQ ID NO: 470500 - RNA, 16 nt, Chlamydia trachomatis
acgcaaaacaucuaga

SEQ ID NO: 470501 - RNA, 18 nt, Chlamydia trachomatis
acgcaaacgaucaaacuc

SEQ ID NO: 470502 - RNA, 20 nt, Chlamydia trachomatis
acgauucuugauaaauaauc

SEQ ID NO: 470503 - RNA, 18 nt, Chlamydia trachomatis
acgcaacccuaaaucucc

SEQ ID NO: 470504 - RNA, 22 nt, Chlamydia trachomatis
acgccaagaauugacagcacca

SEQ ID NO: 470505 - RNA, 16 nt, Chlamydia trachomatis
acgccagcuaagagaa

SEQ ID NO: 470506 - RNA, 12 nt, Chlamydia trachomatis
acgcaucuccaa

SEQ ID NO: 470507 - RNA, 17 nt, Chlamydia trachomatis
acgcaucuccaaagaca

SEQ ID NO: 470508 - RNA, 19 nt, Chlamydia trachomatis
acgcaucuccaaagacaca

SEQ ID NO: 470509 - RNA, 17 nt, Chlamydia trachomatis
acgccauaucaaagcua

SEQ ID NO: 470510 - RNA, 22 nt, Chlamydia trachomatis
acgccauaucaaagcuaacuca

SEQ ID NO: 470511 - RNA, 13 nt, Chlamydia trachomatis
acgcucuuucuua

SEQ ID NO: 470512 - RNA, 17 nt, Chlamydia trachomatis
acgcucuuuuucuucca

SEQ ID NO: 470513 - RNA, 18 nt, Chlamydia trachomatis
acgcucuuuuucuuccag

SEQ ID NO: 470514 - RNA, 13 nt, Chlamydia trachomatis
acgcucuccaaag

SEQ ID NO: 470515 - RNA, 17 nt, Chlamydia trachomatis
acgcucauagauuucag

SEQ ID NO: 470516 - RNA, 17 nt, Chlamydia trachomatis
acgcucaggcuaucaca

SEQ ID NO: 470517 - RNA, 19 nt, Chlamydia trachomatis
acgcucaggcuaucacaaa

SEQ ID NO: 470518 - RNA, 17 nt, Chlamydia trachomatis
acggagagaaagagggg

SEQ ID NO: 470519 - RNA, 14 nt, Chlamydia trachomatis
acggauaaagaaag

SEQ ID NO: 470520 - RNA, 18 nt, Chlamydia trachomatis
acggcaauaaagaaauaa

SEQ ID NO: 470521 - RNA, 17 nt, Chlamydia trachomatis
acgguggaacagcucua

SEQ ID NO: 470522 - RNA, 20 nt, Chlamydia trachomatis
acgguggaacagcucuaaag

SEQ ID NO: 470523 - RNA, 17 nt, Chlamydia trachomatis
acuauugaaauaccacu

SEQ ID NO: 470524 - RNA, 22 nt, Chlamydia trachomatis
acuacauucgccucuucucuuu

SEQ ID NO: 470525 - RNA, 20 nt, Chlamydia trachomatis
acuaccaaaccuuaaaagca

SEQ ID NO: 470526 - RNA, 15 nt, Chlamydia trachomatis
acuagaugcaauaaa

SEQ ID NO: 470527 - RNA, 14 nt, Chlamydia trachomatis
acuaguuuuuuccc

SEQ ID NO: 470528 - RNA, 20 nt, Chlamydia trachomatis
acuacagucuuccucugcuu

SEQ ID NO: 470529 - RNA, 22 nt, Chlamydia trachomatis
acuaauaaauuagggaagagca

SEQ ID NO: 470530 - RNA, 12 nt, Chlamydia trachomatis
acuaacaaauag

SEQ ID NO: 470531 - RNA, 13 nt, Chlamydia trachomatis
acuaacaucaaag

SEQ ID NO: 470532 - RNA, 18 nt, Chlamydia trachomatis
acuaacaucaaagaucuu

SEQ ID NO: 470533 - RNA, 23 nt, Chlamydia trachomatis
acuaagauccacuggaauagcua

SEQ ID NO: 470534 - RNA, 16 nt, Chlamydia trachomatis
acuaagucuguugccu

SEQ ID NO: 470535 - RNA, 16 nt, Chlamydia trachomatis
acguaggccacaagau

SEQ ID NO: 470536 - RNA, 17 nt, Chlamydia trachomatis
acguagauaucuuuacu

SEQ ID NO: 470537 - RNA, 22 nt, Chlamydia trachomatis
acgugcgacugcccuugagaac

SEQ ID NO: 470538 - RNA, 13 nt, Chlamydia trachomatis
acguuuaaugaau

SEQ ID NO: 470539 - RNA, 14 nt, Chlamydia trachomatis
acguuuagccucca

SEQ ID NO: 470540 - RNA, 15 nt, Chlamydia trachomatis
acuaaacuaucuaaa

SEQ ID NO: 470541 - RNA, 16 nt, Chlamydia trachomatis
acuaaaggaaacaagc

SEQ ID NO: 470542 - RNA, 18 nt, Chlamydia trachomatis
acuaaaggaaacaagcag

SEQ ID NO: 470543 - RNA, 13 nt, Chlamydia trachomatis
acuaaaucucuug

SEQ ID NO: 470544 - RNA, 23 nt, Chlamydia trachomatis
acuccuaaaguaagauuuuucag

SEQ ID NO: 470545 - RNA, 16 nt, Chlamydia trachomatis
acuccuaaaucgcaaa

SEQ ID NO: 470546 - RNA, 17 nt, Chlamydia trachomatis
acucccauaaucacaga

SEQ ID NO: 470547 - RNA, 15 nt, Chlamydia trachomatis
acucccccuuucaaa

SEQ ID NO: 470548 - RNA, 16 nt, Chlamydia trachomatis
acucccccuuucaaag

SEQ ID NO: 470549 - RNA, 18 nt, Chlamydia trachomatis
acucuuacgagcuuucuu

SEQ ID NO: 470550 - RNA, 20 nt, Chlamydia trachomatis
acucuucagguugcuugaau

SEQ ID NO: 470551 - RNA, 20 nt, Chlamydia trachomatis
acucuuguagaccuaagcua

SEQ ID NO: 470552 - RNA, 20 nt, Chlamydia trachomatis
acucuuguaucauauucuuu

SEQ ID NO: 470553 - RNA, 18 nt, Chlamydia trachomatis
acucugcggcuccuucuu

SEQ ID NO: 470554 - RNA, 19 nt, Chlamydia trachomatis
acucugcaccggcaaagaa

SEQ ID NO: 470555 - RNA, 22 nt, Chlamydia trachomatis
acucucgggccaaaaagacuac

SEQ ID NO: 470556 - RNA, 13 nt, Chlamydia trachomatis
acucucucucccc

SEQ ID NO: 470557 - RNA, 15 nt, Chlamydia trachomatis
acucuacaaaauaaa

SEQ ID NO: 470558 - RNA, 15 nt, Chlamydia trachomatis
acucuccuaauucaa

SEQ ID NO: 470559 - RNA, 11 nt, Chlamydia trachomatis
acucuuuucuu

SEQ ID NO: 470560 - RNA, 16 nt, Chlamydia trachomatis
acucuuuuuaaaucaa

SEQ ID NO: 470561 - RNA, 14 nt, Chlamydia trachomatis
acugaaagauucac

SEQ ID NO: 470562 - RNA, 20 nt, Chlamydia trachomatis
acugaaagauucacgaguuu

SEQ ID NO: 470563 - RNA, 16 nt, Chlamydia trachomatis
acugagagagcaauac

SEQ ID NO: 470564 - RNA, 19 nt, Chlamydia trachomatis
acugcaucauguugcguuu

SEQ ID NO: 470565 - RNA, 14 nt, Chlamydia trachomatis
acuggauccuaaau

SEQ ID NO: 470566 - RNA, 16 nt, Chlamydia trachomatis
acugcucuucuaacuu

SEQ ID NO: 470567 - RNA, 15 nt, Chlamydia trachomatis
acugcucugccauaa

SEQ ID NO: 470568 - RNA, 17 nt, Chlamydia trachomatis
acugucugagccuaugc

SEQ ID NO: 470569 - RNA, 13 nt, Chlamydia trachomatis
acuguugagaaaa

SEQ ID NO: 470570 - RNA, 21 nt, Chlamydia trachomatis
acuguugaggagacuuuagcu

SEQ ID NO: 470571 - RNA, 19 nt, Chlamydia trachomatis
acuuaccuuguuagaaaug

SEQ ID NO: 470572 - RNA, 15 nt, Chlamydia trachomatis
acuuacucucuaacu

SEQ ID NO: 470573 - RNA, 16 nt, Chlamydia trachomatis
acuucagcaacauuca

SEQ ID NO: 470574 - RNA, 23 nt, Chlamydia trachomatis
acuucagcgcgaauaaauccucu

SEQ ID NO: 470575 - RNA, 20 nt, Chlamydia trachomatis
acuucauacauaacuauccc

SEQ ID NO: 470576 - RNA, 23 nt, Chlamydia trachomatis
acuucaaguucuucuuccacaga

SEQ ID NO: 470577 - RNA, 14 nt, Chlamydia trachomatis
acuuagagacauuu

SEQ ID NO: 470578 - RNA, 13 nt, Chlamydia trachomatis
acuuagcacucaa

SEQ ID NO: 470579 - RNA, 22 nt, Chlamydia trachomatis
acuuagcaguuacauuuuucgc

SEQ ID NO: 470580 - RNA, 18 nt, Chlamydia trachomatis
acuucccuaauacaauca

SEQ ID NO: 470581 - RNA, 22 nt, Chlamydia trachomatis
acuucccacggaagaggagaga

SEQ ID NO: 470582 - RNA, 16 nt, Chlamydia trachomatis
acuucaucgagaagau

SEQ ID NO: 470583 - RNA, 19 nt, Chlamydia trachomatis
acuucaucgagaagaucuu

SEQ ID NO: 470584 - RNA, 17 nt, Chlamydia trachomatis
acuucauuuuugcuaaa

SEQ ID NO: 470585 - RNA, 22 nt, Chlamydia trachomatis
acuuccguaccaaggauuuuuu

SEQ ID NO: 470586 - RNA, 19 nt, Chlamydia trachomatis
acuucuuuaaagccuuucu

SEQ ID NO: 470587 - RNA, 11 nt, Chlamydia trachomatis
acuucuuuucc

SEQ ID NO: 470588 - RNA, 18 nt, Chlamydia trachomatis
acuucuuuuccaucuuua

SEQ ID NO: 470589 - RNA, 13 nt, Chlamydia trachomatis
acuucuucuuugg

SEQ ID NO: 470590 - RNA, 20 nt, Chlamydia trachomatis
acuucuucuuuggaaaaaaa

SEQ ID NO: 470591 - RNA, 22 nt, Chlamydia trachomatis
acuucuuguauaaguucuuuuu

SEQ ID NO: 470592 - RNA, 19 nt, Chlamydia trachomatis
acuucuucuaaguauucuu

SEQ ID NO: 470593 - RNA, 13 nt, Chlamydia trachomatis
acuucuucuagag

SEQ ID NO: 470594 - RNA, 13 nt, Chlamydia trachomatis
acuucuagauaga

SEQ ID NO: 470595 - RNA, 22 nt, Chlamydia trachomatis
acuucuauccggaguaccaaaa

SEQ ID NO: 470596 - RNA, 15 nt, Chlamydia trachomatis
acuucuccaguuaau

SEQ ID NO: 470597 - RNA, 22 nt, Chlamydia trachomatis
acuucucgaaaaaaugccucca

SEQ ID NO: 470598 - RNA, 23 nt, Chlamydia trachomatis
acuucucgaaaaaaugccuccau

SEQ ID NO: 470599 - RNA, 15 nt, Chlamydia trachomatis
acuucucuuguucug

SEQ ID NO: 470600 - RNA, 15 nt, Chlamydia trachomatis
acuucugcuaaaaau

SEQ ID NO: 470601 - RNA, 21 nt, Chlamydia trachomatis
acuucugcuaaaaaugcuugc

SEQ ID NO: 470602 - RNA, 18 nt, Chlamydia trachomatis
acuucuggagauugaaua

SEQ ID NO: 470603 - RNA, 22 nt, Chlamydia trachomatis
acuucuggcaguaacaagcaca

SEQ ID NO: 470604 - RNA, 17 nt, Chlamydia trachomatis
acuucuuacuuaaaaaa

SEQ ID NO: 470605 - RNA, 18 nt, Chlamydia trachomatis
acuucuuacuuaaaaaac

SEQ ID NO: 470606 - RNA, 21 nt, Chlamydia trachomatis
acuucuuacuuaaaaaacaaa

SEQ ID NO: 470607 - RNA, 13 nt, Chlamydia trachomatis
agaaaagagcagc

SEQ ID NO: 470608 - RNA, 23 nt, Chlamydia trachomatis
agaaaacaucgccauucccaaau

SEQ ID NO: 470609 - RNA, 18 nt, Chlamydia trachomatis
agaaaaggauaguuucga

SEQ ID NO: 470610 - RNA, 11 nt, Chlamydia trachomatis
agaaaaggccg

SEQ ID NO: 470611 - RNA, 14 nt, Chlamydia trachomatis
agaaaauaaacaca

SEQ ID NO: 470612 - RNA, 16 nt, Chlamydia trachomatis
agaaaauaaguuaccu

SEQ ID NO: 470613 - RNA, 19 nt, Chlamydia trachomatis
agaaacagccugcuuucuu

SEQ ID NO: 470614 - RNA, 14 nt, Chlamydia trachomatis
agaaacaggagaaa

SEQ ID NO: 470615 - RNA, 16 nt, Chlamydia trachomatis
agaaacaggagaaaga

SEQ ID NO: 470616 - RNA, 18 nt, Chlamydia trachomatis
agaaacaggagaaagaac

SEQ ID NO: 470617 - RNA, 17 nt, Chlamydia trachomatis
acuuuugguucugccag

SEQ ID NO: 470618 - RNA, 22 nt, Chlamydia trachomatis
acuugaguaaucaguugaaaga

SEQ ID NO: 470619 - RNA, 17 nt, Chlamydia trachomatis
acuugauaaauagcaau

SEQ ID NO: 470620 - RNA, 18 nt, Chlamydia trachomatis
acuugauuggauaacguc

SEQ ID NO: 470621 - RNA, 12 nt, Chlamydia trachomatis
acuuuuuagcau

SEQ ID NO: 470622 - RNA, 22 nt, Chlamydia trachomatis
acuuuuuagcaucugauacuga

SEQ ID NO: 470623 - RNA, 19 nt, Chlamydia trachomatis
agaaaaacuccuucuguug

SEQ ID NO: 470624 - RNA, 13 nt, Chlamydia trachomatis
agaaaaagggaga

SEQ ID NO: 470625 - RNA, 19 nt, Chlamydia trachomatis
agaaaaaguaagcgaagaa

SEQ ID NO: 470626 - RNA, 12 nt, Chlamydia trachomatis
agaaaaauaaaa

SEQ ID NO: 470627 - RNA, 19 nt, Chlamydia trachomatis
agaaaaaucuagacaagca

SEQ ID NO: 470628 - RNA, 16 nt, Chlamydia trachomatis
agaaaaauugcaaaga

SEQ ID NO: 470629 - RNA, 22 nt, Chlamydia trachomatis
agaaaacagccaagcaagauau

SEQ ID NO: 470630 - RNA, 20 nt, Chlamydia trachomatis
agaaacuauugaucaaagua

SEQ ID NO: 470631 - RNA, 17 nt, Chlamydia trachomatis
agaaacuguaauguccu

SEQ ID NO: 470632 - RNA, 15 nt, Chlamydia trachomatis
agaaacuucuggaga

SEQ ID NO: 470633 - RNA, 12 nt, Chlamydia trachomatis
agaaacuucuuc

SEQ ID NO: 470634 - RNA, 15 nt, Chlamydia trachomatis
agaaacuucuucuaa

SEQ ID NO: 470635 - RNA, 14 nt, Chlamydia trachomatis
agaaacuuuucugc

SEQ ID NO: 470636 - RNA, 17 nt, Chlamydia trachomatis
agaaacuuuucugcaga

SEQ ID NO: 470637 - RNA, 14 nt, Chlamydia trachomatis
agaaagaaccacaa

SEQ ID NO: 470638 - RNA, 17 nt, Chlamydia trachomatis
agaaagagccaacgaau

SEQ ID NO: 470639 - RNA, 23 nt, Chlamydia trachomatis
agaaagagcgaugauuaucaccu

SEQ ID NO: 470640 - RNA, 23 nt, Chlamydia trachomatis
agaaagagggguuucauuuauag

SEQ ID NO: 470641 - RNA, 18 nt, Chlamydia trachomatis
agaaagcccuauuuccua

SEQ ID NO: 470642 - RNA, 22 nt, Chlamydia trachomatis
agaaagccuucucuuuucacaa

SEQ ID NO: 470643 - RNA, 14 nt, Chlamydia trachomatis
agaaagcugggaaa

SEQ ID NO: 470644 - RNA, 21 nt, Chlamydia trachomatis
agaaaggucugcauauuuaau

SEQ ID NO: 470645 - RNA, 16 nt, Chlamydia trachomatis
agaaagguuuuucuua

SEQ ID NO: 470646 - RNA, 22 nt, Chlamydia trachomatis
agaaaguaauucuucuugaucg

SEQ ID NO: 470647 - RNA, 15 nt, Chlamydia trachomatis
agaaaguuuuuuuca

SEQ ID NO: 470648 - RNA, 18 nt, Chlamydia trachomatis
agaaaguuuuuuucagga

SEQ ID NO: 470649 - RNA, 23 nt, Chlamydia trachomatis
agaaauagcuucguagagcaaga

SEQ ID NO: 470650 - RNA, 21 nt, Chlamydia trachomatis
agaaauaugacagagcccuuc

SEQ ID NO: 470651 - RNA, 22 nt, Chlamydia trachomatis
aaaacaauuuccuuagaaagaa

SEQ ID NO: 470652 - RNA, 13 nt, Chlamydia trachomatis
aaaacacaaaagc

SEQ ID NO: 470653 - RNA, 14 nt, Chlamydia trachomatis
agaaauuacagaag

SEQ ID NO: 470654 - RNA, 15 nt, Chlamydia trachomatis
agaaauucuucaucu

SEQ ID NO: 470655 - RNA, 20 nt, Chlamydia trachomatis
agaaauugauagugaaauaa

SEQ ID NO: 470656 - RNA, 16 nt, Chlamydia trachomatis
agaaauugcucaggaa

SEQ ID NO: 470657 - RNA, 15 nt, Chlamydia trachomatis
agaacaagauaaaga

SEQ ID NO: 470658 - RNA, 15 nt, Chlamydia trachomatis
agaacaaucuggagc

SEQ ID NO: 470659 - RNA, 20 nt, Chlamydia trachomatis
agaacagauugagaauaaau

SEQ ID NO: 470660 - RNA, 23 nt, Chlamydia trachomatis
agaacagauugagaauaaauaua

SEQ ID NO: 470661 - RNA, 18 nt, Chlamydia trachomatis
agaacagauuuagagaau

SEQ ID NO: 470662 - RNA, 20 nt, Chlamydia trachomatis
agaacagauuuagagaauaa

SEQ ID NO: 470663 - RNA, 14 nt, Chlamydia trachomatis
agaaccgcaagcaa

SEQ ID NO: 470664 - RNA, 15 nt, Chlamydia trachomatis
agaacauaacaaggc

SEQ ID NO: 470665 - RNA, 16 nt, Chlamydia trachomatis
agaacauaacacauau

SEQ ID NO: 470666 - RNA, 17 nt, Chlamydia trachomatis
agaacaguguccuucca

SEQ ID NO: 470667 - RNA, 19 nt, Chlamydia trachomatis
agaacaguguccuuccaug

SEQ ID NO: 470668 - RNA, 20 nt, Chlamydia trachomatis
agaacguuuagcuaacucuu

SEQ ID NO: 470669 - RNA, 19 nt, Chlamydia trachomatis
agaacguuucgucucuuua

SEQ ID NO: 470670 - RNA, 16 nt, Chlamydia trachomatis
agaacucaaaauaaag

SEQ ID NO: 470671 - RNA, 19 nt, Chlamydia trachomatis
agaacucaaaauaaagaaa

SEQ ID NO: 470672 - RNA, 13 nt, Chlamydia trachomatis
agaacucccccuu

SEQ ID NO: 470673 - RNA, 17 nt, Chlamydia trachomatis
agaacucccuccaaaaa

SEQ ID NO: 470674 - RNA, 14 nt, Chlamydia trachomatis
agaacugcagugac

SEQ ID NO: 470675 - RNA, 14 nt, Chlamydia trachomatis
agaacugucuucuu

SEQ ID NO: 470676 - RNA, 16 nt, Chlamydia trachomatis
agaagauccuucgcag

SEQ ID NO: 470677 - RNA, 18 nt, Chlamydia trachomatis
agaagaucccaacaggag

SEQ ID NO: 470678 - RNA, 13 nt, Chlamydia trachomatis
agaagaucccaua

SEQ ID NO: 470679 - RNA, 14 nt, Chlamydia trachomatis
agaaggaagaggag

SEQ ID NO: 470680 - RNA, 14 nt, Chlamydia trachomatis
agaaggccuuuuuu

SEQ ID NO: 470681 - RNA, 11 nt, Chlamydia trachomatis
agaaggaucua

SEQ ID NO: 470682 - RNA, 22 nt, Chlamydia trachomatis
agaagcuaugagaauuuccagc

SEQ ID NO: 470683 - RNA, 21 nt, Chlamydia trachomatis
agaagcuccuuuaccuuucac

SEQ ID NO: 470684 - RNA, 12 nt, Chlamydia trachomatis
agaagcugcaua

SEQ ID NO: 470685 - RNA, 19 nt, Chlamydia trachomatis
agaagcugagcuucucgcu

SEQ ID NO: 470686 - RNA, 15 nt, Chlamydia trachomatis
agaagcugcagagau

SEQ ID NO: 470687 - RNA, 23 nt, Chlamydia trachomatis
agaaggggcauuacgccccuucu

SEQ ID NO: 470688 - RNA, 15 nt, Chlamydia trachomatis
agaagguaacaaugc

SEQ ID NO: 470689 - RNA, 19 nt, Chlamydia trachomatis
agaagguccgccaacuauu

SEQ ID NO: 470690 - RNA, 15 nt, Chlamydia trachomatis
agaaggucugaacaa

SEQ ID NO: 470691 - RNA, 17 nt, Chlamydia trachomatis
agaagguugaauuucag

SEQ ID NO: 470692 - RNA, 14 nt, Chlamydia trachomatis
agaaguaaaacaga

SEQ ID NO: 470693 - RNA, 19 nt, Chlamydia trachomatis
agaaguaacaccucuucug

SEQ ID NO: 470694 - RNA, 12 nt, Chlamydia trachomatis
agaauccaaagu

SEQ ID NO: 470695 - RNA, 17 nt, Chlamydia trachomatis
agaauccaaauuuuguu

SEQ ID NO: 470696 - RNA, 16 nt, Chlamydia trachomatis
agaauccuuuucagaa

SEQ ID NO: 470697 - RNA, 15 nt, Chlamydia trachomatis
agaaugaucacuuga

SEQ ID NO: 470698 - RNA, 22 nt, Chlamydia trachomatis
agaaugaucacuugaaucacac

SEQ ID NO: 470699 - RNA, 22 nt, Chlamydia trachomatis
agaauguggguguagguuuugu

SEQ ID NO: 470700 - RNA, 18 nt, Chlamydia trachomatis
agaaugugacuaaaggcg

SEQ ID NO: 470701 - RNA, 22 nt, Chlamydia trachomatis
agaauugacgaaucgcaccauu

SEQ ID NO: 470702 - RNA, 15 nt, Chlamydia trachomatis
agaauuggaaacucu

SEQ ID NO: 470703 - RNA, 17 nt, Chlamydia trachomatis
agaauugccgaaucaaa

SEQ ID NO: 470704 - RNA, 16 nt, Chlamydia trachomatis
agaauuuuccguaaaa

SEQ ID NO: 470705 - RNA, 20 nt, Chlamydia trachomatis
agaauuuuucuaaaaucugc

SEQ ID NO: 470706 - RNA, 19 nt, Chlamydia trachomatis
agacaaauugcacuaaaga

SEQ ID NO: 470707 - RNA, 18 nt, Chlamydia trachomatis
agacaagacuucuucuaa

SEQ ID NO: 470708 - RNA, 20 nt, Chlamydia trachomatis
agacaauggucuccuaaauc

SEQ ID NO: 470709 - RNA, 15 nt, Chlamydia trachomatis
agacaauucagaaau

SEQ ID NO: 470710 - RNA, 17 nt, Chlamydia trachomatis
agacaauucagaaauau

SEQ ID NO: 470711 - RNA, 21 nt, Chlamydia trachomatis
agacaauucagaaauaugaca

SEQ ID NO: 470712 - RNA, 22 nt, Chlamydia trachomatis
agacacuauuaaaaaggcuaga

SEQ ID NO: 470713 - RNA, 13 nt, Chlamydia trachomatis
agacagaacaaac

SEQ ID NO: 470714 - RNA, 17 nt, Chlamydia trachomatis
agacagagaauagcugc

SEQ ID NO: 470715 - RNA, 18 nt, Chlamydia trachomatis
agacagagaauagcugcc

SEQ ID NO: 470716 - RNA, 15 nt, Chlamydia trachomatis
agacagcucuugcau

SEQ ID NO: 470717 - RNA, 19 nt, Chlamydia trachomatis
agacaucgcuguauuuccu

SEQ ID NO: 470718 - RNA, 15 nt, Chlamydia trachomatis
agacauaaaagcugu

SEQ ID NO: 470719 - RNA, 18 nt, Chlamydia trachomatis
agaccaggauuccccguc

SEQ ID NO: 470720 - RNA, 14 nt, Chlamydia trachomatis
aaaacagccaagca

SEQ ID NO: 470721 - RNA, 21 nt, Chlamydia trachomatis
agaccugcuucagcagcauaa

SEQ ID NO: 470722 - RNA, 15 nt, Chlamydia trachomatis
agaccgcucucuuuu

SEQ ID NO: 470723 - RNA, 17 nt, Chlamydia trachomatis
agaccgagauuaucauu

SEQ ID NO: 470724 - RNA, 19 nt, Chlamydia trachomatis
agaccauuggaauuuucau

SEQ ID NO: 470725 - RNA, 10 nt, Chlamydia trachomatis
aaaacagcuc

SEQ ID NO: 470726 - RNA, 18 nt, Chlamydia trachomatis
agacgauucucaugcacu

SEQ ID NO: 470727 - RNA, 24 nt, Chlamydia trachomatis
agacgcaucacggcuucugucccu

SEQ ID NO: 470728 - RNA, 20 nt, Chlamydia trachomatis
agacguucuugcugagaauc

SEQ ID NO: 470729 - RNA, 13 nt, Chlamydia trachomatis
agagaucauacca

SEQ ID NO: 470730 - RNA, 13 nt, Chlamydia trachomatis
agagaucccgaau

SEQ ID NO: 470731 - RNA, 14 nt, Chlamydia trachomatis
agagaucuucugaa

SEQ ID NO: 470732 - RNA, 15 nt, Chlamydia trachomatis
agagaucuucugaaa

SEQ ID NO: 470733 - RNA, 18 nt, Chlamydia trachomatis
agagaucuucugaaaaau

SEQ ID NO: 470734 - RNA, 17 nt, Chlamydia trachomatis
agagaugauauuuucau

SEQ ID NO: 470735 - RNA, 12 nt, Chlamydia trachomatis
agagaugcguug

SEQ ID NO: 470736 - RNA, 21 nt, Chlamydia trachomatis
agagaugggucuuuuugcuac

SEQ ID NO: 470737 - RNA, 13 nt, Chlamydia trachomatis
agagcaauauguu

SEQ ID NO: 470738 - RNA, 21 nt, Chlamydia trachomatis
aaaacauuccugccaaaaacc

SEQ ID NO: 470739 - RNA, 22 nt, Chlamydia trachomatis
aaaacauuccugccaaaaacca

SEQ ID NO: 470740 - RNA, 23 nt, Chlamydia trachomatis
agagcuuugaucuuuguucucua

SEQ ID NO: 470741 - RNA, 20 nt, Chlamydia trachomatis
agagcuuugcacaccugcuu

SEQ ID NO: 470742 - RNA, 15 nt, Chlamydia trachomatis
agagcuuuucuuccc

SEQ ID NO: 470743 - RNA, 21 nt, Chlamydia trachomatis
agagcuuuuuuuuucagcaau

SEQ ID NO: 470744 - RNA, 16 nt, Chlamydia trachomatis
agaggccuccauuucc

SEQ ID NO: 470745 - RNA, 19 nt, Chlamydia trachomatis
agaggcgaaaguuuccuua

SEQ ID NO: 470746 - RNA, 20 nt, Chlamydia trachomatis
agaggauuauuccgagagaa

SEQ ID NO: 470747 - RNA, 13 nt, Chlamydia trachomatis
agaggcaccucuu

SEQ ID NO: 470748 - RNA, 16 nt, Chlamydia trachomatis
agaggcauggaauggg

SEQ ID NO: 470749 - RNA, 20 nt, Chlamydia trachomatis
agaggcauggaauggggagg

SEQ ID NO: 470750 - RNA, 23 nt, Chlamydia trachomatis
agaggagaaggucgucagugcag

SEQ ID NO: 470751 - RNA, 13 nt, Chlamydia trachomatis
agaggagaggcua

SEQ ID NO: 470752 - RNA, 18 nt, Chlamydia trachomatis
agaggagauauucagguc

SEQ ID NO: 470753 - RNA, 23 nt, Chlamydia trachomatis
agaggagggagaauuaauaggaa

SEQ ID NO: 470754 - RNA, 22 nt, Chlamydia trachomatis
agaggaucagcguugggauaga

SEQ ID NO: 470755 - RNA, 23 nt, Chlamydia trachomatis
agaggcuaguaaugugucuaaag

SEQ ID NO: 470756 - RNA, 17 nt, Chlamydia trachomatis
agaggcuauugauuuuu

SEQ ID NO: 470757 - RNA, 16 nt, Chlamydia trachomatis
agagguagccaaagaa

SEQ ID NO: 470758 - RNA, 19 nt, Chlamydia trachomatis
agagguuguuacagucugu

SEQ ID NO: 470759 - RNA, 22 nt, Chlamydia trachomatis
agagguuguuacagucuguguu

SEQ ID NO: 470760 - RNA, 20 nt, Chlamydia trachomatis
agaggugugauaggagagga

SEQ ID NO: 470761 - RNA, 22 nt, Chlamydia trachomatis
agauaaguccaucuaaagggag

SEQ ID NO: 470762 - RNA, 20 nt, Chlamydia trachomatis
agauaagcaagcauaauucc

SEQ ID NO: 470763 - RNA, 14 nt, Chlamydia trachomatis
agauagaucuaaag

SEQ ID NO: 470764 - RNA, 23 nt, Chlamydia trachomatis
agauacuuuaccgcaaauaucca

SEQ ID NO: 470765 - RNA, 22 nt, Chlamydia trachomatis
agauacuuuccgcuggaaacau

SEQ ID NO: 470766 - RNA, 21 nt, Chlamydia trachomatis
agaguuccuaaauaccucuuu

SEQ ID NO: 470767 - RNA, 16 nt, Chlamydia trachomatis
agaguugcaaguuggu

SEQ ID NO: 470768 - RNA, 14 nt, Chlamydia trachomatis
agaguuaccaauca

SEQ ID NO: 470769 - RNA, 22 nt, Chlamydia trachomatis
agaguaaucggauagagaagaa

SEQ ID NO: 470770 - RNA, 22 nt, Chlamydia trachomatis
agagugugcuucuggacuauuu

SEQ ID NO: 470771 - RNA, 13 nt, Chlamydia trachomatis
agauauccaaucc

SEQ ID NO: 470772 - RNA, 20 nt, Chlamydia trachomatis
agauauagguuccaucuaaa

SEQ ID NO: 470773 - RNA, 21 nt, Chlamydia trachomatis
agauagccuccgcuaauuuuu

SEQ ID NO: 470774 - RNA, 19 nt, Chlamydia trachomatis
agauauucacgcaucccaa

SEQ ID NO: 470775 - RNA, 14 nt, Chlamydia trachomatis
agauauccauagcc

SEQ ID NO: 470776 - RNA, 23 nt, Chlamydia trachomatis
agauaucuuuacucuuuucuuua

SEQ ID NO: 470777 - RNA, 14 nt, Chlamydia trachomatis
agaucauaucugca

SEQ ID NO: 470778 - RNA, 16 nt, Chlamydia trachomatis
agaucauaaagucuac

SEQ ID NO: 470779 - RNA, 22 nt, Chlamydia trachomatis
agaucauaaagucuaccaguuc

SEQ ID NO: 470780 - RNA, 22 nt, Chlamydia trachomatis
agaucaugggaaauaaauaagu

SEQ ID NO: 470781 - RNA, 22 nt, Chlamydia trachomatis
agauccacuggaauagcuagag

SEQ ID NO: 470782 - RNA, 13 nt, Chlamydia trachomatis
agauccucuuucg

SEQ ID NO: 470783 - RNA, 16 nt, Chlamydia trachomatis
agaugaccacuacucu

SEQ ID NO: 470784 - RNA, 21 nt, Chlamydia trachomatis
agaugacucaaacugugaaga

SEQ ID NO: 470785 - RNA, 13 nt, Chlamydia trachomatis
agauggagaggag

SEQ ID NO: 470786 - RNA, 15 nt, Chlamydia trachomatis
agauggagaggagua

SEQ ID NO: 470787 - RNA, 20 nt, Chlamydia trachomatis
agauguaggauucagagagg

SEQ ID NO: 470788 - RNA, 17 nt, Chlamydia trachomatis
agauuaagauuauaauu

SEQ ID NO: 470789 - RNA, 16 nt, Chlamydia trachomatis
agauguuaucucuggu

SEQ ID NO: 470790 - RNA, 16 nt, Chlamydia trachomatis
agauucagcaagauuc

SEQ ID NO: 470791 - RNA, 20 nt, Chlamydia trachomatis
agauucagcaagauucuccu

SEQ ID NO: 470792 - RNA, 11 nt, Chlamydia trachomatis
agauuccacaa

SEQ ID NO: 470793 - RNA, 19 nt, Chlamydia trachomatis
agauuccacaacggcccuu

SEQ ID NO: 470794 - RNA, 13 nt, Chlamydia trachomatis
agauucgcugcug

SEQ ID NO: 470795 - RNA, 15 nt, Chlamydia trachomatis
agauucgcugcuguc

SEQ ID NO: 470796 - RNA, 21 nt, Chlamydia trachomatis
agauugauuguugcauaucca

SEQ ID NO: 470797 - RNA, 15 nt, Chlamydia trachomatis
agauugcaacucuug

SEQ ID NO: 470798 - RNA, 21 nt, Chlamydia trachomatis
agauugccuuuucuauuuaga

SEQ ID NO: 470799 - RNA, 22 nt, Chlamydia trachomatis
agauugccuuuucuauuuagag

SEQ ID NO: 470800 - RNA, 15 nt, Chlamydia trachomatis
agauuuaucugcuau

SEQ ID NO: 470801 - RNA, 23 nt, Chlamydia trachomatis
agauuuaucugcuauagaaagca

SEQ ID NO: 470802 - RNA, 17 nt, Chlamydia trachomatis
agauuuagagaauaauc

SEQ ID NO: 470803 - RNA, 21 nt, Chlamydia trachomatis
agauuucgauuugaugagagc

SEQ ID NO: 470804 - RNA, 21 nt, Chlamydia trachomatis
agauuucuucuguagccccag

SEQ ID NO: 470805 - RNA, 14 nt, Chlamydia trachomatis
agauuugccuccag

SEQ ID NO: 470806 - RNA, 19 nt, Chlamydia trachomatis
agauuuguuuaaaagaagc

SEQ ID NO: 470807 - RNA, 20 nt, Chlamydia trachomatis
agauuuuaugacccagaauc

SEQ ID NO: 470808 - RNA, 18 nt, Chlamydia trachomatis
agauuuucaugcaaguaa

SEQ ID NO: 470809 - RNA, 23 nt, Chlamydia trachomatis
agauuuucuagggaaaaaaagag

SEQ ID NO: 470810 - RNA, 15 nt, Chlamydia trachomatis
agauuuuuagaagga

SEQ ID NO: 470811 - RNA, 16 nt, Chlamydia trachomatis
agauuuuuagaaggaa

SEQ ID NO: 470812 - RNA, 15 nt, Chlamydia trachomatis
agcaaacuucauauu

SEQ ID NO: 470813 - RNA, 13 nt, Chlamydia trachomatis
agcaaaaucuucu

SEQ ID NO: 470814 - RNA, 14 nt, Chlamydia trachomatis
agcaaaagaaaaau

SEQ ID NO: 470815 - RNA, 19 nt, Chlamydia trachomatis
agcaaaagaagaaucuucu

SEQ ID NO: 470816 - RNA, 23 nt, Chlamydia trachomatis
agcaaaagaagaaucuucuucga

SEQ ID NO: 470817 - RNA, 15 nt, Chlamydia trachomatis
agcaaaaaaaucgau

SEQ ID NO: 470818 - RNA, 20 nt, Chlamydia trachomatis
agauuuuuugagcaaaauag

SEQ ID NO: 470819 - RNA, 15 nt, Chlamydia trachomatis
agcaaaaacugucug

SEQ ID NO: 470820 - RNA, 20 nt, Chlamydia trachomatis
agcaaaacauccaugucuaa

SEQ ID NO: 470821 - RNA, 18 nt, Chlamydia trachomatis
agcaaauuaacagauaua

SEQ ID NO: 470822 - RNA, 14 nt, Chlamydia trachomatis
agcaacaauauccu

SEQ ID NO: 470823 - RNA, 15 nt, Chlamydia trachomatis
agcaaauagauaacu

SEQ ID NO: 470824 - RNA, 21 nt, Chlamydia trachomatis
agcaaauagauaacuuugaac

SEQ ID NO: 470825 - RNA, 22 nt, Chlamydia trachomatis
agcaaauccugcgcgcaaauca

SEQ ID NO: 470826 - RNA, 13 nt, Chlamydia trachomatis
agcaacauucacg

SEQ ID NO: 470827 - RNA, 17 nt, Chlamydia trachomatis
agcaaccgauucuucac

SEQ ID NO: 470828 - RNA, 18 nt, Chlamydia trachomatis
agcaaccgauucuucaca

SEQ ID NO: 470829 - RNA, 17 nt, Chlamydia trachomatis
agcaacgaaaccaaaau

SEQ ID NO: 470830 - RNA, 22 nt, Chlamydia trachomatis
agcaacgacaaacgggagccca

SEQ ID NO: 470831 - RNA, 15 nt, Chlamydia trachomatis
agcaacgagcaauag

SEQ ID NO: 470832 - RNA, 13 nt, Chlamydia trachomatis
agcacguacaaua

SEQ ID NO: 470833 - RNA, 16 nt, Chlamydia trachomatis
agcaccuuuacaauca

SEQ ID NO: 470834 - RNA, 22 nt, Chlamydia trachomatis
agcacucaaacacucgugaaau

SEQ ID NO: 470835 - RNA, 16 nt, Chlamydia trachomatis
agcacucucaacgaaa

SEQ ID NO: 470836 - RNA, 13 nt, Chlamydia trachomatis
agcacuucuucuu

SEQ ID NO: 470837 - RNA, 16 nt, Chlamydia trachomatis
agcacuucuucuuugg

SEQ ID NO: 470838 - RNA, 16 nt, Chlamydia trachomatis
agcagaaagaaugcuu

SEQ ID NO: 470839 - RNA, 15 nt, Chlamydia trachomatis
agcagauauggaaga

SEQ ID NO: 470840 - RNA, 19 nt, Chlamydia trachomatis
agcagauauggaagaacag

SEQ ID NO: 470841 - RNA, 12 nt, Chlamydia trachomatis
agcagaucaucc

SEQ ID NO: 470842 - RNA, 22 nt, Chlamydia trachomatis
agcagagauaugaguggcaagg

SEQ ID NO: 470843 - RNA, 12 nt, Chlamydia trachomatis
agcagcaaagau

SEQ ID NO: 470844 - RNA, 14 nt, Chlamydia trachomatis
agcagcaguuuuua

SEQ ID NO: 470845 - RNA, 20 nt, Chlamydia trachomatis
agcagcauucguguguagga

SEQ ID NO: 470846 - RNA, 21 nt, Chlamydia trachomatis
agcagcauucguguguaggaa

SEQ ID NO: 470847 - RNA, 18 nt, Chlamydia trachomatis
agcaggcgaacagugaca

SEQ ID NO: 470848 - RNA, 19 nt, Chlamydia trachomatis
agcaggcgaacagugacag

SEQ ID NO: 470849 - RNA, 14 nt, Chlamydia trachomatis
agcaguagcuacuu

SEQ ID NO: 470850 - RNA, 21 nt, Chlamydia trachomatis
agcaguagcuacuucagggug

SEQ ID NO: 470851 - RNA, 13 nt, Chlamydia trachomatis
agcagucuagagg

SEQ ID NO: 470852 - RNA, 19 nt, Chlamydia trachomatis
agcauaauuccuaggaaug

SEQ ID NO: 470853 - RNA, 17 nt, Chlamydia trachomatis
agcaguuacauuuuucg

SEQ ID NO: 470854 - RNA, 18 nt, Chlamydia trachomatis
agcauacguuagcaaaga

SEQ ID NO: 470855 - RNA, 12 nt, Chlamydia trachomatis
agcauagccuug

SEQ ID NO: 470856 - RNA, 14 nt, Chlamydia trachomatis
agcauagcuucuug

SEQ ID NO: 470857 - RNA, 16 nt, Chlamydia trachomatis
agcaucaguaaaaaua

SEQ ID NO: 470858 - RNA, 18 nt, Chlamydia trachomatis
agcaucauccccagaagc

SEQ ID NO: 470859 - RNA, 18 nt, Chlamydia trachomatis
agcaucuuuaccauuucc

SEQ ID NO: 470860 - RNA, 18 nt, Chlamydia trachomatis
agcaugauauuuugaaga

SEQ ID NO: 470861 - RNA, 23 nt, Chlamydia trachomatis
agcaugaucaugcagaugaagaa

SEQ ID NO: 470862 - RNA, 14 nt, Chlamydia trachomatis
agcaugcaaaacag

SEQ ID NO: 470863 - RNA, 17 nt, Chlamydia trachomatis
agcaugcaaaacagcuc

SEQ ID NO: 470864 - RNA, 14 nt, Chlamydia trachomatis
agcaugaccucaga

SEQ ID NO: 470865 - RNA, 14 nt, Chlamydia trachomatis
agcauggaagacaa

SEQ ID NO: 470866 - RNA, 19 nt, Chlamydia trachomatis
agccaagaacaaagcaucu

SEQ ID NO: 470867 - RNA, 17 nt, Chlamydia trachomatis
agccauaucaggaccua

SEQ ID NO: 470868 - RNA, 15 nt, Chlamydia trachomatis
agccauagcauccgc

SEQ ID NO: 470869 - RNA, 13 nt, Chlamydia trachomatis
agccauagccauc

SEQ ID NO: 470870 - RNA, 19 nt, Chlamydia trachomatis
agcccagaacaacuucucu

SEQ ID NO: 470871 - RNA, 18 nt, Chlamydia trachomatis
agccccaaaaacagcaga

SEQ ID NO: 470872 - RNA, 15 nt, Chlamydia trachomatis
agccccaccagagau

SEQ ID NO: 470873 - RNA, 16 nt, Chlamydia trachomatis
agccccgaaacccaac

SEQ ID NO: 470874 - RNA, 20 nt, Chlamydia trachomatis
agccccuaaagccacacaug

SEQ ID NO: 470875 - RNA, 12 nt, Chlamydia trachomatis
agccccuccgcu

SEQ ID NO: 470876 - RNA, 18 nt, Chlamydia trachomatis
agccccuugaaaggggcu

SEQ ID NO: 470877 - RNA, 16 nt, Chlamydia trachomatis
agccugaauuugcucu

SEQ ID NO: 470878 - RNA, 15 nt, Chlamydia trachomatis
agccugcuuucuucu

SEQ ID NO: 470879 - RNA, 17 nt, Chlamydia trachomatis
agccugcuuucuucugc

SEQ ID NO: 470880 - RNA, 19 nt, Chlamydia trachomatis
agccugugcauuuguggac

SEQ ID NO: 470881 - RNA, 17 nt, Chlamydia trachomatis
agccugugccuuucguu

SEQ ID NO: 470882 - RNA, 22 nt, Chlamydia trachomatis
agccuuucucuaaaagaagagc

SEQ ID NO: 470883 - RNA, 23 nt, Chlamydia trachomatis
agccuuucucuaaaagaagagcg

SEQ ID NO: 470884 - RNA, 16 nt, Chlamydia trachomatis
agccuuuuauucuuca

SEQ ID NO: 470885 - RNA, 15 nt, Chlamydia trachomatis
agccuuuuguuuucu

SEQ ID NO: 470886 - RNA, 19 nt, Chlamydia trachomatis
agccuuuuguuuucuugau

SEQ ID NO: 470887 - RNA, 15 nt, Chlamydia trachomatis
agcgaaaaaaaaaga

SEQ ID NO: 470888 - RNA, 14 nt, Chlamydia trachomatis
agcgaaaaaucaca

SEQ ID NO: 470889 - RNA, 19 nt, Chlamydia trachomatis
agcgacuccaacacgaaug

SEQ ID NO: 470890 - RNA, 19 nt, Chlamydia trachomatis
agcgacugcugcagaaauc

SEQ ID NO: 470891 - RNA, 16 nt, Chlamydia trachomatis
agcgauuaugaaaaag

SEQ ID NO: 470892 - RNA, 20 nt, Chlamydia trachomatis
agcgaugagcuuaucacaaa

SEQ ID NO: 470893 - RNA, 12 nt, Chlamydia trachomatis
agcgaucucccg

SEQ ID NO: 470894 - RNA, 15 nt, Chlamydia trachomatis
agcgaguaagccgga

SEQ ID NO: 470895 - RNA, 14 nt, Chlamydia trachomatis
agcgaguuugugga

SEQ ID NO: 470896 - RNA, 23 nt, Chlamydia trachomatis
agcgauucgcgcauaugcagaag

SEQ ID NO: 470897 - RNA, 14 nt, Chlamydia trachomatis
agcgcaaccccgca

SEQ ID NO: 470898 - RNA, 23 nt, Chlamydia trachomatis
agcgcaaccccgcauaccaaagc

SEQ ID NO: 470899 - RNA, 13 nt, Chlamydia trachomatis
agcgcaaagcgga

SEQ ID NO: 470900 - RNA, 21 nt, Chlamydia trachomatis
agcgauuuucugaaguucuuu

SEQ ID NO: 470901 - RNA, 14 nt, Chlamydia trachomatis
agcgggagaaggau

SEQ ID NO: 470902 - RNA, 20 nt, Chlamydia trachomatis
agcgggagagagccuugagu

SEQ ID NO: 470903 - RNA, 17 nt, Chlamydia trachomatis
agcgggcgguaaaaggu

SEQ ID NO: 470904 - RNA, 20 nt, Chlamydia trachomatis
agcgggcgguaaaagguauc

SEQ ID NO: 470905 - RNA, 18 nt, Chlamydia trachomatis
agcgucuuuucacaaggu

SEQ ID NO: 470906 - RNA, 15 nt, Chlamydia trachomatis
agcguaaaagagauu

SEQ ID NO: 470907 - RNA, 23 nt, Chlamydia trachomatis
agcgucaucuuugagaagcaucu

SEQ ID NO: 470908 - RNA, 15 nt, Chlamydia trachomatis
agcguaauagcucug

SEQ ID NO: 470909 - RNA, 22 nt, Chlamydia trachomatis
agcgugugaccaucuucaccaa

SEQ ID NO: 470910 - RNA, 17 nt, Chlamydia trachomatis
agcuaagaaaauaaaca

SEQ ID NO: 470911 - RNA, 13 nt, Chlamydia trachomatis
agcuaagagaagc

SEQ ID NO: 470912 - RNA, 14 nt, Chlamydia trachomatis
agcguuuuccccuu

SEQ ID NO: 470913 - RNA, 17 nt, Chlamydia trachomatis
agcuaaacuucuuguua

SEQ ID NO: 470914 - RNA, 18 nt, Chlamydia trachomatis
agcuaaagcagaaacagc

SEQ ID NO: 470915 - RNA, 19 nt, Chlamydia trachomatis
agcguucguucgguaaguc

SEQ ID NO: 470916 - RNA, 19 nt, Chlamydia trachomatis
agcguucgcgucuagcuuu

SEQ ID NO: 470917 - RNA, 12 nt, Chlamydia trachomatis
agcguucugaga

SEQ ID NO: 470918 - RNA, 23 nt, Chlamydia trachomatis
agcuacuaaacgauucaauccag

SEQ ID NO: 470919 - RNA, 15 nt, Chlamydia trachomatis
agcuacuagauagau

SEQ ID NO: 470920 - RNA, 19 nt, Chlamydia trachomatis
agcuagaacauacccuaaa

SEQ ID NO: 470921 - RNA, 12 nt, Chlamydia trachomatis
agcuagaagaau

SEQ ID NO: 470922 - RNA, 14 nt, Chlamydia trachomatis
agcuagaagaauca

SEQ ID NO: 470923 - RNA, 18 nt, Chlamydia trachomatis
agcuagaaaauagcaucu

SEQ ID NO: 470924 - RNA, 23 nt, Chlamydia trachomatis
agcuagaaaauagcaucucugua

SEQ ID NO: 470925 - RNA, 14 nt, Chlamydia trachomatis
agcuagagcaugca

SEQ ID NO: 470926 - RNA, 13 nt, Chlamydia trachomatis
agcuaaucuuuuu

SEQ ID NO: 470927 - RNA, 22 nt, Chlamydia trachomatis
agcuagguaaagguuucuggaa

SEQ ID NO: 470928 - RNA, 17 nt, Chlamydia trachomatis
agcuauaaaauacgcag

SEQ ID NO: 470929 - RNA, 12 nt, Chlamydia trachomatis
agcuauauaugc

SEQ ID NO: 470930 - RNA, 19 nt, Chlamydia trachomatis
agcuaucaauaaagaagcc

SEQ ID NO: 470931 - RNA, 18 nt, Chlamydia trachomatis
agcuauucccacuacauu

SEQ ID NO: 470932 - RNA, 14 nt, Chlamydia trachomatis
agcuauuucuuuuu

SEQ ID NO: 470933 - RNA, 19 nt, Chlamydia trachomatis
agcucaacaaggauuuuuu

SEQ ID NO: 470934 - RNA, 21 nt, Chlamydia trachomatis
agcucauuagaaugauugaua

SEQ ID NO: 470935 - RNA, 22 nt, Chlamydia trachomatis
agcucauuuucuauuucagaca

SEQ ID NO: 470936 - RNA, 19 nt, Chlamydia trachomatis
agcugcaguuucugagaaa

SEQ ID NO: 470937 - RNA, 13 nt, Chlamydia trachomatis
agcugcugcuugg

SEQ ID NO: 470938 - RNA, 17 nt, Chlamydia trachomatis
agcugcuuuacaucccu

SEQ ID NO: 470939 - RNA, 14 nt, Chlamydia trachomatis
agcugucagaucau

SEQ ID NO: 470940 - RNA, 18 nt, Chlamydia trachomatis
agcuguacgauggaaaua

SEQ ID NO: 470941 - RNA, 13 nt, Chlamydia trachomatis
agcuguaugccaa

SEQ ID NO: 470942 - RNA, 20 nt, Chlamydia trachomatis
agcuucguagagcaagauac

SEQ ID NO: 470943 - RNA, 18 nt, Chlamydia trachomatis
agcuucuaauuucuuucu

SEQ ID NO: 470944 - RNA, 16 nt, Chlamydia trachomatis
agcuucuagaaauucu

SEQ ID NO: 470945 - RNA, 15 nt, Chlamydia trachomatis
agcuuccacagcagu

SEQ ID NO: 470946 - RNA, 16 nt, Chlamydia trachomatis
agcuuccuguuuauca

SEQ ID NO: 470947 - RNA, 13 nt, Chlamydia trachomatis
agcuuagauauac

SEQ ID NO: 470948 - RNA, 16 nt, Chlamydia trachomatis
agcuuagcucccugcu

SEQ ID NO: 470949 - RNA, 17 nt, Chlamydia trachomatis
agcuuaguuacaagaca

SEQ ID NO: 470950 - RNA, 15 nt, Chlamydia trachomatis
agcuuauaacuaaga

SEQ ID NO: 470951 - RNA, 14 nt, Chlamydia trachomatis
agcuucaucauuga

SEQ ID NO: 470952 - RNA, 15 nt, Chlamydia trachomatis
agcuugcacagcaag

SEQ ID NO: 470953 - RNA, 20 nt, Chlamydia trachomatis
agcuugagagcauucuucug

SEQ ID NO: 470954 - RNA, 16 nt, Chlamydia trachomatis
agcuugaucaaagaau

SEQ ID NO: 470955 - RNA, 17 nt, Chlamydia trachomatis
agcuucugccauuucua

SEQ ID NO: 470956 - RNA, 15 nt, Chlamydia trachomatis
agcuucuccaucuga

SEQ ID NO: 470957 - RNA, 23 nt, Chlamydia trachomatis
agcuucuccaucugacuuuuuag

SEQ ID NO: 470958 - RNA, 19 nt, Chlamydia trachomatis
agcuucucgaucagcccaa

SEQ ID NO: 470959 - RNA, 23 nt, Chlamydia trachomatis
agcuucucuucacuuugauaaua

SEQ ID NO: 470960 - RNA, 22 nt, Chlamydia trachomatis
agcuucugacucuaguguuugu

SEQ ID NO: 470961 - RNA, 16 nt, Chlamydia trachomatis
agcuugucuccuucuu

SEQ ID NO: 470962 - RNA, 14 nt, Chlamydia trachomatis
agcuuguucuucga

SEQ ID NO: 470963 - RNA, 21 nt, Chlamydia trachomatis
agcuuugauuaaccaaaagag

SEQ ID NO: 470964 - RNA, 11 nt, Chlamydia trachomatis
aggaaagccua

SEQ ID NO: 470965 - RNA, 15 nt, Chlamydia trachomatis
agcuuuucuaacguu

SEQ ID NO: 470966 - RNA, 22 nt, Chlamydia trachomatis
agcuuuguuaaucgauucuugg

SEQ ID NO: 470967 - RNA, 14 nt, Chlamydia trachomatis
agcuuuuccgcugc

SEQ ID NO: 470968 - RNA, 15 nt, Chlamydia trachomatis
agcuuuuccgcugca

SEQ ID NO: 470969 - RNA, 14 nt, Chlamydia trachomatis
agcuuuuccacauu

SEQ ID NO: 470970 - RNA, 19 nt, Chlamydia trachomatis
agcuuuucggugaggaagg

SEQ ID NO: 470971 - RNA, 19 nt, Chlamydia trachomatis
aggaaauaccuuguuuuuu

SEQ ID NO: 470972 - RNA, 12 nt, Chlamydia trachomatis
aggaacuucuuc

SEQ ID NO: 470973 - RNA, 20 nt, Chlamydia trachomatis
aggaagaauaauacaggagg

SEQ ID NO: 470974 - RNA, 16 nt, Chlamydia trachomatis
aggaacucuaaauacc

SEQ ID NO: 470975 - RNA, 17 nt, Chlamydia trachomatis
aggaagauucacgggag

SEQ ID NO: 470976 - RNA, 12 nt, Chlamydia trachomatis
aggaagcugaga

SEQ ID NO: 470977 - RNA, 13 nt, Chlamydia trachomatis
aggacucuaagag

SEQ ID NO: 470978 - RNA, 21 nt, Chlamydia trachomatis
aggagaaaggcuuugucuaua

SEQ ID NO: 470979 - RNA, 18 nt, Chlamydia trachomatis
aggagauaauuuucugac

SEQ ID NO: 470980 - RNA, 19 nt, Chlamydia trachomatis
aggagauccggauaugcaa

SEQ ID NO: 470981 - RNA, 17 nt, Chlamydia trachomatis
aggagaauaccaccaua

SEQ ID NO: 470982 - RNA, 19 nt, Chlamydia trachomatis
aggagaaacgacaggcuau

SEQ ID NO: 470983 - RNA, 12 nt, Chlamydia trachomatis
aggagaaagaau

SEQ ID NO: 470984 - RNA, 23 nt, Chlamydia trachomatis
aggcacucgagucaugcaaagga

SEQ ID NO: 470985 - RNA, 18 nt, Chlamydia trachomatis
aggccauuucaugacagc

SEQ ID NO: 470986 - RNA, 21 nt, Chlamydia trachomatis
aggcauuccuuggcaaagagc

SEQ ID NO: 470987 - RNA, 18 nt, Chlamydia trachomatis
aggcacaugggcauagaa

SEQ ID NO: 470988 - RNA, 22 nt, Chlamydia trachomatis
aggauuuuuuucccacaaacaa

SEQ ID NO: 470989 - RNA, 20 nt, Chlamydia trachomatis
aggauuuuuuucugcaaucu

SEQ ID NO: 470990 - RNA, 14 nt, Chlamydia trachomatis
aggcaacaaauaac

SEQ ID NO: 470991 - RNA, 21 nt, Chlamydia trachomatis
aggcaacaaauaacccuccga

SEQ ID NO: 470992 - RNA, 22 nt, Chlamydia trachomatis
aggauucauauuccaaagaaau

SEQ ID NO: 470993 - RNA, 16 nt, Chlamydia trachomatis
aggauucgguaucuga

SEQ ID NO: 470994 - RNA, 19 nt, Chlamydia trachomatis
aggauucgguaucugagcu

SEQ ID NO: 470995 - RNA, 22 nt, Chlamydia trachomatis
aggauucgguaucugagcuuug

SEQ ID NO: 470996 - RNA, 23 nt, Chlamydia trachomatis
aggauucguugcucccaucaacu

SEQ ID NO: 470997 - RNA, 16 nt, Chlamydia trachomatis
aggauucucugcacaa

SEQ ID NO: 470998 - RNA, 18 nt, Chlamydia trachomatis
aggauuggaaaauccaaa

SEQ ID NO: 470999 - RNA, 17 nt, Chlamydia trachomatis
aggagcauaaauaucuu

SEQ ID NO: 471000 - RNA, 13 nt, Chlamydia trachomatis
aggagcaagaaua

SEQ ID NO: 471001 - RNA, 13 nt, Chlamydia trachomatis
aggccucccuauc

SEQ ID NO: 471002 - RNA, 16 nt, Chlamydia trachomatis
aggcgaacagugacag

SEQ ID NO: 471003 - RNA, 20 nt, Chlamydia trachomatis
aggcgaucacgccuccaucc

SEQ ID NO: 471004 - RNA, 19 nt, Chlamydia trachomatis
aggcuuucaaaaagagcua

SEQ ID NO: 471005 - RNA, 16 nt, Chlamydia trachomatis
aggcuugggugacugc

SEQ ID NO: 471006 - RNA, 21 nt, Chlamydia trachomatis
aggcuuguugccaaccaccug

SEQ ID NO: 471007 - RNA, 19 nt, Chlamydia trachomatis
aggcuuuuuuuuucauaaa

SEQ ID NO: 471008 - RNA, 20 nt, Chlamydia trachomatis
agggaaaaaacuagaaggga

SEQ ID NO: 471009 - RNA, 12 nt, Chlamydia trachomatis
aggcuuuuccau

SEQ ID NO: 471010 - RNA, 20 nt, Chlamydia trachomatis
aggcuuuuccauuccuccua

SEQ ID NO: 471011 - RNA, 14 nt, Chlamydia trachomatis
aggcuuuucuauuu

SEQ ID NO: 471012 - RNA, 16 nt, Chlamydia trachomatis
agggaaacguaaaaga

SEQ ID NO: 471013 - RNA, 15 nt, Chlamydia trachomatis
agggaacaaaccaau

SEQ ID NO: 471014 - RNA, 17 nt, Chlamydia trachomatis
agggaaucauaaggaag

SEQ ID NO: 471015 - RNA, 20 nt, Chlamydia trachomatis
agggaauguuucccuucuuu

SEQ ID NO: 471016 - RNA, 13 nt, Chlamydia trachomatis
agggaagagaaac

SEQ ID NO: 471017 - RNA, 17 nt, Chlamydia trachomatis
agggaagauaggagcau

SEQ ID NO: 471018 - RNA, 14 nt, Chlamydia trachomatis
agggagaaggggaa

SEQ ID NO: 471019 - RNA, 16 nt, Chlamydia trachomatis
agggagaaggggaagg

SEQ ID NO: 471020 - RNA, 17 nt, Chlamydia trachomatis
agggagaaggggaagga

SEQ ID NO: 471021 - RNA, 19 nt, Chlamydia trachomatis
agggagaaggggaaggaau

SEQ ID NO: 471022 - RNA, 19 nt, Chlamydia trachomatis
agggacaucgaaaaucacu

SEQ ID NO: 471023 - RNA, 14 nt, Chlamydia trachomatis
agggagagcuuagg

SEQ ID NO: 471024 - RNA, 22 nt, Chlamydia trachomatis
agggagauguuuacugagaaua

SEQ ID NO: 471025 - RNA, 13 nt, Chlamydia trachomatis
agggagcaaagcu

SEQ ID NO: 471026 - RNA, 19 nt, Chlamydia trachomatis
agggagguauuccuguaga

SEQ ID NO: 471027 - RNA, 15 nt, Chlamydia trachomatis
agggauuuugaguuc

SEQ ID NO: 471028 - RNA, 22 nt, Chlamydia trachomatis
agggcguuauauuggaagauaa

SEQ ID NO: 471029 - RNA, 17 nt, Chlamydia trachomatis
aggggcaucuggagaua

SEQ ID NO: 471030 - RNA, 14 nt, Chlamydia trachomatis
agguacuuacccuu

SEQ ID NO: 471031 - RNA, 22 nt, Chlamydia trachomatis
agguaaucuguagagagcccca

SEQ ID NO: 471032 - RNA, 21 nt, Chlamydia trachomatis
agguagccagguaaacucaag

SEQ ID NO: 471033 - RNA, 17 nt, Chlamydia trachomatis
aggguagaaaaagagaa

SEQ ID NO: 471034 - RNA, 19 nt, Chlamydia trachomatis
aggguagaaaaagagaaau

SEQ ID NO: 471035 - RNA, 14 nt, Chlamydia trachomatis
aggucucccuccuc

SEQ ID NO: 471036 - RNA, 13 nt, Chlamydia trachomatis
aggugauuuucuu

SEQ ID NO: 471037 - RNA, 19 nt, Chlamydia trachomatis
agguaugugcucauuuccu

SEQ ID NO: 471038 - RNA, 13 nt, Chlamydia trachomatis
aggucauauccac

SEQ ID NO: 471039 - RNA, 19 nt, Chlamydia trachomatis
aggucauucgucaaagaag

SEQ ID NO: 471040 - RNA, 14 nt, Chlamydia trachomatis
aguaaccauuccuu

SEQ ID NO: 471041 - RNA, 20 nt, Chlamydia trachomatis
aguaaaggaugaucuucacc

SEQ ID NO: 471042 - RNA, 20 nt, Chlamydia trachomatis
aguaacaagcacagaauaga

SEQ ID NO: 471043 - RNA, 13 nt, Chlamydia trachomatis
aguaacaccucuu

SEQ ID NO: 471044 - RNA, 15 nt, Chlamydia trachomatis
aguaaucggauagag

SEQ ID NO: 471045 - RNA, 16 nt, Chlamydia trachomatis
aguaauuccaaauaau

SEQ ID NO: 471046 - RNA, 18 nt, Chlamydia trachomatis
aguaauuccaaauaauac

SEQ ID NO: 471047 - RNA, 16 nt, Chlamydia trachomatis
agguugccuuuaucuc

SEQ ID NO: 471048 - RNA, 23 nt, Chlamydia trachomatis
agguugacuuucccugcaacauu

SEQ ID NO: 471049 - RNA, 15 nt, Chlamydia trachomatis
agguugugaagaacu

SEQ ID NO: 471050 - RNA, 18 nt, Chlamydia trachomatis
agguuuaggagagagccc

SEQ ID NO: 471051 - RNA, 20 nt, Chlamydia trachomatis
agguuucuauacgcacauag

SEQ ID NO: 471052 - RNA, 14 nt, Chlamydia trachomatis
aguaaaaucuaaaa

SEQ ID NO: 471053 - RNA, 15 nt, Chlamydia trachomatis
aguaaaaucuaaaau

SEQ ID NO: 471054 - RNA, 18 nt, Chlamydia trachomatis
aguaggacucuaagagaa

SEQ ID NO: 471055 - RNA, 17 nt, Chlamydia trachomatis
aguagggauuuccuuau

SEQ ID NO: 471056 - RNA, 23 nt, Chlamydia trachomatis
aguaggucguugauaaugauaga

SEQ ID NO: 471057 - RNA, 21 nt, Chlamydia trachomatis
aguagucuacuccauuuuaag

SEQ ID NO: 471058 - RNA, 12 nt, Chlamydia trachomatis
aguaguugaaua

SEQ ID NO: 471059 - RNA, 13 nt, Chlamydia trachomatis
aguagcaaauuaa

SEQ ID NO: 471060 - RNA, 16 nt, Chlamydia trachomatis
aguagcaaauuaacag

SEQ ID NO: 471061 - RNA, 19 nt, Chlamydia trachomatis
aguagcaaauuaacagaua

SEQ ID NO: 471062 - RNA, 14 nt, Chlamydia trachomatis
aguaucuaacaaua

SEQ ID NO: 471063 - RNA, 20 nt, Chlamydia trachomatis
aguauccagaaguuuuaaca

SEQ ID NO: 471064 - RNA, 16 nt, Chlamydia trachomatis
aguauuuaacuuuuca

SEQ ID NO: 471065 - RNA, 18 nt, Chlamydia trachomatis
aguauucuguaaaaggaa

SEQ ID NO: 471066 - RNA, 17 nt, Chlamydia trachomatis
aguauuaaacuucaaac

SEQ ID NO: 471067 - RNA, 20 nt, Chlamydia trachomatis
aguccggacuuuccucuggu

SEQ ID NO: 471068 - RNA, 23 nt, Chlamydia trachomatis
aguccggacuuuccucugguacu

SEQ ID NO: 471069 - RNA, 12 nt, Chlamydia trachomatis
aguauuuucaaa

SEQ ID NO: 471070 - RNA, 15 nt, Chlamydia trachomatis
aguccugagccaauc

SEQ ID NO: 471071 - RNA, 19 nt, Chlamydia trachomatis
aguccuccuguagcucuua

SEQ ID NO: 471072 - RNA, 18 nt, Chlamydia trachomatis
aguccucuaaaguauucu

SEQ ID NO: 471073 - RNA, 14 nt, Chlamydia trachomatis
agucgauucuggca

SEQ ID NO: 471074 - RNA, 16 nt, Chlamydia trachomatis
agucgauucuggcaua

SEQ ID NO: 471075 - RNA, 14 nt, Chlamydia trachomatis
agucuccauaagaa

SEQ ID NO: 471076 - RNA, 13 nt, Chlamydia trachomatis
agucucccaaauu

SEQ ID NO: 471077 - RNA, 16 nt, Chlamydia trachomatis
agucuccgacaccagg

SEQ ID NO: 471078 - RNA, 21 nt, Chlamydia trachomatis
agucuccgacaccaggcaaug

SEQ ID NO: 471079 - RNA, 20 nt, Chlamydia trachomatis
agucucgaauucuaucaaca

SEQ ID NO: 471080 - RNA, 13 nt, Chlamydia trachomatis
agucucuaacaac

SEQ ID NO: 471081 - RNA, 18 nt, Chlamydia trachomatis
agucucugccaccucauu

SEQ ID NO: 471082 - RNA, 17 nt, Chlamydia trachomatis
agucugcauuaaacacu

SEQ ID NO: 471083 - RNA, 16 nt, Chlamydia trachomatis
agucugcuccaccuuc

SEQ ID NO: 471084 - RNA, 15 nt, Chlamydia trachomatis
agucuuguccuuccc

SEQ ID NO: 471085 - RNA, 15 nt, Chlamydia trachomatis
agucuuuauaucuug

SEQ ID NO: 471086 - RNA, 17 nt, Chlamydia trachomatis
agucuuuuacuuugaaa

SEQ ID NO: 471087 - RNA, 21 nt, Chlamydia trachomatis
agugcagaagauaagcaagga

SEQ ID NO: 471088 - RNA, 23 nt, Chlamydia trachomatis
agugcagcguucugagaugaaaa

SEQ ID NO: 471089 - RNA, 14 nt, Chlamydia trachomatis
agugccagcauuca

SEQ ID NO: 471090 - RNA, 15 nt, Chlamydia trachomatis
agugccagcauucau

SEQ ID NO: 471091 - RNA, 17 nt, Chlamydia trachomatis
agugcauggagaauggc

SEQ ID NO: 471092 - RNA, 14 nt, Chlamydia trachomatis
agugccaacaucaa

SEQ ID NO: 471093 - RNA, 16 nt, Chlamydia trachomatis
agugaaugcuccauac

SEQ ID NO: 471094 - RNA, 14 nt, Chlamydia trachomatis
agugaucuuuuuag

SEQ ID NO: 471095 - RNA, 16 nt, Chlamydia trachomatis
agugauuuuaaaccaa

SEQ ID NO: 471096 - RNA, 17 nt, Chlamydia trachomatis
agugauuuuaaaccaau

SEQ ID NO: 471097 - RNA, 16 nt, Chlamydia trachomatis
agugcgcuuagcacuu

SEQ ID NO: 471098 - RNA, 17 nt, Chlamydia trachomatis
agugcgcuuagcacuug

SEQ ID NO: 471099 - RNA, 13 nt, Chlamydia trachomatis
aguggcaucuggu

SEQ ID NO: 471100 - RNA, 17 nt, Chlamydia trachomatis
aguggcaagggggagca

SEQ ID NO: 471101 - RNA, 22 nt, Chlamydia trachomatis
aguguccuuccauggauaaaau

SEQ ID NO: 471102 - RNA, 13 nt, Chlamydia trachomatis
aguuacuuuucuc

SEQ ID NO: 471103 - RNA, 17 nt, Chlamydia trachomatis
aguuagcauguucagaa

SEQ ID NO: 471104 - RNA, 16 nt, Chlamydia trachomatis
aguuagccguaucucc

SEQ ID NO: 471105 - RNA, 18 nt, Chlamydia trachomatis
aguucagacagagaagaa

SEQ ID NO: 471106 - RNA, 16 nt, Chlamydia trachomatis
aguucucucccuuccu

SEQ ID NO: 471107 - RNA, 16 nt, Chlamydia trachomatis
aguucuccuucuugug

SEQ ID NO: 471108 - RNA, 22 nt, Chlamydia trachomatis
aguucuguuauuuguucucuua

SEQ ID NO: 471109 - RNA, 17 nt, Chlamydia trachomatis
aguucuucuuccacaga

SEQ ID NO: 471110 - RNA, 18 nt, Chlamydia trachomatis
aguugaucauugauaaau

SEQ ID NO: 471111 - RNA, 20 nt, Chlamydia trachomatis
aguucauugguaagauucga

SEQ ID NO: 471112 - RNA, 18 nt, Chlamydia trachomatis
aguugccccuuauuuacc

SEQ ID NO: 471113 - RNA, 13 nt, Chlamydia trachomatis
aguuguuuucuug

SEQ ID NO: 471114 - RNA, 16 nt, Chlamydia trachomatis
aguuuacgaguaucug

SEQ ID NO: 471115 - RNA, 12 nt, Chlamydia trachomatis
aguuuacugcaa

SEQ ID NO: 471116 - RNA, 19 nt, Chlamydia trachomatis
aguuucaaacauccaguaa

SEQ ID NO: 471117 - RNA, 13 nt, Chlamydia trachomatis
aguuuccuuuaaa

SEQ ID NO: 471118 - RNA, 20 nt, Chlamydia trachomatis
aguuucucgcagaugcuucu

SEQ ID NO: 471119 - RNA, 17 nt, Chlamydia trachomatis
aguuucugagaaaucua

SEQ ID NO: 471120 - RNA, 18 nt, Chlamydia trachomatis
aguuucuuccagacaaaa

SEQ ID NO: 471121 - RNA, 16 nt, Chlamydia trachomatis
aguuucuucgauagaa

SEQ ID NO: 471122 - RNA, 22 nt, Chlamydia trachomatis
aguuucuucgauagaaaugguu

SEQ ID NO: 471123 - RNA, 12 nt, Chlamydia trachomatis
aguuucuuucuu

SEQ ID NO: 471124 - RNA, 19 nt, Chlamydia trachomatis
aguuucuuuguucacagaa

SEQ ID NO: 471125 - RNA, 23 nt, Chlamydia trachomatis
aguuucuuuguucacagaaaguc

SEQ ID NO: 471126 - RNA, 22 nt, Chlamydia trachomatis
aguuucccguuguuuucuuaga

SEQ ID NO: 471127 - RNA, 20 nt, Chlamydia trachomatis
aguuucccuucgucccuugc

SEQ ID NO: 471128 - RNA, 13 nt, Chlamydia trachomatis
aguuucaucccca

SEQ ID NO: 471129 - RNA, 17 nt, Chlamydia trachomatis
aguuuuaagaagaggua

SEQ ID NO: 471130 - RNA, 20 nt, Chlamydia trachomatis
aguuugccaguaaucaaauu

SEQ ID NO: 471131 - RNA, 15 nt, Chlamydia trachomatis
aguuugaaucacaga

SEQ ID NO: 471132 - RNA, 22 nt, Chlamydia trachomatis
aguuugaaucacagaaacuucu

SEQ ID NO: 471133 - RNA, 18 nt, Chlamydia trachomatis
auaaagucacuacuucau

SEQ ID NO: 471134 - RNA, 14 nt, Chlamydia trachomatis
auaaauagcaaugc

SEQ ID NO: 471135 - RNA, 15 nt, Chlamydia trachomatis
auaaaaucaaauaaa

SEQ ID NO: 471136 - RNA, 21 nt, Chlamydia trachomatis
auaaaauccaauguaaaauga

SEQ ID NO: 471137 - RNA, 23 nt, Chlamydia trachomatis
auaaaauccuucugccucuuuua

SEQ ID NO: 471138 - RNA, 23 nt, Chlamydia trachomatis
auaaaauggaaauaaaaagccca

SEQ ID NO: 471139 - RNA, 17 nt, Chlamydia trachomatis
auaacgucauugcuugc

SEQ ID NO: 471140 - RNA, 20 nt, Chlamydia trachomatis
auaacuggaguuuuccugaa

SEQ ID NO: 471141 - RNA, 23 nt, Chlamydia trachomatis
auaacugguguggguaagaauaa

SEQ ID NO: 471142 - RNA, 17 nt, Chlamydia trachomatis
auaaccagaauccuuuu

SEQ ID NO: 471143 - RNA, 18 nt, Chlamydia trachomatis
auaaccagaauccuuuuc

SEQ ID NO: 471144 - RNA, 15 nt, Chlamydia trachomatis
auaaccaugagcucc

SEQ ID NO: 471145 - RNA, 19 nt, Chlamydia trachomatis
auaacccuccgacccaaga

SEQ ID NO: 471146 - RNA, 15 nt, Chlamydia trachomatis
auaaccugaagauuu

SEQ ID NO: 471147 - RNA, 21 nt, Chlamydia trachomatis
auaaauccucuuugaauaucc

SEQ ID NO: 471148 - RNA, 22 nt, Chlamydia trachomatis
auaaauccucuuugaauauccg

SEQ ID NO: 471149 - RNA, 15 nt, Chlamydia trachomatis
auaaaucucuuccaa

SEQ ID NO: 471150 - RNA, 15 nt, Chlamydia trachomatis
auaacaaacaacacu

SEQ ID NO: 471151 - RNA, 14 nt, Chlamydia trachomatis
auaacaacaauaaa

SEQ ID NO: 471152 - RNA, 14 nt, Chlamydia trachomatis
auaacaaccaucaa

SEQ ID NO: 471153 - RNA, 18 nt, Chlamydia trachomatis
auaacaaggcuuuuccau

SEQ ID NO: 471154 - RNA, 21 nt, Chlamydia trachomatis
auaacaaguuucuuccagaca

SEQ ID NO: 471155 - RNA, 15 nt, Chlamydia trachomatis
auaacaauccuagac

SEQ ID NO: 471156 - RNA, 14 nt, Chlamydia trachomatis
auaacaauuuuaaa

SEQ ID NO: 471157 - RNA, 15 nt, Chlamydia trachomatis
auaacaauuuuaaaa

SEQ ID NO: 471158 - RNA, 21 nt, Chlamydia trachomatis
auaacaauuuuaaaaucuccu

SEQ ID NO: 471159 - RNA, 23 nt, Chlamydia trachomatis
auaacacauaucuccaaaaauau

SEQ ID NO: 471160 - RNA, 21 nt, Chlamydia trachomatis
auaacacccuguaaaaggcgc

SEQ ID NO: 471161 - RNA, 18 nt, Chlamydia trachomatis
auaacacucucaucuaaa

SEQ ID NO: 471162 - RNA, 15 nt, Chlamydia trachomatis
auaacagcaagacaa

SEQ ID NO: 471163 - RNA, 10 nt, Chlamydia trachomatis
auaacagcac

SEQ ID NO: 471164 - RNA, 16 nt, Chlamydia trachomatis
auaacagcacaaacaa

SEQ ID NO: 471165 - RNA, 15 nt, Chlamydia trachomatis
auaacaugguugauu

SEQ ID NO: 471166 - RNA, 21 nt, Chlamydia trachomatis
auaauccuaugcaguaaagaa

SEQ ID NO: 471167 - RNA, 13 nt, Chlamydia trachomatis
auaauaggauagg

SEQ ID NO: 471168 - RNA, 13 nt, Chlamydia trachomatis
auaauagucauac

SEQ ID NO: 471169 - RNA, 24 nt, Chlamydia trachomatis
auaaucugugccagcugcugcuug

SEQ ID NO: 471170 - RNA, 16 nt, Chlamydia trachomatis
auaauggacugguugu

SEQ ID NO: 471171 - RNA, 15 nt, Chlamydia trachomatis
auaagucuuuuacuu

SEQ ID NO: 471172 - RNA, 18 nt, Chlamydia trachomatis
auaagaauguuuccuaau

SEQ ID NO: 471173 - RNA, 22 nt, Chlamydia trachomatis
auaaguccuuaucuucuugaga

SEQ ID NO: 471174 - RNA, 19 nt, Chlamydia trachomatis
auaagaaaucuucucuuga

SEQ ID NO: 471175 - RNA, 14 nt, Chlamydia trachomatis
auaaguuaccucuu

SEQ ID NO: 471176 - RNA, 16 nt, Chlamydia trachomatis
auaaguuaccucuuua

SEQ ID NO: 471177 - RNA, 22 nt, Chlamydia trachomatis
auaaguuaccucuuuacgcaca

SEQ ID NO: 471178 - RNA, 17 nt, Chlamydia trachomatis
auaaguucacugacugu

SEQ ID NO: 471179 - RNA, 11 nt, Chlamydia trachomatis
auaaguuuuuc

SEQ ID NO: 471180 - RNA, 13 nt, Chlamydia trachomatis
auaauaaagauag

SEQ ID NO: 471181 - RNA, 16 nt, Chlamydia trachomatis
auaauaaagauagcau

SEQ ID NO: 471182 - RNA, 22 nt, Chlamydia trachomatis
auaauacaaagcacgauaaaag

SEQ ID NO: 471183 - RNA, 14 nt, Chlamydia trachomatis
auaauacaaaggag

SEQ ID NO: 471184 - RNA, 14 nt, Chlamydia trachomatis
auaauacagauuuu

SEQ ID NO: 471185 - RNA, 15 nt, Chlamydia trachomatis
auaauacagauuuuu

SEQ ID NO: 471186 - RNA, 21 nt, Chlamydia trachomatis
auaauacagauuuuucgaaaa

SEQ ID NO: 471187 - RNA, 20 nt, Chlamydia trachomatis
auacaagacucacagcaaau

SEQ ID NO: 471188 - RNA, 13 nt, Chlamydia trachomatis
auacaagagagaa

SEQ ID NO: 471189 - RNA, 15 nt, Chlamydia trachomatis
auacaagagagaaca

SEQ ID NO: 471190 - RNA, 13 nt, Chlamydia trachomatis
auacaaagauugc

SEQ ID NO: 471191 - RNA, 22 nt, Chlamydia trachomatis
auacaaaggagcccaagcuuuc

SEQ ID NO: 471192 - RNA, 15 nt, Chlamydia trachomatis
auacaaaucuuuuau

SEQ ID NO: 471193 - RNA, 17 nt, Chlamydia trachomatis
auacaaguauuucuugu

SEQ ID NO: 471194 - RNA, 13 nt, Chlamydia trachomatis
auacaauuccugc

SEQ ID NO: 471195 - RNA, 14 nt, Chlamydia trachomatis
auacacagcaucaa

SEQ ID NO: 471196 - RNA, 14 nt, Chlamydia trachomatis
auacacaucaaaau

SEQ ID NO: 471197 - RNA, 20 nt, Chlamydia trachomatis
auacaccgcaucagccccaa

SEQ ID NO: 471198 - RNA, 23 nt, Chlamydia trachomatis
auacaccgcaucagccccaaaaa

SEQ ID NO: 471199 - RNA, 16 nt, Chlamydia trachomatis
auacagaacauuucuc

SEQ ID NO: 471200 - RNA, 19 nt, Chlamydia trachomatis
auacagacaucuaaagucu

SEQ ID NO: 471201 - RNA, 23 nt, Chlamydia trachomatis
auacagagcaaggugaccucugc

SEQ ID NO: 471202 - RNA, 18 nt, Chlamydia trachomatis
auaauuuaauuaaagaga

SEQ ID NO: 471203 - RNA, 12 nt, Chlamydia trachomatis
auaauuuccccu

SEQ ID NO: 471204 - RNA, 11 nt, Chlamydia trachomatis
auaauuucuag

SEQ ID NO: 471205 - RNA, 13 nt, Chlamydia trachomatis
auaauuuuccuuu

SEQ ID NO: 471206 - RNA, 21 nt, Chlamydia trachomatis
auaauuuucuucacuuccucu

SEQ ID NO: 471207 - RNA, 22 nt, Chlamydia trachomatis
auaauuuucuucacuuccucuc

SEQ ID NO: 471208 - RNA, 20 nt, Chlamydia trachomatis
auacuggcagggauaguaaa

SEQ ID NO: 471209 - RNA, 17 nt, Chlamydia trachomatis
auacuucuuacuuaaaa

SEQ ID NO: 471210 - RNA, 19 nt, Chlamydia trachomatis
auacuucuuacuuaaaaaa

SEQ ID NO: 471211 - RNA, 22 nt, Chlamydia trachomatis
auacuucuuacuuaaaaaacaa

SEQ ID NO: 471212 - RNA, 21 nt, Chlamydia trachomatis
auacuuuagauuuguuuaaaa

SEQ ID NO: 471213 - RNA, 13 nt, Chlamydia trachomatis
auacgcucuuuca

SEQ ID NO: 471214 - RNA, 17 nt, Chlamydia trachomatis
auacucaacuccagagc

SEQ ID NO: 471215 - RNA, 18 nt, Chlamydia trachomatis
auacucccauagcuucuu

SEQ ID NO: 471216 - RNA, 17 nt, Chlamydia trachomatis
auacgaggagcuugaga

SEQ ID NO: 471217 - RNA, 13 nt, Chlamydia trachomatis
auacgaaagauuu

SEQ ID NO: 471218 - RNA, 13 nt, Chlamydia trachomatis
auacgaauaagag

SEQ ID NO: 471219 - RNA, 15 nt, Chlamydia trachomatis
auaccuucuuacaua

SEQ ID NO: 471220 - RNA, 21 nt, Chlamydia trachomatis
auacgcauaugcgucuucccu

SEQ ID NO: 471221 - RNA, 17 nt, Chlamydia trachomatis
auacaggccgucaauau

SEQ ID NO: 471222 - RNA, 18 nt, Chlamydia trachomatis
auagaaaccgaaaaaaag

SEQ ID NO: 471223 - RNA, 17 nt, Chlamydia trachomatis
auagagaacucgugaau

SEQ ID NO: 471224 - RNA, 18 nt, Chlamydia trachomatis
auagaggcgccuacuucu

SEQ ID NO: 471225 - RNA, 13 nt, Chlamydia trachomatis
auacuuuucaauu

SEQ ID NO: 471226 - RNA, 19 nt, Chlamydia trachomatis
auagaaaaaaacagcucug

SEQ ID NO: 471227 - RNA, 13 nt, Chlamydia trachomatis
auagauuagaaga

SEQ ID NO: 471228 - RNA, 22 nt, Chlamydia trachomatis
auagauauugccuacaagaccu

SEQ ID NO: 471229 - RNA, 16 nt, Chlamydia trachomatis
auagaucaagaaaaga

SEQ ID NO: 471230 - RNA, 14 nt, Chlamydia trachomatis
auagaucuaaagca

SEQ ID NO: 471231 - RNA, 13 nt, Chlamydia trachomatis
auagaucuacagc

SEQ ID NO: 471232 - RNA, 23 nt, Chlamydia trachomatis
auagauaacuuugaacaaauuua

SEQ ID NO: 471233 - RNA, 20 nt, Chlamydia trachomatis
auagauaaguccaucuaaag

SEQ ID NO: 471234 - RNA, 13 nt, Chlamydia trachomatis
auagauagcucca

SEQ ID NO: 471235 - RNA, 14 nt, Chlamydia trachomatis
auagcaggauuuuc

SEQ ID NO: 471236 - RNA, 15 nt, Chlamydia trachomatis
auagcagggaacaca

SEQ ID NO: 471237 - RNA, 16 nt, Chlamydia trachomatis
auagcagggaacacag

SEQ ID NO: 471238 - RNA, 17 nt, Chlamydia trachomatis
auagcaacugcuuucuu

SEQ ID NO: 471239 - RNA, 16 nt, Chlamydia trachomatis
auagcacccuuuuuau

SEQ ID NO: 471240 - RNA, 18 nt, Chlamydia trachomatis
auagcacccuuuuuauaa

SEQ ID NO: 471241 - RNA, 16 nt, Chlamydia trachomatis
auagccaaaugcaccu

SEQ ID NO: 471242 - RNA, 19 nt, Chlamydia trachomatis
auagccacagcauacguua

SEQ ID NO: 471243 - RNA, 18 nt, Chlamydia trachomatis
auagcgaaaaaucacaau

SEQ ID NO: 471244 - RNA, 17 nt, Chlamydia trachomatis
auaguugcaaaaagaac

SEQ ID NO: 471245 - RNA, 13 nt, Chlamydia trachomatis
auaguuucgagua

SEQ ID NO: 471246 - RNA, 18 nt, Chlamydia trachomatis
auaguuucgaguaauucc

SEQ ID NO: 471247 - RNA, 14 nt, Chlamydia trachomatis
auauaaagaagacu

SEQ ID NO: 471248 - RNA, 23 nt, Chlamydia trachomatis
auagugacgugaggaaguucugc

SEQ ID NO: 471249 - RNA, 17 nt, Chlamydia trachomatis
auagugcagaagauaag

SEQ ID NO: 471250 - RNA, 12 nt, Chlamydia trachomatis
auagucuugcau

SEQ ID NO: 471251 - RNA, 16 nt, Chlamydia trachomatis
auagcucgcauuugua

SEQ ID NO: 471252 - RNA, 19 nt, Chlamydia trachomatis
auagcucugcagauuuugu

SEQ ID NO: 471253 - RNA, 21 nt, Chlamydia trachomatis
auagcucaguugguagagcaa

SEQ ID NO: 471254 - RNA, 18 nt, Chlamydia trachomatis
auagcugacuuugaagau

SEQ ID NO: 471255 - RNA, 18 nt, Chlamydia trachomatis
auagcuacagcaauagag

SEQ ID NO: 471256 - RNA, 15 nt, Chlamydia trachomatis
auagcuagagcaugc

SEQ ID NO: 471257 - RNA, 16 nt, Chlamydia trachomatis
auagcuauaaaauacg

SEQ ID NO: 471258 - RNA, 12 nt, Chlamydia trachomatis
auauacucagag

SEQ ID NO: 471259 - RNA, 13 nt, Chlamydia trachomatis
auauacucagaga

SEQ ID NO: 471260 - RNA, 19 nt, Chlamydia trachomatis
auauaaagucacuacuuca

SEQ ID NO: 471261 - RNA, 21 nt, Chlamydia trachomatis
auauaaguaucguaaacaaaa

SEQ ID NO: 471262 - RNA, 20 nt, Chlamydia trachomatis
auauaccacggaacauaccg

SEQ ID NO: 471263 - RNA, 17 nt, Chlamydia trachomatis
auauaccccuaaaggaa

SEQ ID NO: 471264 - RNA, 13 nt, Chlamydia trachomatis
auauacccauuug

SEQ ID NO: 471265 - RNA, 14 nt, Chlamydia trachomatis
auauccaucaauca

SEQ ID NO: 471266 - RNA, 14 nt, Chlamydia trachomatis
auauccaucauaaa

SEQ ID NO: 471267 - RNA, 21 nt, Chlamydia trachomatis
auauccaucauaaaaagauag

SEQ ID NO: 471268 - RNA, 16 nt, Chlamydia trachomatis
auauauuuaagaagcu

SEQ ID NO: 471269 - RNA, 17 nt, Chlamydia trachomatis
auauauuuaagaagcua

SEQ ID NO: 471270 - RNA, 15 nt, Chlamydia trachomatis
auaucaaaaauagca

SEQ ID NO: 471271 - RNA, 17 nt, Chlamydia trachomatis
auaucgcguccaaaaag

SEQ ID NO: 471272 - RNA, 23 nt, Chlamydia trachomatis
auaugagccuugccuacagaauc

SEQ ID NO: 471273 - RNA, 18 nt, Chlamydia trachomatis
auaugaguggcaaggggg

SEQ ID NO: 471274 - RNA, 22 nt, Chlamydia trachomatis
auaugaguggcaagggggagca

SEQ ID NO: 471275 - RNA, 20 nt, Chlamydia trachomatis
auaucuggauugugaagaac

SEQ ID NO: 471276 - RNA, 15 nt, Chlamydia trachomatis
auaucguaaacaacc

SEQ ID NO: 471277 - RNA, 17 nt, Chlamydia trachomatis
auaucuaggucucccag

SEQ ID NO: 471278 - RNA, 15 nt, Chlamydia trachomatis
auaucucaggauaaa

SEQ ID NO: 471279 - RNA, 18 nt, Chlamydia trachomatis
aucaaaacgcucagaaaa

SEQ ID NO: 471280 - RNA, 22 nt, Chlamydia trachomatis
auauuggcaccauccauagugc

SEQ ID NO: 471281 - RNA, 13 nt, Chlamydia trachomatis
auauuuaagauag

SEQ ID NO: 471282 - RNA, 21 nt, Chlamydia trachomatis
auauugcucuaaagucuuucc

SEQ ID NO: 471283 - RNA, 18 nt, Chlamydia trachomatis
auauuggaagauaacaau

SEQ ID NO: 471284 - RNA, 21 nt, Chlamydia trachomatis
auauugaucuccccaucgaca

SEQ ID NO: 471285 - RNA, 23 nt, Chlamydia trachomatis
auauugacggccuguaugugaaa

SEQ ID NO: 471286 - RNA, 14 nt, Chlamydia trachomatis
auaugcacuaacga

SEQ ID NO: 471287 - RNA, 17 nt, Chlamydia trachomatis
auaugcagaagaccagu

SEQ ID NO: 471288 - RNA, 19 nt, Chlamydia trachomatis
auauucaugugaacagagc

SEQ ID NO: 471289 - RNA, 19 nt, Chlamydia trachomatis
auauuccaaagaaauguug

SEQ ID NO: 471290 - RNA, 16 nt, Chlamydia trachomatis
aucaaaaucaauaaug

SEQ ID NO: 471291 - RNA, 22 nt, Chlamydia trachomatis
aucaaaaucaauaaugucucca

SEQ ID NO: 471292 - RNA, 13 nt, Chlamydia trachomatis
aucaaaccaaaaa

SEQ ID NO: 471293 - RNA, 19 nt, Chlamydia trachomatis
aucaaacucuuuuucagac

SEQ ID NO: 471294 - RNA, 20 nt, Chlamydia trachomatis
aucaaacucuuuuucagaca

SEQ ID NO: 471295 - RNA, 20 nt, Chlamydia trachomatis
aucaacaagauuuuuuacaa

SEQ ID NO: 471296 - RNA, 22 nt, Chlamydia trachomatis
aucaagagaaaucagaugccau

SEQ ID NO: 471297 - RNA, 16 nt, Chlamydia trachomatis
aucaauaaugucucca

SEQ ID NO: 471298 - RNA, 13 nt, Chlamydia trachomatis
aucaauaaagaag

SEQ ID NO: 471299 - RNA, 14 nt, Chlamydia trachomatis
aucaauaaagaagc

SEQ ID NO: 471300 - RNA, 23 nt, Chlamydia trachomatis
aucaauaaccugaagauuuuuua

SEQ ID NO: 471301 - RNA, 19 nt, Chlamydia trachomatis
aucaaguauugugccaccg

SEQ ID NO: 471302 - RNA, 20 nt, Chlamydia trachomatis
aucaaucguagaaaaccgaa

SEQ ID NO: 471303 - RNA, 20 nt, Chlamydia trachomatis
aucaauauucgcaauauaga

SEQ ID NO: 471304 - RNA, 17 nt, Chlamydia trachomatis
aucacuuccuuuucaau

SEQ ID NO: 471305 - RNA, 15 nt, Chlamydia trachomatis
aucagcaaaugugga

SEQ ID NO: 471306 - RNA, 13 nt, Chlamydia trachomatis
aucagagcaauag

SEQ ID NO: 471307 - RNA, 14 nt, Chlamydia trachomatis
aucagagcaauaga

SEQ ID NO: 471308 - RNA, 18 nt, Chlamydia trachomatis
aucagagggacgagcagc

SEQ ID NO: 471309 - RNA, 23 nt, Chlamydia trachomatis
aucagcgcucauaggacaauuau

SEQ ID NO: 471310 - RNA, 17 nt, Chlamydia trachomatis
aucagcuguuccuuuua

SEQ ID NO: 471311 - RNA, 13 nt, Chlamydia trachomatis
aucauaaggaaga

SEQ ID NO: 471312 - RNA, 21 nt, Chlamydia trachomatis
aucaguggaacugcuucccuc

SEQ ID NO: 471313 - RNA, 19 nt, Chlamydia trachomatis
aaaacgcucuccaaagaau

SEQ ID NO: 471314 - RNA, 23 nt, Chlamydia trachomatis
aaaacgcucuccaaagaauagaa

SEQ ID NO: 471315 - RNA, 17 nt, Chlamydia trachomatis
aucaguguacccucgau

SEQ ID NO: 471316 - RNA, 13 nt, Chlamydia trachomatis
aucauaaaaagau

SEQ ID NO: 471317 - RNA, 16 nt, Chlamydia trachomatis
aucagcuuuuccacau

SEQ ID NO: 471318 - RNA, 21 nt, Chlamydia trachomatis
aucaggaaucacuaagucugu

SEQ ID NO: 471319 - RNA, 18 nt, Chlamydia trachomatis
aaaacgcucagaaaacuu

SEQ ID NO: 471320 - RNA, 19 nt, Chlamydia trachomatis
aaaacgcucagaaaacuua

SEQ ID NO: 471321 - RNA, 22 nt, Chlamydia trachomatis
aucaucaaccgcgacagccaca

SEQ ID NO: 471322 - RNA, 22 nt, Chlamydia trachomatis
aucauccauaaaaacugcugcu

SEQ ID NO: 471323 - RNA, 22 nt, Chlamydia trachomatis
aucaucauggaaaauauggcuc

SEQ ID NO: 471324 - RNA, 13 nt, Chlamydia trachomatis
aucauuugccaaa

SEQ ID NO: 471325 - RNA, 15 nt, Chlamydia trachomatis
aucauucaucuuuac

SEQ ID NO: 471326 - RNA, 16 nt, Chlamydia trachomatis
aucauucaucuuuacu

SEQ ID NO: 471327 - RNA, 16 nt, Chlamydia trachomatis
aaaagaaaaaucuccu

SEQ ID NO: 471328 - RNA, 14 nt, Chlamydia trachomatis
aaaagaaacaaaac

SEQ ID NO: 471329 - RNA, 22 nt, Chlamydia trachomatis
aaaagaaaccgaucccugaaua

SEQ ID NO: 471330 - RNA, 13 nt, Chlamydia trachomatis
aucauucaaaauc

SEQ ID NO: 471331 - RNA, 16 nt, Chlamydia trachomatis
aucauucaaaauccau

SEQ ID NO: 471332 - RNA, 21 nt, Chlamydia trachomatis
aaaacuaccuagugauuuuaa

SEQ ID NO: 471333 - RNA, 22 nt, Chlamydia trachomatis
aaaacuaccuagugauuuuaaa

SEQ ID NO: 471334 - RNA, 21 nt, Chlamydia trachomatis
aucauuaauuagaauuuccag

SEQ ID NO: 471335 - RNA, 15 nt, Chlamydia trachomatis
aaaacuuuacuucaa

SEQ ID NO: 471336 - RNA, 20 nt, Chlamydia trachomatis
aaaacuuucucgcaauauau

SEQ ID NO: 471337 - RNA, 17 nt, Chlamydia trachomatis
aaaacuuugacaagcag

SEQ ID NO: 471338 - RNA, 12 nt, Chlamydia trachomatis
aaaacuuuucuu

SEQ ID NO: 471339 - RNA, 11 nt, Chlamydia trachomatis
aaaagaaaaaa

SEQ ID NO: 471340 - RNA, 23 nt, Chlamydia trachomatis
auccagacaauggucuccuaaau

SEQ ID NO: 471341 - RNA, 18 nt, Chlamydia trachomatis
auccacuuuuaggauagu

SEQ ID NO: 471342 - RNA, 22 nt, Chlamydia trachomatis
aucauuuucuguaauuuuaaau

SEQ ID NO: 471343 - RNA, 23 nt, Chlamydia trachomatis
auccaaaaggauggcgguguuuc

SEQ ID NO: 471344 - RNA, 15 nt, Chlamydia trachomatis
auccaagcacuccuc

SEQ ID NO: 471345 - RNA, 16 nt, Chlamydia trachomatis
auccaaggaaaccaag

SEQ ID NO: 471346 - RNA, 17 nt, Chlamydia trachomatis
auccaggagauguagga

SEQ ID NO: 471347 - RNA, 16 nt, Chlamydia trachomatis
auccauucccagauua

SEQ ID NO: 471348 - RNA, 19 nt, Chlamydia trachomatis
auccauuuacgagguagcc

SEQ ID NO: 471349 - RNA, 14 nt, Chlamydia trachomatis
aucccagaauaaag

SEQ ID NO: 471350 - RNA, 20 nt, Chlamydia trachomatis
auccccucaaaaaauguuuu

SEQ ID NO: 471351 - RNA, 14 nt, Chlamydia trachomatis
aucccggaggcaac

SEQ ID NO: 471352 - RNA, 23 nt, Chlamydia trachomatis
aucccagccugugcauuugugga

SEQ ID NO: 471353 - RNA, 16 nt, Chlamydia trachomatis
aucccagggagagaga

SEQ ID NO: 471354 - RNA, 18 nt, Chlamydia trachomatis
aucccagggagagagagc

SEQ ID NO: 471355 - RNA, 16 nt, Chlamydia trachomatis
aucccauaaaagccau

SEQ ID NO: 471356 - RNA, 12 nt, Chlamydia trachomatis
aucccguucuug

SEQ ID NO: 471357 - RNA, 17 nt, Chlamydia trachomatis
aucccucuagcaaccaa

SEQ ID NO: 471358 - RNA, 22 nt, Chlamydia trachomatis
aucccucuagcaaccaauucuc

SEQ ID NO: 471359 - RNA, 16 nt, Chlamydia trachomatis
aucccugugcuaucuu

SEQ ID NO: 471360 - RNA, 15 nt, Chlamydia trachomatis
aucccuuucauucuu

SEQ ID NO: 471361 - RNA, 16 nt, Chlamydia trachomatis
aucccuuuuucaagaa

SEQ ID NO: 471362 - RNA, 15 nt, Chlamydia trachomatis
aucccuuuuucagga

SEQ ID NO: 471363 - RNA, 16 nt, Chlamydia trachomatis
auccgcaccaaucacc

SEQ ID NO: 471364 - RNA, 20 nt, Chlamydia trachomatis
auccgaaugaauuuccccug

SEQ ID NO: 471365 - RNA, 16 nt, Chlamydia trachomatis
auccgagcauuuucca

SEQ ID NO: 471366 - RNA, 16 nt, Chlamydia trachomatis
auccgcaguaaaaucu

SEQ ID NO: 471367 - RNA, 22 nt, Chlamydia trachomatis
auccgcaguaaaaucuaaaaua

SEQ ID NO: 471368 - RNA, 15 nt, Chlamydia trachomatis
auccgcagagaugau

SEQ ID NO: 471369 - RNA, 17 nt, Chlamydia trachomatis
auccuggaguauuuuca

SEQ ID NO: 471370 - RNA, 20 nt, Chlamydia trachomatis
auccugcauuuauccacagg

SEQ ID NO: 471371 - RNA, 23 nt, Chlamydia trachomatis
auccgcuccccuuccuguucuuc

SEQ ID NO: 471372 - RNA, 21 nt, Chlamydia trachomatis
auccgcuuggaauacaucacu

SEQ ID NO: 471373 - RNA, 16 nt, Chlamydia trachomatis
auccugcagcaaauaa

SEQ ID NO: 471374 - RNA, 15 nt, Chlamydia trachomatis
aucgaaaguaaaauu

SEQ ID NO: 471375 - RNA, 18 nt, Chlamydia trachomatis
auccuguggucacaagaa

SEQ ID NO: 471376 - RNA, 13 nt, Chlamydia trachomatis
auccuucugccuc

SEQ ID NO: 471377 - RNA, 13 nt, Chlamydia trachomatis
aucgaauaaaaau

SEQ ID NO: 471378 - RNA, 16 nt, Chlamydia trachomatis
aucgaggugauuuucu

SEQ ID NO: 471379 - RNA, 19 nt, Chlamydia trachomatis
aucgccaaaaaucauuucc

SEQ ID NO: 471380 - RNA, 19 nt, Chlamydia trachomatis
aucgauaccuauuccaaau

SEQ ID NO: 471381 - RNA, 20 nt, Chlamydia trachomatis
aucgcggcuaucgucuuuaa

SEQ ID NO: 471382 - RNA, 14 nt, Chlamydia trachomatis
aucgcggaagaaag

SEQ ID NO: 471383 - RNA, 16 nt, Chlamydia trachomatis
aucgcggaagaaagca

SEQ ID NO: 471384 - RNA, 15 nt, Chlamydia trachomatis
aucgcuucugcugaa

SEQ ID NO: 471385 - RNA, 12 nt, Chlamydia trachomatis
aucggaauagca

SEQ ID NO: 471386 - RNA, 17 nt, Chlamydia trachomatis
aucguaagcaacaauau

SEQ ID NO: 471387 - RNA, 19 nt, Chlamydia trachomatis
aucguagagaucuucugaa

SEQ ID NO: 471388 - RNA, 19 nt, Chlamydia trachomatis
aucuaauuuuagauaaaag

SEQ ID NO: 471389 - RNA, 14 nt, Chlamydia trachomatis
aucuacaaaaccaa

SEQ ID NO: 471390 - RNA, 15 nt, Chlamydia trachomatis
aucuacaaaaccaaa

SEQ ID NO: 471391 - RNA, 16 nt, Chlamydia trachomatis
aucuacaaaaccaaaa

SEQ ID NO: 471392 - RNA, 18 nt, Chlamydia trachomatis
aucuacaaaaccaaaauc

SEQ ID NO: 471393 - RNA, 21 nt, Chlamydia trachomatis
aucuacaaaaccaaaaucgua

SEQ ID NO: 471394 - RNA, 23 nt, Chlamydia trachomatis
aucuacacgcucaggcuaucaca

SEQ ID NO: 471395 - RNA, 14 nt, Chlamydia trachomatis
aucuagacaaucug

SEQ ID NO: 471396 - RNA, 17 nt, Chlamydia trachomatis
aucuagaggaaugugaa

SEQ ID NO: 471397 - RNA, 20 nt, Chlamydia trachomatis
aucuauaaucuauuuuauac

SEQ ID NO: 471398 - RNA, 12 nt, Chlamydia trachomatis
aucuauaggaug

SEQ ID NO: 471399 - RNA, 18 nt, Chlamydia trachomatis
aucuaucaacuuuacaua

SEQ ID NO: 471400 - RNA, 19 nt, Chlamydia trachomatis
aucuaucgcuugaaaagaa

SEQ ID NO: 471401 - RNA, 21 nt, Chlamydia trachomatis
aucuaucuggaucuugggaac

SEQ ID NO: 471402 - RNA, 14 nt, Chlamydia trachomatis
aucuaugaaaaaag

SEQ ID NO: 471403 - RNA, 18 nt, Chlamydia trachomatis
aucucgagcuaagaaaau

SEQ ID NO: 471404 - RNA, 19 nt, Chlamydia trachomatis
aucucgagcuaagaaaaua

SEQ ID NO: 471405 - RNA, 22 nt, Chlamydia trachomatis
aucucugguaaaaauagaaaac

SEQ ID NO: 471406 - RNA, 14 nt, Chlamydia trachomatis
aucucuuucucuag

SEQ ID NO: 471407 - RNA, 15 nt, Chlamydia trachomatis
aucucuuuuaccucu

SEQ ID NO: 471408 - RNA, 21 nt, Chlamydia trachomatis
aucucuuuuaccucuaacagu

SEQ ID NO: 471409 - RNA, 17 nt, Chlamydia trachomatis
aucuccaaaauucugua

SEQ ID NO: 471410 - RNA, 16 nt, Chlamydia trachomatis
aucuccaaagacacac

SEQ ID NO: 471411 - RNA, 18 nt, Chlamydia trachomatis
aucuccaaucacagcaau

SEQ ID NO: 471412 - RNA, 13 nt, Chlamydia trachomatis
aucuccuaagaca

SEQ ID NO: 471413 - RNA, 14 nt, Chlamydia trachomatis
aucuccuaagacaa

SEQ ID NO: 471414 - RNA, 15 nt, Chlamydia trachomatis
aucuccuaagacaag

SEQ ID NO: 471415 - RNA, 13 nt, Chlamydia trachomatis
aucuccuccuauu

SEQ ID NO: 471416 - RNA, 15 nt, Chlamydia trachomatis
aucuccuuccucuuu

SEQ ID NO: 471417 - RNA, 22 nt, Chlamydia trachomatis
aucuccuuccucuuuaaccaga

SEQ ID NO: 471418 - RNA, 18 nt, Chlamydia trachomatis
aucuccuucucagagcuu

SEQ ID NO: 471419 - RNA, 17 nt, Chlamydia trachomatis
aucuccuuugcuaacaa

SEQ ID NO: 471420 - RNA, 18 nt, Chlamydia trachomatis
aucuccuuugcuaacaaa

SEQ ID NO: 471421 - RNA, 20 nt, Chlamydia trachomatis
aucuccuuugcuaacaaaga

SEQ ID NO: 471422 - RNA, 23 nt, Chlamydia trachomatis
aucugaaucuguguugcaaagag

SEQ ID NO: 471423 - RNA, 18 nt, Chlamydia trachomatis
aucucuuuuuacaacucu

SEQ ID NO: 471424 - RNA, 16 nt, Chlamydia trachomatis
aucugcgguauccaua

SEQ ID NO: 471425 - RNA, 23 nt, Chlamydia trachomatis
aucugcgguauccauacgaaaga

SEQ ID NO: 471426 - RNA, 18 nt, Chlamydia trachomatis
aucugcuauagaaagcaa

SEQ ID NO: 471427 - RNA, 19 nt, Chlamydia trachomatis
aucuguauccuaacuaaaa

SEQ ID NO: 471428 - RNA, 23 nt, Chlamydia trachomatis
aucuguauggcagacaaaacaag

SEQ ID NO: 471429 - RNA, 15 nt, Chlamydia trachomatis
aucugucagucuucu

SEQ ID NO: 471430 - RNA, 13 nt, Chlamydia trachomatis
aucuguccaaaga

SEQ ID NO: 471431 - RNA, 15 nt, Chlamydia trachomatis
aucuguccaaagaga

SEQ ID NO: 471432 - RNA, 22 nt, Chlamydia trachomatis
aucuuaaacaagaucuaucuau

SEQ ID NO: 471433 - RNA, 22 nt, Chlamydia trachomatis
aucugggaggagaacucuuucc

SEQ ID NO: 471434 - RNA, 18 nt, Chlamydia trachomatis
aucugggauggaaauaau

SEQ ID NO: 471435 - RNA, 19 nt, Chlamydia trachomatis
aucuggcugaagaaguuga

SEQ ID NO: 471436 - RNA, 22 nt, Chlamydia trachomatis
aucuguaacuacaucuaaaaga

SEQ ID NO: 471437 - RNA, 20 nt, Chlamydia trachomatis
aucuguaauaaacccuggau

SEQ ID NO: 471438 - RNA, 19 nt, Chlamydia trachomatis
aucuguagagagccccacc

SEQ ID NO: 471439 - RNA, 23 nt, Chlamydia trachomatis
aucuguaggggagggacuucuuc

SEQ ID NO: 471440 - RNA, 12 nt, Chlamydia trachomatis
aucuucaaagaa

SEQ ID NO: 471441 - RNA, 14 nt, Chlamydia trachomatis
aucuucaacaagau

SEQ ID NO: 471442 - RNA, 18 nt, Chlamydia trachomatis
aucuucaacccuuuuaau

SEQ ID NO: 471443 - RNA, 17 nt, Chlamydia trachomatis
aucuucaauccacugca

SEQ ID NO: 471444 - RNA, 20 nt, Chlamydia trachomatis
aucuucaauggcaaaacuuc

SEQ ID NO: 471445 - RNA, 17 nt, Chlamydia trachomatis
aucuucaccccuuacaa

SEQ ID NO: 471446 - RNA, 19 nt, Chlamydia trachomatis
aucuucaccccuuacaaug

SEQ ID NO: 471447 - RNA, 16 nt, Chlamydia trachomatis
aucuucacggagagaa

SEQ ID NO: 471448 - RNA, 17 nt, Chlamydia trachomatis
aucuucagaaaucuucu

SEQ ID NO: 471449 - RNA, 18 nt, Chlamydia trachomatis
aucuucagaagcggcaug

SEQ ID NO: 471450 - RNA, 18 nt, Chlamydia trachomatis
aucuuccagccuacaaau

SEQ ID NO: 471451 - RNA, 16 nt, Chlamydia trachomatis
aucuucccaauauauu

SEQ ID NO: 471452 - RNA, 24 nt, Chlamydia trachomatis
aucuucccaauauauuccugucuu

SEQ ID NO: 471453 - RNA, 16 nt, Chlamydia trachomatis
aucuuccggaaggaug

SEQ ID NO: 471454 - RNA, 22 nt, Chlamydia trachomatis
aucuuccggaaggauguuuccc

SEQ ID NO: 471455 - RNA, 21 nt, Chlamydia trachomatis
aucuucggcagaagcugcaga

SEQ ID NO: 471456 - RNA, 16 nt, Chlamydia trachomatis
aucuucuaaaugcugu

SEQ ID NO: 471457 - RNA, 18 nt, Chlamydia trachomatis
aucuuuccaauaucuuca

SEQ ID NO: 471458 - RNA, 15 nt, Chlamydia trachomatis
aucuuuguucucuaa

SEQ ID NO: 471459 - RNA, 16 nt, Chlamydia trachomatis
augaaaaagaagcuaa

SEQ ID NO: 471460 - RNA, 15 nt, Chlamydia trachomatis
augaaaaagccugug

SEQ ID NO: 471461 - RNA, 13 nt, Chlamydia trachomatis
augaaaagcuuuc

SEQ ID NO: 471462 - RNA, 23 nt, Chlamydia trachomatis
augaaauaucauucccuacggaa

SEQ ID NO: 471463 - RNA, 18 nt, Chlamydia trachomatis
augaaauaucguaaccag

SEQ ID NO: 471464 - RNA, 15 nt, Chlamydia trachomatis
augaacagcaagagg

SEQ ID NO: 471465 - RNA, 21 nt, Chlamydia trachomatis
augaaccagggagagcuuagg

SEQ ID NO: 471466 - RNA, 11 nt, Chlamydia trachomatis
augaacaacau

SEQ ID NO: 471467 - RNA, 14 nt, Chlamydia trachomatis
augaacaacauaaa

SEQ ID NO: 471468 - RNA, 17 nt, Chlamydia trachomatis
augaacaacauaaaauc

SEQ ID NO: 471469 - RNA, 15 nt, Chlamydia trachomatis
augaagcuaaaaaau

SEQ ID NO: 471470 - RNA, 16 nt, Chlamydia trachomatis
augaagcuaaaaaauc

SEQ ID NO: 471471 - RNA, 16 nt, Chlamydia trachomatis
augaaggccaaagaaa

SEQ ID NO: 471472 - RNA, 18 nt, Chlamydia trachomatis
augaaggccaaagaaaua

SEQ ID NO: 471473 - RNA, 20 nt, Chlamydia trachomatis
augaaggccaaagaaauagc

SEQ ID NO: 471474 - RNA, 18 nt, Chlamydia trachomatis
augaacggacgacugcaa

SEQ ID NO: 471475 - RNA, 15 nt, Chlamydia trachomatis
augaaugagcuuaga

SEQ ID NO: 471476 - RNA, 20 nt, Chlamydia trachomatis
augaauuuuaucuaaaaagg

SEQ ID NO: 471477 - RNA, 20 nt, Chlamydia trachomatis
augacauaagcaaauccugc

SEQ ID NO: 471478 - RNA, 18 nt, Chlamydia trachomatis
augacagguuucaugaca

SEQ ID NO: 471479 - RNA, 22 nt, Chlamydia trachomatis
augacauuccucgauaaugcuu

SEQ ID NO: 471480 - RNA, 15 nt, Chlamydia trachomatis
augagcuuaucacaa

SEQ ID NO: 471481 - RNA, 21 nt, Chlamydia trachomatis
augagcuuaucacaaaccagc

SEQ ID NO: 471482 - RNA, 22 nt, Chlamydia trachomatis
augaggacagaguucucugagg

SEQ ID NO: 471483 - RNA, 11 nt, Chlamydia trachomatis
augagguaaug

SEQ ID NO: 471484 - RNA, 17 nt, Chlamydia trachomatis
augauagaguagggaau

SEQ ID NO: 471485 - RNA, 15 nt, Chlamydia trachomatis
augauauagauuuua

SEQ ID NO: 471486 - RNA, 20 nt, Chlamydia trachomatis
augauauuaguuagugaagu

SEQ ID NO: 471487 - RNA, 15 nt, Chlamydia trachomatis
augaucauaaauacu

SEQ ID NO: 471488 - RNA, 19 nt, Chlamydia trachomatis
augaucacaugaucauagu

SEQ ID NO: 471489 - RNA, 14 nt, Chlamydia trachomatis
augaucagcaaaaa

SEQ ID NO: 471490 - RNA, 16 nt, Chlamydia trachomatis
augaucagcaaaaaga

SEQ ID NO: 471491 - RNA, 17 nt, Chlamydia trachomatis
augaucagcaaaaagag

SEQ ID NO: 471492 - RNA, 22 nt, Chlamydia trachomatis
augauacgcauaugcgucuucc

SEQ ID NO: 471493 - RNA, 14 nt, Chlamydia trachomatis
augaucuaaaggaa

SEQ ID NO: 471494 - RNA, 21 nt, Chlamydia trachomatis
augcaggcgagucuuucuaga

SEQ ID NO: 471495 - RNA, 12 nt, Chlamydia trachomatis
augcaucuauug

SEQ ID NO: 471496 - RNA, 21 nt, Chlamydia trachomatis
augcaucugauguuccaucuu

SEQ ID NO: 471497 - RNA, 14 nt, Chlamydia trachomatis
augcccuaaagaga

SEQ ID NO: 471498 - RNA, 17 nt, Chlamydia trachomatis
augcgcaauccuuuuaa

SEQ ID NO: 471499 - RNA, 19 nt, Chlamydia trachomatis
augcggauuaaagaaggaa

SEQ ID NO: 471500 - RNA, 17 nt, Chlamydia trachomatis
augcggcgucugucaac

SEQ ID NO: 471501 - RNA, 18 nt, Chlamydia trachomatis
augcggcccacacuaccc

SEQ ID NO: 471502 - RNA, 14 nt, Chlamydia trachomatis
augcguagucucua

SEQ ID NO: 471503 - RNA, 16 nt, Chlamydia trachomatis
augcgugucacagacu

SEQ ID NO: 471504 - RNA, 21 nt, Chlamydia trachomatis
augcguuaauuaauaagccuu

SEQ ID NO: 471505 - RNA, 17 nt, Chlamydia trachomatis
augcugaagcuacuaaa

SEQ ID NO: 471506 - RNA, 17 nt, Chlamydia trachomatis
augcugaaugguggcau

SEQ ID NO: 471507 - RNA, 23 nt, Chlamydia trachomatis
augcucacaaaccaaaaccacac

SEQ ID NO: 471508 - RNA, 13 nt, Chlamydia trachomatis
aaaagacccagua

SEQ ID NO: 471509 - RNA, 20 nt, Chlamydia trachomatis
aaaagacccaguaguuuacu

SEQ ID NO: 471510 - RNA, 15 nt, Chlamydia trachomatis
aaaagaccucuuuuu

SEQ ID NO: 471511 - RNA, 14 nt, Chlamydia trachomatis
aaaagagcauaaua

SEQ ID NO: 471512 - RNA, 16 nt, Chlamydia trachomatis
aaaagagcuaaacuuc

SEQ ID NO: 471513 - RNA, 18 nt, Chlamydia trachomatis
aaaagagcuucuucuaaa

SEQ ID NO: 471514 - RNA, 15 nt, Chlamydia trachomatis
aaaagagcuuuucuu

SEQ ID NO: 471515 - RNA, 14 nt, Chlamydia trachomatis
aaaagaggagaaca

SEQ ID NO: 471516 - RNA, 16 nt, Chlamydia trachomatis
auggcaaaaucuucau

SEQ ID NO: 471517 - RNA, 16 nt, Chlamydia trachomatis
auggcauuuacaaacg

SEQ ID NO: 471518 - RNA, 19 nt, Chlamydia trachomatis
augggaagcucggucucau

SEQ ID NO: 471519 - RNA, 19 nt, Chlamydia trachomatis
auggggguuacuucaaguu

SEQ ID NO: 471520 - RNA, 22 nt, Chlamydia trachomatis
augggauggcugcuaucuucua

SEQ ID NO: 471521 - RNA, 12 nt, Chlamydia trachomatis
augguauucuaa

SEQ ID NO: 471522 - RNA, 17 nt, Chlamydia trachomatis
auggguaaggggaagau

SEQ ID NO: 471523 - RNA, 19 nt, Chlamydia trachomatis
augguuuguccuuuucucc

SEQ ID NO: 471524 - RNA, 22 nt, Chlamydia trachomatis
auggucgucucagcuucaaccu

SEQ ID NO: 471525 - RNA, 17 nt, Chlamydia trachomatis
auggucuccuaaauccu

SEQ ID NO: 471526 - RNA, 19 nt, Chlamydia trachomatis
auguacucugcaaaaucuu

SEQ ID NO: 471527 - RNA, 13 nt, Chlamydia trachomatis
auguagaaauuuu

SEQ ID NO: 471528 - RNA, 17 nt, Chlamydia trachomatis
auguagaaauuuuaaau

SEQ ID NO: 471529 - RNA, 16 nt, Chlamydia trachomatis
auguagccaaggaaga

SEQ ID NO: 471530 - RNA, 17 nt, Chlamydia trachomatis
auguaagccuaaaacuc

SEQ ID NO: 471531 - RNA, 16 nt, Chlamydia trachomatis
auguaagcgagauaag

SEQ ID NO: 471532 - RNA, 20 nt, Chlamydia trachomatis
auguaagucuauaauaugaa

SEQ ID NO: 471533 - RNA, 22 nt, Chlamydia trachomatis
auguacgcuaaaaacucuuuca

SEQ ID NO: 471534 - RNA, 14 nt, Chlamydia trachomatis
auguacgcucuuuc

SEQ ID NO: 471535 - RNA, 22 nt, Chlamydia trachomatis
auguccacaaggagauauuucc

SEQ ID NO: 471536 - RNA, 22 nt, Chlamydia trachomatis
auguauggaaagggaggaggaa

SEQ ID NO: 471537 - RNA, 13 nt, Chlamydia trachomatis
aaaagauuuugaa

SEQ ID NO: 471538 - RNA, 9 nt, Chlamydia trachomatis
aaaagauuu

SEQ ID NO: 471539 - RNA, 13 nt, Chlamydia trachomatis
aaaagauuucaga

SEQ ID NO: 471540 - RNA, 13 nt, Chlamydia trachomatis
aaaagauuucccc

SEQ ID NO: 471541 - RNA, 22 nt, Chlamydia trachomatis
aaaagauagugcagaagauaag

SEQ ID NO: 471542 - RNA, 15 nt, Chlamydia trachomatis
aaaagaucuucaaca

SEQ ID NO: 471543 - RNA, 21 nt, Chlamydia trachomatis
aaaagaucuucaacaagauuu

SEQ ID NO: 471544 - RNA, 20 nt, Chlamydia trachomatis
auuaaaccacccuucccaac

SEQ ID NO: 471545 - RNA, 15 nt, Chlamydia trachomatis
auuaaagguuuccca

SEQ ID NO: 471546 - RNA, 16 nt, Chlamydia trachomatis
auguuucuuauuugcc

SEQ ID NO: 471547 - RNA, 22 nt, Chlamydia trachomatis
auguuuacgaggagguuaccac

SEQ ID NO: 471548 - RNA, 17 nt, Chlamydia trachomatis
auguuguuaaagcuuuu

SEQ ID NO: 471549 - RNA, 19 nt, Chlamydia trachomatis
auguucacacuuucuucca

SEQ ID NO: 471550 - RNA, 21 nt, Chlamydia trachomatis
auguccucuuuaucuaaagaa

SEQ ID NO: 471551 - RNA, 20 nt, Chlamydia trachomatis
aaaagcacugcguauuugaa

SEQ ID NO: 471552 - RNA, 14 nt, Chlamydia trachomatis
auuaacaggaagaa

SEQ ID NO: 471553 - RNA, 16 nt, Chlamydia trachomatis
auuaacaggaagaaua

SEQ ID NO: 471554 - RNA, 21 nt, Chlamydia trachomatis
auuaacccaaaagauccauuu

SEQ ID NO: 471555 - RNA, 15 nt, Chlamydia trachomatis
auuacagcaagaaga

SEQ ID NO: 471556 - RNA, 19 nt, Chlamydia trachomatis
auuacagcaagaagaagag

SEQ ID NO: 471557 - RNA, 20 nt, Chlamydia trachomatis
auuacagcaagaagaagaga

SEQ ID NO: 471558 - RNA, 19 nt, Chlamydia trachomatis
auuacacaacucuuuuccu

SEQ ID NO: 471559 - RNA, 23 nt, Chlamydia trachomatis
auuacacaacucuuuuccuaaac

SEQ ID NO: 471560 - RNA, 18 nt, Chlamydia trachomatis
auuauuacgaacagcaau

SEQ ID NO: 471561 - RNA, 14 nt, Chlamydia trachomatis
auuauuauuuaaaa

SEQ ID NO: 471562 - RNA, 21 nt, Chlamydia trachomatis
auuauucacacuuaaaaagaa

SEQ ID NO: 471563 - RNA, 19 nt, Chlamydia trachomatis
auuacgaauuucugggaaa

SEQ ID NO: 471564 - RNA, 21 nt, Chlamydia trachomatis
auuacgccccuucuucaagaa

SEQ ID NO: 471565 - RNA, 17 nt, Chlamydia trachomatis
auuagcgggagaaggau

SEQ ID NO: 471566 - RNA, 12 nt, Chlamydia trachomatis
auuaggaagaag

SEQ ID NO: 471567 - RNA, 22 nt, Chlamydia trachomatis
aaaagcugggcagcaagagaga

SEQ ID NO: 471568 - RNA, 20 nt, Chlamydia trachomatis
aaaagcugcuuuauccaaag

SEQ ID NO: 471569 - RNA, 23 nt, Chlamydia trachomatis
aaaagcugcuuuauccaaagaua

SEQ ID NO: 471570 - RNA, 21 nt, Chlamydia trachomatis
auuagggaagagcaauauguu

SEQ ID NO: 471571 - RNA, 17 nt, Chlamydia trachomatis
auuaguaauaaaggaaa

SEQ ID NO: 471572 - RNA, 18 nt, Chlamydia trachomatis
auuaguaauaaaggaaac

SEQ ID NO: 471573 - RNA, 16 nt, Chlamydia trachomatis
auucaggcucuuucag

SEQ ID NO: 471574 - RNA, 17 nt, Chlamydia trachomatis
auucaggcucuuucaga

SEQ ID NO: 471575 - RNA, 20 nt, Chlamydia trachomatis
auucaggcucuuucagagaa

SEQ ID NO: 471576 - RNA, 16 nt, Chlamydia trachomatis
auucaguucgaaguuc

SEQ ID NO: 471577 - RNA, 13 nt, Chlamydia trachomatis
auucacuucaacu

SEQ ID NO: 471578 - RNA, 17 nt, Chlamydia trachomatis
auucagaacaagugcag

SEQ ID NO: 471579 - RNA, 15 nt, Chlamydia trachomatis
auucaauccagacuc

SEQ ID NO: 471580 - RNA, 20 nt, Chlamydia trachomatis
auucaauccagacucuugua

SEQ ID NO: 471581 - RNA, 17 nt, Chlamydia trachomatis
auucaaaucuucuucua

SEQ ID NO: 471582 - RNA, 16 nt, Chlamydia trachomatis
aaaaggcuagagauau

SEQ ID NO: 471583 - RNA, 18 nt, Chlamydia trachomatis
aaaaggcuagagauauca

SEQ ID NO: 471584 - RNA, 16 nt, Chlamydia trachomatis
auucaauuaaagccac

SEQ ID NO: 471585 - RNA, 16 nt, Chlamydia trachomatis
aaaaggcauaaaagag

SEQ ID NO: 471586 - RNA, 17 nt, Chlamydia trachomatis
auucacacuuaaaaaga

SEQ ID NO: 471587 - RNA, 20 nt, Chlamydia trachomatis
auucacacuuaaaaagaaac

SEQ ID NO: 471588 - RNA, 19 nt, Chlamydia trachomatis
auuccaguuacccucuuua

SEQ ID NO: 471589 - RNA, 14 nt, Chlamydia trachomatis
auucauagaaguca

SEQ ID NO: 471590 - RNA, 20 nt, Chlamydia trachomatis
auuccccgagacgcaucacg

SEQ ID NO: 471591 - RNA, 14 nt, Chlamydia trachomatis
auuccucuaaacaa

SEQ ID NO: 471592 - RNA, 18 nt, Chlamydia trachomatis
auuccguacucugauuag

SEQ ID NO: 471593 - RNA, 20 nt, Chlamydia trachomatis
auuccguacucugauuagaa

SEQ ID NO: 471594 - RNA, 15 nt, Chlamydia trachomatis
auuccugccaaaaac

SEQ ID NO: 471595 - RNA, 14 nt, Chlamydia trachomatis
auucgaaaagagcu

SEQ ID NO: 471596 - RNA, 12 nt, Chlamydia trachomatis
auucgaauaauc

SEQ ID NO: 471597 - RNA, 22 nt, Chlamydia trachomatis
auucgagagacggcacaggugu

SEQ ID NO: 471598 - RNA, 19 nt, Chlamydia trachomatis
auucgauauacgcucuuuc

SEQ ID NO: 471599 - RNA, 14 nt, Chlamydia trachomatis
auucgcauuaaaua

SEQ ID NO: 471600 - RNA, 15 nt, Chlamydia trachomatis
auucgccacgaggau

SEQ ID NO: 471601 - RNA, 13 nt, Chlamydia trachomatis
auugaacauuuuc

SEQ ID NO: 471602 - RNA, 20 nt, Chlamydia trachomatis
auugaacccauagauucaug

SEQ ID NO: 471603 - RNA, 19 nt, Chlamydia trachomatis
auucuuugguaauagcaaa

SEQ ID NO: 471604 - RNA, 19 nt, Chlamydia trachomatis
auucuuucuggagcaucag

SEQ ID NO: 471605 - RNA, 17 nt, Chlamydia trachomatis
auucuuucuuaucuguc

SEQ ID NO: 471606 - RNA, 23 nt, Chlamydia trachomatis
auucuuucuuaucugucagucuu

SEQ ID NO: 471607 - RNA, 22 nt, Chlamydia trachomatis
auucuuucauucguuucuuccc

SEQ ID NO: 471608 - RNA, 14 nt, Chlamydia trachomatis
auucuuucgauauc

SEQ ID NO: 471609 - RNA, 16 nt, Chlamydia trachomatis
auucuuagcccagauu

SEQ ID NO: 471610 - RNA, 18 nt, Chlamydia trachomatis
auucuagcaaccgauucu

SEQ ID NO: 471611 - RNA, 19 nt, Chlamydia trachomatis
auucucaccuugaacguag

SEQ ID NO: 471612 - RNA, 18 nt, Chlamydia trachomatis
auucucaggaucuaauuc

SEQ ID NO: 471613 - RNA, 14 nt, Chlamydia trachomatis
auucuccaggagau

SEQ ID NO: 471614 - RNA, 14 nt, Chlamydia trachomatis
auucuccgaauaaa

SEQ ID NO: 471615 - RNA, 17 nt, Chlamydia trachomatis
auucugucgacaagcac

SEQ ID NO: 471616 - RNA, 15 nt, Chlamydia trachomatis
auugagcaaaaaaag

SEQ ID NO: 471617 - RNA, 17 nt, Chlamydia trachomatis
auugagcaaaaaaagag

SEQ ID NO: 471618 - RNA, 14 nt, Chlamydia trachomatis
auugagaacauaac

SEQ ID NO: 471619 - RNA, 20 nt, Chlamydia trachomatis
auugagaacauaacacauau

SEQ ID NO: 471620 - RNA, 21 nt, Chlamydia trachomatis
auugaguucugcuugcgaaua

SEQ ID NO: 471621 - RNA, 18 nt, Chlamydia trachomatis
auugaauaaaucuaucca

SEQ ID NO: 471622 - RNA, 12 nt, Chlamydia trachomatis
auugaauacagu

SEQ ID NO: 471623 - RNA, 15 nt, Chlamydia trachomatis
auugacaacuuucuu

SEQ ID NO: 471624 - RNA, 20 nt, Chlamydia trachomatis
auugacagcaccaagcucca

SEQ ID NO: 471625 - RNA, 18 nt, Chlamydia trachomatis
auuuaccggguagauaca

SEQ ID NO: 471626 - RNA, 17 nt, Chlamydia trachomatis
auuuacgaaguauuuuc

SEQ ID NO: 471627 - RNA, 21 nt, Chlamydia trachomatis
auuuacgagaggguuucuucu

SEQ ID NO: 471628 - RNA, 18 nt, Chlamydia trachomatis
auuuacaaacgaagcugc

SEQ ID NO: 471629 - RNA, 12 nt, Chlamydia trachomatis
auuuagacacau

SEQ ID NO: 471630 - RNA, 17 nt, Chlamydia trachomatis
auuuagaguuccuaaau

SEQ ID NO: 471631 - RNA, 19 nt, Chlamydia trachomatis
auugugcaagccccccucu

SEQ ID NO: 471632 - RNA, 23 nt, Chlamydia trachomatis
auugugcuuuuaucuucaaagaa

SEQ ID NO: 471633 - RNA, 16 nt, Chlamydia trachomatis
auuuaauuaaagagau

SEQ ID NO: 471634 - RNA, 22 nt, Chlamydia trachomatis
auugcuaccgauguauuuguac

SEQ ID NO: 471635 - RNA, 13 nt, Chlamydia trachomatis
auugcuucauaaa

SEQ ID NO: 471636 - RNA, 20 nt, Chlamydia trachomatis
auugauucuaugagaagaaa

SEQ ID NO: 471637 - RNA, 16 nt, Chlamydia trachomatis
auuggaagauaacaau

SEQ ID NO: 471638 - RNA, 15 nt, Chlamydia trachomatis
auuggaaaauccaaa

SEQ ID NO: 471639 - RNA, 20 nt, Chlamydia trachomatis
auuggaauuuucaucaaaau

SEQ ID NO: 471640 - RNA, 13 nt, Chlamydia trachomatis
auuggacucagaa

SEQ ID NO: 471641 - RNA, 14 nt, Chlamydia trachomatis
auuggacucagaau

SEQ ID NO: 471642 - RNA, 20 nt, Chlamydia trachomatis
auuggggauccuacagcaga

SEQ ID NO: 471643 - RNA, 15 nt, Chlamydia trachomatis
auuguauagcuuuua

SEQ ID NO: 471644 - RNA, 17 nt, Chlamydia trachomatis
auuguaucaacagauga

SEQ ID NO: 471645 - RNA, 17 nt, Chlamydia trachomatis
auuuccagcauuuuaaa

SEQ ID NO: 471646 - RNA, 21 nt, Chlamydia trachomatis
auuuccagcauuuuaaaauca

SEQ ID NO: 471647 - RNA, 16 nt, Chlamydia trachomatis
auuuccaaaaucuuca

SEQ ID NO: 471648 - RNA, 17 nt, Chlamydia trachomatis
auuuccauagaaagaua

SEQ ID NO: 471649 - RNA, 13 nt, Chlamydia trachomatis
auuuccuaccauc

SEQ ID NO: 471650 - RNA, 23 nt, Chlamydia trachomatis
auuuccuaccaucaauccuggaa

SEQ ID NO: 471651 - RNA, 15 nt, Chlamydia trachomatis
auuuccugcaagcac

SEQ ID NO: 471652 - RNA, 18 nt, Chlamydia trachomatis
auuuccuuagaaagaauu

SEQ ID NO: 471653 - RNA, 17 nt, Chlamydia trachomatis
auuuggcaauggcaaaa

SEQ ID NO: 471654 - RNA, 22 nt, Chlamydia trachomatis
auuuggcaauggcaaaaucuuc

SEQ ID NO: 471655 - RNA, 15 nt, Chlamydia trachomatis
auuuggauaugccug

SEQ ID NO: 471656 - RNA, 15 nt, Chlamydia trachomatis
auuuguaccaaccca

SEQ ID NO: 471657 - RNA, 18 nt, Chlamydia trachomatis
auuuguguauggaaguag

SEQ ID NO: 471658 - RNA, 12 nt, Chlamydia trachomatis
auuugugugcaa

SEQ ID NO: 471659 - RNA, 13 nt, Chlamydia trachomatis
auuugugugccaa

SEQ ID NO: 471660 - RNA, 21 nt, Chlamydia trachomatis
auuucuccagcaucuuuucuu

SEQ ID NO: 471661 - RNA, 13 nt, Chlamydia trachomatis
auuucuuguugua

SEQ ID NO: 471662 - RNA, 15 nt, Chlamydia trachomatis
auuucuuucucaugc

SEQ ID NO: 471663 - RNA, 16 nt, Chlamydia trachomatis
auuugaauagggggag

SEQ ID NO: 471664 - RNA, 21 nt, Chlamydia trachomatis
auuugacuaggauuacagcaa

SEQ ID NO: 471665 - RNA, 22 nt, Chlamydia trachomatis
auuugacucucauaagaauaca

SEQ ID NO: 471666 - RNA, 21 nt, Chlamydia trachomatis
auuugcagaagcuccaaagaa

SEQ ID NO: 471667 - RNA, 15 nt, Chlamydia trachomatis
auuugccaaugaaau

SEQ ID NO: 471668 - RNA, 16 nt, Chlamydia trachomatis
auuugcgugauaaaaa

SEQ ID NO: 471669 - RNA, 18 nt, Chlamydia trachomatis
auuugcuacaguaucugc

SEQ ID NO: 471670 - RNA, 19 nt, Chlamydia trachomatis
auuugcuacaguaucugcu

SEQ ID NO: 471671 - RNA, 12 nt, Chlamydia trachomatis
caaaacauccca

SEQ ID NO: 471672 - RNA, 15 nt, Chlamydia trachomatis
caaaacaucccagca

SEQ ID NO: 471673 - RNA, 18 nt, Chlamydia trachomatis
caaaacaucccagcaaua

SEQ ID NO: 471674 - RNA, 14 nt, Chlamydia trachomatis
caaaacaaacaaua

SEQ ID NO: 471675 - RNA, 20 nt, Chlamydia trachomatis
caaaaaucgcugagcucuuu

SEQ ID NO: 471676 - RNA, 13 nt, Chlamydia trachomatis
caaaaaucucuuu

SEQ ID NO: 471677 - RNA, 17 nt, Chlamydia trachomatis
caaaaaucugcaacaaa

SEQ ID NO: 471678 - RNA, 18 nt, Chlamydia trachomatis
caaaaacaaucaaagcac

SEQ ID NO: 471679 - RNA, 13 nt, Chlamydia trachomatis
caaaaacagcaga

SEQ ID NO: 471680 - RNA, 18 nt, Chlamydia trachomatis
caaaaacagcuucuauag

SEQ ID NO: 471681 - RNA, 16 nt, Chlamydia trachomatis
caaaaagcgugucaau

SEQ ID NO: 471682 - RNA, 16 nt, Chlamydia trachomatis
caaaaauacuucuuuu

SEQ ID NO: 471683 - RNA, 13 nt, Chlamydia trachomatis
caaaaauagcaau

SEQ ID NO: 471684 - RNA, 15 nt, Chlamydia trachomatis
caaaaauagcaucug

SEQ ID NO: 471685 - RNA, 17 nt, Chlamydia trachomatis
caaaaauagcaucugga

SEQ ID NO: 471686 - RNA, 15 nt, Chlamydia trachomatis
auuuuuuaagaaguc

SEQ ID NO: 471687 - RNA, 13 nt, Chlamydia trachomatis
auuuuuugagcaa

SEQ ID NO: 471688 - RNA, 20 nt, Chlamydia trachomatis
caaaaaagaaucuaaaaagc

SEQ ID NO: 471689 - RNA, 13 nt, Chlamydia trachomatis
caaaaaagaggga

SEQ ID NO: 471690 - RNA, 15 nt, Chlamydia trachomatis
caaaaaagagggagu

SEQ ID NO: 471691 - RNA, 14 nt, Chlamydia trachomatis
caaaaaagauuucc

SEQ ID NO: 471692 - RNA, 22 nt, Chlamydia trachomatis
auuuucugguuucuuaaacaaa

SEQ ID NO: 471693 - RNA, 24 nt, Chlamydia trachomatis
auuuucuucacuuccucucucuca

SEQ ID NO: 471694 - RNA, 18 nt, Chlamydia trachomatis
auuuucagcaaaagaaga

SEQ ID NO: 471695 - RNA, 13 nt, Chlamydia trachomatis
auuuuccacaaau

SEQ ID NO: 471696 - RNA, 19 nt, Chlamydia trachomatis
auuuuaugacccagaauca

SEQ ID NO: 471697 - RNA, 18 nt, Chlamydia trachomatis
auuuuauucaaaucuucu

SEQ ID NO: 471698 - RNA, 19 nt, Chlamydia trachomatis
auuuuauucaaaucuucuu

SEQ ID NO: 471699 - RNA, 18 nt, Chlamydia trachomatis
auuuucuuuaggcauuaa

SEQ ID NO: 471700 - RNA, 15 nt, Chlamydia trachomatis
auuuugaagauaaaa

SEQ ID NO: 471701 - RNA, 23 nt, Chlamydia trachomatis
auuuugaauaauagaaaaacuau

SEQ ID NO: 471702 - RNA, 13 nt, Chlamydia trachomatis
auuuugaauacga

SEQ ID NO: 471703 - RNA, 15 nt, Chlamydia trachomatis
auuuugaggcucucu

SEQ ID NO: 471704 - RNA, 20 nt, Chlamydia trachomatis
auuuuuaccaaaccuuucaa

SEQ ID NO: 471705 - RNA, 13 nt, Chlamydia trachomatis
caaagcuucuaac

SEQ ID NO: 471706 - RNA, 18 nt, Chlamydia trachomatis
caaagcuucuaacgcuuc

SEQ ID NO: 471707 - RNA, 20 nt, Chlamydia trachomatis
caaagcuauuugcaagaacu

SEQ ID NO: 471708 - RNA, 19 nt, Chlamydia trachomatis
caaagcucuagcaauagag

SEQ ID NO: 471709 - RNA, 20 nt, Chlamydia trachomatis
caaagcucuagcaauagaga

SEQ ID NO: 471710 - RNA, 22 nt, Chlamydia trachomatis
caaagcugcuuuagcugcuuua

SEQ ID NO: 471711 - RNA, 14 nt, Chlamydia trachomatis
caaagcacgauaaa

SEQ ID NO: 471712 - RNA, 15 nt, Chlamydia trachomatis
caaagcacgauaaaa

SEQ ID NO: 471713 - RNA, 19 nt, Chlamydia trachomatis
caaagcacgauaaaagaca

SEQ ID NO: 471714 - RNA, 18 nt, Chlamydia trachomatis
caaagcacuguccacauu

SEQ ID NO: 471715 - RNA, 18 nt, Chlamydia trachomatis
caaagcagucuagagguu

SEQ ID NO: 471716 - RNA, 20 nt, Chlamydia trachomatis
caaacucuuuuucagacaaa

SEQ ID NO: 471717 - RNA, 12 nt, Chlamydia trachomatis
caaagagagcaa

SEQ ID NO: 471718 - RNA, 9 nt, Chlamydia trachomatis
caaagagau

SEQ ID NO: 471719 - RNA, 15 nt, Chlamydia trachomatis
caaagaguagggagc

SEQ ID NO: 471720 - RNA, 15 nt, Chlamydia trachomatis
caaagguguuuucua

SEQ ID NO: 471721 - RNA, 17 nt, Chlamydia trachomatis
caaaguaaucucuuaau

SEQ ID NO: 471722 - RNA, 19 nt, Chlamydia trachomatis
caaaguggcguuguuucua

SEQ ID NO: 471723 - RNA, 19 nt, Chlamydia trachomatis
caaaguuuuguguuuccaa

SEQ ID NO: 471724 - RNA, 18 nt, Chlamydia trachomatis
caaaguuuuuguuuuuuu

SEQ ID NO: 471725 - RNA, 12 nt, Chlamydia trachomatis
caaauaaaacga

SEQ ID NO: 471726 - RNA, 20 nt, Chlamydia trachomatis
caaauaaagcggcuaaagaa

SEQ ID NO: 471727 - RNA, 13 nt, Chlamydia trachomatis
caaauaacagaaa

SEQ ID NO: 471728 - RNA, 21 nt, Chlamydia trachomatis
caaauaacuuuuucucuugcu

SEQ ID NO: 471729 - RNA, 13 nt, Chlamydia trachomatis
caaauaagaaagu

SEQ ID NO: 471730 - RNA, 16 nt, Chlamydia trachomatis
caaauaagaaaguuuu

SEQ ID NO: 471731 - RNA, 19 nt, Chlamydia trachomatis
caaauaagaaaguuuuuuu

SEQ ID NO: 471732 - RNA, 22 nt, Chlamydia trachomatis
caaauaagaaaguuuuuuucag

SEQ ID NO: 471733 - RNA, 17 nt, Chlamydia trachomatis
caaauaauaaaccaaag

SEQ ID NO: 471734 - RNA, 18 nt, Chlamydia trachomatis
caaauaauaaaccaaagg

SEQ ID NO: 471735 - RNA, 22 nt, Chlamydia trachomatis
caaauaauuguuggcgaauuuc

SEQ ID NO: 471736 - RNA, 12 nt, Chlamydia trachomatis
caaauaccaaaa

SEQ ID NO: 471737 - RNA, 14 nt, Chlamydia trachomatis
caaauaccaaaaua

SEQ ID NO: 471738 - RNA, 17 nt, Chlamydia trachomatis
caaauaccaaaauauca

SEQ ID NO: 471739 - RNA, 12 nt, Chlamydia trachomatis
caaacacugcaa

SEQ ID NO: 471740 - RNA, 21 nt, Chlamydia trachomatis
caaacagaaccuuuuuaaaau

SEQ ID NO: 471741 - RNA, 14 nt, Chlamydia trachomatis
caaacauagaagga

SEQ ID NO: 471742 - RNA, 17 nt, Chlamydia trachomatis
caaacccauccauggca

SEQ ID NO: 471743 - RNA, 13 nt, Chlamydia trachomatis
caaaccgaagagg

SEQ ID NO: 471744 - RNA, 21 nt, Chlamydia trachomatis
caacacugacuauuccugaag

SEQ ID NO: 471745 - RNA, 14 nt, Chlamydia trachomatis
caacagaugacuca

SEQ ID NO: 471746 - RNA, 15 nt, Chlamydia trachomatis
caacaaggauuuuuu

SEQ ID NO: 471747 - RNA, 22 nt, Chlamydia trachomatis
caacaaguuccuggauccaaaa

SEQ ID NO: 471748 - RNA, 18 nt, Chlamydia trachomatis
caacaaguugauacaaga

SEQ ID NO: 471749 - RNA, 17 nt, Chlamydia trachomatis
caacaauccacccacaa

SEQ ID NO: 471750 - RNA, 20 nt, Chlamydia trachomatis
caacaauuuucguuguugua

SEQ ID NO: 471751 - RNA, 14 nt, Chlamydia trachomatis
caaauagcaaagcg

SEQ ID NO: 471752 - RNA, 17 nt, Chlamydia trachomatis
caaauaggcgaauuucu

SEQ ID NO: 471753 - RNA, 20 nt, Chlamydia trachomatis
caaauaggcgaauuucucua

SEQ ID NO: 471754 - RNA, 20 nt, Chlamydia trachomatis
caaaugcguuaaacuuucuu

SEQ ID NO: 471755 - RNA, 22 nt, Chlamydia trachomatis
caaaugcguuaaacuuucuugc

SEQ ID NO: 471756 - RNA, 22 nt, Chlamydia trachomatis
caaauuacgcgucuaaaacaau

SEQ ID NO: 471757 - RNA, 14 nt, Chlamydia trachomatis
caaauuugcagaag

SEQ ID NO: 471758 - RNA, 16 nt, Chlamydia trachomatis
caaauuuucaugaaaa

SEQ ID NO: 471759 - RNA, 18 nt, Chlamydia trachomatis
caacaaccaacucuccuu

SEQ ID NO: 471760 - RNA, 18 nt, Chlamydia trachomatis
caacaggagaucccaaaa

SEQ ID NO: 471761 - RNA, 18 nt, Chlamydia trachomatis
caacauaauaaauauuau

SEQ ID NO: 471762 - RNA, 18 nt, Chlamydia trachomatis
caaccacuguauccaaaa

SEQ ID NO: 471763 - RNA, 13 nt, Chlamydia trachomatis
caaccacuguuca

SEQ ID NO: 471764 - RNA, 13 nt, Chlamydia trachomatis
caaccuucuccaa

SEQ ID NO: 471765 - RNA, 21 nt, Chlamydia trachomatis
caaccuucugacugagagagc

SEQ ID NO: 471766 - RNA, 21 nt, Chlamydia trachomatis
caaccuuuccuguauaagaaa

SEQ ID NO: 471767 - RNA, 22 nt, Chlamydia trachomatis
caaccuuuccuguauaagaaaa

SEQ ID NO: 471768 - RNA, 23 nt, Chlamydia trachomatis
caaccuuuccuguauaagaaaaa

SEQ ID NO: 471769 - RNA, 19 nt, Chlamydia trachomatis
caacgaaaccaaaauaucu

SEQ ID NO: 471770 - RNA, 15 nt, Chlamydia trachomatis
caacgagaaguccug

SEQ ID NO: 471771 - RNA, 20 nt, Chlamydia trachomatis
caacgagugccgaauaauga

SEQ ID NO: 471772 - RNA, 17 nt, Chlamydia trachomatis
caacgauaaacagaucu

SEQ ID NO: 471773 - RNA, 19 nt, Chlamydia trachomatis
caacgauauaaagaagacu

SEQ ID NO: 471774 - RNA, 21 nt, Chlamydia trachomatis
caacgauauaaagaagacuuc

SEQ ID NO: 471775 - RNA, 19 nt, Chlamydia trachomatis
caacguuuucacuagggua

SEQ ID NO: 471776 - RNA, 14 nt, Chlamydia trachomatis
caacuaaaggaaac

SEQ ID NO: 471777 - RNA, 16 nt, Chlamydia trachomatis
caacuucuaagagccc

SEQ ID NO: 471778 - RNA, 15 nt, Chlamydia trachomatis
caacugauucguuug

SEQ ID NO: 471779 - RNA, 23 nt, Chlamydia trachomatis
caacuugaucuacagcaaaaccu

SEQ ID NO: 471780 - RNA, 15 nt, Chlamydia trachomatis
caacuucucuuguuc

SEQ ID NO: 471781 - RNA, 17 nt, Chlamydia trachomatis
caacuugcguuuucuug

SEQ ID NO: 471782 - RNA, 19 nt, Chlamydia trachomatis
caacuuggugcagaagaau

SEQ ID NO: 471783 - RNA, 15 nt, Chlamydia trachomatis
caacuuucuuuugug

SEQ ID NO: 471784 - RNA, 13 nt, Chlamydia trachomatis
caacuuuucagca

SEQ ID NO: 471785 - RNA, 21 nt, Chlamydia trachomatis
caagaaaauagguaaagaagu

SEQ ID NO: 471786 - RNA, 22 nt, Chlamydia trachomatis
caagaaaauagguaaagaaguu

SEQ ID NO: 471787 - RNA, 23 nt, Chlamydia trachomatis
caagaacagauugagaauaaaua

SEQ ID NO: 471788 - RNA, 13 nt, Chlamydia trachomatis
caagaagaacucu

SEQ ID NO: 471789 - RNA, 20 nt, Chlamydia trachomatis
caagaaaggccuauccaagg

SEQ ID NO: 471790 - RNA, 22 nt, Chlamydia trachomatis
caagaaacuguaauguccucuu

SEQ ID NO: 471791 - RNA, 14 nt, Chlamydia trachomatis
caagaaacuuuucu

SEQ ID NO: 471792 - RNA, 21 nt, Chlamydia trachomatis
caagaagagucucuaacaaca

SEQ ID NO: 471793 - RNA, 22 nt, Chlamydia trachomatis
caagacgauucucaugcacugu

SEQ ID NO: 471794 - RNA, 19 nt, Chlamydia trachomatis
caagacucacagcaaauaa

SEQ ID NO: 471795 - RNA, 12 nt, Chlamydia trachomatis
caagauuuugaa

SEQ ID NO: 471796 - RNA, 16 nt, Chlamydia trachomatis
caagcaacgaaaccaa

SEQ ID NO: 471797 - RNA, 15 nt, Chlamydia trachomatis
caagaggcuuaaaga

SEQ ID NO: 471798 - RNA, 21 nt, Chlamydia trachomatis
caagagugugguaugcugaag

SEQ ID NO: 471799 - RNA, 12 nt, Chlamydia trachomatis
caagccauuucc

SEQ ID NO: 471800 - RNA, 13 nt, Chlamydia trachomatis
caaggaaaagaug

SEQ ID NO: 471801 - RNA, 15 nt, Chlamydia trachomatis
caaggaaaagaugaa

SEQ ID NO: 471802 - RNA, 21 nt, Chlamydia trachomatis
caaggaaaccaagggaauaaa

SEQ ID NO: 471803 - RNA, 14 nt, Chlamydia trachomatis
caaggcuaagaaag

SEQ ID NO: 471804 - RNA, 21 nt, Chlamydia trachomatis
caagggaugaagcuaaaaaau

SEQ ID NO: 471805 - RNA, 22 nt, Chlamydia trachomatis
caagggaugaagcuaaaaaauc

SEQ ID NO: 471806 - RNA, 18 nt, Chlamydia trachomatis
caagggggguuaagaaaa

SEQ ID NO: 471807 - RNA, 12 nt, Chlamydia trachomatis
caagguucuuca

SEQ ID NO: 471808 - RNA, 14 nt, Chlamydia trachomatis
caaggugaccucug

SEQ ID NO: 471809 - RNA, 15 nt, Chlamydia trachomatis
caauccgaagauuau

SEQ ID NO: 471810 - RNA, 15 nt, Chlamydia trachomatis
caauccgaauaaguc

SEQ ID NO: 471811 - RNA, 19 nt, Chlamydia trachomatis
caaucauuugugugccaau

SEQ ID NO: 471812 - RNA, 19 nt, Chlamydia trachomatis
caaucauuauccauaaaaa

SEQ ID NO: 471813 - RNA, 21 nt, Chlamydia trachomatis
caauauucccuguauucugag

SEQ ID NO: 471814 - RNA, 20 nt, Chlamydia trachomatis
caaucauaucaagaauuucu

SEQ ID NO: 471815 - RNA, 22 nt, Chlamydia trachomatis
caaugagcgcuuuuucuucucu

SEQ ID NO: 471816 - RNA, 16 nt, Chlamydia trachomatis
caaugaaacggaauga

SEQ ID NO: 471817 - RNA, 22 nt, Chlamydia trachomatis
caaugccgcccaaggaaaagau

SEQ ID NO: 471818 - RNA, 15 nt, Chlamydia trachomatis
caaugcgaucagaaa

SEQ ID NO: 471819 - RNA, 18 nt, Chlamydia trachomatis
caauagccauuaacaaca

SEQ ID NO: 471820 - RNA, 19 nt, Chlamydia trachomatis
caauagccauuaacaacaa

SEQ ID NO: 471821 - RNA, 18 nt, Chlamydia trachomatis
caauagcaggaacuucuu

SEQ ID NO: 471822 - RNA, 20 nt, Chlamydia trachomatis
caauagcaggaacuucuuca

SEQ ID NO: 471823 - RNA, 19 nt, Chlamydia trachomatis
caauagcuaagguaacaau

SEQ ID NO: 471824 - RNA, 18 nt, Chlamydia trachomatis
caauagguuuaaauaagu

SEQ ID NO: 471825 - RNA, 19 nt, Chlamydia trachomatis
caauagugacuagguguug

SEQ ID NO: 471826 - RNA, 14 nt, Chlamydia trachomatis
caauauaacuagaa

SEQ ID NO: 471827 - RNA, 23 nt, Chlamydia trachomatis
caauauguuauacgcaaguauug

SEQ ID NO: 471828 - RNA, 17 nt, Chlamydia trachomatis
caauauuacgaauuucu

SEQ ID NO: 471829 - RNA, 22 nt, Chlamydia trachomatis
caaguaaccauuccuucguccc

SEQ ID NO: 471830 - RNA, 20 nt, Chlamydia trachomatis
caaguaauuuggcucuuuaa

SEQ ID NO: 471831 - RNA, 18 nt, Chlamydia trachomatis
caaguucuucuuccacag

SEQ ID NO: 471832 - RNA, 22 nt, Chlamydia trachomatis
caaguucuucuuuagaaacuaa

SEQ ID NO: 471833 - RNA, 20 nt, Chlamydia trachomatis
caauaacagcacaaacaaau

SEQ ID NO: 471834 - RNA, 21 nt, Chlamydia trachomatis
caauuuacuaucaggaauaau

SEQ ID NO: 471835 - RNA, 23 nt, Chlamydia trachomatis
caauuuacuaucaggaauaauga

SEQ ID NO: 471836 - RNA, 20 nt, Chlamydia trachomatis
caauuguugagcagcaaaga

SEQ ID NO: 471837 - RNA, 21 nt, Chlamydia trachomatis
caauuguugagcagcaaagau

SEQ ID NO: 471838 - RNA, 13 nt, Chlamydia trachomatis
caauuguuggaca

SEQ ID NO: 471839 - RNA, 15 nt, Chlamydia trachomatis
cacaaacaaaaaaga

SEQ ID NO: 471840 - RNA, 12 nt, Chlamydia trachomatis
cacaaagagaag

SEQ ID NO: 471841 - RNA, 17 nt, Chlamydia trachomatis
cacaaagagaaggccuu

SEQ ID NO: 471842 - RNA, 18 nt, Chlamydia trachomatis
caauguucuauauacauu

SEQ ID NO: 471843 - RNA, 19 nt, Chlamydia trachomatis
caauuaaagccacugugaa

SEQ ID NO: 471844 - RNA, 14 nt, Chlamydia trachomatis
caauucaucagcac

SEQ ID NO: 471845 - RNA, 12 nt, Chlamydia trachomatis
cacaauuuuugu

SEQ ID NO: 471846 - RNA, 16 nt, Chlamydia trachomatis
cacaauuuuuguuccu

SEQ ID NO: 471847 - RNA, 19 nt, Chlamydia trachomatis
cacaauuuuuguuccuuuc

SEQ ID NO: 471848 - RNA, 20 nt, Chlamydia trachomatis
cacaauuuuucuuugagaaa

SEQ ID NO: 471849 - RNA, 15 nt, Chlamydia trachomatis
cacaaauauacucuu

SEQ ID NO: 471850 - RNA, 23 nt, Chlamydia trachomatis
cacaaaucuuucuuucuaagaaa

SEQ ID NO: 471851 - RNA, 13 nt, Chlamydia trachomatis
cacagaauuuaca

SEQ ID NO: 471852 - RNA, 15 nt, Chlamydia trachomatis
cacaugcucaucaaa

SEQ ID NO: 471853 - RNA, 15 nt, Chlamydia trachomatis
cacaugguucaaaca

SEQ ID NO: 471854 - RNA, 15 nt, Chlamydia trachomatis
cacaugucauccuua

SEQ ID NO: 471855 - RNA, 22 nt, Chlamydia trachomatis
cacaucuguauccuaacuaaaa

SEQ ID NO: 471856 - RNA, 20 nt, Chlamydia trachomatis
cacaguuuacgaguaucugu

SEQ ID NO: 471857 - RNA, 17 nt, Chlamydia trachomatis
caccaaucaccgcugcu

SEQ ID NO: 471858 - RNA, 21 nt, Chlamydia trachomatis
caccauauccauaacuuuaau

SEQ ID NO: 471859 - RNA, 14 nt, Chlamydia trachomatis
aaaauaaaaaaaaa

SEQ ID NO: 471860 - RNA, 21 nt, Chlamydia trachomatis
aaaaguuugccaguaaucaaa

SEQ ID NO: 471861 - RNA, 12 nt, Chlamydia trachomatis
aaaaguucauag

SEQ ID NO: 471862 - RNA, 16 nt, Chlamydia trachomatis
cacccaaauauacuca

SEQ ID NO: 471863 - RNA, 15 nt, Chlamydia trachomatis
caccccuaaaagagc

SEQ ID NO: 471864 - RNA, 21 nt, Chlamydia trachomatis
cacccuuucuuacuccuucuc

SEQ ID NO: 471865 - RNA, 16 nt, Chlamydia trachomatis
aaaauaaguccauuga

SEQ ID NO: 471866 - RNA, 17 nt, Chlamydia trachomatis
caccugagcuauaccgc

SEQ ID NO: 471867 - RNA, 18 nt, Chlamydia trachomatis
caccucuccuugaacaau

SEQ ID NO: 471868 - RNA, 12 nt, Chlamydia trachomatis
caccucuuuuug

SEQ ID NO: 471869 - RNA, 20 nt, Chlamydia trachomatis
caccgugcucgaaacucauc

SEQ ID NO: 471870 - RNA, 20 nt, Chlamydia trachomatis
caccguagaauuucuucuuu

SEQ ID NO: 471871 - RNA, 17 nt, Chlamydia trachomatis
caccuuuacaaucaucu

SEQ ID NO: 471872 - RNA, 13 nt, Chlamydia trachomatis
caccuuucguuuc

SEQ ID NO: 471873 - RNA, 22 nt, Chlamydia trachomatis
caccuugcuuaacacuucuuua

SEQ ID NO: 471874 - RNA, 13 nt, Chlamydia trachomatis
caccuucauuuca

SEQ ID NO: 471875 - RNA, 18 nt, Chlamydia trachomatis
caccuucauuucaagaga

SEQ ID NO: 471876 - RNA, 19 nt, Chlamydia trachomatis
caccuuuuuugcuaaaaga

SEQ ID NO: 471877 - RNA, 20 nt, Chlamydia trachomatis
caccuuuuuugcuaaaagaa

SEQ ID NO: 471878 - RNA, 21 nt, Chlamydia trachomatis
caccuuuuuugcuaaaagaaa

SEQ ID NO: 471879 - RNA, 15 nt, Chlamydia trachomatis
cacgcacuuuuuguu

SEQ ID NO: 471880 - RNA, 21 nt, Chlamydia trachomatis
cacgauauauccauucaggau

SEQ ID NO: 471881 - RNA, 14 nt, Chlamydia trachomatis
cacgccauaucaaa

SEQ ID NO: 471882 - RNA, 20 nt, Chlamydia trachomatis
cacggaacauaccguagauc

SEQ ID NO: 471883 - RNA, 16 nt, Chlamydia trachomatis
aaaauauacucagaga

SEQ ID NO: 471884 - RNA, 13 nt, Chlamydia trachomatis
aaaauauagacug

SEQ ID NO: 471885 - RNA, 16 nt, Chlamydia trachomatis
cacggcuucugucccu

SEQ ID NO: 471886 - RNA, 22 nt, Chlamydia trachomatis
cacgguaaucuucacggagaga

SEQ ID NO: 471887 - RNA, 13 nt, Chlamydia trachomatis
cacggugcagagg

SEQ ID NO: 471888 - RNA, 15 nt, Chlamydia trachomatis
cacuuuauuagaguu

SEQ ID NO: 471889 - RNA, 12 nt, Chlamydia trachomatis
cacgucggcuuu

SEQ ID NO: 471890 - RNA, 14 nt, Chlamydia trachomatis
cacuuuugugaaaa

SEQ ID NO: 471891 - RNA, 18 nt, Chlamydia trachomatis
cagaaacaaauaacuuuu

SEQ ID NO: 471892 - RNA, 23 nt, Chlamydia trachomatis
cagaaacaauuucaucacagaua

SEQ ID NO: 471893 - RNA, 13 nt, Chlamydia trachomatis
cagaaaaaauaau

SEQ ID NO: 471894 - RNA, 15 nt, Chlamydia trachomatis
cagaacaacuucucu

SEQ ID NO: 471895 - RNA, 16 nt, Chlamydia trachomatis
cagaacaagugcagcg

SEQ ID NO: 471896 - RNA, 22 nt, Chlamydia trachomatis
cagaacaagugcagcguucuga

SEQ ID NO: 471897 - RNA, 20 nt, Chlamydia trachomatis
cagaagacuuuggaagaggc

SEQ ID NO: 471898 - RNA, 16 nt, Chlamydia trachomatis
cagaagaggcaaaaau

SEQ ID NO: 471899 - RNA, 21 nt, Chlamydia trachomatis
cagaagaucccaacaggagau

SEQ ID NO: 471900 - RNA, 18 nt, Chlamydia trachomatis
cagaagcaagaaucaaag

SEQ ID NO: 471901 - RNA, 15 nt, Chlamydia trachomatis
cagaauuacccugaa

SEQ ID NO: 471902 - RNA, 14 nt, Chlamydia trachomatis
cagacagagaagaa

SEQ ID NO: 471903 - RNA, 15 nt, Chlamydia trachomatis
cagacagauguacag

SEQ ID NO: 471904 - RNA, 19 nt, Chlamydia trachomatis
cagaauugagcacaagcug

SEQ ID NO: 471905 - RNA, 21 nt, Chlamydia trachomatis
cagacaagccuucaggauucc

SEQ ID NO: 471906 - RNA, 14 nt, Chlamydia trachomatis
cagacaauggucuc

SEQ ID NO: 471907 - RNA, 21 nt, Chlamydia trachomatis
cagacuaaguuguaaaacaac

SEQ ID NO: 471908 - RNA, 22 nt, Chlamydia trachomatis
cagacucagguuauccaaauaa

SEQ ID NO: 471909 - RNA, 13 nt, Chlamydia trachomatis
aaaauauuuugcu

SEQ ID NO: 471910 - RNA, 23 nt, Chlamydia trachomatis
cagagaagaacacacuuucccca

SEQ ID NO: 471911 - RNA, 18 nt, Chlamydia trachomatis
cagagcuuugcagauccc

SEQ ID NO: 471912 - RNA, 15 nt, Chlamydia trachomatis
cagagcccuucuuuu

SEQ ID NO: 471913 - RNA, 18 nt, Chlamydia trachomatis
cagagccaaaacaaacaa

SEQ ID NO: 471914 - RNA, 17 nt, Chlamydia trachomatis
cagaggagggagaugau

SEQ ID NO: 471915 - RNA, 13 nt, Chlamydia trachomatis
cagagaggcugua

SEQ ID NO: 471916 - RNA, 20 nt, Chlamydia trachomatis
cagagaggcuguaacuaaac

SEQ ID NO: 471917 - RNA, 15 nt, Chlamydia trachomatis
cagagcaauagacac

SEQ ID NO: 471918 - RNA, 13 nt, Chlamydia trachomatis
aaaauccaaagua

SEQ ID NO: 471919 - RNA, 15 nt, Chlamydia trachomatis
aaaauccaaaguacu

SEQ ID NO: 471920 - RNA, 19 nt, Chlamydia trachomatis
cagagagccagcgaggcuu

SEQ ID NO: 471921 - RNA, 14 nt, Chlamydia trachomatis
aaaaucagcuugau

SEQ ID NO: 471922 - RNA, 17 nt, Chlamydia trachomatis
cagauaaucaguugugg

SEQ ID NO: 471923 - RNA, 17 nt, Chlamydia trachomatis
cagaugacucaaacugu

SEQ ID NO: 471924 - RNA, 16 nt, Chlamydia trachomatis
cagaucuugaucugaa

SEQ ID NO: 471925 - RNA, 13 nt, Chlamydia trachomatis
cagaucuuuuuca

SEQ ID NO: 471926 - RNA, 21 nt, Chlamydia trachomatis
cagaucuuuuucauuuuaugu

SEQ ID NO: 471927 - RNA, 21 nt, Chlamydia trachomatis
cagaugcuucugccuuuugau

SEQ ID NO: 471928 - RNA, 22 nt, Chlamydia trachomatis
cagauuugaguuuaucauugaa

SEQ ID NO: 471929 - RNA, 12 nt, Chlamydia trachomatis
aaaaucuugucg

SEQ ID NO: 471930 - RNA, 18 nt, Chlamydia trachomatis
aaaauggaaauaaaaagc

SEQ ID NO: 471931 - RNA, 22 nt, Chlamydia trachomatis
aaaaugcuugcguauagagcau

SEQ ID NO: 471932 - RNA, 23 nt, Chlamydia trachomatis
cagcacuucuucuuuggaaaaaa

SEQ ID NO: 471933 - RNA, 14 nt, Chlamydia trachomatis
cagcagaaggugug

SEQ ID NO: 471934 - RNA, 23 nt, Chlamydia trachomatis
cagcaggcgaacagugacagcau

SEQ ID NO: 471935 - RNA, 15 nt, Chlamydia trachomatis
cagcagcuuccugag

SEQ ID NO: 471936 - RNA, 19 nt, Chlamydia trachomatis
cagcagucgcgcagcuucu

SEQ ID NO: 471937 - RNA, 18 nt, Chlamydia trachomatis
cagcaucucgguauucuc

SEQ ID NO: 471938 - RNA, 19 nt, Chlamydia trachomatis
cagcauccugaacccgcug

SEQ ID NO: 471939 - RNA, 18 nt, Chlamydia trachomatis
cagcaucccaagaauggu

SEQ ID NO: 471940 - RNA, 17 nt, Chlamydia trachomatis
cagcauccaauagaguu

SEQ ID NO: 471941 - RNA, 13 nt, Chlamydia trachomatis
cagcauucauaaa

SEQ ID NO: 471942 - RNA, 17 nt, Chlamydia trachomatis
cagcauucauaaacaca

SEQ ID NO: 471943 - RNA, 17 nt, Chlamydia trachomatis
cagccacaguacggcag

SEQ ID NO: 471944 - RNA, 12 nt, Chlamydia trachomatis
cagccgaaacag

SEQ ID NO: 471945 - RNA, 15 nt, Chlamydia trachomatis
cagccucaucauuaa

SEQ ID NO: 471946 - RNA, 21 nt, Chlamydia trachomatis
cagccucaucauuaauuagaa

SEQ ID NO: 471947 - RNA, 14 nt, Chlamydia trachomatis
cagccucuccagaa

SEQ ID NO: 471948 - RNA, 15 nt, Chlamydia trachomatis
cagccucuccagaaa

SEQ ID NO: 471949 - RNA, 18 nt, Chlamydia trachomatis
cagccucucuuugcucca

SEQ ID NO: 471950 - RNA, 19 nt, Chlamydia trachomatis
cagccucucuuugcuccac

SEQ ID NO: 471951 - RNA, 14 nt, Chlamydia trachomatis
cagccugcuuucuu

SEQ ID NO: 471952 - RNA, 17 nt, Chlamydia trachomatis
cagccugcuuucuucug

SEQ ID NO: 471953 - RNA, 20 nt, Chlamydia trachomatis
cagcgaaauacgguauacac

SEQ ID NO: 471954 - RNA, 19 nt, Chlamydia trachomatis
cagcuccuaucacucccug

SEQ ID NO: 471955 - RNA, 20 nt, Chlamydia trachomatis
cagcuccuaucacucccugc

SEQ ID NO: 471956 - RNA, 15 nt, Chlamydia trachomatis
cagcucuccucguga

SEQ ID NO: 471957 - RNA, 11 nt, Chlamydia trachomatis
cagcucuaaag

SEQ ID NO: 471958 - RNA, 19 nt, Chlamydia trachomatis
cagcucuaaagagccaaaa

SEQ ID NO: 471959 - RNA, 16 nt, Chlamydia trachomatis
cagcucuaauuaauaa

SEQ ID NO: 471960 - RNA, 20 nt, Chlamydia trachomatis
cagcuagaacauacccuaaa

SEQ ID NO: 471961 - RNA, 12 nt, Chlamydia trachomatis
aaaauugcaaag

SEQ ID NO: 471962 - RNA, 14 nt, Chlamydia trachomatis
aaaauugcaaagag

SEQ ID NO: 471963 - RNA, 14 nt, Chlamydia trachomatis
cagcuaacagcucu

SEQ ID NO: 471964 - RNA, 14 nt, Chlamydia trachomatis
cagcuaaccaugcu

SEQ ID NO: 471965 - RNA, 22 nt, Chlamydia trachomatis
cagcuaaagaaucuccuguaca

SEQ ID NO: 471966 - RNA, 16 nt, Chlamydia trachomatis
cagcuaauuccauaau

SEQ ID NO: 471967 - RNA, 23 nt, Chlamydia trachomatis
cagcuaauuccauaaucguggaa

SEQ ID NO: 471968 - RNA, 13 nt, Chlamydia trachomatis
cagcuuucuuuuc

SEQ ID NO: 471969 - RNA, 23 nt, Chlamydia trachomatis
cagcuuuucuaacguuccuccuc

SEQ ID NO: 471970 - RNA, 22 nt, Chlamydia trachomatis
cagcuucuugaaugccuaacga

SEQ ID NO: 471971 - RNA, 16 nt, Chlamydia trachomatis
cagcucuuacuccuaa

SEQ ID NO: 471972 - RNA, 12 nt, Chlamydia trachomatis
aaaauuucucuu

SEQ ID NO: 471973 - RNA, 17 nt, Chlamydia trachomatis
caggaaucacaguaaua

SEQ ID NO: 471974 - RNA, 22 nt, Chlamydia trachomatis
aaaauuuuacguaauucaugau

SEQ ID NO: 471975 - RNA, 24 nt, Chlamydia trachomatis
caggagcgcuuuuuuuuuagaaca

SEQ ID NO: 471976 - RNA, 19 nt, Chlamydia trachomatis
caggagagucugcuacaaa

SEQ ID NO: 471977 - RNA, 23 nt, Chlamydia trachomatis
caggagaguguuugcauucuuuu

SEQ ID NO: 471978 - RNA, 21 nt, Chlamydia trachomatis
caggagauguaggauucagag

SEQ ID NO: 471979 - RNA, 15 nt, Chlamydia trachomatis
caggccuuccaccuu

SEQ ID NO: 471980 - RNA, 12 nt, Chlamydia trachomatis
cagggagagaga

SEQ ID NO: 471981 - RNA, 14 nt, Chlamydia trachomatis
cagggagaagggga

SEQ ID NO: 471982 - RNA, 20 nt, Chlamydia trachomatis
cagggcugacuaaauacaaa

SEQ ID NO: 471983 - RNA, 23 nt, Chlamydia trachomatis
caggucuaggggaagaaucaaua

SEQ ID NO: 471984 - RNA, 15 nt, Chlamydia trachomatis
caggucauucgucaa

SEQ ID NO: 471985 - RNA, 20 nt, Chlamydia trachomatis
caggucauauccacuuggag

SEQ ID NO: 471986 - RNA, 14 nt, Chlamydia trachomatis
caggucacauuuuc

SEQ ID NO: 471987 - RNA, 16 nt, Chlamydia trachomatis
caggugaauucuccag

SEQ ID NO: 471988 - RNA, 17 nt, Chlamydia trachomatis
cagguugagcaagcuca

SEQ ID NO: 471989 - RNA, 20 nt, Chlamydia trachomatis
cagguuuacggucacuccuc

SEQ ID NO: 471990 - RNA, 22 nt, Chlamydia trachomatis
cagguuuacggucacuccucca

SEQ ID NO: 471991 - RNA, 21 nt, Chlamydia trachomatis
aaacaaauaacuuuuucucuu

SEQ ID NO: 471992 - RNA, 19 nt, Chlamydia trachomatis
aaacaaauccuagaagagc

SEQ ID NO: 471993 - RNA, 13 nt, Chlamydia trachomatis
aaacaacaaagaa

SEQ ID NO: 471994 - RNA, 19 nt, Chlamydia trachomatis
aaacaacacugacuauucc

SEQ ID NO: 471995 - RNA, 13 nt, Chlamydia trachomatis
aaacaaccauaau

SEQ ID NO: 471996 - RNA, 15 nt, Chlamydia trachomatis
caguaaaaucuaaaa

SEQ ID NO: 471997 - RNA, 19 nt, Chlamydia trachomatis
caguaaauuucaucccaca

SEQ ID NO: 471998 - RNA, 17 nt, Chlamydia trachomatis
caguaacaagcacagaa

SEQ ID NO: 471999 - RNA, 20 nt, Chlamydia trachomatis
caguauauccucucuucuua

SEQ ID NO: 472000 - RNA, 12 nt, Chlamydia trachomatis
caguaguuuacu

SEQ ID NO: 472001 - RNA, 17 nt, Chlamydia trachomatis
caguacugcuacaaaag

SEQ ID NO: 472002 - RNA, 19 nt, Chlamydia trachomatis
caguacuuacgagaucgcc

SEQ ID NO: 472003 - RNA, 20 nt, Chlamydia trachomatis
caguagaaacuuacuuuucu

SEQ ID NO: 472004 - RNA, 22 nt, Chlamydia trachomatis
caguaccgucacucuugauagu

SEQ ID NO: 472005 - RNA, 15 nt, Chlamydia trachomatis
caguaccauuacuac

SEQ ID NO: 472006 - RNA, 22 nt, Chlamydia trachomatis
cagucaauccacgaauuuucuc

SEQ ID NO: 472007 - RNA, 12 nt, Chlamydia trachomatis
cagucuguguuu

SEQ ID NO: 472008 - RNA, 15 nt, Chlamydia trachomatis
cagucuuccucugcu

SEQ ID NO: 472009 - RNA, 17 nt, Chlamydia trachomatis
cagucuucuuuucugag

SEQ ID NO: 472010 - RNA, 19 nt, Chlamydia trachomatis
cagugacauuauuuuuucg

SEQ ID NO: 472011 - RNA, 19 nt, Chlamydia trachomatis
cagugacuugauuggauaa

SEQ ID NO: 472012 - RNA, 22 nt, Chlamydia trachomatis
caguccucccaaaauaccuuug

SEQ ID NO: 472013 - RNA, 19 nt, Chlamydia trachomatis
cagucucuuauaaucugga

SEQ ID NO: 472014 - RNA, 19 nt, Chlamydia trachomatis
cagucgcgcagcuucuggu

SEQ ID NO: 472015 - RNA, 13 nt, Chlamydia trachomatis
cauacuucccaca

SEQ ID NO: 472016 - RNA, 18 nt, Chlamydia trachomatis
cauacuucccacauacuu

SEQ ID NO: 472017 - RNA, 13 nt, Chlamydia trachomatis
cauacuucugaau

SEQ ID NO: 472018 - RNA, 21 nt, Chlamydia trachomatis
cauacuuuucaauuacagcau

SEQ ID NO: 472019 - RNA, 20 nt, Chlamydia trachomatis
cauagaaaauggcugcuugg

SEQ ID NO: 472020 - RNA, 18 nt, Chlamydia trachomatis
cauagaucccuuucauuc

SEQ ID NO: 472021 - RNA, 20 nt, Chlamydia trachomatis
cauagggaucccacaaagaa

SEQ ID NO: 472022 - RNA, 23 nt, Chlamydia trachomatis
cauaggcgugaagagagacacua

SEQ ID NO: 472023 - RNA, 21 nt, Chlamydia trachomatis
cauaggcuccugcaagggaac

SEQ ID NO: 472024 - RNA, 18 nt, Chlamydia trachomatis
cauagcggacauuucacu

SEQ ID NO: 472025 - RNA, 23 nt, Chlamydia trachomatis
cauagcaugggcugcaucagcaa

SEQ ID NO: 472026 - RNA, 13 nt, Chlamydia trachomatis
cauagccaucauc

SEQ ID NO: 472027 - RNA, 15 nt, Chlamydia trachomatis
cauagcucgcauuug

SEQ ID NO: 472028 - RNA, 17 nt, Chlamydia trachomatis
cauagcugaacccuuca

SEQ ID NO: 472029 - RNA, 13 nt, Chlamydia trachomatis
cauagcuucuugc

SEQ ID NO: 472030 - RNA, 14 nt, Chlamydia trachomatis
cauagcuucuugcg

SEQ ID NO: 472031 - RNA, 13 nt, Chlamydia trachomatis
caucaacagaaga

SEQ ID NO: 472032 - RNA, 17 nt, Chlamydia trachomatis
caucaaagaucuuucua

SEQ ID NO: 472033 - RNA, 15 nt, Chlamydia trachomatis
cauauucuugcuaag

SEQ ID NO: 472034 - RNA, 18 nt, Chlamydia trachomatis
cauauauucagaagaaga

SEQ ID NO: 472035 - RNA, 14 nt, Chlamydia trachomatis
cauauauuggagug

SEQ ID NO: 472036 - RNA, 15 nt, Chlamydia trachomatis
cauaucaagaauuuc

SEQ ID NO: 472037 - RNA, 17 nt, Chlamydia trachomatis
cauaucgacuagcugua

SEQ ID NO: 472038 - RNA, 11 nt, Chlamydia trachomatis
caucagcaaga

SEQ ID NO: 472039 - RNA, 15 nt, Chlamydia trachomatis
caucacgaagaguuu

SEQ ID NO: 472040 - RNA, 22 nt, Chlamydia trachomatis
caucacuauaagucaaaagaau

SEQ ID NO: 472041 - RNA, 16 nt, Chlamydia trachomatis
caucacuccaagaaga

SEQ ID NO: 472042 - RNA, 22 nt, Chlamydia trachomatis
caucacuccaagaagagucucu

SEQ ID NO: 472043 - RNA, 23 nt, Chlamydia trachomatis
caucaauaaugggccguuuuucu

SEQ ID NO: 472044 - RNA, 18 nt, Chlamydia trachomatis
cauccaaaacaucccagc

SEQ ID NO: 472045 - RNA, 17 nt, Chlamydia trachomatis
cauccacuugggcgcca

SEQ ID NO: 472046 - RNA, 23 nt, Chlamydia trachomatis
cauccauaaaaacugcugcuauc

SEQ ID NO: 472047 - RNA, 19 nt, Chlamydia trachomatis
cauccauauauucagaaga

SEQ ID NO: 472048 - RNA, 15 nt, Chlamydia trachomatis
caucccacucuucuu

SEQ ID NO: 472049 - RNA, 19 nt, Chlamydia trachomatis
cauccuuuaucuugagaga

SEQ ID NO: 472050 - RNA, 13 nt, Chlamydia trachomatis
cauccuuggcuuu

SEQ ID NO: 472051 - RNA, 13 nt, Chlamydia trachomatis
cauccuucugcua

SEQ ID NO: 472052 - RNA, 14 nt, Chlamydia trachomatis
cauccuucugcuau

SEQ ID NO: 472053 - RNA, 22 nt, Chlamydia trachomatis
cauccuuuuggaagaucucuuu

SEQ ID NO: 472054 - RNA, 16 nt, Chlamydia trachomatis
caucgaaaacaaagag

SEQ ID NO: 472055 - RNA, 21 nt, Chlamydia trachomatis
caucgagaaaaugaugaaaaa

SEQ ID NO: 472056 - RNA, 17 nt, Chlamydia trachomatis
caucgcuguauuuccuu

SEQ ID NO: 472057 - RNA, 20 nt, Chlamydia trachomatis
caucgggaguccuuccaggu

SEQ ID NO: 472058 - RNA, 17 nt, Chlamydia trachomatis
caucuucucgaaagaga

SEQ ID NO: 472059 - RNA, 19 nt, Chlamydia trachomatis
caucuuuaaagaggaucag

SEQ ID NO: 472060 - RNA, 15 nt, Chlamydia trachomatis
caugaaaagcuuuca

SEQ ID NO: 472061 - RNA, 19 nt, Chlamydia trachomatis
caucuuuuuuaaaaagcug

SEQ ID NO: 472062 - RNA, 10 nt, Chlamydia trachomatis
caucuuuucg

SEQ ID NO: 472063 - RNA, 22 nt, Chlamydia trachomatis
caucuuuugccuauagagcaau

SEQ ID NO: 472064 - RNA, 23 nt, Chlamydia trachomatis
caugaccucagauuuaucugcua

SEQ ID NO: 472065 - RNA, 21 nt, Chlamydia trachomatis
caugaccaagguuguuaugua

SEQ ID NO: 472066 - RNA, 22 nt, Chlamydia trachomatis
caugaaucagcuuuuccacauu

SEQ ID NO: 472067 - RNA, 13 nt, Chlamydia trachomatis
caugaaugacugc

SEQ ID NO: 472068 - RNA, 13 nt, Chlamydia trachomatis
caugaauggaaag

SEQ ID NO: 472069 - RNA, 21 nt, Chlamydia trachomatis
caugaauuguuucuccauagc

SEQ ID NO: 472070 - RNA, 23 nt, Chlamydia trachomatis
caugagaccgucaaaaagaucuu

SEQ ID NO: 472071 - RNA, 20 nt, Chlamydia trachomatis
caugagccucuaacucuucu

SEQ ID NO: 472072 - RNA, 14 nt, Chlamydia trachomatis
caugaguugcucaa

SEQ ID NO: 472073 - RNA, 19 nt, Chlamydia trachomatis
caugauaaugaguuccgaa

SEQ ID NO: 472074 - RNA, 16 nt, Chlamydia trachomatis
caugauucaaaauaau

SEQ ID NO: 472075 - RNA, 21 nt, Chlamydia trachomatis
caugaucucugcagaagaagc

SEQ ID NO: 472076 - RNA, 19 nt, Chlamydia trachomatis
caugauuuccugauaggca

SEQ ID NO: 472077 - RNA, 15 nt, Chlamydia trachomatis
caugcaauccuucuu

SEQ ID NO: 472078 - RNA, 20 nt, Chlamydia trachomatis
caugcaaaggauaaauauuu

SEQ ID NO: 472079 - RNA, 13 nt, Chlamydia trachomatis
caugauuucuuua

SEQ ID NO: 472080 - RNA, 14 nt, Chlamydia trachomatis
caugccagaagcua

SEQ ID NO: 472081 - RNA, 16 nt, Chlamydia trachomatis
caugccaucguugaua

SEQ ID NO: 472082 - RNA, 16 nt, Chlamydia trachomatis
caugccgcacauccgc

SEQ ID NO: 472083 - RNA, 22 nt, Chlamydia trachomatis
caugcggauuaaagaaggaaaa

SEQ ID NO: 472084 - RNA, 23 nt, Chlamydia trachomatis
caugcguuaauuaauaagccuuu

SEQ ID NO: 472085 - RNA, 19 nt, Chlamydia trachomatis
caugggcugcaucagcaag

SEQ ID NO: 472086 - RNA, 17 nt, Chlamydia trachomatis
caugguuaccugugaag

SEQ ID NO: 472087 - RNA, 15 nt, Chlamydia trachomatis
cauguuuuggcuccu

SEQ ID NO: 472088 - RNA, 14 nt, Chlamydia trachomatis
cauguuuuucagau

SEQ ID NO: 472089 - RNA, 22 nt, Chlamydia trachomatis
cauguugcguuuguaagaucug

SEQ ID NO: 472090 - RNA, 15 nt, Chlamydia trachomatis
cauguauagucaucu

SEQ ID NO: 472091 - RNA, 22 nt, Chlamydia trachomatis
cauguauagucaucugcagccu

SEQ ID NO: 472092 - RNA, 16 nt, Chlamydia trachomatis
cauguauucuccuuuu

SEQ ID NO: 472093 - RNA, 18 nt, Chlamydia trachomatis
cauuaaagacuacaaaac

SEQ ID NO: 472094 - RNA, 14 nt, Chlamydia trachomatis
cauuaucuucuucu

SEQ ID NO: 472095 - RNA, 17 nt, Chlamydia trachomatis
cauuauccauaaaaaua

SEQ ID NO: 472096 - RNA, 16 nt, Chlamydia trachomatis
cauuauuaacaggaag

SEQ ID NO: 472097 - RNA, 14 nt, Chlamydia trachomatis
cauuccaggacgaa

SEQ ID NO: 472098 - RNA, 20 nt, Chlamydia trachomatis
cauuccaggacgaacgaaga

SEQ ID NO: 472099 - RNA, 15 nt, Chlamydia trachomatis
cauuauuauuuaaaa

SEQ ID NO: 472100 - RNA, 19 nt, Chlamydia trachomatis
cauuauuauuuaaaacaau

SEQ ID NO: 472101 - RNA, 13 nt, Chlamydia trachomatis
cauugagaagucc

SEQ ID NO: 472102 - RNA, 15 nt, Chlamydia trachomatis
cauugagcaaaaaaa

SEQ ID NO: 472103 - RNA, 14 nt, Chlamydia trachomatis
cauucuuacuaaag

SEQ ID NO: 472104 - RNA, 21 nt, Chlamydia trachomatis
cauucuuagauuuucaugcaa

SEQ ID NO: 472105 - RNA, 18 nt, Chlamydia trachomatis
cauucuuagugaaugcuc

SEQ ID NO: 472106 - RNA, 22 nt, Chlamydia trachomatis
cauucuuagugaaugcuccaua

SEQ ID NO: 472107 - RNA, 18 nt, Chlamydia trachomatis
cauucccgccaauuuuuu

SEQ ID NO: 472108 - RNA, 20 nt, Chlamydia trachomatis
cauucugcguuuaauuccuu

SEQ ID NO: 472109 - RNA, 14 nt, Chlamydia trachomatis
cauuuucuguaauu

SEQ ID NO: 472110 - RNA, 21 nt, Chlamydia trachomatis
cauuuucguaagcauagcuuc

SEQ ID NO: 472111 - RNA, 23 nt, Chlamydia trachomatis
cauugaguucugcuugcgaauaa

SEQ ID NO: 472112 - RNA, 20 nt, Chlamydia trachomatis
ccaaacacugcaacaguaaa

SEQ ID NO: 472113 - RNA, 22 nt, Chlamydia trachomatis
ccaaacauaagaggcaccucuu

SEQ ID NO: 472114 - RNA, 18 nt, Chlamydia trachomatis
ccaaacaucaugguugcu

SEQ ID NO: 472115 - RNA, 19 nt, Chlamydia trachomatis
ccaaacauuuugaggcuuu

SEQ ID NO: 472116 - RNA, 21 nt, Chlamydia trachomatis
ccaaacccauccauggcaaug

SEQ ID NO: 472117 - RNA, 12 nt, Chlamydia trachomatis
ccaaaaucuuca

SEQ ID NO: 472118 - RNA, 14 nt, Chlamydia trachomatis
ccaaaaacaaucaa

SEQ ID NO: 472119 - RNA, 20 nt, Chlamydia trachomatis
ccaaaaaggaaaucacugaa

SEQ ID NO: 472120 - RNA, 21 nt, Chlamydia trachomatis
ccaaaaaguccgcuaauccau

SEQ ID NO: 472121 - RNA, 15 nt, Chlamydia trachomatis
ccaaaaaugaacaua

SEQ ID NO: 472122 - RNA, 13 nt, Chlamydia trachomatis
ccaaaacaaacaa

SEQ ID NO: 472123 - RNA, 19 nt, Chlamydia trachomatis
ccaaaacaucccagcaaua

SEQ ID NO: 472124 - RNA, 20 nt, Chlamydia trachomatis
ccaacuauugaaauaccacu

SEQ ID NO: 472125 - RNA, 15 nt, Chlamydia trachomatis
ccaagaacaaagcau

SEQ ID NO: 472126 - RNA, 16 nt, Chlamydia trachomatis
ccaagaacaaagcauc

SEQ ID NO: 472127 - RNA, 12 nt, Chlamydia trachomatis
ccaagaaacugu

SEQ ID NO: 472128 - RNA, 15 nt, Chlamydia trachomatis
ccaagccauuuccag

SEQ ID NO: 472129 - RNA, 22 nt, Chlamydia trachomatis
ccaagacgauucucaugcacug

SEQ ID NO: 472130 - RNA, 19 nt, Chlamydia trachomatis
ccaagggaugaagcuaaaa

SEQ ID NO: 472131 - RNA, 13 nt, Chlamydia trachomatis
ccaacagaccccu

SEQ ID NO: 472132 - RNA, 17 nt, Chlamydia trachomatis
ccaaauagguaugugcu

SEQ ID NO: 472133 - RNA, 20 nt, Chlamydia trachomatis
ccaaaugcggcccacacuac

SEQ ID NO: 472134 - RNA, 14 nt, Chlamydia trachomatis
ccacaagauuuuga

SEQ ID NO: 472135 - RNA, 13 nt, Chlamydia trachomatis
ccaauucucugcc

SEQ ID NO: 472136 - RNA, 15 nt, Chlamydia trachomatis
ccacaaaaucagcaa

SEQ ID NO: 472137 - RNA, 16 nt, Chlamydia trachomatis
ccacaaacaauuccac

SEQ ID NO: 472138 - RNA, 19 nt, Chlamydia trachomatis
ccaaugaaauaucauuccc

SEQ ID NO: 472139 - RNA, 14 nt, Chlamydia trachomatis
ccaaguaauucaac

SEQ ID NO: 472140 - RNA, 14 nt, Chlamydia trachomatis
ccacacuuccccau

SEQ ID NO: 472141 - RNA, 22 nt, Chlamydia trachomatis
ccacagaacaugggcgucucuu

SEQ ID NO: 472142 - RNA, 16 nt, Chlamydia trachomatis
ccacaugguucaaaca

SEQ ID NO: 472143 - RNA, 22 nt, Chlamydia trachomatis
ccacauccugagcccaaggaga

SEQ ID NO: 472144 - RNA, 13 nt, Chlamydia trachomatis
ccaccgcaugaaa

SEQ ID NO: 472145 - RNA, 15 nt, Chlamydia trachomatis
ccaccuaauucccca

SEQ ID NO: 472146 - RNA, 16 nt, Chlamydia trachomatis
ccacugguucucuuua

SEQ ID NO: 472147 - RNA, 18 nt, Chlamydia trachomatis
ccacugguucucuuuauc

SEQ ID NO: 472148 - RNA, 23 nt, Chlamydia trachomatis
ccacuugcuccacacaacauaac

SEQ ID NO: 472149 - RNA, 10 nt, Chlamydia trachomatis
ccagaaggga

SEQ ID NO: 472150 - RNA, 21 nt, Chlamydia trachomatis
ccagaaucaucugguauucua

SEQ ID NO: 472151 - RNA, 19 nt, Chlamydia trachomatis
ccagaauccuuuucagaau

SEQ ID NO: 472152 - RNA, 12 nt, Chlamydia trachomatis
ccagacaaaaag

SEQ ID NO: 472153 - RNA, 23 nt, Chlamydia trachomatis
ccagacaaaaagaaagccuucuc

SEQ ID NO: 472154 - RNA, 23 nt, Chlamydia trachomatis
ccacuuuuaggauagugacguga

SEQ ID NO: 472155 - RNA, 14 nt, Chlamydia trachomatis
ccagaaacaggaga

SEQ ID NO: 472156 - RNA, 22 nt, Chlamydia trachomatis
ccagaaacaggagaaagaaccu

SEQ ID NO: 472157 - RNA, 16 nt, Chlamydia trachomatis
ccagaacaacuucucu

SEQ ID NO: 472158 - RNA, 19 nt, Chlamydia trachomatis
ccagagucuccgcuuaaaa

SEQ ID NO: 472159 - RNA, 13 nt, Chlamydia trachomatis
ccagacccuucca

SEQ ID NO: 472160 - RNA, 17 nt, Chlamydia trachomatis
ccagacgcccuccuccu

SEQ ID NO: 472161 - RNA, 15 nt, Chlamydia trachomatis
ccagauacugcucca

SEQ ID NO: 472162 - RNA, 21 nt, Chlamydia trachomatis
ccagaucuguuaccugggaaa

SEQ ID NO: 472163 - RNA, 22 nt, Chlamydia trachomatis
ccagauuuuucaaaaauagcaa

SEQ ID NO: 472164 - RNA, 16 nt, Chlamydia trachomatis
ccagcaagaagacgcu

SEQ ID NO: 472165 - RNA, 20 nt, Chlamydia trachomatis
ccagcagacccaaaugcggc

SEQ ID NO: 472166 - RNA, 20 nt, Chlamydia trachomatis
ccagcaucucgguauucuca

SEQ ID NO: 472167 - RNA, 13 nt, Chlamydia trachomatis
ccagcauucauaa

SEQ ID NO: 472168 - RNA, 13 nt, Chlamydia trachomatis
ccagcaucuuuuc

SEQ ID NO: 472169 - RNA, 22 nt, Chlamydia trachomatis
ccaggggugacagcuuucacag

SEQ ID NO: 472170 - RNA, 17 nt, Chlamydia trachomatis
ccagguucguuauucuc

SEQ ID NO: 472171 - RNA, 19 nt, Chlamydia trachomatis
ccaguaauuuaucuagaaa

SEQ ID NO: 472172 - RNA, 17 nt, Chlamydia trachomatis
ccagucuacagccuccu

SEQ ID NO: 472173 - RNA, 23 nt, Chlamydia trachomatis
ccagugaugaaauugagaacaua

SEQ ID NO: 472174 - RNA, 23 nt, Chlamydia trachomatis
ccauaaaaacugcugcuaucauc

SEQ ID NO: 472175 - RNA, 16 nt, Chlamydia trachomatis
ccauaaaauccaaugu

SEQ ID NO: 472176 - RNA, 12 nt, Chlamydia trachomatis
ccauacaucauc

SEQ ID NO: 472177 - RNA, 17 nt, Chlamydia trachomatis
ccauaguaccucgagca

SEQ ID NO: 472178 - RNA, 19 nt, Chlamydia trachomatis
ccauagguagaaaaggaua

SEQ ID NO: 472179 - RNA, 14 nt, Chlamydia trachomatis
aaacaaucaaagca

SEQ ID NO: 472180 - RNA, 15 nt, Chlamydia trachomatis
aaacaaucaaagcac

SEQ ID NO: 472181 - RNA, 15 nt, Chlamydia trachomatis
ccaucauagaagcaa

SEQ ID NO: 472182 - RNA, 21 nt, Chlamydia trachomatis
ccauccaaaacaucccagcaa

SEQ ID NO: 472183 - RNA, 21 nt, Chlamydia trachomatis
ccaugaaugacugcgcuauga

SEQ ID NO: 472184 - RNA, 17 nt, Chlamydia trachomatis
ccaugaacagcauuuac

SEQ ID NO: 472185 - RNA, 21 nt, Chlamydia trachomatis
ccaugaacagcauuuacuccu

SEQ ID NO: 472186 - RNA, 17 nt, Chlamydia trachomatis
ccaucuuuaaagaggau

SEQ ID NO: 472187 - RNA, 19 nt, Chlamydia trachomatis
ccaugagcaaccuuuccug

SEQ ID NO: 472188 - RNA, 21 nt, Chlamydia trachomatis
ccaugcaucuccucuggagcc

SEQ ID NO: 472189 - RNA, 19 nt, Chlamydia trachomatis
ccauggaauagcuucugac

SEQ ID NO: 472190 - RNA, 23 nt, Chlamydia trachomatis
ccaugggaucuagaaguuuuccc

SEQ ID NO: 472191 - RNA, 13 nt, Chlamydia trachomatis
ccauguuuuuagu

SEQ ID NO: 472192 - RNA, 12 nt, Chlamydia trachomatis
ccauuccuccua

SEQ ID NO: 472193 - RNA, 22 nt, Chlamydia trachomatis
ccauuuucauggcugcaauucu

SEQ ID NO: 472194 - RNA, 18 nt, Chlamydia trachomatis
cccaagcguauuugcauu

SEQ ID NO: 472195 - RNA, 17 nt, Chlamydia trachomatis
cccaagaagcgaagcau

SEQ ID NO: 472196 - RNA, 23 nt, Chlamydia trachomatis
cccaagacgauucucaugcacug

SEQ ID NO: 472197 - RNA, 16 nt, Chlamydia trachomatis
cccagauuacauugag

SEQ ID NO: 472198 - RNA, 20 nt, Chlamydia trachomatis
cccagauuacauugagauga

SEQ ID NO: 472199 - RNA, 16 nt, Chlamydia trachomatis
cccaggauaacaaaca

SEQ ID NO: 472200 - RNA, 14 nt, Chlamydia trachomatis
cccaucaacucucu

SEQ ID NO: 472201 - RNA, 15 nt, Chlamydia trachomatis
aaacaccauccaauc

SEQ ID NO: 472202 - RNA, 13 nt, Chlamydia trachomatis
aaacacaaaagca

SEQ ID NO: 472203 - RNA, 24 nt, Chlamydia trachomatis
aaacacaccgggagcauggucucu

SEQ ID NO: 472204 - RNA, 13 nt, Chlamydia trachomatis
aaacacacugggu

SEQ ID NO: 472205 - RNA, 18 nt, Chlamydia trachomatis
aaacaauuuccuuagaaa

SEQ ID NO: 472206 - RNA, 22 nt, Chlamydia trachomatis
cccagguugucauugaucacau

SEQ ID NO: 472207 - RNA, 21 nt, Chlamydia trachomatis
cccaugaacagcauuuacucc

SEQ ID NO: 472208 - RNA, 19 nt, Chlamydia trachomatis
ccccaucccuugcaaaaau

SEQ ID NO: 472209 - RNA, 14 nt, Chlamydia trachomatis
ccccaucucuuuug

SEQ ID NO: 472210 - RNA, 11 nt, Chlamydia trachomatis
ccccuucugga

SEQ ID NO: 472211 - RNA, 16 nt, Chlamydia trachomatis
ccccuuuuuuuauucu

SEQ ID NO: 472212 - RNA, 15 nt, Chlamydia trachomatis
ccccuccuucuucac

SEQ ID NO: 472213 - RNA, 10 nt, Chlamydia trachomatis
ccccuccgcu

SEQ ID NO: 472214 - RNA, 10 nt, Chlamydia trachomatis
ccccucugca

SEQ ID NO: 472215 - RNA, 13 nt, Chlamydia trachomatis
ccccucuuuuuca

SEQ ID NO: 472216 - RNA, 19 nt, Chlamydia trachomatis
cccguuaaugggucaagaa

SEQ ID NO: 472217 - RNA, 17 nt, Chlamydia trachomatis
cccuaaucgaauuacuc

SEQ ID NO: 472218 - RNA, 20 nt, Chlamydia trachomatis
cccuaaucgaauuacucugc

SEQ ID NO: 472219 - RNA, 21 nt, Chlamydia trachomatis
cccuaaucgaauuacucugcc

SEQ ID NO: 472220 - RNA, 17 nt, Chlamydia trachomatis
cccuagcagcucuuacu

SEQ ID NO: 472221 - RNA, 15 nt, Chlamydia trachomatis
cccuaguacaaaaau

SEQ ID NO: 472222 - RNA, 19 nt, Chlamydia trachomatis
cccuacggaauagccucca

SEQ ID NO: 472223 - RNA, 22 nt, Chlamydia trachomatis
cccuacgcuacgagcaacacga

SEQ ID NO: 472224 - RNA, 13 nt, Chlamydia trachomatis
cccuaccuucagc

SEQ ID NO: 472225 - RNA, 16 nt, Chlamydia trachomatis
cccuccgcugauuaga

SEQ ID NO: 472226 - RNA, 17 nt, Chlamydia trachomatis
cccucgacgcuguccaa

SEQ ID NO: 472227 - RNA, 23 nt, Chlamydia trachomatis
cccugagaaauugcucaggaauc

SEQ ID NO: 472228 - RNA, 16 nt, Chlamydia trachomatis
cccugaacuaacacgu

SEQ ID NO: 472229 - RNA, 22 nt, Chlamydia trachomatis
cccucuuuuucaccagcaaaag

SEQ ID NO: 472230 - RNA, 13 nt, Chlamydia trachomatis
cccugaaagacuu

SEQ ID NO: 472231 - RNA, 13 nt, Chlamydia trachomatis
cccucuucucuca

SEQ ID NO: 472232 - RNA, 16 nt, Chlamydia trachomatis
cccucuuccuucccuu

SEQ ID NO: 472233 - RNA, 13 nt, Chlamydia trachomatis
cccucucucagau

SEQ ID NO: 472234 - RNA, 18 nt, Chlamydia trachomatis
cccuuuuuuuauucuuuc

SEQ ID NO: 472235 - RNA, 22 nt, Chlamydia trachomatis
aaacagcuucuucuucucuuuc

SEQ ID NO: 472236 - RNA, 20 nt, Chlamydia trachomatis
cccuuaacacccucuuccuu

SEQ ID NO: 472237 - RNA, 22 nt, Chlamydia trachomatis
cccuuacccaaacaucuacacg

SEQ ID NO: 472238 - RNA, 18 nt, Chlamydia trachomatis
cccuuagggaaaccccaa

SEQ ID NO: 472239 - RNA, 13 nt, Chlamydia trachomatis
aaacauaagagca

SEQ ID NO: 472240 - RNA, 21 nt, Chlamydia trachomatis
aaacauaagaggcaccucuuu

SEQ ID NO: 472241 - RNA, 12 nt, Chlamydia trachomatis
aaacauccagua

SEQ ID NO: 472242 - RNA, 14 nt, Chlamydia trachomatis
aaacaucccagcaa

SEQ ID NO: 472243 - RNA, 20 nt, Chlamydia trachomatis
aaacaucccagcaauaccga

SEQ ID NO: 472244 - RNA, 19 nt, Chlamydia trachomatis
ccgaagcaugauauuuuga

SEQ ID NO: 472245 - RNA, 17 nt, Chlamydia trachomatis
ccgaagauuauaccagc

SEQ ID NO: 472246 - RNA, 18 nt, Chlamydia trachomatis
aaacaucgccauucccaa

SEQ ID NO: 472247 - RNA, 13 nt, Chlamydia trachomatis
ccgaauaaaauca

SEQ ID NO: 472248 - RNA, 14 nt, Chlamydia trachomatis
ccgaaucccaucuc

SEQ ID NO: 472249 - RNA, 14 nt, Chlamydia trachomatis
aaacauuccaaaua

SEQ ID NO: 472250 - RNA, 20 nt, Chlamydia trachomatis
aaacauuccugccaaaaacc

SEQ ID NO: 472251 - RNA, 17 nt, Chlamydia trachomatis
ccgauguauuuguacca

SEQ ID NO: 472252 - RNA, 17 nt, Chlamydia trachomatis
ccgauucaaaagcuauc

SEQ ID NO: 472253 - RNA, 19 nt, Chlamydia trachomatis
ccgcacauccgcuucuuca

SEQ ID NO: 472254 - RNA, 16 nt, Chlamydia trachomatis
ccgcauaccaaagcau

SEQ ID NO: 472255 - RNA, 23 nt, Chlamydia trachomatis
ccgccaauuuuuuuauccaaaaa

SEQ ID NO: 472256 - RNA, 18 nt, Chlamydia trachomatis
aaaccaucuguaaagcuu

SEQ ID NO: 472257 - RNA, 12 nt, Chlamydia trachomatis
aaaccaguucug

SEQ ID NO: 472258 - RNA, 20 nt, Chlamydia trachomatis
aaaccaguucugguuuuugu

SEQ ID NO: 472259 - RNA, 17 nt, Chlamydia trachomatis
ccgccauuuaugaagcc

SEQ ID NO: 472260 - RNA, 21 nt, Chlamydia trachomatis
ccgccccguguugaauuacuu

SEQ ID NO: 472261 - RNA, 11 nt, Chlamydia trachomatis
ccggauucugu

SEQ ID NO: 472262 - RNA, 18 nt, Chlamydia trachomatis
ccggacauuccaaaccca

SEQ ID NO: 472263 - RNA, 20 nt, Chlamydia trachomatis
ccgcuuaagcuguucuucca

SEQ ID NO: 472264 - RNA, 16 nt, Chlamydia trachomatis
aaaccuguuucugaau

SEQ ID NO: 472265 - RNA, 13 nt, Chlamydia trachomatis
ccgguaauagaag

SEQ ID NO: 472266 - RNA, 18 nt, Chlamydia trachomatis
aaacgauaaaaagcuggg

SEQ ID NO: 472267 - RNA, 13 nt, Chlamydia trachomatis
ccguucaaagcaa

SEQ ID NO: 472268 - RNA, 18 nt, Chlamydia trachomatis
ccguuccaucuuccaaag

SEQ ID NO: 472269 - RNA, 21 nt, Chlamydia trachomatis
ccguucgggucauaaacauau

SEQ ID NO: 472270 - RNA, 11 nt, Chlamydia trachomatis
ccguugauagu

SEQ ID NO: 472271 - RNA, 17 nt, Chlamydia trachomatis
ccguucucucuaaaauc

SEQ ID NO: 472272 - RNA, 15 nt, Chlamydia trachomatis
ccguuuguucucugg

SEQ ID NO: 472273 - RNA, 10 nt, Chlamydia trachomatis
ccuaaacaaa

SEQ ID NO: 472274 - RNA, 22 nt, Chlamydia trachomatis
ccuaaagaagccauaguagaaa

SEQ ID NO: 472275 - RNA, 18 nt, Chlamydia trachomatis
ccuaaagagacgcaugcu

SEQ ID NO: 472276 - RNA, 15 nt, Chlamydia trachomatis
ccuaaaucuccuccu

SEQ ID NO: 472277 - RNA, 17 nt, Chlamydia trachomatis
ccuaaauucauaacacc

SEQ ID NO: 472278 - RNA, 18 nt, Chlamydia trachomatis
ccuaacgaggcacaaaau

SEQ ID NO: 472279 - RNA, 21 nt, Chlamydia trachomatis
ccuaagccgaguagacucuaa

SEQ ID NO: 472280 - RNA, 15 nt, Chlamydia trachomatis
ccuaagcuauguaaa

SEQ ID NO: 472281 - RNA, 18 nt, Chlamydia trachomatis
ccuaagcuauguaaaaaa

SEQ ID NO: 472282 - RNA, 20 nt, Chlamydia trachomatis
ccuaagggccgaacuaauau

SEQ ID NO: 472283 - RNA, 16 nt, Chlamydia trachomatis
ccuaauagaaauagcu

SEQ ID NO: 472284 - RNA, 16 nt, Chlamydia trachomatis
ccuagcagcucuuacu

SEQ ID NO: 472285 - RNA, 17 nt, Chlamydia trachomatis
ccuagacgauuaauagg

SEQ ID NO: 472286 - RNA, 15 nt, Chlamydia trachomatis
ccuagagccaaucca

SEQ ID NO: 472287 - RNA, 19 nt, Chlamydia trachomatis
ccuacuagcgcauagcgua

SEQ ID NO: 472288 - RNA, 18 nt, Chlamydia trachomatis
ccuaccaucaauccugga

SEQ ID NO: 472289 - RNA, 19 nt, Chlamydia trachomatis
ccuacauacaugcuuuuga

SEQ ID NO: 472290 - RNA, 19 nt, Chlamydia trachomatis
ccuacauuguaaauagacu

SEQ ID NO: 472291 - RNA, 12 nt, Chlamydia trachomatis
ccuacaagaccu

SEQ ID NO: 472292 - RNA, 14 nt, Chlamydia trachomatis
ccuaaucuuucuaa

SEQ ID NO: 472293 - RNA, 21 nt, Chlamydia trachomatis
ccuaauguagaaauuuuaaau

SEQ ID NO: 472294 - RNA, 12 nt, Chlamydia trachomatis
ccuaauucaaca

SEQ ID NO: 472295 - RNA, 15 nt, Chlamydia trachomatis
ccuaauuuaaaaucu

SEQ ID NO: 472296 - RNA, 19 nt, Chlamydia trachomatis
ccuaauuuucuaggagaag

SEQ ID NO: 472297 - RNA, 16 nt, Chlamydia trachomatis
ccuacaaauaaagucu

SEQ ID NO: 472298 - RNA, 20 nt, Chlamydia trachomatis
ccuacaaaauaguucacucc

SEQ ID NO: 472299 - RNA, 14 nt, Chlamydia trachomatis
ccuauagagcaauc

SEQ ID NO: 472300 - RNA, 20 nt, Chlamydia trachomatis
ccuaucaccacuaaucccac

SEQ ID NO: 472301 - RNA, 21 nt, Chlamydia trachomatis
ccuaucaccacuaaucccacc

SEQ ID NO: 472302 - RNA, 23 nt, Chlamydia trachomatis
ccuagcgaagucuucuaucacag

SEQ ID NO: 472303 - RNA, 16 nt, Chlamydia trachomatis
ccucacacacaaaaaa

SEQ ID NO: 472304 - RNA, 20 nt, Chlamydia trachomatis
ccucagcauagcgcuucccg

SEQ ID NO: 472305 - RNA, 19 nt, Chlamydia trachomatis
ccucagauuuaucugcuau

SEQ ID NO: 472306 - RNA, 18 nt, Chlamydia trachomatis
ccuccagauacugcucca

SEQ ID NO: 472307 - RNA, 16 nt, Chlamydia trachomatis
ccuccaucucugcuuc

SEQ ID NO: 472308 - RNA, 22 nt, Chlamydia trachomatis
ccucgauccgguucuuuuguaa

SEQ ID NO: 472309 - RNA, 15 nt, Chlamydia trachomatis
ccugcaccucuuuca

SEQ ID NO: 472310 - RNA, 19 nt, Chlamydia trachomatis
ccugcuucagcagcauaaa

SEQ ID NO: 472311 - RNA, 13 nt, Chlamydia trachomatis
ccuggauccaaaa

SEQ ID NO: 472312 - RNA, 18 nt, Chlamydia trachomatis
ccuggagggaaaacacca

SEQ ID NO: 472313 - RNA, 15 nt, Chlamydia trachomatis
ccuggagaaaauccc

SEQ ID NO: 472314 - RNA, 19 nt, Chlamydia trachomatis
ccugcuugaaguagcauug

SEQ ID NO: 472315 - RNA, 19 nt, Chlamydia trachomatis
ccugcuucuauagaaacac

SEQ ID NO: 472316 - RNA, 14 nt, Chlamydia trachomatis
ccuggcugcagaag

SEQ ID NO: 472317 - RNA, 20 nt, Chlamydia trachomatis
ccugggccaaacaguucuug

SEQ ID NO: 472318 - RNA, 21 nt, Chlamydia trachomatis
ccuuaauagugcguccuucuu

SEQ ID NO: 472319 - RNA, 12 nt, Chlamydia trachomatis
ccuuauggcuca

SEQ ID NO: 472320 - RNA, 21 nt, Chlamydia trachomatis
ccuuauggcucagcuucaacu

SEQ ID NO: 472321 - RNA, 17 nt, Chlamydia trachomatis
ccuuacccaaacaucua

SEQ ID NO: 472322 - RNA, 18 nt, Chlamydia trachomatis
ccuucagagguagccaaa

SEQ ID NO: 472323 - RNA, 22 nt, Chlamydia trachomatis
ccuucgauauggcaaucgcgga

SEQ ID NO: 472324 - RNA, 19 nt, Chlamydia trachomatis
ccuugaacguaggccacaa

SEQ ID NO: 472325 - RNA, 14 nt, Chlamydia trachomatis
ccuugaacuagaaa

SEQ ID NO: 472326 - RNA, 20 nt, Chlamydia trachomatis
ccuucuuucuggaaucauuc

SEQ ID NO: 472327 - RNA, 21 nt, Chlamydia trachomatis
ccuucuuucuggaaucauuca

SEQ ID NO: 472328 - RNA, 17 nt, Chlamydia trachomatis
ccuucuuucuucuaaga

SEQ ID NO: 472329 - RNA, 21 nt, Chlamydia trachomatis
ccuucuuucuucuaagaaguu

SEQ ID NO: 472330 - RNA, 14 nt, Chlamydia trachomatis
ccuucuuuuuccuc

SEQ ID NO: 472331 - RNA, 12 nt, Chlamydia trachomatis
ccuucuugaugc

SEQ ID NO: 472332 - RNA, 18 nt, Chlamydia trachomatis
ccuugagauccuuaaacu

SEQ ID NO: 472333 - RNA, 19 nt, Chlamydia trachomatis
ccuuguuagaaaugcaaau

SEQ ID NO: 472334 - RNA, 22 nt, Chlamydia trachomatis
ccuuguucccacaccaucuuac

SEQ ID NO: 472335 - RNA, 22 nt, Chlamydia trachomatis
ccuuuugaaacaucuuuuaaag

SEQ ID NO: 472336 - RNA, 23 nt, Chlamydia trachomatis
ccuuucacuagacguuuagccuc

SEQ ID NO: 472337 - RNA, 17 nt, Chlamydia trachomatis
ccuuucauaauaguccu

SEQ ID NO: 472338 - RNA, 16 nt, Chlamydia trachomatis
ccuuucgucacagauu

SEQ ID NO: 472339 - RNA, 18 nt, Chlamydia trachomatis
ccuuucgucacagauuug

SEQ ID NO: 472340 - RNA, 13 nt, Chlamydia trachomatis
ccuuucaaauacc

SEQ ID NO: 472341 - RNA, 15 nt, Chlamydia trachomatis
ccuuuaguuaccaaa

SEQ ID NO: 472342 - RNA, 21 nt, Chlamydia trachomatis
ccuuuaguuaccaaaaaggaa

SEQ ID NO: 472343 - RNA, 19 nt, Chlamydia trachomatis
ccuuuaucuugagagaccu

SEQ ID NO: 472344 - RNA, 19 nt, Chlamydia trachomatis
ccuuuaaccucugcaagaa

SEQ ID NO: 472345 - RNA, 18 nt, Chlamydia trachomatis
ccuuuaauuaugcaaaaa

SEQ ID NO: 472346 - RNA, 11 nt, Chlamydia trachomatis
ccuuuuuaaaa

SEQ ID NO: 472347 - RNA, 15 nt, Chlamydia trachomatis
ccuuuuuaaaauaau

SEQ ID NO: 472348 - RNA, 17 nt, Chlamydia trachomatis
cgaagcugcaauagaaa

SEQ ID NO: 472349 - RNA, 19 nt, Chlamydia trachomatis
cgaaucacaugucauccuu

SEQ ID NO: 472350 - RNA, 15 nt, Chlamydia trachomatis
cgaaucgucucucug

SEQ ID NO: 472351 - RNA, 20 nt, Chlamydia trachomatis
cgaaucgcccuuauugguau

SEQ ID NO: 472352 - RNA, 23 nt, Chlamydia trachomatis
cgaaugcguugcucuaccaacug

SEQ ID NO: 472353 - RNA, 19 nt, Chlamydia trachomatis
cgaauucuuugaucuguaa

SEQ ID NO: 472354 - RNA, 17 nt, Chlamydia trachomatis
cgaauuggaucucccuc

SEQ ID NO: 472355 - RNA, 15 nt, Chlamydia trachomatis
cgaauuuguagaucu

SEQ ID NO: 472356 - RNA, 16 nt, Chlamydia trachomatis
cgaauuuuucugcuag

SEQ ID NO: 472357 - RNA, 23 nt, Chlamydia trachomatis
cgacaacaugaaccgcagcaaca

SEQ ID NO: 472358 - RNA, 19 nt, Chlamydia trachomatis
cgacaacgauauaaagaag

SEQ ID NO: 472359 - RNA, 16 nt, Chlamydia trachomatis
cgacaaacgggagccc

SEQ ID NO: 472360 - RNA, 18 nt, Chlamydia trachomatis
cgacagcguuuuccccuu

SEQ ID NO: 472361 - RNA, 14 nt, Chlamydia trachomatis
cgauaucagcaaaa

SEQ ID NO: 472362 - RNA, 17 nt, Chlamydia trachomatis
cgauauacgcucuuuca

SEQ ID NO: 472363 - RNA, 18 nt, Chlamydia trachomatis
cgauaguacaaguauaua

SEQ ID NO: 472364 - RNA, 15 nt, Chlamydia trachomatis
cgaucacagaaacgg

SEQ ID NO: 472365 - RNA, 15 nt, Chlamydia trachomatis
cgauaccugucccug

SEQ ID NO: 472366 - RNA, 16 nt, Chlamydia trachomatis
cgauaccuauuccaaa

SEQ ID NO: 472367 - RNA, 11 nt, Chlamydia trachomatis
cgauccaagga

SEQ ID NO: 472368 - RNA, 18 nt, Chlamydia trachomatis
cgauccucuugagcauug

SEQ ID NO: 472369 - RNA, 12 nt, Chlamydia trachomatis
cgaucuccucau

SEQ ID NO: 472370 - RNA, 15 nt, Chlamydia trachomatis
cgaugguucuuguga

SEQ ID NO: 472371 - RNA, 18 nt, Chlamydia trachomatis
cgauuaggguagucgcuu

SEQ ID NO: 472372 - RNA, 12 nt, Chlamydia trachomatis
cgauucuccgaa

SEQ ID NO: 472373 - RNA, 16 nt, Chlamydia trachomatis
cgauucaauccagacu

SEQ ID NO: 472374 - RNA, 15 nt, Chlamydia trachomatis
cgcaagcaugucgag

SEQ ID NO: 472375 - RNA, 21 nt, Chlamydia trachomatis
cgcaaguauuggagacaacaa

SEQ ID NO: 472376 - RNA, 18 nt, Chlamydia trachomatis
cgcaauagauagucugca

SEQ ID NO: 472377 - RNA, 16 nt, Chlamydia trachomatis
cgcaauauagagcaua

SEQ ID NO: 472378 - RNA, 22 nt, Chlamydia trachomatis
cgcaauccuuuuaagauaucca

SEQ ID NO: 472379 - RNA, 15 nt, Chlamydia trachomatis
cgcacccaaucuucu

SEQ ID NO: 472380 - RNA, 14 nt, Chlamydia trachomatis
cgcaggggaauaca

SEQ ID NO: 472381 - RNA, 23 nt, Chlamydia trachomatis
cgcagcuuucguugaucacggaa

SEQ ID NO: 472382 - RNA, 17 nt, Chlamydia trachomatis
cgcagcuucuuuaggau

SEQ ID NO: 472383 - RNA, 12 nt, Chlamydia trachomatis
cgcauaccaaag

SEQ ID NO: 472384 - RNA, 23 nt, Chlamydia trachomatis
cgccccucuuuuucaccagcaaa

SEQ ID NO: 472385 - RNA, 16 nt, Chlamydia trachomatis
cgccgggggagccaaa

SEQ ID NO: 472386 - RNA, 14 nt, Chlamydia trachomatis
cgccucuaucucuu

SEQ ID NO: 472387 - RNA, 14 nt, Chlamydia trachomatis
cgcguuuccgcggc

SEQ ID NO: 472388 - RNA, 12 nt, Chlamydia trachomatis
cgcuagcuuucc

SEQ ID NO: 472389 - RNA, 19 nt, Chlamydia trachomatis
cgcuagggucuucucugug

SEQ ID NO: 472390 - RNA, 21 nt, Chlamydia trachomatis
cgcuauaaucccaaaaacaau

SEQ ID NO: 472391 - RNA, 13 nt, Chlamydia trachomatis
cgcuaucaauaaa

SEQ ID NO: 472392 - RNA, 14 nt, Chlamydia trachomatis
cgcucuuucuuacg

SEQ ID NO: 472393 - RNA, 15 nt, Chlamydia trachomatis
cgcugaguuuccuuu

SEQ ID NO: 472394 - RNA, 12 nt, Chlamydia trachomatis
cgcugcgagaga

SEQ ID NO: 472395 - RNA, 14 nt, Chlamydia trachomatis
cgcugcgagagagc

SEQ ID NO: 472396 - RNA, 15 nt, Chlamydia trachomatis
cgcuggcuuuguccu

SEQ ID NO: 472397 - RNA, 21 nt, Chlamydia trachomatis
cgcuguccaaucguauaauaa

SEQ ID NO: 472398 - RNA, 19 nt, Chlamydia trachomatis
cgcuucucgcuaaauugaa

SEQ ID NO: 472399 - RNA, 14 nt, Chlamydia trachomatis
cgcuucaaaacuaa

SEQ ID NO: 472400 - RNA, 21 nt, Chlamydia trachomatis
cgcuuggaauacaucacugca

SEQ ID NO: 472401 - RNA, 16 nt, Chlamydia trachomatis
cggccauccacgcaaa

SEQ ID NO: 472402 - RNA, 22 nt, Chlamydia trachomatis
cggcuacccccuucuccuuuuu

SEQ ID NO: 472403 - RNA, 11 nt, Chlamydia trachomatis
cggcucuucuu

SEQ ID NO: 472404 - RNA, 17 nt, Chlamydia trachomatis
cgggaaacauuccaaau

SEQ ID NO: 472405 - RNA, 15 nt, Chlamydia trachomatis
cgggggagcugaugu

SEQ ID NO: 472406 - RNA, 23 nt, Chlamydia trachomatis
cgggggagcugauguaagcgaga

SEQ ID NO: 472407 - RNA, 22 nt, Chlamydia trachomatis
cggguagucaugaauggaaagu

SEQ ID NO: 472408 - RNA, 18 nt, Chlamydia trachomatis
cgguacaucgguguugaa

SEQ ID NO: 472409 - RNA, 18 nt, Chlamydia trachomatis
cgguagcgauuuucugaa

SEQ ID NO: 472410 - RNA, 12 nt, Chlamydia trachomatis
cgguauuaauaa

SEQ ID NO: 472411 - RNA, 14 nt, Chlamydia trachomatis
cgguauuaauaaug

SEQ ID NO: 472412 - RNA, 22 nt, Chlamydia trachomatis
cgguauauucuucaccuuuucc

SEQ ID NO: 472413 - RNA, 18 nt, Chlamydia trachomatis
aaacuaaaaguugcucuu

SEQ ID NO: 472414 - RNA, 15 nt, Chlamydia trachomatis
aaacuaguuugguuu

SEQ ID NO: 472415 - RNA, 22 nt, Chlamydia trachomatis
cggucgacagcguuuuccccuu

SEQ ID NO: 472416 - RNA, 12 nt, Chlamydia trachomatis
cggucuacaaau

SEQ ID NO: 472417 - RNA, 14 nt, Chlamydia trachomatis
cggucuauggcaaa

SEQ ID NO: 472418 - RNA, 13 nt, Chlamydia trachomatis
cggugaggaaggc

SEQ ID NO: 472419 - RNA, 15 nt, Chlamydia trachomatis
cggugaggaaggcug

SEQ ID NO: 472420 - RNA, 13 nt, Chlamydia trachomatis
cgguugcacaaau

SEQ ID NO: 472421 - RNA, 23 nt, Chlamydia trachomatis
cgguuaacacaauuuuuguuccu

SEQ ID NO: 472422 - RNA, 17 nt, Chlamydia trachomatis
cgguuugauuuccucuu

SEQ ID NO: 472423 - RNA, 16 nt, Chlamydia trachomatis
cguaaaccuucuugaa

SEQ ID NO: 472424 - RNA, 20 nt, Chlamydia trachomatis
cguaaacgauuaacucugca

SEQ ID NO: 472425 - RNA, 14 nt, Chlamydia trachomatis
cguaaaagaguaag

SEQ ID NO: 472426 - RNA, 12 nt, Chlamydia trachomatis
cguaaacaacca

SEQ ID NO: 472427 - RNA, 21 nt, Chlamydia trachomatis
cguaaccagcggcaaaaauau

SEQ ID NO: 472428 - RNA, 14 nt, Chlamydia trachomatis
cguaugcaacaaca

SEQ ID NO: 472429 - RNA, 18 nt, Chlamydia trachomatis
cguauuaucugcaaccca

SEQ ID NO: 472430 - RNA, 13 nt, Chlamydia trachomatis
cgucaaagaagua

SEQ ID NO: 472431 - RNA, 18 nt, Chlamydia trachomatis
cguaauaauuaaggacuu

SEQ ID NO: 472432 - RNA, 17 nt, Chlamydia trachomatis
cgucaguugcuccuccg

SEQ ID NO: 472433 - RNA, 12 nt, Chlamydia trachomatis
cgucugcauaaa

SEQ ID NO: 472434 - RNA, 19 nt, Chlamydia trachomatis
cgucucuugucagaagagg

SEQ ID NO: 472435 - RNA, 14 nt, Chlamydia trachomatis
cgugaaauaaauca

SEQ ID NO: 472436 - RNA, 19 nt, Chlamydia trachomatis
cgugaucacugugagagca

SEQ ID NO: 472437 - RNA, 22 nt, Chlamydia trachomatis
cguggaaucccguaauagagcc

SEQ ID NO: 472438 - RNA, 20 nt, Chlamydia trachomatis
cguuccauuaauuuggcuuc

SEQ ID NO: 472439 - RNA, 22 nt, Chlamydia trachomatis
cguuaaagaauuauuugccucu

SEQ ID NO: 472440 - RNA, 15 nt, Chlamydia trachomatis
cguucuugacaaaac

SEQ ID NO: 472441 - RNA, 22 nt, Chlamydia trachomatis
cguucuugaguagaagaaugaa

SEQ ID NO: 472442 - RNA, 16 nt, Chlamydia trachomatis
cguucuugcugagaau

SEQ ID NO: 472443 - RNA, 12 nt, Chlamydia trachomatis
cguucucucuaa

SEQ ID NO: 472444 - RNA, 21 nt, Chlamydia trachomatis
cguuuaucuaauuuuagauaa

SEQ ID NO: 472445 - RNA, 15 nt, Chlamydia trachomatis
cguuuagcagccuga

SEQ ID NO: 472446 - RNA, 16 nt, Chlamydia trachomatis
cguuuagccuccaucu

SEQ ID NO: 472447 - RNA, 17 nt, Chlamydia trachomatis
cuaaaucgcaaacaggu

SEQ ID NO: 472448 - RNA, 20 nt, Chlamydia trachomatis
cuaaaucuaaaauuuccuua

SEQ ID NO: 472449 - RNA, 17 nt, Chlamydia trachomatis
cuaaaucucuuggagag

SEQ ID NO: 472450 - RNA, 19 nt, Chlamydia trachomatis
cuaaaucucuuggagagaa

SEQ ID NO: 472451 - RNA, 20 nt, Chlamydia trachomatis
cuaaaucucuuggagagaau

SEQ ID NO: 472452 - RNA, 16 nt, Chlamydia trachomatis
cuaaauucagauccca

SEQ ID NO: 472453 - RNA, 15 nt, Chlamydia trachomatis
cuaaagccauaagac

SEQ ID NO: 472454 - RNA, 22 nt, Chlamydia trachomatis
cuaaagccaucucggaucgaga

SEQ ID NO: 472455 - RNA, 16 nt, Chlamydia trachomatis
cuaaaggaaguagaga

SEQ ID NO: 472456 - RNA, 19 nt, Chlamydia trachomatis
cuaaaggugcgauuacuuc

SEQ ID NO: 472457 - RNA, 16 nt, Chlamydia trachomatis
cuaaagucuccauaag

SEQ ID NO: 472458 - RNA, 13 nt, Chlamydia trachomatis
cuaaagucuuucc

SEQ ID NO: 472459 - RNA, 16 nt, Chlamydia trachomatis
cuaaagucuuuuccuc

SEQ ID NO: 472460 - RNA, 14 nt, Chlamydia trachomatis
cuaaaguugguaga

SEQ ID NO: 472461 - RNA, 15 nt, Chlamydia trachomatis
cuaaauaccucuuuu

SEQ ID NO: 472462 - RNA, 23 nt, Chlamydia trachomatis
cuaaauaccucuuuuuuucccua

SEQ ID NO: 472463 - RNA, 16 nt, Chlamydia trachomatis
cuaaaaacucuuucau

SEQ ID NO: 472464 - RNA, 16 nt, Chlamydia trachomatis
cuaaaaacucuuuuuc

SEQ ID NO: 472465 - RNA, 11 nt, Chlamydia trachomatis
cuaaaaagcca

SEQ ID NO: 472466 - RNA, 18 nt, Chlamydia trachomatis
cuaaaaagccauacaaag

SEQ ID NO: 472467 - RNA, 22 nt, Chlamydia trachomatis
cuaaaaucaccauauccauaac

SEQ ID NO: 472468 - RNA, 18 nt, Chlamydia trachomatis
cuaaaaucccuaacucuu

SEQ ID NO: 472469 - RNA, 15 nt, Chlamydia trachomatis
cuaaacuaucuaaaa

SEQ ID NO: 472470 - RNA, 14 nt, Chlamydia trachomatis
cuaaagaaaagcuu

SEQ ID NO: 472471 - RNA, 15 nt, Chlamydia trachomatis
cuaaagacaaaacuu

SEQ ID NO: 472472 - RNA, 20 nt, Chlamydia trachomatis
cuaaagacaaaacuucuucg

SEQ ID NO: 472473 - RNA, 16 nt, Chlamydia trachomatis
cuaaagacacuaucac

SEQ ID NO: 472474 - RNA, 16 nt, Chlamydia trachomatis
cuaaagacagcauaau

SEQ ID NO: 472475 - RNA, 23 nt, Chlamydia trachomatis
cuaaagagacgcaugcuucuuua

SEQ ID NO: 472476 - RNA, 19 nt, Chlamydia trachomatis
cuaaagcacguuuaacuuc

SEQ ID NO: 472477 - RNA, 21 nt, Chlamydia trachomatis
cuacgagcugaccuuuuacuu

SEQ ID NO: 472478 - RNA, 13 nt, Chlamydia trachomatis
cuaccuuuuuccc

SEQ ID NO: 472479 - RNA, 22 nt, Chlamydia trachomatis
cuaacaugcucaacauuagaau

SEQ ID NO: 472480 - RNA, 17 nt, Chlamydia trachomatis
cuaaccaaguuuuuuuc

SEQ ID NO: 472481 - RNA, 17 nt, Chlamydia trachomatis
cuacugucgaacgcuuc

SEQ ID NO: 472482 - RNA, 23 nt, Chlamydia trachomatis
cuacugucgaacgcuucuuccca

SEQ ID NO: 472483 - RNA, 18 nt, Chlamydia trachomatis
cuacuguagcaccaaguu

SEQ ID NO: 472484 - RNA, 16 nt, Chlamydia trachomatis
cuacugggucuuuuuu

SEQ ID NO: 472485 - RNA, 16 nt, Chlamydia trachomatis
cuacugaugacuuucg

SEQ ID NO: 472486 - RNA, 20 nt, Chlamydia trachomatis
cuacuagauagauggcauuu

SEQ ID NO: 472487 - RNA, 14 nt, Chlamydia trachomatis
cuacucaacaaauu

SEQ ID NO: 472488 - RNA, 18 nt, Chlamydia trachomatis
cuacucauccuaacugua

SEQ ID NO: 472489 - RNA, 19 nt, Chlamydia trachomatis
cuacuccaauggaaauaag

SEQ ID NO: 472490 - RNA, 20 nt, Chlamydia trachomatis
cuacuccaauggaaauaaga

SEQ ID NO: 472491 - RNA, 14 nt, Chlamydia trachomatis
cuacucuuccuuga

SEQ ID NO: 472492 - RNA, 15 nt, Chlamydia trachomatis
cuacucuuccuugau

SEQ ID NO: 472493 - RNA, 13 nt, Chlamydia trachomatis
cuagcagccucuc

SEQ ID NO: 472494 - RNA, 13 nt, Chlamydia trachomatis
cuagcaaacgaag

SEQ ID NO: 472495 - RNA, 21 nt, Chlamydia trachomatis
cuagcaaauucgcuaccaaaa

SEQ ID NO: 472496 - RNA, 14 nt, Chlamydia trachomatis
cuagcaauagagau

SEQ ID NO: 472497 - RNA, 22 nt, Chlamydia trachomatis
cuaggcgacacgcuucuucaaa

SEQ ID NO: 472498 - RNA, 17 nt, Chlamydia trachomatis
cuaggcucaugagccuc

SEQ ID NO: 472499 - RNA, 18 nt, Chlamydia trachomatis
cuagcuguaaauguucau

SEQ ID NO: 472500 - RNA, 14 nt, Chlamydia trachomatis
cuagcuucuugucg

SEQ ID NO: 472501 - RNA, 22 nt, Chlamydia trachomatis
cuaggauuacagcaagaagaag

SEQ ID NO: 472502 - RNA, 18 nt, Chlamydia trachomatis
cuaggauuacuuuuucua

SEQ ID NO: 472503 - RNA, 21 nt, Chlamydia trachomatis
cuaggcaaauauccuaaauua

SEQ ID NO: 472504 - RNA, 18 nt, Chlamydia trachomatis
cuacuucuggaggaguau

SEQ ID NO: 472505 - RNA, 21 nt, Chlamydia trachomatis
cuacuuuuugacauucugccg

SEQ ID NO: 472506 - RNA, 15 nt, Chlamydia trachomatis
cuagaggaaugugaa

SEQ ID NO: 472507 - RNA, 21 nt, Chlamydia trachomatis
cuagagucagaagcuauucca

SEQ ID NO: 472508 - RNA, 17 nt, Chlamydia trachomatis
cuagauccguuuuucua

SEQ ID NO: 472509 - RNA, 17 nt, Chlamydia trachomatis
cuagaugcaauaaacgc

SEQ ID NO: 472510 - RNA, 22 nt, Chlamydia trachomatis
cuaucccggaggcaacaaauaa

SEQ ID NO: 472511 - RNA, 23 nt, Chlamydia trachomatis
cuaucccggaggcaacaaauaac

SEQ ID NO: 472512 - RNA, 15 nt, Chlamydia trachomatis
cuaucaucgcacagc

SEQ ID NO: 472513 - RNA, 13 nt, Chlamydia trachomatis
cuaucaucuuuug

SEQ ID NO: 472514 - RNA, 19 nt, Chlamydia trachomatis
cuaucauugagcaaaaaaa

SEQ ID NO: 472515 - RNA, 20 nt, Chlamydia trachomatis
cuaucauugagcaaaaaaag

SEQ ID NO: 472516 - RNA, 21 nt, Chlamydia trachomatis
cuaucagcgcucauaggacaa

SEQ ID NO: 472517 - RNA, 15 nt, Chlamydia trachomatis
cuaucgcuugaaaag

SEQ ID NO: 472518 - RNA, 20 nt, Chlamydia trachomatis
cuaugcaaaguuucugaaaa

SEQ ID NO: 472519 - RNA, 22 nt, Chlamydia trachomatis
cuaugcaaaguuucugaaaagu

SEQ ID NO: 472520 - RNA, 12 nt, Chlamydia trachomatis
cuaugcaguaaa

SEQ ID NO: 472521 - RNA, 17 nt, Chlamydia trachomatis
cuaugcaguaaagaaaa

SEQ ID NO: 472522 - RNA, 23 nt, Chlamydia trachomatis
cuaugcgcggaaggaaaaagaaa

SEQ ID NO: 472523 - RNA, 16 nt, Chlamydia trachomatis
cuaugcgugucacaga

SEQ ID NO: 472524 - RNA, 20 nt, Chlamydia trachomatis
cuaugcucacaaaccaaaac

SEQ ID NO: 472525 - RNA, 13 nt, Chlamydia trachomatis
cuaugguuuuuuc

SEQ ID NO: 472526 - RNA, 21 nt, Chlamydia trachomatis
cuauguaaaaaaucuugucgu

SEQ ID NO: 472527 - RNA, 21 nt, Chlamydia trachomatis
cuauguaaaaauucuaaagua

SEQ ID NO: 472528 - RNA, 19 nt, Chlamydia trachomatis
cuauguaaacaagaauaau

SEQ ID NO: 472529 - RNA, 19 nt, Chlamydia trachomatis
cuauacccgacuaaaaaau

SEQ ID NO: 472530 - RNA, 16 nt, Chlamydia trachomatis
cuauaggaauagccuc

SEQ ID NO: 472531 - RNA, 19 nt, Chlamydia trachomatis
cuauaggaugguauucgcu

SEQ ID NO: 472532 - RNA, 17 nt, Chlamydia trachomatis
cuauaauugcuaaggaa

SEQ ID NO: 472533 - RNA, 12 nt, Chlamydia trachomatis
cuauacagcauc

SEQ ID NO: 472534 - RNA, 13 nt, Chlamydia trachomatis
cuaggucucccag

SEQ ID NO: 472535 - RNA, 15 nt, Chlamydia trachomatis
cuaggucucccuagc

SEQ ID NO: 472536 - RNA, 22 nt, Chlamydia trachomatis
cuagguaaagguuucuggaaaa

SEQ ID NO: 472537 - RNA, 22 nt, Chlamydia trachomatis
cuagguacgccguaagcauucc

SEQ ID NO: 472538 - RNA, 16 nt, Chlamydia trachomatis
cuagguagucucuagu

SEQ ID NO: 472539 - RNA, 23 nt, Chlamydia trachomatis
cuaggggaagaaucaauauccac

SEQ ID NO: 472540 - RNA, 18 nt, Chlamydia trachomatis
cuaggguguauugguuau

SEQ ID NO: 472541 - RNA, 19 nt, Chlamydia trachomatis
cuauaaucuauuuuauacu

SEQ ID NO: 472542 - RNA, 23 nt, Chlamydia trachomatis
cuauaugagccuugccuacagaa

SEQ ID NO: 472543 - RNA, 18 nt, Chlamydia trachomatis
cuaucaacaucuguguca

SEQ ID NO: 472544 - RNA, 18 nt, Chlamydia trachomatis
cuaucaacuuuacauaag

SEQ ID NO: 472545 - RNA, 15 nt, Chlamydia trachomatis
cuaucaauuguucug

SEQ ID NO: 472546 - RNA, 19 nt, Chlamydia trachomatis
cucaccuaaauucagaucc

SEQ ID NO: 472547 - RNA, 14 nt, Chlamydia trachomatis
cucaccgaaaaauu

SEQ ID NO: 472548 - RNA, 19 nt, Chlamydia trachomatis
cucaaguucauugguaaga

SEQ ID NO: 472549 - RNA, 23 nt, Chlamydia trachomatis
cucaauaaucgcucguuccucag

SEQ ID NO: 472550 - RNA, 15 nt, Chlamydia trachomatis
cucaauagcagcauu

SEQ ID NO: 472551 - RNA, 19 nt, Chlamydia trachomatis
cucaaucaccacgagaucu

SEQ ID NO: 472552 - RNA, 21 nt, Chlamydia trachomatis
cucacagcaaauaaagagguu

SEQ ID NO: 472553 - RNA, 17 nt, Chlamydia trachomatis
cucaagcgauuaugaaa

SEQ ID NO: 472554 - RNA, 18 nt, Chlamydia trachomatis
cucaagcgauuaugaaaa

SEQ ID NO: 472555 - RNA, 17 nt, Chlamydia trachomatis
cucaacucgcuccagaa

SEQ ID NO: 472556 - RNA, 16 nt, Chlamydia trachomatis
cucaacgcucaacucg

SEQ ID NO: 472557 - RNA, 22 nt, Chlamydia trachomatis
cucaacgaaagcauccccaaaa

SEQ ID NO: 472558 - RNA, 16 nt, Chlamydia trachomatis
cucaacacugaaaauc

SEQ ID NO: 472559 - RNA, 14 nt, Chlamydia trachomatis
cuauuacauauagg

SEQ ID NO: 472560 - RNA, 13 nt, Chlamydia trachomatis
cucaaauuucucu

SEQ ID NO: 472561 - RNA, 15 nt, Chlamydia trachomatis
cucagaaucugucua

SEQ ID NO: 472562 - RNA, 17 nt, Chlamydia trachomatis
cucagauucgaauaauc

SEQ ID NO: 472563 - RNA, 14 nt, Chlamydia trachomatis
cucagguucccuug

SEQ ID NO: 472564 - RNA, 18 nt, Chlamydia trachomatis
cucauaagcagggcugua

SEQ ID NO: 472565 - RNA, 20 nt, Chlamydia trachomatis
cucauaccuaaacaaggauu

SEQ ID NO: 472566 - RNA, 18 nt, Chlamydia trachomatis
cucaguugguagagcaac

SEQ ID NO: 472567 - RNA, 16 nt, Chlamydia trachomatis
cucaucaaauagcaaa

SEQ ID NO: 472568 - RNA, 22 nt, Chlamydia trachomatis
cucaucaaauagcaaagcgauc

SEQ ID NO: 472569 - RNA, 18 nt, Chlamydia trachomatis
cucaucugacggaauuuu

SEQ ID NO: 472570 - RNA, 17 nt, Chlamydia trachomatis
cucaucuuuuuuaaaaa

SEQ ID NO: 472571 - RNA, 18 nt, Chlamydia trachomatis
cucaucuuuuuuaaaaag

SEQ ID NO: 472572 - RNA, 20 nt, Chlamydia trachomatis
cucaucuuuuuuaaaaagcu

SEQ ID NO: 472573 - RNA, 18 nt, Chlamydia trachomatis
cucaugaacagcaagagg

SEQ ID NO: 472574 - RNA, 16 nt, Chlamydia trachomatis
cucaugcacugucuca

SEQ ID NO: 472575 - RNA, 14 nt, Chlamydia trachomatis
cuccaggaaaagcu

SEQ ID NO: 472576 - RNA, 13 nt, Chlamydia trachomatis
cuccagcuucucc

SEQ ID NO: 472577 - RNA, 17 nt, Chlamydia trachomatis
cuccagcuucuucuaua

SEQ ID NO: 472578 - RNA, 13 nt, Chlamydia trachomatis
cuccagcucuucc

SEQ ID NO: 472579 - RNA, 21 nt, Chlamydia trachomatis
cuccauaagaaauuaacacca

SEQ ID NO: 472580 - RNA, 12 nt, Chlamydia trachomatis
cuccauacgcug

SEQ ID NO: 472581 - RNA, 11 nt, Chlamydia trachomatis
cucccuccucu

SEQ ID NO: 472582 - RNA, 13 nt, Chlamydia trachomatis
cuccaucucugcu

SEQ ID NO: 472583 - RNA, 14 nt, Chlamydia trachomatis
cuccaucucugcuu

SEQ ID NO: 472584 - RNA, 15 nt, Chlamydia trachomatis
cuccaucucugcuuc

SEQ ID NO: 472585 - RNA, 10 nt, Chlamydia trachomatis
cuccaucucg

SEQ ID NO: 472586 - RNA, 20 nt, Chlamydia trachomatis
cucccaauauacaaguauuu

SEQ ID NO: 472587 - RNA, 22 nt, Chlamydia trachomatis
cucccuuagcaacagucaauuc

SEQ ID NO: 472588 - RNA, 14 nt, Chlamydia trachomatis
cuccgaaaauaccc

SEQ ID NO: 472589 - RNA, 13 nt, Chlamydia trachomatis
cuccgccuucugc

SEQ ID NO: 472590 - RNA, 14 nt, Chlamydia trachomatis
cuccuggagaaaau

SEQ ID NO: 472591 - RNA, 16 nt, Chlamydia trachomatis
cuccugcagcuaaaga

SEQ ID NO: 472592 - RNA, 15 nt, Chlamydia trachomatis
cuccugcaacaagaa

SEQ ID NO: 472593 - RNA, 13 nt, Chlamydia trachomatis
cuccugcaaggga

SEQ ID NO: 472594 - RNA, 16 nt, Chlamydia trachomatis
cuccuuugcuaacaaa

SEQ ID NO: 472595 - RNA, 19 nt, Chlamydia trachomatis
cuccuuugcuaacaaagaa

SEQ ID NO: 472596 - RNA, 20 nt, Chlamydia trachomatis
cuccuucucagagcuuugca

SEQ ID NO: 472597 - RNA, 13 nt, Chlamydia trachomatis
cuccuucuugaug

SEQ ID NO: 472598 - RNA, 19 nt, Chlamydia trachomatis
cuccuucuugugagagaaa

SEQ ID NO: 472599 - RNA, 20 nt, Chlamydia trachomatis
cuccuucuugugagagaaau

SEQ ID NO: 472600 - RNA, 18 nt, Chlamydia trachomatis
cuccuugaacaauuugug

SEQ ID NO: 472601 - RNA, 20 nt, Chlamydia trachomatis
cucgagccuguuuagaaaga

SEQ ID NO: 472602 - RNA, 21 nt, Chlamydia trachomatis
cucgagccuguuuagaaagag

SEQ ID NO: 472603 - RNA, 17 nt, Chlamydia trachomatis
cucgauccgguucuuuu

SEQ ID NO: 472604 - RNA, 14 nt, Chlamydia trachomatis
cucgauccaaagcc

SEQ ID NO: 472605 - RNA, 16 nt, Chlamydia trachomatis
cucgcuucaaaacuaa

SEQ ID NO: 472606 - RNA, 16 nt, Chlamydia trachomatis
cucggauccagaagca

SEQ ID NO: 472607 - RNA, 21 nt, Chlamydia trachomatis
cucggccagagcucauagucu

SEQ ID NO: 472608 - RNA, 22 nt, Chlamydia trachomatis
cucggccagagcucauagucug

SEQ ID NO: 472609 - RNA, 15 nt, Chlamydia trachomatis
cucgucgaagaaauc

SEQ ID NO: 472610 - RNA, 16 nt, Chlamydia trachomatis
cucguaaaaaagauaa

SEQ ID NO: 472611 - RNA, 22 nt, Chlamydia trachomatis
cucuauguucuuaauaaucugu

SEQ ID NO: 472612 - RNA, 23 nt, Chlamydia trachomatis
cucuaucccgcgguagaaagucc

SEQ ID NO: 472613 - RNA, 16 nt, Chlamydia trachomatis
cucucaccgaaaaauu

SEQ ID NO: 472614 - RNA, 15 nt, Chlamydia trachomatis
cucucauaagaucuu

SEQ ID NO: 472615 - RNA, 11 nt, Chlamydia trachomatis
cucucaucuaa

SEQ ID NO: 472616 - RNA, 15 nt, Chlamydia trachomatis
cucuccgugaagauu

SEQ ID NO: 472617 - RNA, 20 nt, Chlamydia trachomatis
cucuccgguguauccucguc

SEQ ID NO: 472618 - RNA, 20 nt, Chlamydia trachomatis
cucucccucuuguaaguccu

SEQ ID NO: 472619 - RNA, 12 nt, Chlamydia trachomatis
cucucccuuccu

SEQ ID NO: 472620 - RNA, 13 nt, Chlamydia trachomatis
cucucuaaaauca

SEQ ID NO: 472621 - RNA, 19 nt, Chlamydia trachomatis
cucucgggccaaaaagacu

SEQ ID NO: 472622 - RNA, 15 nt, Chlamydia trachomatis
cucucuugguaacaa

SEQ ID NO: 472623 - RNA, 12 nt, Chlamydia trachomatis
cucucuuuauga

SEQ ID NO: 472624 - RNA, 11 nt, Chlamydia trachomatis
cucucuuuuuu

SEQ ID NO: 472625 - RNA, 14 nt, Chlamydia trachomatis
cucucuuuuuuuug

SEQ ID NO: 472626 - RNA, 19 nt, Chlamydia trachomatis
cucugaaagagcuucuuuu

SEQ ID NO: 472627 - RNA, 14 nt, Chlamydia trachomatis
cucugccaccucau

SEQ ID NO: 472628 - RNA, 19 nt, Chlamydia trachomatis
cucugcacaauauuaucua

SEQ ID NO: 472629 - RNA, 17 nt, Chlamydia trachomatis
cucugcagauuuuguag

SEQ ID NO: 472630 - RNA, 13 nt, Chlamydia trachomatis
cucugauuagaag

SEQ ID NO: 472631 - RNA, 15 nt, Chlamydia trachomatis
cucugcaaaaucuuc

SEQ ID NO: 472632 - RNA, 19 nt, Chlamydia trachomatis
cucuucaagaucaaaguca

SEQ ID NO: 472633 - RNA, 23 nt, Chlamydia trachomatis
cucuuaauccuugcacuaagaau

SEQ ID NO: 472634 - RNA, 17 nt, Chlamydia trachomatis
cucuuacgagcuuucuu

SEQ ID NO: 472635 - RNA, 15 nt, Chlamydia trachomatis
cucuuagaagcucuc

SEQ ID NO: 472636 - RNA, 22 nt, Chlamydia trachomatis
cucuuaucguagagaucuucug

SEQ ID NO: 472637 - RNA, 22 nt, Chlamydia trachomatis
cucuggucgugaucacugugag

SEQ ID NO: 472638 - RNA, 15 nt, Chlamydia trachomatis
cucugguaaaaauag

SEQ ID NO: 472639 - RNA, 13 nt, Chlamydia trachomatis
cucuuccuucccu

SEQ ID NO: 472640 - RNA, 16 nt, Chlamydia trachomatis
cucuuccccuucuuua

SEQ ID NO: 472641 - RNA, 21 nt, Chlamydia trachomatis
cucuucccgccguuuguucuc

SEQ ID NO: 472642 - RNA, 21 nt, Chlamydia trachomatis
cucuuccgaagauucgcugcu

SEQ ID NO: 472643 - RNA, 12 nt, Chlamydia trachomatis
cucuuccauaau

SEQ ID NO: 472644 - RNA, 16 nt, Chlamydia trachomatis
cucuuccaacaauuuu

SEQ ID NO: 472645 - RNA, 22 nt, Chlamydia trachomatis
cucuucuaucgaucgaagcauu

SEQ ID NO: 472646 - RNA, 14 nt, Chlamydia trachomatis
cucuugagcauuga

SEQ ID NO: 472647 - RNA, 13 nt, Chlamydia trachomatis
cucuugaaaacuc

SEQ ID NO: 472648 - RNA, 19 nt, Chlamydia trachomatis
cucuucuucugaagagaaa

SEQ ID NO: 472649 - RNA, 22 nt, Chlamydia trachomatis
cucuuguaaguccuuacauaaa

SEQ ID NO: 472650 - RNA, 17 nt, Chlamydia trachomatis
cucuugucgauaaagua

SEQ ID NO: 472651 - RNA, 21 nt, Chlamydia trachomatis
cucuuguaucauauucuuugu

SEQ ID NO: 472652 - RNA, 20 nt, Chlamydia trachomatis
cucuuguugaauaucguaaa

SEQ ID NO: 472653 - RNA, 15 nt, Chlamydia trachomatis
cucuuuacgcacaaa

SEQ ID NO: 472654 - RNA, 14 nt, Chlamydia trachomatis
cucuuuuuuuuugu

SEQ ID NO: 472655 - RNA, 17 nt, Chlamydia trachomatis
cugaaaaugcucuaaag

SEQ ID NO: 472656 - RNA, 15 nt, Chlamydia trachomatis
cucuuuagcaugcac

SEQ ID NO: 472657 - RNA, 19 nt, Chlamydia trachomatis
cucuuuauuaaacucccaa

SEQ ID NO: 472658 - RNA, 18 nt, Chlamydia trachomatis
cucuuucagaugcacuuc

SEQ ID NO: 472659 - RNA, 12 nt, Chlamydia trachomatis
cucuuuccucua

SEQ ID NO: 472660 - RNA, 15 nt, Chlamydia trachomatis
cucuuucgaaaacaa

SEQ ID NO: 472661 - RNA, 11 nt, Chlamydia trachomatis
cucuuucucuc

SEQ ID NO: 472662 - RNA, 15 nt, Chlamydia trachomatis
cucuuuuuaaaaggc

SEQ ID NO: 472663 - RNA, 21 nt, Chlamydia trachomatis
cucuuuuuaaaaggcuuuauc

SEQ ID NO: 472664 - RNA, 19 nt, Chlamydia trachomatis
cucuuuuucagacaaaaag

SEQ ID NO: 472665 - RNA, 20 nt, Chlamydia trachomatis
cugaacauacaauuuagacu

SEQ ID NO: 472666 - RNA, 19 nt, Chlamydia trachomatis
cugaagaaaaaucuagaca

SEQ ID NO: 472667 - RNA, 13 nt, Chlamydia trachomatis
cugaagauuuuuu

SEQ ID NO: 472668 - RNA, 18 nt, Chlamydia trachomatis
cugaagauuuuuuaauaa

SEQ ID NO: 472669 - RNA, 18 nt, Chlamydia trachomatis
cugaaggugugaaagaaa

SEQ ID NO: 472670 - RNA, 17 nt, Chlamydia trachomatis
cugacaaagcuuccuua

SEQ ID NO: 472671 - RNA, 22 nt, Chlamydia trachomatis
cugacagaaguuagaaucugcu

SEQ ID NO: 472672 - RNA, 20 nt, Chlamydia trachomatis
cugacggauccugcuggugg

SEQ ID NO: 472673 - RNA, 14 nt, Chlamydia trachomatis
cugacuacagucuu

SEQ ID NO: 472674 - RNA, 18 nt, Chlamydia trachomatis
cugagauguuuacgagga

SEQ ID NO: 472675 - RNA, 19 nt, Chlamydia trachomatis
cugagauguuuacgaggag

SEQ ID NO: 472676 - RNA, 17 nt, Chlamydia trachomatis
cugagacuccagcuucu

SEQ ID NO: 472677 - RNA, 19 nt, Chlamydia trachomatis
cugagacuccagcuucucc

SEQ ID NO: 472678 - RNA, 21 nt, Chlamydia trachomatis
cugagagagcaauacggcaaa

SEQ ID NO: 472679 - RNA, 13 nt, Chlamydia trachomatis
cugagagaugaug

SEQ ID NO: 472680 - RNA, 16 nt, Chlamydia trachomatis
cugagagaaaaucaua

SEQ ID NO: 472681 - RNA, 20 nt, Chlamydia trachomatis
cugagaggaguuuuuuucac

SEQ ID NO: 472682 - RNA, 14 nt, Chlamydia trachomatis
cugaguuuccuuua

SEQ ID NO: 472683 - RNA, 17 nt, Chlamydia trachomatis
cugauaaggaggcuuca

SEQ ID NO: 472684 - RNA, 15 nt, Chlamydia trachomatis
cugagcauuucucuc

SEQ ID NO: 472685 - RNA, 16 nt, Chlamydia trachomatis
cugagucuugugcucu

SEQ ID NO: 472686 - RNA, 23 nt, Chlamydia trachomatis
cugaucaacaagagcuuguucuu

SEQ ID NO: 472687 - RNA, 22 nt, Chlamydia trachomatis
cugcaagcacacuugauaaaua

SEQ ID NO: 472688 - RNA, 15 nt, Chlamydia trachomatis
cugcaagagaucgua

SEQ ID NO: 472689 - RNA, 21 nt, Chlamydia trachomatis
cugcaacucucuugguaacaa

SEQ ID NO: 472690 - RNA, 18 nt, Chlamydia trachomatis
cugcaaggagcuucuuua

SEQ ID NO: 472691 - RNA, 21 nt, Chlamydia trachomatis
cugcaauaaggggaagaaaua

SEQ ID NO: 472692 - RNA, 21 nt, Chlamydia trachomatis
cugcaauagaaaccuuauaua

SEQ ID NO: 472693 - RNA, 17 nt, Chlamydia trachomatis
cugcaaucucuuguuuc

SEQ ID NO: 472694 - RNA, 21 nt, Chlamydia trachomatis
cugcaaugagugcggccauga

SEQ ID NO: 472695 - RNA, 17 nt, Chlamydia trachomatis
cugcacaauauuaucua

SEQ ID NO: 472696 - RNA, 20 nt, Chlamydia trachomatis
cugcacaauauuaucuacag

SEQ ID NO: 472697 - RNA, 13 nt, Chlamydia trachomatis
cugcagugacauu

SEQ ID NO: 472698 - RNA, 21 nt, Chlamydia trachomatis
cugcagugacauuauuuuuuc

SEQ ID NO: 472699 - RNA, 14 nt, Chlamydia trachomatis
cugcauaacagcaa

SEQ ID NO: 472700 - RNA, 13 nt, Chlamydia trachomatis
cugcccaucaucg

SEQ ID NO: 472701 - RNA, 20 nt, Chlamydia trachomatis
cugccucuuuuaccgagaga

SEQ ID NO: 472702 - RNA, 22 nt, Chlamydia trachomatis
cugcgcauccacuacugucaga

SEQ ID NO: 472703 - RNA, 17 nt, Chlamydia trachomatis
cugcgaugccaaagaaa

SEQ ID NO: 472704 - RNA, 23 nt, Chlamydia trachomatis
cugcgggauauguuaaagcccag

SEQ ID NO: 472705 - RNA, 15 nt, Chlamydia trachomatis
cugcuauagaaagca

SEQ ID NO: 472706 - RNA, 23 nt, Chlamydia trachomatis
cugcucgaguucuguuauuuguu

SEQ ID NO: 472707 - RNA, 16 nt, Chlamydia trachomatis
cugcucagagauccca

SEQ ID NO: 472708 - RNA, 17 nt, Chlamydia trachomatis
cugcugcccaagagauu

SEQ ID NO: 472709 - RNA, 20 nt, Chlamydia trachomatis
cuggaaaaggcugugaauaa

SEQ ID NO: 472710 - RNA, 15 nt, Chlamydia trachomatis
cugcuucacagcuaa

SEQ ID NO: 472711 - RNA, 18 nt, Chlamydia trachomatis
cugcuucacagcuaauca

SEQ ID NO: 472712 - RNA, 18 nt, Chlamydia trachomatis
cugcuuuauccaaagaua

SEQ ID NO: 472713 - RNA, 15 nt, Chlamydia trachomatis
cugcuuucuuuguuc

SEQ ID NO: 472714 - RNA, 15 nt, Chlamydia trachomatis
cugcugcuuggaaua

SEQ ID NO: 472715 - RNA, 18 nt, Chlamydia trachomatis
cuggcaauaaucuuuuua

SEQ ID NO: 472716 - RNA, 19 nt, Chlamydia trachomatis
cuggauccaaaaaagaauc

SEQ ID NO: 472717 - RNA, 20 nt, Chlamydia trachomatis
cuggacuauuuucaaaaccu

SEQ ID NO: 472718 - RNA, 14 nt, Chlamydia trachomatis
cuuaaccgugaacu

SEQ ID NO: 472719 - RNA, 20 nt, Chlamydia trachomatis
aaacugcucaaggaaacucu

SEQ ID NO: 472720 - RNA, 19 nt, Chlamydia trachomatis
cuuaacacccucuuccuuc

SEQ ID NO: 472721 - RNA, 21 nt, Chlamydia trachomatis
cuuaacacccucuuccuuccc

SEQ ID NO: 472722 - RNA, 22 nt, Chlamydia trachomatis
cuuaaaggucgagcucccauuu

SEQ ID NO: 472723 - RNA, 23 nt, Chlamydia trachomatis
cuguuaugaaccagggagagcuu

SEQ ID NO: 472724 - RNA, 21 nt, Chlamydia trachomatis
cuguuaguagcuucucuucac

SEQ ID NO: 472725 - RNA, 12 nt, Chlamydia trachomatis
cuguuagugaag

SEQ ID NO: 472726 - RNA, 12 nt, Chlamydia trachomatis
cuguuccugaaa

SEQ ID NO: 472727 - RNA, 19 nt, Chlamydia trachomatis
cuguuccuaauacuaaacu

SEQ ID NO: 472728 - RNA, 16 nt, Chlamydia trachomatis
cuguugugggagauuc

SEQ ID NO: 472729 - RNA, 19 nt, Chlamydia trachomatis
cuguuucagaaacuuccca

SEQ ID NO: 472730 - RNA, 22 nt, Chlamydia trachomatis
cuguuuaucacuaucugcaaaa

SEQ ID NO: 472731 - RNA, 14 nt, Chlamydia trachomatis
cuuagagacauuua

SEQ ID NO: 472732 - RNA, 23 nt, Chlamydia trachomatis
cuuagcagauaauucucgcaaag

SEQ ID NO: 472733 - RNA, 16 nt, Chlamydia trachomatis
cuuagcaguuacauuu

SEQ ID NO: 472734 - RNA, 12 nt, Chlamydia trachomatis
cuuacucuuccg

SEQ ID NO: 472735 - RNA, 18 nt, Chlamydia trachomatis
cuuacgagcuuucuuacg

SEQ ID NO: 472736 - RNA, 12 nt, Chlamydia trachomatis
cuuaaugcuuga

SEQ ID NO: 472737 - RNA, 17 nt, Chlamydia trachomatis
cuuacauaagauccauc

SEQ ID NO: 472738 - RNA, 22 nt, Chlamydia trachomatis
cuuacaucaggggaauucgcua

SEQ ID NO: 472739 - RNA, 16 nt, Chlamydia trachomatis
cuuacaucgagugugu

SEQ ID NO: 472740 - RNA, 19 nt, Chlamydia trachomatis
cuuaucguuuggagaauug

SEQ ID NO: 472741 - RNA, 12 nt, Chlamydia trachomatis
cuuauuaaaaga

SEQ ID NO: 472742 - RNA, 18 nt, Chlamydia trachomatis
cuuauuuaccuugagucc

SEQ ID NO: 472743 - RNA, 15 nt, Chlamydia trachomatis
cuuagcccagauuuu

SEQ ID NO: 472744 - RNA, 14 nt, Chlamydia trachomatis
cuuagccuuguuua

SEQ ID NO: 472745 - RNA, 15 nt, Chlamydia trachomatis
cuuagccuuguuuau

SEQ ID NO: 472746 - RNA, 23 nt, Chlamydia trachomatis
cuuagcucccugcucuugaagau

SEQ ID NO: 472747 - RNA, 22 nt, Chlamydia trachomatis
cuuagcuccuaaucuuucuaau

SEQ ID NO: 472748 - RNA, 21 nt, Chlamydia trachomatis
cuuaggaccuaauaucugcuc

SEQ ID NO: 472749 - RNA, 20 nt, Chlamydia trachomatis
cuucaaccuagauauugacg

SEQ ID NO: 472750 - RNA, 16 nt, Chlamydia trachomatis
cuucaagagcuguauu

SEQ ID NO: 472751 - RNA, 18 nt, Chlamydia trachomatis
cuucaaaaaagauuuccc

SEQ ID NO: 472752 - RNA, 22 nt, Chlamydia trachomatis
cuucaaaaaagauuuccccuuu

SEQ ID NO: 472753 - RNA, 13 nt, Chlamydia trachomatis
cuucaaucuguag

SEQ ID NO: 472754 - RNA, 17 nt, Chlamydia trachomatis
cuucaauggcaaaacuu

SEQ ID NO: 472755 - RNA, 18 nt, Chlamydia trachomatis
cuucacccauaaaaaaga

SEQ ID NO: 472756 - RNA, 14 nt, Chlamydia trachomatis
cuucaggggagaaa

SEQ ID NO: 472757 - RNA, 19 nt, Chlamydia trachomatis
cuucaggggagaaaacauc

SEQ ID NO: 472758 - RNA, 15 nt, Chlamydia trachomatis
cuucaggauuggaaa

SEQ ID NO: 472759 - RNA, 21 nt, Chlamydia trachomatis
cuucagagguagccaaagaau

SEQ ID NO: 472760 - RNA, 14 nt, Chlamydia trachomatis
cuucagcaacauuc

SEQ ID NO: 472761 - RNA, 24 nt, Chlamydia trachomatis
cuucaucaauauucgcaauauaga

SEQ ID NO: 472762 - RNA, 17 nt, Chlamydia trachomatis
cuuccagacgcccuccu

SEQ ID NO: 472763 - RNA, 14 nt, Chlamydia trachomatis
aaacuucuggagau

SEQ ID NO: 472764 - RNA, 20 nt, Chlamydia trachomatis
cuuccaaaggauauacagaa

SEQ ID NO: 472765 - RNA, 17 nt, Chlamydia trachomatis
cuuccaaauagggucuu

SEQ ID NO: 472766 - RNA, 21 nt, Chlamydia trachomatis
cuuccaaaucugcaagaacaa

SEQ ID NO: 472767 - RNA, 18 nt, Chlamydia trachomatis
cuuccaaauuucccucuu

SEQ ID NO: 472768 - RNA, 21 nt, Chlamydia trachomatis
cuuccaaauuucccucuuccc

SEQ ID NO: 472769 - RNA, 21 nt, Chlamydia trachomatis
cuucccgcuauuuuccucuuc

SEQ ID NO: 472770 - RNA, 22 nt, Chlamydia trachomatis
cuucccgcuauuuuccucuuca

SEQ ID NO: 472771 - RNA, 21 nt, Chlamydia trachomatis
cuuccggauuaucgagaacca

SEQ ID NO: 472772 - RNA, 21 nt, Chlamydia trachomatis
cuuccguccccuuacccaaac

SEQ ID NO: 472773 - RNA, 15 nt, Chlamydia trachomatis
cuuccuacagcuaga

SEQ ID NO: 472774 - RNA, 21 nt, Chlamydia trachomatis
cuuccucaguauaaaaaaagu

SEQ ID NO: 472775 - RNA, 16 nt, Chlamydia trachomatis
cuuccugcuucaaaaa

SEQ ID NO: 472776 - RNA, 22 nt, Chlamydia trachomatis
cuuccuuaucuaauuccuucaa

SEQ ID NO: 472777 - RNA, 12 nt, Chlamydia trachomatis
cuucgagcuguu

SEQ ID NO: 472778 - RNA, 14 nt, Chlamydia trachomatis
cuucgaggcucccc

SEQ ID NO: 472779 - RNA, 15 nt, Chlamydia trachomatis
cuucgauaagaaaaa

SEQ ID NO: 472780 - RNA, 17 nt, Chlamydia trachomatis
cuucgauaagaaaaaaa

SEQ ID NO: 472781 - RNA, 19 nt, Chlamydia trachomatis
cuucgaguacuggggucag

SEQ ID NO: 472782 - RNA, 20 nt, Chlamydia trachomatis
cuucucccgcuaauuuuuua

SEQ ID NO: 472783 - RNA, 14 nt, Chlamydia trachomatis
cuucucgcaaaaga

SEQ ID NO: 472784 - RNA, 14 nt, Chlamydia trachomatis
cuucucgcuacaaa

SEQ ID NO: 472785 - RNA, 15 nt, Chlamydia trachomatis
cuucucgcuacaaau

SEQ ID NO: 472786 - RNA, 16 nt, Chlamydia trachomatis
cuucucgcuacaaauc

SEQ ID NO: 472787 - RNA, 16 nt, Chlamydia trachomatis
cuucucuagaaaaggc

SEQ ID NO: 472788 - RNA, 17 nt, Chlamydia trachomatis
cuucucuagaaaaggcc

SEQ ID NO: 472789 - RNA, 14 nt, Chlamydia trachomatis
cuucucuuguucug

SEQ ID NO: 472790 - RNA, 13 nt, Chlamydia trachomatis
cuucucuucacuu

SEQ ID NO: 472791 - RNA, 21 nt, Chlamydia trachomatis
cuucucuugaaucaaaaaguu

SEQ ID NO: 472792 - RNA, 22 nt, Chlamydia trachomatis
cuucugacucuaguguuuguac

SEQ ID NO: 472793 - RNA, 21 nt, Chlamydia trachomatis
cuucugauaaaugucccugaa

SEQ ID NO: 472794 - RNA, 19 nt, Chlamydia trachomatis
cuucuggacuauuuucaaa

SEQ ID NO: 472795 - RNA, 15 nt, Chlamydia trachomatis
cuucugcuaaaaaug

SEQ ID NO: 472796 - RNA, 23 nt, Chlamydia trachomatis
cuucugcuaaaaaugcuugcgua

SEQ ID NO: 472797 - RNA, 9 nt, Chlamydia trachomatis
cuucugcug

SEQ ID NO: 472798 - RNA, 18 nt, Chlamydia trachomatis
cuucuauguaaaaauucu

SEQ ID NO: 472799 - RNA, 13 nt, Chlamydia trachomatis
cuucuaacuuuuc

SEQ ID NO: 472800 - RNA, 19 nt, Chlamydia trachomatis
cuucuaaguauucuucugc

SEQ ID NO: 472801 - RNA, 12 nt, Chlamydia trachomatis
cuucuacaaaaa

SEQ ID NO: 472802 - RNA, 20 nt, Chlamydia trachomatis
cuucuaaagaaucuaccacg

SEQ ID NO: 472803 - RNA, 18 nt, Chlamydia trachomatis
cuucguuaugagcauuug

SEQ ID NO: 472804 - RNA, 23 nt, Chlamydia trachomatis
cuucgugagacagcacuucuucu

SEQ ID NO: 472805 - RNA, 14 nt, Chlamydia trachomatis
cuucuguagcccca

SEQ ID NO: 472806 - RNA, 18 nt, Chlamydia trachomatis
cuucuguagccccagucu

SEQ ID NO: 472807 - RNA, 17 nt, Chlamydia trachomatis
cuucugucccuauacga

SEQ ID NO: 472808 - RNA, 18 nt, Chlamydia trachomatis
cuucuucacccauaaaaa

SEQ ID NO: 472809 - RNA, 15 nt, Chlamydia trachomatis
cuucuguuuuuucag

SEQ ID NO: 472810 - RNA, 20 nt, Chlamydia trachomatis
cuucuugaaugccuaacgau

SEQ ID NO: 472811 - RNA, 15 nt, Chlamydia trachomatis
cuucuucuaaagaau

SEQ ID NO: 472812 - RNA, 22 nt, Chlamydia trachomatis
cuucuucuaaguauucuucugc

SEQ ID NO: 472813 - RNA, 19 nt, Chlamydia trachomatis
cuucuucuagugccucaau

SEQ ID NO: 472814 - RNA, 13 nt, Chlamydia trachomatis
cuucuucuucuuu

SEQ ID NO: 472815 - RNA, 23 nt, Chlamydia trachomatis
cuucuucuuuagcucgcuucaaa

SEQ ID NO: 472816 - RNA, 13 nt, Chlamydia trachomatis
cuucuuccuucau

SEQ ID NO: 472817 - RNA, 14 nt, Chlamydia trachomatis
cuucuuccuucaua

SEQ ID NO: 472818 - RNA, 10 nt, Chlamydia trachomatis
cuucuucauc

SEQ ID NO: 472819 - RNA, 15 nt, Chlamydia trachomatis
cuucuucauguucug

SEQ ID NO: 472820 - RNA, 14 nt, Chlamydia trachomatis
cuucuuccacagaa

SEQ ID NO: 472821 - RNA, 16 nt, Chlamydia trachomatis
cuucuuccacagaagu

SEQ ID NO: 472822 - RNA, 13 nt, Chlamydia trachomatis
cuugaaaagaacc

SEQ ID NO: 472823 - RNA, 18 nt, Chlamydia trachomatis
cuucuuguuuagaggaga

SEQ ID NO: 472824 - RNA, 22 nt, Chlamydia trachomatis
cuucuuuagcucgcuucaaaac

SEQ ID NO: 472825 - RNA, 19 nt, Chlamydia trachomatis
cuucuuuaggcgaauaagc

SEQ ID NO: 472826 - RNA, 23 nt, Chlamydia trachomatis
cuucuuuauaaucgaucacagaa

SEQ ID NO: 472827 - RNA, 12 nt, Chlamydia trachomatis
cuucuuuuccug

SEQ ID NO: 472828 - RNA, 20 nt, Chlamydia trachomatis
cuugaacguaggccacaaga

SEQ ID NO: 472829 - RNA, 17 nt, Chlamydia trachomatis
cuugaaccccuccucca

SEQ ID NO: 472830 - RNA, 20 nt, Chlamydia trachomatis
cuugaauuagguaagcaagu

SEQ ID NO: 472831 - RNA, 17 nt, Chlamydia trachomatis
cuugaauuguuggauuu

SEQ ID NO: 472832 - RNA, 18 nt, Chlamydia trachomatis
cuugagagaccugcuuca

SEQ ID NO: 472833 - RNA, 16 nt, Chlamydia trachomatis
cuugagagcauucuuc

SEQ ID NO: 472834 - RNA, 22 nt, Chlamydia trachomatis
cuugagagcauucuucugaaca

SEQ ID NO: 472835 - RNA, 22 nt, Chlamydia trachomatis
cuugagaacaaaccaucuguaa

SEQ ID NO: 472836 - RNA, 19 nt, Chlamydia trachomatis
cuugagaauccaaauuuug

SEQ ID NO: 472837 - RNA, 23 nt, Chlamydia trachomatis
cuugaggaagauaaguccuccua

SEQ ID NO: 472838 - RNA, 21 nt, Chlamydia trachomatis
cuugagcgucuuuaaguccag

SEQ ID NO: 472839 - RNA, 20 nt, Chlamydia trachomatis
cuugaggauaguauucuuug

SEQ ID NO: 472840 - RNA, 23 nt, Chlamydia trachomatis
cuugaguccgcaaacaaaauaau

SEQ ID NO: 472841 - RNA, 13 nt, Chlamydia trachomatis
cuugauaaauaau

SEQ ID NO: 472842 - RNA, 13 nt, Chlamydia trachomatis
cuugauaagaguc

SEQ ID NO: 472843 - RNA, 19 nt, Chlamydia trachomatis
cuugaucuacagcaaaacc

SEQ ID NO: 472844 - RNA, 20 nt, Chlamydia trachomatis
cuugaucggagucugcucca

SEQ ID NO: 472845 - RNA, 21 nt, Chlamydia trachomatis
cuugaucggagucugcuccac

SEQ ID NO: 472846 - RNA, 19 nt, Chlamydia trachomatis
cuugaugcccaggauaaca

SEQ ID NO: 472847 - RNA, 21 nt, Chlamydia trachomatis
cuugaugaauuuuaucuaaaa

SEQ ID NO: 472848 - RNA, 14 nt, Chlamydia trachomatis
cuugauucuugaau

SEQ ID NO: 472849 - RNA, 16 nt, Chlamydia trachomatis
cuugauucuugaauca

SEQ ID NO: 472850 - RNA, 18 nt, Chlamydia trachomatis
cuugauucuugaaucaga

SEQ ID NO: 472851 - RNA, 12 nt, Chlamydia trachomatis
cuugcagaacag

SEQ ID NO: 472852 - RNA, 15 nt, Chlamydia trachomatis
cuugcccaaacucca

SEQ ID NO: 472853 - RNA, 21 nt, Chlamydia trachomatis
cuugccaucauuaucuucuuc

SEQ ID NO: 472854 - RNA, 11 nt, Chlamydia trachomatis
aaacuuucuug

SEQ ID NO: 472855 - RNA, 18 nt, Chlamydia trachomatis
aaacuuugacaagcagua

SEQ ID NO: 472856 - RNA, 20 nt, Chlamydia trachomatis
aaacuuuaccgacuucaacu

SEQ ID NO: 472857 - RNA, 13 nt, Chlamydia trachomatis
aaacuucuuccaa

SEQ ID NO: 472858 - RNA, 23 nt, Chlamydia trachomatis
aaacuucuucgucugugagagag

SEQ ID NO: 472859 - RNA, 14 nt, Chlamydia trachomatis
cuugcgaugccucu

SEQ ID NO: 472860 - RNA, 19 nt, Chlamydia trachomatis
cuugcgaugccucuaacac

SEQ ID NO: 472861 - RNA, 13 nt, Chlamydia trachomatis
cuugcgcaucaaa

SEQ ID NO: 472862 - RNA, 15 nt, Chlamydia trachomatis
cuugcggagccgauu

SEQ ID NO: 472863 - RNA, 18 nt, Chlamydia trachomatis
cuugcuaagaacauaaca

SEQ ID NO: 472864 - RNA, 18 nt, Chlamydia trachomatis
cuugcuauccugcucaac

SEQ ID NO: 472865 - RNA, 20 nt, Chlamydia trachomatis
cuuggaauagguugccuuua

SEQ ID NO: 472866 - RNA, 22 nt, Chlamydia trachomatis
cuuggaccauaaaacuuguucc

SEQ ID NO: 472867 - RNA, 13 nt, Chlamydia trachomatis
cuuggauuucuuc

SEQ ID NO: 472868 - RNA, 18 nt, Chlamydia trachomatis
cuuggagagaaugaagaa

SEQ ID NO: 472869 - RNA, 10 nt, Chlamydia trachomatis
cuuggcaggc

SEQ ID NO: 472870 - RNA, 18 nt, Chlamydia trachomatis
cuuggccuuuuagcccuc

SEQ ID NO: 472871 - RNA, 16 nt, Chlamydia trachomatis
cuugggaaucuucuuc

SEQ ID NO: 472872 - RNA, 17 nt, Chlamydia trachomatis
cuuguagaaaaagaugg

SEQ ID NO: 472873 - RNA, 17 nt, Chlamydia trachomatis
cuuguagagaggcaaac

SEQ ID NO: 472874 - RNA, 20 nt, Chlamydia trachomatis
cuuguagugaaguucccuuu

SEQ ID NO: 472875 - RNA, 19 nt, Chlamydia trachomatis
cuuguaacuaagcuucuca

SEQ ID NO: 472876 - RNA, 14 nt, Chlamydia trachomatis
cuuguaauaucaaa

SEQ ID NO: 472877 - RNA, 20 nt, Chlamydia trachomatis
cuuguaucgcaagguugacu

SEQ ID NO: 472878 - RNA, 18 nt, Chlamydia trachomatis
cuuguaugguuuguccuu

SEQ ID NO: 472879 - RNA, 18 nt, Chlamydia trachomatis
cuugucaaacuaggcaau

SEQ ID NO: 472880 - RNA, 11 nt, Chlamydia trachomatis
aaacuuuucug

SEQ ID NO: 472881 - RNA, 22 nt, Chlamydia trachomatis
aaacuuuucugcagagcacaaa

SEQ ID NO: 472882 - RNA, 22 nt, Chlamydia trachomatis
cuugguuuugucucgcagcacc

SEQ ID NO: 472883 - RNA, 13 nt, Chlamydia trachomatis
cuuggugcagaag

SEQ ID NO: 472884 - RNA, 20 nt, Chlamydia trachomatis
cuuggugcagaagaauagga

SEQ ID NO: 472885 - RNA, 20 nt, Chlamydia trachomatis
cuuggggcgggcgacaugcu

SEQ ID NO: 472886 - RNA, 14 nt, Chlamydia trachomatis
cuuguucugcugcu

SEQ ID NO: 472887 - RNA, 20 nt, Chlamydia trachomatis
cuuguucgguauugaaagca

SEQ ID NO: 472888 - RNA, 15 nt, Chlamydia trachomatis
aaagaaauagcuauc

SEQ ID NO: 472889 - RNA, 22 nt, Chlamydia trachomatis
aaagaacauauuaggagcaaga

SEQ ID NO: 472890 - RNA, 22 nt, Chlamydia trachomatis
aaagaacguuucgucucuuuaa

SEQ ID NO: 472891 - RNA, 19 nt, Chlamydia trachomatis
aaagaacucccuccaaaaa

SEQ ID NO: 472892 - RNA, 22 nt, Chlamydia trachomatis
aaagaacucccuccaaaaaaga

SEQ ID NO: 472893 - RNA, 20 nt, Chlamydia trachomatis
aaagaagaaucuucuucgaa

SEQ ID NO: 472894 - RNA, 14 nt, Chlamydia trachomatis
cuuguuucaaagau

SEQ ID NO: 472895 - RNA, 20 nt, Chlamydia trachomatis
cuuguuuuauacucuaaaag

SEQ ID NO: 472896 - RNA, 21 nt, Chlamydia trachomatis
cuuguuuugcucgagaaauga

SEQ ID NO: 472897 - RNA, 16 nt, Chlamydia trachomatis
cuuguuuuuuaagagu

SEQ ID NO: 472898 - RNA, 20 nt, Chlamydia trachomatis
cuugucucucgaauagcucc

SEQ ID NO: 472899 - RNA, 11 nt, Chlamydia trachomatis
aaagaaaaaaa

SEQ ID NO: 472900 - RNA, 18 nt, Chlamydia trachomatis
aaagaaaaaaagaggucu

SEQ ID NO: 472901 - RNA, 12 nt, Chlamydia trachomatis
aaagaaaaauaa

SEQ ID NO: 472902 - RNA, 16 nt, Chlamydia trachomatis
aaagaaaaauaaaaau

SEQ ID NO: 472903 - RNA, 19 nt, Chlamydia trachomatis
aaagaaaaauaaaaauagu

SEQ ID NO: 472904 - RNA, 14 nt, Chlamydia trachomatis
aaagaaaagcuuuc

SEQ ID NO: 472905 - RNA, 14 nt, Chlamydia trachomatis
aaagaaacaaaacg

SEQ ID NO: 472906 - RNA, 15 nt, Chlamydia trachomatis
cuugugaggagcucu

SEQ ID NO: 472907 - RNA, 14 nt, Chlamydia trachomatis
cuugugauaucucc

SEQ ID NO: 472908 - RNA, 23 nt, Chlamydia trachomatis
cuuguguugagccccuugaaagg

SEQ ID NO: 472909 - RNA, 18 nt, Chlamydia trachomatis
cuuguucccacaccaucu

SEQ ID NO: 472910 - RNA, 15 nt, Chlamydia trachomatis
aaagacagaacaaac

SEQ ID NO: 472911 - RNA, 21 nt, Chlamydia trachomatis
aaagacagaacaaacgaagga

SEQ ID NO: 472912 - RNA, 12 nt, Chlamydia trachomatis
aaagaauuugcu

SEQ ID NO: 472913 - RNA, 17 nt, Chlamydia trachomatis
aaagaauuuuuagggaa

SEQ ID NO: 472914 - RNA, 15 nt, Chlamydia trachomatis
aaagaaucuuugucu

SEQ ID NO: 472915 - RNA, 17 nt, Chlamydia trachomatis
aaagaauggaucucccu

SEQ ID NO: 472916 - RNA, 21 nt, Chlamydia trachomatis
aaagaagccauaguagaaauu

SEQ ID NO: 472917 - RNA, 12 nt, Chlamydia trachomatis
aaagaagcuuuu

SEQ ID NO: 472918 - RNA, 14 nt, Chlamydia trachomatis
aaagaaucuaaaaa

SEQ ID NO: 472919 - RNA, 14 nt, Chlamydia trachomatis
cuuuaacaucuuua

SEQ ID NO: 472920 - RNA, 16 nt, Chlamydia trachomatis
cuuuaagguacuucua

SEQ ID NO: 472921 - RNA, 23 nt, Chlamydia trachomatis
cuuuacaucccuugaacuagaaa

SEQ ID NO: 472922 - RNA, 22 nt, Chlamydia trachomatis
cuuuaccaaagaauucuugcua

SEQ ID NO: 472923 - RNA, 14 nt, Chlamydia trachomatis
cuuuauguaaggaa

SEQ ID NO: 472924 - RNA, 16 nt, Chlamydia trachomatis
cuuuaugacuguugau

SEQ ID NO: 472925 - RNA, 23 nt, Chlamydia trachomatis
cuuuaugacuguugaugaugucc

SEQ ID NO: 472926 - RNA, 17 nt, Chlamydia trachomatis
cuuuacuuucuuugcua

SEQ ID NO: 472927 - RNA, 18 nt, Chlamydia trachomatis
cuuucagaugcacuuccu

SEQ ID NO: 472928 - RNA, 21 nt, Chlamydia trachomatis
cuuuccaagaaucaaaaaguu

SEQ ID NO: 472929 - RNA, 24 nt, Chlamydia trachomatis
cuuuccuagcgaagucuucuauca

SEQ ID NO: 472930 - RNA, 21 nt, Chlamydia trachomatis
cuuucuggaaucauucaucuu

SEQ ID NO: 472931 - RNA, 22 nt, Chlamydia trachomatis
cuuucuuacgaccguauuuuuu

SEQ ID NO: 472932 - RNA, 16 nt, Chlamydia trachomatis
cuuucuuacuccuucu

SEQ ID NO: 472933 - RNA, 17 nt, Chlamydia trachomatis
cuuugaacaaauuuauc

SEQ ID NO: 472934 - RNA, 13 nt, Chlamydia trachomatis
cuuugaagcgcuu

SEQ ID NO: 472935 - RNA, 19 nt, Chlamydia trachomatis
cuuugaagguaagaaaguc

SEQ ID NO: 472936 - RNA, 13 nt, Chlamydia trachomatis
cuuuggaagaggc

SEQ ID NO: 472937 - RNA, 14 nt, Chlamydia trachomatis
cuuuggaagaggcg

SEQ ID NO: 472938 - RNA, 19 nt, Chlamydia trachomatis
cuuugaggacugacagaag

SEQ ID NO: 472939 - RNA, 21 nt, Chlamydia trachomatis
cuuugaguccaacgcugcgcu

SEQ ID NO: 472940 - RNA, 19 nt, Chlamydia trachomatis
cuuugauaauacucuucua

SEQ ID NO: 472941 - RNA, 21 nt, Chlamydia trachomatis
cuuugggauagauagcuccaa

SEQ ID NO: 472942 - RNA, 18 nt, Chlamydia trachomatis
cuuuggcagaaccuucca

SEQ ID NO: 472943 - RNA, 19 nt, Chlamydia trachomatis
cuuuggcagaaccuuccac

SEQ ID NO: 472944 - RNA, 16 nt, Chlamydia trachomatis
cuuuguaaaauaccua

SEQ ID NO: 472945 - RNA, 13 nt, Chlamydia trachomatis
cuuuuaagggaau

SEQ ID NO: 472946 - RNA, 14 nt, Chlamydia trachomatis
cuuuuaauacuuua

SEQ ID NO: 472947 - RNA, 16 nt, Chlamydia trachomatis
gaaaaacagaaagaaa

SEQ ID NO: 472948 - RNA, 17 nt, Chlamydia trachomatis
gaaaaagaagaucccau

SEQ ID NO: 472949 - RNA, 19 nt, Chlamydia trachomatis
gaaaaagaagcuaauagcu

SEQ ID NO: 472950 - RNA, 20 nt, Chlamydia trachomatis
gaaaaaaggucucucuuuau

SEQ ID NO: 472951 - RNA, 13 nt, Chlamydia trachomatis
gaaaaaauaaugg

SEQ ID NO: 472952 - RNA, 15 nt, Chlamydia trachomatis
cuuuuuuuauaaagg

SEQ ID NO: 472953 - RNA, 14 nt, Chlamydia trachomatis
cuuuuuuuauucuu

SEQ ID NO: 472954 - RNA, 15 nt, Chlamydia trachomatis
cuuuuucauuuuaug

SEQ ID NO: 472955 - RNA, 12 nt, Chlamydia trachomatis
cuuuuuccucuu

SEQ ID NO: 472956 - RNA, 16 nt, Chlamydia trachomatis
cuuuuugauuuuucuu

SEQ ID NO: 472957 - RNA, 21 nt, Chlamydia trachomatis
cuuuuuggacgaggguuuaaa

SEQ ID NO: 472958 - RNA, 15 nt, Chlamydia trachomatis
cuuuugaucuuucca

SEQ ID NO: 472959 - RNA, 21 nt, Chlamydia trachomatis
cuuuuggaagaucucuuucuc

SEQ ID NO: 472960 - RNA, 22 nt, Chlamydia trachomatis
cuuuuacaauagcauuugucuu

SEQ ID NO: 472961 - RNA, 16 nt, Chlamydia trachomatis
cuuuuaggugcgcaua

SEQ ID NO: 472962 - RNA, 23 nt, Chlamydia trachomatis
cuuuugguucugccaguuaauca

SEQ ID NO: 472963 - RNA, 15 nt, Chlamydia trachomatis
cuuuuuaaaucaauu

SEQ ID NO: 472964 - RNA, 15 nt, Chlamydia trachomatis
cuuuuuaauuuucug

SEQ ID NO: 472965 - RNA, 22 nt, Chlamydia trachomatis
cuuuuuauccuacgguaucaau

SEQ ID NO: 472966 - RNA, 16 nt, Chlamydia trachomatis
gaaaauagguaaagaa

SEQ ID NO: 472967 - RNA, 14 nt, Chlamydia trachomatis
gaaaauagauuuuc

SEQ ID NO: 472968 - RNA, 18 nt, Chlamydia trachomatis
gaaaauagcaucucugua

SEQ ID NO: 472969 - RNA, 22 nt, Chlamydia trachomatis
gaaaauauggcucccagagaau

SEQ ID NO: 472970 - RNA, 13 nt, Chlamydia trachomatis
gaaaauuucucuu

SEQ ID NO: 472971 - RNA, 23 nt, Chlamydia trachomatis
gaaaagccuucuuucaaaagaag

SEQ ID NO: 472972 - RNA, 13 nt, Chlamydia trachomatis
gaaaaagagaaau

SEQ ID NO: 472973 - RNA, 13 nt, Chlamydia trachomatis
gaaaaaucacaau

SEQ ID NO: 472974 - RNA, 18 nt, Chlamydia trachomatis
gaaacaaggcuaagaaag

SEQ ID NO: 472975 - RNA, 17 nt, Chlamydia trachomatis
gaaacacaccgggagca

SEQ ID NO: 472976 - RNA, 15 nt, Chlamydia trachomatis
gaaacaccucuccuu

SEQ ID NO: 472977 - RNA, 17 nt, Chlamydia trachomatis
gaaacagccugcuuucu

SEQ ID NO: 472978 - RNA, 19 nt, Chlamydia trachomatis
gaaacagccugcuuucuuc

SEQ ID NO: 472979 - RNA, 20 nt, Chlamydia trachomatis
gaaacagcuucuucuucucu

SEQ ID NO: 472980 - RNA, 21 nt, Chlamydia trachomatis
gaaacauuugcgugauaaaaa

SEQ ID NO: 472981 - RNA, 13 nt, Chlamydia trachomatis
gaaaccaacaaga

SEQ ID NO: 472982 - RNA, 18 nt, Chlamydia trachomatis
gaaaccccucuuucucuc

SEQ ID NO: 472983 - RNA, 20 nt, Chlamydia trachomatis
gaaaccccaauguuucccau

SEQ ID NO: 472984 - RNA, 13 nt, Chlamydia trachomatis
gaaacccaacgca

SEQ ID NO: 472985 - RNA, 21 nt, Chlamydia trachomatis
gaaaccuguuucugaaucaaa

SEQ ID NO: 472986 - RNA, 14 nt, Chlamydia trachomatis
gaaacuuuccuacu

SEQ ID NO: 472987 - RNA, 14 nt, Chlamydia trachomatis
gaaagagaaucauc

SEQ ID NO: 472988 - RNA, 21 nt, Chlamydia trachomatis
gaaagagcuuagcucccugcu

SEQ ID NO: 472989 - RNA, 12 nt, Chlamydia trachomatis
gaaagagcuucu

SEQ ID NO: 472990 - RNA, 19 nt, Chlamydia trachomatis
gaaagaggcuucgauaaga

SEQ ID NO: 472991 - RNA, 18 nt, Chlamydia trachomatis
gaaagagggguuucauuu

SEQ ID NO: 472992 - RNA, 17 nt, Chlamydia trachomatis
gaaagaaccucaauagc

SEQ ID NO: 472993 - RNA, 15 nt, Chlamydia trachomatis
gaaagaaugagguaa

SEQ ID NO: 472994 - RNA, 16 nt, Chlamydia trachomatis
gaaagagugauucggu

SEQ ID NO: 472995 - RNA, 13 nt, Chlamydia trachomatis
gaaagccuaucgc

SEQ ID NO: 472996 - RNA, 19 nt, Chlamydia trachomatis
gaaauccccagucucucca

SEQ ID NO: 472997 - RNA, 15 nt, Chlamydia trachomatis
gaaauaugacagagc

SEQ ID NO: 472998 - RNA, 13 nt, Chlamydia trachomatis
gaaauaaaaaccu

SEQ ID NO: 472999 - RNA, 12 nt, Chlamydia trachomatis
gaaauaaaaagc

SEQ ID NO: 473000 - RNA, 22 nt, Chlamydia trachomatis
gaaauaaaaagcccagaacaac

SEQ ID NO: 473001 - RNA, 15 nt, Chlamydia trachomatis
gaaauaaaauggaaa

SEQ ID NO: 473002 - RNA, 18 nt, Chlamydia trachomatis
gaaauagcuuaccucaau

SEQ ID NO: 473003 - RNA, 19 nt, Chlamydia trachomatis
gaaauaggauuuaaaccau

SEQ ID NO: 473004 - RNA, 19 nt, Chlamydia trachomatis
gaaaguuccgguauauucu

SEQ ID NO: 473005 - RNA, 22 nt, Chlamydia trachomatis
gaaaguuccgguauauucuuca

SEQ ID NO: 473006 - RNA, 19 nt, Chlamydia trachomatis
gaaaggucugcauauuuaa

SEQ ID NO: 473007 - RNA, 12 nt, Chlamydia trachomatis
gaaaguccugcu

SEQ ID NO: 473008 - RNA, 22 nt, Chlamydia trachomatis
gaaaguccugcuucuuuuuccc

SEQ ID NO: 473009 - RNA, 14 nt, Chlamydia trachomatis
gaaagggaggagga

SEQ ID NO: 473010 - RNA, 23 nt, Chlamydia trachomatis
gaaauguuugaucugagaaagcu

SEQ ID NO: 473011 - RNA, 20 nt, Chlamydia trachomatis
aaagagcuaaacuucuuguu

SEQ ID NO: 473012 - RNA, 17 nt, Chlamydia trachomatis
aaagagcuucuagaaau

SEQ ID NO: 473013 - RNA, 17 nt, Chlamydia trachomatis
gaaauuaguaauaaagg

SEQ ID NO: 473014 - RNA, 23 nt, Chlamydia trachomatis
gaaaucuucggcagaagcugcag

SEQ ID NO: 473015 - RNA, 21 nt, Chlamydia trachomatis
gaaaucuucucuugaaucaaa

SEQ ID NO: 473016 - RNA, 15 nt, Chlamydia trachomatis
gaacaagcaaaacau

SEQ ID NO: 473017 - RNA, 16 nt, Chlamydia trachomatis
gaacaagcaaaacaua

SEQ ID NO: 473018 - RNA, 13 nt, Chlamydia trachomatis
gaacaacugcuga

SEQ ID NO: 473019 - RNA, 14 nt, Chlamydia trachomatis
gaacaacuucucuu

SEQ ID NO: 473020 - RNA, 20 nt, Chlamydia trachomatis
gaacaacuugaucuacagca

SEQ ID NO: 473021 - RNA, 14 nt, Chlamydia trachomatis
gaacaauuugugau

SEQ ID NO: 473022 - RNA, 21 nt, Chlamydia trachomatis
gaacagauuuagagaauaauc

SEQ ID NO: 473023 - RNA, 17 nt, Chlamydia trachomatis
gaacagcaagaggcccu

SEQ ID NO: 473024 - RNA, 14 nt, Chlamydia trachomatis
gaacagguuauaga

SEQ ID NO: 473025 - RNA, 18 nt, Chlamydia trachomatis
gaagaaguuuacgaacaa

SEQ ID NO: 473026 - RNA, 12 nt, Chlamydia trachomatis
gaagaaggagau

SEQ ID NO: 473027 - RNA, 18 nt, Chlamydia trachomatis
gaagaauucgcacuaucu

SEQ ID NO: 473028 - RNA, 13 nt, Chlamydia trachomatis
gaagaccaaaaau

SEQ ID NO: 473029 - RNA, 15 nt, Chlamydia trachomatis
gaagaagagcugcug

SEQ ID NO: 473030 - RNA, 14 nt, Chlamydia trachomatis
gaagaagaggguuu

SEQ ID NO: 473031 - RNA, 16 nt, Chlamydia trachomatis
gaagaagauguuguua

SEQ ID NO: 473032 - RNA, 19 nt, Chlamydia trachomatis
gaacaucggaccacauucu

SEQ ID NO: 473033 - RNA, 23 nt, Chlamydia trachomatis
gaagaacugucuucuuucaaaga

SEQ ID NO: 473034 - RNA, 15 nt, Chlamydia trachomatis
gaagaagaagaacug

SEQ ID NO: 473035 - RNA, 17 nt, Chlamydia trachomatis
gaacaugggcgucucuu

SEQ ID NO: 473036 - RNA, 13 nt, Chlamydia trachomatis
gaacaucgagaaa

SEQ ID NO: 473037 - RNA, 15 nt, Chlamydia trachomatis
gaacaucgagaaaau

SEQ ID NO: 473038 - RNA, 17 nt, Chlamydia trachomatis
gaagaucuuuccuugug

SEQ ID NO: 473039 - RNA, 15 nt, Chlamydia trachomatis
gaagaucucuuucuc

SEQ ID NO: 473040 - RNA, 19 nt, Chlamydia trachomatis
gaagaucucuuucucuaga

SEQ ID NO: 473041 - RNA, 23 nt, Chlamydia trachomatis
gaagaucuucagaaaucuucuua

SEQ ID NO: 473042 - RNA, 21 nt, Chlamydia trachomatis
gaagagcugcugucagaagaa

SEQ ID NO: 473043 - RNA, 19 nt, Chlamydia trachomatis
gaagaucccaacaggagau

SEQ ID NO: 473044 - RNA, 21 nt, Chlamydia trachomatis
gaagacccguuuucucuugaa

SEQ ID NO: 473045 - RNA, 15 nt, Chlamydia trachomatis
gaagagagagccucc

SEQ ID NO: 473046 - RNA, 14 nt, Chlamydia trachomatis
gaagagauguuugu

SEQ ID NO: 473047 - RNA, 23 nt, Chlamydia trachomatis
gaagagcagagguaugcagacuc

SEQ ID NO: 473048 - RNA, 15 nt, Chlamydia trachomatis
gaagagccaucaaau

SEQ ID NO: 473049 - RNA, 13 nt, Chlamydia trachomatis
gaagauuugcaaa

SEQ ID NO: 473050 - RNA, 17 nt, Chlamydia trachomatis
gaagauguuguuaaagc

SEQ ID NO: 473051 - RNA, 15 nt, Chlamydia trachomatis
gaagauucgcugcug

SEQ ID NO: 473052 - RNA, 18 nt, Chlamydia trachomatis
gaagcauagggcuaagaa

SEQ ID NO: 473053 - RNA, 17 nt, Chlamydia trachomatis
gaagcauucucucauaa

SEQ ID NO: 473054 - RNA, 23 nt, Chlamydia trachomatis
gaagcauucucucauaagaucuu

SEQ ID NO: 473055 - RNA, 18 nt, Chlamydia trachomatis
gaagcauuucucuccaaa

SEQ ID NO: 473056 - RNA, 23 nt, Chlamydia trachomatis
gaagcgacagcccaagaucuucc

SEQ ID NO: 473057 - RNA, 22 nt, Chlamydia trachomatis
gaagcguucgcgucuagcuuuu

SEQ ID NO: 473058 - RNA, 22 nt, Chlamydia trachomatis
gaagcuaaaaaauccaggauuc

SEQ ID NO: 473059 - RNA, 20 nt, Chlamydia trachomatis
gaagcuaauagcuugaagaa

SEQ ID NO: 473060 - RNA, 17 nt, Chlamydia trachomatis
aaagauagugcagaaga

SEQ ID NO: 473061 - RNA, 19 nt, Chlamydia trachomatis
gaagugguuaaugucucuu

SEQ ID NO: 473062 - RNA, 22 nt, Chlamydia trachomatis
gaaguucuuuuuccucuucaga

SEQ ID NO: 473063 - RNA, 13 nt, Chlamydia trachomatis
gaaguugagaagc

SEQ ID NO: 473064 - RNA, 14 nt, Chlamydia trachomatis
gaaguugagaagcg

SEQ ID NO: 473065 - RNA, 22 nt, Chlamydia trachomatis
gaauaaagguaaucuguagaga

SEQ ID NO: 473066 - RNA, 11 nt, Chlamydia trachomatis
gaauaaucuua

SEQ ID NO: 473067 - RNA, 23 nt, Chlamydia trachomatis
gaauaaugauucccagggagagu

SEQ ID NO: 473068 - RNA, 14 nt, Chlamydia trachomatis
gaauaaugauuuuu

SEQ ID NO: 473069 - RNA, 23 nt, Chlamydia trachomatis
gaauacaagaaaggccuauccaa

SEQ ID NO: 473070 - RNA, 15 nt, Chlamydia trachomatis
gaauacgaaaugaca

SEQ ID NO: 473071 - RNA, 14 nt, Chlamydia trachomatis
gaauacgggaugcg

SEQ ID NO: 473072 - RNA, 19 nt, Chlamydia trachomatis
gaagcugcaguuucugaga

SEQ ID NO: 473073 - RNA, 16 nt, Chlamydia trachomatis
gaagcuccucuucuuc

SEQ ID NO: 473074 - RNA, 22 nt, Chlamydia trachomatis
gaagcucuucgagucuucccuu

SEQ ID NO: 473075 - RNA, 19 nt, Chlamydia trachomatis
gaaggcuuuucuauuuuua

SEQ ID NO: 473076 - RNA, 18 nt, Chlamydia trachomatis
gaaggugugaaagaaaaa

SEQ ID NO: 473077 - RNA, 19 nt, Chlamydia trachomatis
gaaggugugaaagaaaaau

SEQ ID NO: 473078 - RNA, 20 nt, Chlamydia trachomatis
gaagucccuccuacuaagga

SEQ ID NO: 473079 - RNA, 21 nt, Chlamydia trachomatis
gaaguccgauaggaaaaaaga

SEQ ID NO: 473080 - RNA, 22 nt, Chlamydia trachomatis
gaagucaugcggauuaaagaag

SEQ ID NO: 473081 - RNA, 18 nt, Chlamydia trachomatis
gaauaucguaaacaacca

SEQ ID NO: 473082 - RNA, 20 nt, Chlamydia trachomatis
gaauaucguaaacaaccaaa

SEQ ID NO: 473083 - RNA, 17 nt, Chlamydia trachomatis
gaauagggggaguucua

SEQ ID NO: 473084 - RNA, 22 nt, Chlamydia trachomatis
gaauagggagguuuuguucgua

SEQ ID NO: 473085 - RNA, 13 nt, Chlamydia trachomatis
gaauaguauacuu

SEQ ID NO: 473086 - RNA, 15 nt, Chlamydia trachomatis
aaagaugaagaaguu

SEQ ID NO: 473087 - RNA, 16 nt, Chlamydia trachomatis
aaagaugaagaaguuu

SEQ ID NO: 473088 - RNA, 12 nt, Chlamydia trachomatis
aaagaucuucaa

SEQ ID NO: 473089 - RNA, 20 nt, Chlamydia trachomatis
aaagaucuucaacaagauuu

SEQ ID NO: 473090 - RNA, 18 nt, Chlamydia trachomatis
gaauacuguuuguuaucu

SEQ ID NO: 473091 - RNA, 23 nt, Chlamydia trachomatis
aaagaugcgaucuccucauccuu

SEQ ID NO: 473092 - RNA, 17 nt, Chlamydia trachomatis
gaauauacccauuugcc

SEQ ID NO: 473093 - RNA, 16 nt, Chlamydia trachomatis
gaauauaccccgaaca

SEQ ID NO: 473094 - RNA, 22 nt, Chlamydia trachomatis
gaaugcagaucauaucugcagc

SEQ ID NO: 473095 - RNA, 15 nt, Chlamydia trachomatis
gaaucuaaaaagcca

SEQ ID NO: 473096 - RNA, 21 nt, Chlamydia trachomatis
gaaucuaaaaagccauacaaa

SEQ ID NO: 473097 - RNA, 23 nt, Chlamydia trachomatis
gaaucucgagcuaagaaaauaaa

SEQ ID NO: 473098 - RNA, 16 nt, Chlamydia trachomatis
gaaucgucucucuggc

SEQ ID NO: 473099 - RNA, 13 nt, Chlamydia trachomatis
gaaucggaugagg

SEQ ID NO: 473100 - RNA, 18 nt, Chlamydia trachomatis
gaaucgguacgaauccuc

SEQ ID NO: 473101 - RNA, 14 nt, Chlamydia trachomatis
gacaagccuucagg

SEQ ID NO: 473102 - RNA, 12 nt, Chlamydia trachomatis
gacaagcacgua

SEQ ID NO: 473103 - RNA, 13 nt, Chlamydia trachomatis
gaauuuucaucaa

SEQ ID NO: 473104 - RNA, 12 nt, Chlamydia trachomatis
gacaaauuucua

SEQ ID NO: 473105 - RNA, 17 nt, Chlamydia trachomatis
gacaaauuucuauagaa

SEQ ID NO: 473106 - RNA, 21 nt, Chlamydia trachomatis
gacaaauugcacuaaagagcu

SEQ ID NO: 473107 - RNA, 17 nt, Chlamydia trachomatis
gacaacaaguugauaca

SEQ ID NO: 473108 - RNA, 21 nt, Chlamydia trachomatis
gacaacagggucacugggauu

SEQ ID NO: 473109 - RNA, 14 nt, Chlamydia trachomatis
gaauggauacuuuu

SEQ ID NO: 473110 - RNA, 17 nt, Chlamydia trachomatis
gaaugcuguacagacug

SEQ ID NO: 473111 - RNA, 18 nt, Chlamydia trachomatis
gaauggccuguuucauaa

SEQ ID NO: 473112 - RNA, 21 nt, Chlamydia trachomatis
gaaugggaagcucggucucau

SEQ ID NO: 473113 - RNA, 17 nt, Chlamydia trachomatis
gaauggggaggaauacu

SEQ ID NO: 473114 - RNA, 14 nt, Chlamydia trachomatis
gaauucauagaagu

SEQ ID NO: 473115 - RNA, 18 nt, Chlamydia trachomatis
gaauucuccaggagauug

SEQ ID NO: 473116 - RNA, 14 nt, Chlamydia trachomatis
gaauucuuucauuc

SEQ ID NO: 473117 - RNA, 20 nt, Chlamydia trachomatis
gaauucuuucauucguuucu

SEQ ID NO: 473118 - RNA, 13 nt, Chlamydia trachomatis
gaauuucuuccuc

SEQ ID NO: 473119 - RNA, 17 nt, Chlamydia trachomatis
gaauuuguguuaaauca

SEQ ID NO: 473120 - RNA, 18 nt, Chlamydia trachomatis
gaauuuguguuaaaucau

SEQ ID NO: 473121 - RNA, 19 nt, Chlamydia trachomatis
gaauuuuaucuaaaaaggc

SEQ ID NO: 473122 - RNA, 21 nt, Chlamydia trachomatis
gacacuaucacuguugagaaa

SEQ ID NO: 473123 - RNA, 23 nt, Chlamydia trachomatis
gacacuaucacuguugagaaaaa

SEQ ID NO: 473124 - RNA, 16 nt, Chlamydia trachomatis
gacacuauuaaaaagg

SEQ ID NO: 473125 - RNA, 21 nt, Chlamydia trachomatis
gacagaacaaacgaaggagcu

SEQ ID NO: 473126 - RNA, 19 nt, Chlamydia trachomatis
gacagaaguuagaaucugc

SEQ ID NO: 473127 - RNA, 19 nt, Chlamydia trachomatis
gacagcaccaagcuccaca

SEQ ID NO: 473128 - RNA, 14 nt, Chlamydia trachomatis
gacauacauaagaa

SEQ ID NO: 473129 - RNA, 22 nt, Chlamydia trachomatis
gacaucgcuguauuuccuucga

SEQ ID NO: 473130 - RNA, 14 nt, Chlamydia trachomatis
gacaucuaaagucu

SEQ ID NO: 473131 - RNA, 16 nt, Chlamydia trachomatis
gacauuaguauagucu

SEQ ID NO: 473132 - RNA, 14 nt, Chlamydia trachomatis
gacauucugccgac

SEQ ID NO: 473133 - RNA, 16 nt, Chlamydia trachomatis
gacauucucggaaaag

SEQ ID NO: 473134 - RNA, 13 nt, Chlamydia trachomatis
gacauugaacauu

SEQ ID NO: 473135 - RNA, 16 nt, Chlamydia trachomatis
gaccagaucauagaaa

SEQ ID NO: 473136 - RNA, 15 nt, Chlamydia trachomatis
gacccuuccaaauuu

SEQ ID NO: 473137 - RNA, 17 nt, Chlamydia trachomatis
gaccuaauaucugcucu

SEQ ID NO: 473138 - RNA, 13 nt, Chlamydia trachomatis
gaccuacaaagau

SEQ ID NO: 473139 - RNA, 20 nt, Chlamydia trachomatis
gaccuacaaagauaaucaaa

SEQ ID NO: 473140 - RNA, 17 nt, Chlamydia trachomatis
gacgaauccagaaagag

SEQ ID NO: 473141 - RNA, 22 nt, Chlamydia trachomatis
gacgaccuacgcguuacgaaug

SEQ ID NO: 473142 - RNA, 16 nt, Chlamydia trachomatis
gacgauucucaugcac

SEQ ID NO: 473143 - RNA, 18 nt, Chlamydia trachomatis
gacgauucucaugcacug

SEQ ID NO: 473144 - RNA, 23 nt, Chlamydia trachomatis
gacgcuguccaaucguauaauaa

SEQ ID NO: 473145 - RNA, 20 nt, Chlamydia trachomatis
gacgcugaucaacaagagcu

SEQ ID NO: 473146 - RNA, 19 nt, Chlamydia trachomatis
gacguuuagccuccaucuc

SEQ ID NO: 473147 - RNA, 18 nt, Chlamydia trachomatis
gacuccagcuucuccauc

SEQ ID NO: 473148 - RNA, 17 nt, Chlamydia trachomatis
gacucucauaagaauac

SEQ ID NO: 473149 - RNA, 12 nt, Chlamydia trachomatis
gacucuaauaaa

SEQ ID NO: 473150 - RNA, 19 nt, Chlamydia trachomatis
gacucgaaggagcuaagaa

SEQ ID NO: 473151 - RNA, 20 nt, Chlamydia trachomatis
gacugcggcagcugcuugga

SEQ ID NO: 473152 - RNA, 12 nt, Chlamydia trachomatis
gacugccgaacu

SEQ ID NO: 473153 - RNA, 14 nt, Chlamydia trachomatis
gacugcaagaucau

SEQ ID NO: 473154 - RNA, 19 nt, Chlamydia trachomatis
gacugacagaaguuagaau

SEQ ID NO: 473155 - RNA, 22 nt, Chlamydia trachomatis
gacugcuccuaacccuuguaca

SEQ ID NO: 473156 - RNA, 14 nt, Chlamydia trachomatis
gacugcgcuaugag

SEQ ID NO: 473157 - RNA, 17 nt, Chlamydia trachomatis
gacuucaacuucuccag

SEQ ID NO: 473158 - RNA, 21 nt, Chlamydia trachomatis
gacuguugaugauguccaaag

SEQ ID NO: 473159 - RNA, 14 nt, Chlamydia trachomatis
gacuucuucgucca

SEQ ID NO: 473160 - RNA, 21 nt, Chlamydia trachomatis
gacuuggguaagagcagagcu

SEQ ID NO: 473161 - RNA, 20 nt, Chlamydia trachomatis
gacuugcuacggaaaccaau

SEQ ID NO: 473162 - RNA, 18 nt, Chlamydia trachomatis
gacuuuccucugguacuc

SEQ ID NO: 473163 - RNA, 17 nt, Chlamydia trachomatis
gacuuuuauucacccaa

SEQ ID NO: 473164 - RNA, 15 nt, Chlamydia trachomatis
gacuuuuuagcaucu

SEQ ID NO: 473165 - RNA, 16 nt, Chlamydia trachomatis
gagaaaaugaugaaaa

SEQ ID NO: 473166 - RNA, 20 nt, Chlamydia trachomatis
gagaaaaugaugaaaaagaa

SEQ ID NO: 473167 - RNA, 13 nt, Chlamydia trachomatis
gagaaaagaaaag

SEQ ID NO: 473168 - RNA, 17 nt, Chlamydia trachomatis
gagaaagcuucuaagaa

SEQ ID NO: 473169 - RNA, 18 nt, Chlamydia trachomatis
gagaaagagggguuucau

SEQ ID NO: 473170 - RNA, 14 nt, Chlamydia trachomatis
gagaaauaaucauc

SEQ ID NO: 473171 - RNA, 14 nt, Chlamydia trachomatis
aaagauuuccccaa

SEQ ID NO: 473172 - RNA, 23 nt, Chlamydia trachomatis
gagaacggcaauaaagaaauaac

SEQ ID NO: 473173 - RNA, 13 nt, Chlamydia trachomatis
gagaacagucucu

SEQ ID NO: 473174 - RNA, 20 nt, Chlamydia trachomatis
aaagcaauccgcuuggaaua

SEQ ID NO: 473175 - RNA, 18 nt, Chlamydia trachomatis
aaagauuucuucuguagc

SEQ ID NO: 473176 - RNA, 16 nt, Chlamydia trachomatis
aaagcaaaacauccau

SEQ ID NO: 473177 - RNA, 12 nt, Chlamydia trachomatis
gagaagaaaaac

SEQ ID NO: 473178 - RNA, 22 nt, Chlamydia trachomatis
gagaagaacacacuuuccccau

SEQ ID NO: 473179 - RNA, 11 nt, Chlamydia trachomatis
gagaagagcca

SEQ ID NO: 473180 - RNA, 16 nt, Chlamydia trachomatis
gagaaguaaaacagaa

SEQ ID NO: 473181 - RNA, 16 nt, Chlamydia trachomatis
gagaagcaucucaaug

SEQ ID NO: 473182 - RNA, 17 nt, Chlamydia trachomatis
gagaauggguaagggga

SEQ ID NO: 473183 - RNA, 23 nt, Chlamydia trachomatis
gagaagucagaugaguuuaucuc

SEQ ID NO: 473184 - RNA, 18 nt, Chlamydia trachomatis
gagaauaccaaaauccuu

SEQ ID NO: 473185 - RNA, 21 nt, Chlamydia trachomatis
gagaauaccaaaauccuucgc

SEQ ID NO: 473186 - RNA, 11 nt, Chlamydia trachomatis
gagaauaccac

SEQ ID NO: 473187 - RNA, 22 nt, Chlamydia trachomatis
gagaccgucaaaaagaucuuca

SEQ ID NO: 473188 - RNA, 22 nt, Chlamydia trachomatis
gagacaacaaguugauacaaga

SEQ ID NO: 473189 - RNA, 17 nt, Chlamydia trachomatis
gagagcauucuucugaa

SEQ ID NO: 473190 - RNA, 14 nt, Chlamydia trachomatis
gagagccagcgagg

SEQ ID NO: 473191 - RNA, 12 nt, Chlamydia trachomatis
gagagccccacc

SEQ ID NO: 473192 - RNA, 20 nt, Chlamydia trachomatis
gagagccuugagugaaaaau

SEQ ID NO: 473193 - RNA, 12 nt, Chlamydia trachomatis
gagagagcaaua

SEQ ID NO: 473194 - RNA, 13 nt, Chlamydia trachomatis
gagagagccuuga

SEQ ID NO: 473195 - RNA, 21 nt, Chlamydia trachomatis
gagagagccuugagugaaaaa

SEQ ID NO: 473196 - RNA, 17 nt, Chlamydia trachomatis
gagagcaaaaucuucug

SEQ ID NO: 473197 - RNA, 12 nt, Chlamydia trachomatis
gagagaaucuuu

SEQ ID NO: 473198 - RNA, 15 nt, Chlamydia trachomatis
gagagaaugaagaau

SEQ ID NO: 473199 - RNA, 23 nt, Chlamydia trachomatis
gagauauaaucuaaagacaaaac

SEQ ID NO: 473200 - RNA, 23 nt, Chlamydia trachomatis
gagauaucacuaccagccccaca

SEQ ID NO: 473201 - RNA, 14 nt, Chlamydia trachomatis
gagaucauaaaguc

SEQ ID NO: 473202 - RNA, 17 nt, Chlamydia trachomatis
gagagcuuccacagcag

SEQ ID NO: 473203 - RNA, 17 nt, Chlamydia trachomatis
gagaugcuccucucuuu

SEQ ID NO: 473204 - RNA, 18 nt, Chlamydia trachomatis
gagauggaguaggggaau

SEQ ID NO: 473205 - RNA, 15 nt, Chlamydia trachomatis
gagaugaucgaguuc

SEQ ID NO: 473206 - RNA, 21 nt, Chlamydia trachomatis
gagcacaaaucuuucuuucua

SEQ ID NO: 473207 - RNA, 14 nt, Chlamydia trachomatis
gagcacaagcuguu

SEQ ID NO: 473208 - RNA, 21 nt, Chlamydia trachomatis
gagcagacgauauuuaagaua

SEQ ID NO: 473209 - RNA, 13 nt, Chlamydia trachomatis
aaagcagcggcaa

SEQ ID NO: 473210 - RNA, 16 nt, Chlamydia trachomatis
aaagcagcuaauucca

SEQ ID NO: 473211 - RNA, 23 nt, Chlamydia trachomatis
gagcauaagaauaaacaacaugg

SEQ ID NO: 473212 - RNA, 15 nt, Chlamydia trachomatis
gagcaugaccucaga

SEQ ID NO: 473213 - RNA, 18 nt, Chlamydia trachomatis
gagcaucaguaaaaauaa

SEQ ID NO: 473214 - RNA, 16 nt, Chlamydia trachomatis
gagcauguagccaagg

SEQ ID NO: 473215 - RNA, 17 nt, Chlamydia trachomatis
gagcauguagccaagga

SEQ ID NO: 473216 - RNA, 21 nt, Chlamydia trachomatis
gagcauguagccaaggaagau

SEQ ID NO: 473217 - RNA, 18 nt, Chlamydia trachomatis
gagcauggucucuguagu

SEQ ID NO: 473218 - RNA, 19 nt, Chlamydia trachomatis
gagcauguguuucuggaaa

SEQ ID NO: 473219 - RNA, 13 nt, Chlamydia trachomatis
gagccaucgccuu

SEQ ID NO: 473220 - RNA, 24 nt, Chlamydia trachomatis
gagccaucgccuucuauagcuaaa

SEQ ID NO: 473221 - RNA, 20 nt, Chlamydia trachomatis
gagcccaaggagaauaccac

SEQ ID NO: 473222 - RNA, 17 nt, Chlamydia trachomatis
gagccgcuuaagcuguu

SEQ ID NO: 473223 - RNA, 23 nt, Chlamydia trachomatis
gagccuguuuagaaagaggacga

SEQ ID NO: 473224 - RNA, 19 nt, Chlamydia trachomatis
gagccuguuucuuaucagc

SEQ ID NO: 473225 - RNA, 13 nt, Chlamydia trachomatis
gagccuugaguga

SEQ ID NO: 473226 - RNA, 20 nt, Chlamydia trachomatis
gagcccugcuucacagcuaa

SEQ ID NO: 473227 - RNA, 19 nt, Chlamydia trachomatis
gagcccuaggcgacacgcu

SEQ ID NO: 473228 - RNA, 17 nt, Chlamydia trachomatis
gagccuuuuauucuuca

SEQ ID NO: 473229 - RNA, 22 nt, Chlamydia trachomatis
gagcuuguucuucgaaauauug

SEQ ID NO: 473230 - RNA, 23 nt, Chlamydia trachomatis
gagcuuguucuucgaaauauugu

SEQ ID NO: 473231 - RNA, 19 nt, Chlamydia trachomatis
gagcuucucgcuacaaauc

SEQ ID NO: 473232 - RNA, 21 nt, Chlamydia trachomatis
gagcuucuuguuuagaggaga

SEQ ID NO: 473233 - RNA, 22 nt, Chlamydia trachomatis
gaggaauaagaggacuuucuuu

SEQ ID NO: 473234 - RNA, 16 nt, Chlamydia trachomatis
gaggaauacuagauuu

SEQ ID NO: 473235 - RNA, 11 nt, Chlamydia trachomatis
gagcuuugagg

SEQ ID NO: 473236 - RNA, 21 nt, Chlamydia trachomatis
gagcuuugauuaaccaaaaga

SEQ ID NO: 473237 - RNA, 14 nt, Chlamydia trachomatis
gagcuuugcagauc

SEQ ID NO: 473238 - RNA, 14 nt, Chlamydia trachomatis
gaggaaugugaaga

SEQ ID NO: 473239 - RNA, 19 nt, Chlamydia trachomatis
gaggauccuaaccaaaaaa

SEQ ID NO: 473240 - RNA, 15 nt, Chlamydia trachomatis
gaggaugauucccug

SEQ ID NO: 473241 - RNA, 21 nt, Chlamydia trachomatis
gaggauguggacgaacaaaaa

SEQ ID NO: 473242 - RNA, 22 nt, Chlamydia trachomatis
gaggauuauuccgagagaagcu

SEQ ID NO: 473243 - RNA, 20 nt, Chlamydia trachomatis
gaggauucgguaucugagcu

SEQ ID NO: 473244 - RNA, 15 nt, Chlamydia trachomatis
gaggcacaaaauccc

SEQ ID NO: 473245 - RNA, 19 nt, Chlamydia trachomatis
gaggcuuuaccguuacagg

SEQ ID NO: 473246 - RNA, 18 nt, Chlamydia trachomatis
gaggcuuuguccuggcca

SEQ ID NO: 473247 - RNA, 15 nt, Chlamydia trachomatis
gagggacgagcagcc

SEQ ID NO: 473248 - RNA, 18 nt, Chlamydia trachomatis
gagggauauuucuuccug

SEQ ID NO: 473249 - RNA, 13 nt, Chlamydia trachomatis
gaggcuguaacua

SEQ ID NO: 473250 - RNA, 12 nt, Chlamydia trachomatis
gaggcuuaaaga

SEQ ID NO: 473251 - RNA, 15 nt, Chlamydia trachomatis
gaggucuuauuaaaa

SEQ ID NO: 473252 - RNA, 20 nt, Chlamydia trachomatis
gagguuuaagucguacauua

SEQ ID NO: 473253 - RNA, 21 nt, Chlamydia trachomatis
gagguuuaggagagagcccuu

SEQ ID NO: 473254 - RNA, 17 nt, Chlamydia trachomatis
gaguaggcucuccuaau

SEQ ID NO: 473255 - RNA, 17 nt, Chlamydia trachomatis
gagucucuaaaaucgug

SEQ ID NO: 473256 - RNA, 20 nt, Chlamydia trachomatis
gaguaucuaucaauuguucu

SEQ ID NO: 473257 - RNA, 19 nt, Chlamydia trachomatis
gagucccuuaacacccucu

SEQ ID NO: 473258 - RNA, 16 nt, Chlamydia trachomatis
gaguccgcaaacaaaa

SEQ ID NO: 473259 - RNA, 16 nt, Chlamydia trachomatis
gauaaagcuaucccaa

SEQ ID NO: 473260 - RNA, 18 nt, Chlamydia trachomatis
gauaaaacccuaagacua

SEQ ID NO: 473261 - RNA, 20 nt, Chlamydia trachomatis
gaguuuuuuuguuuccauua

SEQ ID NO: 473262 - RNA, 19 nt, Chlamydia trachomatis
gauaaaaacucucuuccac

SEQ ID NO: 473263 - RNA, 13 nt, Chlamydia trachomatis
gauaacaaacaac

SEQ ID NO: 473264 - RNA, 13 nt, Chlamydia trachomatis
gauaacaaccauc

SEQ ID NO: 473265 - RNA, 18 nt, Chlamydia trachomatis
gauaacaaccaucaaagc

SEQ ID NO: 473266 - RNA, 18 nt, Chlamydia trachomatis
gauaacaacucuccuaau

SEQ ID NO: 473267 - RNA, 17 nt, Chlamydia trachomatis
gaguucccguuaauggg

SEQ ID NO: 473268 - RNA, 20 nt, Chlamydia trachomatis
gaguuagccuaaauagcuca

SEQ ID NO: 473269 - RNA, 15 nt, Chlamydia trachomatis
gaguuaggcugcucc

SEQ ID NO: 473270 - RNA, 23 nt, Chlamydia trachomatis
gauaaugccuuuugcacaaagga

SEQ ID NO: 473271 - RNA, 13 nt, Chlamydia trachomatis
gauaaucucugaa

SEQ ID NO: 473272 - RNA, 23 nt, Chlamydia trachomatis
gauaaucucugaaagagcuucuu

SEQ ID NO: 473273 - RNA, 17 nt, Chlamydia trachomatis
gauaauacucuucuauc

SEQ ID NO: 473274 - RNA, 18 nt, Chlamydia trachomatis
gauaacacucucaucuaa

SEQ ID NO: 473275 - RNA, 20 nt, Chlamydia trachomatis
gauaaguccaucuaaaggga

SEQ ID NO: 473276 - RNA, 18 nt, Chlamydia trachomatis
gauaccaagccauuucca

SEQ ID NO: 473277 - RNA, 19 nt, Chlamydia trachomatis
gauaccaagccauuuccag

SEQ ID NO: 473278 - RNA, 17 nt, Chlamydia trachomatis
gauacaagagagaacaa

SEQ ID NO: 473279 - RNA, 19 nt, Chlamydia trachomatis
gauaauuuuccuuuuuccc

SEQ ID NO: 473280 - RNA, 14 nt, Chlamydia trachomatis
gauaauuuucugac

SEQ ID NO: 473281 - RNA, 20 nt, Chlamydia trachomatis
gauaguucuaacacuuuuuu

SEQ ID NO: 473282 - RNA, 12 nt, Chlamydia trachomatis
gauaguuacaga

SEQ ID NO: 473283 - RNA, 14 nt, Chlamydia trachomatis
gauagcuaaucuuu

SEQ ID NO: 473284 - RNA, 21 nt, Chlamydia trachomatis
gauagccuccgcuaauuuuug

SEQ ID NO: 473285 - RNA, 24 nt, Chlamydia trachomatis
gauaguuuuguaaacgagagccca

SEQ ID NO: 473286 - RNA, 20 nt, Chlamydia trachomatis
gauauaaucuaaagacaaaa

SEQ ID NO: 473287 - RNA, 20 nt, Chlamydia trachomatis
gauacucaacgucuugucuc

SEQ ID NO: 473288 - RNA, 15 nt, Chlamydia trachomatis
gauagcagcaguuuu

SEQ ID NO: 473289 - RNA, 15 nt, Chlamydia trachomatis
gauagcaugcaaaac

SEQ ID NO: 473290 - RNA, 18 nt, Chlamydia trachomatis
gauauucuuuuaauacuu

SEQ ID NO: 473291 - RNA, 13 nt, Chlamydia trachomatis
gaucaaagaaucu

SEQ ID NO: 473292 - RNA, 14 nt, Chlamydia trachomatis
gauauucuaauccu

SEQ ID NO: 473293 - RNA, 19 nt, Chlamydia trachomatis
gauaucuaggucucccagg

SEQ ID NO: 473294 - RNA, 23 nt, Chlamydia trachomatis
gauaucuaggucucccagguugu

SEQ ID NO: 473295 - RNA, 23 nt, Chlamydia trachomatis
gauaucucccuuagcaacaguca

SEQ ID NO: 473296 - RNA, 20 nt, Chlamydia trachomatis
gauauccaucauaaaaagau

SEQ ID NO: 473297 - RNA, 23 nt, Chlamydia trachomatis
gauaucccuuuccaagaaucaaa

SEQ ID NO: 473298 - RNA, 15 nt, Chlamydia trachomatis
gcaacgagaaguccu

SEQ ID NO: 473299 - RNA, 16 nt, Chlamydia trachomatis
gcaaccucuauagcca

SEQ ID NO: 473300 - RNA, 21 nt, Chlamydia trachomatis
gcaaccuuuccuguauaagaa

SEQ ID NO: 473301 - RNA, 19 nt, Chlamydia trachomatis
gcaacgaacuuuccauagc

SEQ ID NO: 473302 - RNA, 18 nt, Chlamydia trachomatis
aaagcgaggcuucaaaga

SEQ ID NO: 473303 - RNA, 20 nt, Chlamydia trachomatis
aaagcgaggcuucaaagaac

SEQ ID NO: 473304 - RNA, 22 nt, Chlamydia trachomatis
aaagcgaggcuucaaagaacau

SEQ ID NO: 473305 - RNA, 14 nt, Chlamydia trachomatis
aaagcgaucuuuga

SEQ ID NO: 473306 - RNA, 15 nt, Chlamydia trachomatis
aaagcgaucuuugaa

SEQ ID NO: 473307 - RNA, 13 nt, Chlamydia trachomatis
gcaacucuugcca

SEQ ID NO: 473308 - RNA, 14 nt, Chlamydia trachomatis
gcaacucucucucc

SEQ ID NO: 473309 - RNA, 17 nt, Chlamydia trachomatis
gcaacucucucucccca

SEQ ID NO: 473310 - RNA, 17 nt, Chlamydia trachomatis
gcaacucuuucauaaaa

SEQ ID NO: 473311 - RNA, 16 nt, Chlamydia trachomatis
gcaacuucuggcagua

SEQ ID NO: 473312 - RNA, 12 nt, Chlamydia trachomatis
gcaacuuuucag

SEQ ID NO: 473313 - RNA, 21 nt, Chlamydia trachomatis
gcaagaacaaagaauggaucu

SEQ ID NO: 473314 - RNA, 14 nt, Chlamydia trachomatis
gcaagaagaagaga

SEQ ID NO: 473315 - RNA, 21 nt, Chlamydia trachomatis
gcaagaagacgcucauaaaga

SEQ ID NO: 473316 - RNA, 12 nt, Chlamydia trachomatis
gcaagaauaaaa

SEQ ID NO: 473317 - RNA, 15 nt, Chlamydia trachomatis
gcaagaauacaagaa

SEQ ID NO: 473318 - RNA, 15 nt, Chlamydia trachomatis
gcaagacaucuauug

SEQ ID NO: 473319 - RNA, 22 nt, Chlamydia trachomatis
gcaagacaucuauugagaagac

SEQ ID NO: 473320 - RNA, 23 nt, Chlamydia trachomatis
gcaagacaucuauugagaagacu

SEQ ID NO: 473321 - RNA, 16 nt, Chlamydia trachomatis
gcaagauauucccuaa

SEQ ID NO: 473322 - RNA, 17 nt, Chlamydia trachomatis
gcaagaucaugggaaau

SEQ ID NO: 473323 - RNA, 22 nt, Chlamydia trachomatis
gcaagaucaugggaaauaaaua

SEQ ID NO: 473324 - RNA, 21 nt, Chlamydia trachomatis
gcaagcccuugagagcaagcc

SEQ ID NO: 473325 - RNA, 15 nt, Chlamydia trachomatis
gcaagcuugucuccu

SEQ ID NO: 473326 - RNA, 20 nt, Chlamydia trachomatis
gcaaggcuuucaaaaagagc

SEQ ID NO: 473327 - RNA, 12 nt, Chlamydia trachomatis
gcaauaaagaaa

SEQ ID NO: 473328 - RNA, 17 nt, Chlamydia trachomatis
gcaagucucugccaccu

SEQ ID NO: 473329 - RNA, 13 nt, Chlamydia trachomatis
gcaaguaaugaca

SEQ ID NO: 473330 - RNA, 19 nt, Chlamydia trachomatis
gcaaguaaugacacuggca

SEQ ID NO: 473331 - RNA, 19 nt, Chlamydia trachomatis
gcaauaauuuccccuauau

SEQ ID NO: 473332 - RNA, 16 nt, Chlamydia trachomatis
gcaauaauaccuuaau

SEQ ID NO: 473333 - RNA, 22 nt, Chlamydia trachomatis
gcaauacgauugguuuaauauu

SEQ ID NO: 473334 - RNA, 14 nt, Chlamydia trachomatis
gcaauagacaccau

SEQ ID NO: 473335 - RNA, 18 nt, Chlamydia trachomatis
gcaauaaucuuuuuauug

SEQ ID NO: 473336 - RNA, 21 nt, Chlamydia trachomatis
gcaauaccgaaucuaauauga

SEQ ID NO: 473337 - RNA, 12 nt, Chlamydia trachomatis
gcaauagauagu

SEQ ID NO: 473338 - RNA, 20 nt, Chlamydia trachomatis
gcaaucacaugguuuucugg

SEQ ID NO: 473339 - RNA, 19 nt, Chlamydia trachomatis
gcaaucaagcuaaucauga

SEQ ID NO: 473340 - RNA, 16 nt, Chlamydia trachomatis
gcaaucauaucaagaa

SEQ ID NO: 473341 - RNA, 17 nt, Chlamydia trachomatis
gcaauccaauuaccagu

SEQ ID NO: 473342 - RNA, 17 nt, Chlamydia trachomatis
gcaaugcaaaacauaac

SEQ ID NO: 473343 - RNA, 20 nt, Chlamydia trachomatis
gcaauggcuaagccauugcu

SEQ ID NO: 473344 - RNA, 21 nt, Chlamydia trachomatis
gcaauggcaaaaucuucauaa

SEQ ID NO: 473345 - RNA, 17 nt, Chlamydia trachomatis
gcaaugguuauaagacc

SEQ ID NO: 473346 - RNA, 22 nt, Chlamydia trachomatis
gcacaaaaucccuucccagcgu

SEQ ID NO: 473347 - RNA, 15 nt, Chlamydia trachomatis
gcacaagauacaagg

SEQ ID NO: 473348 - RNA, 14 nt, Chlamydia trachomatis
gcacaaaggaacau

SEQ ID NO: 473349 - RNA, 17 nt, Chlamydia trachomatis
gcacaaagauuucuucu

SEQ ID NO: 473350 - RNA, 24 nt, Chlamydia trachomatis
gcacaagcuguuccuaauagaucu

SEQ ID NO: 473351 - RNA, 16 nt, Chlamydia trachomatis
gcacaauaacagcaca

SEQ ID NO: 473352 - RNA, 22 nt, Chlamydia trachomatis
gcacaauaacagcacaaacaaa

SEQ ID NO: 473353 - RNA, 18 nt, Chlamydia trachomatis
gcacaugggcauagaaua

SEQ ID NO: 473354 - RNA, 13 nt, Chlamydia trachomatis
gcaccauaauaug

SEQ ID NO: 473355 - RNA, 12 nt, Chlamydia trachomatis
gcaccauaauau

SEQ ID NO: 473356 - RNA, 18 nt, Chlamydia trachomatis
gcaccacgugcaacacaa

SEQ ID NO: 473357 - RNA, 17 nt, Chlamydia trachomatis
gcacccuuucuuacucc

SEQ ID NO: 473358 - RNA, 19 nt, Chlamydia trachomatis
gcacccuuucuuacuccuu

SEQ ID NO: 473359 - RNA, 14 nt, Chlamydia trachomatis
gcaccucuuucaga

SEQ ID NO: 473360 - RNA, 21 nt, Chlamydia trachomatis
gcaccuuuuuugcuaaaagaa

SEQ ID NO: 473361 - RNA, 19 nt, Chlamydia trachomatis
gcaccuuuacaaucaucuu

SEQ ID NO: 473362 - RNA, 15 nt, Chlamydia trachomatis
gcacgauaaaagaca

SEQ ID NO: 473363 - RNA, 13 nt, Chlamydia trachomatis
gcacuaaagagcu

SEQ ID NO: 473364 - RNA, 14 nt, Chlamydia trachomatis
gcacuaagaauaaa

SEQ ID NO: 473365 - RNA, 14 nt, Chlamydia trachomatis
gcacuagcuugaug

SEQ ID NO: 473366 - RNA, 13 nt, Chlamydia trachomatis
gcacucaaauuuc

SEQ ID NO: 473367 - RNA, 16 nt, Chlamydia trachomatis
gcacucaaauuucucu

SEQ ID NO: 473368 - RNA, 17 nt, Chlamydia trachomatis
gcacucaaauuucucua

SEQ ID NO: 473369 - RNA, 17 nt, Chlamydia trachomatis
gcacucgagucaugcaa

SEQ ID NO: 473370 - RNA, 10 nt, Chlamydia trachomatis
gcacuuuccg

SEQ ID NO: 473371 - RNA, 13 nt, Chlamydia trachomatis
gcagaaaaauuua

SEQ ID NO: 473372 - RNA, 23 nt, Chlamydia trachomatis
gcagaaacaaauaacuuuuucuc

SEQ ID NO: 473373 - RNA, 23 nt, Chlamydia trachomatis
gcacuucuucuuuggaaaaaaaa

SEQ ID NO: 473374 - RNA, 16 nt, Chlamydia trachomatis
gcacuguccacauuau

SEQ ID NO: 473375 - RNA, 20 nt, Chlamydia trachomatis
gcacugguauucugcagaaa

SEQ ID NO: 473376 - RNA, 16 nt, Chlamydia trachomatis
gcagaacuagucuacu

SEQ ID NO: 473377 - RNA, 14 nt, Chlamydia trachomatis
gcagaaccuuccac

SEQ ID NO: 473378 - RNA, 20 nt, Chlamydia trachomatis
gcagaagcaagaaucaaagg

SEQ ID NO: 473379 - RNA, 16 nt, Chlamydia trachomatis
gcagaacagcucuagc

SEQ ID NO: 473380 - RNA, 24 nt, Chlamydia trachomatis
gcagacccaaaugcggcccacacu

SEQ ID NO: 473381 - RNA, 12 nt, Chlamydia trachomatis
gcagagaaagcu

SEQ ID NO: 473382 - RNA, 18 nt, Chlamydia trachomatis
gcagagagccagcgaggc

SEQ ID NO: 473383 - RNA, 13 nt, Chlamydia trachomatis
gcagagauaaaga

SEQ ID NO: 473384 - RNA, 20 nt, Chlamydia trachomatis
gcagaggggggcuugcacaa

SEQ ID NO: 473385 - RNA, 18 nt, Chlamydia trachomatis
gcagagguaugcagacuc

SEQ ID NO: 473386 - RNA, 15 nt, Chlamydia trachomatis
gcagagccaaaacaa

SEQ ID NO: 473387 - RNA, 15 nt, Chlamydia trachomatis
gcagaucauaucugc

SEQ ID NO: 473388 - RNA, 19 nt, Chlamydia trachomatis
gcagauauggaagaacagc

SEQ ID NO: 473389 - RNA, 18 nt, Chlamydia trachomatis
gcagaucccggcuugccu

SEQ ID NO: 473390 - RNA, 16 nt, Chlamydia trachomatis
gcagaugcaucuauug

SEQ ID NO: 473391 - RNA, 17 nt, Chlamydia trachomatis
gcagcaucuauuuucuc

SEQ ID NO: 473392 - RNA, 16 nt, Chlamydia trachomatis
gcagcggcaaugguua

SEQ ID NO: 473393 - RNA, 22 nt, Chlamydia trachomatis
gcagcguucugagaugaaaaua

SEQ ID NO: 473394 - RNA, 21 nt, Chlamydia trachomatis
gcagcuccuauaauugcuaag

SEQ ID NO: 473395 - RNA, 23 nt, Chlamydia trachomatis
gcagcuccuauaauugcuaagga

SEQ ID NO: 473396 - RNA, 15 nt, Chlamydia trachomatis
gcagggagaagggga

SEQ ID NO: 473397 - RNA, 20 nt, Chlamydia trachomatis
gcagguacuuacccuuauaa

SEQ ID NO: 473398 - RNA, 20 nt, Chlamydia trachomatis
gcauaccaagcuuucugcca

SEQ ID NO: 473399 - RNA, 13 nt, Chlamydia trachomatis
gcauacuuuucaa

SEQ ID NO: 473400 - RNA, 16 nt, Chlamydia trachomatis
gcaucccaaaauagca

SEQ ID NO: 473401 - RNA, 15 nt, Chlamydia trachomatis
gcaucagccccaaaa

SEQ ID NO: 473402 - RNA, 16 nt, Chlamydia trachomatis
gcaucccgaaucccau

SEQ ID NO: 473403 - RNA, 13 nt, Chlamydia trachomatis
gcaucuuuucuua

SEQ ID NO: 473404 - RNA, 18 nt, Chlamydia trachomatis
gcaucuuuucuuauaaag

SEQ ID NO: 473405 - RNA, 17 nt, Chlamydia trachomatis
gcaugaacauacguuuu

SEQ ID NO: 473406 - RNA, 12 nt, Chlamydia trachomatis
gcaugagauaua

SEQ ID NO: 473407 - RNA, 19 nt, Chlamydia trachomatis
gcauucucucauaagaucu

SEQ ID NO: 473408 - RNA, 22 nt, Chlamydia trachomatis
gcauucucucauaagaucuuua

SEQ ID NO: 473409 - RNA, 22 nt, Chlamydia trachomatis
gccaaaaaccagccuauuagau

SEQ ID NO: 473410 - RNA, 17 nt, Chlamydia trachomatis
gcauugguauugccaug

SEQ ID NO: 473411 - RNA, 15 nt, Chlamydia trachomatis
gcauugugaugaaac

SEQ ID NO: 473412 - RNA, 17 nt, Chlamydia trachomatis
gccaaccaccuguugcu

SEQ ID NO: 473413 - RNA, 18 nt, Chlamydia trachomatis
gccaaggaagaucaagga

SEQ ID NO: 473414 - RNA, 18 nt, Chlamydia trachomatis
gccaauacgaacaugucc

SEQ ID NO: 473415 - RNA, 17 nt, Chlamydia trachomatis
gccacaaccacuguuca

SEQ ID NO: 473416 - RNA, 15 nt, Chlamydia trachomatis
gccaauuucucuacc

SEQ ID NO: 473417 - RNA, 12 nt, Chlamydia trachomatis
gccaauguucua

SEQ ID NO: 473418 - RNA, 16 nt, Chlamydia trachomatis
gccacacuuccccauu

SEQ ID NO: 473419 - RNA, 21 nt, Chlamydia trachomatis
gccacacuuccccauucuucu

SEQ ID NO: 473420 - RNA, 19 nt, Chlamydia trachomatis
gccacugcacaucacagau

SEQ ID NO: 473421 - RNA, 13 nt, Chlamydia trachomatis
gccaguaaucaaa

SEQ ID NO: 473422 - RNA, 18 nt, Chlamydia trachomatis
gccauacuuacuucuaug

SEQ ID NO: 473423 - RNA, 16 nt, Chlamydia trachomatis
gccauaagcuguaggu

SEQ ID NO: 473424 - RNA, 13 nt, Chlamydia trachomatis
gccauaauaaaag

SEQ ID NO: 473425 - RNA, 16 nt, Chlamydia trachomatis
gccauaauaaaaggcu

SEQ ID NO: 473426 - RNA, 14 nt, Chlamydia trachomatis
gccaucauuaucuu

SEQ ID NO: 473427 - RNA, 21 nt, Chlamydia trachomatis
gccaugacauaagcaaauccu

SEQ ID NO: 473428 - RNA, 12 nt, Chlamydia trachomatis
gccauucuuacu

SEQ ID NO: 473429 - RNA, 18 nt, Chlamydia trachomatis
gcccaagcuuucaucucc

SEQ ID NO: 473430 - RNA, 13 nt, Chlamydia trachomatis
gcccagucaagag

SEQ ID NO: 473431 - RNA, 16 nt, Chlamydia trachomatis
gcccagucaagagcuu

SEQ ID NO: 473432 - RNA, 15 nt, Chlamydia trachomatis
gcccaugagaaacca

SEQ ID NO: 473433 - RNA, 16 nt, Chlamydia trachomatis
gccccaaaaacagcag

SEQ ID NO: 473434 - RNA, 17 nt, Chlamydia trachomatis
gccccaaaaacagcaga

SEQ ID NO: 473435 - RNA, 22 nt, Chlamydia trachomatis
gccccagaaacacuaucuccua

SEQ ID NO: 473436 - RNA, 18 nt, Chlamydia trachomatis
gccccuauguaaacaaga

SEQ ID NO: 473437 - RNA, 11 nt, Chlamydia trachomatis
gccccuccgcu

SEQ ID NO: 473438 - RNA, 14 nt, Chlamydia trachomatis
gcccuaauaaaagg

SEQ ID NO: 473439 - RNA, 13 nt, Chlamydia trachomatis
gcccuccugcaga

SEQ ID NO: 473440 - RNA, 13 nt, Chlamydia trachomatis
aaagcgucuccaa

SEQ ID NO: 473441 - RNA, 13 nt, Chlamydia trachomatis
aaagcguucuccg

SEQ ID NO: 473442 - RNA, 18 nt, Chlamydia trachomatis
aaagcuaacucaccuaaa

SEQ ID NO: 473443 - RNA, 19 nt, Chlamydia trachomatis
aaagcuacagucuguccag

SEQ ID NO: 473444 - RNA, 18 nt, Chlamydia trachomatis
aaagcuaucccaaaagaa

SEQ ID NO: 473445 - RNA, 21 nt, Chlamydia trachomatis
aaagcuaugcccaggauagga

SEQ ID NO: 473446 - RNA, 15 nt, Chlamydia trachomatis
gccguaagcauuccc

SEQ ID NO: 473447 - RNA, 21 nt, Chlamydia trachomatis
gccuaaagagacgcaugcuuc

SEQ ID NO: 473448 - RNA, 13 nt, Chlamydia trachomatis
gccuguggcaacu

SEQ ID NO: 473449 - RNA, 16 nt, Chlamydia trachomatis
gccuguggcaacuaau

SEQ ID NO: 473450 - RNA, 23 nt, Chlamydia trachomatis
gccuuaggaccuaauaucugcuc

SEQ ID NO: 473451 - RNA, 23 nt, Chlamydia trachomatis
gccuucccgacagaggauagagc

SEQ ID NO: 473452 - RNA, 13 nt, Chlamydia trachomatis
gccuucuuguuuu

SEQ ID NO: 473453 - RNA, 21 nt, Chlamydia trachomatis
gccuuuagauaguuacuucca

SEQ ID NO: 473454 - RNA, 15 nt, Chlamydia trachomatis
gcgaaaaaaaaagaa

SEQ ID NO: 473455 - RNA, 17 nt, Chlamydia trachomatis
gcgcuccagcucuucca

SEQ ID NO: 473456 - RNA, 20 nt, Chlamydia trachomatis
gcgcuucccgcuauuuuccu

SEQ ID NO: 473457 - RNA, 15 nt, Chlamydia trachomatis
gcgcuuucuaaagca

SEQ ID NO: 473458 - RNA, 18 nt, Chlamydia trachomatis
gcggcaaugguuauaaga

SEQ ID NO: 473459 - RNA, 18 nt, Chlamydia trachomatis
gcgguggaagaucuucag

SEQ ID NO: 473460 - RNA, 21 nt, Chlamydia trachomatis
gcgguggaagaucuucagaaa

SEQ ID NO: 473461 - RNA, 20 nt, Chlamydia trachomatis
gcggucguggcgggcaccgu

SEQ ID NO: 473462 - RNA, 16 nt, Chlamydia trachomatis
gcgguccucgggaaau

SEQ ID NO: 473463 - RNA, 15 nt, Chlamydia trachomatis
gcguaagcaacgaca

SEQ ID NO: 473464 - RNA, 22 nt, Chlamydia trachomatis
gcguacgcaaagugcuaauaac

SEQ ID NO: 473465 - RNA, 17 nt, Chlamydia trachomatis
gcguaauuuucuagcuu

SEQ ID NO: 473466 - RNA, 20 nt, Chlamydia trachomatis
gcguagaucccagaauaaag

SEQ ID NO: 473467 - RNA, 20 nt, Chlamydia trachomatis
gcguagcucagagauuuccu

SEQ ID NO: 473468 - RNA, 20 nt, Chlamydia trachomatis
gcguauuugaaaucaaaagg

SEQ ID NO: 473469 - RNA, 21 nt, Chlamydia trachomatis
gcguauuugaaaucaaaaggc

SEQ ID NO: 473470 - RNA, 19 nt, Chlamydia trachomatis
gcguaguguagucagaaga

SEQ ID NO: 473471 - RNA, 13 nt, Chlamydia trachomatis
gcgucaucuuuga

SEQ ID NO: 473472 - RNA, 17 nt, Chlamydia trachomatis
gcgucaucuuugagaag

SEQ ID NO: 473473 - RNA, 22 nt, Chlamydia trachomatis
gcguuguagcugucccccagau

SEQ ID NO: 473474 - RNA, 17 nt, Chlamydia trachomatis
gcuaaaaacucuuucau

SEQ ID NO: 473475 - RNA, 15 nt, Chlamydia trachomatis
gcguuuaauuccuug

SEQ ID NO: 473476 - RNA, 13 nt, Chlamydia trachomatis
gcuaaaaccuuag

SEQ ID NO: 473477 - RNA, 17 nt, Chlamydia trachomatis
gcuaaagcagaaacagc

SEQ ID NO: 473478 - RNA, 21 nt, Chlamydia trachomatis
gcuaaagcagaaacagcuucu

SEQ ID NO: 473479 - RNA, 21 nt, Chlamydia trachomatis
gcuaaaggaucugagcaguga

SEQ ID NO: 473480 - RNA, 13 nt, Chlamydia trachomatis
gcuaacaaagaau

SEQ ID NO: 473481 - RNA, 15 nt, Chlamydia trachomatis
gcuaagaaaauaaac

SEQ ID NO: 473482 - RNA, 15 nt, Chlamydia trachomatis
gcuaaggaaagagag

SEQ ID NO: 473483 - RNA, 16 nt, Chlamydia trachomatis
gcuaauccaugcaucu

SEQ ID NO: 473484 - RNA, 14 nt, Chlamydia trachomatis
gcuacaguaucugc

SEQ ID NO: 473485 - RNA, 18 nt, Chlamydia trachomatis
gcuacaagggugcuaacu

SEQ ID NO: 473486 - RNA, 21 nt, Chlamydia trachomatis
gcuaauuuuucucuaauaguu

SEQ ID NO: 473487 - RNA, 19 nt, Chlamydia trachomatis
gcuacaaacugcucaagga

SEQ ID NO: 473488 - RNA, 16 nt, Chlamydia trachomatis
gcuaucaauaaagaag

SEQ ID NO: 473489 - RNA, 21 nt, Chlamydia trachomatis
gcuaucagcgcucauaggaca

SEQ ID NO: 473490 - RNA, 14 nt, Chlamydia trachomatis
gcuaucauuuccaa

SEQ ID NO: 473491 - RNA, 19 nt, Chlamydia trachomatis
gcuaucgguaaugccuuuu

SEQ ID NO: 473492 - RNA, 15 nt, Chlamydia trachomatis
gcuauccugcucaac

SEQ ID NO: 473493 - RNA, 16 nt, Chlamydia trachomatis
gcuauauguaagaagc

SEQ ID NO: 473494 - RNA, 15 nt, Chlamydia trachomatis
gcuagcuuuccucac

SEQ ID NO: 473495 - RNA, 13 nt, Chlamydia trachomatis
gcuaggcaaauau

SEQ ID NO: 473496 - RNA, 21 nt, Chlamydia trachomatis
gcuagucguaugcgcccauca

SEQ ID NO: 473497 - RNA, 21 nt, Chlamydia trachomatis
gcuagccuggcugcagaagac

SEQ ID NO: 473498 - RNA, 18 nt, Chlamydia trachomatis
gcuagauccguuuuucua

SEQ ID NO: 473499 - RNA, 14 nt, Chlamydia trachomatis
gcuagaaaauagca

SEQ ID NO: 473500 - RNA, 12 nt, Chlamydia trachomatis
gcuagaagaaga

SEQ ID NO: 473501 - RNA, 15 nt, Chlamydia trachomatis
gcuagaagaagagga

SEQ ID NO: 473502 - RNA, 17 nt, Chlamydia trachomatis
gcuagaagaaucauaga

SEQ ID NO: 473503 - RNA, 16 nt, Chlamydia trachomatis
gcuauugguagaggcu

SEQ ID NO: 473504 - RNA, 13 nt, Chlamydia trachomatis
gcuauuacauaua

SEQ ID NO: 473505 - RNA, 23 nt, Chlamydia trachomatis
gcuaugcgcggaaggaaaaagaa

SEQ ID NO: 473506 - RNA, 19 nt, Chlamydia trachomatis
gcuaugaaaaauccuucca

SEQ ID NO: 473507 - RNA, 20 nt, Chlamydia trachomatis
gcuaugaaaaauccuuccau

SEQ ID NO: 473508 - RNA, 14 nt, Chlamydia trachomatis
gcucaaagaugagu

SEQ ID NO: 473509 - RNA, 14 nt, Chlamydia trachomatis
gcuauuuucagcaa

SEQ ID NO: 473510 - RNA, 21 nt, Chlamydia trachomatis
gcucaacaaggauuuuuuucu

SEQ ID NO: 473511 - RNA, 15 nt, Chlamydia trachomatis
gcucagcuucaacug

SEQ ID NO: 473512 - RNA, 13 nt, Chlamydia trachomatis
gcuccccucuuuu

SEQ ID NO: 473513 - RNA, 15 nt, Chlamydia trachomatis
gcuccagcucuucca

SEQ ID NO: 473514 - RNA, 16 nt, Chlamydia trachomatis
gcuccagcucuuccau

SEQ ID NO: 473515 - RNA, 20 nt, Chlamydia trachomatis
gcuccagaacgaaggacacu

SEQ ID NO: 473516 - RNA, 12 nt, Chlamydia trachomatis
gcucauuagaau

SEQ ID NO: 473517 - RNA, 15 nt, Chlamydia trachomatis
gcucuaaagagccaa

SEQ ID NO: 473518 - RNA, 13 nt, Chlamydia trachomatis
gcucguucacuau

SEQ ID NO: 473519 - RNA, 14 nt, Chlamydia trachomatis
gcucucuucacaaa

SEQ ID NO: 473520 - RNA, 10 nt, Chlamydia trachomatis
gcucucuuuu

SEQ ID NO: 473521 - RNA, 13 nt, Chlamydia trachomatis
gcucucuuuucug

SEQ ID NO: 473522 - RNA, 18 nt, Chlamydia trachomatis
gcucugucguuaaagaau

SEQ ID NO: 473523 - RNA, 23 nt, Chlamydia trachomatis
gcucuguucaauuguuggacaaa

SEQ ID NO: 473524 - RNA, 19 nt, Chlamydia trachomatis
gcucuucucucagaugggu

SEQ ID NO: 473525 - RNA, 15 nt, Chlamydia trachomatis
gcugauaaauuucuu

SEQ ID NO: 473526 - RNA, 18 nt, Chlamydia trachomatis
gcugauaaggaggcuuca

SEQ ID NO: 473527 - RNA, 15 nt, Chlamydia trachomatis
gcugagcucuuuccu

SEQ ID NO: 473528 - RNA, 18 nt, Chlamydia trachomatis
gcugagcuuuuuuucacu

SEQ ID NO: 473529 - RNA, 15 nt, Chlamydia trachomatis
gcugaggaagcauuu

SEQ ID NO: 473530 - RNA, 14 nt, Chlamydia trachomatis
gcucuuuuucuucc

SEQ ID NO: 473531 - RNA, 15 nt, Chlamydia trachomatis
gcucuuucagagaaa

SEQ ID NO: 473532 - RNA, 23 nt, Chlamydia trachomatis
gcugcuuuacaucccuugaacua

SEQ ID NO: 473533 - RNA, 17 nt, Chlamydia trachomatis
gcugcugucagaagaau

SEQ ID NO: 473534 - RNA, 20 nt, Chlamydia trachomatis
gcugcucuaaccaccugagc

SEQ ID NO: 473535 - RNA, 20 nt, Chlamydia trachomatis
aaagcugguuuuuuuugaaa

SEQ ID NO: 473536 - RNA, 14 nt, Chlamydia trachomatis
gcuggcuuuguccu

SEQ ID NO: 473537 - RNA, 15 nt, Chlamydia trachomatis
gcuggcuuuguccuc

SEQ ID NO: 473538 - RNA, 15 nt, Chlamydia trachomatis
gcuguaaaacauuuc

SEQ ID NO: 473539 - RNA, 20 nt, Chlamydia trachomatis
gcugguugguuuucuuguuc

SEQ ID NO: 473540 - RNA, 20 nt, Chlamydia trachomatis
aaagcuuuuguuaaccaagc

SEQ ID NO: 473541 - RNA, 19 nt, Chlamydia trachomatis
aaagcuuuuuccaaagcuu

SEQ ID NO: 473542 - RNA, 14 nt, Chlamydia trachomatis
aaaggaaacaagca

SEQ ID NO: 473543 - RNA, 12 nt, Chlamydia trachomatis
aaagcuucccuu

SEQ ID NO: 473544 - RNA, 14 nt, Chlamydia trachomatis
aaagcuucccuucu

SEQ ID NO: 473545 - RNA, 19 nt, Chlamydia trachomatis
aaagcuucuaagaacaacg

SEQ ID NO: 473546 - RNA, 14 nt, Chlamydia trachomatis
aaagcuuuguugca

SEQ ID NO: 473547 - RNA, 15 nt, Chlamydia trachomatis
gcugugacuccuucu

SEQ ID NO: 473548 - RNA, 12 nt, Chlamydia trachomatis
gcuuuguccugg

SEQ ID NO: 473549 - RNA, 15 nt, Chlamydia trachomatis
gcuuugucucugugu

SEQ ID NO: 473550 - RNA, 23 nt, Chlamydia trachomatis
gcuuuuacaauagcauuugucuu

SEQ ID NO: 473551 - RNA, 15 nt, Chlamydia trachomatis
gcuuugaucuuuguu

SEQ ID NO: 473552 - RNA, 12 nt, Chlamydia trachomatis
gcuuucuuuucc

SEQ ID NO: 473553 - RNA, 20 nt, Chlamydia trachomatis
gcuuucuuuuccaucguuua

SEQ ID NO: 473554 - RNA, 16 nt, Chlamydia trachomatis
gcuuucuacauggcca

SEQ ID NO: 473555 - RNA, 14 nt, Chlamydia trachomatis
gcuuuuuauccuac

SEQ ID NO: 473556 - RNA, 23 nt, Chlamydia trachomatis
gcuuuuuaggauucauauuccaa

SEQ ID NO: 473557 - RNA, 13 nt, Chlamydia trachomatis
gcuuuucuuuuuu

SEQ ID NO: 473558 - RNA, 18 nt, Chlamydia trachomatis
gcuuuugcugcuucacua

SEQ ID NO: 473559 - RNA, 15 nt, Chlamydia trachomatis
gcuuuucuauuucau

SEQ ID NO: 473560 - RNA, 15 nt, Chlamydia trachomatis
gcuuuucuuuccuag

SEQ ID NO: 473561 - RNA, 12 nt, Chlamydia trachomatis
gcuuuucuuuuu

SEQ ID NO: 473562 - RNA, 22 nt, Chlamydia trachomatis
ggaaaaaauuaacaauccccaa

SEQ ID NO: 473563 - RNA, 14 nt, Chlamydia trachomatis
ggaaaaaagaagcu

SEQ ID NO: 473564 - RNA, 22 nt, Chlamydia trachomatis
ggaaaaaagaagcuuuucccua

SEQ ID NO: 473565 - RNA, 16 nt, Chlamydia trachomatis
ggaaaaagcuaucauc

SEQ ID NO: 473566 - RNA, 17 nt, Chlamydia trachomatis
gcuuuuucuucucuagc

SEQ ID NO: 473567 - RNA, 14 nt, Chlamydia trachomatis
ggaaaagcuauucc

SEQ ID NO: 473568 - RNA, 21 nt, Chlamydia trachomatis
ggaaacauucccuucuuuaau

SEQ ID NO: 473569 - RNA, 13 nt, Chlamydia trachomatis
ggaaacaaauucc

SEQ ID NO: 473570 - RNA, 15 nt, Chlamydia trachomatis
ggaaacguaaaagag

SEQ ID NO: 473571 - RNA, 20 nt, Chlamydia trachomatis
ggaaacugucggugaaagcu

SEQ ID NO: 473572 - RNA, 23 nt, Chlamydia trachomatis
ggaaauaggaccgacauuaguau

SEQ ID NO: 473573 - RNA, 16 nt, Chlamydia trachomatis
ggaaaucacugaauca

SEQ ID NO: 473574 - RNA, 22 nt, Chlamydia trachomatis
ggaaaucuucgugcagggagaa

SEQ ID NO: 473575 - RNA, 15 nt, Chlamydia trachomatis
ggaaaugcacaauaa

SEQ ID NO: 473576 - RNA, 13 nt, Chlamydia trachomatis
ggaaagcuaugcc

SEQ ID NO: 473577 - RNA, 15 nt, Chlamydia trachomatis
ggaaauaaaaagccc

SEQ ID NO: 473578 - RNA, 16 nt, Chlamydia trachomatis
ggaaauaagagaggcu

SEQ ID NO: 473579 - RNA, 20 nt, Chlamydia trachomatis
ggaaccggaggauaaaucag

SEQ ID NO: 473580 - RNA, 17 nt, Chlamydia trachomatis
ggaagauaauggcaaaa

SEQ ID NO: 473581 - RNA, 23 nt, Chlamydia trachomatis
ggaagauaauggcaaaaauacca

SEQ ID NO: 473582 - RNA, 16 nt, Chlamydia trachomatis
ggaagauacagccugc

SEQ ID NO: 473583 - RNA, 19 nt, Chlamydia trachomatis
ggaagauaacaauccuaga

SEQ ID NO: 473584 - RNA, 15 nt, Chlamydia trachomatis
ggaagagagcuuuga

SEQ ID NO: 473585 - RNA, 13 nt, Chlamydia trachomatis
ggaagaacagcag

SEQ ID NO: 473586 - RNA, 23 nt, Chlamydia trachomatis
ggaagaacagcagcagugccacu

SEQ ID NO: 473587 - RNA, 18 nt, Chlamydia trachomatis
ggaagaagaagaacugca

SEQ ID NO: 473588 - RNA, 16 nt, Chlamydia trachomatis
ggaagaauaauacagg

SEQ ID NO: 473589 - RNA, 18 nt, Chlamydia trachomatis
ggaagaauaauacaggag

SEQ ID NO: 473590 - RNA, 19 nt, Chlamydia trachomatis
ggaagaucucuuucucuag

SEQ ID NO: 473591 - RNA, 22 nt, Chlamydia trachomatis
ggaagaucucuuucucuagaau

SEQ ID NO: 473592 - RNA, 19 nt, Chlamydia trachomatis
ggaagcauuucucuccaaa

SEQ ID NO: 473593 - RNA, 21 nt, Chlamydia trachomatis
ggaagcauuucucuccaaacc

SEQ ID NO: 473594 - RNA, 12 nt, Chlamydia trachomatis
ggaagcaaaaac

SEQ ID NO: 473595 - RNA, 21 nt, Chlamydia trachomatis
ggaaggaaaaagaaaaaaaga

SEQ ID NO: 473596 - RNA, 16 nt, Chlamydia trachomatis
ggaaggauguuucccu

SEQ ID NO: 473597 - RNA, 23 nt, Chlamydia trachomatis
ggaauacuguuuguuaucuaaau

SEQ ID NO: 473598 - RNA, 16 nt, Chlamydia trachomatis
aaagggagaggauucc

SEQ ID NO: 473599 - RNA, 18 nt, Chlamydia trachomatis
ggacccaugaacagcauu

SEQ ID NO: 473600 - RNA, 23 nt, Chlamydia trachomatis
aaaggggaaguccgauaggaaaa

SEQ ID NO: 473601 - RNA, 17 nt, Chlamydia trachomatis
ggaccuaauaucugcuc

SEQ ID NO: 473602 - RNA, 20 nt, Chlamydia trachomatis
ggaaucucgagcuaagaaaa

SEQ ID NO: 473603 - RNA, 15 nt, Chlamydia trachomatis
ggaaucuucuucgga

SEQ ID NO: 473604 - RNA, 12 nt, Chlamydia trachomatis
ggagaagaagag

SEQ ID NO: 473605 - RNA, 13 nt, Chlamydia trachomatis
ggagaagaagagg

SEQ ID NO: 473606 - RNA, 17 nt, Chlamydia trachomatis
ggagaaggggaaggaau

SEQ ID NO: 473607 - RNA, 13 nt, Chlamydia trachomatis
aaagguuuuucuu

SEQ ID NO: 473608 - RNA, 18 nt, Chlamydia trachomatis
ggacuaguccugaagcaa

SEQ ID NO: 473609 - RNA, 14 nt, Chlamydia trachomatis
aaagguuguugcca

SEQ ID NO: 473610 - RNA, 19 nt, Chlamydia trachomatis
aaagguuucuggaaaaucu

SEQ ID NO: 473611 - RNA, 21 nt, Chlamydia trachomatis
aaagguuuguuuccucucucu

SEQ ID NO: 473612 - RNA, 17 nt, Chlamydia trachomatis
ggagccuacguccugau

SEQ ID NO: 473613 - RNA, 20 nt, Chlamydia trachomatis
ggagauguaggauucagaga

SEQ ID NO: 473614 - RNA, 22 nt, Chlamydia trachomatis
ggagcgauagaauuucuuccuc

SEQ ID NO: 473615 - RNA, 17 nt, Chlamydia trachomatis
ggagauguuuacugaga

SEQ ID NO: 473616 - RNA, 17 nt, Chlamydia trachomatis
ggagaucccaaaagauu

SEQ ID NO: 473617 - RNA, 23 nt, Chlamydia trachomatis
ggagaguuuugcuacagcuguug

SEQ ID NO: 473618 - RNA, 21 nt, Chlamydia trachomatis
ggagacaacaaguugauacaa

SEQ ID NO: 473619 - RNA, 13 nt, Chlamydia trachomatis
ggagggagaugau

SEQ ID NO: 473620 - RNA, 15 nt, Chlamydia trachomatis
ggaggcaacaaauaa

SEQ ID NO: 473621 - RNA, 15 nt, Chlamydia trachomatis
ggaggacuaacaugc

SEQ ID NO: 473622 - RNA, 23 nt, Chlamydia trachomatis
ggaguacuucuaaaauuugugug

SEQ ID NO: 473623 - RNA, 19 nt, Chlamydia trachomatis
ggauccuaaauccagcgug

SEQ ID NO: 473624 - RNA, 11 nt, Chlamydia trachomatis
ggaucagcaug

SEQ ID NO: 473625 - RNA, 20 nt, Chlamydia trachomatis
ggaucaccgaacaaccuucu

SEQ ID NO: 473626 - RNA, 15 nt, Chlamydia trachomatis
ggauaucuucuugaa

SEQ ID NO: 473627 - RNA, 15 nt, Chlamydia trachomatis
ggauugacagcuguu

SEQ ID NO: 473628 - RNA, 21 nt, Chlamydia trachomatis
ggauugcaauccuuuuuccuu

SEQ ID NO: 473629 - RNA, 16 nt, Chlamydia trachomatis
ggauugggggcggcag

SEQ ID NO: 473630 - RNA, 19 nt, Chlamydia trachomatis
ggcaauccuuuugauucug

SEQ ID NO: 473631 - RNA, 18 nt, Chlamydia trachomatis
ggcaauuccucuaaacaa

SEQ ID NO: 473632 - RNA, 18 nt, Chlamydia trachomatis
ggcaccccuaaaagagcu

SEQ ID NO: 473633 - RNA, 16 nt, Chlamydia trachomatis
ggcagcagagccaaaa

SEQ ID NO: 473634 - RNA, 17 nt, Chlamydia trachomatis
ggcacucaaauuucucu

SEQ ID NO: 473635 - RNA, 12 nt, Chlamydia trachomatis
ggcauagucuug

SEQ ID NO: 473636 - RNA, 17 nt, Chlamydia trachomatis
ggcauaaaagagaagaa

SEQ ID NO: 473637 - RNA, 23 nt, Chlamydia trachomatis
ggcccaacuggcaagucuaggag

SEQ ID NO: 473638 - RNA, 17 nt, Chlamydia trachomatis
aaaguuccaucuccuga

SEQ ID NO: 473639 - RNA, 23 nt, Chlamydia trachomatis
aaaguuccaucuccugauuccga

SEQ ID NO: 473640 - RNA, 20 nt, Chlamydia trachomatis
aaaguuggucgcagaauaag

SEQ ID NO: 473641 - RNA, 14 nt, Chlamydia trachomatis
aaaguucucucccu

SEQ ID NO: 473642 - RNA, 20 nt, Chlamydia trachomatis
aaauaaaaaaaaagaggagg

SEQ ID NO: 473643 - RNA, 22 nt, Chlamydia trachomatis
aaaguuuucgaauuuuuuucuu

SEQ ID NO: 473644 - RNA, 15 nt, Chlamydia trachomatis
ggccuccauuuccau

SEQ ID NO: 473645 - RNA, 13 nt, Chlamydia trachomatis
aaauaaaaagccc

SEQ ID NO: 473646 - RNA, 14 nt, Chlamydia trachomatis
aaauaaaacgaaaa

SEQ ID NO: 473647 - RNA, 15 nt, Chlamydia trachomatis
aaauaaagaaauuau

SEQ ID NO: 473648 - RNA, 12 nt, Chlamydia trachomatis
aaauaaagaggu

SEQ ID NO: 473649 - RNA, 13 nt, Chlamydia trachomatis
ggcgaaugcccuu

SEQ ID NO: 473650 - RNA, 18 nt, Chlamydia trachomatis
ggcgaauuucucuaucug

SEQ ID NO: 473651 - RNA, 16 nt, Chlamydia trachomatis
ggcgaauuucuugaac

SEQ ID NO: 473652 - RNA, 22 nt, Chlamydia trachomatis
aaauacaaaucuuuuaucuucu

SEQ ID NO: 473653 - RNA, 14 nt, Chlamydia trachomatis
aaauacacagcauc

SEQ ID NO: 473654 - RNA, 24 nt, Chlamydia trachomatis
ggcgcgcgcguaauuuucuagcuu

SEQ ID NO: 473655 - RNA, 20 nt, Chlamydia trachomatis
ggcgcuucucuuugaaagag

SEQ ID NO: 473656 - RNA, 19 nt, Chlamydia trachomatis
ggcggcgguggaagaucuu

SEQ ID NO: 473657 - RNA, 13 nt, Chlamydia trachomatis
ggcuaaagaagag

SEQ ID NO: 473658 - RNA, 17 nt, Chlamydia trachomatis
ggcuagccguguucuga

SEQ ID NO: 473659 - RNA, 18 nt, Chlamydia trachomatis
ggcuagccguguucugaa

SEQ ID NO: 473660 - RNA, 16 nt, Chlamydia trachomatis
ggcuccuaacaaagcu

SEQ ID NO: 473661 - RNA, 15 nt, Chlamydia trachomatis
ggugacccauaagau

SEQ ID NO: 473662 - RNA, 12 nt, Chlamydia trachomatis
ggcuccccagaa

SEQ ID NO: 473663 - RNA, 12 nt, Chlamydia trachomatis
ggugacgaaucc

SEQ ID NO: 473664 - RNA, 22 nt, Chlamydia trachomatis
ggugacgaauccagaaagagcg

SEQ ID NO: 473665 - RNA, 20 nt, Chlamydia trachomatis
ggugcacaaguuuauggaaa

SEQ ID NO: 473666 - RNA, 22 nt, Chlamydia trachomatis
ggugauuuucuuuaggcauuaa

SEQ ID NO: 473667 - RNA, 22 nt, Chlamydia trachomatis
gguggacuuaacuacucaacaa

SEQ ID NO: 473668 - RNA, 15 nt, Chlamydia trachomatis
gguuccaucuaaagg

SEQ ID NO: 473669 - RNA, 23 nt, Chlamydia trachomatis
gguuaccugugaagaaacuucug

SEQ ID NO: 473670 - RNA, 14 nt, Chlamydia trachomatis
gguuaugagcccaa

SEQ ID NO: 473671 - RNA, 14 nt, Chlamydia trachomatis
gguguuagaaaaua

SEQ ID NO: 473672 - RNA, 12 nt, Chlamydia trachomatis
ggugugauagga

SEQ ID NO: 473673 - RNA, 11 nt, Chlamydia trachomatis
gguucugccag

SEQ ID NO: 473674 - RNA, 21 nt, Chlamydia trachomatis
gguucugccaguuaaucaauu

SEQ ID NO: 473675 - RNA, 19 nt, Chlamydia trachomatis
gguucuuagcgcuuguaug

SEQ ID NO: 473676 - RNA, 21 nt, Chlamydia trachomatis
gguucuucugagcuagaaugu

SEQ ID NO: 473677 - RNA, 21 nt, Chlamydia trachomatis
gguuggaaaucuucgugcagg

SEQ ID NO: 473678 - RNA, 16 nt, Chlamydia trachomatis
gguuguagaggagaag

SEQ ID NO: 473679 - RNA, 14 nt, Chlamydia trachomatis
gguugugaagaacu

SEQ ID NO: 473680 - RNA, 19 nt, Chlamydia trachomatis
gguuguuacagucuguguu

SEQ ID NO: 473681 - RNA, 16 nt, Chlamydia trachomatis
gguuucuuaaacaaaa

SEQ ID NO: 473682 - RNA, 16 nt, Chlamydia trachomatis
guaaaaauagaaaacg

SEQ ID NO: 473683 - RNA, 17 nt, Chlamydia trachomatis
guaaaagaguaagugcu

SEQ ID NO: 473684 - RNA, 21 nt, Chlamydia trachomatis
guaaaauagcacgcaaaacau

SEQ ID NO: 473685 - RNA, 15 nt, Chlamydia trachomatis
guaaacaagaauaau

SEQ ID NO: 473686 - RNA, 24 nt, Chlamydia trachomatis
guaaacaauauucuuuuccauauu

SEQ ID NO: 473687 - RNA, 21 nt, Chlamydia trachomatis
guaaagcugcuuuacaucccu

SEQ ID NO: 473688 - RNA, 15 nt, Chlamydia trachomatis
guaaaggaugaucuu

SEQ ID NO: 473689 - RNA, 14 nt, Chlamydia trachomatis
guaaacucaagggc

SEQ ID NO: 473690 - RNA, 14 nt, Chlamydia trachomatis
guaaagaaaagcuc

SEQ ID NO: 473691 - RNA, 15 nt, Chlamydia trachomatis
guaaauauuuugcca

SEQ ID NO: 473692 - RNA, 22 nt, Chlamydia trachomatis
guaaauccuugcuaggagguuu

SEQ ID NO: 473693 - RNA, 10 nt, Chlamydia trachomatis
guaacaauau

SEQ ID NO: 473694 - RNA, 16 nt, Chlamydia trachomatis
guaacaaucacaggcu

SEQ ID NO: 473695 - RNA, 19 nt, Chlamydia trachomatis
guaacaccaaauccuccau

SEQ ID NO: 473696 - RNA, 15 nt, Chlamydia trachomatis
guaaccaagcuuagc

SEQ ID NO: 473697 - RNA, 18 nt, Chlamydia trachomatis
guaaccagcggcaaaaau

SEQ ID NO: 473698 - RNA, 14 nt, Chlamydia trachomatis
guaacgaggccucc

SEQ ID NO: 473699 - RNA, 16 nt, Chlamydia trachomatis
guaacuaaauuuuuaa

SEQ ID NO: 473700 - RNA, 15 nt, Chlamydia trachomatis
guaagcaacgacaaa

SEQ ID NO: 473701 - RNA, 15 nt, Chlamydia trachomatis
guaagaucuguagca

SEQ ID NO: 473702 - RNA, 19 nt, Chlamydia trachomatis
guaagaucuguagcaagaa

SEQ ID NO: 473703 - RNA, 11 nt, Chlamydia trachomatis
guaauaucaaa

SEQ ID NO: 473704 - RNA, 14 nt, Chlamydia trachomatis
guaauaucaaagag

SEQ ID NO: 473705 - RNA, 20 nt, Chlamydia trachomatis
guaauaaacccuggaugcac

SEQ ID NO: 473706 - RNA, 21 nt, Chlamydia trachomatis
guaaggaagccagccccuccc

SEQ ID NO: 473707 - RNA, 15 nt, Chlamydia trachomatis
guaagcgcuuccauu

SEQ ID NO: 473708 - RNA, 20 nt, Chlamydia trachomatis
guaagcuaauuuuucucuaa

SEQ ID NO: 473709 - RNA, 13 nt, Chlamydia trachomatis
guaagcgaagaag

SEQ ID NO: 473710 - RNA, 23 nt, Chlamydia trachomatis
guaagggguuuucuuggcaggcg

SEQ ID NO: 473711 - RNA, 17 nt, Chlamydia trachomatis
guaagugcauaccuguu

SEQ ID NO: 473712 - RNA, 11 nt, Chlamydia trachomatis
guaagugcuaa

SEQ ID NO: 473713 - RNA, 14 nt, Chlamydia trachomatis
guaaguguugagga

SEQ ID NO: 473714 - RNA, 16 nt, Chlamydia trachomatis
guacccacugcacagg

SEQ ID NO: 473715 - RNA, 16 nt, Chlamydia trachomatis
guacggaguaucuauc

SEQ ID NO: 473716 - RNA, 21 nt, Chlamydia trachomatis
guacggcagccgaaacagacu

SEQ ID NO: 473717 - RNA, 21 nt, Chlamydia trachomatis
guacgcuaaaaacucuuucau

SEQ ID NO: 473718 - RNA, 18 nt, Chlamydia trachomatis
guacgccguaagcauucc

SEQ ID NO: 473719 - RNA, 18 nt, Chlamydia trachomatis
guaccuggaaaggagaaa

SEQ ID NO: 473720 - RNA, 18 nt, Chlamydia trachomatis
guaccaaggauuuuuuuc

SEQ ID NO: 473721 - RNA, 14 nt, Chlamydia trachomatis
guacaggcauuucc

SEQ ID NO: 473722 - RNA, 23 nt, Chlamydia trachomatis
guacaaggcucuugaaaaggagc

SEQ ID NO: 473723 - RNA, 22 nt, Chlamydia trachomatis
guacaaucauuauccauaaaaa

SEQ ID NO: 473724 - RNA, 21 nt, Chlamydia trachomatis
guaauuuggcucuuuaauauu

SEQ ID NO: 473725 - RNA, 16 nt, Chlamydia trachomatis
guaauuuuaaauccug

SEQ ID NO: 473726 - RNA, 19 nt, Chlamydia trachomatis
guaauuuucuagcuucuug

SEQ ID NO: 473727 - RNA, 22 nt, Chlamydia trachomatis
guaauguccucuuuaucuaaag

SEQ ID NO: 473728 - RNA, 15 nt, Chlamydia trachomatis
guaauuccaaauaau

SEQ ID NO: 473729 - RNA, 17 nt, Chlamydia trachomatis
guaauuccaaauaauac

SEQ ID NO: 473730 - RNA, 16 nt, Chlamydia trachomatis
guaauucgagccuguu

SEQ ID NO: 473731 - RNA, 22 nt, Chlamydia trachomatis
guaauucgagccuguuuugcaa

SEQ ID NO: 473732 - RNA, 16 nt, Chlamydia trachomatis
guaaucgcuucugcug

SEQ ID NO: 473733 - RNA, 19 nt, Chlamydia trachomatis
guaaucuucacggagagaa

SEQ ID NO: 473734 - RNA, 21 nt, Chlamydia trachomatis
guaaucuucacggagagaaag

SEQ ID NO: 473735 - RNA, 14 nt, Chlamydia trachomatis
guaaugaaggaaau

SEQ ID NO: 473736 - RNA, 19 nt, Chlamydia trachomatis
guaaugaucagcaaaaaga

SEQ ID NO: 473737 - RNA, 21 nt, Chlamydia trachomatis
guaaugccuuuuguuuucaaa

SEQ ID NO: 473738 - RNA, 16 nt, Chlamydia trachomatis
guagaaccacuuuucu

SEQ ID NO: 473739 - RNA, 18 nt, Chlamydia trachomatis
guagaaacuuacuuuucu

SEQ ID NO: 473740 - RNA, 20 nt, Chlamydia trachomatis
guagaaacuuacuuuucuua

SEQ ID NO: 473741 - RNA, 19 nt, Chlamydia trachomatis
guacuuuugguucugccag

SEQ ID NO: 473742 - RNA, 10 nt, Chlamydia trachomatis
guagaaaaag

SEQ ID NO: 473743 - RNA, 15 nt, Chlamydia trachomatis
guagaaaaggauagu

SEQ ID NO: 473744 - RNA, 12 nt, Chlamydia trachomatis
guacuuacccuu

SEQ ID NO: 473745 - RNA, 17 nt, Chlamydia trachomatis
guacuucuaaaauuugu

SEQ ID NO: 473746 - RNA, 16 nt, Chlamydia trachomatis
guacucugauuagaag

SEQ ID NO: 473747 - RNA, 19 nt, Chlamydia trachomatis
guacucugcaaaaucuucc

SEQ ID NO: 473748 - RNA, 23 nt, Chlamydia trachomatis
guacugauauucuuuuaauacuu

SEQ ID NO: 473749 - RNA, 22 nt, Chlamydia trachomatis
guacuccucaagcgauuaugaa

SEQ ID NO: 473750 - RNA, 14 nt, Chlamydia trachomatis
guagaauuucuucu

SEQ ID NO: 473751 - RNA, 14 nt, Chlamydia trachomatis
guagaggagaacaa

SEQ ID NO: 473752 - RNA, 17 nt, Chlamydia trachomatis
guagagacgagaaaucu

SEQ ID NO: 473753 - RNA, 12 nt, Chlamydia trachomatis
guagagcaagau

SEQ ID NO: 473754 - RNA, 15 nt, Chlamydia trachomatis
guagagguuuccuua

SEQ ID NO: 473755 - RNA, 21 nt, Chlamydia trachomatis
guagauccgauaucagcaaaa

SEQ ID NO: 473756 - RNA, 13 nt, Chlamydia trachomatis
guagccaaagaau

SEQ ID NO: 473757 - RNA, 14 nt, Chlamydia trachomatis
guagcaaucacuaa

SEQ ID NO: 473758 - RNA, 18 nt, Chlamydia trachomatis
guagauucuggaggagga

SEQ ID NO: 473759 - RNA, 19 nt, Chlamydia trachomatis
guagauucuggaggaggac

SEQ ID NO: 473760 - RNA, 17 nt, Chlamydia trachomatis
guagaugcuuuguaaaa

SEQ ID NO: 473761 - RNA, 13 nt, Chlamydia trachomatis
guagaucuuuucg

SEQ ID NO: 473762 - RNA, 17 nt, Chlamydia trachomatis
guagcgagcaagcuuuu

SEQ ID NO: 473763 - RNA, 15 nt, Chlamydia trachomatis
guagccccuuuagaa

SEQ ID NO: 473764 - RNA, 22 nt, Chlamydia trachomatis
guaggcacucgagucaugcaaa

SEQ ID NO: 473765 - RNA, 22 nt, Chlamydia trachomatis
guaggaucgccgguuaacacaa

SEQ ID NO: 473766 - RNA, 17 nt, Chlamydia trachomatis
guaggauucagagaggu

SEQ ID NO: 473767 - RNA, 15 nt, Chlamydia trachomatis
guaggacucuaagag

SEQ ID NO: 473768 - RNA, 23 nt, Chlamydia trachomatis
guagcucguuuuuuuguuguugc

SEQ ID NO: 473769 - RNA, 16 nt, Chlamydia trachomatis
guagcuaaauucaggg

SEQ ID NO: 473770 - RNA, 12 nt, Chlamydia trachomatis
guaguaagaccc

SEQ ID NO: 473771 - RNA, 15 nt, Chlamydia trachomatis
guaggguagaacagg

SEQ ID NO: 473772 - RNA, 14 nt, Chlamydia trachomatis
guagguaucugaau

SEQ ID NO: 473773 - RNA, 20 nt, Chlamydia trachomatis
guagugggcucguggagggg

SEQ ID NO: 473774 - RNA, 17 nt, Chlamydia trachomatis
guagucucuagcaucgu

SEQ ID NO: 473775 - RNA, 19 nt, Chlamydia trachomatis
guagugccagcauucauaa

SEQ ID NO: 473776 - RNA, 19 nt, Chlamydia trachomatis
guaguauuuaacuuuucaa

SEQ ID NO: 473777 - RNA, 12 nt, Chlamydia trachomatis
guaguuagguaa

SEQ ID NO: 473778 - RNA, 12 nt, Chlamydia trachomatis
guauaagaaaaa

SEQ ID NO: 473779 - RNA, 23 nt, Chlamydia trachomatis
guauaauuuacgaaguauuuucg

SEQ ID NO: 473780 - RNA, 16 nt, Chlamydia trachomatis
guaucugaacaagaag

SEQ ID NO: 473781 - RNA, 20 nt, Chlamydia trachomatis
guaucugaacaagaagauuu

SEQ ID NO: 473782 - RNA, 21 nt, Chlamydia trachomatis
guaucccuaccuaaagggugc

SEQ ID NO: 473783 - RNA, 16 nt, Chlamydia trachomatis
guauccaaaacauaag

SEQ ID NO: 473784 - RNA, 20 nt, Chlamydia trachomatis
guaucaacagaugacucaaa

SEQ ID NO: 473785 - RNA, 13 nt, Chlamydia trachomatis
gucaacauaauag

SEQ ID NO: 473786 - RNA, 15 nt, Chlamydia trachomatis
gucaaaauuaucuaa

SEQ ID NO: 473787 - RNA, 15 nt, Chlamydia trachomatis
guauugugccaccga

SEQ ID NO: 473788 - RNA, 17 nt, Chlamydia trachomatis
guauugugcguaauguu

SEQ ID NO: 473789 - RNA, 22 nt, Chlamydia trachomatis
guauuuaggaacucuaaauacc

SEQ ID NO: 473790 - RNA, 21 nt, Chlamydia trachomatis
guauuugcauugacuaucugc

SEQ ID NO: 473791 - RNA, 18 nt, Chlamydia trachomatis
guauuuuagagaaaagaa

SEQ ID NO: 473792 - RNA, 11 nt, Chlamydia trachomatis
guauuuuauuc

SEQ ID NO: 473793 - RNA, 12 nt, Chlamydia trachomatis
guauuuuauuca

SEQ ID NO: 473794 - RNA, 16 nt, Chlamydia trachomatis
guaugcucgagccugu

SEQ ID NO: 473795 - RNA, 21 nt, Chlamydia trachomatis
guaugcucgccucuaucucuu

SEQ ID NO: 473796 - RNA, 22 nt, Chlamydia trachomatis
guauguuuggauugccugcucc

SEQ ID NO: 473797 - RNA, 22 nt, Chlamydia trachomatis
guauuacggaaaagcuuuuuaa

SEQ ID NO: 473798 - RNA, 19 nt, Chlamydia trachomatis
gucagagagaggcugcauu

SEQ ID NO: 473799 - RNA, 18 nt, Chlamydia trachomatis
gucagcuguacgauggaa

SEQ ID NO: 473800 - RNA, 18 nt, Chlamydia trachomatis
gucaggauuuaaagccuu

SEQ ID NO: 473801 - RNA, 22 nt, Chlamydia trachomatis
guccaugugagaacgaagccca

SEQ ID NO: 473802 - RNA, 22 nt, Chlamydia trachomatis
gucccugugucucgguuuucuu

SEQ ID NO: 473803 - RNA, 22 nt, Chlamydia trachomatis
guccugucguaaugaaggaaau

SEQ ID NO: 473804 - RNA, 14 nt, Chlamydia trachomatis
guccuuaucuucuu

SEQ ID NO: 473805 - RNA, 12 nt, Chlamydia trachomatis
guccuggccaaa

SEQ ID NO: 473806 - RNA, 23 nt, Chlamydia trachomatis
guccuggccaaaaaaucagcuug

SEQ ID NO: 473807 - RNA, 18 nt, Chlamydia trachomatis
guccucggaugaccgaau

SEQ ID NO: 473808 - RNA, 16 nt, Chlamydia trachomatis
gucgaauuuuucugcu

SEQ ID NO: 473809 - RNA, 14 nt, Chlamydia trachomatis
gucguacuccucgu

SEQ ID NO: 473810 - RNA, 21 nt, Chlamydia trachomatis
gucuaaagaucggcuuacauc

SEQ ID NO: 473811 - RNA, 23 nt, Chlamydia trachomatis
gugccagcauucauaaacacagc

SEQ ID NO: 473812 - RNA, 16 nt, Chlamydia trachomatis
gugccgaaggggauuu

SEQ ID NO: 473813 - RNA, 15 nt, Chlamydia trachomatis
gugcauuuguggaca

SEQ ID NO: 473814 - RNA, 20 nt, Chlamydia trachomatis
aaauauagacugucuauuug

SEQ ID NO: 473815 - RNA, 20 nt, Chlamydia trachomatis
aaauauaggguccaaacaua

SEQ ID NO: 473816 - RNA, 16 nt, Chlamydia trachomatis
gugcaguagccauagc

SEQ ID NO: 473817 - RNA, 13 nt, Chlamydia trachomatis
gugcauaccuuuu

SEQ ID NO: 473818 - RNA, 17 nt, Chlamydia trachomatis
gugauuuucuuuaggca

SEQ ID NO: 473819 - RNA, 17 nt, Chlamydia trachomatis
gugaugcggagcgauga

SEQ ID NO: 473820 - RNA, 13 nt, Chlamydia trachomatis
gugauaucuccac

SEQ ID NO: 473821 - RNA, 11 nt, Chlamydia trachomatis
gucucacuucc

SEQ ID NO: 473822 - RNA, 14 nt, Chlamydia trachomatis
gugcuaacuuucuu

SEQ ID NO: 473823 - RNA, 18 nt, Chlamydia trachomatis
gugcuccugcagacaagc

SEQ ID NO: 473824 - RNA, 19 nt, Chlamydia trachomatis
gugguauagaggaauaaga

SEQ ID NO: 473825 - RNA, 16 nt, Chlamydia trachomatis
guguaucaaaaucaau

SEQ ID NO: 473826 - RNA, 18 nt, Chlamydia trachomatis
guguaagcguuuucuagu

SEQ ID NO: 473827 - RNA, 14 nt, Chlamydia trachomatis
guguaaggagagaa

SEQ ID NO: 473828 - RNA, 15 nt, Chlamydia trachomatis
guuauucucaaguug

SEQ ID NO: 473829 - RNA, 18 nt, Chlamydia trachomatis
guuacuaacaucaaagau

SEQ ID NO: 473830 - RNA, 14 nt, Chlamydia trachomatis
guuagacaaaaaau

SEQ ID NO: 473831 - RNA, 17 nt, Chlamydia trachomatis
guuagcaaagacauaaa

SEQ ID NO: 473832 - RNA, 20 nt, Chlamydia trachomatis
guuagcaaagacauaaaagc

SEQ ID NO: 473833 - RNA, 19 nt, Chlamydia trachomatis
guuauaagaccuaauccac

SEQ ID NO: 473834 - RNA, 13 nt, Chlamydia trachomatis
guuacauacuuuu

SEQ ID NO: 473835 - RNA, 13 nt, Chlamydia trachomatis
guuacagaugccu

SEQ ID NO: 473836 - RNA, 16 nt, Chlamydia trachomatis
gugucgaaaaugguuu

SEQ ID NO: 473837 - RNA, 19 nt, Chlamydia trachomatis
guuaaagaauuauuugccu

SEQ ID NO: 473838 - RNA, 13 nt, Chlamydia trachomatis
guucaagagaggc

SEQ ID NO: 473839 - RNA, 13 nt, Chlamydia trachomatis
guucaauuaaaga

SEQ ID NO: 473840 - RNA, 21 nt, Chlamydia trachomatis
guucacugacuguagaaaauc

SEQ ID NO: 473841 - RNA, 14 nt, Chlamydia trachomatis
guucagaacucaaa

SEQ ID NO: 473842 - RNA, 12 nt, Chlamydia trachomatis
guucagaaucug

SEQ ID NO: 473843 - RNA, 15 nt, Chlamydia trachomatis
guucagacagagaag

SEQ ID NO: 473844 - RNA, 21 nt, Chlamydia trachomatis
guucauugguaagauucgaag

SEQ ID NO: 473845 - RNA, 15 nt, Chlamydia trachomatis
guuccuaauagaucu

SEQ ID NO: 473846 - RNA, 21 nt, Chlamydia trachomatis
guuccuauacaagaaaacagc

SEQ ID NO: 473847 - RNA, 21 nt, Chlamydia trachomatis
guucccuuuacaaugaugaga

SEQ ID NO: 473848 - RNA, 15 nt, Chlamydia trachomatis
guucccacaccaucu

SEQ ID NO: 473849 - RNA, 15 nt, Chlamydia trachomatis
guucccauccaaagg

SEQ ID NO: 473850 - RNA, 16 nt, Chlamydia trachomatis
guucgaauccuucucc

SEQ ID NO: 473851 - RNA, 14 nt, Chlamydia trachomatis
guucguauaauuua

SEQ ID NO: 473852 - RNA, 21 nt, Chlamydia trachomatis
guucgcuauaaucccaaaaac

SEQ ID NO: 473853 - RNA, 12 nt, Chlamydia trachomatis
guucucucccuu

SEQ ID NO: 473854 - RNA, 15 nt, Chlamydia trachomatis
guucucucuaaaauc

SEQ ID NO: 473855 - RNA, 19 nt, Chlamydia trachomatis
guucucucucagcagcuuc

SEQ ID NO: 473856 - RNA, 23 nt, Chlamydia trachomatis
guucucuuuauccuguucuccaa

SEQ ID NO: 473857 - RNA, 14 nt, Chlamydia trachomatis
guucuggagcaaca

SEQ ID NO: 473858 - RNA, 21 nt, Chlamydia trachomatis
guucugugggauagaaacuca

SEQ ID NO: 473859 - RNA, 21 nt, Chlamydia trachomatis
guucuugaguagaagaaugaa

SEQ ID NO: 473860 - RNA, 18 nt, Chlamydia trachomatis
guucuucacuuuucuagc

SEQ ID NO: 473861 - RNA, 23 nt, Chlamydia trachomatis
guugaauauaccccgaacaaucu

SEQ ID NO: 473862 - RNA, 19 nt, Chlamydia trachomatis
guugaauuucaggaguagg

SEQ ID NO: 473863 - RNA, 14 nt, Chlamydia trachomatis
guugauagcguucg

SEQ ID NO: 473864 - RNA, 13 nt, Chlamydia trachomatis
guugcauaaauuu

SEQ ID NO: 473865 - RNA, 13 nt, Chlamydia trachomatis
guugcaucaacaa

SEQ ID NO: 473866 - RNA, 13 nt, Chlamydia trachomatis
guuggagaaacaa

SEQ ID NO: 473867 - RNA, 13 nt, Chlamydia trachomatis
guuguagaggaga

SEQ ID NO: 473868 - RNA, 22 nt, Chlamydia trachomatis
guuguaucccuaguacaaaaau

SEQ ID NO: 473869 - RNA, 18 nt, Chlamydia trachomatis
guuguucggauucaucaa

SEQ ID NO: 473870 - RNA, 23 nt, Chlamydia trachomatis
guuguuucuaauggaugaucugu

SEQ ID NO: 473871 - RNA, 14 nt, Chlamydia trachomatis
guuuacaaaugauu

SEQ ID NO: 473872 - RNA, 13 nt, Chlamydia trachomatis
guuuagauguugu

SEQ ID NO: 473873 - RNA, 14 nt, Chlamydia trachomatis
guuuagcagccuga

SEQ ID NO: 473874 - RNA, 20 nt, Chlamydia trachomatis
guuuagccuccaucucugcu

SEQ ID NO: 473875 - RNA, 17 nt, Chlamydia trachomatis
guuuaggcggcauuuua

SEQ ID NO: 473876 - RNA, 23 nt, Chlamydia trachomatis
guuuauaaauuucuaaauauuua

SEQ ID NO: 473877 - RNA, 16 nt, Chlamydia trachomatis
guuuauaacuccaagg

SEQ ID NO: 473878 - RNA, 22 nt, Chlamydia trachomatis
guuuauuaucuagaaaagagca

SEQ ID NO: 473879 - RNA, 22 nt, Chlamydia trachomatis
uaaaagcugcuuuauccaaaga

SEQ ID NO: 473880 - RNA, 13 nt, Chlamydia trachomatis
uaaaaggcuacua

SEQ ID NO: 473881 - RNA, 17 nt, Chlamydia trachomatis
uaaaaggguagaaaaag

SEQ ID NO: 473882 - RNA, 19 nt, Chlamydia trachomatis
uaaaaggguagaaaaagag

SEQ ID NO: 473883 - RNA, 23 nt, Chlamydia trachomatis
uaaaaggguagaaaaagagaaau

SEQ ID NO: 473884 - RNA, 15 nt, Chlamydia trachomatis
uaaaagucucuaaag

SEQ ID NO: 473885 - RNA, 12 nt, Chlamydia trachomatis
uaaaauaaucuu

SEQ ID NO: 473886 - RNA, 13 nt, Chlamydia trachomatis
uaaaauaaucuug

SEQ ID NO: 473887 - RNA, 19 nt, Chlamydia trachomatis
uaaaauagcacgcaaaaca

SEQ ID NO: 473888 - RNA, 16 nt, Chlamydia trachomatis
uaaaauccaauguaaa

SEQ ID NO: 473889 - RNA, 22 nt, Chlamydia trachomatis
uaaaauccuucugccucuuuua

SEQ ID NO: 473890 - RNA, 12 nt, Chlamydia trachomatis
uaaaaugagaaa

SEQ ID NO: 473891 - RNA, 13 nt, Chlamydia trachomatis
uaaaauggaaaua

SEQ ID NO: 473892 - RNA, 17 nt, Chlamydia trachomatis
uaaaacgaaaaacagaa

SEQ ID NO: 473893 - RNA, 21 nt, Chlamydia trachomatis
uaaaacgaaaaacagaaagaa

SEQ ID NO: 473894 - RNA, 16 nt, Chlamydia trachomatis
uaaaacuacagaaaga

SEQ ID NO: 473895 - RNA, 18 nt, Chlamydia trachomatis
uaaaacuacagaaagagu

SEQ ID NO: 473896 - RNA, 19 nt, Chlamydia trachomatis
uaaaacuacagaaagaguc

SEQ ID NO: 473897 - RNA, 19 nt, Chlamydia trachomatis
uaaaacuaccugauagagu

SEQ ID NO: 473898 - RNA, 11 nt, Chlamydia trachomatis
uaaaagaagcu

SEQ ID NO: 473899 - RNA, 15 nt, Chlamydia trachomatis
uaaaagaguaagugc

SEQ ID NO: 473900 - RNA, 22 nt, Chlamydia trachomatis
uaaaacauuucugcaacucucu

SEQ ID NO: 473901 - RNA, 13 nt, Chlamydia trachomatis
uaaaacauuuuau

SEQ ID NO: 473902 - RNA, 16 nt, Chlamydia trachomatis
uaaaacaaccauaaua

SEQ ID NO: 473903 - RNA, 20 nt, Chlamydia trachomatis
uaaaacaauuuccuuagaaa

SEQ ID NO: 473904 - RNA, 13 nt, Chlamydia trachomatis
uaaaaaugcuugc

SEQ ID NO: 473905 - RNA, 14 nt, Chlamydia trachomatis
uaaaaauucuaaag

SEQ ID NO: 473906 - RNA, 14 nt, Chlamydia trachomatis
uaaaaauagaaaac

SEQ ID NO: 473907 - RNA, 21 nt, Chlamydia trachomatis
uaaaaaggcuagagauaucac

SEQ ID NO: 473908 - RNA, 19 nt, Chlamydia trachomatis
uaaaaagggggcuuuagca

SEQ ID NO: 473909 - RNA, 14 nt, Chlamydia trachomatis
uaaaaacuggagaa

SEQ ID NO: 473910 - RNA, 18 nt, Chlamydia trachomatis
uaaaaagccauacaaaga

SEQ ID NO: 473911 - RNA, 21 nt, Chlamydia trachomatis
uaaaaagcccuuuccucauaa

SEQ ID NO: 473912 - RNA, 16 nt, Chlamydia trachomatis
uaaaaagccaagagaa

SEQ ID NO: 473913 - RNA, 20 nt, Chlamydia trachomatis
uaaaaaaucuugucguuccu

SEQ ID NO: 473914 - RNA, 16 nt, Chlamydia trachomatis
uaaaaacgcuccaaau

SEQ ID NO: 473915 - RNA, 15 nt, Chlamydia trachomatis
uaaaaacucuuucau

SEQ ID NO: 473916 - RNA, 12 nt, Chlamydia trachomatis
guuuuuuuguuu

SEQ ID NO: 473917 - RNA, 18 nt, Chlamydia trachomatis
uaaaaaaagucuguuccu

SEQ ID NO: 473918 - RNA, 17 nt, Chlamydia trachomatis
uaaaaaaauucuugcca

SEQ ID NO: 473919 - RNA, 24 nt, Chlamydia trachomatis
uaaaaaacaaugauauucuaaucc

SEQ ID NO: 473920 - RNA, 17 nt, Chlamydia trachomatis
uaaaaaagauaauccaa

SEQ ID NO: 473921 - RNA, 22 nt, Chlamydia trachomatis
guuuuucuaagugcaucauuuu

SEQ ID NO: 473922 - RNA, 16 nt, Chlamydia trachomatis
guuuuucuccucucuc

SEQ ID NO: 473923 - RNA, 18 nt, Chlamydia trachomatis
guuuuucuccucucucuu

SEQ ID NO: 473924 - RNA, 13 nt, Chlamydia trachomatis
guuuguuuuuuuc

SEQ ID NO: 473925 - RNA, 15 nt, Chlamydia trachomatis
guuuguuuuuuucaa

SEQ ID NO: 473926 - RNA, 19 nt, Chlamydia trachomatis
guuuuaauuccaucuuuuc

SEQ ID NO: 473927 - RNA, 22 nt, Chlamydia trachomatis
guuuauuuuccgaauaaaauca

SEQ ID NO: 473928 - RNA, 21 nt, Chlamydia trachomatis
guuucaaacauccaguaauuu

SEQ ID NO: 473929 - RNA, 16 nt, Chlamydia trachomatis
guuucuucuuuugaga

SEQ ID NO: 473930 - RNA, 23 nt, Chlamydia trachomatis
guuucuugcugggagauagcucg

SEQ ID NO: 473931 - RNA, 13 nt, Chlamydia trachomatis
guuugaucugaga

SEQ ID NO: 473932 - RNA, 14 nt, Chlamydia trachomatis
guuugcacaagaua

SEQ ID NO: 473933 - RNA, 12 nt, Chlamydia trachomatis
guuuucgaauuu

SEQ ID NO: 473934 - RNA, 19 nt, Chlamydia trachomatis
guuuucgaauuuuuuucuu

SEQ ID NO: 473935 - RNA, 21 nt, Chlamydia trachomatis
guuuucgaauuuuuuucuuug

SEQ ID NO: 473936 - RNA, 22 nt, Chlamydia trachomatis
guuuucgacggaacucuuuauu

SEQ ID NO: 473937 - RNA, 19 nt, Chlamydia trachomatis
guuuuccgcacccaaucuu

SEQ ID NO: 473938 - RNA, 20 nt, Chlamydia trachomatis
guuuucucuugaaaaaacca

SEQ ID NO: 473939 - RNA, 21 nt, Chlamydia trachomatis
guuuucuugugauaucuccac

SEQ ID NO: 473940 - RNA, 21 nt, Chlamydia trachomatis
guuuugucucgcagcaccugu

SEQ ID NO: 473941 - RNA, 20 nt, Chlamydia trachomatis
guuuuguucguaaugaugua

SEQ ID NO: 473942 - RNA, 23 nt, Chlamydia trachomatis
aaaucaguggaacugcuucccuc

SEQ ID NO: 473943 - RNA, 18 nt, Chlamydia trachomatis
aaaucaugaauuguuucu

SEQ ID NO: 473944 - RNA, 20 nt, Chlamydia trachomatis
aaaucauggauguacgcucu

SEQ ID NO: 473945 - RNA, 18 nt, Chlamydia trachomatis
uaaacgguugauaaacuc

SEQ ID NO: 473946 - RNA, 13 nt, Chlamydia trachomatis
uaaacccucugca

SEQ ID NO: 473947 - RNA, 12 nt, Chlamydia trachomatis
uaaacccacgaa

SEQ ID NO: 473948 - RNA, 16 nt, Chlamydia trachomatis
uaaacuucuuguuaau

SEQ ID NO: 473949 - RNA, 19 nt, Chlamydia trachomatis
uaaacuuucuugcaugacu

SEQ ID NO: 473950 - RNA, 20 nt, Chlamydia trachomatis
uaaagaaagcccuauuuccu

SEQ ID NO: 473951 - RNA, 22 nt, Chlamydia trachomatis
uaaagaagccauaguagaaauu

SEQ ID NO: 473952 - RNA, 14 nt, Chlamydia trachomatis
uaaagaagccuucu

SEQ ID NO: 473953 - RNA, 23 nt, Chlamydia trachomatis
uaaagaaggaaaauccauugauu

SEQ ID NO: 473954 - RNA, 14 nt, Chlamydia trachomatis
uaaaauuacaauaa

SEQ ID NO: 473955 - RNA, 18 nt, Chlamydia trachomatis
uaaaauuuccuuauacau

SEQ ID NO: 473956 - RNA, 21 nt, Chlamydia trachomatis
uaaacaaaagauuauaggggu

SEQ ID NO: 473957 - RNA, 21 nt, Chlamydia trachomatis
uaaacaauauucuuuuccaua

SEQ ID NO: 473958 - RNA, 22 nt, Chlamydia trachomatis
uaaacaauauucuuuuccauau

SEQ ID NO: 473959 - RNA, 21 nt, Chlamydia trachomatis
uaaacacaaguaugagaggaa

SEQ ID NO: 473960 - RNA, 17 nt, Chlamydia trachomatis
uaaacauacacagauac

SEQ ID NO: 473961 - RNA, 20 nt, Chlamydia trachomatis
uaaacauacacagauacuga

SEQ ID NO: 473962 - RNA, 13 nt, Chlamydia trachomatis
uaaagauuuuccu

SEQ ID NO: 473963 - RNA, 16 nt, Chlamydia trachomatis
uaaagaagaggagaua

SEQ ID NO: 473964 - RNA, 23 nt, Chlamydia trachomatis
uaaagacguucuugcugagaauc

SEQ ID NO: 473965 - RNA, 16 nt, Chlamydia trachomatis
uaaagagaucucucca

SEQ ID NO: 473966 - RNA, 20 nt, Chlamydia trachomatis
uaaaggugcgauuacuucag

SEQ ID NO: 473967 - RNA, 14 nt, Chlamydia trachomatis
uaaagcggcuaaag

SEQ ID NO: 473968 - RNA, 21 nt, Chlamydia trachomatis
uaaagccuuucucuaaaagaa

SEQ ID NO: 473969 - RNA, 11 nt, Chlamydia trachomatis
uaaaggaucau

SEQ ID NO: 473970 - RNA, 21 nt, Chlamydia trachomatis
uaaauacaaaucuuuuaucuu

SEQ ID NO: 473971 - RNA, 16 nt, Chlamydia trachomatis
uaaauauuaucagacc

SEQ ID NO: 473972 - RNA, 16 nt, Chlamydia trachomatis
uaaauauucauauguu

SEQ ID NO: 473973 - RNA, 20 nt, Chlamydia trachomatis
uaacaaccaucaaagcagcg

SEQ ID NO: 473974 - RNA, 21 nt, Chlamydia trachomatis
uaaauugcgacaccuaauccu

SEQ ID NO: 473975 - RNA, 13 nt, Chlamydia trachomatis
uaaauauuuugcc

SEQ ID NO: 473976 - RNA, 14 nt, Chlamydia trachomatis
uaaauauuuugcca

SEQ ID NO: 473977 - RNA, 17 nt, Chlamydia trachomatis
uaaaucuauccauaauu

SEQ ID NO: 473978 - RNA, 13 nt, Chlamydia trachomatis
uaacaggcuuccu

SEQ ID NO: 473979 - RNA, 21 nt, Chlamydia trachomatis
uaacagggauggucucacaca

SEQ ID NO: 473980 - RNA, 12 nt, Chlamydia trachomatis
uaacagcucuuc

SEQ ID NO: 473981 - RNA, 15 nt, Chlamydia trachomatis
uaacaggaagaauau

SEQ ID NO: 473982 - RNA, 19 nt, Chlamydia trachomatis
uaacaauccccaaaccagu

SEQ ID NO: 473983 - RNA, 13 nt, Chlamydia trachomatis
uaacaauccuaga

SEQ ID NO: 473984 - RNA, 23 nt, Chlamydia trachomatis
uaacaauccuagacgauuaauag

SEQ ID NO: 473985 - RNA, 21 nt, Chlamydia trachomatis
uaacaaugcugauaaaaauaa

SEQ ID NO: 473986 - RNA, 14 nt, Chlamydia trachomatis
uaacagcaagacaa

SEQ ID NO: 473987 - RNA, 15 nt, Chlamydia trachomatis
uaacagcaagcuugu

SEQ ID NO: 473988 - RNA, 15 nt, Chlamydia trachomatis
uaacagcacaaacaa

SEQ ID NO: 473989 - RNA, 20 nt, Chlamydia trachomatis
uaacauucugaacauacaau

SEQ ID NO: 473990 - RNA, 17 nt, Chlamydia trachomatis
uaaccaaaaaaaggcuc

SEQ ID NO: 473991 - RNA, 11 nt, Chlamydia trachomatis
uaaccaaacag

SEQ ID NO: 473992 - RNA, 21 nt, Chlamydia trachomatis
uaaccaugagcuccaaaguaa

SEQ ID NO: 473993 - RNA, 17 nt, Chlamydia trachomatis
uaaccggaacaaucacg

SEQ ID NO: 473994 - RNA, 22 nt, Chlamydia trachomatis
uaaccucuacgaaaaagucaag

SEQ ID NO: 473995 - RNA, 18 nt, Chlamydia trachomatis
uaaccucugcaagaaaau

SEQ ID NO: 473996 - RNA, 20 nt, Chlamydia trachomatis
uaaccucugcaagaaaauaa

SEQ ID NO: 473997 - RNA, 14 nt, Chlamydia trachomatis
uaaccugaagauuu

SEQ ID NO: 473998 - RNA, 14 nt, Chlamydia trachomatis
uaaugcuuagaaac

SEQ ID NO: 473999 - RNA, 18 nt, Chlamydia trachomatis
uaaugcaggcgagucuuu

SEQ ID NO: 474000 - RNA, 16 nt, Chlamydia trachomatis
uaaucuucuauuuguu

SEQ ID NO: 474001 - RNA, 17 nt, Chlamydia trachomatis
uaaucuuggacuuucua

SEQ ID NO: 474002 - RNA, 13 nt, Chlamydia trachomatis
uaaugaaggaaau

SEQ ID NO: 474003 - RNA, 21 nt, Chlamydia trachomatis
uaaugaagguuucuaaaaaac

SEQ ID NO: 474004 - RNA, 14 nt, Chlamydia trachomatis
uaaucggcaaaaga

SEQ ID NO: 474005 - RNA, 20 nt, Chlamydia trachomatis
uaaucuaaagacaaaacuuc

SEQ ID NO: 474006 - RNA, 12 nt, Chlamydia trachomatis
uaaucuauuuua

SEQ ID NO: 474007 - RNA, 14 nt, Chlamydia trachomatis
uaaucucuuaaucc

SEQ ID NO: 474008 - RNA, 20 nt, Chlamydia trachomatis
uaacgaggcacaaaaucccu

SEQ ID NO: 474009 - RNA, 22 nt, Chlamydia trachomatis
uaacgaguacagaauagaaauu

SEQ ID NO: 474010 - RNA, 19 nt, Chlamydia trachomatis
uaacgauaguacaaguaua

SEQ ID NO: 474011 - RNA, 19 nt, Chlamydia trachomatis
uaacgauucuugauaaaua

SEQ ID NO: 474012 - RNA, 15 nt, Chlamydia trachomatis
uaauccguaguuggc

SEQ ID NO: 474013 - RNA, 13 nt, Chlamydia trachomatis
uaauucuucuuga

SEQ ID NO: 474014 - RNA, 12 nt, Chlamydia trachomatis
uaauuuccccua

SEQ ID NO: 474015 - RNA, 23 nt, Chlamydia trachomatis
uaauuucugaguccucuaaagua

SEQ ID NO: 474016 - RNA, 22 nt, Chlamydia trachomatis
uaauuucuagauggauaaucuc

SEQ ID NO: 474017 - RNA, 13 nt, Chlamydia trachomatis
uaaugggcuccuu

SEQ ID NO: 474018 - RNA, 14 nt, Chlamydia trachomatis
uaauucaacauaau

SEQ ID NO: 474019 - RNA, 22 nt, Chlamydia trachomatis
uaauucaacauaauaaauauua

SEQ ID NO: 474020 - RNA, 16 nt, Chlamydia trachomatis
uaauucaggcucuuuc

SEQ ID NO: 474021 - RNA, 13 nt, Chlamydia trachomatis
uaauucaugaucu

SEQ ID NO: 474022 - RNA, 17 nt, Chlamydia trachomatis
uaauucuagcaaccgau

SEQ ID NO: 474023 - RNA, 18 nt, Chlamydia trachomatis
uaauucucgcaaagaauc

SEQ ID NO: 474024 - RNA, 17 nt, Chlamydia trachomatis
uacaugauagucagaau

SEQ ID NO: 474025 - RNA, 21 nt, Chlamydia trachomatis
uacaugauagucagaauaaua

SEQ ID NO: 474026 - RNA, 18 nt, Chlamydia trachomatis
uacauguaguaaucugcu

SEQ ID NO: 474027 - RNA, 23 nt, Chlamydia trachomatis
uacauuguaaauagacuucuucg

SEQ ID NO: 474028 - RNA, 16 nt, Chlamydia trachomatis
uaccaaaaaacauucc

SEQ ID NO: 474029 - RNA, 22 nt, Chlamydia trachomatis
uaccaaaaaggaaaucacugaa

SEQ ID NO: 474030 - RNA, 22 nt, Chlamydia trachomatis
uaccaaaccuuaaaagcaaggc

SEQ ID NO: 474031 - RNA, 17 nt, Chlamydia trachomatis
uaccaaaccuuucaaau

SEQ ID NO: 474032 - RNA, 19 nt, Chlamydia trachomatis
uaccaaagaauucuugcua

SEQ ID NO: 474033 - RNA, 12 nt, Chlamydia trachomatis
uaccaagauuag

SEQ ID NO: 474034 - RNA, 23 nt, Chlamydia trachomatis
uacaggccucccuaucaauuccu

SEQ ID NO: 474035 - RNA, 20 nt, Chlamydia trachomatis
uacagcuagcucuccauuua

SEQ ID NO: 474036 - RNA, 16 nt, Chlamydia trachomatis
uacagcggauuagucg

SEQ ID NO: 474037 - RNA, 13 nt, Chlamydia trachomatis
uacagccuccucu

SEQ ID NO: 474038 - RNA, 13 nt, Chlamydia trachomatis
uacagcgaaauac

SEQ ID NO: 474039 - RNA, 19 nt, Chlamydia trachomatis
uacagcgacacguuuuccu

SEQ ID NO: 474040 - RNA, 17 nt, Chlamydia trachomatis
uacagcaagaagaagag

SEQ ID NO: 474041 - RNA, 12 nt, Chlamydia trachomatis
uacagcaugccu

SEQ ID NO: 474042 - RNA, 19 nt, Chlamydia trachomatis
uacagcaugccuucuuccu

SEQ ID NO: 474043 - RNA, 23 nt, Chlamydia trachomatis
uacagaucuugaucugaaaagag

SEQ ID NO: 474044 - RNA, 23 nt, Chlamydia trachomatis
uacagcaaaaccuuuugaaacau

SEQ ID NO: 474045 - RNA, 17 nt, Chlamydia trachomatis
uacagaagaaccuccau

SEQ ID NO: 474046 - RNA, 17 nt, Chlamydia trachomatis
uacagacgaaaacgcau

SEQ ID NO: 474047 - RNA, 20 nt, Chlamydia trachomatis
uacagacuguggcaaggcuu

SEQ ID NO: 474048 - RNA, 14 nt, Chlamydia trachomatis
uacagagaaaaaga

SEQ ID NO: 474049 - RNA, 18 nt, Chlamydia trachomatis
uacagagccuuuuauucu

SEQ ID NO: 474050 - RNA, 16 nt, Chlamydia trachomatis
uacagauaccaagcca

SEQ ID NO: 474051 - RNA, 23 nt, Chlamydia trachomatis
uacagauaccaagccauuuccag

SEQ ID NO: 474052 - RNA, 18 nt, Chlamydia trachomatis
uacacgcugaguuuccuu

SEQ ID NO: 474053 - RNA, 22 nt, Chlamydia trachomatis
uacacguuuuagaaugguucuu

SEQ ID NO: 474054 - RNA, 23 nt, Chlamydia trachomatis
uacaccuguauugggauaauaau

SEQ ID NO: 474055 - RNA, 17 nt, Chlamydia trachomatis
uacacagcaucaagaau

SEQ ID NO: 474056 - RNA, 16 nt, Chlamydia trachomatis
uacacaucaaaaugau

SEQ ID NO: 474057 - RNA, 14 nt, Chlamydia trachomatis
uacaaucaucuucc

SEQ ID NO: 474058 - RNA, 20 nt, Chlamydia trachomatis
uacaaugaccgaagguucuu

SEQ ID NO: 474059 - RNA, 22 nt, Chlamydia trachomatis
uaauuuuaccgauaucucccuu

SEQ ID NO: 474060 - RNA, 13 nt, Chlamydia trachomatis
uaauuuuagauaa

SEQ ID NO: 474061 - RNA, 17 nt, Chlamydia trachomatis
uacaauaauacaaagca

SEQ ID NO: 474062 - RNA, 21 nt, Chlamydia trachomatis
uacaauaauacaaagcacgau

SEQ ID NO: 474063 - RNA, 18 nt, Chlamydia trachomatis
uacaauagguuuaaauaa

SEQ ID NO: 474064 - RNA, 22 nt, Chlamydia trachomatis
uacaauaguaccuucaaucugu

SEQ ID NO: 474065 - RNA, 16 nt, Chlamydia trachomatis
uaccuucuuacauaag

SEQ ID NO: 474066 - RNA, 21 nt, Chlamydia trachomatis
uaccuugaguccgcaaacaaa

SEQ ID NO: 474067 - RNA, 16 nt, Chlamydia trachomatis
uaccuuguuuuuuaag

SEQ ID NO: 474068 - RNA, 14 nt, Chlamydia trachomatis
uaccuuuugcaauc

SEQ ID NO: 474069 - RNA, 14 nt, Chlamydia trachomatis
uacgaaaugacaca

SEQ ID NO: 474070 - RNA, 12 nt, Chlamydia trachomatis
uacgaacaagau

SEQ ID NO: 474071 - RNA, 16 nt, Chlamydia trachomatis
uacgaacaagaugacu

SEQ ID NO: 474072 - RNA, 18 nt, Chlamydia trachomatis
uaccucgagcaacgagga

SEQ ID NO: 474073 - RNA, 20 nt, Chlamydia trachomatis
uaccucuaaagauccucuuu

SEQ ID NO: 474074 - RNA, 14 nt, Chlamydia trachomatis
uaccucuccauuuu

SEQ ID NO: 474075 - RNA, 14 nt, Chlamydia trachomatis
uaccucuuuacgca

SEQ ID NO: 474076 - RNA, 20 nt, Chlamydia trachomatis
uaccucuuuacgcacaaaga

SEQ ID NO: 474077 - RNA, 14 nt, Chlamydia trachomatis
uaccuggaaaggag

SEQ ID NO: 474078 - RNA, 20 nt, Chlamydia trachomatis
uaccucaauagcagcauucu

SEQ ID NO: 474079 - RNA, 18 nt, Chlamydia trachomatis
uaccuagugauuuuaaac

SEQ ID NO: 474080 - RNA, 12 nt, Chlamydia trachomatis
uaccuauuccaa

SEQ ID NO: 474081 - RNA, 22 nt, Chlamydia trachomatis
uaccuaaacaaggauuuucuuc

SEQ ID NO: 474082 - RNA, 14 nt, Chlamydia trachomatis
uaccuaaagaagcc

SEQ ID NO: 474083 - RNA, 19 nt, Chlamydia trachomatis
uaccuacacgauauaucca

SEQ ID NO: 474084 - RNA, 23 nt, Chlamydia trachomatis
uaccgccucaaacaaucuaaaaa

SEQ ID NO: 474085 - RNA, 16 nt, Chlamydia trachomatis
uaccacgagcauaaga

SEQ ID NO: 474086 - RNA, 21 nt, Chlamydia trachomatis
uaccacgagcauaagaauaaa

SEQ ID NO: 474087 - RNA, 17 nt, Chlamydia trachomatis
uacgguuucaagagcau

SEQ ID NO: 474088 - RNA, 20 nt, Chlamydia trachomatis
uacggcaaaagguuguugcc

SEQ ID NO: 474089 - RNA, 16 nt, Chlamydia trachomatis
uacggacggacaaauu

SEQ ID NO: 474090 - RNA, 21 nt, Chlamydia trachomatis
uacggacggacaaauuucuau

SEQ ID NO: 474091 - RNA, 21 nt, Chlamydia trachomatis
uacggaagagucuguuucugu

SEQ ID NO: 474092 - RNA, 23 nt, Chlamydia trachomatis
uacggaauagccuccaaacauuu

SEQ ID NO: 474093 - RNA, 22 nt, Chlamydia trachomatis
uacggaaaaagaagaucccaua

SEQ ID NO: 474094 - RNA, 13 nt, Chlamydia trachomatis
uacggaaaccaau

SEQ ID NO: 474095 - RNA, 21 nt, Chlamydia trachomatis
uacgcugguauaccaggagcg

SEQ ID NO: 474096 - RNA, 17 nt, Chlamydia trachomatis
uacgcuuccuacagcua

SEQ ID NO: 474097 - RNA, 13 nt, Chlamydia trachomatis
uacgcucuuucuu

SEQ ID NO: 474098 - RNA, 17 nt, Chlamydia trachomatis
uacgaacgccuguuuuc

SEQ ID NO: 474099 - RNA, 20 nt, Chlamydia trachomatis
uacgaauaagaguccuaaua

SEQ ID NO: 474100 - RNA, 20 nt, Chlamydia trachomatis
uacgaauuucugggaaaauu

SEQ ID NO: 474101 - RNA, 22 nt, Chlamydia trachomatis
uacgauauccaucauaaaaaga

SEQ ID NO: 474102 - RNA, 14 nt, Chlamydia trachomatis
uacuccaccuagga

SEQ ID NO: 474103 - RNA, 12 nt, Chlamydia trachomatis
uacucaucuuuu

SEQ ID NO: 474104 - RNA, 14 nt, Chlamydia trachomatis
uacucaucuuuuuu

SEQ ID NO: 474105 - RNA, 19 nt, Chlamydia trachomatis
uacuauucgagaaugaaua

SEQ ID NO: 474106 - RNA, 13 nt, Chlamydia trachomatis
uacguuuucucug

SEQ ID NO: 474107 - RNA, 14 nt, Chlamydia trachomatis
uacuauccgaagcu

SEQ ID NO: 474108 - RNA, 19 nt, Chlamydia trachomatis
uagaaccacuuuucuguau

SEQ ID NO: 474109 - RNA, 18 nt, Chlamydia trachomatis
uagaacggcauucccauu

SEQ ID NO: 474110 - RNA, 19 nt, Chlamydia trachomatis
uagaacggcauucccauuu

SEQ ID NO: 474111 - RNA, 14 nt, Chlamydia trachomatis
uagaaauucaucau

SEQ ID NO: 474112 - RNA, 16 nt, Chlamydia trachomatis
uagaaauuuuaaaucc

SEQ ID NO: 474113 - RNA, 17 nt, Chlamydia trachomatis
uagaacagauuuagaga

SEQ ID NO: 474114 - RNA, 20 nt, Chlamydia trachomatis
uagaacagauuuagagaaua

SEQ ID NO: 474115 - RNA, 18 nt, Chlamydia trachomatis
uagaagaaucauagaaac

SEQ ID NO: 474116 - RNA, 21 nt, Chlamydia trachomatis
uagaagacaaagaucguaaaa

SEQ ID NO: 474117 - RNA, 17 nt, Chlamydia trachomatis
uagaaugcguucuucua

SEQ ID NO: 474118 - RNA, 21 nt, Chlamydia trachomatis
uagaaucucggucaucuguuu

SEQ ID NO: 474119 - RNA, 18 nt, Chlamydia trachomatis
uagaaggucugaacaacu

SEQ ID NO: 474120 - RNA, 13 nt, Chlamydia trachomatis
uagagaaaagaaa

SEQ ID NO: 474121 - RNA, 14 nt, Chlamydia trachomatis
uagagaaaagaaaa

SEQ ID NO: 474122 - RNA, 15 nt, Chlamydia trachomatis
uagagaaaagaaaag

SEQ ID NO: 474123 - RNA, 18 nt, Chlamydia trachomatis
uagagaaaagaaaagggg

SEQ ID NO: 474124 - RNA, 16 nt, Chlamydia trachomatis
uagagaacguacuuua

SEQ ID NO: 474125 - RNA, 18 nt, Chlamydia trachomatis
uagagaagaauugaagua

SEQ ID NO: 474126 - RNA, 19 nt, Chlamydia trachomatis
uagagaauggguaagggga

SEQ ID NO: 474127 - RNA, 17 nt, Chlamydia trachomatis
uagagaauuagagauaa

SEQ ID NO: 474128 - RNA, 17 nt, Chlamydia trachomatis
uagagacggucuacaaa

SEQ ID NO: 474129 - RNA, 22 nt, Chlamydia trachomatis
uagagacggucuacaaauagug

SEQ ID NO: 474130 - RNA, 20 nt, Chlamydia trachomatis
uagacuguugaggagacuuu

SEQ ID NO: 474131 - RNA, 18 nt, Chlamydia trachomatis
uagaccuaagcuauguaa

SEQ ID NO: 474132 - RNA, 14 nt, Chlamydia trachomatis
uagaauuucuuccu

SEQ ID NO: 474133 - RNA, 17 nt, Chlamydia trachomatis
uagaauuucuuccucua

SEQ ID NO: 474134 - RNA, 12 nt, Chlamydia trachomatis
uagaauuuuguc

SEQ ID NO: 474135 - RNA, 20 nt, Chlamydia trachomatis
uagacaacguuuaaugaaua

SEQ ID NO: 474136 - RNA, 15 nt, Chlamydia trachomatis
uacuuucccuauuuu

SEQ ID NO: 474137 - RNA, 17 nt, Chlamydia trachomatis
uacuuucccuauuuuuu

SEQ ID NO: 474138 - RNA, 23 nt, Chlamydia trachomatis
uacuuucucuucaagaucaaagu

SEQ ID NO: 474139 - RNA, 16 nt, Chlamydia trachomatis
uacuuucuuugcuauu

SEQ ID NO: 474140 - RNA, 13 nt, Chlamydia trachomatis
uacuucuaaaauu

SEQ ID NO: 474141 - RNA, 15 nt, Chlamydia trachomatis
uacuucuaaaauuug

SEQ ID NO: 474142 - RNA, 16 nt, Chlamydia trachomatis
uacuucauguaaauuu

SEQ ID NO: 474143 - RNA, 11 nt, Chlamydia trachomatis
uacuucauuuu

SEQ ID NO: 474144 - RNA, 15 nt, Chlamydia trachomatis
uacuucauuuuugcu

SEQ ID NO: 474145 - RNA, 21 nt, Chlamydia trachomatis
uacuucccacauacuuggauc

SEQ ID NO: 474146 - RNA, 14 nt, Chlamydia trachomatis
uacuuccguuucuu

SEQ ID NO: 474147 - RNA, 15 nt, Chlamydia trachomatis
uacuccgaucaauuc

SEQ ID NO: 474148 - RNA, 20 nt, Chlamydia trachomatis
uacuccucgucgaagaaauc

SEQ ID NO: 474149 - RNA, 14 nt, Chlamydia trachomatis
uacugggaaaucau

SEQ ID NO: 474150 - RNA, 12 nt, Chlamydia trachomatis
uacuguacuccu

SEQ ID NO: 474151 - RNA, 16 nt, Chlamydia trachomatis
uagaaaaagagaaaua

SEQ ID NO: 474152 - RNA, 20 nt, Chlamydia trachomatis
uagaaaaagggagaggauuc

SEQ ID NO: 474153 - RNA, 13 nt, Chlamydia trachomatis
uagaaaagagcag

SEQ ID NO: 474154 - RNA, 15 nt, Chlamydia trachomatis
uagaaaagagcagcu

SEQ ID NO: 474155 - RNA, 15 nt, Chlamydia trachomatis
uagaaaaucauagau

SEQ ID NO: 474156 - RNA, 12 nt, Chlamydia trachomatis
uagaaaaucuau

SEQ ID NO: 474157 - RNA, 13 nt, Chlamydia trachomatis
uagaaaaucuauu

SEQ ID NO: 474158 - RNA, 22 nt, Chlamydia trachomatis
uagaaacuccguaguccacauu

SEQ ID NO: 474159 - RNA, 12 nt, Chlamydia trachomatis
uagaaagaacca

SEQ ID NO: 474160 - RNA, 17 nt, Chlamydia trachomatis
uagaaagaaccacaaaa

SEQ ID NO: 474161 - RNA, 21 nt, Chlamydia trachomatis
uagaaagcuacagucugucca

SEQ ID NO: 474162 - RNA, 22 nt, Chlamydia trachomatis
uagaaagcuacagucuguccag

SEQ ID NO: 474163 - RNA, 15 nt, Chlamydia trachomatis
uagaaauuacagaag

SEQ ID NO: 474164 - RNA, 16 nt, Chlamydia trachomatis
uagaaauuacagaaga

SEQ ID NO: 474165 - RNA, 13 nt, Chlamydia trachomatis
uagauagcuccaa

SEQ ID NO: 474166 - RNA, 15 nt, Chlamydia trachomatis
uagauagcuccaagg

SEQ ID NO: 474167 - RNA, 17 nt, Chlamydia trachomatis
uagauaggggaaacuag

SEQ ID NO: 474168 - RNA, 23 nt, Chlamydia trachomatis
uagauaggggaaacuagcaaauu

SEQ ID NO: 474169 - RNA, 17 nt, Chlamydia trachomatis
uagauauaaauuuggau

SEQ ID NO: 474170 - RNA, 17 nt, Chlamydia trachomatis
uagaucccuuucauucu

SEQ ID NO: 474171 - RNA, 16 nt, Chlamydia trachomatis
uagauccgcagccacu

SEQ ID NO: 474172 - RNA, 20 nt, Chlamydia trachomatis
uagaucuaaggaauguggag

SEQ ID NO: 474173 - RNA, 20 nt, Chlamydia trachomatis
uagaucuguuagugaagagc

SEQ ID NO: 474174 - RNA, 16 nt, Chlamydia trachomatis
uagaucuuuucgucuu

SEQ ID NO: 474175 - RNA, 22 nt, Chlamydia trachomatis
uagauguuguggguuuggaaau

SEQ ID NO: 474176 - RNA, 20 nt, Chlamydia trachomatis
uagauucagcaagauucucc

SEQ ID NO: 474177 - RNA, 19 nt, Chlamydia trachomatis
uagauucccuuuaaagaaa

SEQ ID NO: 474178 - RNA, 20 nt, Chlamydia trachomatis
uagauggauaaucucugaaa

SEQ ID NO: 474179 - RNA, 17 nt, Chlamydia trachomatis
uagaugcaauaaacgcu

SEQ ID NO: 474180 - RNA, 14 nt, Chlamydia trachomatis
uagagguuuccuua

SEQ ID NO: 474181 - RNA, 17 nt, Chlamydia trachomatis
uagagguauuuuauuca

SEQ ID NO: 474182 - RNA, 18 nt, Chlamydia trachomatis
uagaggagaacaagauaa

SEQ ID NO: 474183 - RNA, 19 nt, Chlamydia trachomatis
uagagcauaucaugugggu

SEQ ID NO: 474184 - RNA, 19 nt, Chlamydia trachomatis
uagagccaugaucaaagaa

SEQ ID NO: 474185 - RNA, 13 nt, Chlamydia trachomatis
uagagccugcaag

SEQ ID NO: 474186 - RNA, 15 nt, Chlamydia trachomatis
uagaguccugagcca

SEQ ID NO: 474187 - RNA, 12 nt, Chlamydia trachomatis
uagauaaaagaa

SEQ ID NO: 474188 - RNA, 22 nt, Chlamydia trachomatis
uagauaaguccaucuaaaggga

SEQ ID NO: 474189 - RNA, 14 nt, Chlamydia trachomatis
uagauaaucguauu

SEQ ID NO: 474190 - RNA, 12 nt, Chlamydia trachomatis
uagauaaugaca

SEQ ID NO: 474191 - RNA, 12 nt, Chlamydia trachomatis
uagauacacaga

SEQ ID NO: 474192 - RNA, 18 nt, Chlamydia trachomatis
uagcauugcgcagaucuc

SEQ ID NO: 474193 - RNA, 22 nt, Chlamydia trachomatis
uagcauugcgcagaucuccuuc

SEQ ID NO: 474194 - RNA, 21 nt, Chlamydia trachomatis
uagccaauccguaugauaaaa

SEQ ID NO: 474195 - RNA, 16 nt, Chlamydia trachomatis
uagcaucauccccaga

SEQ ID NO: 474196 - RNA, 13 nt, Chlamydia trachomatis
uagcaucguuuuu

SEQ ID NO: 474197 - RNA, 13 nt, Chlamydia trachomatis
uagcaucuggaac

SEQ ID NO: 474198 - RNA, 12 nt, Chlamydia trachomatis
uagcaucuucac

SEQ ID NO: 474199 - RNA, 16 nt, Chlamydia trachomatis
uagcaugcaaaacagc

SEQ ID NO: 474200 - RNA, 10 nt, Chlamydia trachomatis
uagcaugccg

SEQ ID NO: 474201 - RNA, 23 nt, Chlamydia trachomatis
uagcaugggcugcaucagcaaga

SEQ ID NO: 474202 - RNA, 15 nt, Chlamydia trachomatis
uagcauguucagaau

SEQ ID NO: 474203 - RNA, 17 nt, Chlamydia trachomatis
uagcauuaauauacuca

SEQ ID NO: 474204 - RNA, 16 nt, Chlamydia trachomatis
uagcagggaacacaga

SEQ ID NO: 474205 - RNA, 16 nt, Chlamydia trachomatis
uagcagcuagaacaua

SEQ ID NO: 474206 - RNA, 22 nt, Chlamydia trachomatis
uagcagauaauucucgcaaaga

SEQ ID NO: 474207 - RNA, 19 nt, Chlamydia trachomatis
uagauuuagcuguuaugaa

SEQ ID NO: 474208 - RNA, 19 nt, Chlamydia trachomatis
uagauuuguuuaaaagaag

SEQ ID NO: 474209 - RNA, 19 nt, Chlamydia trachomatis
uagauuuuagaaggaucau

SEQ ID NO: 474210 - RNA, 14 nt, Chlamydia trachomatis
uagauuuucaugca

SEQ ID NO: 474211 - RNA, 16 nt, Chlamydia trachomatis
uagcaaagacauaaaa

SEQ ID NO: 474212 - RNA, 22 nt, Chlamydia trachomatis
uagcaaaucuggcugaagaagu

SEQ ID NO: 474213 - RNA, 23 nt, Chlamydia trachomatis
uagcaaauucgcuaccaaaaauu

SEQ ID NO: 474214 - RNA, 18 nt, Chlamydia trachomatis
uagcaaccgauucuucac

SEQ ID NO: 474215 - RNA, 18 nt, Chlamydia trachomatis
uagcaacgaacuuuccau

SEQ ID NO: 474216 - RNA, 11 nt, Chlamydia trachomatis
uagcaagacau

SEQ ID NO: 474217 - RNA, 23 nt, Chlamydia trachomatis
uagcaaugccgaaaccaacaaga

SEQ ID NO: 474218 - RNA, 19 nt, Chlamydia trachomatis
uagcaaugcgaucagaaac

SEQ ID NO: 474219 - RNA, 22 nt, Chlamydia trachomatis
uagcacccuuuuuauaaucucc

SEQ ID NO: 474220 - RNA, 16 nt, Chlamydia trachomatis
uagcacgcaaaacauc

SEQ ID NO: 474221 - RNA, 14 nt, Chlamydia trachomatis
uagccaauuuccau

SEQ ID NO: 474222 - RNA, 20 nt, Chlamydia trachomatis
uagccaauuuccauggagcu

SEQ ID NO: 474223 - RNA, 12 nt, Chlamydia trachomatis
uagccuccaaac

SEQ ID NO: 474224 - RNA, 18 nt, Chlamydia trachomatis
uagccuccgcuaauuuuu

SEQ ID NO: 474225 - RNA, 21 nt, Chlamydia trachomatis
uagcggaacaagcaaaacaua

SEQ ID NO: 474226 - RNA, 16 nt, Chlamydia trachomatis
uagcguaaaagagauu

SEQ ID NO: 474227 - RNA, 13 nt, Chlamydia trachomatis
uagcugauaagga

SEQ ID NO: 474228 - RNA, 22 nt, Chlamydia trachomatis
uagcucccugcucuugaagaua

SEQ ID NO: 474229 - RNA, 15 nt, Chlamydia trachomatis
uagcucguuuuuuug

SEQ ID NO: 474230 - RNA, 14 nt, Chlamydia trachomatis
uagcuucagaagaa

SEQ ID NO: 474231 - RNA, 19 nt, Chlamydia trachomatis
uagcuucguagagcaagau

SEQ ID NO: 474232 - RNA, 22 nt, Chlamydia trachomatis
uagcuguuaugaaccagggaga

SEQ ID NO: 474233 - RNA, 18 nt, Chlamydia trachomatis
uagcgucuaacuaaaugu

SEQ ID NO: 474234 - RNA, 19 nt, Chlamydia trachomatis
uagcuaaaagcucuugucg

SEQ ID NO: 474235 - RNA, 20 nt, Chlamydia trachomatis
uagcuaaagcagaaacagcu

SEQ ID NO: 474236 - RNA, 16 nt, Chlamydia trachomatis
uagcuaaauucaacug

SEQ ID NO: 474237 - RNA, 23 nt, Chlamydia trachomatis
uagcuaaucuuuuugauuuuucu

SEQ ID NO: 474238 - RNA, 12 nt, Chlamydia trachomatis
uagcuacagcaa

SEQ ID NO: 474239 - RNA, 22 nt, Chlamydia trachomatis
uagcuaucgcggcuaucgucuu

SEQ ID NO: 474240 - RNA, 12 nt, Chlamydia trachomatis
uaggaucuggaa

SEQ ID NO: 474241 - RNA, 13 nt, Chlamydia trachomatis
uaggaucuggaac

SEQ ID NO: 474242 - RNA, 15 nt, Chlamydia trachomatis
uaggaugucugcggu

SEQ ID NO: 474243 - RNA, 16 nt, Chlamydia trachomatis
uaggauuaaaauccau

SEQ ID NO: 474244 - RNA, 16 nt, Chlamydia trachomatis
uaggauucguugcucc

SEQ ID NO: 474245 - RNA, 21 nt, Chlamydia trachomatis
uaggacaauuaucuccuaaga

SEQ ID NO: 474246 - RNA, 13 nt, Chlamydia trachomatis
uaggagagaaucu

SEQ ID NO: 474247 - RNA, 15 nt, Chlamydia trachomatis
uaggagagagcccuu

SEQ ID NO: 474248 - RNA, 13 nt, Chlamydia trachomatis
uaggagaggauua

SEQ ID NO: 474249 - RNA, 12 nt, Chlamydia trachomatis
uaggagcaagaa

SEQ ID NO: 474250 - RNA, 21 nt, Chlamydia trachomatis
uaggaggaacccuuuguaguu

SEQ ID NO: 474251 - RNA, 17 nt, Chlamydia trachomatis
uagcuucuaauuucuuu

SEQ ID NO: 474252 - RNA, 17 nt, Chlamydia trachomatis
uagcuugaugauagucu

SEQ ID NO: 474253 - RNA, 15 nt, Chlamydia trachomatis
uagcuugcacagcaa

SEQ ID NO: 474254 - RNA, 15 nt, Chlamydia trachomatis
uaggaaaugagagcu

SEQ ID NO: 474255 - RNA, 15 nt, Chlamydia trachomatis
uaggaacuacauucg

SEQ ID NO: 474256 - RNA, 21 nt, Chlamydia trachomatis
uaggaacuacauucgccucuu

SEQ ID NO: 474257 - RNA, 15 nt, Chlamydia trachomatis
uaggaacucuaaaua

SEQ ID NO: 474258 - RNA, 20 nt, Chlamydia trachomatis
uaggcauaguuggugucuuu

SEQ ID NO: 474259 - RNA, 14 nt, Chlamydia trachomatis
uagggaagauagga

SEQ ID NO: 474260 - RNA, 17 nt, Chlamydia trachomatis
uagggagguauuccugu

SEQ ID NO: 474261 - RNA, 17 nt, Chlamydia trachomatis
uagggaucccacaaaga

SEQ ID NO: 474262 - RNA, 16 nt, Chlamydia trachomatis
uagggaucucagcugg

SEQ ID NO: 474263 - RNA, 21 nt, Chlamydia trachomatis
uagggaaaaacuuuucuuccu

SEQ ID NO: 474264 - RNA, 19 nt, Chlamydia trachomatis
uaggcgugaagagagacac

SEQ ID NO: 474265 - RNA, 16 nt, Chlamydia trachomatis
uaggguuguuuuagaa

SEQ ID NO: 474266 - RNA, 17 nt, Chlamydia trachomatis
uaggguuguuuuagaau

SEQ ID NO: 474267 - RNA, 20 nt, Chlamydia trachomatis
uaggguuguuuuagaaugcg

SEQ ID NO: 474268 - RNA, 22 nt, Chlamydia trachomatis
uagguaaagguuucuggaaaau

SEQ ID NO: 474269 - RNA, 15 nt, Chlamydia trachomatis
uagguaccacgccaa

SEQ ID NO: 474270 - RNA, 14 nt, Chlamydia trachomatis
uagguagaaaagga

SEQ ID NO: 474271 - RNA, 15 nt, Chlamydia trachomatis
uagguagaaaaggau

SEQ ID NO: 474272 - RNA, 23 nt, Chlamydia trachomatis
uagguaucgaaaguaaaauuccu

SEQ ID NO: 474273 - RNA, 15 nt, Chlamydia trachomatis
uagguaucugaaucu

SEQ ID NO: 474274 - RNA, 17 nt, Chlamydia trachomatis
uaggucugaagaaaaau

SEQ ID NO: 474275 - RNA, 15 nt, Chlamydia trachomatis
uaguauaugcucuuu

SEQ ID NO: 474276 - RNA, 20 nt, Chlamydia trachomatis
uaguauuacggaaaagcuuu

SEQ ID NO: 474277 - RNA, 23 nt, Chlamydia trachomatis
uagguuuuaaagaggcgacagcu

SEQ ID NO: 474278 - RNA, 15 nt, Chlamydia trachomatis
uaguaaaaacuauaa

SEQ ID NO: 474279 - RNA, 18 nt, Chlamydia trachomatis
uaguacguguuaucaaag

SEQ ID NO: 474280 - RNA, 16 nt, Chlamydia trachomatis
uaguuccacuuaauac

SEQ ID NO: 474281 - RNA, 17 nt, Chlamydia trachomatis
uagugucuucgaauccu

SEQ ID NO: 474282 - RNA, 15 nt, Chlamydia trachomatis
uaguuaaauguugau

SEQ ID NO: 474283 - RNA, 19 nt, Chlamydia trachomatis
uaguguagucagaagauac

SEQ ID NO: 474284 - RNA, 18 nt, Chlamydia trachomatis
uaguccacauucacuuca

SEQ ID NO: 474285 - RNA, 15 nt, Chlamydia trachomatis
uaguccuaucaccac

SEQ ID NO: 474286 - RNA, 19 nt, Chlamydia trachomatis
uaguuucgaguaauuccaa

SEQ ID NO: 474287 - RNA, 14 nt, Chlamydia trachomatis
uauaaauuauacaa

SEQ ID NO: 474288 - RNA, 13 nt, Chlamydia trachomatis
uaucaaaaucaau

SEQ ID NO: 474289 - RNA, 13 nt, Chlamydia trachomatis
uaucaaagagugu

SEQ ID NO: 474290 - RNA, 21 nt, Chlamydia trachomatis
uaucaaauuuuucagaaaaag

SEQ ID NO: 474291 - RNA, 18 nt, Chlamydia trachomatis
uauauucuucuucugcaa

SEQ ID NO: 474292 - RNA, 21 nt, Chlamydia trachomatis
uauauugcuucauaaaaaaga

SEQ ID NO: 474293 - RNA, 18 nt, Chlamydia trachomatis
uaucaaaaauagcaucug

SEQ ID NO: 474294 - RNA, 12 nt, Chlamydia trachomatis
uaucauucccua

SEQ ID NO: 474295 - RNA, 13 nt, Chlamydia trachomatis
uauccaaaaggau

SEQ ID NO: 474296 - RNA, 22 nt, Chlamydia trachomatis
uauccaaagcugcuuuagcugc

SEQ ID NO: 474297 - RNA, 17 nt, Chlamydia trachomatis
uauccaagcacuccuca

SEQ ID NO: 474298 - RNA, 18 nt, Chlamydia trachomatis
uaucacuguugagaaaaa

SEQ ID NO: 474299 - RNA, 19 nt, Chlamydia trachomatis
uaucacuguugagaaaaac

SEQ ID NO: 474300 - RNA, 16 nt, Chlamydia trachomatis
uauauauuuaagaagc

SEQ ID NO: 474301 - RNA, 17 nt, Chlamydia trachomatis
uauagcugcggagagaa

SEQ ID NO: 474302 - RNA, 20 nt, Chlamydia trachomatis
uauagcaaugcgaucagaaa

SEQ ID NO: 474303 - RNA, 23 nt, Chlamydia trachomatis
uauagccacgauaagaucuugag

SEQ ID NO: 474304 - RNA, 13 nt, Chlamydia trachomatis
uauacagagcaag

SEQ ID NO: 474305 - RNA, 22 nt, Chlamydia trachomatis
uauacagcaugccuucuuccuu

SEQ ID NO: 474306 - RNA, 19 nt, Chlamydia trachomatis
uauaccagcagacccaaau

SEQ ID NO: 474307 - RNA, 17 nt, Chlamydia trachomatis
uauacgaaauaacaaag

SEQ ID NO: 474308 - RNA, 18 nt, Chlamydia trachomatis
uauacgaaauaacaaagc

SEQ ID NO: 474309 - RNA, 11 nt, Chlamydia trachomatis
uauacucagag

SEQ ID NO: 474310 - RNA, 12 nt, Chlamydia trachomatis
uauacucagaga

SEQ ID NO: 474311 - RNA, 15 nt, Chlamydia trachomatis
uauacucuaaaaguu

SEQ ID NO: 474312 - RNA, 20 nt, Chlamydia trachomatis
uauacuucuuacuuaaaaaa

SEQ ID NO: 474313 - RNA, 15 nt, Chlamydia trachomatis
uauagaagacuaauc

SEQ ID NO: 474314 - RNA, 19 nt, Chlamydia trachomatis
uauccgcaguaaaaucuaa

SEQ ID NO: 474315 - RNA, 23 nt, Chlamydia trachomatis
uauccgcaguaaaaucuaaaaua

SEQ ID NO: 474316 - RNA, 14 nt, Chlamydia trachomatis
uauccaucauaaaa

SEQ ID NO: 474317 - RNA, 15 nt, Chlamydia trachomatis
uauccaucauaaaaa

SEQ ID NO: 474318 - RNA, 19 nt, Chlamydia trachomatis
uauccaucauaaaaagaua

SEQ ID NO: 474319 - RNA, 21 nt, Chlamydia trachomatis
uauccaucauaaaaagauagu

SEQ ID NO: 474320 - RNA, 20 nt, Chlamydia trachomatis
uauuacggaaaagcuuuuua

SEQ ID NO: 474321 - RNA, 19 nt, Chlamydia trachomatis
uauuauuacgaacagcaau

SEQ ID NO: 474322 - RNA, 17 nt, Chlamydia trachomatis
uauucacccaaauauac

SEQ ID NO: 474323 - RNA, 22 nt, Chlamydia trachomatis
uauucacgcaucccaaaauagc

SEQ ID NO: 474324 - RNA, 15 nt, Chlamydia trachomatis
uauucagaagaagag

SEQ ID NO: 474325 - RNA, 20 nt, Chlamydia trachomatis
uauucagaagaagagcugcu

SEQ ID NO: 474326 - RNA, 19 nt, Chlamydia trachomatis
uauucgcaauauagagcau

SEQ ID NO: 474327 - RNA, 15 nt, Chlamydia trachomatis
uauuccaaagaaaug

SEQ ID NO: 474328 - RNA, 16 nt, Chlamydia trachomatis
uauucgcuauuucgau

SEQ ID NO: 474329 - RNA, 23 nt, Chlamydia trachomatis
uauucgcuauuucgaucuuacca

SEQ ID NO: 474330 - RNA, 16 nt, Chlamydia trachomatis
uauucucaaguugagu

SEQ ID NO: 474331 - RNA, 16 nt, Chlamydia trachomatis
uauucuccgauaauuu

SEQ ID NO: 474332 - RNA, 12 nt, Chlamydia trachomatis
uauucuccuuuu

SEQ ID NO: 474333 - RNA, 21 nt, Chlamydia trachomatis
uauucucgcccccauaacggu

SEQ ID NO: 474334 - RNA, 17 nt, Chlamydia trachomatis
uauucugcagaaaaauu

SEQ ID NO: 474335 - RNA, 17 nt, Chlamydia trachomatis
uauuuacagaauagugg

SEQ ID NO: 474336 - RNA, 20 nt, Chlamydia trachomatis
uauuuaccuugaguccgcaa

SEQ ID NO: 474337 - RNA, 13 nt, Chlamydia trachomatis
uauuuacgagagg

SEQ ID NO: 474338 - RNA, 20 nt, Chlamydia trachomatis
uauucuguaaaaggaauucu

SEQ ID NO: 474339 - RNA, 22 nt, Chlamydia trachomatis
uauugagaagacuuacucucua

SEQ ID NO: 474340 - RNA, 14 nt, Chlamydia trachomatis
ucaaaguagcaauc

SEQ ID NO: 474341 - RNA, 15 nt, Chlamydia trachomatis
ucaaaaucaauaaug

SEQ ID NO: 474342 - RNA, 21 nt, Chlamydia trachomatis
ucaaagaagcuccuuuaccuu

SEQ ID NO: 474343 - RNA, 17 nt, Chlamydia trachomatis
ucaaaaagagcuaaacu

SEQ ID NO: 474344 - RNA, 16 nt, Chlamydia trachomatis
ucaaaaaauguuuuug

SEQ ID NO: 474345 - RNA, 23 nt, Chlamydia trachomatis
ucaaaaacacuacgcuacagagu

SEQ ID NO: 474346 - RNA, 19 nt, Chlamydia trachomatis
ucaaaaauagcaucuggaa

SEQ ID NO: 474347 - RNA, 19 nt, Chlamydia trachomatis
ucaaaaccuugaugaauuu

SEQ ID NO: 474348 - RNA, 18 nt, Chlamydia trachomatis
ucaaaacgcucagaaaac

SEQ ID NO: 474349 - RNA, 21 nt, Chlamydia trachomatis
ucaaaacgcucagaaaacuua

SEQ ID NO: 474350 - RNA, 12 nt, Chlamydia trachomatis
uauuuuuggaug

SEQ ID NO: 474351 - RNA, 16 nt, Chlamydia trachomatis
uauuuuugggaaaaaa

SEQ ID NO: 474352 - RNA, 15 nt, Chlamydia trachomatis
ucaaaaaaggaaucu

SEQ ID NO: 474353 - RNA, 16 nt, Chlamydia trachomatis
ucaaaaaaggaaucug

SEQ ID NO: 474354 - RNA, 20 nt, Chlamydia trachomatis
uauuuuaggcggcuuuucua

SEQ ID NO: 474355 - RNA, 16 nt, Chlamydia trachomatis
uauuuguucucuuaga

SEQ ID NO: 474356 - RNA, 23 nt, Chlamydia trachomatis
uauuugguggaguguggaagcua

SEQ ID NO: 474357 - RNA, 18 nt, Chlamydia trachomatis
uauuuggaucucuuagac

SEQ ID NO: 474358 - RNA, 17 nt, Chlamydia trachomatis
uauuuccagcauuuuaa

SEQ ID NO: 474359 - RNA, 15 nt, Chlamydia trachomatis
uauuuccauaagaga

SEQ ID NO: 474360 - RNA, 23 nt, Chlamydia trachomatis
uauuuccccuacaaacauccuua

SEQ ID NO: 474361 - RNA, 14 nt, Chlamydia trachomatis
uauuucccagugau

SEQ ID NO: 474362 - RNA, 20 nt, Chlamydia trachomatis
uauuucccaugucuguugaa

SEQ ID NO: 474363 - RNA, 21 nt, Chlamydia trachomatis
uauuucugucuuagcaaagaa

SEQ ID NO: 474364 - RNA, 22 nt, Chlamydia trachomatis
ucaagagaaaucagaugccauc

SEQ ID NO: 474365 - RNA, 15 nt, Chlamydia trachomatis
ucaacgggaacaaaa

SEQ ID NO: 474366 - RNA, 13 nt, Chlamydia trachomatis
ucaaaucuucuuc

SEQ ID NO: 474367 - RNA, 16 nt, Chlamydia trachomatis
ucaaaucuucuucuaa

SEQ ID NO: 474368 - RNA, 18 nt, Chlamydia trachomatis
ucaaaucuucuucuaagc

SEQ ID NO: 474369 - RNA, 14 nt, Chlamydia trachomatis
ucaaaucgaaacug

SEQ ID NO: 474370 - RNA, 14 nt, Chlamydia trachomatis
ucaagaucaaaguc

SEQ ID NO: 474371 - RNA, 16 nt, Chlamydia trachomatis
ucaagccuacagcuag

SEQ ID NO: 474372 - RNA, 14 nt, Chlamydia trachomatis
ucaaugcuucuauu

SEQ ID NO: 474373 - RNA, 19 nt, Chlamydia trachomatis
ucaagugacuuuuagcaaa

SEQ ID NO: 474374 - RNA, 14 nt, Chlamydia trachomatis
ucaaguucauuggu

SEQ ID NO: 474375 - RNA, 14 nt, Chlamydia trachomatis
ucacaauuuuucuu

SEQ ID NO: 474376 - RNA, 18 nt, Chlamydia trachomatis
ucacacacaaaaaaaaga

SEQ ID NO: 474377 - RNA, 12 nt, Chlamydia trachomatis
ucacaacuaguu

SEQ ID NO: 474378 - RNA, 19 nt, Chlamydia trachomatis
ucaauuacagcaucuacag

SEQ ID NO: 474379 - RNA, 14 nt, Chlamydia trachomatis
ucaauuuuuccauu

SEQ ID NO: 474380 - RNA, 16 nt, Chlamydia trachomatis
ucacaaagagaaggcc

SEQ ID NO: 474381 - RNA, 18 nt, Chlamydia trachomatis
ucacaaauuuaucugcua

SEQ ID NO: 474382 - RNA, 15 nt, Chlamydia trachomatis
ucacagagcuucucu

SEQ ID NO: 474383 - RNA, 15 nt, Chlamydia trachomatis
ucacagaaacggaag

SEQ ID NO: 474384 - RNA, 12 nt, Chlamydia trachomatis
ucacagaaaguc

SEQ ID NO: 474385 - RNA, 14 nt, Chlamydia trachomatis
ucaccacuuuuccg

SEQ ID NO: 474386 - RNA, 19 nt, Chlamydia trachomatis
ucaccagcaaaagaaaaau

SEQ ID NO: 474387 - RNA, 22 nt, Chlamydia trachomatis
ucaccccaucccuugcaaaaau

SEQ ID NO: 474388 - RNA, 15 nt, Chlamydia trachomatis
ucaccucuugccugc

SEQ ID NO: 474389 - RNA, 15 nt, Chlamydia trachomatis
ucaccuauuaagaau

SEQ ID NO: 474390 - RNA, 21 nt, Chlamydia trachomatis
ucacuaaaaguaguccuauca

SEQ ID NO: 474391 - RNA, 12 nt, Chlamydia trachomatis
ucacuaauauag

SEQ ID NO: 474392 - RNA, 20 nt, Chlamydia trachomatis
ucacuccuccuccuaaacaa

SEQ ID NO: 474393 - RNA, 14 nt, Chlamydia trachomatis
ucacucgcacacga

SEQ ID NO: 474394 - RNA, 22 nt, Chlamydia trachomatis
ucacuccaagaagagucucuaa

SEQ ID NO: 474395 - RNA, 20 nt, Chlamydia trachomatis
ucagccgaugcccaagaaac

SEQ ID NO: 474396 - RNA, 21 nt, Chlamydia trachomatis
ucagccgaugcccaagaaacu

SEQ ID NO: 474397 - RNA, 21 nt, Chlamydia trachomatis
ucacugaccgaagaacucaaa

SEQ ID NO: 474398 - RNA, 23 nt, Chlamydia trachomatis
ucacugagaggaguuuuuuucac

SEQ ID NO: 474399 - RNA, 17 nt, Chlamydia trachomatis
ucagcuguacgauggaa

SEQ ID NO: 474400 - RNA, 17 nt, Chlamydia trachomatis
ucagcuaacgacgagaa

SEQ ID NO: 474401 - RNA, 14 nt, Chlamydia trachomatis
ucagcuuuuccaca

SEQ ID NO: 474402 - RNA, 16 nt, Chlamydia trachomatis
ucagcuucacguuuuu

SEQ ID NO: 474403 - RNA, 13 nt, Chlamydia trachomatis
ucagcuucaaccu

SEQ ID NO: 474404 - RNA, 12 nt, Chlamydia trachomatis
ucagcuucaacu

SEQ ID NO: 474405 - RNA, 13 nt, Chlamydia trachomatis
ucagcuucaacug

SEQ ID NO: 474406 - RNA, 19 nt, Chlamydia trachomatis
ucaggaauauuaagaucca

SEQ ID NO: 474407 - RNA, 21 nt, Chlamydia trachomatis
ucaggaauauuaagauccauu

SEQ ID NO: 474408 - RNA, 13 nt, Chlamydia trachomatis
ucaggggagaaaa

SEQ ID NO: 474409 - RNA, 12 nt, Chlamydia trachomatis
ucagguuugcau

SEQ ID NO: 474410 - RNA, 17 nt, Chlamydia trachomatis
ucagguuauccaaauaa

SEQ ID NO: 474411 - RNA, 18 nt, Chlamydia trachomatis
ucagguugcuugaauaag

SEQ ID NO: 474412 - RNA, 14 nt, Chlamydia trachomatis
ucagguaauuguga

SEQ ID NO: 474413 - RNA, 17 nt, Chlamydia trachomatis
ucagguaauugugaaug

SEQ ID NO: 474414 - RNA, 19 nt, Chlamydia trachomatis
ucauaagccucauccccuu

SEQ ID NO: 474415 - RNA, 15 nt, Chlamydia trachomatis
ucauaaaauuucaua

SEQ ID NO: 474416 - RNA, 19 nt, Chlamydia trachomatis
ucauaaaggaaagggcuuu

SEQ ID NO: 474417 - RNA, 15 nt, Chlamydia trachomatis
ucaguucgaaguucc

SEQ ID NO: 474418 - RNA, 16 nt, Chlamydia trachomatis
ucaguuuguucagaaa

SEQ ID NO: 474419 - RNA, 14 nt, Chlamydia trachomatis
ucaucaaaauauuu

SEQ ID NO: 474420 - RNA, 15 nt, Chlamydia trachomatis
ucaucaaaauauuuu

SEQ ID NO: 474421 - RNA, 13 nt, Chlamydia trachomatis
ucaucaaacucuu

SEQ ID NO: 474422 - RNA, 22 nt, Chlamydia trachomatis
ucauauguuacaggugauucaa

SEQ ID NO: 474423 - RNA, 17 nt, Chlamydia trachomatis
ucauauuccaaagaaau

SEQ ID NO: 474424 - RNA, 16 nt, Chlamydia trachomatis
ucauauucuuugucac

SEQ ID NO: 474425 - RNA, 18 nt, Chlamydia trachomatis
ucauaguuaacggaaaua

SEQ ID NO: 474426 - RNA, 14 nt, Chlamydia trachomatis
ucauaggaauguau

SEQ ID NO: 474427 - RNA, 18 nt, Chlamydia trachomatis
ucauagucugauccauuu

SEQ ID NO: 474428 - RNA, 22 nt, Chlamydia trachomatis
ucauagauugugguuagaaauu

SEQ ID NO: 474429 - RNA, 20 nt, Chlamydia trachomatis
ucauacuggcagggauagua

SEQ ID NO: 474430 - RNA, 20 nt, Chlamydia trachomatis
ucauaauuaaagguuuccca

SEQ ID NO: 474431 - RNA, 16 nt, Chlamydia trachomatis
ucauaauaguccuacu

SEQ ID NO: 474432 - RNA, 17 nt, Chlamydia trachomatis
ucauacauaacuauccc

SEQ ID NO: 474433 - RNA, 22 nt, Chlamydia trachomatis
ucauacgagccuguuucuuauc

SEQ ID NO: 474434 - RNA, 16 nt, Chlamydia trachomatis
ucaucagcuguuccuu

SEQ ID NO: 474435 - RNA, 14 nt, Chlamydia trachomatis
ucaucaucauggaa

SEQ ID NO: 474436 - RNA, 17 nt, Chlamydia trachomatis
ucaucaucauggaaaau

SEQ ID NO: 474437 - RNA, 16 nt, Chlamydia trachomatis
ucaucaugagaacgau

SEQ ID NO: 474438 - RNA, 21 nt, Chlamydia trachomatis
ucauccuagcagcuaauacuu

SEQ ID NO: 474439 - RNA, 14 nt, Chlamydia trachomatis
ucauccuuggcuuu

SEQ ID NO: 474440 - RNA, 19 nt, Chlamydia trachomatis
ucaucgaaaacaaagaguu

SEQ ID NO: 474441 - RNA, 19 nt, Chlamydia trachomatis
ucaucgaugauaucuucug

SEQ ID NO: 474442 - RNA, 21 nt, Chlamydia trachomatis
ucaucgaugauaucuucugaa

SEQ ID NO: 474443 - RNA, 22 nt, Chlamydia trachomatis
ucaucgagaacggcaauaaaga

SEQ ID NO: 474444 - RNA, 21 nt, Chlamydia trachomatis
ucaucgagaagaucuuuccuu

SEQ ID NO: 474445 - RNA, 19 nt, Chlamydia trachomatis
ucaucggcuugcccaaacu

SEQ ID NO: 474446 - RNA, 23 nt, Chlamydia trachomatis
ucaucuauaggaugguauucgcu

SEQ ID NO: 474447 - RNA, 22 nt, Chlamydia trachomatis
ucaucuucccaagacucaauca

SEQ ID NO: 474448 - RNA, 13 nt, Chlamydia trachomatis
ucaugcaccaacu

SEQ ID NO: 474449 - RNA, 16 nt, Chlamydia trachomatis
ucaugcagaugaagaa

SEQ ID NO: 474450 - RNA, 19 nt, Chlamydia trachomatis
ucaugcagaugaagaaucu

SEQ ID NO: 474451 - RNA, 14 nt, Chlamydia trachomatis
ucaugcaaguaauu

SEQ ID NO: 474452 - RNA, 17 nt, Chlamydia trachomatis
ucaugaaaagcuuucaa

SEQ ID NO: 474453 - RNA, 16 nt, Chlamydia trachomatis
ucauggaauaguugca

SEQ ID NO: 474454 - RNA, 20 nt, Chlamydia trachomatis
ucaugcggauuaaagaagga

SEQ ID NO: 474455 - RNA, 21 nt, Chlamydia trachomatis
ucaugguuaccugugaagaaa

SEQ ID NO: 474456 - RNA, 13 nt, Chlamydia trachomatis
ucauuaaaggaau

SEQ ID NO: 474457 - RNA, 18 nt, Chlamydia trachomatis
ucauuaaaggaauaauuu

SEQ ID NO: 474458 - RNA, 16 nt, Chlamydia trachomatis
ucauuaucuucuucua

SEQ ID NO: 474459 - RNA, 21 nt, Chlamydia trachomatis
ucauucaaaauccauucccag

SEQ ID NO: 474460 - RNA, 16 nt, Chlamydia trachomatis
ucauucgucaaagaag

SEQ ID NO: 474461 - RNA, 14 nt, Chlamydia trachomatis
ucauuuuaauaaga

SEQ ID NO: 474462 - RNA, 23 nt, Chlamydia trachomatis
ucauuuuauguaaauauuuugcc

SEQ ID NO: 474463 - RNA, 19 nt, Chlamydia trachomatis
ucauuuuucuguaauaagu

SEQ ID NO: 474464 - RNA, 15 nt, Chlamydia trachomatis
uccaaaaaagaaucu

SEQ ID NO: 474465 - RNA, 23 nt, Chlamydia trachomatis
uccaaaaaagaaucuaaaaagcc

SEQ ID NO: 474466 - RNA, 19 nt, Chlamydia trachomatis
uccaaaaauauggggccag

SEQ ID NO: 474467 - RNA, 18 nt, Chlamydia trachomatis
uccaaaaauugaaagaga

SEQ ID NO: 474468 - RNA, 22 nt, Chlamydia trachomatis
uccaaaaguguuuagaagugcu

SEQ ID NO: 474469 - RNA, 14 nt, Chlamydia trachomatis
uccaaaaucaucaa

SEQ ID NO: 474470 - RNA, 17 nt, Chlamydia trachomatis
uccaaaaucaucaaccg

SEQ ID NO: 474471 - RNA, 20 nt, Chlamydia trachomatis
uccacaacacgucuuaaagg

SEQ ID NO: 474472 - RNA, 14 nt, Chlamydia trachomatis
uccaaaaucuucaa

SEQ ID NO: 474473 - RNA, 22 nt, Chlamydia trachomatis
uccaaaauuucagggaaacgua

SEQ ID NO: 474474 - RNA, 18 nt, Chlamydia trachomatis
uccaaagcuuuaauaaua

SEQ ID NO: 474475 - RNA, 15 nt, Chlamydia trachomatis
uccaaauaaaacgaa

SEQ ID NO: 474476 - RNA, 15 nt, Chlamydia trachomatis
uccacauuauucaca

SEQ ID NO: 474477 - RNA, 17 nt, Chlamydia trachomatis
uccacauuauucacacu

SEQ ID NO: 474478 - RNA, 23 nt, Chlamydia trachomatis
uccaccagcagucgcgcagcuuc

SEQ ID NO: 474479 - RNA, 19 nt, Chlamydia trachomatis
uccagaguucauuuuuucu

SEQ ID NO: 474480 - RNA, 20 nt, Chlamydia trachomatis
uccagaguucauuuuuucuu

SEQ ID NO: 474481 - RNA, 21 nt, Chlamydia trachomatis
uccagacaaaaagaaagccuu

SEQ ID NO: 474482 - RNA, 18 nt, Chlamydia trachomatis
uccagacgcccuccuccu

SEQ ID NO: 474483 - RNA, 13 nt, Chlamydia trachomatis
uccagagcaaaua

SEQ ID NO: 474484 - RNA, 16 nt, Chlamydia trachomatis
uccagagcaaauagaa

SEQ ID NO: 474485 - RNA, 22 nt, Chlamydia trachomatis
uccagagcauguguuucuggaa

SEQ ID NO: 474486 - RNA, 23 nt, Chlamydia trachomatis
uccagagcauguguuucuggaaa

SEQ ID NO: 474487 - RNA, 16 nt, Chlamydia trachomatis
uccagaggaaauauug

SEQ ID NO: 474488 - RNA, 13 nt, Chlamydia trachomatis
uccacgaagagca

SEQ ID NO: 474489 - RNA, 15 nt, Chlamydia trachomatis
uccaccguagauacu

SEQ ID NO: 474490 - RNA, 16 nt, Chlamydia trachomatis
uccagccucuccagaa

SEQ ID NO: 474491 - RNA, 13 nt, Chlamydia trachomatis
uccagcgcacacu

SEQ ID NO: 474492 - RNA, 16 nt, Chlamydia trachomatis
uccaguacugcuacaa

SEQ ID NO: 474493 - RNA, 21 nt, Chlamydia trachomatis
uccauaagaauguuuccuaau

SEQ ID NO: 474494 - RNA, 14 nt, Chlamydia trachomatis
uccauaauuucuag

SEQ ID NO: 474495 - RNA, 16 nt, Chlamydia trachomatis
uccauacaaagguaaa

SEQ ID NO: 474496 - RNA, 14 nt, Chlamydia trachomatis
uccagcuucuccau

SEQ ID NO: 474497 - RNA, 15 nt, Chlamydia trachomatis
ucgccaaucagugua

SEQ ID NO: 474498 - RNA, 14 nt, Chlamydia trachomatis
uccauacgcugcug

SEQ ID NO: 474499 - RNA, 16 nt, Chlamydia trachomatis
ucgcccuuauugguau

SEQ ID NO: 474500 - RNA, 23 nt, Chlamydia trachomatis
ucgccgggggagccaaaaagucc

SEQ ID NO: 474501 - RNA, 15 nt, Chlamydia trachomatis
ucgccucuaucucuu

SEQ ID NO: 474502 - RNA, 19 nt, Chlamydia trachomatis
ucgcuauuuccccuacaaa

SEQ ID NO: 474503 - RNA, 22 nt, Chlamydia trachomatis
ucgcuauagcaugaucaugcag

SEQ ID NO: 474504 - RNA, 18 nt, Chlamydia trachomatis
ucgcuucaaaacuaaaag

SEQ ID NO: 474505 - RNA, 20 nt, Chlamydia trachomatis
ucgcuucaaaacuaaaaguu

SEQ ID NO: 474506 - RNA, 12 nt, Chlamydia trachomatis
ucgcuucugcug

SEQ ID NO: 474507 - RNA, 17 nt, Chlamydia trachomatis
ucggacaguucuuuauc

SEQ ID NO: 474508 - RNA, 11 nt, Chlamydia trachomatis
ucggagaagaa

SEQ ID NO: 474509 - RNA, 14 nt, Chlamydia trachomatis
ucggagaagaagag

SEQ ID NO: 474510 - RNA, 16 nt, Chlamydia trachomatis
ucggagaagaagaggg

SEQ ID NO: 474511 - RNA, 15 nt, Chlamydia trachomatis
ucggauagagaagaa

SEQ ID NO: 474512 - RNA, 14 nt, Chlamydia trachomatis
ucggcaaaagaucu

SEQ ID NO: 474513 - RNA, 13 nt, Chlamydia trachomatis
ucggccuuuucua

SEQ ID NO: 474514 - RNA, 22 nt, Chlamydia trachomatis
ucggccuuuucuagagaagaga

SEQ ID NO: 474515 - RNA, 19 nt, Chlamydia trachomatis
ucgguaaguccgcagagau

SEQ ID NO: 474516 - RNA, 23 nt, Chlamydia trachomatis
ucggucacgaaguuuuuuuaaaa

SEQ ID NO: 474517 - RNA, 13 nt, Chlamydia trachomatis
ucguaaaaaagau

SEQ ID NO: 474518 - RNA, 18 nt, Chlamydia trachomatis
ucgguuguauaaacccac

SEQ ID NO: 474519 - RNA, 17 nt, Chlamydia trachomatis
ucgucagggagaaaacg

SEQ ID NO: 474520 - RNA, 19 nt, Chlamydia trachomatis
ucgucaggggaucuguacc

SEQ ID NO: 474521 - RNA, 12 nt, Chlamydia trachomatis
ucgucagugcag

SEQ ID NO: 474522 - RNA, 13 nt, Chlamydia trachomatis
ucgucccaucuug

SEQ ID NO: 474523 - RNA, 13 nt, Chlamydia trachomatis
ucguccuccgcca

SEQ ID NO: 474524 - RNA, 21 nt, Chlamydia trachomatis
ucguauaaguuuuaagaagag

SEQ ID NO: 474525 - RNA, 14 nt, Chlamydia trachomatis
ucguagacuucuug

SEQ ID NO: 474526 - RNA, 17 nt, Chlamydia trachomatis
ucguaaguguugaggaa

SEQ ID NO: 474527 - RNA, 20 nt, Chlamydia trachomatis
ucguaaguguugaggaacau

SEQ ID NO: 474528 - RNA, 19 nt, Chlamydia trachomatis
ucguaagcauagcuucuug

SEQ ID NO: 474529 - RNA, 16 nt, Chlamydia trachomatis
ucguaaugaaggaaau

SEQ ID NO: 474530 - RNA, 14 nt, Chlamydia trachomatis
ucguaaugauguau

SEQ ID NO: 474531 - RNA, 19 nt, Chlamydia trachomatis
ucgucucagcuucaaccuu

SEQ ID NO: 474532 - RNA, 17 nt, Chlamydia trachomatis
ucgucuuuaacccuuca

SEQ ID NO: 474533 - RNA, 16 nt, Chlamydia trachomatis
ucgugaggcaugaaca

SEQ ID NO: 474534 - RNA, 15 nt, Chlamydia trachomatis
ucgugaauguuaaca

SEQ ID NO: 474535 - RNA, 17 nt, Chlamydia trachomatis
ucgugaauguuaacauc

SEQ ID NO: 474536 - RNA, 22 nt, Chlamydia trachomatis
ucgugccagcacaucacuauaa

SEQ ID NO: 474537 - RNA, 17 nt, Chlamydia trachomatis
ucgugcagggagaaggg

SEQ ID NO: 474538 - RNA, 19 nt, Chlamydia trachomatis
ucgugucaggcgauaugcu

SEQ ID NO: 474539 - RNA, 17 nt, Chlamydia trachomatis
ucgugugacuguaaguu

SEQ ID NO: 474540 - RNA, 19 nt, Chlamydia trachomatis
ucguuacgcguaaagauuu

SEQ ID NO: 474541 - RNA, 20 nt, Chlamydia trachomatis
ucguuacgcguaaagauuuu

SEQ ID NO: 474542 - RNA, 12 nt, Chlamydia trachomatis
ucguucaauuaa

SEQ ID NO: 474543 - RNA, 19 nt, Chlamydia trachomatis
ucuaacgcuuccucuccuu

SEQ ID NO: 474544 - RNA, 21 nt, Chlamydia trachomatis
ucuaacgcuuccucuccuucu

SEQ ID NO: 474545 - RNA, 15 nt, Chlamydia trachomatis
ucuaagaacaacgcu

SEQ ID NO: 474546 - RNA, 20 nt, Chlamydia trachomatis
ucuaagcgaaacaguucuuu

SEQ ID NO: 474547 - RNA, 18 nt, Chlamydia trachomatis
ucuaagcuagaaaauagc

SEQ ID NO: 474548 - RNA, 15 nt, Chlamydia trachomatis
aaaucuucauaagaa

SEQ ID NO: 474549 - RNA, 17 nt, Chlamydia trachomatis
aaaucuucauaagaaaa

SEQ ID NO: 474550 - RNA, 19 nt, Chlamydia trachomatis
aaaucuucauaagaaaauu

SEQ ID NO: 474551 - RNA, 14 nt, Chlamydia trachomatis
aaaucuuucuuucu

SEQ ID NO: 474552 - RNA, 22 nt, Chlamydia trachomatis
aaaugaaaccccucuuucucuc

SEQ ID NO: 474553 - RNA, 17 nt, Chlamydia trachomatis
aaaugaaggccaaagaa

SEQ ID NO: 474554 - RNA, 14 nt, Chlamydia trachomatis
ucuaacacuuuauc

SEQ ID NO: 474555 - RNA, 18 nt, Chlamydia trachomatis
ucuaaaugcuguaaaaca

SEQ ID NO: 474556 - RNA, 21 nt, Chlamydia trachomatis
ucuaaaugcuguaaaacauuu

SEQ ID NO: 474557 - RNA, 12 nt, Chlamydia trachomatis
ucuaaagaaaag

SEQ ID NO: 474558 - RNA, 12 nt, Chlamydia trachomatis
ucuaaagaauag

SEQ ID NO: 474559 - RNA, 15 nt, Chlamydia trachomatis
ucuaaagauccucuu

SEQ ID NO: 474560 - RNA, 16 nt, Chlamydia trachomatis
ucuaaagauccucuuu

SEQ ID NO: 474561 - RNA, 17 nt, Chlamydia trachomatis
ucuaaagauccucuuuc

SEQ ID NO: 474562 - RNA, 18 nt, Chlamydia trachomatis
ucuaaagcagcuaaccau

SEQ ID NO: 474563 - RNA, 22 nt, Chlamydia trachomatis
ucuaaagcuuuuguuaaccaag

SEQ ID NO: 474564 - RNA, 12 nt, Chlamydia trachomatis
ucuaaagucuga

SEQ ID NO: 474565 - RNA, 18 nt, Chlamydia trachomatis
ucguuugugcuaaaucuc

SEQ ID NO: 474566 - RNA, 12 nt, Chlamydia trachomatis
ucuaaaaaacuu

SEQ ID NO: 474567 - RNA, 18 nt, Chlamydia trachomatis
ucuaaaaaggcacuuugu

SEQ ID NO: 474568 - RNA, 20 nt, Chlamydia trachomatis
ucuaaaacaauuuccuuaga

SEQ ID NO: 474569 - RNA, 16 nt, Chlamydia trachomatis
ucuaaacccucugcau

SEQ ID NO: 474570 - RNA, 22 nt, Chlamydia trachomatis
ucuaauaggguuaggaaagcac

SEQ ID NO: 474571 - RNA, 20 nt, Chlamydia trachomatis
ucuaauauuaguugcaguga

SEQ ID NO: 474572 - RNA, 13 nt, Chlamydia trachomatis
ucuaauuaauaac

SEQ ID NO: 474573 - RNA, 14 nt, Chlamydia trachomatis
ucuaauuccuucaa

SEQ ID NO: 474574 - RNA, 20 nt, Chlamydia trachomatis
ucuaauuuuagauaaaagaa

SEQ ID NO: 474575 - RNA, 17 nt, Chlamydia trachomatis
ucuacaaaaccaaaauc

SEQ ID NO: 474576 - RNA, 21 nt, Chlamydia trachomatis
ucuacaaauaguguaaggaga

SEQ ID NO: 474577 - RNA, 19 nt, Chlamydia trachomatis
ucuacagugaaaccgcaag

SEQ ID NO: 474578 - RNA, 13 nt, Chlamydia trachomatis
ucuacauccaaaa

SEQ ID NO: 474579 - RNA, 20 nt, Chlamydia trachomatis
ucuacauccaaaaauugaaa

SEQ ID NO: 474580 - RNA, 21 nt, Chlamydia trachomatis
ucuacaugguaccuucucaaa

SEQ ID NO: 474581 - RNA, 19 nt, Chlamydia trachomatis
ucuacgcuuccuacagcua

SEQ ID NO: 474582 - RNA, 16 nt, Chlamydia trachomatis
aaaugagaaauaaaaa

SEQ ID NO: 474583 - RNA, 19 nt, Chlamydia trachomatis
ucuaccguauuaucugcaa

SEQ ID NO: 474584 - RNA, 17 nt, Chlamydia trachomatis
aaaugcaaauuugcaga

SEQ ID NO: 474585 - RNA, 15 nt, Chlamydia trachomatis
ucuagcugauaagga

SEQ ID NO: 474586 - RNA, 19 nt, Chlamydia trachomatis
ucuagggaaaaaaagaggu

SEQ ID NO: 474587 - RNA, 21 nt, Chlamydia trachomatis
ucuagggaaaaaaagagguau

SEQ ID NO: 474588 - RNA, 19 nt, Chlamydia trachomatis
ucuagguauuuagguagca

SEQ ID NO: 474589 - RNA, 20 nt, Chlamydia trachomatis
aaaugauaauccucgcaauc

SEQ ID NO: 474590 - RNA, 13 nt, Chlamydia trachomatis
aaaugaucgccuc

SEQ ID NO: 474591 - RNA, 21 nt, Chlamydia trachomatis
aaaugaucuaaaggaaaaauu

SEQ ID NO: 474592 - RNA, 20 nt, Chlamydia trachomatis
ucuacuuuuuguuuagacaa

SEQ ID NO: 474593 - RNA, 16 nt, Chlamydia trachomatis
aaaugaugaaaaagaa

SEQ ID NO: 474594 - RNA, 20 nt, Chlamydia trachomatis
ucuagaagaccaaaaaugaa

SEQ ID NO: 474595 - RNA, 13 nt, Chlamydia trachomatis
ucuagagauaucc

SEQ ID NO: 474596 - RNA, 19 nt, Chlamydia trachomatis
ucuagagccugcaagagau

SEQ ID NO: 474597 - RNA, 16 nt, Chlamydia trachomatis
ucuagagguauuuuau

SEQ ID NO: 474598 - RNA, 22 nt, Chlamydia trachomatis
ucuagccaauccguaugauaaa

SEQ ID NO: 474599 - RNA, 15 nt, Chlamydia trachomatis
ucuaucgcuugaaaa

SEQ ID NO: 474600 - RNA, 18 nt, Chlamydia trachomatis
ucuauccggaguaccaaa

SEQ ID NO: 474601 - RNA, 14 nt, Chlamydia trachomatis
ucuauccauaauuu

SEQ ID NO: 474602 - RNA, 12 nt, Chlamydia trachomatis
ucuauccauaca

SEQ ID NO: 474603 - RNA, 18 nt, Chlamydia trachomatis
ucuaucaacuuuacauaa

SEQ ID NO: 474604 - RNA, 14 nt, Chlamydia trachomatis
ucuauggcaaaagg

SEQ ID NO: 474605 - RNA, 19 nt, Chlamydia trachomatis
ucuauguaaaaauucuaaa

SEQ ID NO: 474606 - RNA, 23 nt, Chlamydia trachomatis
ucuauguaaaaauucuaaaguaa

SEQ ID NO: 474607 - RNA, 13 nt, Chlamydia trachomatis
ucuaugagaagaa

SEQ ID NO: 474608 - RNA, 13 nt, Chlamydia trachomatis
ucuauaauaugaa

SEQ ID NO: 474609 - RNA, 21 nt, Chlamydia trachomatis
ucuauagaaacacgcaacccu

SEQ ID NO: 474610 - RNA, 19 nt, Chlamydia trachomatis
ucuauaguaauagcuagau

SEQ ID NO: 474611 - RNA, 21 nt, Chlamydia trachomatis
ucucaaaacgcucuccaaaga

SEQ ID NO: 474612 - RNA, 19 nt, Chlamydia trachomatis
ucuauguucuuaauaaucu

SEQ ID NO: 474613 - RNA, 20 nt, Chlamydia trachomatis
ucuauguucuuaauaaucug

SEQ ID NO: 474614 - RNA, 18 nt, Chlamydia trachomatis
ucuauucguguccucuau

SEQ ID NO: 474615 - RNA, 21 nt, Chlamydia trachomatis
ucuauuggacucagaaucuuu

SEQ ID NO: 474616 - RNA, 14 nt, Chlamydia trachomatis
ucucaccgaaaaau

SEQ ID NO: 474617 - RNA, 15 nt, Chlamydia trachomatis
ucucaccgaaaaauu

SEQ ID NO: 474618 - RNA, 18 nt, Chlamydia trachomatis
ucucagcagcuuccugag

SEQ ID NO: 474619 - RNA, 13 nt, Chlamydia trachomatis
ucucauaagaaua

SEQ ID NO: 474620 - RNA, 17 nt, Chlamydia trachomatis
ucucauaagaauacaaa

SEQ ID NO: 474621 - RNA, 21 nt, Chlamydia trachomatis
ucucauuauauaaagccccuc

SEQ ID NO: 474622 - RNA, 15 nt, Chlamydia trachomatis
ucuccaaaauucugu

SEQ ID NO: 474623 - RNA, 21 nt, Chlamydia trachomatis
ucuccaggagagucugcuaca

SEQ ID NO: 474624 - RNA, 22 nt, Chlamydia trachomatis
ucuccagaguucauuuuuucuu

SEQ ID NO: 474625 - RNA, 20 nt, Chlamydia trachomatis
ucuccaaucacagcaauagc

SEQ ID NO: 474626 - RNA, 20 nt, Chlamydia trachomatis
ucucccgaugaucuuuccaa

SEQ ID NO: 474627 - RNA, 17 nt, Chlamydia trachomatis
ucucccuaagaucucuu

SEQ ID NO: 474628 - RNA, 17 nt, Chlamydia trachomatis
ucuccaucugacuuuuu

SEQ ID NO: 474629 - RNA, 20 nt, Chlamydia trachomatis
ucuccaugauccccuacgcu

SEQ ID NO: 474630 - RNA, 23 nt, Chlamydia trachomatis
ucucccaagaaacuuuucugcag

SEQ ID NO: 474631 - RNA, 17 nt, Chlamydia trachomatis
ucuccgcuuaaaacuac

SEQ ID NO: 474632 - RNA, 14 nt, Chlamydia trachomatis
ucuccgguucucuu

SEQ ID NO: 474633 - RNA, 15 nt, Chlamydia trachomatis
ucuccuaauucaaca

SEQ ID NO: 474634 - RNA, 20 nt, Chlamydia trachomatis
ucuccuauugagcgcaaagc

SEQ ID NO: 474635 - RNA, 13 nt, Chlamydia trachomatis
ucuccucucucuu

SEQ ID NO: 474636 - RNA, 17 nt, Chlamydia trachomatis
ucuccuucuuuaauaaa

SEQ ID NO: 474637 - RNA, 22 nt, Chlamydia trachomatis
ucuccuucuuugacaaagucag

SEQ ID NO: 474638 - RNA, 15 nt, Chlamydia trachomatis
ucucgcaaagaauca

SEQ ID NO: 474639 - RNA, 21 nt, Chlamydia trachomatis
ucucgcagaugcuucugccuu

SEQ ID NO: 474640 - RNA, 15 nt, Chlamydia trachomatis
ucucgccaaccauag

SEQ ID NO: 474641 - RNA, 18 nt, Chlamydia trachomatis
ucucgagcuaagaaaaua

SEQ ID NO: 474642 - RNA, 13 nt, Chlamydia trachomatis
ucucgaaugcugu

SEQ ID NO: 474643 - RNA, 14 nt, Chlamydia trachomatis
ucucgaaugcugua

SEQ ID NO: 474644 - RNA, 15 nt, Chlamydia trachomatis
ucucgaauucuauca

SEQ ID NO: 474645 - RNA, 15 nt, Chlamydia trachomatis
ucucgaaagagaaca

SEQ ID NO: 474646 - RNA, 21 nt, Chlamydia trachomatis
ucugaaacgcacuccaauaua

SEQ ID NO: 474647 - RNA, 21 nt, Chlamydia trachomatis
ucugaaagagcuucuuuuuca

SEQ ID NO: 474648 - RNA, 13 nt, Chlamydia trachomatis
ucucuuguuucaa

SEQ ID NO: 474649 - RNA, 17 nt, Chlamydia trachomatis
ucugaaacuagucucuu

SEQ ID NO: 474650 - RNA, 22 nt, Chlamydia trachomatis
ucugaaacuagucucuucugug

SEQ ID NO: 474651 - RNA, 13 nt, Chlamydia trachomatis
ucugcagaagaag

SEQ ID NO: 474652 - RNA, 17 nt, Chlamydia trachomatis
ucugcagaagaagcccc

SEQ ID NO: 474653 - RNA, 14 nt, Chlamydia trachomatis
ucugcagagagcca

SEQ ID NO: 474654 - RNA, 21 nt, Chlamydia trachomatis
ucugcagagaucauaccaaua

SEQ ID NO: 474655 - RNA, 16 nt, Chlamydia trachomatis
ucugcagccuacauac

SEQ ID NO: 474656 - RNA, 19 nt, Chlamydia trachomatis
ucugaguauuaaggaaaug

SEQ ID NO: 474657 - RNA, 19 nt, Chlamydia trachomatis
ucugaguccucuaaaguau

SEQ ID NO: 474658 - RNA, 18 nt, Chlamydia trachomatis
ucugcaagaaaauaaguu

SEQ ID NO: 474659 - RNA, 15 nt, Chlamydia trachomatis
ucugcaagaaaauag

SEQ ID NO: 474660 - RNA, 22 nt, Chlamydia trachomatis
ucugcaagaaaauagguaaaga

SEQ ID NO: 474661 - RNA, 20 nt, Chlamydia trachomatis
ucucuccccauaauaggagg

SEQ ID NO: 474662 - RNA, 22 nt, Chlamydia trachomatis
ucucucauaccuaaacaaggau

SEQ ID NO: 474663 - RNA, 20 nt, Chlamydia trachomatis
ucucucaugucuagcuagaa

SEQ ID NO: 474664 - RNA, 22 nt, Chlamydia trachomatis
ucucuccggagaacaguguccu

SEQ ID NO: 474665 - RNA, 20 nt, Chlamydia trachomatis
ucucucgcgaacaauaucug

SEQ ID NO: 474666 - RNA, 14 nt, Chlamydia trachomatis
ucucucucagcagc

SEQ ID NO: 474667 - RNA, 16 nt, Chlamydia trachomatis
ucucuaaaaucacaca

SEQ ID NO: 474668 - RNA, 15 nt, Chlamydia trachomatis
ucucuaaagacagca

SEQ ID NO: 474669 - RNA, 17 nt, Chlamydia trachomatis
ucucuaacuuaauaagg

SEQ ID NO: 474670 - RNA, 19 nt, Chlamydia trachomatis
ucucguugauuaaaguuuc

SEQ ID NO: 474671 - RNA, 15 nt, Chlamydia trachomatis
ucucuaaaaacucuu

SEQ ID NO: 474672 - RNA, 21 nt, Chlamydia trachomatis
ucucuaaaaacucuuuuucua

SEQ ID NO: 474673 - RNA, 15 nt, Chlamydia trachomatis
ucucgcugcgagaga

SEQ ID NO: 474674 - RNA, 23 nt, Chlamydia trachomatis
ucucugauggaaaugcugugacu

SEQ ID NO: 474675 - RNA, 13 nt, Chlamydia trachomatis
ucucugcagagaa

SEQ ID NO: 474676 - RNA, 14 nt, Chlamydia trachomatis
ucucuggaaaaggc

SEQ ID NO: 474677 - RNA, 19 nt, Chlamydia trachomatis
ucucugguaaaaauagaaa

SEQ ID NO: 474678 - RNA, 18 nt, Chlamydia trachomatis
ucucuggucgugaucacu

SEQ ID NO: 474679 - RNA, 17 nt, Chlamydia trachomatis
ucucuugcauguauagu

SEQ ID NO: 474680 - RNA, 22 nt, Chlamydia trachomatis
ucucuugcauguauagucaucu

SEQ ID NO: 474681 - RNA, 23 nt, Chlamydia trachomatis
ucugcuugcgaauaacuaauaua

SEQ ID NO: 474682 - RNA, 22 nt, Chlamydia trachomatis
ucugcuucgccaaacacugcaa

SEQ ID NO: 474683 - RNA, 15 nt, Chlamydia trachomatis
ucugcauauuuaauu

SEQ ID NO: 474684 - RNA, 19 nt, Chlamydia trachomatis
ucugcaucuuuauagaauu

SEQ ID NO: 474685 - RNA, 20 nt, Chlamydia trachomatis
ucugcauaacagcaagacaa

SEQ ID NO: 474686 - RNA, 15 nt, Chlamydia trachomatis
ucugguauucuaaau

SEQ ID NO: 474687 - RNA, 18 nt, Chlamydia trachomatis
ucugggaaaauuaaaagg

SEQ ID NO: 474688 - RNA, 14 nt, Chlamydia trachomatis
ucuggcugaagaag

SEQ ID NO: 474689 - RNA, 17 nt, Chlamydia trachomatis
ucuggauugugaagaac

SEQ ID NO: 474690 - RNA, 15 nt, Chlamydia trachomatis
ucuguauccuaacua

SEQ ID NO: 474691 - RNA, 16 nt, Chlamydia trachomatis
ucuguauaacaauuuu

SEQ ID NO: 474692 - RNA, 18 nt, Chlamydia trachomatis
ucuguagauucagcaaga

SEQ ID NO: 474693 - RNA, 20 nt, Chlamydia trachomatis
ucuguaggagagaaucuuuu

SEQ ID NO: 474694 - RNA, 21 nt, Chlamydia trachomatis
ucuguacgucugcaagaaaau

SEQ ID NO: 474695 - RNA, 14 nt, Chlamydia trachomatis
ucuguaaggcagga

SEQ ID NO: 474696 - RNA, 17 nt, Chlamydia trachomatis
ucugguuucuuaaacaa

SEQ ID NO: 474697 - RNA, 20 nt, Chlamydia trachomatis
ucuguaaaaggaauucuucg

SEQ ID NO: 474698 - RNA, 13 nt, Chlamydia trachomatis
ucugguguaggaa

SEQ ID NO: 474699 - RNA, 17 nt, Chlamydia trachomatis
ucugucguuaaagaauu

SEQ ID NO: 474700 - RNA, 21 nt, Chlamydia trachomatis
ucugucuaagauuuucaucuu

SEQ ID NO: 474701 - RNA, 21 nt, Chlamydia trachomatis
ucugucuuagcaaagaaauag

SEQ ID NO: 474702 - RNA, 15 nt, Chlamydia trachomatis
ucugugcaaucagcu

SEQ ID NO: 474703 - RNA, 17 nt, Chlamydia trachomatis
ucuuaguaaggcgagaa

SEQ ID NO: 474704 - RNA, 18 nt, Chlamydia trachomatis
ucuuaguuugugaugagg

SEQ ID NO: 474705 - RNA, 18 nt, Chlamydia trachomatis
ucuuaucguagagaucuu

SEQ ID NO: 474706 - RNA, 20 nt, Chlamydia trachomatis
ucuuaucguagagaucuucu

SEQ ID NO: 474707 - RNA, 11 nt, Chlamydia trachomatis
ucuucaagaag

SEQ ID NO: 474708 - RNA, 22 nt, Chlamydia trachomatis
ucuucaagaucaaagucaggau

SEQ ID NO: 474709 - RNA, 21 nt, Chlamydia trachomatis
ucuguuaacugacaauccagu

SEQ ID NO: 474710 - RNA, 20 nt, Chlamydia trachomatis
ucuguuaguagcuucucuuc

SEQ ID NO: 474711 - RNA, 20 nt, Chlamydia trachomatis
ucuguuauuuguucucuuag

SEQ ID NO: 474712 - RNA, 19 nt, Chlamydia trachomatis
ucuguucagaacucaaaau

SEQ ID NO: 474713 - RNA, 20 nt, Chlamydia trachomatis
ucuguugaaagcuauuuucu

SEQ ID NO: 474714 - RNA, 19 nt, Chlamydia trachomatis
ucuuacaagggcacucgcg

SEQ ID NO: 474715 - RNA, 19 nt, Chlamydia trachomatis
ucuuacauaagauccaucu

SEQ ID NO: 474716 - RNA, 20 nt, Chlamydia trachomatis
ucuuacgaccguauuuuuua

SEQ ID NO: 474717 - RNA, 21 nt, Chlamydia trachomatis
ucuuccaucacuccaagaaga

SEQ ID NO: 474718 - RNA, 22 nt, Chlamydia trachomatis
ucuucccaacuuuuuuagcaac

SEQ ID NO: 474719 - RNA, 21 nt, Chlamydia trachomatis
ucuucccaauauauuccuguc

SEQ ID NO: 474720 - RNA, 20 nt, Chlamydia trachomatis
ucuuccguauggguuuuugu

SEQ ID NO: 474721 - RNA, 17 nt, Chlamydia trachomatis
ucuuccucuaauuuuac

SEQ ID NO: 474722 - RNA, 15 nt, Chlamydia trachomatis
ucuuccuucccuucc

SEQ ID NO: 474723 - RNA, 15 nt, Chlamydia trachomatis
ucuucggacauugaa

SEQ ID NO: 474724 - RNA, 17 nt, Chlamydia trachomatis
ucuucggacauugaaca

SEQ ID NO: 474725 - RNA, 15 nt, Chlamydia trachomatis
ucuucacggagagaa

SEQ ID NO: 474726 - RNA, 21 nt, Chlamydia trachomatis
ucuucacggagagaaagaggg

SEQ ID NO: 474727 - RNA, 16 nt, Chlamydia trachomatis
ucuucaauggcaaaac

SEQ ID NO: 474728 - RNA, 23 nt, Chlamydia trachomatis
ucuucacagagcuucucuaaaug

SEQ ID NO: 474729 - RNA, 22 nt, Chlamydia trachomatis
ucuucaccaacuccaagcauua

SEQ ID NO: 474730 - RNA, 21 nt, Chlamydia trachomatis
ucuuccagccuacaaauaaag

SEQ ID NO: 474731 - RNA, 22 nt, Chlamydia trachomatis
ugaaaguuccgguauauucuuc

SEQ ID NO: 474732 - RNA, 12 nt, Chlamydia trachomatis
ugaaaguagcua

SEQ ID NO: 474733 - RNA, 15 nt, Chlamydia trachomatis
ugaaaguagcuacuu

SEQ ID NO: 474734 - RNA, 14 nt, Chlamydia trachomatis
ugaaagucuuuaua

SEQ ID NO: 474735 - RNA, 20 nt, Chlamydia trachomatis
ugaaagagcuucuuuuucaa

SEQ ID NO: 474736 - RNA, 23 nt, Chlamydia trachomatis
ugaaagagugauucgguaaucac

SEQ ID NO: 474737 - RNA, 17 nt, Chlamydia trachomatis
ugaaaccgcaagucucu

SEQ ID NO: 474738 - RNA, 15 nt, Chlamydia trachomatis
ugaaaccccucuuuc

SEQ ID NO: 474739 - RNA, 18 nt, Chlamydia trachomatis
ugaaacaucuuuuaaagu

SEQ ID NO: 474740 - RNA, 17 nt, Chlamydia trachomatis
ugaaacccaucucuaua

SEQ ID NO: 474741 - RNA, 19 nt, Chlamydia trachomatis
ugaaauaugcauagucuuc

SEQ ID NO: 474742 - RNA, 23 nt, Chlamydia trachomatis
ugaaauaugcauagucuucagga

SEQ ID NO: 474743 - RNA, 16 nt, Chlamydia trachomatis
ugaacagcaagaggcc

SEQ ID NO: 474744 - RNA, 16 nt, Chlamydia trachomatis
ugaacauccaccagca

SEQ ID NO: 474745 - RNA, 21 nt, Chlamydia trachomatis
ugaagaacugucuucuuucaa

SEQ ID NO: 474746 - RNA, 14 nt, Chlamydia trachomatis
ugaagagaaaaauu

SEQ ID NO: 474747 - RNA, 13 nt, Chlamydia trachomatis
ugaagagcagagg

SEQ ID NO: 474748 - RNA, 19 nt, Chlamydia trachomatis
ugaagaaacuucuggagau

SEQ ID NO: 474749 - RNA, 20 nt, Chlamydia trachomatis
ugaaccagggagagcuuagg

SEQ ID NO: 474750 - RNA, 14 nt, Chlamydia trachomatis
ugaacgagaaaaag

SEQ ID NO: 474751 - RNA, 17 nt, Chlamydia trachomatis
ugaagauucuaaaaugc

SEQ ID NO: 474752 - RNA, 22 nt, Chlamydia trachomatis
ugaagauauucaugugaacaga

SEQ ID NO: 474753 - RNA, 22 nt, Chlamydia trachomatis
ugaagauuaccguggagaauca

SEQ ID NO: 474754 - RNA, 20 nt, Chlamydia trachomatis
ugaagcgcuuguagugaagu

SEQ ID NO: 474755 - RNA, 20 nt, Chlamydia trachomatis
ugaaggugugaaagaaaaau

SEQ ID NO: 474756 - RNA, 14 nt, Chlamydia trachomatis
ugaaguucuuuuuc

SEQ ID NO: 474757 - RNA, 20 nt, Chlamydia trachomatis
ugaauacaaaccgaagaggg

SEQ ID NO: 474758 - RNA, 21 nt, Chlamydia trachomatis
ugaauacaaaccgaagaggga

SEQ ID NO: 474759 - RNA, 22 nt, Chlamydia trachomatis
ugaauacgauccucuggauaua

SEQ ID NO: 474760 - RNA, 18 nt, Chlamydia trachomatis
ugaauaggaagaauaaua

SEQ ID NO: 474761 - RNA, 19 nt, Chlamydia trachomatis
ugaauaggaagaauaauac

SEQ ID NO: 474762 - RNA, 19 nt, Chlamydia trachomatis
ugaauagguucuauccaua

SEQ ID NO: 474763 - RNA, 18 nt, Chlamydia trachomatis
ugaauaucguaaacaacc

SEQ ID NO: 474764 - RNA, 22 nt, Chlamydia trachomatis
ugaauauucccgaacuuuauua

SEQ ID NO: 474765 - RNA, 13 nt, Chlamydia trachomatis
ugaauuuccccug

SEQ ID NO: 474766 - RNA, 22 nt, Chlamydia trachomatis
ugaauuugaacagcgacauucu

SEQ ID NO: 474767 - RNA, 14 nt, Chlamydia trachomatis
ugaaugucuuuuuc

SEQ ID NO: 474768 - RNA, 16 nt, Chlamydia trachomatis
ugaauguuaacaucuu

SEQ ID NO: 474769 - RNA, 14 nt, Chlamydia trachomatis
ugaauucuccagga

SEQ ID NO: 474770 - RNA, 13 nt, Chlamydia trachomatis
ugaauugaauaca

SEQ ID NO: 474771 - RNA, 13 nt, Chlamydia trachomatis
ugaaucuguguug

SEQ ID NO: 474772 - RNA, 17 nt, Chlamydia trachomatis
ugaaucagaaguugagc

SEQ ID NO: 474773 - RNA, 22 nt, Chlamydia trachomatis
ugaaucagaaguugagcaacua

SEQ ID NO: 474774 - RNA, 15 nt, Chlamydia trachomatis
ugaaucagcuuuucc

SEQ ID NO: 474775 - RNA, 19 nt, Chlamydia trachomatis
ugaauccagaauuaauuuc

SEQ ID NO: 474776 - RNA, 13 nt, Chlamydia trachomatis
ugaaucaaacaga

SEQ ID NO: 474777 - RNA, 16 nt, Chlamydia trachomatis
ugaaucacagaaacuu

SEQ ID NO: 474778 - RNA, 22 nt, Chlamydia trachomatis
ugaaucacagaaacuucuucua

SEQ ID NO: 474779 - RNA, 18 nt, Chlamydia trachomatis
ugacagcaccaagcucca

SEQ ID NO: 474780 - RNA, 19 nt, Chlamydia trachomatis
ugacagcaccaagcuccac

SEQ ID NO: 474781 - RNA, 15 nt, Chlamydia trachomatis
ugacagcauagauau

SEQ ID NO: 474782 - RNA, 23 nt, Chlamydia trachomatis
ugacagcauagauauugccuaca

SEQ ID NO: 474783 - RNA, 15 nt, Chlamydia trachomatis
ugacaggcagcagag

SEQ ID NO: 474784 - RNA, 21 nt, Chlamydia trachomatis
ugacagguuucaugacauuca

SEQ ID NO: 474785 - RNA, 12 nt, Chlamydia trachomatis
ugacaaacuuuc

SEQ ID NO: 474786 - RNA, 19 nt, Chlamydia trachomatis
ugaccaucuucaccaacuc

SEQ ID NO: 474787 - RNA, 18 nt, Chlamydia trachomatis
ugacugcggcagcugcuu

SEQ ID NO: 474788 - RNA, 20 nt, Chlamydia trachomatis
ugacuggcgagaagcaugca

SEQ ID NO: 474789 - RNA, 17 nt, Chlamydia trachomatis
ugagauccuuaaacucu

SEQ ID NO: 474790 - RNA, 15 nt, Chlamydia trachomatis
ugagaauuuccagca

SEQ ID NO: 474791 - RNA, 19 nt, Chlamydia trachomatis
ugagaaucggauccuucga

SEQ ID NO: 474792 - RNA, 19 nt, Chlamydia trachomatis
ugagaaaaagaagaacgcc

SEQ ID NO: 474793 - RNA, 20 nt, Chlamydia trachomatis
ugacuuuuagcaaauaauag

SEQ ID NO: 474794 - RNA, 21 nt, Chlamydia trachomatis
ugacuuuuauucacccaaaua

SEQ ID NO: 474795 - RNA, 21 nt, Chlamydia trachomatis
ugagcagaauagauucccuuu

SEQ ID NO: 474796 - RNA, 16 nt, Chlamydia trachomatis
ugagcagcaaagaucg

SEQ ID NO: 474797 - RNA, 22 nt, Chlamydia trachomatis
ugagaugcuccucucuuuggua

SEQ ID NO: 474798 - RNA, 22 nt, Chlamydia trachomatis
ugagccgcuauucacuaccaga

SEQ ID NO: 474799 - RNA, 19 nt, Chlamydia trachomatis
ugagccucuaacucuucug

SEQ ID NO: 474800 - RNA, 21 nt, Chlamydia trachomatis
ugagccucuaacucuucugga

SEQ ID NO: 474801 - RNA, 14 nt, Chlamydia trachomatis
ugagcauuucucuc

SEQ ID NO: 474802 - RNA, 17 nt, Chlamydia trachomatis
ugagcauuugccaauga

SEQ ID NO: 474803 - RNA, 15 nt, Chlamydia trachomatis
ugagcaucuggagug

SEQ ID NO: 474804 - RNA, 16 nt, Chlamydia trachomatis
ugagcuuuauuuucau

SEQ ID NO: 474805 - RNA, 17 nt, Chlamydia trachomatis
ugagcuuaucacaaacc

SEQ ID NO: 474806 - RNA, 22 nt, Chlamydia trachomatis
ugagucucgcgcuaaaaccuua

SEQ ID NO: 474807 - RNA, 16 nt, Chlamydia trachomatis
ugauacaauuccugcu

SEQ ID NO: 474808 - RNA, 22 nt, Chlamydia trachomatis
ugaucucaacgcucaacucgcu

SEQ ID NO: 474809 - RNA, 22 nt, Chlamydia trachomatis
ugaucccuaauaugaagaacuu

SEQ ID NO: 474810 - RNA, 19 nt, Chlamydia trachomatis
ugaucauugauaaauucua

SEQ ID NO: 474811 - RNA, 17 nt, Chlamydia trachomatis
ugaucacugugagagca

SEQ ID NO: 474812 - RNA, 18 nt, Chlamydia trachomatis
ugauauuuugaagauaaa

SEQ ID NO: 474813 - RNA, 15 nt, Chlamydia trachomatis
ugaucaaauccugcu

SEQ ID NO: 474814 - RNA, 17 nt, Chlamydia trachomatis
ugaucuuuaagcucuuc

SEQ ID NO: 474815 - RNA, 15 nt, Chlamydia trachomatis
ugaucuuuguucucu

SEQ ID NO: 474816 - RNA, 23 nt, Chlamydia trachomatis
ugaucuuuguucucuaaagauuc

SEQ ID NO: 474817 - RNA, 22 nt, Chlamydia trachomatis
ugaucuuuugcuguggaaaaau

SEQ ID NO: 474818 - RNA, 21 nt, Chlamydia trachomatis
ugaugcccaggauaacaaaca

SEQ ID NO: 474819 - RNA, 22 nt, Chlamydia trachomatis
ugaugcccaggauaacaaacaa

SEQ ID NO: 474820 - RNA, 18 nt, Chlamydia trachomatis
ugaugccguacaaggaaa

SEQ ID NO: 474821 - RNA, 18 nt, Chlamydia trachomatis
ugauggagauugcaacuc

SEQ ID NO: 474822 - RNA, 21 nt, Chlamydia trachomatis
ugauuauaaauggauacuaac

SEQ ID NO: 474823 - RNA, 14 nt, Chlamydia trachomatis
ugauguuccaucuu

SEQ ID NO: 474824 - RNA, 18 nt, Chlamydia trachomatis
ugauuaaaguuucuaaua

SEQ ID NO: 474825 - RNA, 16 nt, Chlamydia trachomatis
ugauuagaaagggcuu

SEQ ID NO: 474826 - RNA, 15 nt, Chlamydia trachomatis
ugauuagaaauugau

SEQ ID NO: 474827 - RNA, 13 nt, Chlamydia trachomatis
ugcagaagaagcc

SEQ ID NO: 474828 - RNA, 21 nt, Chlamydia trachomatis
ugcagaagaagccccaauagc

SEQ ID NO: 474829 - RNA, 23 nt, Chlamydia trachomatis
ugcagaagaagccccaauagcua

SEQ ID NO: 474830 - RNA, 16 nt, Chlamydia trachomatis
ugcagaagaccaguca

SEQ ID NO: 474831 - RNA, 22 nt, Chlamydia trachomatis
ugcagaagauaagcaaggaaua

SEQ ID NO: 474832 - RNA, 19 nt, Chlamydia trachomatis
ugcagaagcuccaaagaac

SEQ ID NO: 474833 - RNA, 12 nt, Chlamydia trachomatis
ugcagaaaaauu

SEQ ID NO: 474834 - RNA, 22 nt, Chlamydia trachomatis
ugcagaaaucccaucaaaagcu

SEQ ID NO: 474835 - RNA, 16 nt, Chlamydia trachomatis
ugcacuuuccguagcc

SEQ ID NO: 474836 - RNA, 20 nt, Chlamydia trachomatis
ugcagaggggggcuugcaca

SEQ ID NO: 474837 - RNA, 16 nt, Chlamydia trachomatis
ugcagagaucauacca

SEQ ID NO: 474838 - RNA, 22 nt, Chlamydia trachomatis
ugcagacaagccuucaggauuc

SEQ ID NO: 474839 - RNA, 23 nt, Chlamydia trachomatis
ugcagacucaaagcuucccuucu

SEQ ID NO: 474840 - RNA, 12 nt, Chlamydia trachomatis
ugcagcaucuau

SEQ ID NO: 474841 - RNA, 19 nt, Chlamydia trachomatis
ugcagggcuugggaucuuc

SEQ ID NO: 474842 - RNA, 17 nt, Chlamydia trachomatis
ugcauauuuaauugcau

SEQ ID NO: 474843 - RNA, 20 nt, Chlamydia trachomatis
ugcauauuuaauugcauuaa

SEQ ID NO: 474844 - RNA, 11 nt, Chlamydia trachomatis
ugcauagcuug

SEQ ID NO: 474845 - RNA, 19 nt, Chlamydia trachomatis
ugcauagcuuguugcagcc

SEQ ID NO: 474846 - RNA, 14 nt, Chlamydia trachomatis
ugcaugguaaaugu

SEQ ID NO: 474847 - RNA, 19 nt, Chlamydia trachomatis
ugcauguaaucccuuuuuc

SEQ ID NO: 474848 - RNA, 19 nt, Chlamydia trachomatis
ugcauguuaguauccauau

SEQ ID NO: 474849 - RNA, 14 nt, Chlamydia trachomatis
ugcauggaaucaua

SEQ ID NO: 474850 - RNA, 12 nt, Chlamydia trachomatis
ugccacacuucc

SEQ ID NO: 474851 - RNA, 23 nt, Chlamydia trachomatis
ugccaagaccucuucaaagaucg

SEQ ID NO: 474852 - RNA, 17 nt, Chlamydia trachomatis
ugccaaaaagaaaauca

SEQ ID NO: 474853 - RNA, 15 nt, Chlamydia trachomatis
ugccagcugcugcuu

SEQ ID NO: 474854 - RNA, 18 nt, Chlamydia trachomatis
ugccaucauuaucuucuu

SEQ ID NO: 474855 - RNA, 13 nt, Chlamydia trachomatis
ugcccaucaucga

SEQ ID NO: 474856 - RNA, 21 nt, Chlamydia trachomatis
ugcccuaaagagaucucucca

SEQ ID NO: 474857 - RNA, 17 nt, Chlamydia trachomatis
ugcccuuugugcauaaa

SEQ ID NO: 474858 - RNA, 14 nt, Chlamydia trachomatis
ugccgaaacuucuc

SEQ ID NO: 474859 - RNA, 18 nt, Chlamydia trachomatis
ugccgaaacuucucggau

SEQ ID NO: 474860 - RNA, 12 nt, Chlamydia trachomatis
ugccgaauaaug

SEQ ID NO: 474861 - RNA, 16 nt, Chlamydia trachomatis
ugccgaaucaaagacu

SEQ ID NO: 474862 - RNA, 19 nt, Chlamydia trachomatis
ugccuauagagcaaucucu

SEQ ID NO: 474863 - RNA, 20 nt, Chlamydia trachomatis
ugccuauagcaggauuuucu

SEQ ID NO: 474864 - RNA, 16 nt, Chlamydia trachomatis
ugccuaacgauucccc

SEQ ID NO: 474865 - RNA, 14 nt, Chlamydia trachomatis
ugcgauuacuucag

SEQ ID NO: 474866 - RNA, 22 nt, Chlamydia trachomatis
ugcgauuugauaucccccuucu

SEQ ID NO: 474867 - RNA, 17 nt, Chlamydia trachomatis
ugcgauuuuuuuuauua

SEQ ID NO: 474868 - RNA, 16 nt, Chlamydia trachomatis
ugcgcauacacaucaa

SEQ ID NO: 474869 - RNA, 23 nt, Chlamydia trachomatis
ugcgcauacacaucaaaaugaua

SEQ ID NO: 474870 - RNA, 13 nt, Chlamydia trachomatis
aaauggugaaacu

SEQ ID NO: 474871 - RNA, 15 nt, Chlamydia trachomatis
aaauggugaaacuuu

SEQ ID NO: 474872 - RNA, 19 nt, Chlamydia trachomatis
ugcgcggaaggaaaaagaa

SEQ ID NO: 474873 - RNA, 18 nt, Chlamydia trachomatis
ugcgcuccacuucuuuuc

SEQ ID NO: 474874 - RNA, 14 nt, Chlamydia trachomatis
ugcguauuugaaau

SEQ ID NO: 474875 - RNA, 18 nt, Chlamydia trachomatis
ugcguauuugaaaucaaa

SEQ ID NO: 474876 - RNA, 21 nt, Chlamydia trachomatis
ugcguucugcaaucucuucac

SEQ ID NO: 474877 - RNA, 20 nt, Chlamydia trachomatis
uggcaaagagcuucuagaaa

SEQ ID NO: 474878 - RNA, 22 nt, Chlamydia trachomatis
uggcacggagaucauagacugu

SEQ ID NO: 474879 - RNA, 14 nt, Chlamydia trachomatis
uggccaaaaaauca

SEQ ID NO: 474880 - RNA, 14 nt, Chlamydia trachomatis
uggcggagaagcug

SEQ ID NO: 474881 - RNA, 23 nt, Chlamydia trachomatis
uggcuucgggacgcccuacagga

SEQ ID NO: 474882 - RNA, 15 nt, Chlamydia trachomatis
ugggaaaaaauuaac

SEQ ID NO: 474883 - RNA, 14 nt, Chlamydia trachomatis
ugggauaagaaauc

SEQ ID NO: 474884 - RNA, 18 nt, Chlamydia trachomatis
ugggauagauagcuccaa

SEQ ID NO: 474885 - RNA, 12 nt, Chlamydia trachomatis
ugggcagcaaga

SEQ ID NO: 474886 - RNA, 22 nt, Chlamydia trachomatis
uggggaucgaucccuuuuucag

SEQ ID NO: 474887 - RNA, 20 nt, Chlamydia trachomatis
uggggggauugggggcggca

SEQ ID NO: 474888 - RNA, 15 nt, Chlamydia trachomatis
ugguaacaccaaaaa

SEQ ID NO: 474889 - RNA, 19 nt, Chlamydia trachomatis
ugguaagggguuuucuugg

SEQ ID NO: 474890 - RNA, 13 nt, Chlamydia trachomatis
ugguaguuucuuc

SEQ ID NO: 474891 - RNA, 16 nt, Chlamydia trachomatis
ugguauagaagaccuu

SEQ ID NO: 474892 - RNA, 13 nt, Chlamydia trachomatis
ugguauucuaaau

SEQ ID NO: 474893 - RNA, 18 nt, Chlamydia trachomatis
ugguauucugcagaaaaa

SEQ ID NO: 474894 - RNA, 18 nt, Chlamydia trachomatis
ugguauuccguacucuga

SEQ ID NO: 474895 - RNA, 17 nt, Chlamydia trachomatis
ugguagcagcuagaaca

SEQ ID NO: 474896 - RNA, 18 nt, Chlamydia trachomatis
ugguagagcaacgcauuc

SEQ ID NO: 474897 - RNA, 14 nt, Chlamydia trachomatis
ugguacuucauuuu

SEQ ID NO: 474898 - RNA, 20 nt, Chlamydia trachomatis
ugguacuucauuuuugcuaa

SEQ ID NO: 474899 - RNA, 15 nt, Chlamydia trachomatis
ugguaccuucucaaa

SEQ ID NO: 474900 - RNA, 21 nt, Chlamydia trachomatis
uggucaaugcugcuguuuauu

SEQ ID NO: 474901 - RNA, 21 nt, Chlamydia trachomatis
uggucacaagaacaucuccaa

SEQ ID NO: 474902 - RNA, 17 nt, Chlamydia trachomatis
ugguccaugauuucuuu

SEQ ID NO: 474903 - RNA, 11 nt, Chlamydia trachomatis
uggucuuuauu

SEQ ID NO: 474904 - RNA, 21 nt, Chlamydia trachomatis
uggucgggaaacauuccaaau

SEQ ID NO: 474905 - RNA, 19 nt, Chlamydia trachomatis
ugguuuucuuguucuuuua

SEQ ID NO: 474906 - RNA, 22 nt, Chlamydia trachomatis
ugguuuuuuuuguuauccaaaa

SEQ ID NO: 474907 - RNA, 20 nt, Chlamydia trachomatis
uguaaaaugagaaauaaaaa

SEQ ID NO: 474908 - RNA, 13 nt, Chlamydia trachomatis
uguaaacaauauu

SEQ ID NO: 474909 - RNA, 23 nt, Chlamydia trachomatis
uguaaauuuucaauagcaaugaa

SEQ ID NO: 474910 - RNA, 18 nt, Chlamydia trachomatis
uguacacgcugaguuucc

SEQ ID NO: 474911 - RNA, 23 nt, Chlamydia trachomatis
uguacaccaccgcaugaaaguag

SEQ ID NO: 474912 - RNA, 15 nt, Chlamydia trachomatis
uguacacgauguucc

SEQ ID NO: 474913 - RNA, 21 nt, Chlamydia trachomatis
uguacuuuugguucugccagu

SEQ ID NO: 474914 - RNA, 23 nt, Chlamydia trachomatis
uguagaaugugugguuguagagg

SEQ ID NO: 474915 - RNA, 17 nt, Chlamydia trachomatis
uguagaaagacuuacca

SEQ ID NO: 474916 - RNA, 17 nt, Chlamydia trachomatis
uguaacgaaguuagcau

SEQ ID NO: 474917 - RNA, 19 nt, Chlamydia trachomatis
uguaacgcagcucaccagc

SEQ ID NO: 474918 - RNA, 13 nt, Chlamydia trachomatis
uguaacuaagcuu

SEQ ID NO: 474919 - RNA, 15 nt, Chlamydia trachomatis
uguaacuaagcuucu

SEQ ID NO: 474920 - RNA, 23 nt, Chlamydia trachomatis
uguaacuaagcuucucaacacug

SEQ ID NO: 474921 - RNA, 14 nt, Chlamydia trachomatis
uguaauaucaaaga

SEQ ID NO: 474922 - RNA, 20 nt, Chlamydia trachomatis
uguaaugcaggcgagucuuu

SEQ ID NO: 474923 - RNA, 19 nt, Chlamydia trachomatis
uguaggagagaaucuuuua

SEQ ID NO: 474924 - RNA, 19 nt, Chlamydia trachomatis
uguaggauucagagaggug

SEQ ID NO: 474925 - RNA, 22 nt, Chlamydia trachomatis
uguaggaaaauacacagcauca

SEQ ID NO: 474926 - RNA, 20 nt, Chlamydia trachomatis
uguagcugucccccagauaa

SEQ ID NO: 474927 - RNA, 22 nt, Chlamydia trachomatis
uguagcugucccccagauaacu

SEQ ID NO: 474928 - RNA, 15 nt, Chlamydia trachomatis
uguagagccaugauc

SEQ ID NO: 474929 - RNA, 13 nt, Chlamydia trachomatis
uguagguuuuaaa

SEQ ID NO: 474930 - RNA, 16 nt, Chlamydia trachomatis
uguauagauacuaaca

SEQ ID NO: 474931 - RNA, 15 nt, Chlamydia trachomatis
uguaucaaaaucaau

SEQ ID NO: 474932 - RNA, 23 nt, Chlamydia trachomatis
uguaguucuaacaucaacugauu

SEQ ID NO: 474933 - RNA, 18 nt, Chlamydia trachomatis
uguauaacaauuuuaaaa

SEQ ID NO: 474934 - RNA, 14 nt, Chlamydia trachomatis
ugucauaagcucua

SEQ ID NO: 474935 - RNA, 14 nt, Chlamydia trachomatis
ugucauagaucggu

SEQ ID NO: 474936 - RNA, 21 nt, Chlamydia trachomatis
ugucagucuucuuuucugaga

SEQ ID NO: 474937 - RNA, 20 nt, Chlamydia trachomatis
ugucagaccuacaaagauaa

SEQ ID NO: 474938 - RNA, 19 nt, Chlamydia trachomatis
ugucagaagaggcaaaaau

SEQ ID NO: 474939 - RNA, 14 nt, Chlamydia trachomatis
ugucggugaaagcu

SEQ ID NO: 474940 - RNA, 18 nt, Chlamydia trachomatis
ugucuauaggaauagccu

SEQ ID NO: 474941 - RNA, 14 nt, Chlamydia trachomatis
ugucuaagauuuuc

SEQ ID NO: 474942 - RNA, 22 nt, Chlamydia trachomatis
ugucuaagauuuucaucuucca

SEQ ID NO: 474943 - RNA, 22 nt, Chlamydia trachomatis
ugugcacugguauucugcagaa

SEQ ID NO: 474944 - RNA, 16 nt, Chlamydia trachomatis
ugugcagaucccggcu

SEQ ID NO: 474945 - RNA, 16 nt, Chlamydia trachomatis
ugugagucuaucuuca

SEQ ID NO: 474946 - RNA, 21 nt, Chlamydia trachomatis
ugugagucuaucuucagguuu

SEQ ID NO: 474947 - RNA, 17 nt, Chlamydia trachomatis
ugugaguuauauuuagg

SEQ ID NO: 474948 - RNA, 18 nt, Chlamydia trachomatis
ugugaguuauauuuagga

SEQ ID NO: 474949 - RNA, 14 nt, Chlamydia trachomatis
ugugcauaaaagcc

SEQ ID NO: 474950 - RNA, 22 nt, Chlamydia trachomatis
ugugcauuuguggacacuuuca

SEQ ID NO: 474951 - RNA, 15 nt, Chlamydia trachomatis
ugucuguugaaagcu

SEQ ID NO: 474952 - RNA, 11 nt, Chlamydia trachomatis
ugugagaguuu

SEQ ID NO: 474953 - RNA, 14 nt, Chlamydia trachomatis
ugugaguccacaug

SEQ ID NO: 474954 - RNA, 20 nt, Chlamydia trachomatis
ugugucucgguuuucuuuag

SEQ ID NO: 474955 - RNA, 17 nt, Chlamydia trachomatis
uguuaaugacaaacuuu

SEQ ID NO: 474956 - RNA, 22 nt, Chlamydia trachomatis
uguuacagucuguguuugcaca

SEQ ID NO: 474957 - RNA, 18 nt, Chlamydia trachomatis
uguuaccugggaaaacuu

SEQ ID NO: 474958 - RNA, 19 nt, Chlamydia trachomatis
uguuaccugggaaaacuuu

SEQ ID NO: 474959 - RNA, 21 nt, Chlamydia trachomatis
ugugcuaaaucuccaaaauuc

SEQ ID NO: 474960 - RNA, 21 nt, Chlamydia trachomatis
ugugggugaugccuauauggu

SEQ ID NO: 474961 - RNA, 17 nt, Chlamydia trachomatis
uguggguuuuuuuauug

SEQ ID NO: 474962 - RNA, 14 nt, Chlamydia trachomatis
ugugggcuuuaauc

SEQ ID NO: 474963 - RNA, 19 nt, Chlamydia trachomatis
uguguacaaggcaggaaaa

SEQ ID NO: 474964 - RNA, 16 nt, Chlamydia trachomatis
uguguagaagaaggaa

SEQ ID NO: 474965 - RNA, 21 nt, Chlamydia trachomatis
uguguaguauuuaacuuuuca

SEQ ID NO: 474966 - RNA, 13 nt, Chlamydia trachomatis
uguguagcuuuuc

SEQ ID NO: 474967 - RNA, 22 nt, Chlamydia trachomatis
uguguauuuauauaggcuucca

SEQ ID NO: 474968 - RNA, 15 nt, Chlamydia trachomatis
uguuccuacuaaaau

SEQ ID NO: 474969 - RNA, 16 nt, Chlamydia trachomatis
uguuccuacuaaaaug

SEQ ID NO: 474970 - RNA, 13 nt, Chlamydia trachomatis
uguuccaucuuuu

SEQ ID NO: 474971 - RNA, 14 nt, Chlamydia trachomatis
uguucccagagaaa

SEQ ID NO: 474972 - RNA, 14 nt, Chlamydia trachomatis
uguuccccauucaa

SEQ ID NO: 474973 - RNA, 16 nt, Chlamydia trachomatis
uguucggauucaucaa

SEQ ID NO: 474974 - RNA, 22 nt, Chlamydia trachomatis
uguuccuuccucgaagcuacug

SEQ ID NO: 474975 - RNA, 17 nt, Chlamydia trachomatis
uguucuacacaucugua

SEQ ID NO: 474976 - RNA, 19 nt, Chlamydia trachomatis
uguucucuaaagauucugu

SEQ ID NO: 474977 - RNA, 14 nt, Chlamydia trachomatis
uguucaauuguugg

SEQ ID NO: 474978 - RNA, 20 nt, Chlamydia trachomatis
uguucacagaaaguccugcu

SEQ ID NO: 474979 - RNA, 14 nt, Chlamydia trachomatis
uguuagugaagagc

SEQ ID NO: 474980 - RNA, 17 nt, Chlamydia trachomatis
uguuagugaagagcaga

SEQ ID NO: 474981 - RNA, 19 nt, Chlamydia trachomatis
uguucuucgaaauauugua

SEQ ID NO: 474982 - RNA, 16 nt, Chlamydia trachomatis
uguucugcgaaagaaa

SEQ ID NO: 474983 - RNA, 16 nt, Chlamydia trachomatis
uguugagaaaaacucu

SEQ ID NO: 474984 - RNA, 20 nt, Chlamydia trachomatis
uguugagcagcaaagaucgu

SEQ ID NO: 474985 - RNA, 15 nt, Chlamydia trachomatis
uguugaggagacuuu

SEQ ID NO: 474986 - RNA, 22 nt, Chlamydia trachomatis
uguugauaucuaggucucccag

SEQ ID NO: 474987 - RNA, 21 nt, Chlamydia trachomatis
uguugcguuuguaagaucugu

SEQ ID NO: 474988 - RNA, 19 nt, Chlamydia trachomatis
uguugcucuauaacauucu

SEQ ID NO: 474989 - RNA, 14 nt, Chlamydia trachomatis
uguuguuaauauca

SEQ ID NO: 474990 - RNA, 17 nt, Chlamydia trachomatis
uguuguugcugagcuuu

SEQ ID NO: 474991 - RNA, 21 nt, Chlamydia trachomatis
uguuuaacccucgacgcuguc

SEQ ID NO: 474992 - RNA, 19 nt, Chlamydia trachomatis
uguuuacugagaauaugug

SEQ ID NO: 474993 - RNA, 14 nt, Chlamydia trachomatis
uguuuagacaauuc

SEQ ID NO: 474994 - RNA, 15 nt, Chlamydia trachomatis
uguugggagagggug

SEQ ID NO: 474995 - RNA, 22 nt, Chlamydia trachomatis
uguuggacaaagguguuuucua

SEQ ID NO: 474996 - RNA, 20 nt, Chlamydia trachomatis
uguuggaguuaauucuuuua

SEQ ID NO: 474997 - RNA, 22 nt, Chlamydia trachomatis
uguuguggguuuggaaauauca

SEQ ID NO: 474998 - RNA, 19 nt, Chlamydia trachomatis
uguuuugcuaugaaaaauc

SEQ ID NO: 474999 - RNA, 13 nt, Chlamydia trachomatis
uguuuguauagaa

SEQ ID NO: 475000 - RNA, 16 nt, Chlamydia trachomatis
uguuuguguuucuaaa

SEQ ID NO: 475001 - RNA, 18 nt, Chlamydia trachomatis
uguuuuauacucuaaaag

SEQ ID NO: 475002 - RNA, 17 nt, Chlamydia trachomatis
uguuucuuaucagcauc

SEQ ID NO: 475003 - RNA, 13 nt, Chlamydia trachomatis
uguuucuugcugg

SEQ ID NO: 475004 - RNA, 17 nt, Chlamydia trachomatis
uguuucuaauggaugau

SEQ ID NO: 475005 - RNA, 12 nt, Chlamydia trachomatis
uguuugcauucu

SEQ ID NO: 475006 - RNA, 16 nt, Chlamydia trachomatis
uguuugcauucuuuua

SEQ ID NO: 475007 - RNA, 18 nt, Chlamydia trachomatis
uguuuggauaagaacuuc

SEQ ID NO: 475008 - RNA, 17 nt, Chlamydia trachomatis
uguuuaucacuaucugc

SEQ ID NO: 475009 - RNA, 20 nt, Chlamydia trachomatis
uguuucccuucuuucuucua

SEQ ID NO: 475010 - RNA, 12 nt, Chlamydia trachomatis
uguuuuuuucaa

SEQ ID NO: 475011 - RNA, 17 nt, Chlamydia trachomatis
uguuuuuuuuuauagga

SEQ ID NO: 475012 - RNA, 17 nt, Chlamydia trachomatis
uuaaaaaacaaaacuac

SEQ ID NO: 475013 - RNA, 16 nt, Chlamydia trachomatis
uuaaaaagaaacaaaa

SEQ ID NO: 475014 - RNA, 20 nt, Chlamydia trachomatis
uuaaaagaccauaguugcag

SEQ ID NO: 475015 - RNA, 17 nt, Chlamydia trachomatis
uuaaaaggguagaaaaa

SEQ ID NO: 475016 - RNA, 22 nt, Chlamydia trachomatis
uuaaaaggguagaaaaagagaa

SEQ ID NO: 475017 - RNA, 21 nt, Chlamydia trachomatis
uuaaaagcacaauaacagcac

SEQ ID NO: 475018 - RNA, 20 nt, Chlamydia trachomatis
uuacaucaggggaauucgcu

SEQ ID NO: 475019 - RNA, 15 nt, Chlamydia trachomatis
uuaccauaucaaaaa

SEQ ID NO: 475020 - RNA, 18 nt, Chlamydia trachomatis
uuaccuguaggaggacaa

SEQ ID NO: 475021 - RNA, 19 nt, Chlamydia trachomatis
uuaccuguaggaggacaag

SEQ ID NO: 475022 - RNA, 15 nt, Chlamydia trachomatis
uuaccucuaacagua

SEQ ID NO: 475023 - RNA, 20 nt, Chlamydia trachomatis
uuaccuuguuagaaaugcaa

SEQ ID NO: 475024 - RNA, 23 nt, Chlamydia trachomatis
uuacgaugaucccuaagauuucc

SEQ ID NO: 475025 - RNA, 15 nt, Chlamydia trachomatis
uuaauuuuuuagaua

SEQ ID NO: 475026 - RNA, 17 nt, Chlamydia trachomatis
uuacaacuaaaggaaac

SEQ ID NO: 475027 - RNA, 19 nt, Chlamydia trachomatis
uuaaucccauaaaagccau

SEQ ID NO: 475028 - RNA, 19 nt, Chlamydia trachomatis
uuagauuuguuuaaaagaa

SEQ ID NO: 475029 - RNA, 23 nt, Chlamydia trachomatis
uuagcaaagacauaaaagcugua

SEQ ID NO: 475030 - RNA, 17 nt, Chlamydia trachomatis
uuagcaaauaauagcuu

SEQ ID NO: 475031 - RNA, 17 nt, Chlamydia trachomatis
uuagauagcuucuuaaa

SEQ ID NO: 475032 - RNA, 21 nt, Chlamydia trachomatis
uuagauagcuucuuaaauaua

SEQ ID NO: 475033 - RNA, 15 nt, Chlamydia trachomatis
uuagaaucugcucac

SEQ ID NO: 475034 - RNA, 13 nt, Chlamydia trachomatis
uuagacaaaaaau

SEQ ID NO: 475035 - RNA, 19 nt, Chlamydia trachomatis
uuagaccaggauuccccgu

SEQ ID NO: 475036 - RNA, 13 nt, Chlamydia trachomatis
uuagauaaaagaa

SEQ ID NO: 475037 - RNA, 15 nt, Chlamydia trachomatis
uuacgcccacguuuc

SEQ ID NO: 475038 - RNA, 20 nt, Chlamydia trachomatis
uuacgcauuugcucuuccaa

SEQ ID NO: 475039 - RNA, 16 nt, Chlamydia trachomatis
uuacgcacaaagauuu

SEQ ID NO: 475040 - RNA, 16 nt, Chlamydia trachomatis
uuacgcacuucugcuc

SEQ ID NO: 475041 - RNA, 21 nt, Chlamydia trachomatis
uuacgcguaaagauuuuccuc

SEQ ID NO: 475042 - RNA, 19 nt, Chlamydia trachomatis
uuacgcgucuaaaacaauu

SEQ ID NO: 475043 - RNA, 14 nt, Chlamydia trachomatis
uuacgcucuuucuu

SEQ ID NO: 475044 - RNA, 22 nt, Chlamydia trachomatis
uuacuaucaggaauaaugauuu

SEQ ID NO: 475045 - RNA, 19 nt, Chlamydia trachomatis
uuacuccuucucugaaaga

SEQ ID NO: 475046 - RNA, 20 nt, Chlamydia trachomatis
uuacuuaaaaaacaaaacua

SEQ ID NO: 475047 - RNA, 21 nt, Chlamydia trachomatis
uuacuuaaaaaacaaaacuac

SEQ ID NO: 475048 - RNA, 15 nt, Chlamydia trachomatis
uuaaagcccaguuaa

SEQ ID NO: 475049 - RNA, 20 nt, Chlamydia trachomatis
uuaaagccacugugaaaugc

SEQ ID NO: 475050 - RNA, 21 nt, Chlamydia trachomatis
uuaaagccacugugaaaugcg

SEQ ID NO: 475051 - RNA, 13 nt, Chlamydia trachomatis
uuaaagcuuuagc

SEQ ID NO: 475052 - RNA, 13 nt, Chlamydia trachomatis
uuaaagcuuuuuc

SEQ ID NO: 475053 - RNA, 14 nt, Chlamydia trachomatis
uuaaagggaaaaaa

SEQ ID NO: 475054 - RNA, 18 nt, Chlamydia trachomatis
uuaaagggaaaaaacuag

SEQ ID NO: 475055 - RNA, 20 nt, Chlamydia trachomatis
uuaaagggggacaaaaauac

SEQ ID NO: 475056 - RNA, 18 nt, Chlamydia trachomatis
uuaaaguaaguaaaagca

SEQ ID NO: 475057 - RNA, 22 nt, Chlamydia trachomatis
uuaaaguauaauccgagcauuu

SEQ ID NO: 475058 - RNA, 21 nt, Chlamydia trachomatis
uuaaauaaguccuuaucuucu

SEQ ID NO: 475059 - RNA, 23 nt, Chlamydia trachomatis
uuaaauaaguccuuaucuucuug

SEQ ID NO: 475060 - RNA, 21 nt, Chlamydia trachomatis
uuaaauauauaccgaggggau

SEQ ID NO: 475061 - RNA, 15 nt, Chlamydia trachomatis
uuaaaugcuucuuaa

SEQ ID NO: 475062 - RNA, 21 nt, Chlamydia trachomatis
uuaaauguugaugguuucuag

SEQ ID NO: 475063 - RNA, 23 nt, Chlamydia trachomatis
uuaacaacaaugucaacauaaua

SEQ ID NO: 475064 - RNA, 17 nt, Chlamydia trachomatis
uuaacaucuuuagaauc

SEQ ID NO: 475065 - RNA, 19 nt, Chlamydia trachomatis
uuaacaugauucaaaauaa

SEQ ID NO: 475066 - RNA, 21 nt, Chlamydia trachomatis
uuaacgauuguuucuguagga

SEQ ID NO: 475067 - RNA, 16 nt, Chlamydia trachomatis
uuaaggccgagaauuu

SEQ ID NO: 475068 - RNA, 22 nt, Chlamydia trachomatis
uuaaggguugcgcuggcuuugu

SEQ ID NO: 475069 - RNA, 21 nt, Chlamydia trachomatis
uuaagguuuguuaaugcugcu

SEQ ID NO: 475070 - RNA, 16 nt, Chlamydia trachomatis
uuaauaaagccauacu

SEQ ID NO: 475071 - RNA, 20 nt, Chlamydia trachomatis
uuaauaccaaggauagggcc

SEQ ID NO: 475072 - RNA, 18 nt, Chlamydia trachomatis
uuaauaccuucuuacaua

SEQ ID NO: 475073 - RNA, 16 nt, Chlamydia trachomatis
uuaauauacucaacac

SEQ ID NO: 475074 - RNA, 15 nt, Chlamydia trachomatis
uuaaucauagaacau

SEQ ID NO: 475075 - RNA, 17 nt, Chlamydia trachomatis
uucaacgggaacaaaac

SEQ ID NO: 475076 - RNA, 20 nt, Chlamydia trachomatis
uucaaaucuucuucuaagcu

SEQ ID NO: 475077 - RNA, 15 nt, Chlamydia trachomatis
uucaacaacuucaau

SEQ ID NO: 475078 - RNA, 15 nt, Chlamydia trachomatis
uucaaagagaucugc

SEQ ID NO: 475079 - RNA, 17 nt, Chlamydia trachomatis
uucaaagagaucugcau

SEQ ID NO: 475080 - RNA, 15 nt, Chlamydia trachomatis
uucaaagcgaucuuu

SEQ ID NO: 475081 - RNA, 23 nt, Chlamydia trachomatis
uuauuuacgagaggguuucuucu

SEQ ID NO: 475082 - RNA, 15 nt, Chlamydia trachomatis
uuaggagagagcccu

SEQ ID NO: 475083 - RNA, 14 nt, Chlamydia trachomatis
uuaggagaaagaau

SEQ ID NO: 475084 - RNA, 17 nt, Chlamydia trachomatis
uuaggcggcauuuuauu

SEQ ID NO: 475085 - RNA, 19 nt, Chlamydia trachomatis
uucacaaagagaaggccuu

SEQ ID NO: 475086 - RNA, 19 nt, Chlamydia trachomatis
uucacaaauuuaucugcua

SEQ ID NO: 475087 - RNA, 21 nt, Chlamydia trachomatis
uucaauguggcugauuaauaa

SEQ ID NO: 475088 - RNA, 15 nt, Chlamydia trachomatis
uucaaggauucauau

SEQ ID NO: 475089 - RNA, 15 nt, Chlamydia trachomatis
uucaaguucuaacuu

SEQ ID NO: 475090 - RNA, 17 nt, Chlamydia trachomatis
uucagaacucaaaauaa

SEQ ID NO: 475091 - RNA, 21 nt, Chlamydia trachomatis
uucagaagaagagcugcuguc

SEQ ID NO: 475092 - RNA, 22 nt, Chlamydia trachomatis
uucagagguagccaaagaauuu

SEQ ID NO: 475093 - RNA, 15 nt, Chlamydia trachomatis
uucagaucccauccu

SEQ ID NO: 475094 - RNA, 15 nt, Chlamydia trachomatis
uucaccagcaaaaga

SEQ ID NO: 475095 - RNA, 15 nt, Chlamydia trachomatis
uucauaaacacagcu

SEQ ID NO: 475096 - RNA, 17 nt, Chlamydia trachomatis
uucauaagccucauccc

SEQ ID NO: 475097 - RNA, 14 nt, Chlamydia trachomatis
uucauaaaaaagac

SEQ ID NO: 475098 - RNA, 18 nt, Chlamydia trachomatis
uucagguugagcaagcuc

SEQ ID NO: 475099 - RNA, 21 nt, Chlamydia trachomatis
uucaucaagguggccauucuu

SEQ ID NO: 475100 - RNA, 13 nt, Chlamydia trachomatis
uucaucacagaua

SEQ ID NO: 475101 - RNA, 16 nt, Chlamydia trachomatis
uucaucagcacccaca

SEQ ID NO: 475102 - RNA, 22 nt, Chlamydia trachomatis
uucauccacuugggcgccauau

SEQ ID NO: 475103 - RNA, 16 nt, Chlamydia trachomatis
uucaucccacaugcua

SEQ ID NO: 475104 - RNA, 19 nt, Chlamydia trachomatis
uucaucaaaauauagacug

SEQ ID NO: 475105 - RNA, 17 nt, Chlamydia trachomatis
uucauauguucuuugaa

SEQ ID NO: 475106 - RNA, 17 nt, Chlamydia trachomatis
uucauauuccaaagaaa

SEQ ID NO: 475107 - RNA, 16 nt, Chlamydia trachomatis
uucauacgagccuguu

SEQ ID NO: 475108 - RNA, 21 nt, Chlamydia trachomatis
uucauacgagccuguuucuua

SEQ ID NO: 475109 - RNA, 13 nt, Chlamydia trachomatis
uucauagaaguca

SEQ ID NO: 475110 - RNA, 19 nt, Chlamydia trachomatis
uucauagcuucuaauuucu

SEQ ID NO: 475111 - RNA, 14 nt, Chlamydia trachomatis
uucauuuuauguaa

SEQ ID NO: 475112 - RNA, 20 nt, Chlamydia trachomatis
uucauuuuauguaaauauuu

SEQ ID NO: 475113 - RNA, 21 nt, Chlamydia trachomatis
uuccaaagcuucuaacgcuuc

SEQ ID NO: 475114 - RNA, 20 nt, Chlamydia trachomatis
uuccaaaggauauacagaac

SEQ ID NO: 475115 - RNA, 16 nt, Chlamydia trachomatis
uuccaacagaccccuu

SEQ ID NO: 475116 - RNA, 22 nt, Chlamydia trachomatis
uuccaaccuaagcgcaagaaac

SEQ ID NO: 475117 - RNA, 17 nt, Chlamydia trachomatis
uuccaacgauaagauga

SEQ ID NO: 475118 - RNA, 16 nt, Chlamydia trachomatis
uuccaagaaucaaaaa

SEQ ID NO: 475119 - RNA, 13 nt, Chlamydia trachomatis
uucauucucagga

SEQ ID NO: 475120 - RNA, 14 nt, Chlamydia trachomatis
uucauuuaauaagu

SEQ ID NO: 475121 - RNA, 22 nt, Chlamydia trachomatis
uucauuuaauaaguuuuucaaa

SEQ ID NO: 475122 - RNA, 17 nt, Chlamydia trachomatis
uucauggcugcaauucu

SEQ ID NO: 475123 - RNA, 20 nt, Chlamydia trachomatis
uucaucuuuacuaggagcaa

SEQ ID NO: 475124 - RNA, 14 nt, Chlamydia trachomatis
uucaugaaaagcuu

SEQ ID NO: 475125 - RNA, 16 nt, Chlamydia trachomatis
uucaugaaacccaucu

SEQ ID NO: 475126 - RNA, 21 nt, Chlamydia trachomatis
uucaugagaccgucaaaaaga

SEQ ID NO: 475127 - RNA, 22 nt, Chlamydia trachomatis
uucaugagaccgucaaaaagau

SEQ ID NO: 475128 - RNA, 18 nt, Chlamydia trachomatis
uuccccauucuucucgaa

SEQ ID NO: 475129 - RNA, 16 nt, Chlamydia trachomatis
uucccgcuauuuuccu

SEQ ID NO: 475130 - RNA, 20 nt, Chlamydia trachomatis
uucccgcuauuuuccucuuc

SEQ ID NO: 475131 - RNA, 15 nt, Chlamydia trachomatis
uucccuguauucuga

SEQ ID NO: 475132 - RNA, 16 nt, Chlamydia trachomatis
uucccuguauucugag

SEQ ID NO: 475133 - RNA, 20 nt, Chlamydia trachomatis
uucccuguauucugagggau

SEQ ID NO: 475134 - RNA, 18 nt, Chlamydia trachomatis
uucccuccuagaaagaac

SEQ ID NO: 475135 - RNA, 15 nt, Chlamydia trachomatis
uucccucuucccgcc

SEQ ID NO: 475136 - RNA, 19 nt, Chlamydia trachomatis
uucccugcaccucuuucag

SEQ ID NO: 475137 - RNA, 14 nt, Chlamydia trachomatis
uucccuucuuucuu

SEQ ID NO: 475138 - RNA, 23 nt, Chlamydia trachomatis
uucccuugguagaggcuauugau

SEQ ID NO: 475139 - RNA, 20 nt, Chlamydia trachomatis
uuccgcacccaaucuucuaa

SEQ ID NO: 475140 - RNA, 14 nt, Chlamydia trachomatis
uuccugaauacuca

SEQ ID NO: 475141 - RNA, 20 nt, Chlamydia trachomatis
uuccugaauacucaaaaauu

SEQ ID NO: 475142 - RNA, 19 nt, Chlamydia trachomatis
uuccucugguacucaucuu

SEQ ID NO: 475143 - RNA, 21 nt, Chlamydia trachomatis
uuccucuucacagagcuucuc

SEQ ID NO: 475144 - RNA, 16 nt, Chlamydia trachomatis
uuccucuucuagaaga

SEQ ID NO: 475145 - RNA, 17 nt, Chlamydia trachomatis
uuccucuucuagaagac

SEQ ID NO: 475146 - RNA, 22 nt, Chlamydia trachomatis
uuccugaaacgaucagcuccug

SEQ ID NO: 475147 - RNA, 23 nt, Chlamydia trachomatis
uuccuuaguuuuaauuccaucuu

SEQ ID NO: 475148 - RNA, 13 nt, Chlamydia trachomatis
uuccguugauagu

SEQ ID NO: 475149 - RNA, 23 nt, Chlamydia trachomatis
uuccuaaacaaaaacucucaaau

SEQ ID NO: 475150 - RNA, 19 nt, Chlamydia trachomatis
uuccgguauauucuucacc

SEQ ID NO: 475151 - RNA, 15 nt, Chlamydia trachomatis
uuccguaacaauauu

SEQ ID NO: 475152 - RNA, 13 nt, Chlamydia trachomatis
uuccguccccuua

SEQ ID NO: 475153 - RNA, 22 nt, Chlamydia trachomatis
uuccuucgguauccugcagcaa

SEQ ID NO: 475154 - RNA, 19 nt, Chlamydia trachomatis
uuccuucagagguagccaa

SEQ ID NO: 475155 - RNA, 14 nt, Chlamydia trachomatis
uucgaauccuucuc

SEQ ID NO: 475156 - RNA, 21 nt, Chlamydia trachomatis
uucgaguaauuccaaauaaua

SEQ ID NO: 475157 - RNA, 15 nt, Chlamydia trachomatis
uucgaggcuucuucu

SEQ ID NO: 475158 - RNA, 20 nt, Chlamydia trachomatis
uucgagaauauuggugauca

SEQ ID NO: 475159 - RNA, 14 nt, Chlamydia trachomatis
uucgauaagaaaaa

SEQ ID NO: 475160 - RNA, 20 nt, Chlamydia trachomatis
uucgauauacgcucuuucag

SEQ ID NO: 475161 - RNA, 15 nt, Chlamydia trachomatis
uucgccacgaggaug

SEQ ID NO: 475162 - RNA, 15 nt, Chlamydia trachomatis
uucggauucaucaaa

SEQ ID NO: 475163 - RNA, 17 nt, Chlamydia trachomatis
uucgggacgcccuacag

SEQ ID NO: 475164 - RNA, 22 nt, Chlamydia trachomatis
uucguugcucccaucaacucuc

SEQ ID NO: 475165 - RNA, 17 nt, Chlamydia trachomatis
uucuccgauaauuuucc

SEQ ID NO: 475166 - RNA, 18 nt, Chlamydia trachomatis
uucuccucccagauuuua

SEQ ID NO: 475167 - RNA, 18 nt, Chlamydia trachomatis
uucucuuuuuaaaaggcu

SEQ ID NO: 475168 - RNA, 17 nt, Chlamydia trachomatis
uucugaacgagaaaaag

SEQ ID NO: 475169 - RNA, 20 nt, Chlamydia trachomatis
uucugaaggugugaaagaaa

SEQ ID NO: 475170 - RNA, 22 nt, Chlamydia trachomatis
uucugaaggugugaaagaaaaa

SEQ ID NO: 475171 - RNA, 16 nt, Chlamydia trachomatis
uucugagaaaucuaaa

SEQ ID NO: 475172 - RNA, 19 nt, Chlamydia trachomatis
uucugagaaaucuaaaaca

SEQ ID NO: 475173 - RNA, 12 nt, Chlamydia trachomatis
uucugagacucc

SEQ ID NO: 475174 - RNA, 20 nt, Chlamydia trachomatis
uucugaaucaacgcuucaua

SEQ ID NO: 475175 - RNA, 19 nt, Chlamydia trachomatis
uucugagcuagaaugugua

SEQ ID NO: 475176 - RNA, 19 nt, Chlamydia trachomatis
uucugagggauaucuggau

SEQ ID NO: 475177 - RNA, 23 nt, Chlamydia trachomatis
uucugaguccucuaaaguauucu

SEQ ID NO: 475178 - RNA, 22 nt, Chlamydia trachomatis
uucugauaaaugucccugaaca

SEQ ID NO: 475179 - RNA, 10 nt, Chlamydia trachomatis
uucugcuaaa

SEQ ID NO: 475180 - RNA, 22 nt, Chlamydia trachomatis
uucugcuaaaggugcgauuacu

SEQ ID NO: 475181 - RNA, 16 nt, Chlamydia trachomatis
uucugcuaaauccauu

SEQ ID NO: 475182 - RNA, 13 nt, Chlamydia trachomatis
uucugcuccaaag

SEQ ID NO: 475183 - RNA, 22 nt, Chlamydia trachomatis
uucugcuccaaagauauagguu

SEQ ID NO: 475184 - RNA, 21 nt, Chlamydia trachomatis
uucuggcgaaucaauuucuag

SEQ ID NO: 475185 - RNA, 23 nt, Chlamydia trachomatis
uucugcuugcgaauaacuaauau

SEQ ID NO: 475186 - RNA, 12 nt, Chlamydia trachomatis
uucugcuuuguc

SEQ ID NO: 475187 - RNA, 14 nt, Chlamydia trachomatis
uucguuucuucccu

SEQ ID NO: 475188 - RNA, 18 nt, Chlamydia trachomatis
uucguuuugaagaagauc

SEQ ID NO: 475189 - RNA, 14 nt, Chlamydia trachomatis
uucuaaaaaacuuu

SEQ ID NO: 475190 - RNA, 14 nt, Chlamydia trachomatis
uucuaaaauuugug

SEQ ID NO: 475191 - RNA, 16 nt, Chlamydia trachomatis
uucuaaacccucugca

SEQ ID NO: 475192 - RNA, 17 nt, Chlamydia trachomatis
uucuaaacccucugcau

SEQ ID NO: 475193 - RNA, 21 nt, Chlamydia trachomatis
uucuacuccugcaacaagaac

SEQ ID NO: 475194 - RNA, 21 nt, Chlamydia trachomatis
uucuacuuuuugggaacccgu

SEQ ID NO: 475195 - RNA, 22 nt, Chlamydia trachomatis
uucuagaagaccaaaaaugaac

SEQ ID NO: 475196 - RNA, 21 nt, Chlamydia trachomatis
uucuagcagccucucuuugcu

SEQ ID NO: 475197 - RNA, 15 nt, Chlamydia trachomatis
uucuagcaaccgauu

SEQ ID NO: 475198 - RNA, 16 nt, Chlamydia trachomatis
uucuauagcuaaagca

SEQ ID NO: 475199 - RNA, 19 nt, Chlamydia trachomatis
uucuauccauuguagaugc

SEQ ID NO: 475200 - RNA, 22 nt, Chlamydia trachomatis
uucucaaaacgcucuccaaaga

SEQ ID NO: 475201 - RNA, 17 nt, Chlamydia trachomatis
uucucaaguugagugca

SEQ ID NO: 475202 - RNA, 23 nt, Chlamydia trachomatis
uucucaaguugagugcagaggau

SEQ ID NO: 475203 - RNA, 23 nt, Chlamydia trachomatis
uucucaugcguuaauuaauaagc

SEQ ID NO: 475204 - RNA, 16 nt, Chlamydia trachomatis
uucuguuauuuguucu

SEQ ID NO: 475205 - RNA, 19 nt, Chlamydia trachomatis
uucugugcaaucagcucuc

SEQ ID NO: 475206 - RNA, 23 nt, Chlamydia trachomatis
uucugguuucuuaaacaaaaaua

SEQ ID NO: 475207 - RNA, 15 nt, Chlamydia trachomatis
uucuguaaggcagga

SEQ ID NO: 475208 - RNA, 20 nt, Chlamydia trachomatis
uucuuaaaagcacaauaaca

SEQ ID NO: 475209 - RNA, 15 nt, Chlamydia trachomatis
uucuuaaacaaaaau

SEQ ID NO: 475210 - RNA, 16 nt, Chlamydia trachomatis
uucuuacuuaaaaaac

SEQ ID NO: 475211 - RNA, 16 nt, Chlamydia trachomatis
uucuuagcccagauuu

SEQ ID NO: 475212 - RNA, 14 nt, Chlamydia trachomatis
uucuuagccuuguu

SEQ ID NO: 475213 - RNA, 13 nt, Chlamydia trachomatis
uucuuaguggcuu

SEQ ID NO: 475214 - RNA, 17 nt, Chlamydia trachomatis
uucuuauacagcaugcc

SEQ ID NO: 475215 - RNA, 19 nt, Chlamydia trachomatis
uucuuccaaauagggucuu

SEQ ID NO: 475216 - RNA, 21 nt, Chlamydia trachomatis
uucuucacccauaaaaaagag

SEQ ID NO: 475217 - RNA, 13 nt, Chlamydia trachomatis
uucuucaagaagg

SEQ ID NO: 475218 - RNA, 22 nt, Chlamydia trachomatis
uucuuccauacccauaauucuu

SEQ ID NO: 475219 - RNA, 23 nt, Chlamydia trachomatis
uucuuccaucacuccaagaagag

SEQ ID NO: 475220 - RNA, 11 nt, Chlamydia trachomatis
uucuucccaac

SEQ ID NO: 475221 - RNA, 19 nt, Chlamydia trachomatis
uucuucccuuuuuucuguu

SEQ ID NO: 475222 - RNA, 23 nt, Chlamydia trachomatis
uucuucgguuugauuuccucuuc

SEQ ID NO: 475223 - RNA, 12 nt, Chlamydia trachomatis
uucuucuauaag

SEQ ID NO: 475224 - RNA, 18 nt, Chlamydia trachomatis
uucuucugccuguugcaa

SEQ ID NO: 475225 - RNA, 12 nt, Chlamydia trachomatis
uucuucugcagg

SEQ ID NO: 475226 - RNA, 18 nt, Chlamydia trachomatis
uucuuggcggaauuuguu

SEQ ID NO: 475227 - RNA, 20 nt, Chlamydia trachomatis
uucuugggauaugccucuaa

SEQ ID NO: 475228 - RNA, 18 nt, Chlamydia trachomatis
uucuucuuuggaaaaaaa

SEQ ID NO: 475229 - RNA, 12 nt, Chlamydia trachomatis
uucuugaaagcu

SEQ ID NO: 475230 - RNA, 11 nt, Chlamydia trachomatis
uugaguucauc

SEQ ID NO: 475231 - RNA, 21 nt, Chlamydia trachomatis
uugauaagcugaaaaugcucu

SEQ ID NO: 475232 - RNA, 22 nt, Chlamydia trachomatis
uugaggaggcggcgguggaaga

SEQ ID NO: 475233 - RNA, 13 nt, Chlamydia trachomatis
uugaguaaucagu

SEQ ID NO: 475234 - RNA, 21 nt, Chlamydia trachomatis
uugaucugaaaagagaagaag

SEQ ID NO: 475235 - RNA, 17 nt, Chlamydia trachomatis
uugaucugagaaagcuu

SEQ ID NO: 475236 - RNA, 14 nt, Chlamydia trachomatis
uugaucuuuccagc

SEQ ID NO: 475237 - RNA, 22 nt, Chlamydia trachomatis
uugaucuuuccagcaggccucu

SEQ ID NO: 475238 - RNA, 21 nt, Chlamydia trachomatis
uugauacaccucuugugauga

SEQ ID NO: 475239 - RNA, 17 nt, Chlamydia trachomatis
uugauagcaacaguuuu

SEQ ID NO: 475240 - RNA, 15 nt, Chlamydia trachomatis
uugauuaggaagaag

SEQ ID NO: 475241 - RNA, 19 nt, Chlamydia trachomatis
uugauuaggaagaaguuuu

SEQ ID NO: 475242 - RNA, 13 nt, Chlamydia trachomatis
uugauuauaaaug

SEQ ID NO: 475243 - RNA, 21 nt, Chlamydia trachomatis
uugcagugauguauuccaagc

SEQ ID NO: 475244 - RNA, 17 nt, Chlamydia trachomatis
uugcauaguuccuguau

SEQ ID NO: 475245 - RNA, 21 nt, Chlamydia trachomatis
uugcagaucguugcuuccaaa

SEQ ID NO: 475246 - RNA, 23 nt, Chlamydia trachomatis
uugcagcauccucaaaaaaggca

SEQ ID NO: 475247 - RNA, 21 nt, Chlamydia trachomatis
uugccaucauuaucuucuucu

SEQ ID NO: 475248 - RNA, 20 nt, Chlamydia trachomatis
uugccaucuucaauggcaaa

SEQ ID NO: 475249 - RNA, 22 nt, Chlamydia trachomatis
uugcgaagguucaagaugcgcu

SEQ ID NO: 475250 - RNA, 19 nt, Chlamydia trachomatis
uugccuuuucuauuuagag

SEQ ID NO: 475251 - RNA, 19 nt, Chlamydia trachomatis
uugcgauuuuuuuuauuag

SEQ ID NO: 475252 - RNA, 17 nt, Chlamydia trachomatis
uugcuguugaacggaau

SEQ ID NO: 475253 - RNA, 19 nt, Chlamydia trachomatis
uugcuuaacacuucuuuag

SEQ ID NO: 475254 - RNA, 23 nt, Chlamydia trachomatis
uugcuuaucauguagcccuaccu

SEQ ID NO: 475255 - RNA, 14 nt, Chlamydia trachomatis
uugcuucauaaaaa

SEQ ID NO: 475256 - RNA, 19 nt, Chlamydia trachomatis
uugcuaaggagaauucucc

SEQ ID NO: 475257 - RNA, 20 nt, Chlamydia trachomatis
uugcuacaguaucugcuagu

SEQ ID NO: 475258 - RNA, 17 nt, Chlamydia trachomatis
uugcuacggaaaccaau

SEQ ID NO: 475259 - RNA, 15 nt, Chlamydia trachomatis
uugcuauuuggaucu

SEQ ID NO: 475260 - RNA, 16 nt, Chlamydia trachomatis
uugcuguauagaguaa

SEQ ID NO: 475261 - RNA, 23 nt, Chlamydia trachomatis
uuggauuagaaaaagggagagga

SEQ ID NO: 475262 - RNA, 22 nt, Chlamydia trachomatis
uuggauaucuugcggagccgau

SEQ ID NO: 475263 - RNA, 19 nt, Chlamydia trachomatis
uuggaucagcuccuaucac

SEQ ID NO: 475264 - RNA, 21 nt, Chlamydia trachomatis
uuggaucccaaaccuccuaaa

SEQ ID NO: 475265 - RNA, 18 nt, Chlamydia trachomatis
uuggcacggagaucauag

SEQ ID NO: 475266 - RNA, 24 nt, Chlamydia trachomatis
uuggcaagaagcugcaguuucuga

SEQ ID NO: 475267 - RNA, 17 nt, Chlamydia trachomatis
uuggaccauaaaacuug

SEQ ID NO: 475268 - RNA, 18 nt, Chlamydia trachomatis
uuggacaaaaaucucaaa

SEQ ID NO: 475269 - RNA, 14 nt, Chlamydia trachomatis
uuggacguuggaga

SEQ ID NO: 475270 - RNA, 18 nt, Chlamydia trachomatis
uuggacuaugcucacaaa

SEQ ID NO: 475271 - RNA, 19 nt, Chlamydia trachomatis
uuggagaacgcauaagcac

SEQ ID NO: 475272 - RNA, 16 nt, Chlamydia trachomatis
uuggagagaaugaaga

SEQ ID NO: 475273 - RNA, 17 nt, Chlamydia trachomatis
uuggaaaaaaaaccaaa

SEQ ID NO: 475274 - RNA, 23 nt, Chlamydia trachomatis
uuggaagaggcgcccacagaaca

SEQ ID NO: 475275 - RNA, 19 nt, Chlamydia trachomatis
uuggcaugcccuaaagaga

SEQ ID NO: 475276 - RNA, 14 nt, Chlamydia trachomatis
uuggcguauuucuu

SEQ ID NO: 475277 - RNA, 15 nt, Chlamydia trachomatis
uuggcggauaucuuc

SEQ ID NO: 475278 - RNA, 20 nt, Chlamydia trachomatis
uugggauagaggaaacacug

SEQ ID NO: 475279 - RNA, 16 nt, Chlamydia trachomatis
uugggaucuucgucag

SEQ ID NO: 475280 - RNA, 23 nt, Chlamydia trachomatis
uugggaaaacgauaaaaagcugg

SEQ ID NO: 475281 - RNA, 22 nt, Chlamydia trachomatis
uugguaaaguaguugaauauac

SEQ ID NO: 475282 - RNA, 12 nt, Chlamydia trachomatis
uugguaagauuc

SEQ ID NO: 475283 - RNA, 14 nt, Chlamydia trachomatis
uuggguuaugagcc

SEQ ID NO: 475284 - RNA, 21 nt, Chlamydia trachomatis
uuggucgggaaacauuccaaa

SEQ ID NO: 475285 - RNA, 16 nt, Chlamydia trachomatis
uugguuuggguuuuaa

SEQ ID NO: 475286 - RNA, 14 nt, Chlamydia trachomatis
uuguaaaacaacca

SEQ ID NO: 475287 - RNA, 14 nt, Chlamydia trachomatis
uuguaaagcuuuuc

SEQ ID NO: 475288 - RNA, 18 nt, Chlamydia trachomatis
uuguagagaggcaaacac

SEQ ID NO: 475289 - RNA, 20 nt, Chlamydia trachomatis
uuguagcaaaagauuuugaa

SEQ ID NO: 475290 - RNA, 14 nt, Chlamydia trachomatis
uuguagccuucuau

SEQ ID NO: 475291 - RNA, 19 nt, Chlamydia trachomatis
uugucgaauuuuucugcua

SEQ ID NO: 475292 - RNA, 19 nt, Chlamydia trachomatis
uugucgauaaaguaaagga

SEQ ID NO: 475293 - RNA, 22 nt, Chlamydia trachomatis
uugucaugacucggaauaagag

SEQ ID NO: 475294 - RNA, 20 nt, Chlamydia trachomatis
uugucauugaucacauuuuc

SEQ ID NO: 475295 - RNA, 18 nt, Chlamydia trachomatis
uuguaucaacagaugacu

SEQ ID NO: 475296 - RNA, 15 nt, Chlamydia trachomatis
uuguaucuugugcaa

SEQ ID NO: 475297 - RNA, 23 nt, Chlamydia trachomatis
uugucaaggcuccguucaaagca

SEQ ID NO: 475298 - RNA, 23 nt, Chlamydia trachomatis
uugucacaaauuaccccaaauua

SEQ ID NO: 475299 - RNA, 21 nt, Chlamydia trachomatis
uugucagaagaggcaaaaauc

SEQ ID NO: 475300 - RNA, 12 nt, Chlamydia trachomatis
uugucuuagaag

SEQ ID NO: 475301 - RNA, 17 nt, Chlamydia trachomatis
uugugaagaacugucuu

SEQ ID NO: 475302 - RNA, 15 nt, Chlamydia trachomatis
uugugaggagcucuc

SEQ ID NO: 475303 - RNA, 13 nt, Chlamydia trachomatis
uugugaugaagac

SEQ ID NO: 475304 - RNA, 18 nt, Chlamydia trachomatis
uugugcaaacaaaagaga

SEQ ID NO: 475305 - RNA, 15 nt, Chlamydia trachomatis
uugugcaaccucuau

SEQ ID NO: 475306 - RNA, 13 nt, Chlamydia trachomatis
uuguggaauugua

SEQ ID NO: 475307 - RNA, 15 nt, Chlamydia trachomatis
uuguugacacugcuu

SEQ ID NO: 475308 - RNA, 13 nt, Chlamydia trachomatis
uuguugagcagca

SEQ ID NO: 475309 - RNA, 11 nt, Chlamydia trachomatis
uuguucugggc

SEQ ID NO: 475310 - RNA, 21 nt, Chlamydia trachomatis
uugugugaacgugagguacag

SEQ ID NO: 475311 - RNA, 22 nt, Chlamydia trachomatis
uuguguagcuuuucggugagga

SEQ ID NO: 475312 - RNA, 15 nt, Chlamydia trachomatis
uuguguuucuaaaau

SEQ ID NO: 475313 - RNA, 14 nt, Chlamydia trachomatis
uuuauggaaaagau

SEQ ID NO: 475314 - RNA, 21 nt, Chlamydia trachomatis
uuuauggaaaagaucuuguuu

SEQ ID NO: 475315 - RNA, 14 nt, Chlamydia trachomatis
uuuaugaacaacau

SEQ ID NO: 475316 - RNA, 15 nt, Chlamydia trachomatis
uuuaugaagcaaaua

SEQ ID NO: 475317 - RNA, 24 nt, Chlamydia trachomatis
uuuaucgcuuuuccaauauuauuu

SEQ ID NO: 475318 - RNA, 17 nt, Chlamydia trachomatis
uuuaucugcuaaagaaa

SEQ ID NO: 475319 - RNA, 14 nt, Chlamydia trachomatis
uuuaucuucaaaga

SEQ ID NO: 475320 - RNA, 16 nt, Chlamydia trachomatis
uuuauguaaauauuuu

SEQ ID NO: 475321 - RNA, 19 nt, Chlamydia trachomatis
uuuagagaguucguuagga

SEQ ID NO: 475322 - RNA, 18 nt, Chlamydia trachomatis
uuuagauaaaagaagcag

SEQ ID NO: 475323 - RNA, 18 nt, Chlamydia trachomatis
uuuauccaaaaaagugua

SEQ ID NO: 475324 - RNA, 21 nt, Chlamydia trachomatis
uuuaccucuccauuuuccugu

SEQ ID NO: 475325 - RNA, 23 nt, Chlamydia trachomatis
uuuacaucccuugaacuagaaau

SEQ ID NO: 475326 - RNA, 20 nt, Chlamydia trachomatis
uuuacgucaauuuuuccauu

SEQ ID NO: 475327 - RNA, 17 nt, Chlamydia trachomatis
uuuacuucaaggucuuu

SEQ ID NO: 475328 - RNA, 15 nt, Chlamydia trachomatis
uuuagaagacaaaga

SEQ ID NO: 475329 - RNA, 17 nt, Chlamydia trachomatis
uuuagaaggaaagcuau

SEQ ID NO: 475330 - RNA, 19 nt, Chlamydia trachomatis
aacaagccuuuaagguacu

SEQ ID NO: 475331 - RNA, 12 nt, Chlamydia trachomatis
aacaagaauaau

SEQ ID NO: 475332 - RNA, 14 nt, Chlamydia trachomatis
aacaagcaaaacau

SEQ ID NO: 475333 - RNA, 15 nt, Chlamydia trachomatis
aacaagcaaaacaua

SEQ ID NO: 475334 - RNA, 14 nt, Chlamydia trachomatis
aacaaggcuuuucc

SEQ ID NO: 475335 - RNA, 16 nt, Chlamydia trachomatis
aacaagggaaugaaau

SEQ ID NO: 475336 - RNA, 17 nt, Chlamydia trachomatis
aacaagguucuucaaca

SEQ ID NO: 475337 - RNA, 19 nt, Chlamydia trachomatis
aacaagguucuucaacaac

SEQ ID NO: 475338 - RNA, 22 nt, Chlamydia trachomatis
aacaagguucuucaacaacuuc

SEQ ID NO: 475339 - RNA, 20 nt, Chlamydia trachomatis
aacaacucuccuaauucaac

SEQ ID NO: 475340 - RNA, 23 nt, Chlamydia trachomatis
aacaacuucaauagcaggaacuu

SEQ ID NO: 475341 - RNA, 15 nt, Chlamydia trachomatis
aacaacuucucuugu

SEQ ID NO: 475342 - RNA, 21 nt, Chlamydia trachomatis
aacaacuugaucuacagcaaa

SEQ ID NO: 475343 - RNA, 15 nt, Chlamydia trachomatis
aacaacugcugauaa

SEQ ID NO: 475344 - RNA, 21 nt, Chlamydia trachomatis
aacaacugcugauaaauuucu

SEQ ID NO: 475345 - RNA, 19 nt, Chlamydia trachomatis
aacaagaacgcuuuccgaa

SEQ ID NO: 475346 - RNA, 16 nt, Chlamydia trachomatis
aacaacauaaaauccu

SEQ ID NO: 475347 - RNA, 15 nt, Chlamydia trachomatis
aacaaccuucugacu

SEQ ID NO: 475348 - RNA, 12 nt, Chlamydia trachomatis
aacaaaagagau

SEQ ID NO: 475349 - RNA, 12 nt, Chlamydia trachomatis
aacaaaaccaaa

SEQ ID NO: 475350 - RNA, 16 nt, Chlamydia trachomatis
aacaaaacuugucuaa

SEQ ID NO: 475351 - RNA, 19 nt, Chlamydia trachomatis
aaauuuuucagaaaaagua

SEQ ID NO: 475352 - RNA, 13 nt, Chlamydia trachomatis
aacaaaaagcgcu

SEQ ID NO: 475353 - RNA, 12 nt, Chlamydia trachomatis
aacaaaaauaac

SEQ ID NO: 475354 - RNA, 15 nt, Chlamydia trachomatis
aacaaacgcagauaa

SEQ ID NO: 475355 - RNA, 15 nt, Chlamydia trachomatis
aacaaauaccaaaau

SEQ ID NO: 475356 - RNA, 19 nt, Chlamydia trachomatis
aacaaauuccucuguagau

SEQ ID NO: 475357 - RNA, 14 nt, Chlamydia trachomatis
aacaacaaagaacu

SEQ ID NO: 475358 - RNA, 17 nt, Chlamydia trachomatis
aacaacaaucaaacguc

SEQ ID NO: 475359 - RNA, 17 nt, Chlamydia trachomatis
aaauugauagugaaaua

SEQ ID NO: 475360 - RNA, 12 nt, Chlamydia trachomatis
uuucaaaaagag

SEQ ID NO: 475361 - RNA, 20 nt, Chlamydia trachomatis
uuucaaaaauagcaauaauu

SEQ ID NO: 475362 - RNA, 21 nt, Chlamydia trachomatis
aaauuuaucugcuaaagaaaa

SEQ ID NO: 475363 - RNA, 18 nt, Chlamydia trachomatis
aaauuuaucugcuuccgu

SEQ ID NO: 475364 - RNA, 15 nt, Chlamydia trachomatis
aaauuucaucccaca

SEQ ID NO: 475365 - RNA, 22 nt, Chlamydia trachomatis
aaauuucauacgcacagcauga

SEQ ID NO: 475366 - RNA, 11 nt, Chlamydia trachomatis
aaauuucccuc

SEQ ID NO: 475367 - RNA, 16 nt, Chlamydia trachomatis
aaauuucccucuuccc

SEQ ID NO: 475368 - RNA, 11 nt, Chlamydia trachomatis
aaauuucucua

SEQ ID NO: 475369 - RNA, 12 nt, Chlamydia trachomatis
aaauuucucuag

SEQ ID NO: 475370 - RNA, 16 nt, Chlamydia trachomatis
aaauuuuaaaucccag

SEQ ID NO: 475371 - RNA, 21 nt, Chlamydia trachomatis
aaauuuuacguaauucaugau

SEQ ID NO: 475372 - RNA, 12 nt, Chlamydia trachomatis
aaauuuucacac

SEQ ID NO: 475373 - RNA, 18 nt, Chlamydia trachomatis
aaauuuucacacauccuu

SEQ ID NO: 475374 - RNA, 21 nt, Chlamydia trachomatis
aacacaaguaugagaggaaga

SEQ ID NO: 475375 - RNA, 12 nt, Chlamydia trachomatis
aacacaagcaga

SEQ ID NO: 475376 - RNA, 18 nt, Chlamydia trachomatis
aacacaagcagacaagca

SEQ ID NO: 475377 - RNA, 12 nt, Chlamydia trachomatis
aacacaauuuuu

SEQ ID NO: 475378 - RNA, 16 nt, Chlamydia trachomatis
aacaauuuccuuagaa

SEQ ID NO: 475379 - RNA, 21 nt, Chlamydia trachomatis
aacaauaauucaggcucuuuc

SEQ ID NO: 475380 - RNA, 13 nt, Chlamydia trachomatis
aacaaucaaagca

SEQ ID NO: 475381 - RNA, 20 nt, Chlamydia trachomatis
aacaaugauauucuaauccu

SEQ ID NO: 475382 - RNA, 18 nt, Chlamydia trachomatis
aacaaugcugauaaaaau

SEQ ID NO: 475383 - RNA, 12 nt, Chlamydia trachomatis
aacaccaaaaaa

SEQ ID NO: 475384 - RNA, 14 nt, Chlamydia trachomatis
aacacauaucucca

SEQ ID NO: 475385 - RNA, 21 nt, Chlamydia trachomatis
aacacauaucuccaaaaauau

SEQ ID NO: 475386 - RNA, 15 nt, Chlamydia trachomatis
aacaccucuccuuga

SEQ ID NO: 475387 - RNA, 21 nt, Chlamydia trachomatis
aacaccucuccuugaacaauu

SEQ ID NO: 475388 - RNA, 12 nt, Chlamydia trachomatis
aacaccugcaua

SEQ ID NO: 475389 - RNA, 22 nt, Chlamydia trachomatis
aacacgaaugccuguggcaacu

SEQ ID NO: 475390 - RNA, 18 nt, Chlamydia trachomatis
aacacccucuuccuuccc

SEQ ID NO: 475391 - RNA, 20 nt, Chlamydia trachomatis
aacaccguauguaagccuaa

SEQ ID NO: 475392 - RNA, 22 nt, Chlamydia trachomatis
aacacgcucauagauuucagca

SEQ ID NO: 475393 - RNA, 16 nt, Chlamydia trachomatis
aacacgucuuaaaggu

SEQ ID NO: 475394 - RNA, 20 nt, Chlamydia trachomatis
aacacuacgcuacagaguua

SEQ ID NO: 475395 - RNA, 16 nt, Chlamydia trachomatis
aacacugaaaaucgcu

SEQ ID NO: 475396 - RNA, 22 nt, Chlamydia trachomatis
aacacugacuauuccugaagga

SEQ ID NO: 475397 - RNA, 19 nt, Chlamydia trachomatis
aacagacuaaguuguaaaa

SEQ ID NO: 475398 - RNA, 13 nt, Chlamydia trachomatis
aacagagcuucau

SEQ ID NO: 475399 - RNA, 14 nt, Chlamydia trachomatis
aacagauauaacaa

SEQ ID NO: 475400 - RNA, 18 nt, Chlamydia trachomatis
aacagauugagaauaaau

SEQ ID NO: 475401 - RNA, 16 nt, Chlamydia trachomatis
aacagcagaacucaac

SEQ ID NO: 475402 - RNA, 21 nt, Chlamydia trachomatis
aacagcuucuucuucucuuuc

SEQ ID NO: 475403 - RNA, 22 nt, Chlamydia trachomatis
aacagcuucuucuucucuuucg

SEQ ID NO: 475404 - RNA, 11 nt, Chlamydia trachomatis
aacagcucuag

SEQ ID NO: 475405 - RNA, 19 nt, Chlamydia trachomatis
aacauaugaauccuugaac

SEQ ID NO: 475406 - RNA, 18 nt, Chlamydia trachomatis
aacauauuaggagcaaga

SEQ ID NO: 475407 - RNA, 13 nt, Chlamydia trachomatis
aacauaauaaaua

SEQ ID NO: 475408 - RNA, 18 nt, Chlamydia trachomatis
aacauacaauuuagacuc

SEQ ID NO: 475409 - RNA, 14 nt, Chlamydia trachomatis
aacauacacagaua

SEQ ID NO: 475410 - RNA, 18 nt, Chlamydia trachomatis
aacauacacagauacuga

SEQ ID NO: 475411 - RNA, 17 nt, Chlamydia trachomatis
aacauacccuaaauucc

SEQ ID NO: 475412 - RNA, 16 nt, Chlamydia trachomatis
aacauaccguagaucc

SEQ ID NO: 475413 - RNA, 20 nt, Chlamydia trachomatis
aacauaccguagauccuuuc

SEQ ID NO: 475414 - RNA, 12 nt, Chlamydia trachomatis
aacaucaaaauu

SEQ ID NO: 475415 - RNA, 14 nt, Chlamydia trachomatis
aacaucaaaauucu

SEQ ID NO: 475416 - RNA, 16 nt, Chlamydia trachomatis
aacaucaaaauucuau

SEQ ID NO: 475417 - RNA, 13 nt, Chlamydia trachomatis
aacaucaaagauc

SEQ ID NO: 475418 - RNA, 13 nt, Chlamydia trachomatis
aacaucaacugau

SEQ ID NO: 475419 - RNA, 16 nt, Chlamydia trachomatis
aacaggggaccaaaaa

SEQ ID NO: 475420 - RNA, 18 nt, Chlamydia trachomatis
aacaggggaccaaaaaag

SEQ ID NO: 475421 - RNA, 23 nt, Chlamydia trachomatis
aacaggggaccaaaaaagcgucu

SEQ ID NO: 475422 - RNA, 20 nt, Chlamydia trachomatis
aacagguuucuuacaagggc

SEQ ID NO: 475423 - RNA, 17 nt, Chlamydia trachomatis
aacaggaccagagauca

SEQ ID NO: 475424 - RNA, 14 nt, Chlamydia trachomatis
aacaggagaugaau

SEQ ID NO: 475425 - RNA, 16 nt, Chlamydia trachomatis
aacagucguaauugcu

SEQ ID NO: 475426 - RNA, 21 nt, Chlamydia trachomatis
aacauaaaauccuucugccuc

SEQ ID NO: 475427 - RNA, 13 nt, Chlamydia trachomatis
aacauaacacaua

SEQ ID NO: 475428 - RNA, 18 nt, Chlamydia trachomatis
aacaucgagaaaaugaug

SEQ ID NO: 475429 - RNA, 19 nt, Chlamydia trachomatis
aacaucgagaaaaugauga

SEQ ID NO: 475430 - RNA, 18 nt, Chlamydia trachomatis
aacaugaaccgcagcaac

SEQ ID NO: 475431 - RNA, 18 nt, Chlamydia trachomatis
aacaucuucccaauauau

SEQ ID NO: 475432 - RNA, 24 nt, Chlamydia trachomatis
aacaugaguugcucaauuguugua

SEQ ID NO: 475433 - RNA, 16 nt, Chlamydia trachomatis
aacaugauuaauucua

SEQ ID NO: 475434 - RNA, 20 nt, Chlamydia trachomatis
aacaugauucaaaauaaugu

SEQ ID NO: 475435 - RNA, 17 nt, Chlamydia trachomatis
aaccaagggaauaaaaa

SEQ ID NO: 475436 - RNA, 22 nt, Chlamydia trachomatis
aaccaaggacggauguugauau

SEQ ID NO: 475437 - RNA, 21 nt, Chlamydia trachomatis
aaccaacgagugccgaauaau

SEQ ID NO: 475438 - RNA, 13 nt, Chlamydia trachomatis
aaccaacucucug

SEQ ID NO: 475439 - RNA, 20 nt, Chlamydia trachomatis
aaccaauuguugagcagcaa

SEQ ID NO: 475440 - RNA, 12 nt, Chlamydia trachomatis
aaccaaaccaga

SEQ ID NO: 475441 - RNA, 18 nt, Chlamydia trachomatis
aaccaaaggcaacaaagg

SEQ ID NO: 475442 - RNA, 21 nt, Chlamydia trachomatis
aacauuauuccgcuucuauuu

SEQ ID NO: 475443 - RNA, 14 nt, Chlamydia trachomatis
aacauuucugcaac

SEQ ID NO: 475444 - RNA, 14 nt, Chlamydia trachomatis
aacauuuuauuaaa

SEQ ID NO: 475445 - RNA, 19 nt, Chlamydia trachomatis
aaccacuguauccaaaaca

SEQ ID NO: 475446 - RNA, 21 nt, Chlamydia trachomatis
aaccacacuucucgaaaaaau

SEQ ID NO: 475447 - RNA, 15 nt, Chlamydia trachomatis
aaccagcggcaaaaa

SEQ ID NO: 475448 - RNA, 17 nt, Chlamydia trachomatis
aaccagccuauuagauu

SEQ ID NO: 475449 - RNA, 17 nt, Chlamydia trachomatis
aaccagaauauaagcac

SEQ ID NO: 475450 - RNA, 19 nt, Chlamydia trachomatis
aaccagaauauaagcaccc

SEQ ID NO: 475451 - RNA, 20 nt, Chlamydia trachomatis
aaccagaauccuuuucagaa

SEQ ID NO: 475452 - RNA, 18 nt, Chlamydia trachomatis
aaccaggucacauuuucc

SEQ ID NO: 475453 - RNA, 20 nt, Chlamydia trachomatis
aaccaggucacauuuuccgu

SEQ ID NO: 475454 - RNA, 21 nt, Chlamydia trachomatis
aaccaguucugguuuuuguaa

SEQ ID NO: 475455 - RNA, 23 nt, Chlamydia trachomatis
aacccaacgcaucuccaaagaca

SEQ ID NO: 475456 - RNA, 19 nt, Chlamydia trachomatis
aacccaagcguauuugcau

SEQ ID NO: 475457 - RNA, 17 nt, Chlamydia trachomatis
aacccaaucgaguagca

SEQ ID NO: 475458 - RNA, 18 nt, Chlamydia trachomatis
aacccuggaugcacaucc

SEQ ID NO: 475459 - RNA, 18 nt, Chlamydia trachomatis
aacccuucaggaaagccu

SEQ ID NO: 475460 - RNA, 15 nt, Chlamydia trachomatis
aacccuaaaucuccu

SEQ ID NO: 475461 - RNA, 21 nt, Chlamydia trachomatis
aacccuaauaaaggccaggcu

SEQ ID NO: 475462 - RNA, 17 nt, Chlamydia trachomatis
aacccuagucgagaaga

SEQ ID NO: 475463 - RNA, 19 nt, Chlamydia trachomatis
aacccucugcauagcuaua

SEQ ID NO: 475464 - RNA, 23 nt, Chlamydia trachomatis
aacccucugcauagcuauaaaau

SEQ ID NO: 475465 - RNA, 22 nt, Chlamydia trachomatis
aaccggagauacggcuaacucc

SEQ ID NO: 475466 - RNA, 19 nt, Chlamydia trachomatis
aaccgcaagucucugccac

SEQ ID NO: 475467 - RNA, 21 nt, Chlamydia trachomatis
aaccgcaagucucugccaccu

SEQ ID NO: 475468 - RNA, 15 nt, Chlamydia trachomatis
aaccgcgacagccac

SEQ ID NO: 475469 - RNA, 14 nt, Chlamydia trachomatis
aaccucuauagcca

SEQ ID NO: 475470 - RNA, 12 nt, Chlamydia trachomatis
aaccucugcaag

SEQ ID NO: 475471 - RNA, 23 nt, Chlamydia trachomatis
aaccucugcaagaaaauaaguua

SEQ ID NO: 475472 - RNA, 15 nt, Chlamydia trachomatis
aaccuccauaagaaa

SEQ ID NO: 475473 - RNA, 21 nt, Chlamydia trachomatis
aaccguucuugacaaaacccu

SEQ ID NO: 475474 - RNA, 22 nt, Chlamydia trachomatis
aaccuaagggccgaacuaauau

SEQ ID NO: 475475 - RNA, 21 nt, Chlamydia trachomatis
aaccuaaguagcaaauuaaca

SEQ ID NO: 475476 - RNA, 18 nt, Chlamydia trachomatis
aaccuacaugccgcgaag

SEQ ID NO: 475477 - RNA, 21 nt, Chlamydia trachomatis
aacgaagcaaaacgcccucca

SEQ ID NO: 475478 - RNA, 24 nt, Chlamydia trachomatis
aacgaagccuguuuugcuaugaaa

SEQ ID NO: 475479 - RNA, 15 nt, Chlamydia trachomatis
aaccuguuucugaau

SEQ ID NO: 475480 - RNA, 22 nt, Chlamydia trachomatis
aaccuguuucugaaucaaacag

SEQ ID NO: 475481 - RNA, 21 nt, Chlamydia trachomatis
aaccuuccacuuuugugaaaa

SEQ ID NO: 475482 - RNA, 19 nt, Chlamydia trachomatis
aaccuugggaaucuucuuc

SEQ ID NO: 475483 - RNA, 15 nt, Chlamydia trachomatis
aaccuuucaaauacc

SEQ ID NO: 475484 - RNA, 18 nt, Chlamydia trachomatis
aaccuuuccuguauaaga

SEQ ID NO: 475485 - RNA, 15 nt, Chlamydia trachomatis
aaccuuugcauuuaa

SEQ ID NO: 475486 - RNA, 19 nt, Chlamydia trachomatis
aaccuuugcauuuaaauga

SEQ ID NO: 475487 - RNA, 13 nt, Chlamydia trachomatis
aacgagaaaaagg

SEQ ID NO: 475488 - RNA, 21 nt, Chlamydia trachomatis
aacgagaugaccacuacucua

SEQ ID NO: 475489 - RNA, 22 nt, Chlamydia trachomatis
aacgaguguaggguagaacagg

SEQ ID NO: 475490 - RNA, 17 nt, Chlamydia trachomatis
aacgaguugaucuuccu

SEQ ID NO: 475491 - RNA, 19 nt, Chlamydia trachomatis
aacgauagcuaaucuuuuu

SEQ ID NO: 475492 - RNA, 19 nt, Chlamydia trachomatis
aacgauauaaagaagacuu

SEQ ID NO: 475493 - RNA, 14 nt, Chlamydia trachomatis
aacgauauccuucu

SEQ ID NO: 475494 - RNA, 16 nt, Chlamydia trachomatis
aacgaucugcgaugcc

SEQ ID NO: 475495 - RNA, 21 nt, Chlamydia trachomatis
aacgaucugcgaugccaaaga

SEQ ID NO: 475496 - RNA, 22 nt, Chlamydia trachomatis
aacgcaauguuuuacaaagugg

SEQ ID NO: 475497 - RNA, 13 nt, Chlamydia trachomatis
aacgauuauguuc

SEQ ID NO: 475498 - RNA, 16 nt, Chlamydia trachomatis
aacgauucaauccaga

SEQ ID NO: 475499 - RNA, 23 nt, Chlamydia trachomatis
aacgauuuugucgauaagaaggu

SEQ ID NO: 475500 - RNA, 20 nt, Chlamydia trachomatis
aacgcaucuccaaagacaca

SEQ ID NO: 475501 - RNA, 15 nt, Chlamydia trachomatis
aacgcauuacauaua

SEQ ID NO: 475502 - RNA, 17 nt, Chlamydia trachomatis
aacgcauuccaaucauu

SEQ ID NO: 475503 - RNA, 16 nt, Chlamydia trachomatis
aacgcauuucuuuguu

SEQ ID NO: 475504 - RNA, 20 nt, Chlamydia trachomatis
aacgccguguucggaaugga

SEQ ID NO: 475505 - RNA, 14 nt, Chlamydia trachomatis
aacggacgacugca

SEQ ID NO: 475506 - RNA, 14 nt, Chlamydia trachomatis
aacggaggauaguu

SEQ ID NO: 475507 - RNA, 14 nt, Chlamydia trachomatis
aacgcuucuuccca

SEQ ID NO: 475508 - RNA, 18 nt, Chlamydia trachomatis
aacggaacucuacaaaau

SEQ ID NO: 475509 - RNA, 14 nt, Chlamydia trachomatis
aacggaauccuaag

SEQ ID NO: 475510 - RNA, 16 nt, Chlamydia trachomatis
aacggcauucccauuu

SEQ ID NO: 475511 - RNA, 14 nt, Chlamydia trachomatis
aacgggaacaaaac

SEQ ID NO: 475512 - RNA, 15 nt, Chlamydia trachomatis
aacgggagcgggaga

SEQ ID NO: 475513 - RNA, 16 nt, Chlamydia trachomatis
aacgguguuagaaaau

SEQ ID NO: 475514 - RNA, 21 nt, Chlamydia trachomatis
aacggugagaaaaagaagaac

SEQ ID NO: 475515 - RNA, 14 nt, Chlamydia trachomatis
aacguaaaagagua

SEQ ID NO: 475516 - RNA, 18 nt, Chlamydia trachomatis
aacguacuuuaggagaaa

SEQ ID NO: 475517 - RNA, 21 nt, Chlamydia trachomatis
aacuaccaaaccuuaaaagca

SEQ ID NO: 475518 - RNA, 23 nt, Chlamydia trachomatis
aacuacccgauucaaaaaucgcu

SEQ ID NO: 475519 - RNA, 14 nt, Chlamydia trachomatis
aacuacucaacaaa

SEQ ID NO: 475520 - RNA, 16 nt, Chlamydia trachomatis
aacuacucaacaaauu

SEQ ID NO: 475521 - RNA, 16 nt, Chlamydia trachomatis
aacuacucccaaauca

SEQ ID NO: 475522 - RNA, 18 nt, Chlamydia trachomatis
aacuagagaucccgaaua

SEQ ID NO: 475523 - RNA, 17 nt, Chlamydia trachomatis
aacuaggcaaucuccuu

SEQ ID NO: 475524 - RNA, 20 nt, Chlamydia trachomatis
aacuagucuacucauccuaa

SEQ ID NO: 475525 - RNA, 14 nt, Chlamydia trachomatis
aacuaaaggaaaca

SEQ ID NO: 475526 - RNA, 13 nt, Chlamydia trachomatis
aacuaaacuccau

SEQ ID NO: 475527 - RNA, 19 nt, Chlamydia trachomatis
aacuaagcuucucaacacu

SEQ ID NO: 475528 - RNA, 21 nt, Chlamydia trachomatis
aacuaagcuucucaacacuga

SEQ ID NO: 475529 - RNA, 14 nt, Chlamydia trachomatis
aacgucccuguguc

SEQ ID NO: 475530 - RNA, 15 nt, Chlamydia trachomatis
aacguccgcuccuuc

SEQ ID NO: 475531 - RNA, 15 nt, Chlamydia trachomatis
aacgucgaaaagcuu

SEQ ID NO: 475532 - RNA, 16 nt, Chlamydia trachomatis
aacgucgaaaagcuuc

SEQ ID NO: 475533 - RNA, 17 nt, Chlamydia trachomatis
aacgucgaaaagcuucu

SEQ ID NO: 475534 - RNA, 19 nt, Chlamydia trachomatis
aacgucgaaaagcuucugc

SEQ ID NO: 475535 - RNA, 20 nt, Chlamydia trachomatis
aacgucgaaaagcuucugcc

SEQ ID NO: 475536 - RNA, 22 nt, Chlamydia trachomatis
aacgucgugccaccgaagggac

SEQ ID NO: 475537 - RNA, 19 nt, Chlamydia trachomatis
aacgugucgaaaaugguuu

SEQ ID NO: 475538 - RNA, 14 nt, Chlamydia trachomatis
aacguuuaaugaau

SEQ ID NO: 475539 - RNA, 19 nt, Chlamydia trachomatis
aacucuuuauuaaacuccc

SEQ ID NO: 475540 - RNA, 11 nt, Chlamydia trachomatis
aacucuugaaa

SEQ ID NO: 475541 - RNA, 18 nt, Chlamydia trachomatis
aacucuugccaguaaaga

SEQ ID NO: 475542 - RNA, 14 nt, Chlamydia trachomatis
aacucuuaaaaggc

SEQ ID NO: 475543 - RNA, 14 nt, Chlamydia trachomatis
aacucuccuuuaaa

SEQ ID NO: 475544 - RNA, 23 nt, Chlamydia trachomatis
aacucucgggccaaaaagacuac

SEQ ID NO: 475545 - RNA, 17 nt, Chlamydia trachomatis
aacucuaaauaccucuu

SEQ ID NO: 475546 - RNA, 19 nt, Chlamydia trachomatis
aacucggguuuuaaaugcu

SEQ ID NO: 475547 - RNA, 20 nt, Chlamydia trachomatis
aacucgugaauguuaacauc

SEQ ID NO: 475548 - RNA, 13 nt, Chlamydia trachomatis
aacucccucauua

SEQ ID NO: 475549 - RNA, 16 nt, Chlamydia trachomatis
aacucccuccaaaaaa

SEQ ID NO: 475550 - RNA, 15 nt, Chlamydia trachomatis
aacuccguaguccac

SEQ ID NO: 475551 - RNA, 17 nt, Chlamydia trachomatis
aacuaucagaagauagu

SEQ ID NO: 475552 - RNA, 23 nt, Chlamydia trachomatis
aacuaucccuacugaaguagcua

SEQ ID NO: 475553 - RNA, 17 nt, Chlamydia trachomatis
aacuauccguuguagac

SEQ ID NO: 475554 - RNA, 19 nt, Chlamydia trachomatis
aacucaaaagcuuuuccgc

SEQ ID NO: 475555 - RNA, 17 nt, Chlamydia trachomatis
aacucaaaauaaagaaa

SEQ ID NO: 475556 - RNA, 14 nt, Chlamydia trachomatis
aacuccaagcacuu

SEQ ID NO: 475557 - RNA, 19 nt, Chlamydia trachomatis
aacuccaagcauuaccaua

SEQ ID NO: 475558 - RNA, 22 nt, Chlamydia trachomatis
aacugagccaagaacaaagcau

SEQ ID NO: 475559 - RNA, 15 nt, Chlamydia trachomatis
aacucuuuuucagac

SEQ ID NO: 475560 - RNA, 16 nt, Chlamydia trachomatis
aacugcucuucuaacu

SEQ ID NO: 475561 - RNA, 18 nt, Chlamydia trachomatis
aacugcagcaucuauuuu

SEQ ID NO: 475562 - RNA, 18 nt, Chlamydia trachomatis
aacuggaguuuuccugaa

SEQ ID NO: 475563 - RNA, 16 nt, Chlamydia trachomatis
aacuggagaauccaua

SEQ ID NO: 475564 - RNA, 13 nt, Chlamydia trachomatis
aacugcuuuccuu

SEQ ID NO: 475565 - RNA, 23 nt, Chlamydia trachomatis
aacugcuuuccuuaguuuuaauu

SEQ ID NO: 475566 - RNA, 22 nt, Chlamydia trachomatis
aacuguacacagggugccaaua

SEQ ID NO: 475567 - RNA, 19 nt, Chlamydia trachomatis
aacuguaucggcagcuccu

SEQ ID NO: 475568 - RNA, 22 nt, Chlamydia trachomatis
aacuguccuuuauucaauauca

SEQ ID NO: 475569 - RNA, 14 nt, Chlamydia trachomatis
aacugugaagaaug

SEQ ID NO: 475570 - RNA, 17 nt, Chlamydia trachomatis
aacugugaagaaugaaa

SEQ ID NO: 475571 - RNA, 16 nt, Chlamydia trachomatis
aacuuuguuauuuuuu

SEQ ID NO: 475572 - RNA, 13 nt, Chlamydia trachomatis
aacuuuagaagac

SEQ ID NO: 475573 - RNA, 17 nt, Chlamydia trachomatis
aacuuuauuauugaaaa

SEQ ID NO: 475574 - RNA, 19 nt, Chlamydia trachomatis
aacuugucuaaaagaauau

SEQ ID NO: 475575 - RNA, 20 nt, Chlamydia trachomatis
aacuuguuccuaauuuaaaa

SEQ ID NO: 475576 - RNA, 22 nt, Chlamydia trachomatis
aacuugcaggagauaauuuucu

SEQ ID NO: 475577 - RNA, 15 nt, Chlamydia trachomatis
aacuugcguuuucuu

SEQ ID NO: 475578 - RNA, 15 nt, Chlamydia trachomatis
aacuucuuccaaaua

SEQ ID NO: 475579 - RNA, 20 nt, Chlamydia trachomatis
aacuucuggagauugaauaa

SEQ ID NO: 475580 - RNA, 12 nt, Chlamydia trachomatis
aacuuaucuguu

SEQ ID NO: 475581 - RNA, 20 nt, Chlamydia trachomatis
aacuuaugaaaacuuuguau

SEQ ID NO: 475582 - RNA, 15 nt, Chlamydia trachomatis
aacuuauuggugagu

SEQ ID NO: 475583 - RNA, 19 nt, Chlamydia trachomatis
aagaacgccugaucaaauc

SEQ ID NO: 475584 - RNA, 21 nt, Chlamydia trachomatis
aagaacucccuccaaaaaaga

SEQ ID NO: 475585 - RNA, 22 nt, Chlamydia trachomatis
aagaacucccuccaaaaaagag

SEQ ID NO: 475586 - RNA, 21 nt, Chlamydia trachomatis
aagaaccacaaaaucagcaaa

SEQ ID NO: 475587 - RNA, 23 nt, Chlamydia trachomatis
aagaaccacaaccucucuaaaaa

SEQ ID NO: 475588 - RNA, 17 nt, Chlamydia trachomatis
aagaaccucaauagcug

SEQ ID NO: 475589 - RNA, 20 nt, Chlamydia trachomatis
aagaaccuccauaagaaauu

SEQ ID NO: 475590 - RNA, 16 nt, Chlamydia trachomatis
aagaacauauuaggag

SEQ ID NO: 475591 - RNA, 18 nt, Chlamydia trachomatis
aagaacacacuuucccca

SEQ ID NO: 475592 - RNA, 13 nt, Chlamydia trachomatis
aagaacaaagaau

SEQ ID NO: 475593 - RNA, 13 nt, Chlamydia trachomatis
aagaacaaagcau

SEQ ID NO: 475594 - RNA, 21 nt, Chlamydia trachomatis
aagaagagguauguuuggauu

SEQ ID NO: 475595 - RNA, 13 nt, Chlamydia trachomatis
aagaagaggagga

SEQ ID NO: 475596 - RNA, 15 nt, Chlamydia trachomatis
aagaagaacugcagu

SEQ ID NO: 475597 - RNA, 12 nt, Chlamydia trachomatis
aagaagaagaga

SEQ ID NO: 475598 - RNA, 17 nt, Chlamydia trachomatis
aagaagacgcucauaaa

SEQ ID NO: 475599 - RNA, 16 nt, Chlamydia trachomatis
aagaacucaaaagcuu

SEQ ID NO: 475600 - RNA, 17 nt, Chlamydia trachomatis
aagaacucaaaagcuuu

SEQ ID NO: 475601 - RNA, 23 nt, Chlamydia trachomatis
aagaacugucuucuuucaaagaa

SEQ ID NO: 475602 - RNA, 20 nt, Chlamydia trachomatis
aagaacuucauugacuguag

SEQ ID NO: 475603 - RNA, 24 nt, Chlamydia trachomatis
aagaagcuccuuuaccuuucacua

SEQ ID NO: 475604 - RNA, 15 nt, Chlamydia trachomatis
aagaagcugcaguuu

SEQ ID NO: 475605 - RNA, 19 nt, Chlamydia trachomatis
aagaagccccaauagcuaa

SEQ ID NO: 475606 - RNA, 14 nt, Chlamydia trachomatis
aagaagccuucuuc

SEQ ID NO: 475607 - RNA, 14 nt, Chlamydia trachomatis
aagaagauguuguu

SEQ ID NO: 475608 - RNA, 22 nt, Chlamydia trachomatis
aagaagauuuuuagaaggaaag

SEQ ID NO: 475609 - RNA, 15 nt, Chlamydia trachomatis
aacuuuuucucuugc

SEQ ID NO: 475610 - RNA, 16 nt, Chlamydia trachomatis
aacuuuuuguagguaa

SEQ ID NO: 475611 - RNA, 15 nt, Chlamydia trachomatis
aagaaaaaaaaccaa

SEQ ID NO: 475612 - RNA, 15 nt, Chlamydia trachomatis
aagaaaaaaagaggu

SEQ ID NO: 475613 - RNA, 23 nt, Chlamydia trachomatis
aagaaaaaaagaggucugugcua

SEQ ID NO: 475614 - RNA, 18 nt, Chlamydia trachomatis
aagaaaacagccaagcaa

SEQ ID NO: 475615 - RNA, 14 nt, Chlamydia trachomatis
aagaaaacuuuacu

SEQ ID NO: 475616 - RNA, 17 nt, Chlamydia trachomatis
aagaaaagagcuuuucu

SEQ ID NO: 475617 - RNA, 17 nt, Chlamydia trachomatis
aagaaaagauaguuuag

SEQ ID NO: 475618 - RNA, 22 nt, Chlamydia trachomatis
aagaaaauagguaaagaaguuu

SEQ ID NO: 475619 - RNA, 13 nt, Chlamydia trachomatis
aagaaaaucagaa

SEQ ID NO: 475620 - RNA, 15 nt, Chlamydia trachomatis
aagaaacuuuucugc

SEQ ID NO: 475621 - RNA, 22 nt, Chlamydia trachomatis
aagaaagaagggaaacauuccc

SEQ ID NO: 475622 - RNA, 17 nt, Chlamydia trachomatis
aagaaagcccuauuucc

SEQ ID NO: 475623 - RNA, 18 nt, Chlamydia trachomatis
aagaaagcccuauuuccu

SEQ ID NO: 475624 - RNA, 19 nt, Chlamydia trachomatis
aagaaagcuucuuguucgu

SEQ ID NO: 475625 - RNA, 18 nt, Chlamydia trachomatis
aagaaaggccuauccaag

SEQ ID NO: 475626 - RNA, 23 nt, Chlamydia trachomatis
aagaaaggccuauccaaggaaac

SEQ ID NO: 475627 - RNA, 22 nt, Chlamydia trachomatis
aagaaauaaaaagcccuuuccu

SEQ ID NO: 475628 - RNA, 21 nt, Chlamydia trachomatis
aagaaauaaccggaacaauca

SEQ ID NO: 475629 - RNA, 19 nt, Chlamydia trachomatis
aagaaauccccagucucuc

SEQ ID NO: 475630 - RNA, 21 nt, Chlamydia trachomatis
aagaaauccccagucucucca

SEQ ID NO: 475631 - RNA, 16 nt, Chlamydia trachomatis
aagaaauuaacaccaa

SEQ ID NO: 475632 - RNA, 22 nt, Chlamydia trachomatis
aagccaucucggaucgagaaga

SEQ ID NO: 475633 - RNA, 15 nt, Chlamydia trachomatis
aagccauaauaaaag

SEQ ID NO: 475634 - RNA, 13 nt, Chlamydia trachomatis
aagccauacaaag

SEQ ID NO: 475635 - RNA, 15 nt, Chlamydia trachomatis
aagccauagccauca

SEQ ID NO: 475636 - RNA, 13 nt, Chlamydia trachomatis
aagaaguuuaaaa

SEQ ID NO: 475637 - RNA, 21 nt, Chlamydia trachomatis
aagaaguuuacgaacaagaug

SEQ ID NO: 475638 - RNA, 16 nt, Chlamydia trachomatis
aagaaggcuuuucuau

SEQ ID NO: 475639 - RNA, 22 nt, Chlamydia trachomatis
aagaaggcuuuucuauuuuuag

SEQ ID NO: 475640 - RNA, 21 nt, Chlamydia trachomatis
aagaagguugaauuucaggag

SEQ ID NO: 475641 - RNA, 16 nt, Chlamydia trachomatis
aagaaguaaugaaggu

SEQ ID NO: 475642 - RNA, 21 nt, Chlamydia trachomatis
aagccccuacucuuccuugau

SEQ ID NO: 475643 - RNA, 20 nt, Chlamydia trachomatis
aagccccuccgcugauuaga

SEQ ID NO: 475644 - RNA, 21 nt, Chlamydia trachomatis
aagccccuccgcugauuagaa

SEQ ID NO: 475645 - RNA, 20 nt, Chlamydia trachomatis
aagccuccgguuuccaaaua

SEQ ID NO: 475646 - RNA, 21 nt, Chlamydia trachomatis
aagccuccugcguuagcaaga

SEQ ID NO: 475647 - RNA, 23 nt, Chlamydia trachomatis
aagccuuuuguuuucuugauucc

SEQ ID NO: 475648 - RNA, 16 nt, Chlamydia trachomatis
aagcgaaaaaaaaaga

SEQ ID NO: 475649 - RNA, 16 nt, Chlamydia trachomatis
aagccuuugcuaucag

SEQ ID NO: 475650 - RNA, 21 nt, Chlamydia trachomatis
aagccuucucuuuucacaaag

SEQ ID NO: 475651 - RNA, 21 nt, Chlamydia trachomatis
aagccuugagccuucaauucu

SEQ ID NO: 475652 - RNA, 23 nt, Chlamydia trachomatis
aagccuugagccuucaauucuug

SEQ ID NO: 475653 - RNA, 17 nt, Chlamydia trachomatis
aagccuuggguucuucu

SEQ ID NO: 475654 - RNA, 22 nt, Chlamydia trachomatis
aagccuuucucuaaaagaagag

SEQ ID NO: 475655 - RNA, 12 nt, Chlamydia trachomatis
aagccugugccu

SEQ ID NO: 475656 - RNA, 20 nt, Chlamydia trachomatis
aagccugugccuuucguuag

SEQ ID NO: 475657 - RNA, 20 nt, Chlamydia trachomatis
aagcgaggcuucaaagaaca

SEQ ID NO: 475658 - RNA, 20 nt, Chlamydia trachomatis
aagcguuccuauacaagaaa

SEQ ID NO: 475659 - RNA, 16 nt, Chlamydia trachomatis
aagcguuuaagugacu

SEQ ID NO: 475660 - RNA, 17 nt, Chlamydia trachomatis
aagcuaagauuccucuu

SEQ ID NO: 475661 - RNA, 16 nt, Chlamydia trachomatis
aagcuaucuaauauua

SEQ ID NO: 475662 - RNA, 15 nt, Chlamydia trachomatis
aagcuauuugcaaga

SEQ ID NO: 475663 - RNA, 18 nt, Chlamydia trachomatis
aagcuauuuucuuccugc

SEQ ID NO: 475664 - RNA, 14 nt, Chlamydia trachomatis
aaggaagaagauag

SEQ ID NO: 475665 - RNA, 20 nt, Chlamydia trachomatis
aaggaccguuagcauagccu

SEQ ID NO: 475666 - RNA, 15 nt, Chlamydia trachomatis
aaggacuaguccuga

SEQ ID NO: 475667 - RNA, 16 nt, Chlamydia trachomatis
aaggacuaguccugaa

SEQ ID NO: 475668 - RNA, 21 nt, Chlamydia trachomatis
aaggacuaguccugaagcaau

SEQ ID NO: 475669 - RNA, 13 nt, Chlamydia trachomatis
aaggacuucaaca

SEQ ID NO: 475670 - RNA, 16 nt, Chlamydia trachomatis
aaggagagaaaagagg

SEQ ID NO: 475671 - RNA, 17 nt, Chlamydia trachomatis
aaggagagaaaagagga

SEQ ID NO: 475672 - RNA, 13 nt, Chlamydia trachomatis
aagcuugaucaaa

SEQ ID NO: 475673 - RNA, 13 nt, Chlamydia trachomatis
aaggaaaaagaaa

SEQ ID NO: 475674 - RNA, 14 nt, Chlamydia trachomatis
aaggaaaaagaaaa

SEQ ID NO: 475675 - RNA, 16 nt, Chlamydia trachomatis
aaggaaaccaagggaa

SEQ ID NO: 475676 - RNA, 21 nt, Chlamydia trachomatis
aaggaaaccaagggaauaaaa

SEQ ID NO: 475677 - RNA, 18 nt, Chlamydia trachomatis
aagcugggcagcaagaga

SEQ ID NO: 475678 - RNA, 20 nt, Chlamydia trachomatis
aagcugggcagcaagagaga

SEQ ID NO: 475679 - RNA, 22 nt, Chlamydia trachomatis
aagcuguaggucgcuugauucu

SEQ ID NO: 475680 - RNA, 22 nt, Chlamydia trachomatis
aagcuuaguuacaagacaauaa

SEQ ID NO: 475681 - RNA, 23 nt, Chlamydia trachomatis
aagcugacgcgccuguguuaacu

SEQ ID NO: 475682 - RNA, 17 nt, Chlamydia trachomatis
aaggagauauuuccaua

SEQ ID NO: 475683 - RNA, 19 nt, Chlamydia trachomatis
aaggauugacagcuguuuc

SEQ ID NO: 475684 - RNA, 19 nt, Chlamydia trachomatis
aaggcuaagaaaaaccuuu

SEQ ID NO: 475685 - RNA, 13 nt, Chlamydia trachomatis
aaggcuuuuccau

SEQ ID NO: 475686 - RNA, 13 nt, Chlamydia trachomatis
aaggguagaaaaa

SEQ ID NO: 475687 - RNA, 15 nt, Chlamydia trachomatis
aaggguagaaaaaga

SEQ ID NO: 475688 - RNA, 18 nt, Chlamydia trachomatis
aaggguagaaaaagagaa

SEQ ID NO: 475689 - RNA, 16 nt, Chlamydia trachomatis
aagggcugagccguuc

SEQ ID NO: 475690 - RNA, 20 nt, Chlamydia trachomatis
aagggcuuuauacuagggaa

SEQ ID NO: 475691 - RNA, 20 nt, Chlamydia trachomatis
aagggaugaagcuaaaaaau

SEQ ID NO: 475692 - RNA, 15 nt, Chlamydia trachomatis
aagggaauaaaaacg

SEQ ID NO: 475693 - RNA, 21 nt, Chlamydia trachomatis
aagggaauaaaaacgcuccaa

SEQ ID NO: 475694 - RNA, 22 nt, Chlamydia trachomatis
aagggaaucauaaggaagaugg

SEQ ID NO: 475695 - RNA, 16 nt, Chlamydia trachomatis
aagguauuuuagagaa

SEQ ID NO: 475696 - RNA, 23 nt, Chlamydia trachomatis
aagguauuuuagagaaaagaaaa

SEQ ID NO: 475697 - RNA, 23 nt, Chlamydia trachomatis
aaggucgagcucccauuucuggc

SEQ ID NO: 475698 - RNA, 12 nt, Chlamydia trachomatis
aaguaaaaugcc

SEQ ID NO: 475699 - RNA, 21 nt, Chlamydia trachomatis
aaguaaugaagguuucuaaaa

SEQ ID NO: 475700 - RNA, 11 nt, Chlamydia trachomatis
aaguaauucuu

SEQ ID NO: 475701 - RNA, 21 nt, Chlamydia trachomatis
aaguagaaccacuuuucugua

SEQ ID NO: 475702 - RNA, 15 nt, Chlamydia trachomatis
aagugugccagcucu

SEQ ID NO: 475703 - RNA, 15 nt, Chlamydia trachomatis
aaguguaaucauuuu

SEQ ID NO: 475704 - RNA, 15 nt, Chlamydia trachomatis
aagucuguuccuaau

SEQ ID NO: 475705 - RNA, 20 nt, Chlamydia trachomatis
aagucuguuccuaauacuaa

SEQ ID NO: 475706 - RNA, 15 nt, Chlamydia trachomatis
aagucuuaaaagggu

SEQ ID NO: 475707 - RNA, 20 nt, Chlamydia trachomatis
aagucuuaaaaggguagaaa

SEQ ID NO: 475708 - RNA, 21 nt, Chlamydia trachomatis
aagucuuaaaaggguagaaaa

SEQ ID NO: 475709 - RNA, 19 nt, Chlamydia trachomatis
aagugaauuugaacagcga

SEQ ID NO: 475710 - RNA, 16 nt, Chlamydia trachomatis
aagugagcccugcuuc

SEQ ID NO: 475711 - RNA, 22 nt, Chlamydia trachomatis
aagugagcccugcuucacagcu

SEQ ID NO: 475712 - RNA, 19 nt, Chlamydia trachomatis
aagugcgcgcuuaauuuuu

SEQ ID NO: 475713 - RNA, 13 nt, Chlamydia trachomatis
aagucucugccac

SEQ ID NO: 475714 - RNA, 13 nt, Chlamydia trachomatis
aagucaaaagaau

SEQ ID NO: 475715 - RNA, 17 nt, Chlamydia trachomatis
aagucaggauuuucuag

SEQ ID NO: 475716 - RNA, 23 nt, Chlamydia trachomatis
aagucaggauuuucuagguacca

SEQ ID NO: 475717 - RNA, 12 nt, Chlamydia trachomatis
aaguagcaauca

SEQ ID NO: 475718 - RNA, 12 nt, Chlamydia trachomatis
aaguagcuaaau

SEQ ID NO: 475719 - RNA, 17 nt, Chlamydia trachomatis
aaguaguccuaucacca

SEQ ID NO: 475720 - RNA, 12 nt, Chlamydia trachomatis
aaguauucuucu

SEQ ID NO: 475721 - RNA, 19 nt, Chlamydia trachomatis
aaguauuggagacaacaag

SEQ ID NO: 475722 - RNA, 21 nt, Chlamydia trachomatis
aauaaucggcaaaagaucuca

SEQ ID NO: 475723 - RNA, 22 nt, Chlamydia trachomatis
aauaaucuuguaauaucaaaga

SEQ ID NO: 475724 - RNA, 11 nt, Chlamydia trachomatis
aauaaugaaau

SEQ ID NO: 475725 - RNA, 20 nt, Chlamydia trachomatis
aauaaugauucccagggaga

SEQ ID NO: 475726 - RNA, 13 nt, Chlamydia trachomatis
aauaaugauuuuu

SEQ ID NO: 475727 - RNA, 18 nt, Chlamydia trachomatis
aauaaugggccguuuuuc

SEQ ID NO: 475728 - RNA, 20 nt, Chlamydia trachomatis
aauaaugggccguuuuucuc

SEQ ID NO: 475729 - RNA, 17 nt, Chlamydia trachomatis
aauaaugggcuccuuca

SEQ ID NO: 475730 - RNA, 16 nt, Chlamydia trachomatis
aauaauguugaagucu

SEQ ID NO: 475731 - RNA, 17 nt, Chlamydia trachomatis
aauaagggcuuuugcaa

SEQ ID NO: 475732 - RNA, 15 nt, Chlamydia trachomatis
aauaaggggaagaaa

SEQ ID NO: 475733 - RNA, 18 nt, Chlamydia trachomatis
aauaaggggaagaaauau

SEQ ID NO: 475734 - RNA, 21 nt, Chlamydia trachomatis
aauaagguauccaacaauauu

SEQ ID NO: 475735 - RNA, 14 nt, Chlamydia trachomatis
aauaagcauccaag

SEQ ID NO: 475736 - RNA, 11 nt, Chlamydia trachomatis
aauaagcgaaa

SEQ ID NO: 475737 - RNA, 21 nt, Chlamydia trachomatis
aauaagucugccacuacuuca

SEQ ID NO: 475738 - RNA, 21 nt, Chlamydia trachomatis
aauaagucuuuuacuuugaaa

SEQ ID NO: 475739 - RNA, 16 nt, Chlamydia trachomatis
aauaaguuaccucuuu

SEQ ID NO: 475740 - RNA, 15 nt, Chlamydia trachomatis
aauaauaaaccaaag

SEQ ID NO: 475741 - RNA, 12 nt, Chlamydia trachomatis
aauaauaaagau

SEQ ID NO: 475742 - RNA, 14 nt, Chlamydia trachomatis
aauaauacaaagca

SEQ ID NO: 475743 - RNA, 15 nt, Chlamydia trachomatis
aauaauacaaagcac

SEQ ID NO: 475744 - RNA, 14 nt, Chlamydia trachomatis
aauaauacagauuu

SEQ ID NO: 475745 - RNA, 15 nt, Chlamydia trachomatis
aauaauacuccaccu

SEQ ID NO: 475746 - RNA, 21 nt, Chlamydia trachomatis
aauaauagaaaccgaaaaaaa

SEQ ID NO: 475747 - RNA, 18 nt, Chlamydia trachomatis
aauaauaucgagcucauu

SEQ ID NO: 475748 - RNA, 23 nt, Chlamydia trachomatis
aauaauaucgagcucauuuucua

SEQ ID NO: 475749 - RNA, 19 nt, Chlamydia trachomatis
aauaauauuuuuucccuuu

SEQ ID NO: 475750 - RNA, 20 nt, Chlamydia trachomatis
aauaaauauuaucagaccuu

SEQ ID NO: 475751 - RNA, 21 nt, Chlamydia trachomatis
aaguucccuuuuguuccagaa

SEQ ID NO: 475752 - RNA, 17 nt, Chlamydia trachomatis
aaguuccgguauauucu

SEQ ID NO: 475753 - RNA, 16 nt, Chlamydia trachomatis
aaguucauugguaaga

SEQ ID NO: 475754 - RNA, 12 nt, Chlamydia trachomatis
aauaaaucacaa

SEQ ID NO: 475755 - RNA, 17 nt, Chlamydia trachomatis
aauaaaucuauccauaa

SEQ ID NO: 475756 - RNA, 15 nt, Chlamydia trachomatis
aauaaaucucuucca

SEQ ID NO: 475757 - RNA, 12 nt, Chlamydia trachomatis
aauaaaucugcu

SEQ ID NO: 475758 - RNA, 21 nt, Chlamydia trachomatis
aauaaauuagggaagagcaau

SEQ ID NO: 475759 - RNA, 23 nt, Chlamydia trachomatis
aauaaauuagggaagagcaauau

SEQ ID NO: 475760 - RNA, 12 nt, Chlamydia trachomatis
aauaacaaagca

SEQ ID NO: 475761 - RNA, 18 nt, Chlamydia trachomatis
aauaacacucgcaucauc

SEQ ID NO: 475762 - RNA, 22 nt, Chlamydia trachomatis
aauaacccgcuuugaaaguuag

SEQ ID NO: 475763 - RNA, 21 nt, Chlamydia trachomatis
aauaacguagauaucuuuacu

SEQ ID NO: 475764 - RNA, 14 nt, Chlamydia trachomatis
aauaacuaauauag

SEQ ID NO: 475765 - RNA, 19 nt, Chlamydia trachomatis
aauaacugagccaagaaca

SEQ ID NO: 475766 - RNA, 11 nt, Chlamydia trachomatis
aauaacugcau

SEQ ID NO: 475767 - RNA, 19 nt, Chlamydia trachomatis
aauaacuggaguuuuccug

SEQ ID NO: 475768 - RNA, 13 nt, Chlamydia trachomatis
aauaagaaaguuu

SEQ ID NO: 475769 - RNA, 16 nt, Chlamydia trachomatis
aauaagaccucuuuuu

SEQ ID NO: 475770 - RNA, 18 nt, Chlamydia trachomatis
aauaagaugaugagugga

SEQ ID NO: 475771 - RNA, 14 nt, Chlamydia trachomatis
aauaauuuccccua

SEQ ID NO: 475772 - RNA, 12 nt, Chlamydia trachomatis
aauaauuucuga

SEQ ID NO: 475773 - RNA, 13 nt, Chlamydia trachomatis
aauaauuucugag

SEQ ID NO: 475774 - RNA, 23 nt, Chlamydia trachomatis
aauaauuugcgcgucuagcgcau

SEQ ID NO: 475775 - RNA, 17 nt, Chlamydia trachomatis
aauaccacaauuuuucu

SEQ ID NO: 475776 - RNA, 15 nt, Chlamydia trachomatis
aauaccaaaauccuu

SEQ ID NO: 475777 - RNA, 14 nt, Chlamydia trachomatis
aauaccuuaauaag

SEQ ID NO: 475778 - RNA, 19 nt, Chlamydia trachomatis
aauacggaagagucuguuu

SEQ ID NO: 475779 - RNA, 12 nt, Chlamydia trachomatis
aauagcaaagaa

SEQ ID NO: 475780 - RNA, 15 nt, Chlamydia trachomatis
aauagcaaagaagac

SEQ ID NO: 475781 - RNA, 16 nt, Chlamydia trachomatis
aauagcaacucuuuca

SEQ ID NO: 475782 - RNA, 18 nt, Chlamydia trachomatis
aauagcaacucuuucaua

SEQ ID NO: 475783 - RNA, 22 nt, Chlamydia trachomatis
aauagauucccuuuaaagaaag

SEQ ID NO: 475784 - RNA, 17 nt, Chlamydia trachomatis
aauagauagucugcauu

SEQ ID NO: 475785 - RNA, 17 nt, Chlamydia trachomatis
aauagcacgcaaaacau

SEQ ID NO: 475786 - RNA, 20 nt, Chlamydia trachomatis
aauagcagcauucucuagac

SEQ ID NO: 475787 - RNA, 16 nt, Chlamydia trachomatis
aauagcauuaauauac

SEQ ID NO: 475788 - RNA, 19 nt, Chlamydia trachomatis
aauagcauuaauauacuca

SEQ ID NO: 475789 - RNA, 15 nt, Chlamydia trachomatis
aauagccacagcaua

SEQ ID NO: 475790 - RNA, 18 nt, Chlamydia trachomatis
aauagccauuaacaacaa

SEQ ID NO: 475791 - RNA, 22 nt, Chlamydia trachomatis
aauacugacccauccaaaacau

SEQ ID NO: 475792 - RNA, 12 nt, Chlamydia trachomatis
aauagaaaaacu

SEQ ID NO: 475793 - RNA, 20 nt, Chlamydia trachomatis
aauagaaaccuuauauaccg

SEQ ID NO: 475794 - RNA, 14 nt, Chlamydia trachomatis
aauagaaauuuuca

SEQ ID NO: 475795 - RNA, 17 nt, Chlamydia trachomatis
aauaucucaggauaaaa

SEQ ID NO: 475796 - RNA, 19 nt, Chlamydia trachomatis
aauauaggguccaaacaua

SEQ ID NO: 475797 - RNA, 21 nt, Chlamydia trachomatis
aauauagguagguuucugcua

SEQ ID NO: 475798 - RNA, 13 nt, Chlamydia trachomatis
aauauagucccua

SEQ ID NO: 475799 - RNA, 22 nt, Chlamydia trachomatis
aauauagucccuaccuucagca

SEQ ID NO: 475800 - RNA, 18 nt, Chlamydia trachomatis
aauaucccacucuucccc

SEQ ID NO: 475801 - RNA, 23 nt, Chlamydia trachomatis
aauauccccauccugaacaauau

SEQ ID NO: 475802 - RNA, 21 nt, Chlamydia trachomatis
aauauagcuguaauaaacacu

SEQ ID NO: 475803 - RNA, 12 nt, Chlamydia trachomatis
aauauacucaac

SEQ ID NO: 475804 - RNA, 14 nt, Chlamydia trachomatis
aauauacucagaga

SEQ ID NO: 475805 - RNA, 15 nt, Chlamydia trachomatis
aauauacucagagau

SEQ ID NO: 475806 - RNA, 15 nt, Chlamydia trachomatis
aauauacucuuugug

SEQ ID NO: 475807 - RNA, 19 nt, Chlamydia trachomatis
aauaguguaaggagagaaa

SEQ ID NO: 475808 - RNA, 21 nt, Chlamydia trachomatis
aauaguuaaaacacaaaagca

SEQ ID NO: 475809 - RNA, 23 nt, Chlamydia trachomatis
aauagccgccuuugcuaggguuc

SEQ ID NO: 475810 - RNA, 19 nt, Chlamydia trachomatis
aauagccuccaaacauuuu

SEQ ID NO: 475811 - RNA, 20 nt, Chlamydia trachomatis
aaucauuuucuguaauuuua

SEQ ID NO: 475812 - RNA, 22 nt, Chlamydia trachomatis
aauccaaagucucgaauucuau

SEQ ID NO: 475813 - RNA, 20 nt, Chlamydia trachomatis
aaucauugggaaaacgauaa

SEQ ID NO: 475814 - RNA, 12 nt, Chlamydia trachomatis
aaucauuuccac

SEQ ID NO: 475815 - RNA, 23 nt, Chlamydia trachomatis
aaucauuuccacaagauuuugaa

SEQ ID NO: 475816 - RNA, 21 nt, Chlamydia trachomatis
aauccacgaauuuucucucua

SEQ ID NO: 475817 - RNA, 23 nt, Chlamydia trachomatis
aauccacgaauuuucucucuagc

SEQ ID NO: 475818 - RNA, 20 nt, Chlamydia trachomatis
aauccagcgugucuaccaau

SEQ ID NO: 475819 - RNA, 12 nt, Chlamydia trachomatis
aauccagcugcu

SEQ ID NO: 475820 - RNA, 12 nt, Chlamydia trachomatis
aauccaggagac

SEQ ID NO: 475821 - RNA, 18 nt, Chlamydia trachomatis
aauccaugcaucuccucu

SEQ ID NO: 475822 - RNA, 18 nt, Chlamydia trachomatis
aauccauucgcauuaaau

SEQ ID NO: 475823 - RNA, 21 nt, Chlamydia trachomatis
aauccauucgcauuaaauaau

SEQ ID NO: 475824 - RNA, 22 nt, Chlamydia trachomatis
aauccauuggugguaacaccaa

SEQ ID NO: 475825 - RNA, 13 nt, Chlamydia trachomatis
aaucccaaaaaca

SEQ ID NO: 475826 - RNA, 20 nt, Chlamydia trachomatis
aaucaguagugguaaggggu

SEQ ID NO: 475827 - RNA, 15 nt, Chlamydia trachomatis
aaucauacauccuac

SEQ ID NO: 475828 - RNA, 17 nt, Chlamydia trachomatis
aaucauagauaaugaca

SEQ ID NO: 475829 - RNA, 15 nt, Chlamydia trachomatis
aaucagcuuuuccac

SEQ ID NO: 475830 - RNA, 18 nt, Chlamydia trachomatis
aaucauauccuuugauga

SEQ ID NO: 475831 - RNA, 17 nt, Chlamydia trachomatis
aaucauucaucuuuacu

SEQ ID NO: 475832 - RNA, 16 nt, Chlamydia trachomatis
aauccgagcauuuucc

SEQ ID NO: 475833 - RNA, 17 nt, Chlamydia trachomatis
aauccgagcauuuucca

SEQ ID NO: 475834 - RNA, 17 nt, Chlamydia trachomatis
aaucccucuagcaacca

SEQ ID NO: 475835 - RNA, 23 nt, Chlamydia trachomatis
aauccgcuccccuuccuguucuu

SEQ ID NO: 475836 - RNA, 12 nt, Chlamydia trachomatis
aauccuaaaauc

SEQ ID NO: 475837 - RNA, 20 nt, Chlamydia trachomatis
aauccuaugcaguaaagaaa

SEQ ID NO: 475838 - RNA, 17 nt, Chlamydia trachomatis
aauccucuuugaauauc

SEQ ID NO: 475839 - RNA, 18 nt, Chlamydia trachomatis
aauccuggaguauuuuca

SEQ ID NO: 475840 - RNA, 21 nt, Chlamydia trachomatis
aaucgcugacggauccugcug

SEQ ID NO: 475841 - RNA, 20 nt, Chlamydia trachomatis
aaucgcugagcucuuuccuc

SEQ ID NO: 475842 - RNA, 19 nt, Chlamydia trachomatis
aaucguauaaguuuuaaga

SEQ ID NO: 475843 - RNA, 22 nt, Chlamydia trachomatis
aaucguauaaguuuuaagaaga

SEQ ID NO: 475844 - RNA, 23 nt, Chlamydia trachomatis
aaucuacaccauuacgaggaagc

SEQ ID NO: 475845 - RNA, 16 nt, Chlamydia trachomatis
aauccuguagggaaga

SEQ ID NO: 475846 - RNA, 21 nt, Chlamydia trachomatis
aauccuguagggaagauagga

SEQ ID NO: 475847 - RNA, 19 nt, Chlamydia trachomatis
aauccuguggucacaagaa

SEQ ID NO: 475848 - RNA, 21 nt, Chlamydia trachomatis
aauccuuaaccgugaacugcu

SEQ ID NO: 475849 - RNA, 19 nt, Chlamydia trachomatis
aauccuugcacuaagaaua

SEQ ID NO: 475850 - RNA, 14 nt, Chlamydia trachomatis
aaucgcggaagaaa

SEQ ID NO: 475851 - RNA, 22 nt, Chlamydia trachomatis
aaugagcgcuuuuucuucucua

SEQ ID NO: 475852 - RNA, 19 nt, Chlamydia trachomatis
aaugagcguguaagcguuu

SEQ ID NO: 475853 - RNA, 18 nt, Chlamydia trachomatis
aaugaucagcaaaaagag

SEQ ID NO: 475854 - RNA, 21 nt, Chlamydia trachomatis
aaugaucgccucuaaagcuuc

SEQ ID NO: 475855 - RNA, 18 nt, Chlamydia trachomatis
aaugaucuaaaggaaaaa

SEQ ID NO: 475856 - RNA, 15 nt, Chlamydia trachomatis
aaugaccgaagguuc

SEQ ID NO: 475857 - RNA, 21 nt, Chlamydia trachomatis
aaugaacauaugcucuuuccc

SEQ ID NO: 475858 - RNA, 21 nt, Chlamydia trachomatis
aaugaaaucacucgcacacga

SEQ ID NO: 475859 - RNA, 17 nt, Chlamydia trachomatis
aaugaaacggaaugaca

SEQ ID NO: 475860 - RNA, 21 nt, Chlamydia trachomatis
aaucuuuggaagcagaaagaa

SEQ ID NO: 475861 - RNA, 17 nt, Chlamydia trachomatis
aaucuuuuacuggagaa

SEQ ID NO: 475862 - RNA, 18 nt, Chlamydia trachomatis
aaucuuuuugauuuuucu

SEQ ID NO: 475863 - RNA, 16 nt, Chlamydia trachomatis
aaucuauccauaauuu

SEQ ID NO: 475864 - RNA, 13 nt, Chlamydia trachomatis
aaucuaucuggau

SEQ ID NO: 475865 - RNA, 20 nt, Chlamydia trachomatis
aaucugggaggagaacucuu

SEQ ID NO: 475866 - RNA, 19 nt, Chlamydia trachomatis
aaucugucuaagauuuuca

SEQ ID NO: 475867 - RNA, 23 nt, Chlamydia trachomatis
aaucugugccagcugcugcuugg

SEQ ID NO: 475868 - RNA, 19 nt, Chlamydia trachomatis
aaucuguguugcaaagaga

SEQ ID NO: 475869 - RNA, 15 nt, Chlamydia trachomatis
aaucuuaaacaagau

SEQ ID NO: 475870 - RNA, 22 nt, Chlamydia trachomatis
aaucuuaaacaagaucuaucua

SEQ ID NO: 475871 - RNA, 23 nt, Chlamydia trachomatis
aaugccuuuugcacaaaggaaca

SEQ ID NO: 475872 - RNA, 21 nt, Chlamydia trachomatis
aaugccuuuuguuuucaaaag

SEQ ID NO: 475873 - RNA, 15 nt, Chlamydia trachomatis
aaugcgaucagaaac

SEQ ID NO: 475874 - RNA, 15 nt, Chlamydia trachomatis
aaugcaguggaagau

SEQ ID NO: 475875 - RNA, 21 nt, Chlamydia trachomatis
aaugcaguggaagauagaaga

SEQ ID NO: 475876 - RNA, 22 nt, Chlamydia trachomatis
aauggauacuaacgguuccauu

SEQ ID NO: 475877 - RNA, 17 nt, Chlamydia trachomatis
aaugguuauaagaccua

SEQ ID NO: 475878 - RNA, 14 nt, Chlamydia trachomatis
aauguaaacaauau

SEQ ID NO: 475879 - RNA, 15 nt, Chlamydia trachomatis
aaugcgugaacuguu

SEQ ID NO: 475880 - RNA, 16 nt, Chlamydia trachomatis
aaugcguuaaacuuuc

SEQ ID NO: 475881 - RNA, 18 nt, Chlamydia trachomatis
aaugcguuaaacuuucuu

SEQ ID NO: 475882 - RNA, 11 nt, Chlamydia trachomatis
aaugcuugaac

SEQ ID NO: 475883 - RNA, 14 nt, Chlamydia trachomatis
aaugcuugaacaac

SEQ ID NO: 475884 - RNA, 21 nt, Chlamydia trachomatis
aauggacugguuguucccgau

SEQ ID NO: 475885 - RNA, 22 nt, Chlamydia trachomatis
aauuccuucagagguagccaaa

SEQ ID NO: 475886 - RNA, 17 nt, Chlamydia trachomatis
aauuccuuggauacgua

SEQ ID NO: 475887 - RNA, 21 nt, Chlamydia trachomatis
aauuccucuaaacaagguucu

SEQ ID NO: 475888 - RNA, 13 nt, Chlamydia trachomatis
aauucgagccugu

SEQ ID NO: 475889 - RNA, 22 nt, Chlamydia trachomatis
aauucgagccuguuuugcaaag

SEQ ID NO: 475890 - RNA, 21 nt, Chlamydia trachomatis
aauucgagucggacaguucuu

SEQ ID NO: 475891 - RNA, 13 nt, Chlamydia trachomatis
aauucguaugcaa

SEQ ID NO: 475892 - RNA, 23 nt, Chlamydia trachomatis
aauucguccuccgccaccaguug

SEQ ID NO: 475893 - RNA, 22 nt, Chlamydia trachomatis
aauucuaaacgagcuagcucuu

SEQ ID NO: 475894 - RNA, 22 nt, Chlamydia trachomatis
aauucuaaaguaagaccgagau

SEQ ID NO: 475895 - RNA, 18 nt, Chlamydia trachomatis
aauucuagcaaccgauuc

SEQ ID NO: 475896 - RNA, 22 nt, Chlamydia trachomatis
aauucuagcaaccgauucuuca

SEQ ID NO: 475897 - RNA, 23 nt, Chlamydia trachomatis
aauucuacuccugcaacaagaac

SEQ ID NO: 475898 - RNA, 13 nt, Chlamydia trachomatis
aauucuaucaaca

SEQ ID NO: 475899 - RNA, 22 nt, Chlamydia trachomatis
aauuccacgaagagcaaaauca

SEQ ID NO: 475900 - RNA, 20 nt, Chlamydia trachomatis
aauucaggcucuuucagaga

SEQ ID NO: 475901 - RNA, 23 nt, Chlamydia trachomatis
aauucaucagcacccacauuacc

SEQ ID NO: 475902 - RNA, 23 nt, Chlamydia trachomatis
aauuauuugccucuauguucuua

SEQ ID NO: 475903 - RNA, 16 nt, Chlamydia trachomatis
aauuaugaucacuaau

SEQ ID NO: 475904 - RNA, 19 nt, Chlamydia trachomatis
aauuaugcaaaaagagcau

SEQ ID NO: 475905 - RNA, 17 nt, Chlamydia trachomatis
aauguacgcuaaaaacu

SEQ ID NO: 475906 - RNA, 23 nt, Chlamydia trachomatis
aauguacgcuaaaaacucuuuca

SEQ ID NO: 475907 - RNA, 13 nt, Chlamydia trachomatis
aauguagaaauuu

SEQ ID NO: 475908 - RNA, 19 nt, Chlamydia trachomatis
aauguagaaauuuuaaauc

SEQ ID NO: 475909 - RNA, 17 nt, Chlamydia trachomatis
aauuaacaauccccaaa

SEQ ID NO: 475910 - RNA, 13 nt, Chlamydia trachomatis
aauuaacccaaaa

SEQ ID NO: 475911 - RNA, 22 nt, Chlamydia trachomatis
aauugucgauaacgaagcaaaa

SEQ ID NO: 475912 - RNA, 17 nt, Chlamydia trachomatis
aauuuaaaaucuaugua

SEQ ID NO: 475913 - RNA, 17 nt, Chlamydia trachomatis
aauuuaauuaaagagau

SEQ ID NO: 475914 - RNA, 19 nt, Chlamydia trachomatis
aauuuaucugcuaaagaaa

SEQ ID NO: 475915 - RNA, 20 nt, Chlamydia trachomatis
aauuuaucugcuaaagaaaa

SEQ ID NO: 475916 - RNA, 23 nt, Chlamydia trachomatis
aauuuaucugcuuccguaacaau

SEQ ID NO: 475917 - RNA, 21 nt, Chlamydia trachomatis
aauuuaugucgcagcuuucuu

SEQ ID NO: 475918 - RNA, 20 nt, Chlamydia trachomatis
aauugcuguuaagauaagca

SEQ ID NO: 475919 - RNA, 19 nt, Chlamydia trachomatis
aauugcgacaccuaauccu

SEQ ID NO: 475920 - RNA, 24 nt, Chlamydia trachomatis
aauugcgaagguucaagaugcgcu

SEQ ID NO: 475921 - RNA, 18 nt, Chlamydia trachomatis
aauugcgguaaacaaugc

SEQ ID NO: 475922 - RNA, 18 nt, Chlamydia trachomatis
aauugcuaaggaaagaga

SEQ ID NO: 475923 - RNA, 15 nt, Chlamydia trachomatis
aauugccgaaucaaa

SEQ ID NO: 475924 - RNA, 18 nt, Chlamydia trachomatis
aauugccgaaucaaagac

SEQ ID NO: 475925 - RNA, 23 nt, Chlamydia trachomatis
aauucuuggaucgcaugaaugag

SEQ ID NO: 475926 - RNA, 13 nt, Chlamydia trachomatis
aauucuuugaucu

SEQ ID NO: 475927 - RNA, 21 nt, Chlamydia trachomatis
aauucuuugaucuguaaaaau

SEQ ID NO: 475928 - RNA, 11 nt, Chlamydia trachomatis
aauugaaguau

SEQ ID NO: 475929 - RNA, 19 nt, Chlamydia trachomatis
aauugagcacaagcuguuc

SEQ ID NO: 475930 - RNA, 21 nt, Chlamydia trachomatis
aauugagcugucucugaugua

SEQ ID NO: 475931 - RNA, 19 nt, Chlamydia trachomatis
acacuuuucagcuuuucuu

SEQ ID NO: 475932 - RNA, 17 nt, Chlamydia trachomatis
acagaaucuguuuugau

SEQ ID NO: 475933 - RNA, 21 nt, Chlamydia trachomatis
acacuucucgaaaaaaugccu

SEQ ID NO: 475934 - RNA, 18 nt, Chlamydia trachomatis
acacuugauaaauagcaa

SEQ ID NO: 475935 - RNA, 18 nt, Chlamydia trachomatis
acacuuuaucagcgucau

SEQ ID NO: 475936 - RNA, 17 nt, Chlamydia trachomatis
acacuguauugcucugc

SEQ ID NO: 475937 - RNA, 22 nt, Chlamydia trachomatis
acacugacuauuccugaaggag

SEQ ID NO: 475938 - RNA, 21 nt, Chlamydia trachomatis
acacucgugaaauaaaucaca

SEQ ID NO: 475939 - RNA, 13 nt, Chlamydia trachomatis
acagauugagaau

SEQ ID NO: 475940 - RNA, 20 nt, Chlamydia trachomatis
acagauugagaauaaauaua

SEQ ID NO: 475941 - RNA, 14 nt, Chlamydia trachomatis
acagcacaaacaaa

SEQ ID NO: 475942 - RNA, 20 nt, Chlamydia trachomatis
acagcacaaacaaauccuag

SEQ ID NO: 475943 - RNA, 21 nt, Chlamydia trachomatis
acagaucuugaucugaaaaga

SEQ ID NO: 475944 - RNA, 22 nt, Chlamydia trachomatis
acagagguaaucguauaaguuu

SEQ ID NO: 475945 - RNA, 19 nt, Chlamydia trachomatis
acagagcuucaucucaaua

SEQ ID NO: 475946 - RNA, 12 nt, Chlamydia trachomatis
acagagcuucuc

SEQ ID NO: 475947 - RNA, 15 nt, Chlamydia trachomatis
acagccaagcaagau

SEQ ID NO: 475948 - RNA, 12 nt, Chlamydia trachomatis
acagcacuucuu

SEQ ID NO: 475949 - RNA, 18 nt, Chlamydia trachomatis
acagcacuucuucuuugg

SEQ ID NO: 475950 - RNA, 19 nt, Chlamydia trachomatis
acagcagaacucaacgaaa

SEQ ID NO: 475951 - RNA, 22 nt, Chlamydia trachomatis
acagcacgagugaugauagaca

SEQ ID NO: 475952 - RNA, 19 nt, Chlamydia trachomatis
acagccugcuuucuucugc

SEQ ID NO: 475953 - RNA, 23 nt, Chlamydia trachomatis
acagccucaucauuaauuagaau

SEQ ID NO: 475954 - RNA, 19 nt, Chlamydia trachomatis
acagcguuuuccccuugca

SEQ ID NO: 475955 - RNA, 15 nt, Chlamydia trachomatis
acaggagaugaauug

SEQ ID NO: 475956 - RNA, 16 nt, Chlamydia trachomatis
acaggauccgcaccaa

SEQ ID NO: 475957 - RNA, 19 nt, Chlamydia trachomatis
acaggauccgcaccaauca

SEQ ID NO: 475958 - RNA, 23 nt, Chlamydia trachomatis
acaggauccgcaccaaucaccgc

SEQ ID NO: 475959 - RNA, 13 nt, Chlamydia trachomatis
acagcuuucacag

SEQ ID NO: 475960 - RNA, 17 nt, Chlamydia trachomatis
acagcuuucacagggac

SEQ ID NO: 475961 - RNA, 15 nt, Chlamydia trachomatis
acagcuguauuuaca

SEQ ID NO: 475962 - RNA, 14 nt, Chlamydia trachomatis
acagcuucuucuuc

SEQ ID NO: 475963 - RNA, 21 nt, Chlamydia trachomatis
acagcuucuucuucucuuucg

SEQ ID NO: 475964 - RNA, 22 nt, Chlamydia trachomatis
acagcucuaaagagccaaaaua

SEQ ID NO: 475965 - RNA, 22 nt, Chlamydia trachomatis
acagcucuguucaauuguugga

SEQ ID NO: 475966 - RNA, 15 nt, Chlamydia trachomatis
acagcucuugcauuu

SEQ ID NO: 475967 - RNA, 18 nt, Chlamydia trachomatis
acagcuaaucauagccau

SEQ ID NO: 475968 - RNA, 20 nt, Chlamydia trachomatis
acagcuaaucauagccauca

SEQ ID NO: 475969 - RNA, 15 nt, Chlamydia trachomatis
acagcuagaauagca

SEQ ID NO: 475970 - RNA, 19 nt, Chlamydia trachomatis
acagggacaucgaaaauca

SEQ ID NO: 475971 - RNA, 20 nt, Chlamydia trachomatis
acagggacaucgaaaaucac

SEQ ID NO: 475972 - RNA, 19 nt, Chlamydia trachomatis
acagggauggucucacaca

SEQ ID NO: 475973 - RNA, 14 nt, Chlamydia trachomatis
acagguuucaugac

SEQ ID NO: 475974 - RNA, 17 nt, Chlamydia trachomatis
acaguaccgucacucuu

SEQ ID NO: 475975 - RNA, 22 nt, Chlamydia trachomatis
acagucuucucgagaagaaaaa

SEQ ID NO: 475976 - RNA, 20 nt, Chlamydia trachomatis
acagugacuugauuggauaa

SEQ ID NO: 475977 - RNA, 18 nt, Chlamydia trachomatis
acauaaaauccuucugcc

SEQ ID NO: 475978 - RNA, 21 nt, Chlamydia trachomatis
acauaaacgguggaacagcuc

SEQ ID NO: 475979 - RNA, 12 nt, Chlamydia trachomatis
acauaaucuucc

SEQ ID NO: 475980 - RNA, 12 nt, Chlamydia trachomatis
acauccaaaaau

SEQ ID NO: 475981 - RNA, 12 nt, Chlamydia trachomatis
acaucaacagaa

SEQ ID NO: 475982 - RNA, 14 nt, Chlamydia trachomatis
acaucuaaaagagu

SEQ ID NO: 475983 - RNA, 20 nt, Chlamydia trachomatis
acaucuguagagccaugauc

SEQ ID NO: 475984 - RNA, 21 nt, Chlamydia trachomatis
acaucugugucauaagcucua

SEQ ID NO: 475985 - RNA, 22 nt, Chlamydia trachomatis
acaugauaaugaguuccgaaca

SEQ ID NO: 475986 - RNA, 15 nt, Chlamydia trachomatis
acaucuucccaauau

SEQ ID NO: 475987 - RNA, 13 nt, Chlamydia trachomatis
acaugaucauagu

SEQ ID NO: 475988 - RNA, 13 nt, Chlamydia trachomatis
accaaaaaaucca

SEQ ID NO: 475989 - RNA, 13 nt, Chlamydia trachomatis
accaaaaauauca

SEQ ID NO: 475990 - RNA, 20 nt, Chlamydia trachomatis
acaugggcauagucucccaa

SEQ ID NO: 475991 - RNA, 16 nt, Chlamydia trachomatis
acaugguucaaacaua

SEQ ID NO: 475992 - RNA, 13 nt, Chlamydia trachomatis
acaugguuuucug

SEQ ID NO: 475993 - RNA, 18 nt, Chlamydia trachomatis
acauguaguaaucugcuu

SEQ ID NO: 475994 - RNA, 17 nt, Chlamydia trachomatis
acauguccuaccaauau

SEQ ID NO: 475995 - RNA, 21 nt, Chlamydia trachomatis
acaugucgauuggaucagcuc

SEQ ID NO: 475996 - RNA, 16 nt, Chlamydia trachomatis
acauuucacuauccaa

SEQ ID NO: 475997 - RNA, 15 nt, Chlamydia trachomatis
accaaucaccgcugc

SEQ ID NO: 475998 - RNA, 12 nt, Chlamydia trachomatis
accaaucacgcu

SEQ ID NO: 475999 - RNA, 15 nt, Chlamydia trachomatis
accaauuguugagca

SEQ ID NO: 476000 - RNA, 19 nt, Chlamydia trachomatis
accaauuguugagcagcaa

SEQ ID NO: 476001 - RNA, 13 nt, Chlamydia trachomatis
accaauuucacca

SEQ ID NO: 476002 - RNA, 15 nt, Chlamydia trachomatis
accacaaaccauccu

SEQ ID NO: 476003 - RNA, 14 nt, Chlamydia trachomatis
accacauucucuuu

SEQ ID NO: 476004 - RNA, 17 nt, Chlamydia trachomatis
accacauucuuucugga

SEQ ID NO: 476005 - RNA, 21 nt, Chlamydia trachomatis
accaacgagugccgaauaaug

SEQ ID NO: 476006 - RNA, 15 nt, Chlamydia trachomatis
accaacugagcuauu

SEQ ID NO: 476007 - RNA, 19 nt, Chlamydia trachomatis
accaaggacggauguugau

SEQ ID NO: 476008 - RNA, 20 nt, Chlamydia trachomatis
accaaggauuuuuuucccac

SEQ ID NO: 476009 - RNA, 17 nt, Chlamydia trachomatis
accaagggaauaaaaac

SEQ ID NO: 476010 - RNA, 14 nt, Chlamydia trachomatis
accaagcugcaccc

SEQ ID NO: 476011 - RNA, 23 nt, Chlamydia trachomatis
accaagcuuagcagauaauucuc

SEQ ID NO: 476012 - RNA, 23 nt, Chlamydia trachomatis
accagaauauaagcacccuuucu

SEQ ID NO: 476013 - RNA, 14 nt, Chlamydia trachomatis
accacugauggcuu

SEQ ID NO: 476014 - RNA, 20 nt, Chlamydia trachomatis
accacuguauccaaaacaua

SEQ ID NO: 476015 - RNA, 14 nt, Chlamydia trachomatis
accacuuuucugua

SEQ ID NO: 476016 - RNA, 13 nt, Chlamydia trachomatis
accagaguuucau

SEQ ID NO: 476017 - RNA, 17 nt, Chlamydia trachomatis
accagguuuacggucac

SEQ ID NO: 476018 - RNA, 21 nt, Chlamydia trachomatis
accagguuuacggucacuccu

SEQ ID NO: 476019 - RNA, 22 nt, Chlamydia trachomatis
accaguugcuaaggagaauucu

SEQ ID NO: 476020 - RNA, 13 nt, Chlamydia trachomatis
accauaggaucug

SEQ ID NO: 476021 - RNA, 16 nt, Chlamydia trachomatis
accauuggaauuuuca

SEQ ID NO: 476022 - RNA, 21 nt, Chlamydia trachomatis
accauuggaauuuucaucaaa

SEQ ID NO: 476023 - RNA, 15 nt, Chlamydia trachomatis
accauccaauccugu

SEQ ID NO: 476024 - RNA, 16 nt, Chlamydia trachomatis
accauuacuacaacag

SEQ ID NO: 476025 - RNA, 23 nt, Chlamydia trachomatis
accauugugaacaauaauucagg

SEQ ID NO: 476026 - RNA, 18 nt, Chlamydia trachomatis
acccaaaugcggcccaca

SEQ ID NO: 476027 - RNA, 15 nt, Chlamydia trachomatis
acccaaucuucuaaa

SEQ ID NO: 476028 - RNA, 16 nt, Chlamydia trachomatis
accccaauguuuccca

SEQ ID NO: 476029 - RNA, 11 nt, Chlamydia trachomatis
accccucuuuc

SEQ ID NO: 476030 - RNA, 23 nt, Chlamydia trachomatis
accgauguauuuguaccaaccca

SEQ ID NO: 476031 - RNA, 17 nt, Chlamydia trachomatis
accgcaugaaaguagcu

SEQ ID NO: 476032 - RNA, 19 nt, Chlamydia trachomatis
accgccucaaacaaucuaa

SEQ ID NO: 476033 - RNA, 20 nt, Chlamydia trachomatis
accgcucuuccauaauuucu

SEQ ID NO: 476034 - RNA, 16 nt, Chlamydia trachomatis
accguagauccuuucg

SEQ ID NO: 476035 - RNA, 18 nt, Chlamydia trachomatis
accguagauccuuucggu

SEQ ID NO: 476036 - RNA, 18 nt, Chlamydia trachomatis
accgucaaaaagaucuuc

SEQ ID NO: 476037 - RNA, 13 nt, Chlamydia trachomatis
accuaagcgcaag

SEQ ID NO: 476038 - RNA, 15 nt, Chlamydia trachomatis
accguucuugacaaa

SEQ ID NO: 476039 - RNA, 23 nt, Chlamydia trachomatis
accuacaaagauaaucaaaccua

SEQ ID NO: 476040 - RNA, 18 nt, Chlamydia trachomatis
accuacacgauauaucca

SEQ ID NO: 476041 - RNA, 15 nt, Chlamydia trachomatis
accuaggagcauucc

SEQ ID NO: 476042 - RNA, 18 nt, Chlamydia trachomatis
accuaguaagugcauacc

SEQ ID NO: 476043 - RNA, 15 nt, Chlamydia trachomatis
accuagugauuuuaa

SEQ ID NO: 476044 - RNA, 19 nt, Chlamydia trachomatis
accuauuccaaauccuccu

SEQ ID NO: 476045 - RNA, 15 nt, Chlamydia trachomatis
accucuugaggaaga

SEQ ID NO: 476046 - RNA, 21 nt, Chlamydia trachomatis
accucuccauuuuccuguucc

SEQ ID NO: 476047 - RNA, 15 nt, Chlamydia trachomatis
accucuccuugaaca

SEQ ID NO: 476048 - RNA, 16 nt, Chlamydia trachomatis
accucugcaagaaaau

SEQ ID NO: 476049 - RNA, 18 nt, Chlamydia trachomatis
accucugcaagaaaauaa

SEQ ID NO: 476050 - RNA, 17 nt, Chlamydia trachomatis
accucuuuacgcacaaa

SEQ ID NO: 476051 - RNA, 20 nt, Chlamydia trachomatis
accucuuuacgcacaaagau

SEQ ID NO: 476052 - RNA, 15 nt, Chlamydia trachomatis
accucuuuuuuuccc

SEQ ID NO: 476053 - RNA, 22 nt, Chlamydia trachomatis
accucuuuuuuugcucaaugau

SEQ ID NO: 476054 - RNA, 12 nt, Chlamydia trachomatis
accugcaagaga

SEQ ID NO: 476055 - RNA, 22 nt, Chlamydia trachomatis
accugggaaaacuuucucgcaa

SEQ ID NO: 476056 - RNA, 16 nt, Chlamydia trachomatis
accuguaggaggacaa

SEQ ID NO: 476057 - RNA, 14 nt, Chlamydia trachomatis
accuguugcuuuuc

SEQ ID NO: 476058 - RNA, 21 nt, Chlamydia trachomatis
accuguuuaucuucaucagcu

SEQ ID NO: 476059 - RNA, 18 nt, Chlamydia trachomatis
accuguuucugaaucaaa

SEQ ID NO: 476060 - RNA, 22 nt, Chlamydia trachomatis
accuguuucugaaucaaacaga

SEQ ID NO: 476061 - RNA, 12 nt, Chlamydia trachomatis
accuuaaaagca

SEQ ID NO: 476062 - RNA, 18 nt, Chlamydia trachomatis
accuuaaaugcaguggaa

SEQ ID NO: 476063 - RNA, 23 nt, Chlamydia trachomatis
accuuaucuuggguaagaccaaa

SEQ ID NO: 476064 - RNA, 22 nt, Chlamydia trachomatis
accuuauuauuacgaacagcaa

SEQ ID NO: 476065 - RNA, 19 nt, Chlamydia trachomatis
accuuagcuccuaaucuuu

SEQ ID NO: 476066 - RNA, 15 nt, Chlamydia trachomatis
accuuaggaauaugu

SEQ ID NO: 476067 - RNA, 14 nt, Chlamydia trachomatis
accuucccgaagua

SEQ ID NO: 476068 - RNA, 12 nt, Chlamydia trachomatis
accuucucaaau

SEQ ID NO: 476069 - RNA, 11 nt, Chlamydia trachomatis
accuucuuaca

SEQ ID NO: 476070 - RNA, 13 nt, Chlamydia trachomatis
accuucuuacaua

SEQ ID NO: 476071 - RNA, 22 nt, Chlamydia trachomatis
accuugccaucauuaucuucuu

SEQ ID NO: 476072 - RNA, 17 nt, Chlamydia trachomatis
accuugaugaauuuuau

SEQ ID NO: 476073 - RNA, 22 nt, Chlamydia trachomatis
accuucuuugggauagauagcu

SEQ ID NO: 476074 - RNA, 13 nt, Chlamydia trachomatis
accuuuucccagu

SEQ ID NO: 476075 - RNA, 15 nt, Chlamydia trachomatis
accuuguuuuuuaag

SEQ ID NO: 476076 - RNA, 23 nt, Chlamydia trachomatis
accuuuaccaaagaauucuugcu

SEQ ID NO: 476077 - RNA, 21 nt, Chlamydia trachomatis
accuuucccucguaauaacug

SEQ ID NO: 476078 - RNA, 18 nt, Chlamydia trachomatis
acgaaaagacucucccuc

SEQ ID NO: 476079 - RNA, 17 nt, Chlamydia trachomatis
acgaaaaacagaaagaa

SEQ ID NO: 476080 - RNA, 16 nt, Chlamydia trachomatis
acgaaagcauccccaa

SEQ ID NO: 476081 - RNA, 19 nt, Chlamydia trachomatis
acgaaagcauccccaaaag

SEQ ID NO: 476082 - RNA, 23 nt, Chlamydia trachomatis
acgaaagauuugaucuucuggaa

SEQ ID NO: 476083 - RNA, 19 nt, Chlamydia trachomatis
acgaaauaggauuuguguu

SEQ ID NO: 476084 - RNA, 12 nt, Chlamydia trachomatis
acgaacaaaaag

SEQ ID NO: 476085 - RNA, 13 nt, Chlamydia trachomatis
acgaacaaaaagu

SEQ ID NO: 476086 - RNA, 14 nt, Chlamydia trachomatis
acgaacaagaugac

SEQ ID NO: 476087 - RNA, 12 nt, Chlamydia trachomatis
acgaagcaaaac

SEQ ID NO: 476088 - RNA, 18 nt, Chlamydia trachomatis
acgaacuuuccauagcau

SEQ ID NO: 476089 - RNA, 24 nt, Chlamydia trachomatis
acgaacuuuccauagcaugggcug

SEQ ID NO: 476090 - RNA, 17 nt, Chlamydia trachomatis
acgaagagcaaaaucau

SEQ ID NO: 476091 - RNA, 18 nt, Chlamydia trachomatis
acgaaugcguugcucuac

SEQ ID NO: 476092 - RNA, 17 nt, Chlamydia trachomatis
acgaaucgcaccauuua

SEQ ID NO: 476093 - RNA, 20 nt, Chlamydia trachomatis
acgaaguuagcauguucaga

SEQ ID NO: 476094 - RNA, 15 nt, Chlamydia trachomatis
acgaauaagcaucca

SEQ ID NO: 476095 - RNA, 13 nt, Chlamydia trachomatis
acgagaagucgug

SEQ ID NO: 476096 - RNA, 14 nt, Chlamydia trachomatis
acgagaucugcauc

SEQ ID NO: 476097 - RNA, 23 nt, Chlamydia trachomatis
acgaggcacaaaaucccuuccca

SEQ ID NO: 476098 - RNA, 13 nt, Chlamydia trachomatis
acgagcuagcucu

SEQ ID NO: 476099 - RNA, 18 nt, Chlamydia trachomatis
acgagugccgaaggggau

SEQ ID NO: 476100 - RNA, 18 nt, Chlamydia trachomatis
acgaguugaucuuccucu

SEQ ID NO: 476101 - RNA, 15 nt, Chlamydia trachomatis
acgauaaaagacaga

SEQ ID NO: 476102 - RNA, 20 nt, Chlamydia trachomatis
acgauaaaagacagaacaaa

SEQ ID NO: 476103 - RNA, 16 nt, Chlamydia trachomatis
acgauccgcuuccugc

SEQ ID NO: 476104 - RNA, 18 nt, Chlamydia trachomatis
acgauccgcuuccugcca

SEQ ID NO: 476105 - RNA, 24 nt, Chlamydia trachomatis
acgaucugcccuuuguacaugaua

SEQ ID NO: 476106 - RNA, 20 nt, Chlamydia trachomatis
acgauuuugucgauaagaag

SEQ ID NO: 476107 - RNA, 16 nt, Chlamydia trachomatis
acgauuaauaggccag

SEQ ID NO: 476108 - RNA, 18 nt, Chlamydia trachomatis
acgauuaucuaaagccau

SEQ ID NO: 476109 - RNA, 14 nt, Chlamydia trachomatis
acgcacaaagauuu

SEQ ID NO: 476110 - RNA, 18 nt, Chlamydia trachomatis
acgcaaguauuggagaca

SEQ ID NO: 476111 - RNA, 17 nt, Chlamydia trachomatis
acggaagugguuaaugu

SEQ ID NO: 476112 - RNA, 17 nt, Chlamydia trachomatis
acggaaguucuugcuug

SEQ ID NO: 476113 - RNA, 17 nt, Chlamydia trachomatis
acggaacucuacaaaau

SEQ ID NO: 476114 - RNA, 16 nt, Chlamydia trachomatis
acggaacucuuuauua

SEQ ID NO: 476115 - RNA, 16 nt, Chlamydia trachomatis
acggaauagccuccaa

SEQ ID NO: 476116 - RNA, 17 nt, Chlamydia trachomatis
acggaaucucgagcuaa

SEQ ID NO: 476117 - RNA, 15 nt, Chlamydia trachomatis
acggaauuuuucuca

SEQ ID NO: 476118 - RNA, 16 nt, Chlamydia trachomatis
acggaauuuuucucac

SEQ ID NO: 476119 - RNA, 14 nt, Chlamydia trachomatis
acggaaaaagaaga

SEQ ID NO: 476120 - RNA, 16 nt, Chlamydia trachomatis
acgcuguuccuuccuc

SEQ ID NO: 476121 - RNA, 22 nt, Chlamydia trachomatis
acggggcuagccguguucugaa

SEQ ID NO: 476122 - RNA, 15 nt, Chlamydia trachomatis
acgguguuagaaaau

SEQ ID NO: 476123 - RNA, 23 nt, Chlamydia trachomatis
acguacauaggcauacaggagag

SEQ ID NO: 476124 - RNA, 21 nt, Chlamydia trachomatis
acgucgaaaagcuucugccau

SEQ ID NO: 476125 - RNA, 23 nt, Chlamydia trachomatis
acguccgcuccuucuuucuggaa

SEQ ID NO: 476126 - RNA, 23 nt, Chlamydia trachomatis
acguuuaccgcucuuccauaauu

SEQ ID NO: 476127 - RNA, 21 nt, Chlamydia trachomatis
acguuucuguucaagagaggc

SEQ ID NO: 476128 - RNA, 17 nt, Chlamydia trachomatis
acguucaacauaugcuc

SEQ ID NO: 476129 - RNA, 14 nt, Chlamydia trachomatis
acguuggagaaaca

SEQ ID NO: 476130 - RNA, 15 nt, Chlamydia trachomatis
acguuuggaaauccu

SEQ ID NO: 476131 - RNA, 20 nt, Chlamydia trachomatis
acguuuuagaaugguucuua

SEQ ID NO: 476132 - RNA, 21 nt, Chlamydia trachomatis
acguuuuucguagacagagaa

SEQ ID NO: 476133 - RNA, 23 nt, Chlamydia trachomatis
acuaaaaguaguccuaucaccac

SEQ ID NO: 476134 - RNA, 13 nt, Chlamydia trachomatis
acuauuuucaaaa

SEQ ID NO: 476135 - RNA, 15 nt, Chlamydia trachomatis
acuauucgagaauga

SEQ ID NO: 476136 - RNA, 18 nt, Chlamydia trachomatis
acuauucgagaaugaaua

SEQ ID NO: 476137 - RNA, 14 nt, Chlamydia trachomatis
acuauugaucaaag

SEQ ID NO: 476138 - RNA, 17 nt, Chlamydia trachomatis
acuauugaauccagaau

SEQ ID NO: 476139 - RNA, 17 nt, Chlamydia trachomatis
acucaaagcuucccuuc

SEQ ID NO: 476140 - RNA, 18 nt, Chlamydia trachomatis
acucaaauuuucaugaaa

SEQ ID NO: 476141 - RNA, 17 nt, Chlamydia trachomatis
acuaucagaagauagua

SEQ ID NO: 476142 - RNA, 19 nt, Chlamydia trachomatis
acuaucauugagcaaaaaa

SEQ ID NO: 476143 - RNA, 20 nt, Chlamydia trachomatis
acuaucauugagcaaaaaaa

SEQ ID NO: 476144 - RNA, 23 nt, Chlamydia trachomatis
acuauccgaagcugcaauagaaa

SEQ ID NO: 476145 - RNA, 19 nt, Chlamydia trachomatis
acuaugcucacaaaccaaa

SEQ ID NO: 476146 - RNA, 13 nt, Chlamydia trachomatis
acuaccuagugau

SEQ ID NO: 476147 - RNA, 22 nt, Chlamydia trachomatis
acuaccccaccuauggcauuca

SEQ ID NO: 476148 - RNA, 22 nt, Chlamydia trachomatis
acuacccgauucaaaaaucgcu

SEQ ID NO: 476149 - RNA, 23 nt, Chlamydia trachomatis
acuacugucagaccuacaaagau

SEQ ID NO: 476150 - RNA, 18 nt, Chlamydia trachomatis
acuacuucaggaucuuca

SEQ ID NO: 476151 - RNA, 15 nt, Chlamydia trachomatis
acuaguuuacgcacu

SEQ ID NO: 476152 - RNA, 16 nt, Chlamydia trachomatis
acuaauucuaaugcuu

SEQ ID NO: 476153 - RNA, 15 nt, Chlamydia trachomatis
acuacagucuuccuc

SEQ ID NO: 476154 - RNA, 18 nt, Chlamydia trachomatis
acuacagucuuccucugc

SEQ ID NO: 476155 - RNA, 13 nt, Chlamydia trachomatis
acuacagucuucu

SEQ ID NO: 476156 - RNA, 14 nt, Chlamydia trachomatis
acuacauucuuuuu

SEQ ID NO: 476157 - RNA, 12 nt, Chlamydia trachomatis
acuccuucucug

SEQ ID NO: 476158 - RNA, 21 nt, Chlamydia trachomatis
acuccugcagcuaaagaaucu

SEQ ID NO: 476159 - RNA, 21 nt, Chlamydia trachomatis
acuccugaaaguuuuuucccc

SEQ ID NO: 476160 - RNA, 22 nt, Chlamydia trachomatis
acuccugaaaguuuuuuccccu

SEQ ID NO: 476161 - RNA, 14 nt, Chlamydia trachomatis
acuccucaagcgau

SEQ ID NO: 476162 - RNA, 19 nt, Chlamydia trachomatis
acuccuccuccuaaacaaa

SEQ ID NO: 476163 - RNA, 16 nt, Chlamydia trachomatis
acuccucgucgaagaa

SEQ ID NO: 476164 - RNA, 17 nt, Chlamydia trachomatis
acuccucgucgaagaaa

SEQ ID NO: 476165 - RNA, 22 nt, Chlamydia trachomatis
acucaacacgaacacuacuauc

SEQ ID NO: 476166 - RNA, 20 nt, Chlamydia trachomatis
acucaacgaaagcaucccca

SEQ ID NO: 476167 - RNA, 18 nt, Chlamydia trachomatis
acucaacuccagagcaaa

SEQ ID NO: 476168 - RNA, 19 nt, Chlamydia trachomatis
acucaacuccagagcaaau

SEQ ID NO: 476169 - RNA, 17 nt, Chlamydia trachomatis
acucaauccuuuaacua

SEQ ID NO: 476170 - RNA, 19 nt, Chlamydia trachomatis
acucuuuuucagacaaaaa

SEQ ID NO: 476171 - RNA, 19 nt, Chlamydia trachomatis
acucuuuguguaaagcgaa

SEQ ID NO: 476172 - RNA, 14 nt, Chlamydia trachomatis
acucugauuagaag

SEQ ID NO: 476173 - RNA, 17 nt, Chlamydia trachomatis
acucugcaaaaucuucc

SEQ ID NO: 476174 - RNA, 19 nt, Chlamydia trachomatis
acucugaacaacugcugau

SEQ ID NO: 476175 - RNA, 23 nt, Chlamydia trachomatis
acucuaucccgcgguagaaaguc

SEQ ID NO: 476176 - RNA, 19 nt, Chlamydia trachomatis
acucuaccauugugaacaa

SEQ ID NO: 476177 - RNA, 15 nt, Chlamydia trachomatis
acucggccagagcuc

SEQ ID NO: 476178 - RNA, 14 nt, Chlamydia trachomatis
acucggaaucucug

SEQ ID NO: 476179 - RNA, 13 nt, Chlamydia trachomatis
acucgcuccagaa

SEQ ID NO: 476180 - RNA, 15 nt, Chlamydia trachomatis
acugcaacaguaaau

SEQ ID NO: 476181 - RNA, 17 nt, Chlamydia trachomatis
acugaaaaucgcuauuu

SEQ ID NO: 476182 - RNA, 22 nt, Chlamydia trachomatis
acugagauguuuacgaggaggu

SEQ ID NO: 476183 - RNA, 23 nt, Chlamydia trachomatis
acugagcuauuuaggcuaacucc

SEQ ID NO: 476184 - RNA, 17 nt, Chlamydia trachomatis
acugcaucauguugcgu

SEQ ID NO: 476185 - RNA, 22 nt, Chlamydia trachomatis
acugcauaguccaugugagaac

SEQ ID NO: 476186 - RNA, 14 nt, Chlamydia trachomatis
acugccgaacugcu

SEQ ID NO: 476187 - RNA, 15 nt, Chlamydia trachomatis
acugcgcuaugagga

SEQ ID NO: 476188 - RNA, 13 nt, Chlamydia trachomatis
acugcucaaggaa

SEQ ID NO: 476189 - RNA, 19 nt, Chlamydia trachomatis
acugcggcagcugcuugga

SEQ ID NO: 476190 - RNA, 15 nt, Chlamydia trachomatis
acugcguauuugaaa

SEQ ID NO: 476191 - RNA, 13 nt, Chlamydia trachomatis
acugcugcuauca

SEQ ID NO: 476192 - RNA, 16 nt, Chlamydia trachomatis
acugcugcuaucaucu

SEQ ID NO: 476193 - RNA, 12 nt, Chlamydia trachomatis
acugcugauaaa

SEQ ID NO: 476194 - RNA, 20 nt, Chlamydia trachomatis
acugcuccuaacccuuguac

SEQ ID NO: 476195 - RNA, 13 nt, Chlamydia trachomatis
acugcucugccau

SEQ ID NO: 476196 - RNA, 21 nt, Chlamydia trachomatis
acugcuucccuccuagaaaga

SEQ ID NO: 476197 - RNA, 21 nt, Chlamydia trachomatis
acugcuuccgaaagcauguuu

SEQ ID NO: 476198 - RNA, 22 nt, Chlamydia trachomatis
acuggaauagcuagagcaugca

SEQ ID NO: 476199 - RNA, 17 nt, Chlamydia trachomatis
acuggaguuuuccugaa

SEQ ID NO: 476200 - RNA, 17 nt, Chlamydia trachomatis
acuggcauagucuugau

SEQ ID NO: 476201 - RNA, 21 nt, Chlamydia trachomatis
acugguauucugcagaaaaau

SEQ ID NO: 476202 - RNA, 16 nt, Chlamydia trachomatis
acugguguggguaaga

SEQ ID NO: 476203 - RNA, 13 nt, Chlamydia trachomatis
acugggauaagaa

SEQ ID NO: 476204 - RNA, 14 nt, Chlamydia trachomatis
acuguugagaaaaa

SEQ ID NO: 476205 - RNA, 17 nt, Chlamydia trachomatis
acuuaacgugucgaaaa

SEQ ID NO: 476206 - RNA, 17 nt, Chlamydia trachomatis
acuguucauucucagga

SEQ ID NO: 476207 - RNA, 14 nt, Chlamydia trachomatis
acugucgaacgcuu

SEQ ID NO: 476208 - RNA, 23 nt, Chlamydia trachomatis
acugucgaacgcuucuucccaac

SEQ ID NO: 476209 - RNA, 22 nt, Chlamydia trachomatis
acuucaaucacuccuccuccua

SEQ ID NO: 476210 - RNA, 19 nt, Chlamydia trachomatis
acuuccguaccaaggauuu

SEQ ID NO: 476211 - RNA, 20 nt, Chlamydia trachomatis
acuuccucuggcuuaucaac

SEQ ID NO: 476212 - RNA, 16 nt, Chlamydia trachomatis
acuuccccauucuucu

SEQ ID NO: 476213 - RNA, 17 nt, Chlamydia trachomatis
acuuccccauucuucuc

SEQ ID NO: 476214 - RNA, 14 nt, Chlamydia trachomatis
acuucccacauacu

SEQ ID NO: 476215 - RNA, 20 nt, Chlamydia trachomatis
acuucccacauacuuggauc

SEQ ID NO: 476216 - RNA, 13 nt, Chlamydia trachomatis
acuuuucuagcag

SEQ ID NO: 476217 - RNA, 14 nt, Chlamydia trachomatis
acuuuuucuacuuu

SEQ ID NO: 476218 - RNA, 21 nt, Chlamydia trachomatis
agaaaaaggucucccaagaaa

SEQ ID NO: 476219 - RNA, 18 nt, Chlamydia trachomatis
agaaacguguaauuuccu

SEQ ID NO: 476220 - RNA, 15 nt, Chlamydia trachomatis
agaaaauuucucuuc

SEQ ID NO: 476221 - RNA, 15 nt, Chlamydia trachomatis
agaaaccgaaaaaaa

SEQ ID NO: 476222 - RNA, 19 nt, Chlamydia trachomatis
agaaaaucagaaagcucug

SEQ ID NO: 476223 - RNA, 9 nt, Chlamydia trachomatis
agaaaaucu

SEQ ID NO: 476224 - RNA, 17 nt, Chlamydia trachomatis
agaaaaugaugaaaaag

SEQ ID NO: 476225 - RNA, 16 nt, Chlamydia trachomatis
agaaaauggcugcuug

SEQ ID NO: 476226 - RNA, 13 nt, Chlamydia trachomatis
agaaaauucuucu

SEQ ID NO: 476227 - RNA, 14 nt, Chlamydia trachomatis
agaaaauuucucuu

SEQ ID NO: 476228 - RNA, 21 nt, Chlamydia trachomatis
agaaacuaaacgaugauagag

SEQ ID NO: 476229 - RNA, 12 nt, Chlamydia trachomatis
agaaacugaaag

SEQ ID NO: 476230 - RNA, 19 nt, Chlamydia trachomatis
agaaacuguaauguccucu

SEQ ID NO: 476231 - RNA, 22 nt, Chlamydia trachomatis
agaaacuguaauguccucuuua

SEQ ID NO: 476232 - RNA, 19 nt, Chlamydia trachomatis
agaaacuguccuuuauuca

SEQ ID NO: 476233 - RNA, 16 nt, Chlamydia trachomatis
agaaacuuacuuuucu

SEQ ID NO: 476234 - RNA, 18 nt, Chlamydia trachomatis
agaaacuuacuuuucuua

SEQ ID NO: 476235 - RNA, 16 nt, Chlamydia trachomatis
agaaacuucaguuugu

SEQ ID NO: 476236 - RNA, 19 nt, Chlamydia trachomatis
agaaagccguucccaauaa

SEQ ID NO: 476237 - RNA, 22 nt, Chlamydia trachomatis
agaaagcucgaauacgaggagc

SEQ ID NO: 476238 - RNA, 23 nt, Chlamydia trachomatis
agaaagcuuauaacuaagaucuc

SEQ ID NO: 476239 - RNA, 17 nt, Chlamydia trachomatis
agaaagggcuuuauacu

SEQ ID NO: 476240 - RNA, 14 nt, Chlamydia trachomatis
agaacaagauaaag

SEQ ID NO: 476241 - RNA, 14 nt, Chlamydia trachomatis
agaacaagugcagc

SEQ ID NO: 476242 - RNA, 13 nt, Chlamydia trachomatis
agaaauuuuaaau

SEQ ID NO: 476243 - RNA, 18 nt, Chlamydia trachomatis
agaacaaacgaaggagcu

SEQ ID NO: 476244 - RNA, 13 nt, Chlamydia trachomatis
agaaaguccugcu

SEQ ID NO: 476245 - RNA, 22 nt, Chlamydia trachomatis
agaaauugauagugaaauaagu

SEQ ID NO: 476246 - RNA, 23 nt, Chlamydia trachomatis
agaaauugauagugaaauaaguc

SEQ ID NO: 476247 - RNA, 14 nt, Chlamydia trachomatis
agaaccaaugaaac

SEQ ID NO: 476248 - RNA, 16 nt, Chlamydia trachomatis
agaaccacaaaaucag

SEQ ID NO: 476249 - RNA, 15 nt, Chlamydia trachomatis
agaaccacuuuucug

SEQ ID NO: 476250 - RNA, 20 nt, Chlamydia trachomatis
agaacaucucggucuuagaa

SEQ ID NO: 476251 - RNA, 21 nt, Chlamydia trachomatis
agaacauuucucgucagggga

SEQ ID NO: 476252 - RNA, 18 nt, Chlamydia trachomatis
agaacaucaacagaagaa

SEQ ID NO: 476253 - RNA, 16 nt, Chlamydia trachomatis
agaacauaacaaggcu

SEQ ID NO: 476254 - RNA, 13 nt, Chlamydia trachomatis
agaacauaacaca

SEQ ID NO: 476255 - RNA, 23 nt, Chlamydia trachomatis
agaacagcucuagcuaaacccaa

SEQ ID NO: 476256 - RNA, 20 nt, Chlamydia trachomatis
agaaccgaauuuguagaucu

SEQ ID NO: 476257 - RNA, 16 nt, Chlamydia trachomatis
agaaccucaauagcug

SEQ ID NO: 476258 - RNA, 21 nt, Chlamydia trachomatis
agaaccuccauaagaaauuaa

SEQ ID NO: 476259 - RNA, 22 nt, Chlamydia trachomatis
agaacgauuuugucgauaagaa

SEQ ID NO: 476260 - RNA, 14 nt, Chlamydia trachomatis
agaacucaaaagcu

SEQ ID NO: 476261 - RNA, 15 nt, Chlamydia trachomatis
agaacucaaaagcuu

SEQ ID NO: 476262 - RNA, 18 nt, Chlamydia trachomatis
agaacucccuccaaaaaa

SEQ ID NO: 476263 - RNA, 19 nt, Chlamydia trachomatis
agaacucccuccaaaaaag

SEQ ID NO: 476264 - RNA, 22 nt, Chlamydia trachomatis
agaacucccuccaaaaaagagg

SEQ ID NO: 476265 - RNA, 12 nt, Chlamydia trachomatis
agaacucuuucc

SEQ ID NO: 476266 - RNA, 12 nt, Chlamydia trachomatis
agaacugcagug

SEQ ID NO: 476267 - RNA, 16 nt, Chlamydia trachomatis
agaacugcagugacau

SEQ ID NO: 476268 - RNA, 16 nt, Chlamydia trachomatis
agaacuucuccuggaa

SEQ ID NO: 476269 - RNA, 17 nt, Chlamydia trachomatis
agaagaaggaagaggag

SEQ ID NO: 476270 - RNA, 15 nt, Chlamydia trachomatis
agaagaacucuucua

SEQ ID NO: 476271 - RNA, 15 nt, Chlamydia trachomatis
agaagaacugcagug

SEQ ID NO: 476272 - RNA, 18 nt, Chlamydia trachomatis
agaagaacugcagugaca

SEQ ID NO: 476273 - RNA, 13 nt, Chlamydia trachomatis
agaagaagaacug

SEQ ID NO: 476274 - RNA, 15 nt, Chlamydia trachomatis
agaagaagaacugca

SEQ ID NO: 476275 - RNA, 15 nt, Chlamydia trachomatis
agaagaagagagaag

SEQ ID NO: 476276 - RNA, 11 nt, Chlamydia trachomatis
agaagaagagc

SEQ ID NO: 476277 - RNA, 13 nt, Chlamydia trachomatis
agaagaagaggag

SEQ ID NO: 476278 - RNA, 23 nt, Chlamydia trachomatis
agaacuuugugcagcacugagau

SEQ ID NO: 476279 - RNA, 15 nt, Chlamydia trachomatis
agaagaaucuucuuc

SEQ ID NO: 476280 - RNA, 20 nt, Chlamydia trachomatis
agaagaaucuucuucgaaau

SEQ ID NO: 476281 - RNA, 16 nt, Chlamydia trachomatis
agaagccaauguucua

SEQ ID NO: 476282 - RNA, 19 nt, Chlamydia trachomatis
agaagguugugaagaacug

SEQ ID NO: 476283 - RNA, 15 nt, Chlamydia trachomatis
agaaguaaaacagaa

SEQ ID NO: 476284 - RNA, 15 nt, Chlamydia trachomatis
agaaguagucuacuc

SEQ ID NO: 476285 - RNA, 19 nt, Chlamydia trachomatis
agaaguaucuaacaauacu

SEQ ID NO: 476286 - RNA, 15 nt, Chlamydia trachomatis
agaaguccuggaggg

SEQ ID NO: 476287 - RNA, 16 nt, Chlamydia trachomatis
agaaguccuucuccac

SEQ ID NO: 476288 - RNA, 23 nt, Chlamydia trachomatis
agaagucuaccguauuaucugca

SEQ ID NO: 476289 - RNA, 13 nt, Chlamydia trachomatis
agaauacaaagca

SEQ ID NO: 476290 - RNA, 12 nt, Chlamydia trachomatis
agaauacaagaa

SEQ ID NO: 476291 - RNA, 15 nt, Chlamydia trachomatis
agaauacaagaaagg

SEQ ID NO: 476292 - RNA, 17 nt, Chlamydia trachomatis
agaauaccaaaauccuu

SEQ ID NO: 476293 - RNA, 12 nt, Chlamydia trachomatis
agaauaccaacu

SEQ ID NO: 476294 - RNA, 12 nt, Chlamydia trachomatis
agaauaccacca

SEQ ID NO: 476295 - RNA, 21 nt, Chlamydia trachomatis
agaagcuaugagaauuuccag

SEQ ID NO: 476296 - RNA, 22 nt, Chlamydia trachomatis
agaagcuccuuuaccuuucacu

SEQ ID NO: 476297 - RNA, 13 nt, Chlamydia trachomatis
agaagcugcaguu

SEQ ID NO: 476298 - RNA, 22 nt, Chlamydia trachomatis
agaagguauuuuagagaaaaga

SEQ ID NO: 476299 - RNA, 14 nt, Chlamydia trachomatis
agaauggaucuccc

SEQ ID NO: 476300 - RNA, 17 nt, Chlamydia trachomatis
agaauggccuguuucau

SEQ ID NO: 476301 - RNA, 18 nt, Chlamydia trachomatis
agaaugguucuuagcgcu

SEQ ID NO: 476302 - RNA, 22 nt, Chlamydia trachomatis
agaaugguccaugauuucuuua

SEQ ID NO: 476303 - RNA, 23 nt, Chlamydia trachomatis
agaauuauuugccucuauguucu

SEQ ID NO: 476304 - RNA, 11 nt, Chlamydia trachomatis
agaaucugcuc

SEQ ID NO: 476305 - RNA, 20 nt, Chlamydia trachomatis
agaaucugcucacuaucugu

SEQ ID NO: 476306 - RNA, 18 nt, Chlamydia trachomatis
agaaucuguuuugauuac

SEQ ID NO: 476307 - RNA, 24 nt, Chlamydia trachomatis
agaaucuuuggaagcagaaagaau

SEQ ID NO: 476308 - RNA, 13 nt, Chlamydia trachomatis
agaaucaaaaagu

SEQ ID NO: 476309 - RNA, 15 nt, Chlamydia trachomatis
agaaucaaaaaguuc

SEQ ID NO: 476310 - RNA, 23 nt, Chlamydia trachomatis
agaaucaaaacgcucagaaaacu

SEQ ID NO: 476311 - RNA, 16 nt, Chlamydia trachomatis
agaaucuaaaaagcca

SEQ ID NO: 476312 - RNA, 16 nt, Chlamydia trachomatis
agacauaaaagcugua

SEQ ID NO: 476313 - RNA, 17 nt, Chlamydia trachomatis
agaauuucuuccucuaa

SEQ ID NO: 476314 - RNA, 16 nt, Chlamydia trachomatis
agacaagcacguggcc

SEQ ID NO: 476315 - RNA, 15 nt, Chlamydia trachomatis
agacaagccuucagg

SEQ ID NO: 476316 - RNA, 16 nt, Chlamydia trachomatis
agacacuauuaaaaag

SEQ ID NO: 476317 - RNA, 17 nt, Chlamydia trachomatis
agacacuauuaaaaagg

SEQ ID NO: 476318 - RNA, 19 nt, Chlamydia trachomatis
agacacuauuaaaaaggcu

SEQ ID NO: 476319 - RNA, 23 nt, Chlamydia trachomatis
agacccaguaguuuacugggccu

SEQ ID NO: 476320 - RNA, 13 nt, Chlamydia trachomatis
agaccaggauucc

SEQ ID NO: 476321 - RNA, 14 nt, Chlamydia trachomatis
agaccauaguugca

SEQ ID NO: 476322 - RNA, 17 nt, Chlamydia trachomatis
agaccauaguugcaggc

SEQ ID NO: 476323 - RNA, 15 nt, Chlamydia trachomatis
agaccuacaaagaua

SEQ ID NO: 476324 - RNA, 19 nt, Chlamydia trachomatis
agaccuaguaagugcauac

SEQ ID NO: 476325 - RNA, 18 nt, Chlamydia trachomatis
agaccucuccauccugcg

SEQ ID NO: 476326 - RNA, 15 nt, Chlamydia trachomatis
agacggucuacaaau

SEQ ID NO: 476327 - RNA, 16 nt, Chlamydia trachomatis
agacguucuugcugag

SEQ ID NO: 476328 - RNA, 17 nt, Chlamydia trachomatis
agacguucuugcugaga

SEQ ID NO: 476329 - RNA, 15 nt, Chlamydia trachomatis
agagauuuccucuuc

SEQ ID NO: 476330 - RNA, 18 nt, Chlamydia trachomatis
agagauuuccucuucuag

SEQ ID NO: 476331 - RNA, 22 nt, Chlamydia trachomatis
agagauuccacuaccccaccua

SEQ ID NO: 476332 - RNA, 21 nt, Chlamydia trachomatis
agagauuuuuugagcaaaaua

SEQ ID NO: 476333 - RNA, 20 nt, Chlamydia trachomatis
agagauaaagcuuuuucuac

SEQ ID NO: 476334 - RNA, 19 nt, Chlamydia trachomatis
agagauaucacuaccagcc

SEQ ID NO: 476335 - RNA, 18 nt, Chlamydia trachomatis
agagauaucccuaaagag

SEQ ID NO: 476336 - RNA, 13 nt, Chlamydia trachomatis
agagaucccaggg

SEQ ID NO: 476337 - RNA, 15 nt, Chlamydia trachomatis
agagaucguacaaug

SEQ ID NO: 476338 - RNA, 18 nt, Chlamydia trachomatis
agagaucuaugaaaaaag

SEQ ID NO: 476339 - RNA, 13 nt, Chlamydia trachomatis
agagaucucucca

SEQ ID NO: 476340 - RNA, 22 nt, Chlamydia trachomatis
agagaucugcauuccaggacga

SEQ ID NO: 476341 - RNA, 15 nt, Chlamydia trachomatis
agagaugaaccauuu

SEQ ID NO: 476342 - RNA, 20 nt, Chlamydia trachomatis
agacuaaucuuccagcguug

SEQ ID NO: 476343 - RNA, 16 nt, Chlamydia trachomatis
agacuauuucuucuag

SEQ ID NO: 476344 - RNA, 23 nt, Chlamydia trachomatis
agacuauuucuucuagauagaga

SEQ ID NO: 476345 - RNA, 17 nt, Chlamydia trachomatis
agacucaaagcuucccu

SEQ ID NO: 476346 - RNA, 15 nt, Chlamydia trachomatis
agacucacagcaaau

SEQ ID NO: 476347 - RNA, 21 nt, Chlamydia trachomatis
agacucacagcaaauaaagag

SEQ ID NO: 476348 - RNA, 19 nt, Chlamydia trachomatis
agagagccccaccagagau

SEQ ID NO: 476349 - RNA, 23 nt, Chlamydia trachomatis
agagagccccaccagagauaaag

SEQ ID NO: 476350 - RNA, 19 nt, Chlamydia trachomatis
agagagccuugagugaaaa

SEQ ID NO: 476351 - RNA, 20 nt, Chlamydia trachomatis
agagagcgggcgguaaaagg

SEQ ID NO: 476352 - RNA, 21 nt, Chlamydia trachomatis
agagagcgguugcacaaaucc

SEQ ID NO: 476353 - RNA, 22 nt, Chlamydia trachomatis
agagagcguccucggauguaag

SEQ ID NO: 476354 - RNA, 15 nt, Chlamydia trachomatis
agagaggcugcauua

SEQ ID NO: 476355 - RNA, 19 nt, Chlamydia trachomatis
agagaggcugcauuacucg

SEQ ID NO: 476356 - RNA, 16 nt, Chlamydia trachomatis
agagaggcuguaacua

SEQ ID NO: 476357 - RNA, 19 nt, Chlamydia trachomatis
agagagcuuugaucuuugu

SEQ ID NO: 476358 - RNA, 14 nt, Chlamydia trachomatis
agagaggagaaaaa

SEQ ID NO: 476359 - RNA, 20 nt, Chlamydia trachomatis
agaggguguugaauauuucc

SEQ ID NO: 476360 - RNA, 21 nt, Chlamydia trachomatis
agaggguguugaauauuuccc

SEQ ID NO: 476361 - RNA, 12 nt, Chlamydia trachomatis
agaggguuucuu

SEQ ID NO: 476362 - RNA, 21 nt, Chlamydia trachomatis
agaggguuucuucuuuugaga

SEQ ID NO: 476363 - RNA, 21 nt, Chlamydia trachomatis
agagguaaucguauaaguuuu

SEQ ID NO: 476364 - RNA, 21 nt, Chlamydia trachomatis
agagguagccaaagaauuuuu

SEQ ID NO: 476365 - RNA, 21 nt, Chlamydia trachomatis
agagguauuuuauucaaaucu

SEQ ID NO: 476366 - RNA, 16 nt, Chlamydia trachomatis
agagguccagucuaca

SEQ ID NO: 476367 - RNA, 18 nt, Chlamydia trachomatis
agagguauguuuggauug

SEQ ID NO: 476368 - RNA, 13 nt, Chlamydia trachomatis
agaggucuuauua

SEQ ID NO: 476369 - RNA, 19 nt, Chlamydia trachomatis
agaggucuuauuaaaagac

SEQ ID NO: 476370 - RNA, 21 nt, Chlamydia trachomatis
agagucucgaaggaauaccca

SEQ ID NO: 476371 - RNA, 22 nt, Chlamydia trachomatis
agagucucuaacaacaguucuu

SEQ ID NO: 476372 - RNA, 20 nt, Chlamydia trachomatis
agagucuccgcuuaaaacua

SEQ ID NO: 476373 - RNA, 17 nt, Chlamydia trachomatis
agagucugcuacaaacu

SEQ ID NO: 476374 - RNA, 12 nt, Chlamydia trachomatis
agagccuugagu

SEQ ID NO: 476375 - RNA, 13 nt, Chlamydia trachomatis
agagcaaucucuu

SEQ ID NO: 476376 - RNA, 19 nt, Chlamydia trachomatis
agagcacaaaucuuucuuu

SEQ ID NO: 476377 - RNA, 21 nt, Chlamydia trachomatis
agagccuaugcgugucacaga

SEQ ID NO: 476378 - RNA, 19 nt, Chlamydia trachomatis
agagcuucuuuuucaagag

SEQ ID NO: 476379 - RNA, 14 nt, Chlamydia trachomatis
agagcuucuucuaa

SEQ ID NO: 476380 - RNA, 19 nt, Chlamydia trachomatis
agagcuucuucuaaagaau

SEQ ID NO: 476381 - RNA, 22 nt, Chlamydia trachomatis
agagcuuugaucuuuguucucu

SEQ ID NO: 476382 - RNA, 13 nt, Chlamydia trachomatis
agagcuuuucuuc

SEQ ID NO: 476383 - RNA, 21 nt, Chlamydia trachomatis
agagcuuuucuucccugagaa

SEQ ID NO: 476384 - RNA, 20 nt, Chlamydia trachomatis
agagcuguuguuaauaucag

SEQ ID NO: 476385 - RNA, 16 nt, Chlamydia trachomatis
agagcuuccacagcag

SEQ ID NO: 476386 - RNA, 13 nt, Chlamydia trachomatis
agaguucucugag

SEQ ID NO: 476387 - RNA, 22 nt, Chlamydia trachomatis
agaguucucugagggugagguc

SEQ ID NO: 476388 - RNA, 18 nt, Chlamydia trachomatis
agaguucguuaggauucg

SEQ ID NO: 476389 - RNA, 23 nt, Chlamydia trachomatis
agaguuucuuuguucacagaaag

SEQ ID NO: 476390 - RNA, 19 nt, Chlamydia trachomatis
agaguuuguagauguagca

SEQ ID NO: 476391 - RNA, 19 nt, Chlamydia trachomatis
agauacaaggcuccuuuuc

SEQ ID NO: 476392 - RNA, 23 nt, Chlamydia trachomatis
agauacagaaucuguuuugauua

SEQ ID NO: 476393 - RNA, 18 nt, Chlamydia trachomatis
agauacagacaucuaaag

SEQ ID NO: 476394 - RNA, 22 nt, Chlamydia trachomatis
agauacaguaaggcucucgcag

SEQ ID NO: 476395 - RNA, 18 nt, Chlamydia trachomatis
agauagcuucuuaaauau

SEQ ID NO: 476396 - RNA, 20 nt, Chlamydia trachomatis
agauagcuucuuaaauauau

SEQ ID NO: 476397 - RNA, 16 nt, Chlamydia trachomatis
agauacuaacaaauag

SEQ ID NO: 476398 - RNA, 19 nt, Chlamydia trachomatis
agauacugguaacugugga

SEQ ID NO: 476399 - RNA, 14 nt, Chlamydia trachomatis
agauagaagagcuu

SEQ ID NO: 476400 - RNA, 13 nt, Chlamydia trachomatis
agauaucuuuacu

SEQ ID NO: 476401 - RNA, 20 nt, Chlamydia trachomatis
agauaugaguggcaaggggg

SEQ ID NO: 476402 - RNA, 19 nt, Chlamydia trachomatis
agauauucaggucauucgu

SEQ ID NO: 476403 - RNA, 17 nt, Chlamydia trachomatis
agauauaaacaauaaga

SEQ ID NO: 476404 - RNA, 18 nt, Chlamydia trachomatis
agauauaaacaauaagaa

SEQ ID NO: 476405 - RNA, 20 nt, Chlamydia trachomatis
agauauaaucuaaagacaaa

SEQ ID NO: 476406 - RNA, 23 nt, Chlamydia trachomatis
agauauagccacgauaagaucuu

SEQ ID NO: 476407 - RNA, 18 nt, Chlamydia trachomatis
agaucaagaaaagauagu

SEQ ID NO: 476408 - RNA, 21 nt, Chlamydia trachomatis
agauauugucuacuuuuuguu

SEQ ID NO: 476409 - RNA, 22 nt, Chlamydia trachomatis
agaucauaggcuccugcaaggg

SEQ ID NO: 476410 - RNA, 13 nt, Chlamydia trachomatis
agaucccaaaaga

SEQ ID NO: 476411 - RNA, 19 nt, Chlamydia trachomatis
agaucccagaauaaaggau

SEQ ID NO: 476412 - RNA, 19 nt, Chlamydia trachomatis
agaucccagggagagagag

SEQ ID NO: 476413 - RNA, 23 nt, Chlamydia trachomatis
agauccggauaugcaaguaauga

SEQ ID NO: 476414 - RNA, 17 nt, Chlamydia trachomatis
agaucccugucauacca

SEQ ID NO: 476415 - RNA, 22 nt, Chlamydia trachomatis
agauccguuuuucuacaacuau

SEQ ID NO: 476416 - RNA, 15 nt, Chlamydia trachomatis
agaucguugcuucca

SEQ ID NO: 476417 - RNA, 20 nt, Chlamydia trachomatis
agaucuaaagcagaaacaau

SEQ ID NO: 476418 - RNA, 16 nt, Chlamydia trachomatis
agaucuaugaaaaaag

SEQ ID NO: 476419 - RNA, 19 nt, Chlamydia trachomatis
agaucuaaggaauguggag

SEQ ID NO: 476420 - RNA, 15 nt, Chlamydia trachomatis
agaucucaucaggau

SEQ ID NO: 476421 - RNA, 14 nt, Chlamydia trachomatis
agaucuccuucuca

SEQ ID NO: 476422 - RNA, 23 nt, Chlamydia trachomatis
agauccuucgcaggggaauacag

SEQ ID NO: 476423 - RNA, 14 nt, Chlamydia trachomatis
agaucgaauaguag

SEQ ID NO: 476424 - RNA, 16 nt, Chlamydia trachomatis
agaucugguccuccag

SEQ ID NO: 476425 - RNA, 20 nt, Chlamydia trachomatis
agaucuguaacuacaucuaa

SEQ ID NO: 476426 - RNA, 16 nt, Chlamydia trachomatis
agaucuguagcaagaa

SEQ ID NO: 476427 - RNA, 13 nt, Chlamydia trachomatis
agaucuucaacaa

SEQ ID NO: 476428 - RNA, 20 nt, Chlamydia trachomatis
agaucuucagaaaucuucuu

SEQ ID NO: 476429 - RNA, 21 nt, Chlamydia trachomatis
agaucuugaucugaaaagaga

SEQ ID NO: 476430 - RNA, 16 nt, Chlamydia trachomatis
agaucuuuacuuucuu

SEQ ID NO: 476431 - RNA, 21 nt, Chlamydia trachomatis
agaucucuuucucuagaauuu

SEQ ID NO: 476432 - RNA, 15 nt, Chlamydia trachomatis
agaucuuucuacauu

SEQ ID NO: 476433 - RNA, 21 nt, Chlamydia trachomatis
agaucuuucuacauuuugcug

SEQ ID NO: 476434 - RNA, 16 nt, Chlamydia trachomatis
agaucuuuucgucuuc

SEQ ID NO: 476435 - RNA, 16 nt, Chlamydia trachomatis
agaucuuuuucauuuu

SEQ ID NO: 476436 - RNA, 18 nt, Chlamydia trachomatis
agaucuuuuucauuuuau

SEQ ID NO: 476437 - RNA, 15 nt, Chlamydia trachomatis
agaugaauugaauac

SEQ ID NO: 476438 - RNA, 16 nt, Chlamydia trachomatis
agaugaauugaauaca

SEQ ID NO: 476439 - RNA, 22 nt, Chlamydia trachomatis
agaugacuuuggcaugcccuaa

SEQ ID NO: 476440 - RNA, 23 nt, Chlamydia trachomatis
agaugacucaaacugugaagaau

SEQ ID NO: 476441 - RNA, 13 nt, Chlamydia trachomatis
agaugaucccauc

SEQ ID NO: 476442 - RNA, 20 nt, Chlamydia trachomatis
agaugauugaaguucuuuuu

SEQ ID NO: 476443 - RNA, 21 nt, Chlamydia trachomatis
agaugauuguuuugauuucau

SEQ ID NO: 476444 - RNA, 19 nt, Chlamydia trachomatis
agaugcuccucucuuuggu

SEQ ID NO: 476445 - RNA, 13 nt, Chlamydia trachomatis
agauguugugggu

SEQ ID NO: 476446 - RNA, 23 nt, Chlamydia trachomatis
agauguuguuaaagcuuuuucca

SEQ ID NO: 476447 - RNA, 19 nt, Chlamydia trachomatis
agauguuuguguuucuaaa

SEQ ID NO: 476448 - RNA, 20 nt, Chlamydia trachomatis
agauucacgaguuuuaggau

SEQ ID NO: 476449 - RNA, 19 nt, Chlamydia trachomatis
agauuccacuaccccaccu

SEQ ID NO: 476450 - RNA, 14 nt, Chlamydia trachomatis
agauucccuuuaaa

SEQ ID NO: 476451 - RNA, 15 nt, Chlamydia trachomatis
agauugccuuuucua

SEQ ID NO: 476452 - RNA, 19 nt, Chlamydia trachomatis
agauucuuugguaauagca

SEQ ID NO: 476453 - RNA, 14 nt, Chlamydia trachomatis
agauucgaauaauc

SEQ ID NO: 476454 - RNA, 17 nt, Chlamydia trachomatis
agauucgcugcugucuu

SEQ ID NO: 476455 - RNA, 14 nt, Chlamydia trachomatis
agcggacauuucac

SEQ ID NO: 476456 - RNA, 18 nt, Chlamydia trachomatis
agcgucuaacuaaauguc

SEQ ID NO: 476457 - RNA, 14 nt, Chlamydia trachomatis
agcgucuccaaaua

SEQ ID NO: 476458 - RNA, 16 nt, Chlamydia trachomatis
agcgucuccaaauaau

SEQ ID NO: 476459 - RNA, 14 nt, Chlamydia trachomatis
agcgggcgguaaaa

SEQ ID NO: 476460 - RNA, 20 nt, Chlamydia trachomatis
agcgugugaccaucuucacc

SEQ ID NO: 476461 - RNA, 21 nt, Chlamydia trachomatis
agcgugucuaccaauuucacc

SEQ ID NO: 476462 - RNA, 21 nt, Chlamydia trachomatis
agcuaacagcucuucuucuga

SEQ ID NO: 476463 - RNA, 22 nt, Chlamydia trachomatis
agcuaacagcucuucuucugaa

SEQ ID NO: 476464 - RNA, 19 nt, Chlamydia trachomatis
agcuaaccaugcuccuuuc

SEQ ID NO: 476465 - RNA, 19 nt, Chlamydia trachomatis
agcuaagaaaauaaacaca

SEQ ID NO: 476466 - RNA, 22 nt, Chlamydia trachomatis
agcuaagaaaauaaacacaagu

SEQ ID NO: 476467 - RNA, 23 nt, Chlamydia trachomatis
agcuaaggauugugcuuuuaucu

SEQ ID NO: 476468 - RNA, 22 nt, Chlamydia trachomatis
agcuaagggcuguguagcaaau

SEQ ID NO: 476469 - RNA, 20 nt, Chlamydia trachomatis
agcuaagguaacaaucacag

SEQ ID NO: 476470 - RNA, 13 nt, Chlamydia trachomatis
agcuaauaacccg

SEQ ID NO: 476471 - RNA, 14 nt, Chlamydia trachomatis
agcuaauaucucag

SEQ ID NO: 476472 - RNA, 22 nt, Chlamydia trachomatis
agcuaaucaugaugaugagagc

SEQ ID NO: 476473 - RNA, 22 nt, Chlamydia trachomatis
agcuaaugccguuacuaacauc

SEQ ID NO: 476474 - RNA, 21 nt, Chlamydia trachomatis
agcuaauuccauaaucgugga

SEQ ID NO: 476475 - RNA, 22 nt, Chlamydia trachomatis
agcuaauuccauaaucguggaa

SEQ ID NO: 476476 - RNA, 12 nt, Chlamydia trachomatis
agcuaucauuuc

SEQ ID NO: 476477 - RNA, 22 nt, Chlamydia trachomatis
agcuaucauuuccaaaaucuuc

SEQ ID NO: 476478 - RNA, 17 nt, Chlamydia trachomatis
agcuaugagaauuucca

SEQ ID NO: 476479 - RNA, 21 nt, Chlamydia trachomatis
agcuauguaaaaaaucuuguc

SEQ ID NO: 476480 - RNA, 17 nt, Chlamydia trachomatis
agcuauuuucuuccugc

SEQ ID NO: 476481 - RNA, 20 nt, Chlamydia trachomatis
agcugccagugcucaaagau

SEQ ID NO: 476482 - RNA, 19 nt, Chlamydia trachomatis
agcucugcagauuuuguag

SEQ ID NO: 476483 - RNA, 17 nt, Chlamydia trachomatis
agcucuuugauaugcag

SEQ ID NO: 476484 - RNA, 13 nt, Chlamydia trachomatis
agcucuaaagagc

SEQ ID NO: 476485 - RNA, 16 nt, Chlamydia trachomatis
agcucuaacucuucuu

SEQ ID NO: 476486 - RNA, 17 nt, Chlamydia trachomatis
agcucuaacucuucuuu

SEQ ID NO: 476487 - RNA, 23 nt, Chlamydia trachomatis
agcucuaauuaauaacgcccucu

SEQ ID NO: 476488 - RNA, 21 nt, Chlamydia trachomatis
agcucguuuagcagccugagg

SEQ ID NO: 476489 - RNA, 13 nt, Chlamydia trachomatis
agcucaucaaaua

SEQ ID NO: 476490 - RNA, 14 nt, Chlamydia trachomatis
agcugcuuggaaua

SEQ ID NO: 476491 - RNA, 15 nt, Chlamydia trachomatis
agcugcuuuauccaa

SEQ ID NO: 476492 - RNA, 23 nt, Chlamydia trachomatis
agcugcuuuauccaaagauagau

SEQ ID NO: 476493 - RNA, 12 nt, Chlamydia trachomatis
agcugcugucag

SEQ ID NO: 476494 - RNA, 16 nt, Chlamydia trachomatis
agcugcugucagaaga

SEQ ID NO: 476495 - RNA, 15 nt, Chlamydia trachomatis
agcugggaaagcugc

SEQ ID NO: 476496 - RNA, 21 nt, Chlamydia trachomatis
agcugggaaaucuugugcuaa

SEQ ID NO: 476497 - RNA, 20 nt, Chlamydia trachomatis
agcugguuuuuuuugaaaag

SEQ ID NO: 476498 - RNA, 22 nt, Chlamydia trachomatis
agcugguuuuuuuugaaaaggg

SEQ ID NO: 476499 - RNA, 13 nt, Chlamydia trachomatis
agcuguaaauguu

SEQ ID NO: 476500 - RNA, 14 nt, Chlamydia trachomatis
agcuguaauaaaca

SEQ ID NO: 476501 - RNA, 15 nt, Chlamydia trachomatis
agcugucccccagau

SEQ ID NO: 476502 - RNA, 18 nt, Chlamydia trachomatis
agcugucccccagauaac

SEQ ID NO: 476503 - RNA, 22 nt, Chlamydia trachomatis
agcuguuuuugcaacaaagcuu

SEQ ID NO: 476504 - RNA, 18 nt, Chlamydia trachomatis
agcuuauuaauuucuaga

SEQ ID NO: 476505 - RNA, 19 nt, Chlamydia trachomatis
agcuuauuaauuucuagau

SEQ ID NO: 476506 - RNA, 15 nt, Chlamydia trachomatis
agcuuagccacugca

SEQ ID NO: 476507 - RNA, 21 nt, Chlamydia trachomatis
agcuuauaacuaagaucucca

SEQ ID NO: 476508 - RNA, 17 nt, Chlamydia trachomatis
agcuuccugagggccuu

SEQ ID NO: 476509 - RNA, 21 nt, Chlamydia trachomatis
agcuuccugagggccuucuuu

SEQ ID NO: 476510 - RNA, 20 nt, Chlamydia trachomatis
agcuuccuuacggaaaguuc

SEQ ID NO: 476511 - RNA, 14 nt, Chlamydia trachomatis
agcuucguagagca

SEQ ID NO: 476512 - RNA, 21 nt, Chlamydia trachomatis
agcuucuaacgcuuccucucc

SEQ ID NO: 476513 - RNA, 21 nt, Chlamydia trachomatis
agcuucuaauuucuuucucau

SEQ ID NO: 476514 - RNA, 19 nt, Chlamydia trachomatis
agcuucuagaaauucuuca

SEQ ID NO: 476515 - RNA, 16 nt, Chlamydia trachomatis
agcuucuccaucugac

SEQ ID NO: 476516 - RNA, 17 nt, Chlamydia trachomatis
agcuucucgcuacaaau

SEQ ID NO: 476517 - RNA, 22 nt, Chlamydia trachomatis
agcuucuuguagauagacuacg

SEQ ID NO: 476518 - RNA, 23 nt, Chlamydia trachomatis
agcuucugguguaggaaaauaca

SEQ ID NO: 476519 - RNA, 16 nt, Chlamydia trachomatis
agcuuugcacaccugc

SEQ ID NO: 476520 - RNA, 20 nt, Chlamydia trachomatis
agcuuuguuaaucgauucuu

SEQ ID NO: 476521 - RNA, 22 nt, Chlamydia trachomatis
agcuuuuacuuccguuucuuag

SEQ ID NO: 476522 - RNA, 16 nt, Chlamydia trachomatis
agcuuuuccgcugcaa

SEQ ID NO: 476523 - RNA, 16 nt, Chlamydia trachomatis
agcuuuucuccuucuu

SEQ ID NO: 476524 - RNA, 14 nt, Chlamydia trachomatis
agcuuuauuuucau

SEQ ID NO: 476525 - RNA, 16 nt, Chlamydia trachomatis
agcuuucacagggaca

SEQ ID NO: 476526 - RNA, 21 nt, Chlamydia trachomatis
agcuuuauugaacccauagau

SEQ ID NO: 476527 - RNA, 20 nt, Chlamydia trachomatis
agcuuuccucacacacaaaa

SEQ ID NO: 476528 - RNA, 12 nt, Chlamydia trachomatis
agcuugcaacac

SEQ ID NO: 476529 - RNA, 18 nt, Chlamydia trachomatis
agcuugucuccuucuuug

SEQ ID NO: 476530 - RNA, 19 nt, Chlamydia trachomatis
agcuugucuccuucuuuga

SEQ ID NO: 476531 - RNA, 22 nt, Chlamydia trachomatis
agcuuguuccguuguagagaua

SEQ ID NO: 476532 - RNA, 14 nt, Chlamydia trachomatis
agcuuuucuuuccu

SEQ ID NO: 476533 - RNA, 20 nt, Chlamydia trachomatis
agcuuuucuucccugagaaa

SEQ ID NO: 476534 - RNA, 21 nt, Chlamydia trachomatis
agcuuuucuucccugagaaau

SEQ ID NO: 476535 - RNA, 13 nt, Chlamydia trachomatis
agcuuuuuccaaa

SEQ ID NO: 476536 - RNA, 17 nt, Chlamydia trachomatis
agcuuuuuccaaagcuu

SEQ ID NO: 476537 - RNA, 16 nt, Chlamydia trachomatis
agcuuuuugcaaugca

SEQ ID NO: 476538 - RNA, 18 nt, Chlamydia trachomatis
aggaaaaagaaaaaaaga

SEQ ID NO: 476539 - RNA, 15 nt, Chlamydia trachomatis
agcuuuuuuucacug

SEQ ID NO: 476540 - RNA, 15 nt, Chlamydia trachomatis
aggaaacucuuaaaa

SEQ ID NO: 476541 - RNA, 18 nt, Chlamydia trachomatis
aggaaagcuaugcccagg

SEQ ID NO: 476542 - RNA, 20 nt, Chlamydia trachomatis
aggaaauaccuuguuuuuua

SEQ ID NO: 476543 - RNA, 13 nt, Chlamydia trachomatis
aggaaaugaaggc

SEQ ID NO: 476544 - RNA, 15 nt, Chlamydia trachomatis
aggaaaugagagcua

SEQ ID NO: 476545 - RNA, 16 nt, Chlamydia trachomatis
aggaaaugaggacaga

SEQ ID NO: 476546 - RNA, 11 nt, Chlamydia trachomatis
aggaacauuug

SEQ ID NO: 476547 - RNA, 17 nt, Chlamydia trachomatis
aggaacuucuucauccu

SEQ ID NO: 476548 - RNA, 19 nt, Chlamydia trachomatis
aggaacucccucauuaaga

SEQ ID NO: 476549 - RNA, 19 nt, Chlamydia trachomatis
aggaagaauaauacaggag

SEQ ID NO: 476550 - RNA, 14 nt, Chlamydia trachomatis
aggaagaaugacaa

SEQ ID NO: 476551 - RNA, 13 nt, Chlamydia trachomatis
aggaagaaauguu

SEQ ID NO: 476552 - RNA, 13 nt, Chlamydia trachomatis
aggaagaagaaga

SEQ ID NO: 476553 - RNA, 16 nt, Chlamydia trachomatis
aggaagagagaacaaa

SEQ ID NO: 476554 - RNA, 12 nt, Chlamydia trachomatis
aggaagcaaaaa

SEQ ID NO: 476555 - RNA, 17 nt, Chlamydia trachomatis
aggaaguugagaagcga

SEQ ID NO: 476556 - RNA, 16 nt, Chlamydia trachomatis
aggaauaaacagguaa

SEQ ID NO: 476557 - RNA, 19 nt, Chlamydia trachomatis
aggaauaaacagguaaaaa

SEQ ID NO: 476558 - RNA, 14 nt, Chlamydia trachomatis
aggaaguagagaau

SEQ ID NO: 476559 - RNA, 15 nt, Chlamydia trachomatis
aggaaugguuacuug

SEQ ID NO: 476560 - RNA, 18 nt, Chlamydia trachomatis
aggaaugguuacuugccu

SEQ ID NO: 476561 - RNA, 22 nt, Chlamydia trachomatis
aggaaugguuacuugccucuuc

SEQ ID NO: 476562 - RNA, 13 nt, Chlamydia trachomatis
aggaaugugaaga

SEQ ID NO: 476563 - RNA, 14 nt, Chlamydia trachomatis
aggaaucacaguaa

SEQ ID NO: 476564 - RNA, 14 nt, Chlamydia trachomatis
aggaauauuaagau

SEQ ID NO: 476565 - RNA, 19 nt, Chlamydia trachomatis
aggaauagcuacaccagau

SEQ ID NO: 476566 - RNA, 21 nt, Chlamydia trachomatis
aggaauagcuacagcaauaga

SEQ ID NO: 476567 - RNA, 16 nt, Chlamydia trachomatis
aggaauagcuacuaga

SEQ ID NO: 476568 - RNA, 20 nt, Chlamydia trachomatis
aggaauagcuacuagauaga

SEQ ID NO: 476569 - RNA, 13 nt, Chlamydia trachomatis
aggaauccucuuc

SEQ ID NO: 476570 - RNA, 23 nt, Chlamydia trachomatis
aggaaucuguccaaagagauugu

SEQ ID NO: 476571 - RNA, 13 nt, Chlamydia trachomatis
aggacgaguguug

SEQ ID NO: 476572 - RNA, 19 nt, Chlamydia trachomatis
aggaccuaauaucugcucu

SEQ ID NO: 476573 - RNA, 17 nt, Chlamydia trachomatis
aggacagacaggaaagc

SEQ ID NO: 476574 - RNA, 15 nt, Chlamydia trachomatis
aggagagucugcuac

SEQ ID NO: 476575 - RNA, 24 nt, Chlamydia trachomatis
aggagaugcuuguggugaagcgcu

SEQ ID NO: 476576 - RNA, 15 nt, Chlamydia trachomatis
aggagagaaaagagg

SEQ ID NO: 476577 - RNA, 16 nt, Chlamydia trachomatis
aggagagaaaagagga

SEQ ID NO: 476578 - RNA, 17 nt, Chlamydia trachomatis
aggagagaaaagaggag

SEQ ID NO: 476579 - RNA, 11 nt, Chlamydia trachomatis
aggagaagagg

SEQ ID NO: 476580 - RNA, 20 nt, Chlamydia trachomatis
aggagaaggucgucagugca

SEQ ID NO: 476581 - RNA, 18 nt, Chlamydia trachomatis
aggacguuuggagcaugu

SEQ ID NO: 476582 - RNA, 12 nt, Chlamydia trachomatis
aggacugacaga

SEQ ID NO: 476583 - RNA, 15 nt, Chlamydia trachomatis
aggacugacagaagu

SEQ ID NO: 476584 - RNA, 20 nt, Chlamydia trachomatis
aggacugacagaaguuagaa

SEQ ID NO: 476585 - RNA, 21 nt, Chlamydia trachomatis
aggagcccaagcuuucaucuc

SEQ ID NO: 476586 - RNA, 21 nt, Chlamydia trachomatis
aggagcuuugauuaaccaaaa

SEQ ID NO: 476587 - RNA, 20 nt, Chlamydia trachomatis
aggaggucucacuuccuugg

SEQ ID NO: 476588 - RNA, 18 nt, Chlamydia trachomatis
aggagucggaccaugaau

SEQ ID NO: 476589 - RNA, 16 nt, Chlamydia trachomatis
aggagucucugcaguc

SEQ ID NO: 476590 - RNA, 21 nt, Chlamydia trachomatis
aggauaaaucaguggaacugc

SEQ ID NO: 476591 - RNA, 16 nt, Chlamydia trachomatis
aggauccaggagaugu

SEQ ID NO: 476592 - RNA, 14 nt, Chlamydia trachomatis
aggauaacaaacaa

SEQ ID NO: 476593 - RNA, 12 nt, Chlamydia trachomatis
aggauaaggaag

SEQ ID NO: 476594 - RNA, 15 nt, Chlamydia trachomatis
aggauaaggaagaag

SEQ ID NO: 476595 - RNA, 16 nt, Chlamydia trachomatis
aggauaaggaagaaga

SEQ ID NO: 476596 - RNA, 15 nt, Chlamydia trachomatis
aggauagacuggcau

SEQ ID NO: 476597 - RNA, 22 nt, Chlamydia trachomatis
aggauagagccccuauguaaac

SEQ ID NO: 476598 - RNA, 18 nt, Chlamydia trachomatis
aggauagccaaagguugu

SEQ ID NO: 476599 - RNA, 15 nt, Chlamydia trachomatis
aggauaguauucuuu

SEQ ID NO: 476600 - RNA, 21 nt, Chlamydia trachomatis
aggaucgcuaucaauaaaaac

SEQ ID NO: 476601 - RNA, 18 nt, Chlamydia trachomatis
aggauccuaaccaaaaaa

SEQ ID NO: 476602 - RNA, 15 nt, Chlamydia trachomatis
aggaucugagcagug

SEQ ID NO: 476603 - RNA, 19 nt, Chlamydia trachomatis
aggaucugaugcaccauaa

SEQ ID NO: 476604 - RNA, 14 nt, Chlamydia trachomatis
aggaucuuccagcc

SEQ ID NO: 476605 - RNA, 14 nt, Chlamydia trachomatis
aggaugucuaucua

SEQ ID NO: 476606 - RNA, 22 nt, Chlamydia trachomatis
aggauguggacgaacaaaaagu

SEQ ID NO: 476607 - RNA, 16 nt, Chlamydia trachomatis
aggauucucaucuugc

SEQ ID NO: 476608 - RNA, 21 nt, Chlamydia trachomatis
aggauuccccgauauaucugu

SEQ ID NO: 476609 - RNA, 13 nt, Chlamydia trachomatis
aggauuccaaggg

SEQ ID NO: 476610 - RNA, 17 nt, Chlamydia trachomatis
aggauuccaagggagau

SEQ ID NO: 476611 - RNA, 18 nt, Chlamydia trachomatis
aggauuacagcaagaaga

SEQ ID NO: 476612 - RNA, 20 nt, Chlamydia trachomatis
aggauuacagcaagaagaag

SEQ ID NO: 476613 - RNA, 17 nt, Chlamydia trachomatis
aggauuacuuuuucuac

SEQ ID NO: 476614 - RNA, 20 nt, Chlamydia trachomatis
aggauuacuuuuucuacuuu

SEQ ID NO: 476615 - RNA, 22 nt, Chlamydia trachomatis
aggauuggaaaauccaaaguac

SEQ ID NO: 476616 - RNA, 19 nt, Chlamydia trachomatis
aggauugguguucuauaug

SEQ ID NO: 476617 - RNA, 15 nt, Chlamydia trachomatis
aggauuuucuucuuu

SEQ ID NO: 476618 - RNA, 22 nt, Chlamydia trachomatis
aggauuuucuucuuuuuuacau

SEQ ID NO: 476619 - RNA, 15 nt, Chlamydia trachomatis
aggcaacagcucugu

SEQ ID NO: 476620 - RNA, 20 nt, Chlamydia trachomatis
aggcaacccucgcagagaaa

SEQ ID NO: 476621 - RNA, 17 nt, Chlamydia trachomatis
aggcaccccuaaaagag

SEQ ID NO: 476622 - RNA, 15 nt, Chlamydia trachomatis
aggcauaauuaugau

SEQ ID NO: 476623 - RNA, 19 nt, Chlamydia trachomatis
aggcauuaaagggaaaaaa

SEQ ID NO: 476624 - RNA, 22 nt, Chlamydia trachomatis
aggcauuccuuggcaaagagcu

SEQ ID NO: 476625 - RNA, 14 nt, Chlamydia trachomatis
aggcccuucuugag

SEQ ID NO: 476626 - RNA, 14 nt, Chlamydia trachomatis
aggccuccauuucc

SEQ ID NO: 476627 - RNA, 15 nt, Chlamydia trachomatis
aggccuccauuucca

SEQ ID NO: 476628 - RNA, 18 nt, Chlamydia trachomatis
aggccuuuuuuuauaaag

SEQ ID NO: 476629 - RNA, 20 nt, Chlamydia trachomatis
aggcgacacgcuucuucaaa

SEQ ID NO: 476630 - RNA, 19 nt, Chlamydia trachomatis
aggcgaauuucucuaucug

SEQ ID NO: 476631 - RNA, 22 nt, Chlamydia trachomatis
aggcgcgcgcguaauuuucuag

SEQ ID NO: 476632 - RNA, 20 nt, Chlamydia trachomatis
aggcggagagaauaccaaaa

SEQ ID NO: 476633 - RNA, 17 nt, Chlamydia trachomatis
aggcguaaaccuucuug

SEQ ID NO: 476634 - RNA, 19 nt, Chlamydia trachomatis
aggcuaguaaugugucuaa

SEQ ID NO: 476635 - RNA, 13 nt, Chlamydia trachomatis
aggcuaacuccau

SEQ ID NO: 476636 - RNA, 18 nt, Chlamydia trachomatis
aggcuaagaaagguuuuu

SEQ ID NO: 476637 - RNA, 22 nt, Chlamydia trachomatis
aggcuccguucaaagcaaacuu

SEQ ID NO: 476638 - RNA, 19 nt, Chlamydia trachomatis
aggcuccugcaagggaaca

SEQ ID NO: 476639 - RNA, 22 nt, Chlamydia trachomatis
aggcuccugcaagggaacaaac

SEQ ID NO: 476640 - RNA, 19 nt, Chlamydia trachomatis
aggcugaucaauaccuagc

SEQ ID NO: 476641 - RNA, 21 nt, Chlamydia trachomatis
aggcugaggauuccaagggag

SEQ ID NO: 476642 - RNA, 16 nt, Chlamydia trachomatis
aggcucuucaguacuu

SEQ ID NO: 476643 - RNA, 21 nt, Chlamydia trachomatis
aggcugcauuacucguuaucu

SEQ ID NO: 476644 - RNA, 13 nt, Chlamydia trachomatis
aggcuguaacuaa

SEQ ID NO: 476645 - RNA, 14 nt, Chlamydia trachomatis
aggcuguaacuaaa

SEQ ID NO: 476646 - RNA, 16 nt, Chlamydia trachomatis
aggcuucaaagaacau

SEQ ID NO: 476647 - RNA, 15 nt, Chlamydia trachomatis
aggcuuccaaaucug

SEQ ID NO: 476648 - RNA, 21 nt, Chlamydia trachomatis
aggcuuccaaaucugcaagaa

SEQ ID NO: 476649 - RNA, 17 nt, Chlamydia trachomatis
aggcuuucaaaaagagc

SEQ ID NO: 476650 - RNA, 13 nt, Chlamydia trachomatis
aggcuucuucuuc

SEQ ID NO: 476651 - RNA, 11 nt, Chlamydia trachomatis
aggcuugggug

SEQ ID NO: 476652 - RNA, 21 nt, Chlamydia trachomatis
agggaaacguaaaagaguaag

SEQ ID NO: 476653 - RNA, 17 nt, Chlamydia trachomatis
aggcuuuucuauuuuua

SEQ ID NO: 476654 - RNA, 16 nt, Chlamydia trachomatis
aggcuuuuuuuuucau

SEQ ID NO: 476655 - RNA, 14 nt, Chlamydia trachomatis
agggaaaaacuuuu

SEQ ID NO: 476656 - RNA, 14 nt, Chlamydia trachomatis
agggaaaacaccau

SEQ ID NO: 476657 - RNA, 12 nt, Chlamydia trachomatis
agggaagagaaa

SEQ ID NO: 476658 - RNA, 13 nt, Chlamydia trachomatis
agggaauaaaaac

SEQ ID NO: 476659 - RNA, 18 nt, Chlamydia trachomatis
agggaaucauaaggaaga

SEQ ID NO: 476660 - RNA, 13 nt, Chlamydia trachomatis
agggaaugacuua

SEQ ID NO: 476661 - RNA, 15 nt, Chlamydia trachomatis
agggacuucuucuag

SEQ ID NO: 476662 - RNA, 19 nt, Chlamydia trachomatis
agggacuucuucuagagau

SEQ ID NO: 476663 - RNA, 16 nt, Chlamydia trachomatis
agggagaauuuuaaac

SEQ ID NO: 476664 - RNA, 21 nt, Chlamydia trachomatis
agggagaugaucgaguucuac

SEQ ID NO: 476665 - RNA, 17 nt, Chlamydia trachomatis
agggauuuuaaagagcu

SEQ ID NO: 476666 - RNA, 17 nt, Chlamydia trachomatis
agggaugaagcuaaaaa

SEQ ID NO: 476667 - RNA, 13 nt, Chlamydia trachomatis
agggauaacaucu

SEQ ID NO: 476668 - RNA, 14 nt, Chlamydia trachomatis
agggauagaaacuc

SEQ ID NO: 476669 - RNA, 15 nt, Chlamydia trachomatis
agggauaguaaaaac

SEQ ID NO: 476670 - RNA, 16 nt, Chlamydia trachomatis
agggauauuucuuccu

SEQ ID NO: 476671 - RNA, 16 nt, Chlamydia trachomatis
aggggaccaaaaaagc

SEQ ID NO: 476672 - RNA, 20 nt, Chlamydia trachomatis
agggcuguauucaucucuac

SEQ ID NO: 476673 - RNA, 18 nt, Chlamydia trachomatis
agggcuguguagcaaaua

SEQ ID NO: 476674 - RNA, 17 nt, Chlamydia trachomatis
agggcuuuugcaaacaa

SEQ ID NO: 476675 - RNA, 15 nt, Chlamydia trachomatis
aggggaagaaucaau

SEQ ID NO: 476676 - RNA, 15 nt, Chlamydia trachomatis
agggggcuuuagcag

SEQ ID NO: 476677 - RNA, 15 nt, Chlamydia trachomatis
aggguagaaaaagag

SEQ ID NO: 476678 - RNA, 18 nt, Chlamydia trachomatis
aggguagaaaaagagaaa

SEQ ID NO: 476679 - RNA, 18 nt, Chlamydia trachomatis
aggguagucgcuuagaua

SEQ ID NO: 476680 - RNA, 15 nt, Chlamydia trachomatis
aggguguuuuucgcu

SEQ ID NO: 476681 - RNA, 21 nt, Chlamydia trachomatis
aggguguuuuucgcuaucuuc

SEQ ID NO: 476682 - RNA, 12 nt, Chlamydia trachomatis
aggguucucuuu

SEQ ID NO: 476683 - RNA, 23 nt, Chlamydia trachomatis
aggguugugaauacaaaccgaag

SEQ ID NO: 476684 - RNA, 20 nt, Chlamydia trachomatis
agguaacuguggguuuuuuu

SEQ ID NO: 476685 - RNA, 17 nt, Chlamydia trachomatis
agguaagggacaacagg

SEQ ID NO: 476686 - RNA, 12 nt, Chlamydia trachomatis
agguauuccugu

SEQ ID NO: 476687 - RNA, 13 nt, Chlamydia trachomatis
agguauuccugua

SEQ ID NO: 476688 - RNA, 20 nt, Chlamydia trachomatis
agguauuuuagagaaaagaa

SEQ ID NO: 476689 - RNA, 23 nt, Chlamydia trachomatis
agguaaucuguagagagccccac

SEQ ID NO: 476690 - RNA, 20 nt, Chlamydia trachomatis
aggucauucgucaaagaagu

SEQ ID NO: 476691 - RNA, 21 nt, Chlamydia trachomatis
aggucauucgucaaagaagua

SEQ ID NO: 476692 - RNA, 19 nt, Chlamydia trachomatis
aggucauugaguucugcuu

SEQ ID NO: 476693 - RNA, 22 nt, Chlamydia trachomatis
aggucuuuuaauaagaccucuu

SEQ ID NO: 476694 - RNA, 14 nt, Chlamydia trachomatis
aggucuuuaccguc

SEQ ID NO: 476695 - RNA, 18 nt, Chlamydia trachomatis
aggucuuaauaauagaaa

SEQ ID NO: 476696 - RNA, 16 nt, Chlamydia trachomatis
aggucuuauuaaaaga

SEQ ID NO: 476697 - RNA, 23 nt, Chlamydia trachomatis
aggucuuauuaaaagaccucuuu

SEQ ID NO: 476698 - RNA, 19 nt, Chlamydia trachomatis
aggucuaggggaagaauca

SEQ ID NO: 476699 - RNA, 20 nt, Chlamydia trachomatis
aggucgcuugauucuugaau

SEQ ID NO: 476700 - RNA, 14 nt, Chlamydia trachomatis
aggugaccucugcg

SEQ ID NO: 476701 - RNA, 22 nt, Chlamydia trachomatis
aggugguacuucauuuuugcua

SEQ ID NO: 476702 - RNA, 18 nt, Chlamydia trachomatis
aggugugaauaggaagaa

SEQ ID NO: 476703 - RNA, 19 nt, Chlamydia trachomatis
agguuaccacauucucuuu

SEQ ID NO: 476704 - RNA, 13 nt, Chlamydia trachomatis
agguugcuugaau

SEQ ID NO: 476705 - RNA, 19 nt, Chlamydia trachomatis
agguucuauaccuaaaagu

SEQ ID NO: 476706 - RNA, 14 nt, Chlamydia trachomatis
agguucuuugauca

SEQ ID NO: 476707 - RNA, 21 nt, Chlamydia trachomatis
agguucuuugaucaaauccug

SEQ ID NO: 476708 - RNA, 15 nt, Chlamydia trachomatis
agguuugucuucaga

SEQ ID NO: 476709 - RNA, 18 nt, Chlamydia trachomatis
agguuuguuuccucucuc

SEQ ID NO: 476710 - RNA, 20 nt, Chlamydia trachomatis
agguuuguuuccucucucug

SEQ ID NO: 476711 - RNA, 20 nt, Chlamydia trachomatis
agguuucugcuaaauccauu

SEQ ID NO: 476712 - RNA, 18 nt, Chlamydia trachomatis
agguuguuacagucugug

SEQ ID NO: 476713 - RNA, 16 nt, Chlamydia trachomatis
agguuguuauguagau

SEQ ID NO: 476714 - RNA, 13 nt, Chlamydia trachomatis
agguuucuaaaaa

SEQ ID NO: 476715 - RNA, 14 nt, Chlamydia trachomatis
agguuucuaaaaaa

SEQ ID NO: 476716 - RNA, 17 nt, Chlamydia trachomatis
aguaaaaauaauuuccu

SEQ ID NO: 476717 - RNA, 17 nt, Chlamydia trachomatis
aguaaagaaaagcuccu

SEQ ID NO: 476718 - RNA, 15 nt, Chlamydia trachomatis
aguacaaaaauacuu

SEQ ID NO: 476719 - RNA, 14 nt, Chlamydia trachomatis
aguaccaaaaaauc

SEQ ID NO: 476720 - RNA, 17 nt, Chlamydia trachomatis
aguaccauaauccuaug

SEQ ID NO: 476721 - RNA, 14 nt, Chlamydia trachomatis
aguaaucaaaaaag

SEQ ID NO: 476722 - RNA, 15 nt, Chlamydia trachomatis
aguaauuccaaauaa

SEQ ID NO: 476723 - RNA, 22 nt, Chlamydia trachomatis
aguaacggaacucuacaaaaua

SEQ ID NO: 476724 - RNA, 20 nt, Chlamydia trachomatis
aguaacuacggaaaaagaag

SEQ ID NO: 476725 - RNA, 18 nt, Chlamydia trachomatis
aguaagaccgagauuauc

SEQ ID NO: 476726 - RNA, 22 nt, Chlamydia trachomatis
aguaagcuaauuuuucucuaau

SEQ ID NO: 476727 - RNA, 13 nt, Chlamydia trachomatis
aguaaguaaaagc

SEQ ID NO: 476728 - RNA, 21 nt, Chlamydia trachomatis
aguaagucaccauuuucucga

SEQ ID NO: 476729 - RNA, 22 nt, Chlamydia trachomatis
aguaaguuucuauacagcauca

SEQ ID NO: 476730 - RNA, 18 nt, Chlamydia trachomatis
auaaugccuauagccaua

SEQ ID NO: 476731 - RNA, 15 nt, Chlamydia trachomatis
auaaucuuuuuauug

SEQ ID NO: 476732 - RNA, 18 nt, Chlamydia trachomatis
auaaugcuuagaaacugu

SEQ ID NO: 476733 - RNA, 23 nt, Chlamydia trachomatis
auaauggcaaaaauaccaaaaaa

SEQ ID NO: 476734 - RNA, 21 nt, Chlamydia trachomatis
auaaucuuccuguaagaggau

SEQ ID NO: 476735 - RNA, 22 nt, Chlamydia trachomatis
auaaucuuggacuuucuaccgc

SEQ ID NO: 476736 - RNA, 21 nt, Chlamydia trachomatis
auaaucgagcaaccagcgcau

SEQ ID NO: 476737 - RNA, 17 nt, Chlamydia trachomatis
auaaucgaucacagaaa

SEQ ID NO: 476738 - RNA, 21 nt, Chlamydia trachomatis
auaaucgaucacagaaacgga

SEQ ID NO: 476739 - RNA, 20 nt, Chlamydia trachomatis
auaauaggauaggaaaugag

SEQ ID NO: 476740 - RNA, 17 nt, Chlamydia trachomatis
auaauacuccaccuagg

SEQ ID NO: 476741 - RNA, 13 nt, Chlamydia trachomatis
auaauaagaugau

SEQ ID NO: 476742 - RNA, 13 nt, Chlamydia trachomatis
auaauaaugggcu

SEQ ID NO: 476743 - RNA, 13 nt, Chlamydia trachomatis
auaauacaaagca

SEQ ID NO: 476744 - RNA, 17 nt, Chlamydia trachomatis
auaauaguccuacucaa

SEQ ID NO: 476745 - RNA, 18 nt, Chlamydia trachomatis
auaauaugguaauggcug

SEQ ID NO: 476746 - RNA, 22 nt, Chlamydia trachomatis
auaagcguuccuauacaagaaa

SEQ ID NO: 476747 - RNA, 18 nt, Chlamydia trachomatis
auaagcugaaaaugcucu

SEQ ID NO: 476748 - RNA, 19 nt, Chlamydia trachomatis
auaagcucuaacucuucuu

SEQ ID NO: 476749 - RNA, 22 nt, Chlamydia trachomatis
auaagcuguaggucgcuugauu

SEQ ID NO: 476750 - RNA, 22 nt, Chlamydia trachomatis
auaaggaagaagauaguagaga

SEQ ID NO: 476751 - RNA, 17 nt, Chlamydia trachomatis
auaaggaagaugggcau

SEQ ID NO: 476752 - RNA, 17 nt, Chlamydia trachomatis
auaaggaagcaaaaacu

SEQ ID NO: 476753 - RNA, 21 nt, Chlamydia trachomatis
auaagccgcucugucaucacu

SEQ ID NO: 476754 - RNA, 20 nt, Chlamydia trachomatis
auaagcacuauaucuccaac

SEQ ID NO: 476755 - RNA, 15 nt, Chlamydia trachomatis
auaagcauuacacaa

SEQ ID NO: 476756 - RNA, 13 nt, Chlamydia trachomatis
auaagaauacaaa

SEQ ID NO: 476757 - RNA, 20 nt, Chlamydia trachomatis
auaagaauguuuccuaauuu

SEQ ID NO: 476758 - RNA, 16 nt, Chlamydia trachomatis
auaagaccucuuuuuu

SEQ ID NO: 476759 - RNA, 19 nt, Chlamydia trachomatis
auaagagaacccuaauaaa

SEQ ID NO: 476760 - RNA, 18 nt, Chlamydia trachomatis
auaagagaagguaacaau

SEQ ID NO: 476761 - RNA, 20 nt, Chlamydia trachomatis
auaaggaauccgcuccccuu

SEQ ID NO: 476762 - RNA, 14 nt, Chlamydia trachomatis
auaagggaaucaua

SEQ ID NO: 476763 - RNA, 20 nt, Chlamydia trachomatis
auaagggaaucauaaggaag

SEQ ID NO: 476764 - RNA, 20 nt, Chlamydia trachomatis
auaagggcuuuugcaaacaa

SEQ ID NO: 476765 - RNA, 15 nt, Chlamydia trachomatis
auaagguucaaggaa

SEQ ID NO: 476766 - RNA, 23 nt, Chlamydia trachomatis
auaaguaaauugcgacaccuaau

SEQ ID NO: 476767 - RNA, 22 nt, Chlamydia trachomatis
auaaguaucguaaacaaaagau

SEQ ID NO: 476768 - RNA, 21 nt, Chlamydia trachomatis
auaagucugccacuacuucag

SEQ ID NO: 476769 - RNA, 23 nt, Chlamydia trachomatis
auaaguucagccccuaaagccac

SEQ ID NO: 476770 - RNA, 22 nt, Chlamydia trachomatis
auaaguuccgcucgauauccug

SEQ ID NO: 476771 - RNA, 16 nt, Chlamydia trachomatis
auaaguucuuuagcuu

SEQ ID NO: 476772 - RNA, 14 nt, Chlamydia trachomatis
auaaguuuuaagaa

SEQ ID NO: 476773 - RNA, 16 nt, Chlamydia trachomatis
auaaguuuuaagaaga

SEQ ID NO: 476774 - RNA, 17 nt, Chlamydia trachomatis
auaauaaaccaaaggca

SEQ ID NO: 476775 - RNA, 18 nt, Chlamydia trachomatis
auaauaaaccaaaggcaa

SEQ ID NO: 476776 - RNA, 12 nt, Chlamydia trachomatis
auaauaaauauu

SEQ ID NO: 476777 - RNA, 19 nt, Chlamydia trachomatis
auaaagcggcuaaagaaga

SEQ ID NO: 476778 - RNA, 23 nt, Chlamydia trachomatis
auaaagcuaucccaaaagaauga

SEQ ID NO: 476779 - RNA, 22 nt, Chlamydia trachomatis
auaaagccccuccgcugauuag

SEQ ID NO: 476780 - RNA, 17 nt, Chlamydia trachomatis
auaaagguaaucuguag

SEQ ID NO: 476781 - RNA, 24 nt, Chlamydia trachomatis
auaaaucugcuaaggccuuaucca

SEQ ID NO: 476782 - RNA, 17 nt, Chlamydia trachomatis
auaaacccacgaaaaga

SEQ ID NO: 476783 - RNA, 22 nt, Chlamydia trachomatis
auaaagagccguucucucuaaa

SEQ ID NO: 476784 - RNA, 21 nt, Chlamydia trachomatis
auaaagagguuguuacagucu

SEQ ID NO: 476785 - RNA, 12 nt, Chlamydia trachomatis
auaaagauagca

SEQ ID NO: 476786 - RNA, 19 nt, Chlamydia trachomatis
auaaaaacugcugcuauca

SEQ ID NO: 476787 - RNA, 21 nt, Chlamydia trachomatis
auaaaaacuggagaauccaua

SEQ ID NO: 476788 - RNA, 11 nt, Chlamydia trachomatis
auaaaaagccc

SEQ ID NO: 476789 - RNA, 17 nt, Chlamydia trachomatis
auaaaaagcugggcagc

SEQ ID NO: 476790 - RNA, 18 nt, Chlamydia trachomatis
auaaacaaggcuaagaaa

SEQ ID NO: 476791 - RNA, 14 nt, Chlamydia trachomatis
auaaacacaaguau

SEQ ID NO: 476792 - RNA, 22 nt, Chlamydia trachomatis
auaaacacaaguaugagaggaa

SEQ ID NO: 476793 - RNA, 12 nt, Chlamydia trachomatis
auaaauuugcug

SEQ ID NO: 476794 - RNA, 19 nt, Chlamydia trachomatis
auaaauuucuuaaaagcac

SEQ ID NO: 476795 - RNA, 20 nt, Chlamydia trachomatis
auaaauuucuuaaaagcaca

SEQ ID NO: 476796 - RNA, 13 nt, Chlamydia trachomatis
auaacaaacaaca

SEQ ID NO: 476797 - RNA, 22 nt, Chlamydia trachomatis
auaacacccuguaaaaggcgca

SEQ ID NO: 476798 - RNA, 17 nt, Chlamydia trachomatis
auaacacucucaucuaa

SEQ ID NO: 476799 - RNA, 18 nt, Chlamydia trachomatis
auaacagcacaaacaaau

SEQ ID NO: 476800 - RNA, 20 nt, Chlamydia trachomatis
auaacauucugaacauacaa

SEQ ID NO: 476801 - RNA, 17 nt, Chlamydia trachomatis
auaacauuauuccgcuu

SEQ ID NO: 476802 - RNA, 13 nt, Chlamydia trachomatis
auaacguuuuaaa

SEQ ID NO: 476803 - RNA, 21 nt, Chlamydia trachomatis
auaacuaagaucuccaugauc

SEQ ID NO: 476804 - RNA, 16 nt, Chlamydia trachomatis
auaacuccaagggaug

SEQ ID NO: 476805 - RNA, 16 nt, Chlamydia trachomatis
auaacuccaucaggaa

SEQ ID NO: 476806 - RNA, 23 nt, Chlamydia trachomatis
auaacucugcggcuccuucuuga

SEQ ID NO: 476807 - RNA, 23 nt, Chlamydia trachomatis
auaacugagccaagaacaaagca

SEQ ID NO: 476808 - RNA, 16 nt, Chlamydia trachomatis
auaacuggaguuuucc

SEQ ID NO: 476809 - RNA, 12 nt, Chlamydia trachomatis
auaagaaaaaaa

SEQ ID NO: 476810 - RNA, 20 nt, Chlamydia trachomatis
auaagaaaaaaaaccaaacu

SEQ ID NO: 476811 - RNA, 13 nt, Chlamydia trachomatis
auaagaaaauucu

SEQ ID NO: 476812 - RNA, 21 nt, Chlamydia trachomatis
auaagaaacacaccgggagca

SEQ ID NO: 476813 - RNA, 16 nt, Chlamydia trachomatis
auaagaacuucuccug

SEQ ID NO: 476814 - RNA, 16 nt, Chlamydia trachomatis
agugacauuuccaaca

SEQ ID NO: 476815 - RNA, 21 nt, Chlamydia trachomatis
agugacauuauuuuuucgaga

SEQ ID NO: 476816 - RNA, 17 nt, Chlamydia trachomatis
agucuucuaucacagcu

SEQ ID NO: 476817 - RNA, 19 nt, Chlamydia trachomatis
agucuucucgagaagaaaa

SEQ ID NO: 476818 - RNA, 14 nt, Chlamydia trachomatis
agucuugugcucug

SEQ ID NO: 476819 - RNA, 18 nt, Chlamydia trachomatis
agucuuuauaucuugucc

SEQ ID NO: 476820 - RNA, 19 nt, Chlamydia trachomatis
agucuuuauuuaaguagaa

SEQ ID NO: 476821 - RNA, 18 nt, Chlamydia trachomatis
agucuggacgaugccauc

SEQ ID NO: 476822 - RNA, 16 nt, Chlamydia trachomatis
agucugcaauccaauu

SEQ ID NO: 476823 - RNA, 18 nt, Chlamydia trachomatis
agucugaauauacccauu

SEQ ID NO: 476824 - RNA, 12 nt, Chlamydia trachomatis
agucuguauauc

SEQ ID NO: 476825 - RNA, 16 nt, Chlamydia trachomatis
agucuguugccugcaa

SEQ ID NO: 476826 - RNA, 18 nt, Chlamydia trachomatis
agucuucaggauuggaaa

SEQ ID NO: 476827 - RNA, 16 nt, Chlamydia trachomatis
agucuucaucaauauu

SEQ ID NO: 476828 - RNA, 14 nt, Chlamydia trachomatis
agucuuccucugcu

SEQ ID NO: 476829 - RNA, 15 nt, Chlamydia trachomatis
aguccuuaucuucuu

SEQ ID NO: 476830 - RNA, 18 nt, Chlamydia trachomatis
aguccuuaucuucuugag

SEQ ID NO: 476831 - RNA, 14 nt, Chlamydia trachomatis
aguccuucuccacc

SEQ ID NO: 476832 - RNA, 16 nt, Chlamydia trachomatis
aguccggacuuuccuc

SEQ ID NO: 476833 - RNA, 16 nt, Chlamydia trachomatis
agucuagagguuuaag

SEQ ID NO: 476834 - RNA, 14 nt, Chlamydia trachomatis
agucucugccaccu

SEQ ID NO: 476835 - RNA, 20 nt, Chlamydia trachomatis
agucucuguauugaucucua

SEQ ID NO: 476836 - RNA, 16 nt, Chlamydia trachomatis
agugacuauuuccuac

SEQ ID NO: 476837 - RNA, 14 nt, Chlamydia trachomatis
agugacuugaguaa

SEQ ID NO: 476838 - RNA, 16 nt, Chlamydia trachomatis
agugcaucauuuugua

SEQ ID NO: 476839 - RNA, 23 nt, Chlamydia trachomatis
agugccucaauuuguagcaaaag

SEQ ID NO: 476840 - RNA, 16 nt, Chlamydia trachomatis
agugcuccugcagaca

SEQ ID NO: 476841 - RNA, 14 nt, Chlamydia trachomatis
agugcucaaagauu

SEQ ID NO: 476842 - RNA, 14 nt, Chlamydia trachomatis
aguguaaucauuuu

SEQ ID NO: 476843 - RNA, 14 nt, Chlamydia trachomatis
aguguaaggagaga

SEQ ID NO: 476844 - RNA, 13 nt, Chlamydia trachomatis
agugguaaggggu

SEQ ID NO: 476845 - RNA, 14 nt, Chlamydia trachomatis
aguggcaaggggga

SEQ ID NO: 476846 - RNA, 22 nt, Chlamydia trachomatis
aguggcaagggggagcauguuu

SEQ ID NO: 476847 - RNA, 17 nt, Chlamydia trachomatis
agugggcucguggaggg

SEQ ID NO: 476848 - RNA, 22 nt, Chlamydia trachomatis
agugugccagcucuaauuaaua

SEQ ID NO: 476849 - RNA, 15 nt, Chlamydia trachomatis
aguguguaguuaucu

SEQ ID NO: 476850 - RNA, 18 nt, Chlamydia trachomatis
aguguugagaagcuuagu

SEQ ID NO: 476851 - RNA, 17 nt, Chlamydia trachomatis
aguguuugcauucuuuu

SEQ ID NO: 476852 - RNA, 18 nt, Chlamydia trachomatis
aguuaaaacacaaaagca

SEQ ID NO: 476853 - RNA, 16 nt, Chlamydia trachomatis
aguuaaaacuccagaa

SEQ ID NO: 476854 - RNA, 14 nt, Chlamydia trachomatis
aguuagacaaaaaa

SEQ ID NO: 476855 - RNA, 14 nt, Chlamydia trachomatis
aguuagcugaaaug

SEQ ID NO: 476856 - RNA, 14 nt, Chlamydia trachomatis
aguuaggcauuccu

SEQ ID NO: 476857 - RNA, 15 nt, Chlamydia trachomatis
aguuccucaaaagaa

SEQ ID NO: 476858 - RNA, 14 nt, Chlamydia trachomatis
aguuagugaagucu

SEQ ID NO: 476859 - RNA, 12 nt, Chlamydia trachomatis
aguucugcugcc

SEQ ID NO: 476860 - RNA, 20 nt, Chlamydia trachomatis
aguucugcugccaaagcuuc

SEQ ID NO: 476861 - RNA, 11 nt, Chlamydia trachomatis
aguugcaaaaa

SEQ ID NO: 476862 - RNA, 19 nt, Chlamydia trachomatis
aguuggccagcucaaagau

SEQ ID NO: 476863 - RNA, 24 nt, Chlamydia trachomatis
aguuggccagcucaaagaugagua

SEQ ID NO: 476864 - RNA, 20 nt, Chlamydia trachomatis
aguuguuggaguuaauucuu

SEQ ID NO: 476865 - RNA, 21 nt, Chlamydia trachomatis
aguuguuggaguuaauucuuu

SEQ ID NO: 476866 - RNA, 17 nt, Chlamydia trachomatis
aguuguugggagagggu

SEQ ID NO: 476867 - RNA, 15 nt, Chlamydia trachomatis
aguuguuugggcugc

SEQ ID NO: 476868 - RNA, 19 nt, Chlamydia trachomatis
aguuuaacagcaagcuugu

SEQ ID NO: 476869 - RNA, 13 nt, Chlamydia trachomatis
aguuuaccucucc

SEQ ID NO: 476870 - RNA, 14 nt, Chlamydia trachomatis
aguuucgaguaauu

SEQ ID NO: 476871 - RNA, 20 nt, Chlamydia trachomatis
aguuucuuccagacaaaaag

SEQ ID NO: 476872 - RNA, 22 nt, Chlamydia trachomatis
aguuucuuccagacaaaaagaa

SEQ ID NO: 476873 - RNA, 23 nt, Chlamydia trachomatis
aguuucuuccagacaaaaagaaa

SEQ ID NO: 476874 - RNA, 11 nt, Chlamydia trachomatis
aguuucuucua

SEQ ID NO: 476875 - RNA, 17 nt, Chlamydia trachomatis
aguuucuuucuuaguuu

SEQ ID NO: 476876 - RNA, 12 nt, Chlamydia trachomatis
aguuugaaucac

SEQ ID NO: 476877 - RNA, 14 nt, Chlamydia trachomatis
aguuugaaucacag

SEQ ID NO: 476878 - RNA, 16 nt, Chlamydia trachomatis
aguuuguggaauugua

SEQ ID NO: 476879 - RNA, 15 nt, Chlamydia trachomatis
aguuuguucagaaag

SEQ ID NO: 476880 - RNA, 16 nt, Chlamydia trachomatis
aguuuugaggaagaaa

SEQ ID NO: 476881 - RNA, 19 nt, Chlamydia trachomatis
auaaaaaaagucuguuccu

SEQ ID NO: 476882 - RNA, 15 nt, Chlamydia trachomatis
auacgccgcauaaca

SEQ ID NO: 476883 - RNA, 21 nt, Chlamydia trachomatis
auacgcaaguauuggagacaa

SEQ ID NO: 476884 - RNA, 22 nt, Chlamydia trachomatis
auaccuuguuuuuuaagaguuu

SEQ ID NO: 476885 - RNA, 19 nt, Chlamydia trachomatis
auacgacguaaucguguuc

SEQ ID NO: 476886 - RNA, 17 nt, Chlamydia trachomatis
auacgagccuguuucuu

SEQ ID NO: 476887 - RNA, 21 nt, Chlamydia trachomatis
auacgaggagcuugagagcau

SEQ ID NO: 476888 - RNA, 13 nt, Chlamydia trachomatis
auacucuaaaagu

SEQ ID NO: 476889 - RNA, 19 nt, Chlamydia trachomatis
auacucuaaaaguuuucuu

SEQ ID NO: 476890 - RNA, 18 nt, Chlamydia trachomatis
auacucagagauauaaga

SEQ ID NO: 476891 - RNA, 17 nt, Chlamydia trachomatis
auacugcuccacaacac

SEQ ID NO: 476892 - RNA, 22 nt, Chlamydia trachomatis
auacugggaggacuaacaugcu

SEQ ID NO: 476893 - RNA, 21 nt, Chlamydia trachomatis
auagagccccuauguaaacaa

SEQ ID NO: 476894 - RNA, 12 nt, Chlamydia trachomatis
auagagcaaucu

SEQ ID NO: 476895 - RNA, 20 nt, Chlamydia trachomatis
auagagcauaucaugugggu

SEQ ID NO: 476896 - RNA, 21 nt, Chlamydia trachomatis
auacuuuuccgaauucuuuca

SEQ ID NO: 476897 - RNA, 14 nt, Chlamydia trachomatis
auacuuuucucccu

SEQ ID NO: 476898 - RNA, 12 nt, Chlamydia trachomatis
auagacuucuuc

SEQ ID NO: 476899 - RNA, 13 nt, Chlamydia trachomatis
auagagaagaauu

SEQ ID NO: 476900 - RNA, 15 nt, Chlamydia trachomatis
auacuuguccccuac

SEQ ID NO: 476901 - RNA, 20 nt, Chlamydia trachomatis
auacuuuaaucauagaacau

SEQ ID NO: 476902 - RNA, 20 nt, Chlamydia trachomatis
auacuuuagauuuguuuaaa

SEQ ID NO: 476903 - RNA, 20 nt, Chlamydia trachomatis
auagaugcgauguaaaugau

SEQ ID NO: 476904 - RNA, 19 nt, Chlamydia trachomatis
auagcaauaauuuccccua

SEQ ID NO: 476905 - RNA, 22 nt, Chlamydia trachomatis
auagcaaugcgaucagaaacgu

SEQ ID NO: 476906 - RNA, 18 nt, Chlamydia trachomatis
auagcuucuaauuucuuu

SEQ ID NO: 476907 - RNA, 21 nt, Chlamydia trachomatis
auagcuucuaauuucuuucuc

SEQ ID NO: 476908 - RNA, 17 nt, Chlamydia trachomatis
auaggaaaaaagaagcu

SEQ ID NO: 476909 - RNA, 16 nt, Chlamydia trachomatis
auaggaaaaagcuauc

SEQ ID NO: 476910 - RNA, 13 nt, Chlamydia trachomatis
auaggaaaugaga

SEQ ID NO: 476911 - RNA, 19 nt, Chlamydia trachomatis
auagcaggaacuucuucau

SEQ ID NO: 476912 - RNA, 19 nt, Chlamydia trachomatis
auagcagggaacacagagu

SEQ ID NO: 476913 - RNA, 17 nt, Chlamydia trachomatis
auagcggguucuuuugc

SEQ ID NO: 476914 - RNA, 24 nt, Chlamydia trachomatis
auaggcaacuugagcaucuggagu

SEQ ID NO: 476915 - RNA, 14 nt, Chlamydia trachomatis
auaggauuuaaacc

SEQ ID NO: 476916 - RNA, 12 nt, Chlamydia trachomatis
auaggagaggau

SEQ ID NO: 476917 - RNA, 22 nt, Chlamydia trachomatis
auaggagaggauuaaggaauga

SEQ ID NO: 476918 - RNA, 18 nt, Chlamydia trachomatis
auaggauaggaaaugaga

SEQ ID NO: 476919 - RNA, 15 nt, Chlamydia trachomatis
auagggauuuuaaag

SEQ ID NO: 476920 - RNA, 18 nt, Chlamydia trachomatis
auagggagguauuccugu

SEQ ID NO: 476921 - RNA, 16 nt, Chlamydia trachomatis
auaggguccaaacaua

SEQ ID NO: 476922 - RNA, 17 nt, Chlamydia trachomatis
auaggguccaaacauaa

SEQ ID NO: 476923 - RNA, 18 nt, Chlamydia trachomatis
auaggguugugaauacaa

SEQ ID NO: 476924 - RNA, 18 nt, Chlamydia trachomatis
auaggcuccugcaaggga

SEQ ID NO: 476925 - RNA, 17 nt, Chlamydia trachomatis
auaggcgaucacgccuc

SEQ ID NO: 476926 - RNA, 21 nt, Chlamydia trachomatis
auagguagguuucugcuaaau

SEQ ID NO: 476927 - RNA, 21 nt, Chlamydia trachomatis
auaguaaaaacuauaaggaau

SEQ ID NO: 476928 - RNA, 15 nt, Chlamydia trachomatis
auagguucuauccau

SEQ ID NO: 476929 - RNA, 13 nt, Chlamydia trachomatis
auaguaccauaau

SEQ ID NO: 476930 - RNA, 19 nt, Chlamydia trachomatis
auaguaccauaauccuaug

SEQ ID NO: 476931 - RNA, 21 nt, Chlamydia trachomatis
auaguagagaauuagagauaa

SEQ ID NO: 476932 - RNA, 18 nt, Chlamydia trachomatis
auaguguaaggagagaaa

SEQ ID NO: 476933 - RNA, 16 nt, Chlamydia trachomatis
auaguuggugucuuug

SEQ ID NO: 476934 - RNA, 20 nt, Chlamydia trachomatis
auaguuuaggcggcauuuua

SEQ ID NO: 476935 - RNA, 19 nt, Chlamydia trachomatis
auaguuucgaguaauucca

SEQ ID NO: 476936 - RNA, 23 nt, Chlamydia trachomatis
auauaaauuuggauuagaaaaag

SEQ ID NO: 476937 - RNA, 13 nt, Chlamydia trachomatis
auauaagagaagg

SEQ ID NO: 476938 - RNA, 23 nt, Chlamydia trachomatis
auauaagagaagguaacaaugcu

SEQ ID NO: 476939 - RNA, 14 nt, Chlamydia trachomatis
auaucaaagagugu

SEQ ID NO: 476940 - RNA, 21 nt, Chlamydia trachomatis
auaucaaucguagaaaaccga

SEQ ID NO: 476941 - RNA, 13 nt, Chlamydia trachomatis
auaucaauuccug

SEQ ID NO: 476942 - RNA, 16 nt, Chlamydia trachomatis
auauagaccagagucu

SEQ ID NO: 476943 - RNA, 15 nt, Chlamydia trachomatis
auauauuuaagaagc

SEQ ID NO: 476944 - RNA, 13 nt, Chlamydia trachomatis
auaucuacuucuu

SEQ ID NO: 476945 - RNA, 17 nt, Chlamydia trachomatis
auaucuacuucuuguuc

SEQ ID NO: 476946 - RNA, 21 nt, Chlamydia trachomatis
auauccuuuuuacuaacuaaa

SEQ ID NO: 476947 - RNA, 16 nt, Chlamydia trachomatis
auaucuaggucuccca

SEQ ID NO: 476948 - RNA, 21 nt, Chlamydia trachomatis
auaucuagguugaagaggcaa

SEQ ID NO: 476949 - RNA, 12 nt, Chlamydia trachomatis
auaucuucugaa

SEQ ID NO: 476950 - RNA, 19 nt, Chlamydia trachomatis
auaucuuuacucuuuucuu

SEQ ID NO: 476951 - RNA, 20 nt, Chlamydia trachomatis
auaucuuuacucuuuucuuu

SEQ ID NO: 476952 - RNA, 15 nt, Chlamydia trachomatis
auaucuugucccauu

SEQ ID NO: 476953 - RNA, 22 nt, Chlamydia trachomatis
auauugccaaaaagaaaaucag

SEQ ID NO: 476954 - RNA, 19 nt, Chlamydia trachomatis
auauugccuacaagaccuc

SEQ ID NO: 476955 - RNA, 15 nt, Chlamydia trachomatis
auauuuugaagauaa

SEQ ID NO: 476956 - RNA, 18 nt, Chlamydia trachomatis
auauuuuugggaaaaaau

SEQ ID NO: 476957 - RNA, 21 nt, Chlamydia trachomatis
auauuuuugggaaaaaauuaa

SEQ ID NO: 476958 - RNA, 22 nt, Chlamydia trachomatis
aucaaaaaguucucucccuucc

SEQ ID NO: 476959 - RNA, 21 nt, Chlamydia trachomatis
auauucuugcuaagaacauaa

SEQ ID NO: 476960 - RNA, 23 nt, Chlamydia trachomatis
auaugauuacuggauaguccuuc

SEQ ID NO: 476961 - RNA, 13 nt, Chlamydia trachomatis
auauucagaagaa

SEQ ID NO: 476962 - RNA, 14 nt, Chlamydia trachomatis
auauucagaagaag

SEQ ID NO: 476963 - RNA, 16 nt, Chlamydia trachomatis
auauucagaagaagag

SEQ ID NO: 476964 - RNA, 22 nt, Chlamydia trachomatis
auauucagaagaagagcugcug

SEQ ID NO: 476965 - RNA, 20 nt, Chlamydia trachomatis
aucaaaacgcucagaaaacu

SEQ ID NO: 476966 - RNA, 15 nt, Chlamydia trachomatis
aucaaacagaaccuu

SEQ ID NO: 476967 - RNA, 22 nt, Chlamydia trachomatis
aucaaacagaaccuuuuuaaaa

SEQ ID NO: 476968 - RNA, 15 nt, Chlamydia trachomatis
aucaaggauaugugc

SEQ ID NO: 476969 - RNA, 13 nt, Chlamydia trachomatis
aucaaugauguag

SEQ ID NO: 476970 - RNA, 17 nt, Chlamydia trachomatis
aucaauuguucugcgaa

SEQ ID NO: 476971 - RNA, 22 nt, Chlamydia trachomatis
aucaauuguucugcgaaagaaa

SEQ ID NO: 476972 - RNA, 20 nt, Chlamydia trachomatis
aucacacgggucucuauauc

SEQ ID NO: 476973 - RNA, 14 nt, Chlamydia trachomatis
aucacagaaacgga

SEQ ID NO: 476974 - RNA, 15 nt, Chlamydia trachomatis
aucaccgaacaaccu

SEQ ID NO: 476975 - RNA, 20 nt, Chlamydia trachomatis
aucaccgaacaaccuucuga

SEQ ID NO: 476976 - RNA, 15 nt, Chlamydia trachomatis
aucaccacgagaucu

SEQ ID NO: 476977 - RNA, 15 nt, Chlamydia trachomatis
aucaccacuaauccc

SEQ ID NO: 476978 - RNA, 16 nt, Chlamydia trachomatis
aucacaugguuuucug

SEQ ID NO: 476979 - RNA, 13 nt, Chlamydia trachomatis
aucacagcaauag

SEQ ID NO: 476980 - RNA, 23 nt, Chlamydia trachomatis
aucacaggcugugauggaaaugu

SEQ ID NO: 476981 - RNA, 22 nt, Chlamydia trachomatis
aucacguaaugagaggugugaa

SEQ ID NO: 476982 - RNA, 21 nt, Chlamydia trachomatis
aucacggaaacugcaaggaug

SEQ ID NO: 476983 - RNA, 16 nt, Chlamydia trachomatis
aucacuccaagaagag

SEQ ID NO: 476984 - RNA, 13 nt, Chlamydia trachomatis
aucacuccuccuc

SEQ ID NO: 476985 - RNA, 15 nt, Chlamydia trachomatis
aucacuccuccuccu

SEQ ID NO: 476986 - RNA, 23 nt, Chlamydia trachomatis
aucacuccuccuccuaaacaaau

SEQ ID NO: 476987 - RNA, 14 nt, Chlamydia trachomatis
aucacuuccuuuuc

SEQ ID NO: 476988 - RNA, 12 nt, Chlamydia trachomatis
aucacuuucugc

SEQ ID NO: 476989 - RNA, 16 nt, Chlamydia trachomatis
aucagaaguugagcaa

SEQ ID NO: 476990 - RNA, 21 nt, Chlamydia trachomatis
aucagaagauaguacccacug

SEQ ID NO: 476991 - RNA, 16 nt, Chlamydia trachomatis
aucagccccaaaaaca

SEQ ID NO: 476992 - RNA, 22 nt, Chlamydia trachomatis
aucagcaaccauauauuuaggg

SEQ ID NO: 476993 - RNA, 22 nt, Chlamydia trachomatis
aucagcagauauggaagaacag

SEQ ID NO: 476994 - RNA, 16 nt, Chlamydia trachomatis
aucagcguugggauag

SEQ ID NO: 476995 - RNA, 22 nt, Chlamydia trachomatis
aucagcguugggauagaggaaa

SEQ ID NO: 476996 - RNA, 16 nt, Chlamydia trachomatis
aucagcuguuccuuuu

SEQ ID NO: 476997 - RNA, 17 nt, Chlamydia trachomatis
aucgaaaauagauuuuc

SEQ ID NO: 476998 - RNA, 15 nt, Chlamydia trachomatis
auccuuuucagaauu

SEQ ID NO: 476999 - RNA, 21 nt, Chlamydia trachomatis
auccuuuuggaagaucucuuu

SEQ ID NO: 477000 - RNA, 22 nt, Chlamydia trachomatis
auccuuuuggaagaucucuuuc

SEQ ID NO: 477001 - RNA, 20 nt, Chlamydia trachomatis
aucgaggugguauagaggaa

SEQ ID NO: 477002 - RNA, 15 nt, Chlamydia trachomatis
aucgaguagcaauaa

SEQ ID NO: 477003 - RNA, 18 nt, Chlamydia trachomatis
aucgagucccuucaauca

SEQ ID NO: 477004 - RNA, 20 nt, Chlamydia trachomatis
aucgcacacaauaaaucaug

SEQ ID NO: 477005 - RNA, 13 nt, Chlamydia trachomatis
aucgaucacagaa

SEQ ID NO: 477006 - RNA, 20 nt, Chlamydia trachomatis
aucgcgacuaaagacuguuu

SEQ ID NO: 477007 - RNA, 23 nt, Chlamydia trachomatis
aucgccuauagaagacuaaucuu

SEQ ID NO: 477008 - RNA, 17 nt, Chlamydia trachomatis
aucggauagagaagaau

SEQ ID NO: 477009 - RNA, 19 nt, Chlamydia trachomatis
aucggauagagaagaauug

SEQ ID NO: 477010 - RNA, 19 nt, Chlamydia trachomatis
aucgguaacuaaauuuuua

SEQ ID NO: 477011 - RNA, 22 nt, Chlamydia trachomatis
aucuaaaauaucauccgcuaaa

SEQ ID NO: 477012 - RNA, 16 nt, Chlamydia trachomatis
aucuaaaauuuccuua

SEQ ID NO: 477013 - RNA, 13 nt, Chlamydia trachomatis
aucuaaagaaaug

SEQ ID NO: 477014 - RNA, 14 nt, Chlamydia trachomatis
aucuaaagaaaugg

SEQ ID NO: 477015 - RNA, 19 nt, Chlamydia trachomatis
aucuaaagaaauggucucu

SEQ ID NO: 477016 - RNA, 22 nt, Chlamydia trachomatis
aucuacaugguaccuucucaaa

SEQ ID NO: 477017 - RNA, 20 nt, Chlamydia trachomatis
aucuaccacggauaaagaaa

SEQ ID NO: 477018 - RNA, 21 nt, Chlamydia trachomatis
aucuacaccauuacgaggaag

SEQ ID NO: 477019 - RNA, 12 nt, Chlamydia trachomatis
aucuaaaggcaa

SEQ ID NO: 477020 - RNA, 18 nt, Chlamydia trachomatis
aucuaaagucugaauaua

SEQ ID NO: 477021 - RNA, 20 nt, Chlamydia trachomatis
aucuagguugaagaggcaag

SEQ ID NO: 477022 - RNA, 14 nt, Chlamydia trachomatis
aucuagacauagcu

SEQ ID NO: 477023 - RNA, 21 nt, Chlamydia trachomatis
aucuagacauagcuuguuccg

SEQ ID NO: 477024 - RNA, 21 nt, Chlamydia trachomatis
aucuagagguauuuuauucaa

SEQ ID NO: 477025 - RNA, 21 nt, Chlamydia trachomatis
aucuacgaguuucucgcagau

SEQ ID NO: 477026 - RNA, 15 nt, Chlamydia trachomatis
aucuagaaaagagca

SEQ ID NO: 477027 - RNA, 16 nt, Chlamydia trachomatis
aucuagaaaagagcag

SEQ ID NO: 477028 - RNA, 18 nt, Chlamydia trachomatis
aucuauccauaauuuucu

SEQ ID NO: 477029 - RNA, 13 nt, Chlamydia trachomatis
aucuaucuuucuu

SEQ ID NO: 477030 - RNA, 15 nt, Chlamydia trachomatis
aucuauuuuauacuu

SEQ ID NO: 477031 - RNA, 16 nt, Chlamydia trachomatis
aucuauuuucucuuua

SEQ ID NO: 477032 - RNA, 17 nt, Chlamydia trachomatis
aucucaaaguuuuuguu

SEQ ID NO: 477033 - RNA, 15 nt, Chlamydia trachomatis
aucucaagucuccac

SEQ ID NO: 477034 - RNA, 16 nt, Chlamydia trachomatis
aucucaggauaaaacc

SEQ ID NO: 477035 - RNA, 13 nt, Chlamydia trachomatis
aucuccaaucaca

SEQ ID NO: 477036 - RNA, 16 nt, Chlamydia trachomatis
aucuccaaucacagca

SEQ ID NO: 477037 - RNA, 19 nt, Chlamydia trachomatis
aucuccaaucacagcaaua

SEQ ID NO: 477038 - RNA, 15 nt, Chlamydia trachomatis
aucuccaacagugac

SEQ ID NO: 477039 - RNA, 14 nt, Chlamydia trachomatis
aucuccagaaauaa

SEQ ID NO: 477040 - RNA, 13 nt, Chlamydia trachomatis
aucuccaaagaca

SEQ ID NO: 477041 - RNA, 22 nt, Chlamydia trachomatis
aucuccuauugagcgcaaagcg

SEQ ID NO: 477042 - RNA, 14 nt, Chlamydia trachomatis
aucuccucauccuu

SEQ ID NO: 477043 - RNA, 16 nt, Chlamydia trachomatis
aucuccucauccuuuu

SEQ ID NO: 477044 - RNA, 17 nt, Chlamydia trachomatis
aucuccucauccuuuug

SEQ ID NO: 477045 - RNA, 20 nt, Chlamydia trachomatis
aucucccucaccucuugccu

SEQ ID NO: 477046 - RNA, 15 nt, Chlamydia trachomatis
aucucccucauuuaa

SEQ ID NO: 477047 - RNA, 20 nt, Chlamydia trachomatis
aucuccucuggagccgucug

SEQ ID NO: 477048 - RNA, 13 nt, Chlamydia trachomatis
aucuccugcagcu

SEQ ID NO: 477049 - RNA, 14 nt, Chlamydia trachomatis
aucuccugcagcua

SEQ ID NO: 477050 - RNA, 15 nt, Chlamydia trachomatis
aucuccuuaauugga

SEQ ID NO: 477051 - RNA, 21 nt, Chlamydia trachomatis
aucuccuuugcuaacaaagaa

SEQ ID NO: 477052 - RNA, 13 nt, Chlamydia trachomatis
aucucgaaagacu

SEQ ID NO: 477053 - RNA, 15 nt, Chlamydia trachomatis
aucucgagucaagaa

SEQ ID NO: 477054 - RNA, 16 nt, Chlamydia trachomatis
aucucguucuacagga

SEQ ID NO: 477055 - RNA, 17 nt, Chlamydia trachomatis
aucucguuucuguuaca

SEQ ID NO: 477056 - RNA, 15 nt, Chlamydia trachomatis
aucucuaccagggau

SEQ ID NO: 477057 - RNA, 19 nt, Chlamydia trachomatis
aucucucagcagaucaucc

SEQ ID NO: 477058 - RNA, 22 nt, Chlamydia trachomatis
aucucuccagaguucauuuuuu

SEQ ID NO: 477059 - RNA, 17 nt, Chlamydia trachomatis
aucucgguauucucaau

SEQ ID NO: 477060 - RNA, 19 nt, Chlamydia trachomatis
aucucggucuuagaaggau

SEQ ID NO: 477061 - RNA, 19 nt, Chlamydia trachomatis
aucucugaaagagcuucuu

SEQ ID NO: 477062 - RNA, 20 nt, Chlamydia trachomatis
aucucugcaacaaagaguuu

SEQ ID NO: 477063 - RNA, 15 nt, Chlamydia trachomatis
aucucugcagaagaa

SEQ ID NO: 477064 - RNA, 13 nt, Chlamydia trachomatis
aucucuggaaaag

SEQ ID NO: 477065 - RNA, 23 nt, Chlamydia trachomatis
aucucugguaaaaauagaaaacg

SEQ ID NO: 477066 - RNA, 16 nt, Chlamydia trachomatis
aucucuucacagguau

SEQ ID NO: 477067 - RNA, 18 nt, Chlamydia trachomatis
aucucuuccuuguagaaa

SEQ ID NO: 477068 - RNA, 20 nt, Chlamydia trachomatis
aucucuuuaagcugggaaag

SEQ ID NO: 477069 - RNA, 23 nt, Chlamydia trachomatis
aucucuuucucuagaauuucccu

SEQ ID NO: 477070 - RNA, 16 nt, Chlamydia trachomatis
aucugaaaagagaaga

SEQ ID NO: 477071 - RNA, 18 nt, Chlamydia trachomatis
aucugaaaagagaagaag

SEQ ID NO: 477072 - RNA, 20 nt, Chlamydia trachomatis
aucugaaaagagaagaaggc

SEQ ID NO: 477073 - RNA, 14 nt, Chlamydia trachomatis
aucugauaggaaua

SEQ ID NO: 477074 - RNA, 22 nt, Chlamydia trachomatis
aucugcaacaaauaccaaaaua

SEQ ID NO: 477075 - RNA, 22 nt, Chlamydia trachomatis
aucugcgacgagguuuuuucuu

SEQ ID NO: 477076 - RNA, 23 nt, Chlamydia trachomatis
aucugcgacgagguuuuuucuuc

SEQ ID NO: 477077 - RNA, 17 nt, Chlamydia trachomatis
aucugcgguauccauac

SEQ ID NO: 477078 - RNA, 16 nt, Chlamydia trachomatis
aucuucuuaauugccu

SEQ ID NO: 477079 - RNA, 14 nt, Chlamydia trachomatis
aucugguauucuaa

SEQ ID NO: 477080 - RNA, 16 nt, Chlamydia trachomatis
aucuucucgaaagaga

SEQ ID NO: 477081 - RNA, 23 nt, Chlamydia trachomatis
aucuucucgaaagagaacacgua

SEQ ID NO: 477082 - RNA, 17 nt, Chlamydia trachomatis
aucuucucuugaaucaa

SEQ ID NO: 477083 - RNA, 14 nt, Chlamydia trachomatis
aucuucugaaaaau

SEQ ID NO: 477084 - RNA, 23 nt, Chlamydia trachomatis
aucuucuggagcaacuucuaaga

SEQ ID NO: 477085 - RNA, 16 nt, Chlamydia trachomatis
aucugggauggaaaua

SEQ ID NO: 477086 - RNA, 21 nt, Chlamydia trachomatis
aucugcuaauaguucucugca

SEQ ID NO: 477087 - RNA, 18 nt, Chlamydia trachomatis
aucuugaucugaaaagag

SEQ ID NO: 477088 - RNA, 15 nt, Chlamydia trachomatis
aucuuuccagcaggc

SEQ ID NO: 477089 - RNA, 20 nt, Chlamydia trachomatis
augaaagcgugcauuugagg

SEQ ID NO: 477090 - RNA, 18 nt, Chlamydia trachomatis
augaaacucuuuuuaaau

SEQ ID NO: 477091 - RNA, 17 nt, Chlamydia trachomatis
augaaaccccucuuucu

SEQ ID NO: 477092 - RNA, 18 nt, Chlamydia trachomatis
augaaaccccucuuucuc

SEQ ID NO: 477093 - RNA, 21 nt, Chlamydia trachomatis
augaaaccccucuuucucucc

SEQ ID NO: 477094 - RNA, 22 nt, Chlamydia trachomatis
aucuuucgaauuggaucucccu

SEQ ID NO: 477095 - RNA, 13 nt, Chlamydia trachomatis
aucuuuugcugug

SEQ ID NO: 477096 - RNA, 17 nt, Chlamydia trachomatis
augaagcaauauaacua

SEQ ID NO: 477097 - RNA, 14 nt, Chlamydia trachomatis
augaagcuaaaaaa

SEQ ID NO: 477098 - RNA, 16 nt, Chlamydia trachomatis
augaaauaucauuccc

SEQ ID NO: 477099 - RNA, 13 nt, Chlamydia trachomatis
augagaagaaagg

SEQ ID NO: 477100 - RNA, 23 nt, Chlamydia trachomatis
augagaagaaaggucugcauauu

SEQ ID NO: 477101 - RNA, 20 nt, Chlamydia trachomatis
augagaaauaaaaaccuuga

SEQ ID NO: 477102 - RNA, 16 nt, Chlamydia trachomatis
augacgcagcaacaac

SEQ ID NO: 477103 - RNA, 21 nt, Chlamydia trachomatis
augacgaggggcuaccucuaa

SEQ ID NO: 477104 - RNA, 16 nt, Chlamydia trachomatis
augagaccgucaaaaa

SEQ ID NO: 477105 - RNA, 14 nt, Chlamydia trachomatis
augagagaaaaggc

SEQ ID NO: 477106 - RNA, 19 nt, Chlamydia trachomatis
augagagcagcuacaaccu

SEQ ID NO: 477107 - RNA, 17 nt, Chlamydia trachomatis
augagagcuuccacagc

SEQ ID NO: 477108 - RNA, 20 nt, Chlamydia trachomatis
augagagcuuccacagcagu

SEQ ID NO: 477109 - RNA, 20 nt, Chlamydia trachomatis
augaauguggggagagcaaa

SEQ ID NO: 477110 - RNA, 17 nt, Chlamydia trachomatis
augaaucagcuuuucca

SEQ ID NO: 477111 - RNA, 18 nt, Chlamydia trachomatis
augaagguuucuaaaaaa

SEQ ID NO: 477112 - RNA, 19 nt, Chlamydia trachomatis
augaagguuucuaaaaaac

SEQ ID NO: 477113 - RNA, 20 nt, Chlamydia trachomatis
augaagguuucuaaaaaacu

SEQ ID NO: 477114 - RNA, 22 nt, Chlamydia trachomatis
augaaggccaaagaaauagcua

SEQ ID NO: 477115 - RNA, 16 nt, Chlamydia trachomatis
augaugaguggauacg

SEQ ID NO: 477116 - RNA, 21 nt, Chlamydia trachomatis
augaugagaaugugacuaaag

SEQ ID NO: 477117 - RNA, 17 nt, Chlamydia trachomatis
augaguggcaaggggga

SEQ ID NO: 477118 - RNA, 22 nt, Chlamydia trachomatis
augaguuccgaacaaaaugaac

SEQ ID NO: 477119 - RNA, 15 nt, Chlamydia trachomatis
augauaaaacucccc

SEQ ID NO: 477120 - RNA, 15 nt, Chlamydia trachomatis
augauuucuuuaaca

SEQ ID NO: 477121 - RNA, 13 nt, Chlamydia trachomatis
augcaacccccac

SEQ ID NO: 477122 - RNA, 14 nt, Chlamydia trachomatis
augcaaagcuuuuc

SEQ ID NO: 477123 - RNA, 14 nt, Chlamydia trachomatis
augcaaauaagaaa

SEQ ID NO: 477124 - RNA, 21 nt, Chlamydia trachomatis
augcaaauaagaaaguuuuuu

SEQ ID NO: 477125 - RNA, 20 nt, Chlamydia trachomatis
augcaggauauucggagcaa

SEQ ID NO: 477126 - RNA, 14 nt, Chlamydia trachomatis
augcaguaaagaaa

SEQ ID NO: 477127 - RNA, 15 nt, Chlamydia trachomatis
augcaguaaagaaaa

SEQ ID NO: 477128 - RNA, 21 nt, Chlamydia trachomatis
augcaguaaagaaaagcuccu

SEQ ID NO: 477129 - RNA, 16 nt, Chlamydia trachomatis
augcaaguaaugacac

SEQ ID NO: 477130 - RNA, 15 nt, Chlamydia trachomatis
augcaauaaacgcuu

SEQ ID NO: 477131 - RNA, 17 nt, Chlamydia trachomatis
augcaaucccguauauu

SEQ ID NO: 477132 - RNA, 16 nt, Chlamydia trachomatis
augcaauccuucuuga

SEQ ID NO: 477133 - RNA, 21 nt, Chlamydia trachomatis
augccagaagcuaugagaauu

SEQ ID NO: 477134 - RNA, 23 nt, Chlamydia trachomatis
augccaauugcgguaaacaaugc

SEQ ID NO: 477135 - RNA, 17 nt, Chlamydia trachomatis
augccacacuuccccau

SEQ ID NO: 477136 - RNA, 18 nt, Chlamydia trachomatis
augccacacuuccccauu

SEQ ID NO: 477137 - RNA, 17 nt, Chlamydia trachomatis
augccaccuaauaugca

SEQ ID NO: 477138 - RNA, 21 nt, Chlamydia trachomatis
augccaagccauuuuguaauu

SEQ ID NO: 477139 - RNA, 13 nt, Chlamydia trachomatis
augcccaggauaa

SEQ ID NO: 477140 - RNA, 17 nt, Chlamydia trachomatis
augccauccauaacgaa

SEQ ID NO: 477141 - RNA, 22 nt, Chlamydia trachomatis
augccgcccaaggaaaagauga

SEQ ID NO: 477142 - RNA, 11 nt, Chlamydia trachomatis
augccucuaag

SEQ ID NO: 477143 - RNA, 16 nt, Chlamydia trachomatis
augccuucuuccuuca

SEQ ID NO: 477144 - RNA, 22 nt, Chlamydia trachomatis
augccuugaggauaguauucuu

SEQ ID NO: 477145 - RNA, 20 nt, Chlamydia trachomatis
augccuuuugcacaaaggaa

SEQ ID NO: 477146 - RNA, 16 nt, Chlamydia trachomatis
auggcagaugcaucua

SEQ ID NO: 477147 - RNA, 18 nt, Chlamydia trachomatis
auggcauucaaccucuca

SEQ ID NO: 477148 - RNA, 15 nt, Chlamydia trachomatis
auggcauuuacaaac

SEQ ID NO: 477149 - RNA, 18 nt, Chlamydia trachomatis
auggcucagcuucaacug

SEQ ID NO: 477150 - RNA, 15 nt, Chlamydia trachomatis
auggcucguaaaaaa

SEQ ID NO: 477151 - RNA, 16 nt, Chlamydia trachomatis
auggcucccagagaau

SEQ ID NO: 477152 - RNA, 15 nt, Chlamydia trachomatis
augggcuccuucaug

SEQ ID NO: 477153 - RNA, 21 nt, Chlamydia trachomatis
augguaauggcuguagcacaa

SEQ ID NO: 477154 - RNA, 15 nt, Chlamydia trachomatis
augguuacuugccuc

SEQ ID NO: 477155 - RNA, 23 nt, Chlamydia trachomatis
auguaaaaaaucuugucguuccu

SEQ ID NO: 477156 - RNA, 22 nt, Chlamydia trachomatis
auguaaaaauucuaaaguaaga

SEQ ID NO: 477157 - RNA, 21 nt, Chlamydia trachomatis
auguaaaaugagaaauaaaaa

SEQ ID NO: 477158 - RNA, 12 nt, Chlamydia trachomatis
auguaagaguuu

SEQ ID NO: 477159 - RNA, 11 nt, Chlamydia trachomatis
auguaggguuu

SEQ ID NO: 477160 - RNA, 19 nt, Chlamydia trachomatis
auguaagcgagauaaggac

SEQ ID NO: 477161 - RNA, 12 nt, Chlamydia trachomatis
auguaaggaaau

SEQ ID NO: 477162 - RNA, 21 nt, Chlamydia trachomatis
auguaagguuugucuucagau

SEQ ID NO: 477163 - RNA, 13 nt, Chlamydia trachomatis
auguccaaagcuc

SEQ ID NO: 477164 - RNA, 13 nt, Chlamydia trachomatis
auguccauacaaa

SEQ ID NO: 477165 - RNA, 16 nt, Chlamydia trachomatis
auguguuucuggaaag

SEQ ID NO: 477166 - RNA, 12 nt, Chlamydia trachomatis
auguuaaagccc

SEQ ID NO: 477167 - RNA, 22 nt, Chlamydia trachomatis
augucgagauaaaaaccucuuc

SEQ ID NO: 477168 - RNA, 12 nt, Chlamydia trachomatis
auguccucuuua

SEQ ID NO: 477169 - RNA, 12 nt, Chlamydia trachomatis
augucuuuuuca

SEQ ID NO: 477170 - RNA, 15 nt, Chlamydia trachomatis
augugcaagauauuc

SEQ ID NO: 477171 - RNA, 21 nt, Chlamydia trachomatis
augugcaagauauucccuaaa

SEQ ID NO: 477172 - RNA, 22 nt, Chlamydia trachomatis
auguuucccuucuuucuucuaa

SEQ ID NO: 477173 - RNA, 15 nt, Chlamydia trachomatis
auguugugugaugaa

SEQ ID NO: 477174 - RNA, 15 nt, Chlamydia trachomatis
auguuguuaaagcuu

SEQ ID NO: 477175 - RNA, 16 nt, Chlamydia trachomatis
auguuggagaacaucg

SEQ ID NO: 477176 - RNA, 20 nt, Chlamydia trachomatis
auuaaaagaccucuuuuuuu

SEQ ID NO: 477177 - RNA, 11 nt, Chlamydia trachomatis
auuaaacuccc

SEQ ID NO: 477178 - RNA, 23 nt, Chlamydia trachomatis
auuaaacuaugcaaaguuucuga

SEQ ID NO: 477179 - RNA, 17 nt, Chlamydia trachomatis
auuaaagacuacaaaac

SEQ ID NO: 477180 - RNA, 12 nt, Chlamydia trachomatis
auuaaagcuuua

SEQ ID NO: 477181 - RNA, 17 nt, Chlamydia trachomatis
auuaaaucgugagcguc

SEQ ID NO: 477182 - RNA, 14 nt, Chlamydia trachomatis
auuaacaacaaugu

SEQ ID NO: 477183 - RNA, 13 nt, Chlamydia trachomatis
auuaagaaucuuu

SEQ ID NO: 477184 - RNA, 12 nt, Chlamydia trachomatis
auuaauaaugaa

SEQ ID NO: 477185 - RNA, 20 nt, Chlamydia trachomatis
auuaauagcggguucuuuug

SEQ ID NO: 477186 - RNA, 21 nt, Chlamydia trachomatis
auuacgaggaagcuguuuaug

SEQ ID NO: 477187 - RNA, 14 nt, Chlamydia trachomatis
auuacuacaacagg

SEQ ID NO: 477188 - RNA, 16 nt, Chlamydia trachomatis
auuaccauaucaaaaa

SEQ ID NO: 477189 - RNA, 17 nt, Chlamydia trachomatis
auuacccugaaagacuu

SEQ ID NO: 477190 - RNA, 18 nt, Chlamydia trachomatis
auuacccugaaagacuuu

SEQ ID NO: 477191 - RNA, 13 nt, Chlamydia trachomatis
auuacgaauagcc

SEQ ID NO: 477192 - RNA, 13 nt, Chlamydia trachomatis
auuacaaaucgua

SEQ ID NO: 477193 - RNA, 16 nt, Chlamydia trachomatis
auuacaauaauacaaa

SEQ ID NO: 477194 - RNA, 17 nt, Chlamydia trachomatis
auuacagcaagaagaag

SEQ ID NO: 477195 - RNA, 19 nt, Chlamydia trachomatis
auuacauauagcauggaag

SEQ ID NO: 477196 - RNA, 13 nt, Chlamydia trachomatis
auuagacacuaaa

SEQ ID NO: 477197 - RNA, 21 nt, Chlamydia trachomatis
auuacugacugguuccccaag

SEQ ID NO: 477198 - RNA, 19 nt, Chlamydia trachomatis
auuacuucagcaacauuca

SEQ ID NO: 477199 - RNA, 15 nt, Chlamydia trachomatis
auuagaaaaagggag

SEQ ID NO: 477200 - RNA, 20 nt, Chlamydia trachomatis
auuagaaaaagggagaggau

SEQ ID NO: 477201 - RNA, 22 nt, Chlamydia trachomatis
auuagucgugugaacggaggau

SEQ ID NO: 477202 - RNA, 18 nt, Chlamydia trachomatis
auucagaacaagugcagc

SEQ ID NO: 477203 - RNA, 20 nt, Chlamydia trachomatis
auucacuuucccccaccuuu

SEQ ID NO: 477204 - RNA, 17 nt, Chlamydia trachomatis
auucacgaguuuuagga

SEQ ID NO: 477205 - RNA, 22 nt, Chlamydia trachomatis
auucacgcaucccaaaauagca

SEQ ID NO: 477206 - RNA, 17 nt, Chlamydia trachomatis
auucacuaccagaggag

SEQ ID NO: 477207 - RNA, 19 nt, Chlamydia trachomatis
auucacacuuaaaaagaaa

SEQ ID NO: 477208 - RNA, 15 nt, Chlamydia trachomatis
auucacccaaauaua

SEQ ID NO: 477209 - RNA, 21 nt, Chlamydia trachomatis
auucacccaaauauacucaac

SEQ ID NO: 477210 - RNA, 14 nt, Chlamydia trachomatis
auucaaaauccauu

SEQ ID NO: 477211 - RNA, 21 nt, Chlamydia trachomatis
auuauuugccucuauguucuu

SEQ ID NO: 477212 - RNA, 13 nt, Chlamydia trachomatis
auucaaaucuucu

SEQ ID NO: 477213 - RNA, 19 nt, Chlamydia trachomatis
auucaaaucuucuucuaag

SEQ ID NO: 477214 - RNA, 13 nt, Chlamydia trachomatis
auucaaccucuca

SEQ ID NO: 477215 - RNA, 20 nt, Chlamydia trachomatis
auucaaccucucaucaguaa

SEQ ID NO: 477216 - RNA, 17 nt, Chlamydia trachomatis
auucaacuggucuucca

SEQ ID NO: 477217 - RNA, 15 nt, Chlamydia trachomatis
auucaagaccaaaag

SEQ ID NO: 477218 - RNA, 22 nt, Chlamydia trachomatis
auucaagugacuuuuagcaaau

SEQ ID NO: 477219 - RNA, 19 nt, Chlamydia trachomatis
auuaucuuguguagaagaa

SEQ ID NO: 477220 - RNA, 20 nt, Chlamydia trachomatis
auuaugaucacuaauauaga

SEQ ID NO: 477221 - RNA, 20 nt, Chlamydia trachomatis
auuaugauuccgcugcucua

SEQ ID NO: 477222 - RNA, 21 nt, Chlamydia trachomatis
auuaucuaaaaaaauucuugc

SEQ ID NO: 477223 - RNA, 16 nt, Chlamydia trachomatis
auuaucucgacuugcu

SEQ ID NO: 477224 - RNA, 17 nt, Chlamydia trachomatis
auuaucgagaaccaauc

SEQ ID NO: 477225 - RNA, 15 nt, Chlamydia trachomatis
auuaucgccaaaaau

SEQ ID NO: 477226 - RNA, 14 nt, Chlamydia trachomatis
auuaucacauucuu

SEQ ID NO: 477227 - RNA, 22 nt, Chlamydia trachomatis
auuaucacauucuuagauuuuc

SEQ ID NO: 477228 - RNA, 14 nt, Chlamydia trachomatis
auuauuuaaaacaa

SEQ ID NO: 477229 - RNA, 17 nt, Chlamydia trachomatis
auuauuccgagagaagc

SEQ ID NO: 477230 - RNA, 15 nt, Chlamydia trachomatis
auuucagcaucaaua

SEQ ID NO: 477231 - RNA, 16 nt, Chlamydia trachomatis
auuucagcaucaauaa

SEQ ID NO: 477232 - RNA, 20 nt, Chlamydia trachomatis
auuucagagccagcuuuaaa

SEQ ID NO: 477233 - RNA, 17 nt, Chlamydia trachomatis
auuucaggaguaggaag

SEQ ID NO: 477234 - RNA, 15 nt, Chlamydia trachomatis
auuuaauaaguuuuu

SEQ ID NO: 477235 - RNA, 15 nt, Chlamydia trachomatis
auuuagagaauaauc

SEQ ID NO: 477236 - RNA, 13 nt, Chlamydia trachomatis
auuuauccacagg

SEQ ID NO: 477237 - RNA, 16 nt, Chlamydia trachomatis
auugucgaauuuuucu

SEQ ID NO: 477238 - RNA, 15 nt, Chlamydia trachomatis
auugucuaaguuggc

SEQ ID NO: 477239 - RNA, 20 nt, Chlamydia trachomatis
auugucuacuuuuuguuuag

SEQ ID NO: 477240 - RNA, 23 nt, Chlamydia trachomatis
auugucuacuuuuuguuuagaca

SEQ ID NO: 477241 - RNA, 22 nt, Chlamydia trachomatis
auugugcaagccccccucugca

SEQ ID NO: 477242 - RNA, 20 nt, Chlamydia trachomatis
auucuggaggaggaccucug

SEQ ID NO: 477243 - RNA, 14 nt, Chlamydia trachomatis
auucuggcauagca

SEQ ID NO: 477244 - RNA, 13 nt, Chlamydia trachomatis
auucuaggaagcu

SEQ ID NO: 477245 - RNA, 22 nt, Chlamydia trachomatis
auucuccgauaauuuuccuuuu

SEQ ID NO: 477246 - RNA, 23 nt, Chlamydia trachomatis
auugacggccuguaugugaaaau

SEQ ID NO: 477247 - RNA, 14 nt, Chlamydia trachomatis
auugaaguucuuuu

SEQ ID NO: 477248 - RNA, 15 nt, Chlamydia trachomatis
auugaaguucuuuuu

SEQ ID NO: 477249 - RNA, 23 nt, Chlamydia trachomatis
auugagaaauaaucaucucaagu

SEQ ID NO: 477250 - RNA, 23 nt, Chlamydia trachomatis
auugagaugaucccaucggcuuu

SEQ ID NO: 477251 - RNA, 13 nt, Chlamydia trachomatis
auugagcaaaaaa

SEQ ID NO: 477252 - RNA, 21 nt, Chlamydia trachomatis
auugagcacaagcuguuccua

SEQ ID NO: 477253 - RNA, 17 nt, Chlamydia trachomatis
auucuuagcccagauuu

SEQ ID NO: 477254 - RNA, 22 nt, Chlamydia trachomatis
auugauuuuuucgcuuuugguu

SEQ ID NO: 477255 - RNA, 14 nt, Chlamydia trachomatis
auugccauguuuuu

SEQ ID NO: 477256 - RNA, 23 nt, Chlamydia trachomatis
auugcacuaaagagcuucggcua

SEQ ID NO: 477257 - RNA, 20 nt, Chlamydia trachomatis
auugcucuaaagucuuucca

SEQ ID NO: 477258 - RNA, 23 nt, Chlamydia trachomatis
auugcucuaaagucuuuccauuu

SEQ ID NO: 477259 - RNA, 23 nt, Chlamydia trachomatis
auugcucuauaggcaaaagauga

SEQ ID NO: 477260 - RNA, 17 nt, Chlamydia trachomatis
auugcuaaggaaagaga

SEQ ID NO: 477261 - RNA, 19 nt, Chlamydia trachomatis
auugcgagggauauuucuu

SEQ ID NO: 477262 - RNA, 18 nt, Chlamydia trachomatis
auuggcacggagaucaua

SEQ ID NO: 477263 - RNA, 21 nt, Chlamydia trachomatis
auuggcucgcaguacuuuacc

SEQ ID NO: 477264 - RNA, 12 nt, Chlamydia trachomatis
auuggaucuccc

SEQ ID NO: 477265 - RNA, 14 nt, Chlamydia trachomatis
auuggagacaacaa

SEQ ID NO: 477266 - RNA, 17 nt, Chlamydia trachomatis
auugcuucauaaaaaag

SEQ ID NO: 477267 - RNA, 20 nt, Chlamydia trachomatis
auuucuuccugugacuuggu

SEQ ID NO: 477268 - RNA, 12 nt, Chlamydia trachomatis
auuucuucuuug

SEQ ID NO: 477269 - RNA, 20 nt, Chlamydia trachomatis
auuuguaguucuaacaucaa

SEQ ID NO: 477270 - RNA, 21 nt, Chlamydia trachomatis
auuuuaaacauucgaaucauu

SEQ ID NO: 477271 - RNA, 17 nt, Chlamydia trachomatis
auuuggcguauuucuug

SEQ ID NO: 477272 - RNA, 15 nt, Chlamydia trachomatis
auuuggauuagaaaa

SEQ ID NO: 477273 - RNA, 14 nt, Chlamydia trachomatis
auuuggaucucuua

SEQ ID NO: 477274 - RNA, 18 nt, Chlamydia trachomatis
auuugcucguuagcagaa

SEQ ID NO: 477275 - RNA, 15 nt, Chlamydia trachomatis
auuugcguuacagau

SEQ ID NO: 477276 - RNA, 17 nt, Chlamydia trachomatis
auuugcguuacagaugc

SEQ ID NO: 477277 - RNA, 12 nt, Chlamydia trachomatis
auuuugaggcuu

SEQ ID NO: 477278 - RNA, 17 nt, Chlamydia trachomatis
auuuugucgauaagaag

SEQ ID NO: 477279 - RNA, 16 nt, Chlamydia trachomatis
auuuuguuaagaauua

SEQ ID NO: 477280 - RNA, 23 nt, Chlamydia trachomatis
auuuucggcaggccuuccaccuu

SEQ ID NO: 477281 - RNA, 14 nt, Chlamydia trachomatis
auuuucucucuagc

SEQ ID NO: 477282 - RNA, 19 nt, Chlamydia trachomatis
auuuucaucauaacauggu

SEQ ID NO: 477283 - RNA, 18 nt, Chlamydia trachomatis
auuuuccucuucacagag

SEQ ID NO: 477284 - RNA, 17 nt, Chlamydia trachomatis
auuuucagcaaaagaag

SEQ ID NO: 477285 - RNA, 15 nt, Chlamydia trachomatis
auuuucaguguugag

SEQ ID NO: 477286 - RNA, 15 nt, Chlamydia trachomatis
auuuucaucaaaaua

SEQ ID NO: 477287 - RNA, 19 nt, Chlamydia trachomatis
auuuuagauaaaagaagca

SEQ ID NO: 477288 - RNA, 16 nt, Chlamydia trachomatis
auuuuauucaaaucuu

SEQ ID NO: 477289 - RNA, 15 nt, Chlamydia trachomatis
auuuuauugagcugg

SEQ ID NO: 477290 - RNA, 12 nt, Chlamydia trachomatis
auuuuaaauccc

SEQ ID NO: 477291 - RNA, 12 nt, Chlamydia trachomatis
auuuuagagaaa

SEQ ID NO: 477292 - RNA, 13 nt, Chlamydia trachomatis
auuuuagagaaaa

SEQ ID NO: 477293 - RNA, 17 nt, Chlamydia trachomatis
auuuuagagaaaagaaa

SEQ ID NO: 477294 - RNA, 22 nt, Chlamydia trachomatis
auuuuucuuugagaaaguuaaa

SEQ ID NO: 477295 - RNA, 18 nt, Chlamydia trachomatis
auuuuucagaaaaaguaa

SEQ ID NO: 477296 - RNA, 12 nt, Chlamydia trachomatis
auuuuuccauuu

SEQ ID NO: 477297 - RNA, 16 nt, Chlamydia trachomatis
auuuuucugcuagaua

SEQ ID NO: 477298 - RNA, 18 nt, Chlamydia trachomatis
auuuuucuguaauaagug

SEQ ID NO: 477299 - RNA, 20 nt, Chlamydia trachomatis
auuuuuuucgauagaaaaaa

SEQ ID NO: 477300 - RNA, 21 nt, Chlamydia trachomatis
auuuuuuuuguguaauagcua

SEQ ID NO: 477301 - RNA, 14 nt, Chlamydia trachomatis
auuuuuuuauccaa

SEQ ID NO: 477302 - RNA, 16 nt, Chlamydia trachomatis
caaaaacacuacgcua

SEQ ID NO: 477303 - RNA, 20 nt, Chlamydia trachomatis
caaaaaccagccuauuagau

SEQ ID NO: 477304 - RNA, 13 nt, Chlamydia trachomatis
caaaaagaaagcc

SEQ ID NO: 477305 - RNA, 15 nt, Chlamydia trachomatis
caaaaagaaagccuu

SEQ ID NO: 477306 - RNA, 19 nt, Chlamydia trachomatis
caaaaauaacgauucuuga

SEQ ID NO: 477307 - RNA, 16 nt, Chlamydia trachomatis
caaaaauauggggcca

SEQ ID NO: 477308 - RNA, 19 nt, Chlamydia trachomatis
caaaaauauggggccagca

SEQ ID NO: 477309 - RNA, 13 nt, Chlamydia trachomatis
caaaaaucugcaa

SEQ ID NO: 477310 - RNA, 20 nt, Chlamydia trachomatis
caaaaaucugcaacaaauac

SEQ ID NO: 477311 - RNA, 15 nt, Chlamydia trachomatis
caaaacaaacaauaa

SEQ ID NO: 477312 - RNA, 14 nt, Chlamydia trachomatis
caaaacauaacacc

SEQ ID NO: 477313 - RNA, 23 nt, Chlamydia trachomatis
caaaaccacacuucucgaaaaaa

SEQ ID NO: 477314 - RNA, 13 nt, Chlamydia trachomatis
caaaacgcucucc

SEQ ID NO: 477315 - RNA, 17 nt, Chlamydia trachomatis
caaaacgcucuccaaag

SEQ ID NO: 477316 - RNA, 19 nt, Chlamydia trachomatis
caaaacgcucuccaaagaa

SEQ ID NO: 477317 - RNA, 21 nt, Chlamydia trachomatis
caaaacgcucuccaaagaaua

SEQ ID NO: 477318 - RNA, 18 nt, Chlamydia trachomatis
caaaaccuuuuacaguuc

SEQ ID NO: 477319 - RNA, 12 nt, Chlamydia trachomatis
caaaacuucggg

SEQ ID NO: 477320 - RNA, 21 nt, Chlamydia trachomatis
caaaacuugucuaaaagaaua

SEQ ID NO: 477321 - RNA, 18 nt, Chlamydia trachomatis
caaaacgcucuuuuucuu

SEQ ID NO: 477322 - RNA, 18 nt, Chlamydia trachomatis
caaaagaagaaucuucuu

SEQ ID NO: 477323 - RNA, 22 nt, Chlamydia trachomatis
caaaagaagaaucuucuucgaa

SEQ ID NO: 477324 - RNA, 21 nt, Chlamydia trachomatis
caaaagaaggcuuuucuauuu

SEQ ID NO: 477325 - RNA, 22 nt, Chlamydia trachomatis
caaaagcauugaacaccauauc

SEQ ID NO: 477326 - RNA, 12 nt, Chlamydia trachomatis
caaaagaugaua

SEQ ID NO: 477327 - RNA, 20 nt, Chlamydia trachomatis
caaaagaugccccaauuccu

SEQ ID NO: 477328 - RNA, 23 nt, Chlamydia trachomatis
caaaagauuucuucuguagcccc

SEQ ID NO: 477329 - RNA, 21 nt, Chlamydia trachomatis
caaaagauuuucaacgggaac

SEQ ID NO: 477330 - RNA, 15 nt, Chlamydia trachomatis
caaaagcgaaccuuu

SEQ ID NO: 477331 - RNA, 19 nt, Chlamydia trachomatis
caaaagcgaggcuucaaag

SEQ ID NO: 477332 - RNA, 11 nt, Chlamydia trachomatis
caaaaggccaa

SEQ ID NO: 477333 - RNA, 15 nt, Chlamydia trachomatis
caaagaaguaaugaa

SEQ ID NO: 477334 - RNA, 14 nt, Chlamydia trachomatis
caaagaauggaucu

SEQ ID NO: 477335 - RNA, 22 nt, Chlamydia trachomatis
caaagaacaguucaugcaccaa

SEQ ID NO: 477336 - RNA, 22 nt, Chlamydia trachomatis
caaagaacauaugaauccuuga

SEQ ID NO: 477337 - RNA, 17 nt, Chlamydia trachomatis
caaagcacuguccacau

SEQ ID NO: 477338 - RNA, 21 nt, Chlamydia trachomatis
caaagcagccacuccugcagc

SEQ ID NO: 477339 - RNA, 20 nt, Chlamydia trachomatis
caaagccccuacucuuccuu

SEQ ID NO: 477340 - RNA, 14 nt, Chlamydia trachomatis
caaagaauuuuuag

SEQ ID NO: 477341 - RNA, 19 nt, Chlamydia trachomatis
caaagacauaaaagcugua

SEQ ID NO: 477342 - RNA, 18 nt, Chlamydia trachomatis
caaagauugcguuacuuc

SEQ ID NO: 477343 - RNA, 20 nt, Chlamydia trachomatis
caaagauugcguuacuucuu

SEQ ID NO: 477344 - RNA, 17 nt, Chlamydia trachomatis
caaagauuucuucuuug

SEQ ID NO: 477345 - RNA, 20 nt, Chlamydia trachomatis
caaaguacgccucuuuugca

SEQ ID NO: 477346 - RNA, 17 nt, Chlamydia trachomatis
caaagguaaauggugaa

SEQ ID NO: 477347 - RNA, 21 nt, Chlamydia trachomatis
caaagguagauccgauaucag

SEQ ID NO: 477348 - RNA, 17 nt, Chlamydia trachomatis
caaaguuucugaaaagu

SEQ ID NO: 477349 - RNA, 13 nt, Chlamydia trachomatis
caaauaaaacgaa

SEQ ID NO: 477350 - RNA, 15 nt, Chlamydia trachomatis
caaauaaaacgaaaa

SEQ ID NO: 477351 - RNA, 22 nt, Chlamydia trachomatis
caaauaaaacgaaaaacagaaa

SEQ ID NO: 477352 - RNA, 16 nt, Chlamydia trachomatis
caaauaaguuaacccu

SEQ ID NO: 477353 - RNA, 20 nt, Chlamydia trachomatis
caaauaauaaaccaaaggca

SEQ ID NO: 477354 - RNA, 16 nt, Chlamydia trachomatis
caaauaggcgaauuuc

SEQ ID NO: 477355 - RNA, 13 nt, Chlamydia trachomatis
caaauagggaggu

SEQ ID NO: 477356 - RNA, 19 nt, Chlamydia trachomatis
caaauaguguaaggagaga

SEQ ID NO: 477357 - RNA, 15 nt, Chlamydia trachomatis
caaauucuucaugca

SEQ ID NO: 477358 - RNA, 19 nt, Chlamydia trachomatis
caaauuacgcgucuaaaac

SEQ ID NO: 477359 - RNA, 17 nt, Chlamydia trachomatis
caaaucaggaaucacua

SEQ ID NO: 477360 - RNA, 22 nt, Chlamydia trachomatis
caacacgguucuguguauuuau

SEQ ID NO: 477361 - RNA, 15 nt, Chlamydia trachomatis
caacaggaccagaga

SEQ ID NO: 477362 - RNA, 12 nt, Chlamydia trachomatis
caacacuccuga

SEQ ID NO: 477363 - RNA, 14 nt, Chlamydia trachomatis
caacacuccugaaa

SEQ ID NO: 477364 - RNA, 16 nt, Chlamydia trachomatis
caacaauauccuccau

SEQ ID NO: 477365 - RNA, 22 nt, Chlamydia trachomatis
caacaauuuucguuguuguaaa

SEQ ID NO: 477366 - RNA, 17 nt, Chlamydia trachomatis
caacaucuccauccgaa

SEQ ID NO: 477367 - RNA, 17 nt, Chlamydia trachomatis
caacaugggcauagucu

SEQ ID NO: 477368 - RNA, 18 nt, Chlamydia trachomatis
caaccagcgcauuaauaa

SEQ ID NO: 477369 - RNA, 20 nt, Chlamydia trachomatis
caaccacuguauccaaaaca

SEQ ID NO: 477370 - RNA, 20 nt, Chlamydia trachomatis
caacccucgcagagaaagag

SEQ ID NO: 477371 - RNA, 23 nt, Chlamydia trachomatis
caacccucgcagagaaagagcca

SEQ ID NO: 477372 - RNA, 20 nt, Chlamydia trachomatis
caaccgauucuucacagcac

SEQ ID NO: 477373 - RNA, 20 nt, Chlamydia trachomatis
caacucuccuuuaaaagcug

SEQ ID NO: 477374 - RNA, 15 nt, Chlamydia trachomatis
caacucugaacaacu

SEQ ID NO: 477375 - RNA, 13 nt, Chlamydia trachomatis
caacucuuuuccu

SEQ ID NO: 477376 - RNA, 11 nt, Chlamydia trachomatis
caacugauucg

SEQ ID NO: 477377 - RNA, 12 nt, Chlamydia trachomatis
caacggcccuuc

SEQ ID NO: 477378 - RNA, 15 nt, Chlamydia trachomatis
caaccucucaucagu

SEQ ID NO: 477379 - RNA, 17 nt, Chlamydia trachomatis
caacuucucuuguucug

SEQ ID NO: 477380 - RNA, 22 nt, Chlamydia trachomatis
caacuucucuuguucugggcug

SEQ ID NO: 477381 - RNA, 18 nt, Chlamydia trachomatis
caacuucaauagcaggaa

SEQ ID NO: 477382 - RNA, 14 nt, Chlamydia trachomatis
caagcagacaagca

SEQ ID NO: 477383 - RNA, 23 nt, Chlamydia trachomatis
caagcacacuugauaaauagcaa

SEQ ID NO: 477384 - RNA, 21 nt, Chlamydia trachomatis
caagcaguagcuacuucaggg

SEQ ID NO: 477385 - RNA, 19 nt, Chlamydia trachomatis
caagcaugucgagauaaaa

SEQ ID NO: 477386 - RNA, 18 nt, Chlamydia trachomatis
caagccccgaaacccaac

SEQ ID NO: 477387 - RNA, 13 nt, Chlamydia trachomatis
caagccauuuugu

SEQ ID NO: 477388 - RNA, 14 nt, Chlamydia trachomatis
caagcguauuugca

SEQ ID NO: 477389 - RNA, 17 nt, Chlamydia trachomatis
caaggaaauaaagaucu

SEQ ID NO: 477390 - RNA, 15 nt, Chlamydia trachomatis
caaggaagucccucc

SEQ ID NO: 477391 - RNA, 20 nt, Chlamydia trachomatis
caaggagaauaccaccauag

SEQ ID NO: 477392 - RNA, 22 nt, Chlamydia trachomatis
caagggugcuaacuuucuucca

SEQ ID NO: 477393 - RNA, 13 nt, Chlamydia trachomatis
caauauccuccau

SEQ ID NO: 477394 - RNA, 16 nt, Chlamydia trachomatis
caauauccuccauagu

SEQ ID NO: 477395 - RNA, 20 nt, Chlamydia trachomatis
caauaucuucagaagcggca

SEQ ID NO: 477396 - RNA, 23 nt, Chlamydia trachomatis
caauaucuagguugaagaggcaa

SEQ ID NO: 477397 - RNA, 14 nt, Chlamydia trachomatis
caauaauucaggcu

SEQ ID NO: 477398 - RNA, 13 nt, Chlamydia trachomatis
caauaauuucccc

SEQ ID NO: 477399 - RNA, 22 nt, Chlamydia trachomatis
caagguucuucaacaacuucaa

SEQ ID NO: 477400 - RNA, 20 nt, Chlamydia trachomatis
caagguugacuuucccugca

SEQ ID NO: 477401 - RNA, 16 nt, Chlamydia trachomatis
caaguaugagaggaag

SEQ ID NO: 477402 - RNA, 20 nt, Chlamydia trachomatis
caauaaaagcugguuuuuuu

SEQ ID NO: 477403 - RNA, 14 nt, Chlamydia trachomatis
caauaaagaaauaa

SEQ ID NO: 477404 - RNA, 12 nt, Chlamydia trachomatis
caauaaagaagc

SEQ ID NO: 477405 - RNA, 19 nt, Chlamydia trachomatis
caauaacagcacaaacaaa

SEQ ID NO: 477406 - RNA, 17 nt, Chlamydia trachomatis
caauaaggggaagaaau

SEQ ID NO: 477407 - RNA, 22 nt, Chlamydia trachomatis
caauaaguuacuguggccacca

SEQ ID NO: 477408 - RNA, 16 nt, Chlamydia trachomatis
caauaauacaaagcac

SEQ ID NO: 477409 - RNA, 13 nt, Chlamydia trachomatis
caauccgccuccg

SEQ ID NO: 477410 - RNA, 12 nt, Chlamydia trachomatis
caauccccaaac

SEQ ID NO: 477411 - RNA, 16 nt, Chlamydia trachomatis
caauccacccacaacg

SEQ ID NO: 477412 - RNA, 15 nt, Chlamydia trachomatis
caauccacgaauuuu

SEQ ID NO: 477413 - RNA, 20 nt, Chlamydia trachomatis
caauccacgaauuuucucuc

SEQ ID NO: 477414 - RNA, 14 nt, Chlamydia trachomatis
caauauuacgaauu

SEQ ID NO: 477415 - RNA, 13 nt, Chlamydia trachomatis
caauauucuuuuc

SEQ ID NO: 477416 - RNA, 24 nt, Chlamydia trachomatis
caaucaaaaacgcgauauccuuuu

SEQ ID NO: 477417 - RNA, 13 nt, Chlamydia trachomatis
caaucaaagcacc

SEQ ID NO: 477418 - RNA, 12 nt, Chlamydia trachomatis
caaucuaaaaaa

SEQ ID NO: 477419 - RNA, 20 nt, Chlamydia trachomatis
caaucguauaauaaugggcu

SEQ ID NO: 477420 - RNA, 21 nt, Chlamydia trachomatis
caaucguauaauaaugggcuc

SEQ ID NO: 477421 - RNA, 16 nt, Chlamydia trachomatis
caaucgcggaagaaag

SEQ ID NO: 477422 - RNA, 19 nt, Chlamydia trachomatis
caaucgaucgauaccuauu

SEQ ID NO: 477423 - RNA, 19 nt, Chlamydia trachomatis
caauccuguggucacaaga

SEQ ID NO: 477424 - RNA, 22 nt, Chlamydia trachomatis
caauccuuggcaagaagcugca

SEQ ID NO: 477425 - RNA, 15 nt, Chlamydia trachomatis
caaugccaagccauu

SEQ ID NO: 477426 - RNA, 16 nt, Chlamydia trachomatis
caaugaucuuuaagcu

SEQ ID NO: 477427 - RNA, 20 nt, Chlamydia trachomatis
caaugauauucuaauccuaa

SEQ ID NO: 477428 - RNA, 12 nt, Chlamydia trachomatis
caaugaggaugu

SEQ ID NO: 477429 - RNA, 19 nt, Chlamydia trachomatis
caaucuucuaaaugcugua

SEQ ID NO: 477430 - RNA, 19 nt, Chlamydia trachomatis
caaucuguaauaaacccug

SEQ ID NO: 477431 - RNA, 16 nt, Chlamydia trachomatis
caaugaccgaagguuc

SEQ ID NO: 477432 - RNA, 20 nt, Chlamydia trachomatis
caauguaaaaugagaaauaa

SEQ ID NO: 477433 - RNA, 17 nt, Chlamydia trachomatis
caauguacgcuaaaaac

SEQ ID NO: 477434 - RNA, 20 nt, Chlamydia trachomatis
caauguacgcuaaaaacucu

SEQ ID NO: 477435 - RNA, 16 nt, Chlamydia trachomatis
caaugucaacauaaua

SEQ ID NO: 477436 - RNA, 16 nt, Chlamydia trachomatis
caaugcuaucagcgaa

SEQ ID NO: 477437 - RNA, 17 nt, Chlamydia trachomatis
caaugcuguuucaggca

SEQ ID NO: 477438 - RNA, 16 nt, Chlamydia trachomatis
caauguucuauauaca

SEQ ID NO: 477439 - RNA, 16 nt, Chlamydia trachomatis
cacuggcaccuuuuuu

SEQ ID NO: 477440 - RNA, 13 nt, Chlamydia trachomatis
cacuggaauagcu

SEQ ID NO: 477441 - RNA, 21 nt, Chlamydia trachomatis
cacugcguauuugaaaucaaa

SEQ ID NO: 477442 - RNA, 21 nt, Chlamydia trachomatis
cacuggguaucugaacaagaa

SEQ ID NO: 477443 - RNA, 17 nt, Chlamydia trachomatis
cacugguauucugcaga

SEQ ID NO: 477444 - RNA, 21 nt, Chlamydia trachomatis
cacugguauucugcagaaaaa

SEQ ID NO: 477445 - RNA, 14 nt, Chlamydia trachomatis
cacuguugagaaaa

SEQ ID NO: 477446 - RNA, 15 nt, Chlamydia trachomatis
cacuguugagaaaaa

SEQ ID NO: 477447 - RNA, 14 nt, Chlamydia trachomatis
cacugucucaugga

SEQ ID NO: 477448 - RNA, 14 nt, Chlamydia trachomatis
cacuguccacauua

SEQ ID NO: 477449 - RNA, 21 nt, Chlamydia trachomatis
cacuuccucucucucaccgaa

SEQ ID NO: 477450 - RNA, 15 nt, Chlamydia trachomatis
cacuuccccauucuu

SEQ ID NO: 477451 - RNA, 20 nt, Chlamydia trachomatis
cacuucaaucacuccuccuc

SEQ ID NO: 477452 - RNA, 12 nt, Chlamydia trachomatis
cacuuuccccau

SEQ ID NO: 477453 - RNA, 19 nt, Chlamydia trachomatis
cacuuuccccauccccuca

SEQ ID NO: 477454 - RNA, 16 nt, Chlamydia trachomatis
cacuuucccccaccuu

SEQ ID NO: 477455 - RNA, 23 nt, Chlamydia trachomatis
cacuuuccgaaauaauugcgaag

SEQ ID NO: 477456 - RNA, 15 nt, Chlamydia trachomatis
cacuuugauaauacu

SEQ ID NO: 477457 - RNA, 20 nt, Chlamydia trachomatis
cacuuuuaccguuccaucuu

SEQ ID NO: 477458 - RNA, 15 nt, Chlamydia trachomatis
cacuuuugugaaaau

SEQ ID NO: 477459 - RNA, 14 nt, Chlamydia trachomatis
cagaaaaaauaaug

SEQ ID NO: 477460 - RNA, 14 nt, Chlamydia trachomatis
cagaaaaaguaagc

SEQ ID NO: 477461 - RNA, 23 nt, Chlamydia trachomatis
cagaaaaaguaagcgaagaagga

SEQ ID NO: 477462 - RNA, 21 nt, Chlamydia trachomatis
cagaaaacuuagcuaaauuca

SEQ ID NO: 477463 - RNA, 18 nt, Chlamydia trachomatis
cagaaaagccuucuuuca

SEQ ID NO: 477464 - RNA, 16 nt, Chlamydia trachomatis
cagaacaaacgaagga

SEQ ID NO: 477465 - RNA, 21 nt, Chlamydia trachomatis
cagaaaucccaucaaaagcua

SEQ ID NO: 477466 - RNA, 20 nt, Chlamydia trachomatis
cagaaauaugacagagcccu

SEQ ID NO: 477467 - RNA, 23 nt, Chlamydia trachomatis
cagaaagaaaugcguuucuucug

SEQ ID NO: 477468 - RNA, 15 nt, Chlamydia trachomatis
cagaaagagaaucau

SEQ ID NO: 477469 - RNA, 23 nt, Chlamydia trachomatis
cagaaagagucacggcaggaaag

SEQ ID NO: 477470 - RNA, 24 nt, Chlamydia trachomatis
cagaaaggaauccuuaaccgugaa

SEQ ID NO: 477471 - RNA, 16 nt, Chlamydia trachomatis
cagaaaguccugcuuc

SEQ ID NO: 477472 - RNA, 19 nt, Chlamydia trachomatis
cagaaaauucuacaacagc

SEQ ID NO: 477473 - RNA, 17 nt, Chlamydia trachomatis
cagaaacacuaucuccu

SEQ ID NO: 477474 - RNA, 14 nt, Chlamydia trachomatis
cagaaacguuuacu

SEQ ID NO: 477475 - RNA, 14 nt, Chlamydia trachomatis
cagaagaagagcug

SEQ ID NO: 477476 - RNA, 12 nt, Chlamydia trachomatis
cagaagaauagg

SEQ ID NO: 477477 - RNA, 23 nt, Chlamydia trachomatis
cagaacuuaucuguucugcucgu

SEQ ID NO: 477478 - RNA, 21 nt, Chlamydia trachomatis
cagaacucgcguauuuuuguu

SEQ ID NO: 477479 - RNA, 19 nt, Chlamydia trachomatis
cagaacucaaaauaaagaa

SEQ ID NO: 477480 - RNA, 19 nt, Chlamydia trachomatis
cagaacaugggcgucucuu

SEQ ID NO: 477481 - RNA, 16 nt, Chlamydia trachomatis
cagaaccuuuuuaaaa

SEQ ID NO: 477482 - RNA, 14 nt, Chlamydia trachomatis
cagaagcuauucca

SEQ ID NO: 477483 - RNA, 12 nt, Chlamydia trachomatis
cagaagcuccaa

SEQ ID NO: 477484 - RNA, 16 nt, Chlamydia trachomatis
cagaagcuccaaagaa

SEQ ID NO: 477485 - RNA, 16 nt, Chlamydia trachomatis
cagaaggaguuuuucu

SEQ ID NO: 477486 - RNA, 17 nt, Chlamydia trachomatis
cagaaggaguuuuucuc

SEQ ID NO: 477487 - RNA, 20 nt, Chlamydia trachomatis
cagaaggaguuuuucuccuc

SEQ ID NO: 477488 - RNA, 17 nt, Chlamydia trachomatis
cagaaguaucuaacaau

SEQ ID NO: 477489 - RNA, 17 nt, Chlamydia trachomatis
cagaaguuuuaacauga

SEQ ID NO: 477490 - RNA, 15 nt, Chlamydia trachomatis
cagaaguuguuggag

SEQ ID NO: 477491 - RNA, 16 nt, Chlamydia trachomatis
cagaaguugagcaacu

SEQ ID NO: 477492 - RNA, 16 nt, Chlamydia trachomatis
cagaaguuagaaucug

SEQ ID NO: 477493 - RNA, 15 nt, Chlamydia trachomatis
cagaaucaucuggua

SEQ ID NO: 477494 - RNA, 23 nt, Chlamydia trachomatis
cagaaucaucugguauucuaaau

SEQ ID NO: 477495 - RNA, 14 nt, Chlamydia trachomatis
cagaauccuuuuca

SEQ ID NO: 477496 - RNA, 23 nt, Chlamydia trachomatis
cagaaucugugcuugcauagaua

SEQ ID NO: 477497 - RNA, 15 nt, Chlamydia trachomatis
cagacccuuccaaau

SEQ ID NO: 477498 - RNA, 24 nt, Chlamydia trachomatis
cagacccuuccaaauuucccucuu

SEQ ID NO: 477499 - RNA, 15 nt, Chlamydia trachomatis
cagaccuacaaagau

SEQ ID NO: 477500 - RNA, 18 nt, Chlamydia trachomatis
cagagcaaauagaauaaa

SEQ ID NO: 477501 - RNA, 21 nt, Chlamydia trachomatis
cagagcacaaaucuuucuuuc

SEQ ID NO: 477502 - RNA, 20 nt, Chlamydia trachomatis
cagagcauguguuucuggaa

SEQ ID NO: 477503 - RNA, 19 nt, Chlamydia trachomatis
cagagccagcuuuaaagag

SEQ ID NO: 477504 - RNA, 13 nt, Chlamydia trachomatis
cagagauaaagac

SEQ ID NO: 477505 - RNA, 23 nt, Chlamydia trachomatis
cagagaggugugauaggagagga

SEQ ID NO: 477506 - RNA, 17 nt, Chlamydia trachomatis
cagagauauaaucuaaa

SEQ ID NO: 477507 - RNA, 23 nt, Chlamydia trachomatis
cagagauauaaucuaaagacaaa

SEQ ID NO: 477508 - RNA, 17 nt, Chlamydia trachomatis
cagagaucccagggaga

SEQ ID NO: 477509 - RNA, 15 nt, Chlamydia trachomatis
cagagaaucuuaaac

SEQ ID NO: 477510 - RNA, 16 nt, Chlamydia trachomatis
cagagaaucuuaaaca

SEQ ID NO: 477511 - RNA, 19 nt, Chlamydia trachomatis
cagagaagaacacacuuuc

SEQ ID NO: 477512 - RNA, 17 nt, Chlamydia trachomatis
cagagaaaauuucucuu

SEQ ID NO: 477513 - RNA, 18 nt, Chlamydia trachomatis
cagacugccuaccugcuc

SEQ ID NO: 477514 - RNA, 20 nt, Chlamydia trachomatis
cagacuuuguuuauuaucua

SEQ ID NO: 477515 - RNA, 23 nt, Chlamydia trachomatis
cagacuuuguuuauuaucuagaa

SEQ ID NO: 477516 - RNA, 17 nt, Chlamydia trachomatis
cagacuaaguuguaaaa

SEQ ID NO: 477517 - RNA, 16 nt, Chlamydia trachomatis
cagacuauuucuucua

SEQ ID NO: 477518 - RNA, 17 nt, Chlamydia trachomatis
cagacgcauagaaucuc

SEQ ID NO: 477519 - RNA, 16 nt, Chlamydia trachomatis
cagacgcccuccuccu

SEQ ID NO: 477520 - RNA, 19 nt, Chlamydia trachomatis
cagacgcccuccuccucgc

SEQ ID NO: 477521 - RNA, 18 nt, Chlamydia trachomatis
cagacgaaaacgcauuac

SEQ ID NO: 477522 - RNA, 21 nt, Chlamydia trachomatis
cagagccuuuuauucuucagu

SEQ ID NO: 477523 - RNA, 15 nt, Chlamydia trachomatis
cagagcuuuuacuuc

SEQ ID NO: 477524 - RNA, 20 nt, Chlamydia trachomatis
cagaggauuuauaaagagau

SEQ ID NO: 477525 - RNA, 23 nt, Chlamydia trachomatis
cagaggauuuauaaagagauggu

SEQ ID NO: 477526 - RNA, 17 nt, Chlamydia trachomatis
cagaguuaacuauuucu

SEQ ID NO: 477527 - RNA, 13 nt, Chlamydia trachomatis
cagaguucucuga

SEQ ID NO: 477528 - RNA, 15 nt, Chlamydia trachomatis
cagagggacgagcag

SEQ ID NO: 477529 - RNA, 14 nt, Chlamydia trachomatis
cagagggccuccca

SEQ ID NO: 477530 - RNA, 15 nt, Chlamydia trachomatis
cagagguagccaaag

SEQ ID NO: 477531 - RNA, 13 nt, Chlamydia trachomatis
cagauauaacaac

SEQ ID NO: 477532 - RNA, 19 nt, Chlamydia trachomatis
cagauauggaagaacagca

SEQ ID NO: 477533 - RNA, 19 nt, Chlamydia trachomatis
cagaucauuuuaauaagau

SEQ ID NO: 477534 - RNA, 13 nt, Chlamydia trachomatis
cagaucauaggcu

SEQ ID NO: 477535 - RNA, 15 nt, Chlamydia trachomatis
cagaucauccauaaa

SEQ ID NO: 477536 - RNA, 16 nt, Chlamydia trachomatis
cagaucauccauaaaa

SEQ ID NO: 477537 - RNA, 19 nt, Chlamydia trachomatis
cagaucauccauaaaaacu

SEQ ID NO: 477538 - RNA, 16 nt, Chlamydia trachomatis
cagauaacuggugugg

SEQ ID NO: 477539 - RNA, 18 nt, Chlamydia trachomatis
cagauaacuggugugggu

SEQ ID NO: 477540 - RNA, 15 nt, Chlamydia trachomatis
cagaugcaucuauug

SEQ ID NO: 477541 - RNA, 17 nt, Chlamydia trachomatis
cagaugcaucuauugua

SEQ ID NO: 477542 - RNA, 19 nt, Chlamydia trachomatis
cagaugccauccagagcug

SEQ ID NO: 477543 - RNA, 14 nt, Chlamydia trachomatis
cagaugcacuuccu

SEQ ID NO: 477544 - RNA, 17 nt, Chlamydia trachomatis
cagaugcacuuccucug

SEQ ID NO: 477545 - RNA, 22 nt, Chlamydia trachomatis
cagaugauugaaguucuuuuuc

SEQ ID NO: 477546 - RNA, 14 nt, Chlamydia trachomatis
cagaugccuugagg

SEQ ID NO: 477547 - RNA, 19 nt, Chlamydia trachomatis
cagauuuuguagcacagcu

SEQ ID NO: 477548 - RNA, 16 nt, Chlamydia trachomatis
cagcaaaaagaggaga

SEQ ID NO: 477549 - RNA, 15 nt, Chlamydia trachomatis
cagauugcuuuaacu

SEQ ID NO: 477550 - RNA, 17 nt, Chlamydia trachomatis
cagauuugaguuuauca

SEQ ID NO: 477551 - RNA, 14 nt, Chlamydia trachomatis
cagauuuagagaau

SEQ ID NO: 477552 - RNA, 17 nt, Chlamydia trachomatis
cagauuuagagaauaau

SEQ ID NO: 477553 - RNA, 18 nt, Chlamydia trachomatis
cagauuuagagaauaauc

SEQ ID NO: 477554 - RNA, 19 nt, Chlamydia trachomatis
cagcaaauguggauagcaa

SEQ ID NO: 477555 - RNA, 12 nt, Chlamydia trachomatis
cagcaacaugca

SEQ ID NO: 477556 - RNA, 14 nt, Chlamydia trachomatis
cagcaagcuugucu

SEQ ID NO: 477557 - RNA, 21 nt, Chlamydia trachomatis
cagcaagcuugucuccuucuu

SEQ ID NO: 477558 - RNA, 19 nt, Chlamydia trachomatis
cagcaagaagaagagagaa

SEQ ID NO: 477559 - RNA, 15 nt, Chlamydia trachomatis
cagcaagagagauug

SEQ ID NO: 477560 - RNA, 20 nt, Chlamydia trachomatis
cagcaagaacagauugagaa

SEQ ID NO: 477561 - RNA, 18 nt, Chlamydia trachomatis
cagcaauaccgaaucuaa

SEQ ID NO: 477562 - RNA, 16 nt, Chlamydia trachomatis
cagcaccaagcuccac

SEQ ID NO: 477563 - RNA, 13 nt, Chlamydia trachomatis
cagcacacuccua

SEQ ID NO: 477564 - RNA, 13 nt, Chlamydia trachomatis
cagcacccacauu

SEQ ID NO: 477565 - RNA, 19 nt, Chlamydia trachomatis
cagcacccacauuaccauu

SEQ ID NO: 477566 - RNA, 18 nt, Chlamydia trachomatis
cagcacgacacuccucug

SEQ ID NO: 477567 - RNA, 21 nt, Chlamydia trachomatis
cagcagaacucaacgaaagca

SEQ ID NO: 477568 - RNA, 14 nt, Chlamydia trachomatis
cagcagacccaaau

SEQ ID NO: 477569 - RNA, 17 nt, Chlamydia trachomatis
cagcagaucauccauaa

SEQ ID NO: 477570 - RNA, 19 nt, Chlamydia trachomatis
cagcaggcgaacagugaca

SEQ ID NO: 477571 - RNA, 21 nt, Chlamydia trachomatis
cagcaggcgaacagugacagc

SEQ ID NO: 477572 - RNA, 20 nt, Chlamydia trachomatis
cagcauaaauccuugagcgu

SEQ ID NO: 477573 - RNA, 19 nt, Chlamydia trachomatis
cagcaugccuucuuccuuc

SEQ ID NO: 477574 - RNA, 12 nt, Chlamydia trachomatis
cagcauucucua

SEQ ID NO: 477575 - RNA, 14 nt, Chlamydia trachomatis
cagcauucucuaga

SEQ ID NO: 477576 - RNA, 15 nt, Chlamydia trachomatis
cagcauuuacuccua

SEQ ID NO: 477577 - RNA, 19 nt, Chlamydia trachomatis
cagcauuuuaaaaucacuu

SEQ ID NO: 477578 - RNA, 22 nt, Chlamydia trachomatis
cagcauuuuaaaaucacuuucu

SEQ ID NO: 477579 - RNA, 13 nt, Chlamydia trachomatis
cagccaagcaaga

SEQ ID NO: 477580 - RNA, 14 nt, Chlamydia trachomatis
cagccaagcaagau

SEQ ID NO: 477581 - RNA, 18 nt, Chlamydia trachomatis
cagccacuugcuccacac

SEQ ID NO: 477582 - RNA, 22 nt, Chlamydia trachomatis
cagccgaaacagacuaaguugu

SEQ ID NO: 477583 - RNA, 15 nt, Chlamydia trachomatis
cagccuacaaauaaa

SEQ ID NO: 477584 - RNA, 16 nt, Chlamydia trachomatis
cagccuacaaauaaag

SEQ ID NO: 477585 - RNA, 18 nt, Chlamydia trachomatis
cagccucugccgcuguag

SEQ ID NO: 477586 - RNA, 21 nt, Chlamydia trachomatis
cagccugcuuucuucugccug

SEQ ID NO: 477587 - RNA, 14 nt, Chlamydia trachomatis
cagccugaggaucc

SEQ ID NO: 477588 - RNA, 19 nt, Chlamydia trachomatis
cagccuuggauuucuucug

SEQ ID NO: 477589 - RNA, 20 nt, Chlamydia trachomatis
cagcgaagaaccgaauuugu

SEQ ID NO: 477590 - RNA, 19 nt, Chlamydia trachomatis
cagccuucccgacagagga

SEQ ID NO: 477591 - RNA, 11 nt, Chlamydia trachomatis
cagcuucaacu

SEQ ID NO: 477592 - RNA, 20 nt, Chlamydia trachomatis
cagcuucaacuggccuuuuu

SEQ ID NO: 477593 - RNA, 22 nt, Chlamydia trachomatis
cagcuucaacuggccuuuuucg

SEQ ID NO: 477594 - RNA, 17 nt, Chlamydia trachomatis
cagcuucacguuuuucg

SEQ ID NO: 477595 - RNA, 18 nt, Chlamydia trachomatis
cagcuguacgauggaaau

SEQ ID NO: 477596 - RNA, 13 nt, Chlamydia trachomatis
caggaacuucuuc

SEQ ID NO: 477597 - RNA, 14 nt, Chlamydia trachomatis
caggaacuucuuca

SEQ ID NO: 477598 - RNA, 21 nt, Chlamydia trachomatis
caggaauauuaagauccauuu

SEQ ID NO: 477599 - RNA, 15 nt, Chlamydia trachomatis
caggaauucguccuc

SEQ ID NO: 477600 - RNA, 19 nt, Chlamydia trachomatis
caggacgaacgaagaacga

SEQ ID NO: 477601 - RNA, 18 nt, Chlamydia trachomatis
caggagaccacucaucau

SEQ ID NO: 477602 - RNA, 21 nt, Chlamydia trachomatis
caggagaccacucaucaugcu

SEQ ID NO: 477603 - RNA, 22 nt, Chlamydia trachomatis
caggagaguguuugcauucuuu

SEQ ID NO: 477604 - RNA, 18 nt, Chlamydia trachomatis
caggagaucccaaaagau

SEQ ID NO: 477605 - RNA, 15 nt, Chlamydia trachomatis
caggagaaaggcuuu

SEQ ID NO: 477606 - RNA, 19 nt, Chlamydia trachomatis
caggauuccggaagauaca

SEQ ID NO: 477607 - RNA, 15 nt, Chlamydia trachomatis
caggcuaucacaaaa

SEQ ID NO: 477608 - RNA, 21 nt, Chlamydia trachomatis
cagggagaaggggaaggaaug

SEQ ID NO: 477609 - RNA, 14 nt, Chlamydia trachomatis
cagggcuguauuca

SEQ ID NO: 477610 - RNA, 23 nt, Chlamydia trachomatis
cagguugcaucaacaauaguauc

SEQ ID NO: 477611 - RNA, 18 nt, Chlamydia trachomatis
caguaaaaucuaaaauau

SEQ ID NO: 477612 - RNA, 14 nt, Chlamydia trachomatis
caguacugcuacaa

SEQ ID NO: 477613 - RNA, 16 nt, Chlamydia trachomatis
caguacugcuacaaaa

SEQ ID NO: 477614 - RNA, 22 nt, Chlamydia trachomatis
caguacuuuaccuguaggagga

SEQ ID NO: 477615 - RNA, 15 nt, Chlamydia trachomatis
caguaagucaccauu

SEQ ID NO: 477616 - RNA, 12 nt, Chlamydia trachomatis
caguaaagaaaa

SEQ ID NO: 477617 - RNA, 22 nt, Chlamydia trachomatis
caguaaagaaaagcuccuagag

SEQ ID NO: 477618 - RNA, 18 nt, Chlamydia trachomatis
caguagaaacuuacuuuu

SEQ ID NO: 477619 - RNA, 21 nt, Chlamydia trachomatis
caguagugguaagggguuuuc

SEQ ID NO: 477620 - RNA, 17 nt, Chlamydia trachomatis
cagucucugaggcaaag

SEQ ID NO: 477621 - RNA, 16 nt, Chlamydia trachomatis
caguggaacugcuucc

SEQ ID NO: 477622 - RNA, 17 nt, Chlamydia trachomatis
caguggaagauagaaga

SEQ ID NO: 477623 - RNA, 13 nt, Chlamydia trachomatis
cagugacuauuuc

SEQ ID NO: 477624 - RNA, 17 nt, Chlamydia trachomatis
cagucuuccucugcuuc

SEQ ID NO: 477625 - RNA, 14 nt, Chlamydia trachomatis
cagucuucuuuucu

SEQ ID NO: 477626 - RNA, 22 nt, Chlamydia trachomatis
cagucuucuuuucugagacucc

SEQ ID NO: 477627 - RNA, 23 nt, Chlamydia trachomatis
cauaaacgguggaacagcucuaa

SEQ ID NO: 477628 - RNA, 17 nt, Chlamydia trachomatis
caguuuacugcaauaag

SEQ ID NO: 477629 - RNA, 21 nt, Chlamydia trachomatis
cauaaaaaagacccaguaguu

SEQ ID NO: 477630 - RNA, 23 nt, Chlamydia trachomatis
cauaaaaaagagguauuuaggaa

SEQ ID NO: 477631 - RNA, 23 nt, Chlamydia trachomatis
cauaaaaacugcugcuaucaucu

SEQ ID NO: 477632 - RNA, 13 nt, Chlamydia trachomatis
cauaaaaagauag

SEQ ID NO: 477633 - RNA, 23 nt, Chlamydia trachomatis
cauaaaaagauagugcagaagau

SEQ ID NO: 477634 - RNA, 15 nt, Chlamydia trachomatis
cauaaauaucuugag

SEQ ID NO: 477635 - RNA, 12 nt, Chlamydia trachomatis
cauaaauuugcu

SEQ ID NO: 477636 - RNA, 16 nt, Chlamydia trachomatis
cauaacacauaucucc

SEQ ID NO: 477637 - RNA, 23 nt, Chlamydia trachomatis
cauaacacauaucuccaaaaaua

SEQ ID NO: 477638 - RNA, 21 nt, Chlamydia trachomatis
cauaacagcaagacaacguua

SEQ ID NO: 477639 - RNA, 19 nt, Chlamydia trachomatis
caguuguugggagagggug

SEQ ID NO: 477640 - RNA, 19 nt, Chlamydia trachomatis
caguucuucacuuuucuag

SEQ ID NO: 477641 - RNA, 16 nt, Chlamydia trachomatis
caguucugguuuuugu

SEQ ID NO: 477642 - RNA, 13 nt, Chlamydia trachomatis
cauaacgagugua

SEQ ID NO: 477643 - RNA, 20 nt, Chlamydia trachomatis
cauaaugaucauguccaugu

SEQ ID NO: 477644 - RNA, 15 nt, Chlamydia trachomatis
cauaauccuaugcag

SEQ ID NO: 477645 - RNA, 20 nt, Chlamydia trachomatis
cauaauccuaugcaguaaag

SEQ ID NO: 477646 - RNA, 22 nt, Chlamydia trachomatis
cauaauccuaugcaguaaagaa

SEQ ID NO: 477647 - RNA, 13 nt, Chlamydia trachomatis
cauacauaagaac

SEQ ID NO: 477648 - RNA, 13 nt, Chlamydia trachomatis
cauaccaaagcau

SEQ ID NO: 477649 - RNA, 17 nt, Chlamydia trachomatis
cauaccaagcuuucugc

SEQ ID NO: 477650 - RNA, 19 nt, Chlamydia trachomatis
cauaccaagcuuucugcca

SEQ ID NO: 477651 - RNA, 15 nt, Chlamydia trachomatis
cauacguuuucucug

SEQ ID NO: 477652 - RNA, 15 nt, Chlamydia trachomatis
cauacuucccacaua

SEQ ID NO: 477653 - RNA, 21 nt, Chlamydia trachomatis
cauaccgaggauccuaaccaa

SEQ ID NO: 477654 - RNA, 15 nt, Chlamydia trachomatis
cauacgcugcugaca

SEQ ID NO: 477655 - RNA, 18 nt, Chlamydia trachomatis
cauauaggcugaaacuug

SEQ ID NO: 477656 - RNA, 15 nt, Chlamydia trachomatis
cauauaguuuucgac

SEQ ID NO: 477657 - RNA, 10 nt, Chlamydia trachomatis
cauaucaaag

SEQ ID NO: 477658 - RNA, 14 nt, Chlamydia trachomatis
cauaucuccuaaaa

SEQ ID NO: 477659 - RNA, 21 nt, Chlamydia trachomatis
cauauguccauacaaagguaa

SEQ ID NO: 477660 - RNA, 14 nt, Chlamydia trachomatis
cauauuagacacua

SEQ ID NO: 477661 - RNA, 16 nt, Chlamydia trachomatis
caucaagguggccauu

SEQ ID NO: 477662 - RNA, 13 nt, Chlamydia trachomatis
caucaaaauauuu

SEQ ID NO: 477663 - RNA, 18 nt, Chlamydia trachomatis
caucaaaauauuuugcug

SEQ ID NO: 477664 - RNA, 20 nt, Chlamydia trachomatis
caucaaaauauagacugucu

SEQ ID NO: 477665 - RNA, 14 nt, Chlamydia trachomatis
caucaaaauucuau

SEQ ID NO: 477666 - RNA, 22 nt, Chlamydia trachomatis
caucaguccugucguaaugaag

SEQ ID NO: 477667 - RNA, 13 nt, Chlamydia trachomatis
caucauaaaaaga

SEQ ID NO: 477668 - RNA, 12 nt, Chlamydia trachomatis
caucauuuugua

SEQ ID NO: 477669 - RNA, 19 nt, Chlamydia trachomatis
cauccaaaacaucccagca

SEQ ID NO: 477670 - RNA, 22 nt, Chlamydia trachomatis
cauccgcuucuucauguucugu

SEQ ID NO: 477671 - RNA, 17 nt, Chlamydia trachomatis
cauccuugcccaagcuu

SEQ ID NO: 477672 - RNA, 15 nt, Chlamydia trachomatis
caucgaauuaauaau

SEQ ID NO: 477673 - RNA, 21 nt, Chlamydia trachomatis
caucgaagcguuuacaaauga

SEQ ID NO: 477674 - RNA, 14 nt, Chlamydia trachomatis
caucuacugaugcu

SEQ ID NO: 477675 - RNA, 17 nt, Chlamydia trachomatis
caucuagagguauuuua

SEQ ID NO: 477676 - RNA, 18 nt, Chlamydia trachomatis
caucuagagguauuuuau

SEQ ID NO: 477677 - RNA, 18 nt, Chlamydia trachomatis
caucuagaucgaauagua

SEQ ID NO: 477678 - RNA, 17 nt, Chlamydia trachomatis
caucuacgaguuucucg

SEQ ID NO: 477679 - RNA, 17 nt, Chlamydia trachomatis
caucuauugagaagacu

SEQ ID NO: 477680 - RNA, 15 nt, Chlamydia trachomatis
caucugacuuuuuag

SEQ ID NO: 477681 - RNA, 21 nt, Chlamydia trachomatis
caucugacuuuuuagcaucug

SEQ ID NO: 477682 - RNA, 13 nt, Chlamydia trachomatis
caucuccucugga

SEQ ID NO: 477683 - RNA, 18 nt, Chlamydia trachomatis
caucuccucuggagccgu

SEQ ID NO: 477684 - RNA, 13 nt, Chlamydia trachomatis
caucuccugauuc

SEQ ID NO: 477685 - RNA, 17 nt, Chlamydia trachomatis
caucuucaagagcugua

SEQ ID NO: 477686 - RNA, 16 nt, Chlamydia trachomatis
caucuucaauggcaaa

SEQ ID NO: 477687 - RNA, 20 nt, Chlamydia trachomatis
caucuuacuugcugcagauu

SEQ ID NO: 477688 - RNA, 21 nt, Chlamydia trachomatis
caucuguaaagcuucgcuuug

SEQ ID NO: 477689 - RNA, 22 nt, Chlamydia trachomatis
caucuguagagccaugaucaaa

SEQ ID NO: 477690 - RNA, 19 nt, Chlamydia trachomatis
caucuuugaagguaagaaa

SEQ ID NO: 477691 - RNA, 23 nt, Chlamydia trachomatis
caucuuuacuaggagcaaaaagu

SEQ ID NO: 477692 - RNA, 14 nt, Chlamydia trachomatis
caucuuuauagaau

SEQ ID NO: 477693 - RNA, 18 nt, Chlamydia trachomatis
caucuugcacauuuucuu

SEQ ID NO: 477694 - RNA, 22 nt, Chlamydia trachomatis
caucuugcauaaggaagcaaaa

SEQ ID NO: 477695 - RNA, 16 nt, Chlamydia trachomatis
caucuucccaauauau

SEQ ID NO: 477696 - RNA, 19 nt, Chlamydia trachomatis
caucuucucgaaagagaac

SEQ ID NO: 477697 - RNA, 17 nt, Chlamydia trachomatis
caucuuuuuuaaaaagc

SEQ ID NO: 477698 - RNA, 15 nt, Chlamydia trachomatis
caugcaaaacagcuc

SEQ ID NO: 477699 - RNA, 18 nt, Chlamydia trachomatis
caugaaaguagcuacuuu

SEQ ID NO: 477700 - RNA, 16 nt, Chlamydia trachomatis
caugauuucuuuaaca

SEQ ID NO: 477701 - RNA, 20 nt, Chlamydia trachomatis
caugauuucuuuaacaucuu

SEQ ID NO: 477702 - RNA, 21 nt, Chlamydia trachomatis
caugcguuaauuaauaagccu

SEQ ID NO: 477703 - RNA, 20 nt, Chlamydia trachomatis
caugcuuuugaucuuuccag

SEQ ID NO: 477704 - RNA, 19 nt, Chlamydia trachomatis
cauggcugcaauucuuagc

SEQ ID NO: 477705 - RNA, 20 nt, Chlamydia trachomatis
caugguauagaagaccuuug

SEQ ID NO: 477706 - RNA, 15 nt, Chlamydia trachomatis
caugggaucuagaag

SEQ ID NO: 477707 - RNA, 17 nt, Chlamydia trachomatis
cauuaaaggaauaauuu

SEQ ID NO: 477708 - RNA, 22 nt, Chlamydia trachomatis
cauuaaagggaaaaaacuagaa

SEQ ID NO: 477709 - RNA, 17 nt, Chlamydia trachomatis
cauuaaacuaugcaaag

SEQ ID NO: 477710 - RNA, 16 nt, Chlamydia trachomatis
cauguuucgccaauga

SEQ ID NO: 477711 - RNA, 21 nt, Chlamydia trachomatis
cauguuuuuaguaccauaaca

SEQ ID NO: 477712 - RNA, 15 nt, Chlamydia trachomatis
caugucuagcuagaa

SEQ ID NO: 477713 - RNA, 13 nt, Chlamydia trachomatis
caugucuucuuuc

SEQ ID NO: 477714 - RNA, 21 nt, Chlamydia trachomatis
cauuacacaacucuuuuccua

SEQ ID NO: 477715 - RNA, 19 nt, Chlamydia trachomatis
cauuagaaugauugauaaa

SEQ ID NO: 477716 - RNA, 15 nt, Chlamydia trachomatis
cauuuucuugaggag

SEQ ID NO: 477717 - RNA, 14 nt, Chlamydia trachomatis
cauuuaaaugaaug

SEQ ID NO: 477718 - RNA, 16 nt, Chlamydia trachomatis
cauuuaauaaguuuuu

SEQ ID NO: 477719 - RNA, 18 nt, Chlamydia trachomatis
cauuuaauaaguuuuuca

SEQ ID NO: 477720 - RNA, 22 nt, Chlamydia trachomatis
cauuuaauauggacuucccuaa

SEQ ID NO: 477721 - RNA, 22 nt, Chlamydia trachomatis
cauuugagacgggaaccccuca

SEQ ID NO: 477722 - RNA, 20 nt, Chlamydia trachomatis
cauuugauaguuuuguaaac

SEQ ID NO: 477723 - RNA, 15 nt, Chlamydia trachomatis
cauuugccaaaaagg

SEQ ID NO: 477724 - RNA, 24 nt, Chlamydia trachomatis
cauuugccaaugaaauaucauucc

SEQ ID NO: 477725 - RNA, 20 nt, Chlamydia trachomatis
cauuugcgugauaaaaacuc

SEQ ID NO: 477726 - RNA, 15 nt, Chlamydia trachomatis
cauuugggagauaca

SEQ ID NO: 477727 - RNA, 21 nt, Chlamydia trachomatis
cauuugucuucgcaaacugcu

SEQ ID NO: 477728 - RNA, 13 nt, Chlamydia trachomatis
cauuugugugcca

SEQ ID NO: 477729 - RNA, 20 nt, Chlamydia trachomatis
cauucuuacuaaagccaucu

SEQ ID NO: 477730 - RNA, 20 nt, Chlamydia trachomatis
cauucuuagauuuucaugca

SEQ ID NO: 477731 - RNA, 23 nt, Chlamydia trachomatis
cauugaacaccauauccuugucc

SEQ ID NO: 477732 - RNA, 19 nt, Chlamydia trachomatis
cauugacaugccagaagcu

SEQ ID NO: 477733 - RNA, 19 nt, Chlamydia trachomatis
cauugauaaguacgugcau

SEQ ID NO: 477734 - RNA, 18 nt, Chlamydia trachomatis
cauuaggauuaaaaucca

SEQ ID NO: 477735 - RNA, 19 nt, Chlamydia trachomatis
cauuauccauaaaaauaau

SEQ ID NO: 477736 - RNA, 16 nt, Chlamydia trachomatis
cauuaucguucucuaa

SEQ ID NO: 477737 - RNA, 15 nt, Chlamydia trachomatis
cauuaucuucuucua

SEQ ID NO: 477738 - RNA, 14 nt, Chlamydia trachomatis
cauucgucaaagaa

SEQ ID NO: 477739 - RNA, 19 nt, Chlamydia trachomatis
cauucguuucuucccuuuu

SEQ ID NO: 477740 - RNA, 22 nt, Chlamydia trachomatis
cauucuaaggagcaugguauuc

SEQ ID NO: 477741 - RNA, 13 nt, Chlamydia trachomatis
cauugauuccauu

SEQ ID NO: 477742 - RNA, 14 nt, Chlamydia trachomatis
cauugauucuauga

SEQ ID NO: 477743 - RNA, 19 nt, Chlamydia trachomatis
cauugauucuaugagaaga

SEQ ID NO: 477744 - RNA, 23 nt, Chlamydia trachomatis
ccaaaaaagaaucuaaaaagcca

SEQ ID NO: 477745 - RNA, 16 nt, Chlamydia trachomatis
ccaccuuaaaugcagu

SEQ ID NO: 477746 - RNA, 15 nt, Chlamydia trachomatis
ccacgaauuuucucu

SEQ ID NO: 477747 - RNA, 18 nt, Chlamydia trachomatis
ccacguuucguaguuuuc

SEQ ID NO: 477748 - RNA, 14 nt, Chlamydia trachomatis
ccacuaaucccacc

SEQ ID NO: 477749 - RNA, 19 nt, Chlamydia trachomatis
ccacuccugcagcuaaaga

SEQ ID NO: 477750 - RNA, 14 nt, Chlamydia trachomatis
ccacuacugucaga

SEQ ID NO: 477751 - RNA, 21 nt, Chlamydia trachomatis
ccacuacugucagaccuacaa

SEQ ID NO: 477752 - RNA, 22 nt, Chlamydia trachomatis
ccacucuucagguugcuugaau

SEQ ID NO: 477753 - RNA, 15 nt, Chlamydia trachomatis
ccagaacaacuucuc

SEQ ID NO: 477754 - RNA, 22 nt, Chlamydia trachomatis
ccagaacaacuucucuuguucu

SEQ ID NO: 477755 - RNA, 17 nt, Chlamydia trachomatis
ccacuugcuccacacaa

SEQ ID NO: 477756 - RNA, 16 nt, Chlamydia trachomatis
ccagauacugcuccac

SEQ ID NO: 477757 - RNA, 15 nt, Chlamydia trachomatis
ccagaauauaagcac

SEQ ID NO: 477758 - RNA, 16 nt, Chlamydia trachomatis
ccagaauauaagcacc

SEQ ID NO: 477759 - RNA, 20 nt, Chlamydia trachomatis
ccagauuuuucaaaaauagc

SEQ ID NO: 477760 - RNA, 14 nt, Chlamydia trachomatis
ccagaucauagaaa

SEQ ID NO: 477761 - RNA, 23 nt, Chlamydia trachomatis
ccagcaggccucuguuuugaaau

SEQ ID NO: 477762 - RNA, 14 nt, Chlamydia trachomatis
ccagccugugcauu

SEQ ID NO: 477763 - RNA, 15 nt, Chlamydia trachomatis
ccagccugugcauuu

SEQ ID NO: 477764 - RNA, 20 nt, Chlamydia trachomatis
ccagcgacauucaauaagcc

SEQ ID NO: 477765 - RNA, 14 nt, Chlamydia trachomatis
ccagcgcuuucuaa

SEQ ID NO: 477766 - RNA, 20 nt, Chlamydia trachomatis
ccagcgcuuucuaaagcagc

SEQ ID NO: 477767 - RNA, 16 nt, Chlamydia trachomatis
ccagcuaauaaguuca

SEQ ID NO: 477768 - RNA, 17 nt, Chlamydia trachomatis
ccagcuaauaaguucac

SEQ ID NO: 477769 - RNA, 20 nt, Chlamydia trachomatis
ccagguauuuccugcaagca

SEQ ID NO: 477770 - RNA, 21 nt, Chlamydia trachomatis
ccaguccucccaaaauaccuu

SEQ ID NO: 477771 - RNA, 12 nt, Chlamydia trachomatis
ccagucuacagc

SEQ ID NO: 477772 - RNA, 14 nt, Chlamydia trachomatis
ccaguucuggagca

SEQ ID NO: 477773 - RNA, 16 nt, Chlamydia trachomatis
ccagugcucaaagauu

SEQ ID NO: 477774 - RNA, 17 nt, Chlamydia trachomatis
ccauauccauaacuuua

SEQ ID NO: 477775 - RNA, 20 nt, Chlamydia trachomatis
ccauaucuacaggccucccu

SEQ ID NO: 477776 - RNA, 15 nt, Chlamydia trachomatis
ccaucaacuguucug

SEQ ID NO: 477777 - RNA, 22 nt, Chlamydia trachomatis
ccauaucaaagcuaacucaccu

SEQ ID NO: 477778 - RNA, 14 nt, Chlamydia trachomatis
ccauaucaggaccu

SEQ ID NO: 477779 - RNA, 13 nt, Chlamydia trachomatis
ccauacaucaucu

SEQ ID NO: 477780 - RNA, 16 nt, Chlamydia trachomatis
ccauacaucaucucuc

SEQ ID NO: 477781 - RNA, 23 nt, Chlamydia trachomatis
ccauaagacuuugugcaaccucu

SEQ ID NO: 477782 - RNA, 22 nt, Chlamydia trachomatis
ccauaauuuucuucacuuccuc

SEQ ID NO: 477783 - RNA, 18 nt, Chlamydia trachomatis
ccaucauaaaaagauagu

SEQ ID NO: 477784 - RNA, 17 nt, Chlamydia trachomatis
ccauuucaugacagcuu

SEQ ID NO: 477785 - RNA, 15 nt, Chlamydia trachomatis
ccauuuccacagguu

SEQ ID NO: 477786 - RNA, 19 nt, Chlamydia trachomatis
ccauuuagaccaggauucc

SEQ ID NO: 477787 - RNA, 20 nt, Chlamydia trachomatis
ccaucuugcacauuuucuug

SEQ ID NO: 477788 - RNA, 21 nt, Chlamydia trachomatis
ccauugauuccauuugcuaca

SEQ ID NO: 477789 - RNA, 21 nt, Chlamydia trachomatis
cccaaaaacaaucaaagcacc

SEQ ID NO: 477790 - RNA, 19 nt, Chlamydia trachomatis
cccaaaauuuuucugcucc

SEQ ID NO: 477791 - RNA, 22 nt, Chlamydia trachomatis
cccaaaauuuuucugcuccaaa

SEQ ID NO: 477792 - RNA, 23 nt, Chlamydia trachomatis
cccaacaagggaaugaaaucacu

SEQ ID NO: 477793 - RNA, 21 nt, Chlamydia trachomatis
cccaaauacugggaaaucauu

SEQ ID NO: 477794 - RNA, 19 nt, Chlamydia trachomatis
cccaaaucaaaccaaaaau

SEQ ID NO: 477795 - RNA, 17 nt, Chlamydia trachomatis
ccccaccuauggcauuc

SEQ ID NO: 477796 - RNA, 19 nt, Chlamydia trachomatis
ccccacgaccacaaacaau

SEQ ID NO: 477797 - RNA, 20 nt, Chlamydia trachomatis
cccaugguauagaagaccuu

SEQ ID NO: 477798 - RNA, 22 nt, Chlamydia trachomatis
ccccagaaacacuaucuccuau

SEQ ID NO: 477799 - RNA, 15 nt, Chlamydia trachomatis
ccccagaagccauaa

SEQ ID NO: 477800 - RNA, 14 nt, Chlamydia trachomatis
cccgauucaaaaau

SEQ ID NO: 477801 - RNA, 21 nt, Chlamydia trachomatis
cccguguugaauuacuugggg

SEQ ID NO: 477802 - RNA, 22 nt, Chlamydia trachomatis
cccuauguaaacaagaauaaua

SEQ ID NO: 477803 - RNA, 14 nt, Chlamydia trachomatis
cccuagucgagaag

SEQ ID NO: 477804 - RNA, 19 nt, Chlamydia trachomatis
cccuagucgagaagaaggu

SEQ ID NO: 477805 - RNA, 18 nt, Chlamydia trachomatis
cccuauccccccuacauu

SEQ ID NO: 477806 - RNA, 17 nt, Chlamydia trachomatis
cccuaauaugaagaacu

SEQ ID NO: 477807 - RNA, 22 nt, Chlamydia trachomatis
cccuaaaagagcuucuucuaaa

SEQ ID NO: 477808 - RNA, 22 nt, Chlamydia trachomatis
cccuaaagagaucucuccagag

SEQ ID NO: 477809 - RNA, 23 nt, Chlamydia trachomatis
cccuaaauauagguagguuucug

SEQ ID NO: 477810 - RNA, 16 nt, Chlamydia trachomatis
cccuaaaucuccuccu

SEQ ID NO: 477811 - RNA, 19 nt, Chlamydia trachomatis
cccuaacgaggcacaaaau

SEQ ID NO: 477812 - RNA, 16 nt, Chlamydia trachomatis
cccucaccucuugccu

SEQ ID NO: 477813 - RNA, 21 nt, Chlamydia trachomatis
cccucaccucuugccugcaaa

SEQ ID NO: 477814 - RNA, 22 nt, Chlamydia trachomatis
cccuuuagaaauuguccaagcu

SEQ ID NO: 477815 - RNA, 18 nt, Chlamydia trachomatis
cccuuucuuacuccuucu

SEQ ID NO: 477816 - RNA, 23 nt, Chlamydia trachomatis
cccuuuuaaagggggacaaaaau

SEQ ID NO: 477817 - RNA, 16 nt, Chlamydia trachomatis
cccuuuuguuccagaa

SEQ ID NO: 477818 - RNA, 19 nt, Chlamydia trachomatis
ccgaauuaaaucugcuccu

SEQ ID NO: 477819 - RNA, 21 nt, Chlamydia trachomatis
ccgacaccaggcaaugcuaag

SEQ ID NO: 477820 - RNA, 18 nt, Chlamydia trachomatis
ccgaauuuguagaucuuu

SEQ ID NO: 477821 - RNA, 22 nt, Chlamydia trachomatis
ccgacaguuucccguuguuuuc

SEQ ID NO: 477822 - RNA, 12 nt, Chlamydia trachomatis
ccgacuucaacu

SEQ ID NO: 477823 - RNA, 22 nt, Chlamydia trachomatis
ccgaguaaucaaaaaaggaauc

SEQ ID NO: 477824 - RNA, 18 nt, Chlamydia trachomatis
ccgcagaaaaaaccacag

SEQ ID NO: 477825 - RNA, 20 nt, Chlamydia trachomatis
ccgcagagaugauauuuuca

SEQ ID NO: 477826 - RNA, 17 nt, Chlamydia trachomatis
ccgcaucagccccaaaa

SEQ ID NO: 477827 - RNA, 15 nt, Chlamydia trachomatis
ccgcaugaaaguagc

SEQ ID NO: 477828 - RNA, 14 nt, Chlamydia trachomatis
ccgcgacagccaca

SEQ ID NO: 477829 - RNA, 19 nt, Chlamydia trachomatis
ccggcaaagaacaguucau

SEQ ID NO: 477830 - RNA, 18 nt, Chlamydia trachomatis
ccgucaguugcuccuccg

SEQ ID NO: 477831 - RNA, 23 nt, Chlamydia trachomatis
ccguauuuuuuacgcucuuucuu

SEQ ID NO: 477832 - RNA, 20 nt, Chlamydia trachomatis
ccguaugauaaaacuccccu

SEQ ID NO: 477833 - RNA, 17 nt, Chlamydia trachomatis
ccuaaauaccucuuuuu

SEQ ID NO: 477834 - RNA, 17 nt, Chlamydia trachomatis
ccuaaaccuccagaagg

SEQ ID NO: 477835 - RNA, 18 nt, Chlamydia trachomatis
ccuaagaaccgcaagcaa

SEQ ID NO: 477836 - RNA, 19 nt, Chlamydia trachomatis
ccuaagaucucuuccuugu

SEQ ID NO: 477837 - RNA, 16 nt, Chlamydia trachomatis
ccuacaaacauccuua

SEQ ID NO: 477838 - RNA, 18 nt, Chlamydia trachomatis
ccuacaaacauccuuacu

SEQ ID NO: 477839 - RNA, 13 nt, Chlamydia trachomatis
ccuaaacaaaugu

SEQ ID NO: 477840 - RNA, 19 nt, Chlamydia trachomatis
ccuaaaaaaaaccauucca

SEQ ID NO: 477841 - RNA, 20 nt, Chlamydia trachomatis
ccuaaaaaaaaccauuccac

SEQ ID NO: 477842 - RNA, 12 nt, Chlamydia trachomatis
ccuauuuuuucc

SEQ ID NO: 477843 - RNA, 20 nt, Chlamydia trachomatis
ccucaaaaaauguuuuugau

SEQ ID NO: 477844 - RNA, 18 nt, Chlamydia trachomatis
ccucaaacaaucuaaaaa

SEQ ID NO: 477845 - RNA, 18 nt, Chlamydia trachomatis
ccuauuucaccacuuuuc

SEQ ID NO: 477846 - RNA, 17 nt, Chlamydia trachomatis
ccuauguaaacaagaau

SEQ ID NO: 477847 - RNA, 15 nt, Chlamydia trachomatis
ccuauggcauucaac

SEQ ID NO: 477848 - RNA, 22 nt, Chlamydia trachomatis
ccucaauuuguagcaaaagauu

SEQ ID NO: 477849 - RNA, 17 nt, Chlamydia trachomatis
ccucaauagcagcauuc

SEQ ID NO: 477850 - RNA, 21 nt, Chlamydia trachomatis
ccucaauagcugacuuugaag

SEQ ID NO: 477851 - RNA, 15 nt, Chlamydia trachomatis
ccucaccucuugccu

SEQ ID NO: 477852 - RNA, 18 nt, Chlamydia trachomatis
ccuauagcaggauuuucu

SEQ ID NO: 477853 - RNA, 14 nt, Chlamydia trachomatis
ccuauccaaggaaa

SEQ ID NO: 477854 - RNA, 22 nt, Chlamydia trachomatis
ccuaggcgacacgcuucuucaa

SEQ ID NO: 477855 - RNA, 14 nt, Chlamydia trachomatis
ccuaguacaaaaau

SEQ ID NO: 477856 - RNA, 17 nt, Chlamydia trachomatis
ccuaguacaaaaauacu

SEQ ID NO: 477857 - RNA, 15 nt, Chlamydia trachomatis
ccuauaauugcuaag

SEQ ID NO: 477858 - RNA, 18 nt, Chlamydia trachomatis
ccuauacgaaauaacaaa

SEQ ID NO: 477859 - RNA, 21 nt, Chlamydia trachomatis
ccuauagaagacuaaucuucc

SEQ ID NO: 477860 - RNA, 16 nt, Chlamydia trachomatis
ccuauagagcaaucuc

SEQ ID NO: 477861 - RNA, 20 nt, Chlamydia trachomatis
ccuagaaagaaccacaaaau

SEQ ID NO: 477862 - RNA, 15 nt, Chlamydia trachomatis
ccuagagagggagau

SEQ ID NO: 477863 - RNA, 16 nt, Chlamydia trachomatis
ccuacuccaauggaaa

SEQ ID NO: 477864 - RNA, 13 nt, Chlamydia trachomatis
ccuacagaaucag

SEQ ID NO: 477865 - RNA, 15 nt, Chlamydia trachomatis
ccucgauaaugcuua

SEQ ID NO: 477866 - RNA, 16 nt, Chlamydia trachomatis
ccucagauuuaucugc

SEQ ID NO: 477867 - RNA, 17 nt, Chlamydia trachomatis
ccucuaaagauccucuu

SEQ ID NO: 477868 - RNA, 22 nt, Chlamydia trachomatis
ccucugcguagaucccagaaua

SEQ ID NO: 477869 - RNA, 12 nt, Chlamydia trachomatis
ccucugcuucuu

SEQ ID NO: 477870 - RNA, 19 nt, Chlamydia trachomatis
ccucuucacagagcuucuc

SEQ ID NO: 477871 - RNA, 14 nt, Chlamydia trachomatis
ccucuagcagagau

SEQ ID NO: 477872 - RNA, 20 nt, Chlamydia trachomatis
ccucuauagccaaaugcacc

SEQ ID NO: 477873 - RNA, 14 nt, Chlamydia trachomatis
ccucuaacucuucu

SEQ ID NO: 477874 - RNA, 16 nt, Chlamydia trachomatis
ccucuaacucuucugg

SEQ ID NO: 477875 - RNA, 18 nt, Chlamydia trachomatis
ccucuaagcaccuuuaca

SEQ ID NO: 477876 - RNA, 18 nt, Chlamydia trachomatis
ccucuaauaaacagaucu

SEQ ID NO: 477877 - RNA, 18 nt, Chlamydia trachomatis
ccucuacaccauaaaacu

SEQ ID NO: 477878 - RNA, 21 nt, Chlamydia trachomatis
ccugagggccuucuuuuuccu

SEQ ID NO: 477879 - RNA, 21 nt, Chlamydia trachomatis
ccugauagaguccugagccaa

SEQ ID NO: 477880 - RNA, 23 nt, Chlamydia trachomatis
ccugaccaauaccuacacgauau

SEQ ID NO: 477881 - RNA, 16 nt, Chlamydia trachomatis
ccugaucaaaucgggc

SEQ ID NO: 477882 - RNA, 13 nt, Chlamydia trachomatis
ccugauggauagu

SEQ ID NO: 477883 - RNA, 14 nt, Chlamydia trachomatis
ccugcaaaaaggcu

SEQ ID NO: 477884 - RNA, 19 nt, Chlamydia trachomatis
ccugcuccggcaaauccug

SEQ ID NO: 477885 - RNA, 16 nt, Chlamydia trachomatis
ccugcuucuauagaaa

SEQ ID NO: 477886 - RNA, 16 nt, Chlamydia trachomatis
ccugcuucacagcuaa

SEQ ID NO: 477887 - RNA, 16 nt, Chlamydia trachomatis
ccuggaaucacaugcu

SEQ ID NO: 477888 - RNA, 20 nt, Chlamydia trachomatis
ccugguccaaggaauaaaca

SEQ ID NO: 477889 - RNA, 13 nt, Chlamydia trachomatis
ccuggcugcagaa

SEQ ID NO: 477890 - RNA, 16 nt, Chlamydia trachomatis
ccuuaaacauacacag

SEQ ID NO: 477891 - RNA, 16 nt, Chlamydia trachomatis
ccuuaauaagcuuuuu

SEQ ID NO: 477892 - RNA, 20 nt, Chlamydia trachomatis
ccuuaauuggggauccuaca

SEQ ID NO: 477893 - RNA, 12 nt, Chlamydia trachomatis
ccuuacccaaac

SEQ ID NO: 477894 - RNA, 22 nt, Chlamydia trachomatis
ccuguuuguuuguuuuuuucaa

SEQ ID NO: 477895 - RNA, 18 nt, Chlamydia trachomatis
ccuuauaguuguuuuuga

SEQ ID NO: 477896 - RNA, 13 nt, Chlamydia trachomatis
ccuuaucuucuug

SEQ ID NO: 477897 - RNA, 22 nt, Chlamydia trachomatis
ccuuaucuucuugagaaaacuu

SEQ ID NO: 477898 - RNA, 13 nt, Chlamydia trachomatis
ccuuacucuuccg

SEQ ID NO: 477899 - RNA, 19 nt, Chlamydia trachomatis
ccuuagauccggcuuuuug

SEQ ID NO: 477900 - RNA, 22 nt, Chlamydia trachomatis
ccuuagggaaaccccaauguuu

SEQ ID NO: 477901 - RNA, 19 nt, Chlamydia trachomatis
ccuuaguuaaaacuccaga

SEQ ID NO: 477902 - RNA, 15 nt, Chlamydia trachomatis
cgauaaaguaaagga

SEQ ID NO: 477903 - RNA, 19 nt, Chlamydia trachomatis
ccuuccaaauuucccucuu

SEQ ID NO: 477904 - RNA, 12 nt, Chlamydia trachomatis
cgauaaaaagcu

SEQ ID NO: 477905 - RNA, 14 nt, Chlamydia trachomatis
cgauaaaaagcugg

SEQ ID NO: 477906 - RNA, 16 nt, Chlamydia trachomatis
cgauaaacagaucuag

SEQ ID NO: 477907 - RNA, 19 nt, Chlamydia trachomatis
cgauauauccauucaggau

SEQ ID NO: 477908 - RNA, 21 nt, Chlamydia trachomatis
cgauaccuauuccaaauccuc

SEQ ID NO: 477909 - RNA, 21 nt, Chlamydia trachomatis
cgauaacaggggcauguaaac

SEQ ID NO: 477910 - RNA, 15 nt, Chlamydia trachomatis
cgauauccuuuuuac

SEQ ID NO: 477911 - RNA, 20 nt, Chlamydia trachomatis
cgauauccaucauaaaaaga

SEQ ID NO: 477912 - RNA, 13 nt, Chlamydia trachomatis
cgaucagcuccug

SEQ ID NO: 477913 - RNA, 18 nt, Chlamydia trachomatis
cgaucagcccaaaucuca

SEQ ID NO: 477914 - RNA, 20 nt, Chlamydia trachomatis
cgauccaaagccucuuguug

SEQ ID NO: 477915 - RNA, 22 nt, Chlamydia trachomatis
cgaucauuaggauuaaaaucca

SEQ ID NO: 477916 - RNA, 12 nt, Chlamydia trachomatis
cgaucuccuucc

SEQ ID NO: 477917 - RNA, 19 nt, Chlamydia trachomatis
cgaucuccuuccucuuuaa

SEQ ID NO: 477918 - RNA, 22 nt, Chlamydia trachomatis
cgaucuccuuccucuuuaacca

SEQ ID NO: 477919 - RNA, 15 nt, Chlamydia trachomatis
cgaucuuucgaauug

SEQ ID NO: 477920 - RNA, 22 nt, Chlamydia trachomatis
cgaugagcuuaucacaaaccag

SEQ ID NO: 477921 - RNA, 22 nt, Chlamydia trachomatis
cgaugagcgaguuuguggaauu

SEQ ID NO: 477922 - RNA, 19 nt, Chlamydia trachomatis
cgaugaucccuaagauuuc

SEQ ID NO: 477923 - RNA, 21 nt, Chlamydia trachomatis
cgaugauauuaguuagugaag

SEQ ID NO: 477924 - RNA, 23 nt, Chlamydia trachomatis
cgaugauauuaguuagugaaguc

SEQ ID NO: 477925 - RNA, 17 nt, Chlamydia trachomatis
cgaugcccaagaaacug

SEQ ID NO: 477926 - RNA, 14 nt, Chlamydia trachomatis
cgauguaaaugaug

SEQ ID NO: 477927 - RNA, 12 nt, Chlamydia trachomatis
cgauucaaaaau

SEQ ID NO: 477928 - RNA, 15 nt, Chlamydia trachomatis
cgcaaagcggauuca

SEQ ID NO: 477929 - RNA, 22 nt, Chlamydia trachomatis
cgcaaaugcguuaaacuuucuu

SEQ ID NO: 477930 - RNA, 17 nt, Chlamydia trachomatis
cgcaaguucuccuucuu

SEQ ID NO: 477931 - RNA, 13 nt, Chlamydia trachomatis
cgcaagucucugc

SEQ ID NO: 477932 - RNA, 16 nt, Chlamydia trachomatis
cgcagcaugaaugaau

SEQ ID NO: 477933 - RNA, 23 nt, Chlamydia trachomatis
cgcagcuucugguguaggaaaau

SEQ ID NO: 477934 - RNA, 22 nt, Chlamydia trachomatis
cgccaaugaucuuuaagcucuu

SEQ ID NO: 477935 - RNA, 18 nt, Chlamydia trachomatis
cgccauaccuaaauucau

SEQ ID NO: 477936 - RNA, 14 nt, Chlamydia trachomatis
cgccauuuaugaag

SEQ ID NO: 477937 - RNA, 14 nt, Chlamydia trachomatis
cgccccucuuuuuc

SEQ ID NO: 477938 - RNA, 13 nt, Chlamydia trachomatis
cgcccuccuccuc

SEQ ID NO: 477939 - RNA, 23 nt, Chlamydia trachomatis
cgccucaaacaaucuaaaaaauu

SEQ ID NO: 477940 - RNA, 15 nt, Chlamydia trachomatis
cgccuccggcuccca

SEQ ID NO: 477941 - RNA, 19 nt, Chlamydia trachomatis
cgccucuuuugcauuucca

SEQ ID NO: 477942 - RNA, 24 nt, Chlamydia trachomatis
cgccucgucgaugaucauaaauac

SEQ ID NO: 477943 - RNA, 19 nt, Chlamydia trachomatis
cgccuugcgcaucaaagga

SEQ ID NO: 477944 - RNA, 15 nt, Chlamydia trachomatis
cgcgauauccuuuuu

SEQ ID NO: 477945 - RNA, 17 nt, Chlamydia trachomatis
cgcgcaaaucaggaauc

SEQ ID NO: 477946 - RNA, 12 nt, Chlamydia trachomatis
cgcgcagcuucu

SEQ ID NO: 477947 - RNA, 15 nt, Chlamydia trachomatis
cgcuaaauugaaauu

SEQ ID NO: 477948 - RNA, 13 nt, Chlamydia trachomatis
cgcuaucgguaau

SEQ ID NO: 477949 - RNA, 17 nt, Chlamydia trachomatis
cgcuaucguaaccaagc

SEQ ID NO: 477950 - RNA, 18 nt, Chlamydia trachomatis
cgcugaguuuccuuuaaa

SEQ ID NO: 477951 - RNA, 16 nt, Chlamydia trachomatis
cgcucguuccucagcu

SEQ ID NO: 477952 - RNA, 20 nt, Chlamydia trachomatis
cgcucaggcuaucacaaaag

SEQ ID NO: 477953 - RNA, 14 nt, Chlamydia trachomatis
cgcuuaauuuuuua

SEQ ID NO: 477954 - RNA, 16 nt, Chlamydia trachomatis
cgcuuuugcugcuuca

SEQ ID NO: 477955 - RNA, 18 nt, Chlamydia trachomatis
cgcuuuuucuucucuagc

SEQ ID NO: 477956 - RNA, 19 nt, Chlamydia trachomatis
cggaaaccaauaaaguacg

SEQ ID NO: 477957 - RNA, 20 nt, Chlamydia trachomatis
cggaaagauagccuccgcua

SEQ ID NO: 477958 - RNA, 22 nt, Chlamydia trachomatis
cggaaaucuucggugaguugua

SEQ ID NO: 477959 - RNA, 18 nt, Chlamydia trachomatis
cggaaauaggauuuaaac

SEQ ID NO: 477960 - RNA, 12 nt, Chlamydia trachomatis
cggagcaucuuc

SEQ ID NO: 477961 - RNA, 20 nt, Chlamydia trachomatis
cggagccgauucaaaagcua

SEQ ID NO: 477962 - RNA, 16 nt, Chlamydia trachomatis
cggauuaugauuccgc

SEQ ID NO: 477963 - RNA, 14 nt, Chlamydia trachomatis
cggcaaauccugca

SEQ ID NO: 477964 - RNA, 13 nt, Chlamydia trachomatis
cggcaggaaagug

SEQ ID NO: 477965 - RNA, 14 nt, Chlamydia trachomatis
cggcaguuucuagg

SEQ ID NO: 477966 - RNA, 22 nt, Chlamydia trachomatis
cggccccuggaauuucuccagc

SEQ ID NO: 477967 - RNA, 14 nt, Chlamydia trachomatis
cggcuucauggaau

SEQ ID NO: 477968 - RNA, 21 nt, Chlamydia trachomatis
cggcuuuucuauuucauuuaa

SEQ ID NO: 477969 - RNA, 14 nt, Chlamydia trachomatis
cgggaaaaaguuug

SEQ ID NO: 477970 - RNA, 17 nt, Chlamydia trachomatis
cggucagcuguacgaug

SEQ ID NO: 477971 - RNA, 20 nt, Chlamydia trachomatis
cggucgacagcguuuucccc

SEQ ID NO: 477972 - RNA, 18 nt, Chlamydia trachomatis
cggucuauggcaaaaggu

SEQ ID NO: 477973 - RNA, 13 nt, Chlamydia trachomatis
cguaaacaaccaa

SEQ ID NO: 477974 - RNA, 20 nt, Chlamydia trachomatis
cgguuugauuuccucuucuu

SEQ ID NO: 477975 - RNA, 21 nt, Chlamydia trachomatis
cguagauaucuuuacucuuuu

SEQ ID NO: 477976 - RNA, 16 nt, Chlamydia trachomatis
cgucaaaaagaucuuc

SEQ ID NO: 477977 - RNA, 16 nt, Chlamydia trachomatis
cguaugcgcccaucaa

SEQ ID NO: 477978 - RNA, 17 nt, Chlamydia trachomatis
cgucacagauuugaguu

SEQ ID NO: 477979 - RNA, 18 nt, Chlamydia trachomatis
cgucaucuuugagaagca

SEQ ID NO: 477980 - RNA, 16 nt, Chlamydia trachomatis
cguccaaaaucaucaa

SEQ ID NO: 477981 - RNA, 22 nt, Chlamydia trachomatis
cguuauauuggaagauaacaau

SEQ ID NO: 477982 - RNA, 21 nt, Chlamydia trachomatis
cguucgguaaguccgcagaga

SEQ ID NO: 477983 - RNA, 12 nt, Chlamydia trachomatis
cguucucuaaag

SEQ ID NO: 477984 - RNA, 17 nt, Chlamydia trachomatis
cuaaacuaucuaaaauc

SEQ ID NO: 477985 - RNA, 18 nt, Chlamydia trachomatis
cuaaacuaucuaaaaucc

SEQ ID NO: 477986 - RNA, 19 nt, Chlamydia trachomatis
cuaaacuaucuaaaauccc

SEQ ID NO: 477987 - RNA, 13 nt, Chlamydia trachomatis
cuaaacuucuugu

SEQ ID NO: 477988 - RNA, 16 nt, Chlamydia trachomatis
cuaaagccauaagacu

SEQ ID NO: 477989 - RNA, 16 nt, Chlamydia trachomatis
cuaaaggaaacaagca

SEQ ID NO: 477990 - RNA, 16 nt, Chlamydia trachomatis
cuaaaggcaacucucu

SEQ ID NO: 477991 - RNA, 18 nt, Chlamydia trachomatis
cuaaaggcaacucucucu

SEQ ID NO: 477992 - RNA, 13 nt, Chlamydia trachomatis
cuaaagucuuaaa

SEQ ID NO: 477993 - RNA, 18 nt, Chlamydia trachomatis
cuaaagucuuaaaagggu

SEQ ID NO: 477994 - RNA, 14 nt, Chlamydia trachomatis
cuaaagucuuucca

SEQ ID NO: 477995 - RNA, 15 nt, Chlamydia trachomatis
cuaaagugagcccuc

SEQ ID NO: 477996 - RNA, 20 nt, Chlamydia trachomatis
cuaaaguauucuguaaaagg

SEQ ID NO: 477997 - RNA, 21 nt, Chlamydia trachomatis
cuaaaaguuuucgaauuuuuu

SEQ ID NO: 477998 - RNA, 23 nt, Chlamydia trachomatis
cuaaaaucccuaacucuugggca

SEQ ID NO: 477999 - RNA, 20 nt, Chlamydia trachomatis
cuaaaaucgugcuaugcauu

SEQ ID NO: 478000 - RNA, 20 nt, Chlamydia trachomatis
cuaaaaugacuaguuuuuuc

SEQ ID NO: 478001 - RNA, 23 nt, Chlamydia trachomatis
cuaaaaugcaaagcuuuucuccu

SEQ ID NO: 478002 - RNA, 20 nt, Chlamydia trachomatis
cuaaacaagguucuucaaca

SEQ ID NO: 478003 - RNA, 14 nt, Chlamydia trachomatis
cuaaacaagucucu

SEQ ID NO: 478004 - RNA, 23 nt, Chlamydia trachomatis
cuaaacaaggauuuucuucuuuu

SEQ ID NO: 478005 - RNA, 19 nt, Chlamydia trachomatis
cuaaacgaugauagaguag

SEQ ID NO: 478006 - RNA, 23 nt, Chlamydia trachomatis
cguuuuccgcacccaaucuucua

SEQ ID NO: 478007 - RNA, 20 nt, Chlamydia trachomatis
cguuucagaaaagccuucuu

SEQ ID NO: 478008 - RNA, 17 nt, Chlamydia trachomatis
cuaccauccgggaauga

SEQ ID NO: 478009 - RNA, 22 nt, Chlamydia trachomatis
cuaccauugugaacaauaauuc

SEQ ID NO: 478010 - RNA, 21 nt, Chlamydia trachomatis
cuaccacggauaaagaaagcc

SEQ ID NO: 478011 - RNA, 12 nt, Chlamydia trachomatis
cuaccagcccca

SEQ ID NO: 478012 - RNA, 19 nt, Chlamydia trachomatis
cuacauguaguaaucugcu

SEQ ID NO: 478013 - RNA, 17 nt, Chlamydia trachomatis
cuacauucgccucuucu

SEQ ID NO: 478014 - RNA, 16 nt, Chlamydia trachomatis
cuacauuguaaauaga

SEQ ID NO: 478015 - RNA, 15 nt, Chlamydia trachomatis
cuacagcaaaaccuu

SEQ ID NO: 478016 - RNA, 13 nt, Chlamydia trachomatis
cuacagagcccuu

SEQ ID NO: 478017 - RNA, 22 nt, Chlamydia trachomatis
cuacagaucauaggcuccugca

SEQ ID NO: 478018 - RNA, 12 nt, Chlamydia trachomatis
cuacagaaucag

SEQ ID NO: 478019 - RNA, 16 nt, Chlamydia trachomatis
cuacagcuagcucucc

SEQ ID NO: 478020 - RNA, 20 nt, Chlamydia trachomatis
cuacaggaguaaauccugcu

SEQ ID NO: 478021 - RNA, 14 nt, Chlamydia trachomatis
cuacagucugucca

SEQ ID NO: 478022 - RNA, 15 nt, Chlamydia trachomatis
cuacagucuguccag

SEQ ID NO: 478023 - RNA, 22 nt, Chlamydia trachomatis
cuacagucuucucgagaagaaa

SEQ ID NO: 478024 - RNA, 13 nt, Chlamydia trachomatis
cuacauaagucuc

SEQ ID NO: 478025 - RNA, 19 nt, Chlamydia trachomatis
cuacacgauauauccauuc

SEQ ID NO: 478026 - RNA, 13 nt, Chlamydia trachomatis
cuacaccagaucc

SEQ ID NO: 478027 - RNA, 22 nt, Chlamydia trachomatis
cuacaagggugcuaacuuucuu

SEQ ID NO: 478028 - RNA, 19 nt, Chlamydia trachomatis
cuaauuuuagauaaaagaa

SEQ ID NO: 478029 - RNA, 13 nt, Chlamydia trachomatis
cuaauuuuugaga

SEQ ID NO: 478030 - RNA, 20 nt, Chlamydia trachomatis
cuaauuuuugagagagcuua

SEQ ID NO: 478031 - RNA, 15 nt, Chlamydia trachomatis
cuacaaacauccuua

SEQ ID NO: 478032 - RNA, 23 nt, Chlamydia trachomatis
cuaaauaccucuuuuuuaugggu

SEQ ID NO: 478033 - RNA, 22 nt, Chlamydia trachomatis
cuaaauauagguagguuucugc

SEQ ID NO: 478034 - RNA, 15 nt, Chlamydia trachomatis
cuaaaucuccuccua

SEQ ID NO: 478035 - RNA, 17 nt, Chlamydia trachomatis
cuaacguuccuccucca

SEQ ID NO: 478036 - RNA, 22 nt, Chlamydia trachomatis
cuaacuaaaugucucuaaguaa

SEQ ID NO: 478037 - RNA, 15 nt, Chlamydia trachomatis
cuaacucaccuaaau

SEQ ID NO: 478038 - RNA, 12 nt, Chlamydia trachomatis
cuaacucuucug

SEQ ID NO: 478039 - RNA, 14 nt, Chlamydia trachomatis
cuaacucuucugga

SEQ ID NO: 478040 - RNA, 13 nt, Chlamydia trachomatis
cuaacucuugaaa

SEQ ID NO: 478041 - RNA, 20 nt, Chlamydia trachomatis
cuaagacuaucccggaggca

SEQ ID NO: 478042 - RNA, 16 nt, Chlamydia trachomatis
cuaagacuuucucuaa

SEQ ID NO: 478043 - RNA, 17 nt, Chlamydia trachomatis
cuaagaugguugcucuu

SEQ ID NO: 478044 - RNA, 21 nt, Chlamydia trachomatis
cuaagauuuucaucuuccaac

SEQ ID NO: 478045 - RNA, 15 nt, Chlamydia trachomatis
cuaagcaccuuuaca

SEQ ID NO: 478046 - RNA, 23 nt, Chlamydia trachomatis
cuaaggagcaugguauucuaaag

SEQ ID NO: 478047 - RNA, 23 nt, Chlamydia trachomatis
cuaauaaauuagggaagagcaau

SEQ ID NO: 478048 - RNA, 17 nt, Chlamydia trachomatis
cuaauaacccgcuuuga

SEQ ID NO: 478049 - RNA, 15 nt, Chlamydia trachomatis
cuaauaauacagauu

SEQ ID NO: 478050 - RNA, 18 nt, Chlamydia trachomatis
cuaauaauacagauuuuu

SEQ ID NO: 478051 - RNA, 21 nt, Chlamydia trachomatis
cuaauaauacagauuuuucga

SEQ ID NO: 478052 - RNA, 18 nt, Chlamydia trachomatis
cuaauaucucaggauaaa

SEQ ID NO: 478053 - RNA, 21 nt, Chlamydia trachomatis
cuaauauuagauagcuucuua

SEQ ID NO: 478054 - RNA, 20 nt, Chlamydia trachomatis
cuaaucaugaugaugagagc

SEQ ID NO: 478055 - RNA, 23 nt, Chlamydia trachomatis
cuaaucccauucugcguuuaauu

SEQ ID NO: 478056 - RNA, 22 nt, Chlamydia trachomatis
cuaaucuugauuaggaagaagu

SEQ ID NO: 478057 - RNA, 12 nt, Chlamydia trachomatis
cuaaucuuuuug

SEQ ID NO: 478058 - RNA, 20 nt, Chlamydia trachomatis
cuaaucuuuuugauuuuucu

SEQ ID NO: 478059 - RNA, 21 nt, Chlamydia trachomatis
cuaaugaaacucuuuuuaaau

SEQ ID NO: 478060 - RNA, 12 nt, Chlamydia trachomatis
cuaaugagcaga

SEQ ID NO: 478061 - RNA, 14 nt, Chlamydia trachomatis
cuaaugagcagaau

SEQ ID NO: 478062 - RNA, 15 nt, Chlamydia trachomatis
cuaaugagcagaaua

SEQ ID NO: 478063 - RNA, 14 nt, Chlamydia trachomatis
cuaauguagaaauu

SEQ ID NO: 478064 - RNA, 18 nt, Chlamydia trachomatis
cuaauucaacauaauaaa

SEQ ID NO: 478065 - RNA, 12 nt, Chlamydia trachomatis
cuaauuccccaa

SEQ ID NO: 478066 - RNA, 15 nt, Chlamydia trachomatis
cuaauuccccaauga

SEQ ID NO: 478067 - RNA, 14 nt, Chlamydia trachomatis
cuaauucuagcaac

SEQ ID NO: 478068 - RNA, 21 nt, Chlamydia trachomatis
cuacccccuucuccuuuuuag

SEQ ID NO: 478069 - RNA, 18 nt, Chlamydia trachomatis
cuaccccuaaagucucca

SEQ ID NO: 478070 - RNA, 23 nt, Chlamydia trachomatis
cuaccgacaaugucaacauacag

SEQ ID NO: 478071 - RNA, 15 nt, Chlamydia trachomatis
cuacucccaaaucaa

SEQ ID NO: 478072 - RNA, 18 nt, Chlamydia trachomatis
cuacuccugcaacaagaa

SEQ ID NO: 478073 - RNA, 21 nt, Chlamydia trachomatis
cuacucguucuauaggaaagg

SEQ ID NO: 478074 - RNA, 13 nt, Chlamydia trachomatis
cuagacauagcuu

SEQ ID NO: 478075 - RNA, 21 nt, Chlamydia trachomatis
cuagacguuuagccuccaucu

SEQ ID NO: 478076 - RNA, 19 nt, Chlamydia trachomatis
cuacuuucccuauuuuuuc

SEQ ID NO: 478077 - RNA, 14 nt, Chlamydia trachomatis
cuacuuucgcuuuu

SEQ ID NO: 478078 - RNA, 18 nt, Chlamydia trachomatis
cuacuuucgcuuuugcug

SEQ ID NO: 478079 - RNA, 19 nt, Chlamydia trachomatis
cuagugauuuuaaaccaau

SEQ ID NO: 478080 - RNA, 17 nt, Chlamydia trachomatis
cuaguacaaaaauacuu

SEQ ID NO: 478081 - RNA, 18 nt, Chlamydia trachomatis
cuaguaaugugucuaaag

SEQ ID NO: 478082 - RNA, 18 nt, Chlamydia trachomatis
cuaggguugugaaaaaaa

SEQ ID NO: 478083 - RNA, 17 nt, Chlamydia trachomatis
cuaggguucuaaagaaa

SEQ ID NO: 478084 - RNA, 19 nt, Chlamydia trachomatis
cuagguaucgaaaguaaaa

SEQ ID NO: 478085 - RNA, 14 nt, Chlamydia trachomatis
cuaggucucccagg

SEQ ID NO: 478086 - RNA, 18 nt, Chlamydia trachomatis
cuagagacggucuacaaa

SEQ ID NO: 478087 - RNA, 16 nt, Chlamydia trachomatis
cuagauccguuuuucu

SEQ ID NO: 478088 - RNA, 16 nt, Chlamydia trachomatis
cuagaucuaaggaaug

SEQ ID NO: 478089 - RNA, 14 nt, Chlamydia trachomatis
cuagaugcaauaaa

SEQ ID NO: 478090 - RNA, 18 nt, Chlamydia trachomatis
cuaggcucaugagccucu

SEQ ID NO: 478091 - RNA, 13 nt, Chlamydia trachomatis
cuagggaaaaaaa

SEQ ID NO: 478092 - RNA, 19 nt, Chlamydia trachomatis
cuauauuuguguacuuuug

SEQ ID NO: 478093 - RNA, 11 nt, Chlamydia trachomatis
cuaucaauaaa

SEQ ID NO: 478094 - RNA, 23 nt, Chlamydia trachomatis
cuaucacuguugagaaaaacucu

SEQ ID NO: 478095 - RNA, 13 nt, Chlamydia trachomatis
cuaucagcacagc

SEQ ID NO: 478096 - RNA, 20 nt, Chlamydia trachomatis
cuaucagcgcucauaggaca

SEQ ID NO: 478097 - RNA, 19 nt, Chlamydia trachomatis
cuaucaggaauaaugauuu

SEQ ID NO: 478098 - RNA, 23 nt, Chlamydia trachomatis
cuaucaggaauaaugauuuuuuu

SEQ ID NO: 478099 - RNA, 15 nt, Chlamydia trachomatis
cuaucauuuccaaaa

SEQ ID NO: 478100 - RNA, 16 nt, Chlamydia trachomatis
cuaucauuuccaaaau

SEQ ID NO: 478101 - RNA, 17 nt, Chlamydia trachomatis
cuaguuauauugcuuca

SEQ ID NO: 478102 - RNA, 17 nt, Chlamydia trachomatis
cuaguuuacgcacuucu

SEQ ID NO: 478103 - RNA, 20 nt, Chlamydia trachomatis
cuauagccaaaugcaccucg

SEQ ID NO: 478104 - RNA, 16 nt, Chlamydia trachomatis
cuauauguaagaagcu

SEQ ID NO: 478105 - RNA, 15 nt, Chlamydia trachomatis
cuaucuaccuuuuuc

SEQ ID NO: 478106 - RNA, 20 nt, Chlamydia trachomatis
cuaucgcggcuaucgucuuu

SEQ ID NO: 478107 - RNA, 17 nt, Chlamydia trachomatis
cuaugcccaggauagga

SEQ ID NO: 478108 - RNA, 20 nt, Chlamydia trachomatis
cuaugcgcggaaggaaaaag

SEQ ID NO: 478109 - RNA, 19 nt, Chlamydia trachomatis
cuauguaaaaauucuaaag

SEQ ID NO: 478110 - RNA, 16 nt, Chlamydia trachomatis
cuaugcaguaaagaaa

SEQ ID NO: 478111 - RNA, 19 nt, Chlamydia trachomatis
cuauguuuacugacaaggc

SEQ ID NO: 478112 - RNA, 19 nt, Chlamydia trachomatis
cuauucguguccucuauuu

SEQ ID NO: 478113 - RNA, 22 nt, Chlamydia trachomatis
cucaaaaacacuacgcuacaga

SEQ ID NO: 478114 - RNA, 14 nt, Chlamydia trachomatis
cuauugauuuuuuc

SEQ ID NO: 478115 - RNA, 15 nt, Chlamydia trachomatis
cuauugauuuuuucg

SEQ ID NO: 478116 - RNA, 18 nt, Chlamydia trachomatis
cucaaaacgcucuccaaa

SEQ ID NO: 478117 - RNA, 14 nt, Chlamydia trachomatis
cucaaaagcuuuuc

SEQ ID NO: 478118 - RNA, 16 nt, Chlamydia trachomatis
cucaaaauaaagaaau

SEQ ID NO: 478119 - RNA, 16 nt, Chlamydia trachomatis
cucaaaucacugagag

SEQ ID NO: 478120 - RNA, 16 nt, Chlamydia trachomatis
cucaaauuuucaugaa

SEQ ID NO: 478121 - RNA, 22 nt, Chlamydia trachomatis
cucaagcgauuaugaaaaagcc

SEQ ID NO: 478122 - RNA, 20 nt, Chlamydia trachomatis
cucaacgucuugucucucga

SEQ ID NO: 478123 - RNA, 22 nt, Chlamydia trachomatis
cucaacuccagagcaaauagaa

SEQ ID NO: 478124 - RNA, 18 nt, Chlamydia trachomatis
cucaacucgcuccagaac

SEQ ID NO: 478125 - RNA, 17 nt, Chlamydia trachomatis
cucaacgccuguuagua

SEQ ID NO: 478126 - RNA, 13 nt, Chlamydia trachomatis
cucaacaaggauu

SEQ ID NO: 478127 - RNA, 15 nt, Chlamydia trachomatis
cucacaaauaacaga

SEQ ID NO: 478128 - RNA, 22 nt, Chlamydia trachomatis
cucaaguucauugguaagauuc

SEQ ID NO: 478129 - RNA, 21 nt, Chlamydia trachomatis
cucaaguugagugcagaggau

SEQ ID NO: 478130 - RNA, 13 nt, Chlamydia trachomatis
cucaugacgagaa

SEQ ID NO: 478131 - RNA, 19 nt, Chlamydia trachomatis
cucaugagccucuaacucu

SEQ ID NO: 478132 - RNA, 20 nt, Chlamydia trachomatis
cucaugagccucuaacucuu

SEQ ID NO: 478133 - RNA, 15 nt, Chlamydia trachomatis
cucaucuuuuuuaaa

SEQ ID NO: 478134 - RNA, 16 nt, Chlamydia trachomatis
cucaucuuuuuuaaaa

SEQ ID NO: 478135 - RNA, 17 nt, Chlamydia trachomatis
cucaucaggaucagcau

SEQ ID NO: 478136 - RNA, 23 nt, Chlamydia trachomatis
cuccaaagauauagguuccaucu

SEQ ID NO: 478137 - RNA, 15 nt, Chlamydia trachomatis
cuccaaagaugcucc

SEQ ID NO: 478138 - RNA, 18 nt, Chlamydia trachomatis
cucauuauauaaagcccc

SEQ ID NO: 478139 - RNA, 13 nt, Chlamydia trachomatis
cuccaaaguaauc

SEQ ID NO: 478140 - RNA, 21 nt, Chlamydia trachomatis
cuccaaauuguguaagauauu

SEQ ID NO: 478141 - RNA, 21 nt, Chlamydia trachomatis
cuccaagaagagucucuaaca

SEQ ID NO: 478142 - RNA, 21 nt, Chlamydia trachomatis
cuccaagauguuggagaacau

SEQ ID NO: 478143 - RNA, 18 nt, Chlamydia trachomatis
cuccaagcauuaccauau

SEQ ID NO: 478144 - RNA, 14 nt, Chlamydia trachomatis
cuccaaucacagca

SEQ ID NO: 478145 - RNA, 15 nt, Chlamydia trachomatis
cuccaaucacagcaa

SEQ ID NO: 478146 - RNA, 19 nt, Chlamydia trachomatis
cuccaaucacagcaauagc

SEQ ID NO: 478147 - RNA, 17 nt, Chlamydia trachomatis
cucauaagaauacaaag

SEQ ID NO: 478148 - RNA, 22 nt, Chlamydia trachomatis
cucauaagaauacaaagcagcc

SEQ ID NO: 478149 - RNA, 22 nt, Chlamydia trachomatis
cucauaagaucuuuacuuucuu

SEQ ID NO: 478150 - RNA, 19 nt, Chlamydia trachomatis
cucauaagcagggcuguau

SEQ ID NO: 478151 - RNA, 23 nt, Chlamydia trachomatis
cucauaagcguuccuauacaaga

SEQ ID NO: 478152 - RNA, 19 nt, Chlamydia trachomatis
cucauaaggaguuuuaggc

SEQ ID NO: 478153 - RNA, 19 nt, Chlamydia trachomatis
cucauagauuucagcauca

SEQ ID NO: 478154 - RNA, 23 nt, Chlamydia trachomatis
cucagggcuauauguaagaagcu

SEQ ID NO: 478155 - RNA, 14 nt, Chlamydia trachomatis
cuccacaagaagua

SEQ ID NO: 478156 - RNA, 18 nt, Chlamydia trachomatis
cuccccuuccuguucuuc

SEQ ID NO: 478157 - RNA, 16 nt, Chlamydia trachomatis
cuccgauaauuuuccu

SEQ ID NO: 478158 - RNA, 16 nt, Chlamydia trachomatis
cucccuccucuuuuuc

SEQ ID NO: 478159 - RNA, 21 nt, Chlamydia trachomatis
cuccucaagcgauuaugaaaa

SEQ ID NO: 478160 - RNA, 23 nt, Chlamydia trachomatis
cuccucaagcgauuaugaaaaag

SEQ ID NO: 478161 - RNA, 20 nt, Chlamydia trachomatis
cuccucagcauagcgcuucc

SEQ ID NO: 478162 - RNA, 18 nt, Chlamydia trachomatis
cuccgcuaggcaaauauc

SEQ ID NO: 478163 - RNA, 15 nt, Chlamydia trachomatis
cuccucccuuuccau

SEQ ID NO: 478164 - RNA, 15 nt, Chlamydia trachomatis
cuccuccuaaacaaa

SEQ ID NO: 478165 - RNA, 16 nt, Chlamydia trachomatis
cuccucuccuaacccu

SEQ ID NO: 478166 - RNA, 12 nt, Chlamydia trachomatis
cuccucucucuu

SEQ ID NO: 478167 - RNA, 12 nt, Chlamydia trachomatis
cuccucucuuug

SEQ ID NO: 478168 - RNA, 22 nt, Chlamydia trachomatis
cuccugaaaguuuuuuccccug

SEQ ID NO: 478169 - RNA, 13 nt, Chlamydia trachomatis
cuccuggaaggug

SEQ ID NO: 478170 - RNA, 20 nt, Chlamydia trachomatis
cuccuucuacaaaaaaugau

SEQ ID NO: 478171 - RNA, 22 nt, Chlamydia trachomatis
cuccuguacaccaccgcaugaa

SEQ ID NO: 478172 - RNA, 23 nt, Chlamydia trachomatis
cuccuuaguuaaaacuccagaaa

SEQ ID NO: 478173 - RNA, 12 nt, Chlamydia trachomatis
cuccuuccucuu

SEQ ID NO: 478174 - RNA, 16 nt, Chlamydia trachomatis
cucgaagcuacugaug

SEQ ID NO: 478175 - RNA, 18 nt, Chlamydia trachomatis
cucgaaggagcuaagaac

SEQ ID NO: 478176 - RNA, 16 nt, Chlamydia trachomatis
cucgaacucagcuucc

SEQ ID NO: 478177 - RNA, 21 nt, Chlamydia trachomatis
cucgcaaguucuccuucuugu

SEQ ID NO: 478178 - RNA, 15 nt, Chlamydia trachomatis
cucgaggacagucuc

SEQ ID NO: 478179 - RNA, 16 nt, Chlamydia trachomatis
cucgagcuaagaaaau

SEQ ID NO: 478180 - RNA, 18 nt, Chlamydia trachomatis
cucgcacacgauuaucua

SEQ ID NO: 478181 - RNA, 14 nt, Chlamydia trachomatis
cucgcagagaaaga

SEQ ID NO: 478182 - RNA, 19 nt, Chlamydia trachomatis
cucgcagagaaagagccaa

SEQ ID NO: 478183 - RNA, 20 nt, Chlamydia trachomatis
cucggccuuuucuagagaag

SEQ ID NO: 478184 - RNA, 22 nt, Chlamydia trachomatis
cucguugauuaaaguuucuaau

SEQ ID NO: 478185 - RNA, 17 nt, Chlamydia trachomatis
cucuaacucuucuggag

SEQ ID NO: 478186 - RNA, 15 nt, Chlamydia trachomatis
cucuaacucuucuuu

SEQ ID NO: 478187 - RNA, 18 nt, Chlamydia trachomatis
cucuaauaaaucugcuaa

SEQ ID NO: 478188 - RNA, 23 nt, Chlamydia trachomatis
cucuaauaggguuaggaaagcac

SEQ ID NO: 478189 - RNA, 21 nt, Chlamydia trachomatis
cucuaauaaacagaucuuuuu

SEQ ID NO: 478190 - RNA, 19 nt, Chlamydia trachomatis
cucuaauuaauaacgcccu

SEQ ID NO: 478191 - RNA, 21 nt, Chlamydia trachomatis
cucuagcaaccaauucucugc

SEQ ID NO: 478192 - RNA, 15 nt, Chlamydia trachomatis
cucucagcagcuucc

SEQ ID NO: 478193 - RNA, 15 nt, Chlamydia trachomatis
cucuagguagucucu

SEQ ID NO: 478194 - RNA, 19 nt, Chlamydia trachomatis
cucucaucaguaaacacuu

SEQ ID NO: 478195 - RNA, 14 nt, Chlamydia trachomatis
cucucaucuaaacg

SEQ ID NO: 478196 - RNA, 22 nt, Chlamydia trachomatis
cucuccauccugcguguacauu

SEQ ID NO: 478197 - RNA, 15 nt, Chlamydia trachomatis
cucuccauuuuccug

SEQ ID NO: 478198 - RNA, 18 nt, Chlamydia trachomatis
cucuccauuuuccuguuc

SEQ ID NO: 478199 - RNA, 13 nt, Chlamydia trachomatis
cucuccuaacccu

SEQ ID NO: 478200 - RNA, 17 nt, Chlamydia trachomatis
cucuccuucuacaaaaa

SEQ ID NO: 478201 - RNA, 15 nt, Chlamydia trachomatis
cucuccuugaacaau

SEQ ID NO: 478202 - RNA, 15 nt, Chlamydia trachomatis
cucucgaauagcucc

SEQ ID NO: 478203 - RNA, 14 nt, Chlamydia trachomatis
cucucgaucucauc

SEQ ID NO: 478204 - RNA, 18 nt, Chlamydia trachomatis
cucucgaucucaucaaaa

SEQ ID NO: 478205 - RNA, 20 nt, Chlamydia trachomatis
cucucuaaaaacucuuuuuc

SEQ ID NO: 478206 - RNA, 12 nt, Chlamydia trachomatis
cucucucagcag

SEQ ID NO: 478207 - RNA, 13 nt, Chlamydia trachomatis
cucucucagcagc

SEQ ID NO: 478208 - RNA, 17 nt, Chlamydia trachomatis
cucugaauccauucuac

SEQ ID NO: 478209 - RNA, 18 nt, Chlamydia trachomatis
cucugaguuaaaggaagg

SEQ ID NO: 478210 - RNA, 22 nt, Chlamydia trachomatis
cucugcaacaaagaguuuaggc

SEQ ID NO: 478211 - RNA, 20 nt, Chlamydia trachomatis
cucugcaaggagcuucuuua

SEQ ID NO: 478212 - RNA, 20 nt, Chlamydia trachomatis
cucugcacaauauuaucuac

SEQ ID NO: 478213 - RNA, 23 nt, Chlamydia trachomatis
cucugcacaauauuaucuacagu

SEQ ID NO: 478214 - RNA, 16 nt, Chlamydia trachomatis
cucugcacggugcaga

SEQ ID NO: 478215 - RNA, 17 nt, Chlamydia trachomatis
cucugcagaagaagccc

SEQ ID NO: 478216 - RNA, 21 nt, Chlamydia trachomatis
cucugccugggguuuuguugc

SEQ ID NO: 478217 - RNA, 21 nt, Chlamydia trachomatis
cucuggucgugaucacuguga

SEQ ID NO: 478218 - RNA, 20 nt, Chlamydia trachomatis
cucuggaacagguuucuuac

SEQ ID NO: 478219 - RNA, 18 nt, Chlamydia trachomatis
cucuucgagucuucccuu

SEQ ID NO: 478220 - RNA, 22 nt, Chlamydia trachomatis
cucuucacaaauauacucuuug

SEQ ID NO: 478221 - RNA, 14 nt, Chlamydia trachomatis
cucuucacaaauuu

SEQ ID NO: 478222 - RNA, 22 nt, Chlamydia trachomatis
cucuucacagagcuucucuaaa

SEQ ID NO: 478223 - RNA, 14 nt, Chlamydia trachomatis
cucuucagacacaa

SEQ ID NO: 478224 - RNA, 14 nt, Chlamydia trachomatis
cucuuccaacaauu

SEQ ID NO: 478225 - RNA, 21 nt, Chlamydia trachomatis
cucuuccacgaugagauacag

SEQ ID NO: 478226 - RNA, 13 nt, Chlamydia trachomatis
cucugucaauaaa

SEQ ID NO: 478227 - RNA, 24 nt, Chlamydia trachomatis
cucugugcacaaucucuuuaagcu

SEQ ID NO: 478228 - RNA, 24 nt, Chlamydia trachomatis
cucuuaaaaggccguuuaccaaug

SEQ ID NO: 478229 - RNA, 20 nt, Chlamydia trachomatis
cucuuguaucauauucuuug

SEQ ID NO: 478230 - RNA, 18 nt, Chlamydia trachomatis
cucuuggagagaaugaag

SEQ ID NO: 478231 - RNA, 15 nt, Chlamydia trachomatis
cucuuggcuuuuuau

SEQ ID NO: 478232 - RNA, 20 nt, Chlamydia trachomatis
cucuuguucugggcugacag

SEQ ID NO: 478233 - RNA, 15 nt, Chlamydia trachomatis
cucuuguuucaaaga

SEQ ID NO: 478234 - RNA, 19 nt, Chlamydia trachomatis
cucuuuacgcacaaagauu

SEQ ID NO: 478235 - RNA, 19 nt, Chlamydia trachomatis
cucuuuagccaauuuccau

SEQ ID NO: 478236 - RNA, 18 nt, Chlamydia trachomatis
cucuuuaucuaaagaaau

SEQ ID NO: 478237 - RNA, 21 nt, Chlamydia trachomatis
cucuugaaccaguuucuuggc

SEQ ID NO: 478238 - RNA, 20 nt, Chlamydia trachomatis
cucuugccugcaaauaauaa

SEQ ID NO: 478239 - RNA, 21 nt, Chlamydia trachomatis
cucuugccugcaaauaauaaa

SEQ ID NO: 478240 - RNA, 15 nt, Chlamydia trachomatis
cucuucuaacuuuuc

SEQ ID NO: 478241 - RNA, 22 nt, Chlamydia trachomatis
cucuucuagagcgugcauggca

SEQ ID NO: 478242 - RNA, 21 nt, Chlamydia trachomatis
cucuucguaguaacuuaugaa

SEQ ID NO: 478243 - RNA, 15 nt, Chlamydia trachomatis
cugaaaaaucaagga

SEQ ID NO: 478244 - RNA, 13 nt, Chlamydia trachomatis
cugaaaagagaag

SEQ ID NO: 478245 - RNA, 22 nt, Chlamydia trachomatis
cucuuuuuuaugggugaagaag

SEQ ID NO: 478246 - RNA, 22 nt, Chlamydia trachomatis
cucuuuccuccucccuuuccau

SEQ ID NO: 478247 - RNA, 17 nt, Chlamydia trachomatis
cucuuuccgacugcagu

SEQ ID NO: 478248 - RNA, 17 nt, Chlamydia trachomatis
cucuuugaacuucaaga

SEQ ID NO: 478249 - RNA, 18 nt, Chlamydia trachomatis
cucuuugcuccacaagaa

SEQ ID NO: 478250 - RNA, 20 nt, Chlamydia trachomatis
cucuuuuaccgagagaugaa

SEQ ID NO: 478251 - RNA, 15 nt, Chlamydia trachomatis
cucuuuucaaaauga

SEQ ID NO: 478252 - RNA, 23 nt, Chlamydia trachomatis
cucuuuuucaccagcaaaagaaa

SEQ ID NO: 478253 - RNA, 19 nt, Chlamydia trachomatis
cugaaaguuuuuuccccug

SEQ ID NO: 478254 - RNA, 17 nt, Chlamydia trachomatis
cugaaagagcuucuuuu

SEQ ID NO: 478255 - RNA, 19 nt, Chlamydia trachomatis
cugaaagagcuucuuuuuc

SEQ ID NO: 478256 - RNA, 17 nt, Chlamydia trachomatis
cugaaagacuuuccaag

SEQ ID NO: 478257 - RNA, 21 nt, Chlamydia trachomatis
cugaaacacgcucauagauuu

SEQ ID NO: 478258 - RNA, 16 nt, Chlamydia trachomatis
cugaacccuucaauaa

SEQ ID NO: 478259 - RNA, 14 nt, Chlamydia trachomatis
cugaacauacaauu

SEQ ID NO: 478260 - RNA, 16 nt, Chlamydia trachomatis
cugaacauccaccagc

SEQ ID NO: 478261 - RNA, 15 nt, Chlamydia trachomatis
cugaagaaaaaucua

SEQ ID NO: 478262 - RNA, 22 nt, Chlamydia trachomatis
cugaagcaaugcuaucagcgaa

SEQ ID NO: 478263 - RNA, 20 nt, Chlamydia trachomatis
cugaaggugugaaagaaaaa

SEQ ID NO: 478264 - RNA, 21 nt, Chlamydia trachomatis
cugaaggugugaaagaaaaau

SEQ ID NO: 478265 - RNA, 23 nt, Chlamydia trachomatis
cugaaggugugaaagaaaaauaa

SEQ ID NO: 478266 - RNA, 20 nt, Chlamydia trachomatis
cugaagucuuuaauaccuuc

SEQ ID NO: 478267 - RNA, 19 nt, Chlamydia trachomatis
cugaauacucaaaaauucc

SEQ ID NO: 478268 - RNA, 18 nt, Chlamydia trachomatis
cugaauaguuguagaagg

SEQ ID NO: 478269 - RNA, 14 nt, Chlamydia trachomatis
cugaaucuguguug

SEQ ID NO: 478270 - RNA, 23 nt, Chlamydia trachomatis
cugaaucuguguugcaaagagag

SEQ ID NO: 478271 - RNA, 16 nt, Chlamydia trachomatis
cugaauggucaauaau

SEQ ID NO: 478272 - RNA, 16 nt, Chlamydia trachomatis
cugacagaaguuagaa

SEQ ID NO: 478273 - RNA, 13 nt, Chlamydia trachomatis
cugacucaaugug

SEQ ID NO: 478274 - RNA, 23 nt, Chlamydia trachomatis
cugagaaucggauccuucgauau

SEQ ID NO: 478275 - RNA, 15 nt, Chlamydia trachomatis
cugagacaucuccug

SEQ ID NO: 478276 - RNA, 11 nt, Chlamydia trachomatis
cugacuauucc

SEQ ID NO: 478277 - RNA, 13 nt, Chlamydia trachomatis
cugacuuucacau

SEQ ID NO: 478278 - RNA, 22 nt, Chlamydia trachomatis
cugagaucgagcuucugcauug

SEQ ID NO: 478279 - RNA, 21 nt, Chlamydia trachomatis
cugagcagugacuaagaucca

SEQ ID NO: 478280 - RNA, 19 nt, Chlamydia trachomatis
cugagccaagaacaaagca

SEQ ID NO: 478281 - RNA, 20 nt, Chlamydia trachomatis
cugagccaucgccuucuaua

SEQ ID NO: 478282 - RNA, 17 nt, Chlamydia trachomatis
cugagcccaaggagaau

SEQ ID NO: 478283 - RNA, 12 nt, Chlamydia trachomatis
cugaugcaccau

SEQ ID NO: 478284 - RNA, 15 nt, Chlamydia trachomatis
cugaugcaccauaau

SEQ ID NO: 478285 - RNA, 16 nt, Chlamydia trachomatis
cugaugcaccauaaua

SEQ ID NO: 478286 - RNA, 22 nt, Chlamydia trachomatis
cugaugcuuggaaauaagcuug

SEQ ID NO: 478287 - RNA, 20 nt, Chlamydia trachomatis
cugauuccgagggaaucauu

SEQ ID NO: 478288 - RNA, 15 nt, Chlamydia trachomatis
cugauuccugcugau

SEQ ID NO: 478289 - RNA, 15 nt, Chlamydia trachomatis
cugauguaauuugga

SEQ ID NO: 478290 - RNA, 17 nt, Chlamydia trachomatis
cugcaacaaauaccaaa

SEQ ID NO: 478291 - RNA, 22 nt, Chlamydia trachomatis
cugcaacaaauaccaaaauauc

SEQ ID NO: 478292 - RNA, 13 nt, Chlamydia trachomatis
cugcaacaguaaa

SEQ ID NO: 478293 - RNA, 16 nt, Chlamydia trachomatis
cugcaccggcaaagaa

SEQ ID NO: 478294 - RNA, 19 nt, Chlamydia trachomatis
cugcaccgugcagaggggg

SEQ ID NO: 478295 - RNA, 19 nt, Chlamydia trachomatis
cugcagcaucuauuuucuc

SEQ ID NO: 478296 - RNA, 18 nt, Chlamydia trachomatis
cugcauagcuauaaaaua

SEQ ID NO: 478297 - RNA, 11 nt, Chlamydia trachomatis
cugcauagcug

SEQ ID NO: 478298 - RNA, 14 nt, Chlamydia trachomatis
cugcauauuuaauu

SEQ ID NO: 478299 - RNA, 22 nt, Chlamydia trachomatis
cugcagcuaaagaaucuccugu

SEQ ID NO: 478300 - RNA, 19 nt, Chlamydia trachomatis
cugcagccuacauacaugc

SEQ ID NO: 478301 - RNA, 16 nt, Chlamydia trachomatis
cugcauuuauccacag

SEQ ID NO: 478302 - RNA, 21 nt, Chlamydia trachomatis
cugcauuuauccacaggucau

SEQ ID NO: 478303 - RNA, 22 nt, Chlamydia trachomatis
cugcaucuuaggaucuaacgca

SEQ ID NO: 478304 - RNA, 18 nt, Chlamydia trachomatis
cugcaucuuuauagaauu

SEQ ID NO: 478305 - RNA, 13 nt, Chlamydia trachomatis
cugcauuaaacac

SEQ ID NO: 478306 - RNA, 16 nt, Chlamydia trachomatis
cugcgaaaaagaaaua

SEQ ID NO: 478307 - RNA, 17 nt, Chlamydia trachomatis
cugcggauuacaaaaga

SEQ ID NO: 478308 - RNA, 19 nt, Chlamydia trachomatis
cugcggauucagaagggga

SEQ ID NO: 478309 - RNA, 15 nt, Chlamydia trachomatis
cugcggcuccuucuu

SEQ ID NO: 478310 - RNA, 17 nt, Chlamydia trachomatis
cugcggcuccuucuuga

SEQ ID NO: 478311 - RNA, 18 nt, Chlamydia trachomatis
cugcguauuugaaaucaa

SEQ ID NO: 478312 - RNA, 17 nt, Chlamydia trachomatis
cugcugauaaauuucuu

SEQ ID NO: 478313 - RNA, 15 nt, Chlamydia trachomatis
cugcugauaaccaga

SEQ ID NO: 478314 - RNA, 17 nt, Chlamydia trachomatis
cugcugccaaagcuucg

SEQ ID NO: 478315 - RNA, 17 nt, Chlamydia trachomatis
cugcuguugcgauuuga

SEQ ID NO: 478316 - RNA, 15 nt, Chlamydia trachomatis
cugcuuaucuccgcu

SEQ ID NO: 478317 - RNA, 22 nt, Chlamydia trachomatis
cugcuucaaaaaagauuucccc

SEQ ID NO: 478318 - RNA, 13 nt, Chlamydia trachomatis
cugcuucacagcu

SEQ ID NO: 478319 - RNA, 17 nt, Chlamydia trachomatis
cugggcagcaagagaga

SEQ ID NO: 478320 - RNA, 17 nt, Chlamydia trachomatis
cugggcacaacgcccag

SEQ ID NO: 478321 - RNA, 14 nt, Chlamydia trachomatis
cugggauggaaaua

SEQ ID NO: 478322 - RNA, 19 nt, Chlamydia trachomatis
cugggauuucgauuaauga

SEQ ID NO: 478323 - RNA, 23 nt, Chlamydia trachomatis
cugggguagcugaugaagcgaca

SEQ ID NO: 478324 - RNA, 13 nt, Chlamydia trachomatis
cugggcugacaga

SEQ ID NO: 478325 - RNA, 20 nt, Chlamydia trachomatis
cugggcauacaccugcaaga

SEQ ID NO: 478326 - RNA, 14 nt, Chlamydia trachomatis
cugguugguuuucu

SEQ ID NO: 478327 - RNA, 21 nt, Chlamydia trachomatis
cugguugguuuucuuguucuu

SEQ ID NO: 478328 - RNA, 19 nt, Chlamydia trachomatis
cugguuucuuaaacaaaaa

SEQ ID NO: 478329 - RNA, 21 nt, Chlamydia trachomatis
cugguuguucccgauuacuug

SEQ ID NO: 478330 - RNA, 22 nt, Chlamydia trachomatis
cugguaaaggaaguugagaagc

SEQ ID NO: 478331 - RNA, 16 nt, Chlamydia trachomatis
cugguaaaaauagaaa

SEQ ID NO: 478332 - RNA, 17 nt, Chlamydia trachomatis
cuggguuuuaucaagag

SEQ ID NO: 478333 - RNA, 16 nt, Chlamydia trachomatis
cuguagaaaaucauag

SEQ ID NO: 478334 - RNA, 15 nt, Chlamydia trachomatis
cuguagagagcccca

SEQ ID NO: 478335 - RNA, 17 nt, Chlamydia trachomatis
cuguagagccaugauca

SEQ ID NO: 478336 - RNA, 19 nt, Chlamydia trachomatis
cuguagaugcuuuguaaaa

SEQ ID NO: 478337 - RNA, 15 nt, Chlamydia trachomatis
cuguagauucagcaa

SEQ ID NO: 478338 - RNA, 21 nt, Chlamydia trachomatis
cuguagauucagcaagauucu

SEQ ID NO: 478339 - RNA, 23 nt, Chlamydia trachomatis
cuguagcaccaaguucuucuuua

SEQ ID NO: 478340 - RNA, 19 nt, Chlamydia trachomatis
cuguaacgauagcuaaucu

SEQ ID NO: 478341 - RNA, 18 nt, Chlamydia trachomatis
cuguaacuaaacuccauu

SEQ ID NO: 478342 - RNA, 18 nt, Chlamydia trachomatis
cuguaacuacaucuaaaa

SEQ ID NO: 478343 - RNA, 19 nt, Chlamydia trachomatis
cuguaagaggaucuccaga

SEQ ID NO: 478344 - RNA, 13 nt, Chlamydia trachomatis
cuguaaguuuauu

SEQ ID NO: 478345 - RNA, 19 nt, Chlamydia trachomatis
cuguaauagcauuaauaua

SEQ ID NO: 478346 - RNA, 19 nt, Chlamydia trachomatis
cuguacgucugcaagaaaa

SEQ ID NO: 478347 - RNA, 13 nt, Chlamydia trachomatis
cuguauagauuag

SEQ ID NO: 478348 - RNA, 18 nt, Chlamydia trachomatis
cuguaggagagaaucuuu

SEQ ID NO: 478349 - RNA, 20 nt, Chlamydia trachomatis
cuguaggagagaaucuuuua

SEQ ID NO: 478350 - RNA, 20 nt, Chlamydia trachomatis
cugucgaacgcuucuuccca

SEQ ID NO: 478351 - RNA, 11 nt, Chlamydia trachomatis
cugucuucuuu

SEQ ID NO: 478352 - RNA, 14 nt, Chlamydia trachomatis
cugucuucuuucaa

SEQ ID NO: 478353 - RNA, 21 nt, Chlamydia trachomatis
cugucuucuuucaaagaagcu

SEQ ID NO: 478354 - RNA, 17 nt, Chlamydia trachomatis
cugugaagaaacuucug

SEQ ID NO: 478355 - RNA, 17 nt, Chlamydia trachomatis
cugugcccaagaagcga

SEQ ID NO: 478356 - RNA, 15 nt, Chlamydia trachomatis
cugugcaaucagcuc

SEQ ID NO: 478357 - RNA, 18 nt, Chlamydia trachomatis
cugugcaaucagcucucg

SEQ ID NO: 478358 - RNA, 22 nt, Chlamydia trachomatis
cuguuauuuguucucuuagaag

SEQ ID NO: 478359 - RNA, 15 nt, Chlamydia trachomatis
cuguucaagagaggc

SEQ ID NO: 478360 - RNA, 18 nt, Chlamydia trachomatis
cuguucagguuugcaugu

SEQ ID NO: 478361 - RNA, 17 nt, Chlamydia trachomatis
cuguuaccugggaaaac

SEQ ID NO: 478362 - RNA, 17 nt, Chlamydia trachomatis
cuguuagugaagagcag

SEQ ID NO: 478363 - RNA, 18 nt, Chlamydia trachomatis
cuguuagugaagagcaga

SEQ ID NO: 478364 - RNA, 15 nt, Chlamydia trachomatis
cuguuaacugacaau

SEQ ID NO: 478365 - RNA, 23 nt, Chlamydia trachomatis
cuguuaacugacaauccaguacu

SEQ ID NO: 478366 - RNA, 17 nt, Chlamydia trachomatis
cugugcuugcauagaua

SEQ ID NO: 478367 - RNA, 18 nt, Chlamydia trachomatis
cuuaacacccucuuccuu

SEQ ID NO: 478368 - RNA, 20 nt, Chlamydia trachomatis
cuuaacaugauucaaaauaa

SEQ ID NO: 478369 - RNA, 15 nt, Chlamydia trachomatis
cuguucccauuuuua

SEQ ID NO: 478370 - RNA, 18 nt, Chlamydia trachomatis
cuguuccuaauacuaaac

SEQ ID NO: 478371 - RNA, 19 nt, Chlamydia trachomatis
cuguuccuaauagaucuac

SEQ ID NO: 478372 - RNA, 15 nt, Chlamydia trachomatis
cuuaaauauucauau

SEQ ID NO: 478373 - RNA, 22 nt, Chlamydia trachomatis
cuuaacugcagcaucuauuuuc

SEQ ID NO: 478374 - RNA, 14 nt, Chlamydia trachomatis
cuuaagcuguucuu

SEQ ID NO: 478375 - RNA, 22 nt, Chlamydia trachomatis
cuuaauaaagccauacuuacuu

SEQ ID NO: 478376 - RNA, 16 nt, Chlamydia trachomatis
cuuaaugcuugaacaa

SEQ ID NO: 478377 - RNA, 16 nt, Chlamydia trachomatis
cuuacuuaaaaaacaa

SEQ ID NO: 478378 - RNA, 23 nt, Chlamydia trachomatis
cuuagaaacuguccuuuauucaa

SEQ ID NO: 478379 - RNA, 14 nt, Chlamydia trachomatis
cuuagaauuuuguc

SEQ ID NO: 478380 - RNA, 17 nt, Chlamydia trachomatis
cuuagagacauuuaguu

SEQ ID NO: 478381 - RNA, 21 nt, Chlamydia trachomatis
cuuagccuuguuucucaacga

SEQ ID NO: 478382 - RNA, 13 nt, Chlamydia trachomatis
cuuagcuauauau

SEQ ID NO: 478383 - RNA, 19 nt, Chlamydia trachomatis
cuuagcucccugcucuuga

SEQ ID NO: 478384 - RNA, 16 nt, Chlamydia trachomatis
cuuaggaauauguugg

SEQ ID NO: 478385 - RNA, 22 nt, Chlamydia trachomatis
cuuaggaccuaauaucugcucu

SEQ ID NO: 478386 - RNA, 13 nt, Chlamydia trachomatis
cuuaguuaaaacu

SEQ ID NO: 478387 - RNA, 17 nt, Chlamydia trachomatis
cuuaguuaaaacuccag

SEQ ID NO: 478388 - RNA, 16 nt, Chlamydia trachomatis
cuuauucucgccccca

SEQ ID NO: 478389 - RNA, 15 nt, Chlamydia trachomatis
cuuaucuucuugaga

SEQ ID NO: 478390 - RNA, 16 nt, Chlamydia trachomatis
cuuaucuucuugagaa

SEQ ID NO: 478391 - RNA, 14 nt, Chlamydia trachomatis
cuuauaacuaagau

SEQ ID NO: 478392 - RNA, 22 nt, Chlamydia trachomatis
cuuauaacuaagaucuccauga

SEQ ID NO: 478393 - RNA, 14 nt, Chlamydia trachomatis
cuuauuuaccuuga

SEQ ID NO: 478394 - RNA, 16 nt, Chlamydia trachomatis
cuuauuuacgaugauc

SEQ ID NO: 478395 - RNA, 20 nt, Chlamydia trachomatis
cuuauuugcccagucaagag

SEQ ID NO: 478396 - RNA, 14 nt, Chlamydia trachomatis
cuucaaaaaagauu

SEQ ID NO: 478397 - RNA, 17 nt, Chlamydia trachomatis
cuucaaaaaagauuucc

SEQ ID NO: 478398 - RNA, 19 nt, Chlamydia trachomatis
cuucaaaaaagauuucccc

SEQ ID NO: 478399 - RNA, 12 nt, Chlamydia trachomatis
cuucaaaacuaa

SEQ ID NO: 478400 - RNA, 14 nt, Chlamydia trachomatis
cuucaaagaacaua

SEQ ID NO: 478401 - RNA, 18 nt, Chlamydia trachomatis
cuucaaauucuacuccug

SEQ ID NO: 478402 - RNA, 15 nt, Chlamydia trachomatis
cuucaaguucuucuu

SEQ ID NO: 478403 - RNA, 21 nt, Chlamydia trachomatis
cuucaaguucuucuuccacag

SEQ ID NO: 478404 - RNA, 21 nt, Chlamydia trachomatis
cuucaacuggccuuuuucguu

SEQ ID NO: 478405 - RNA, 22 nt, Chlamydia trachomatis
cuucaacuggccuuuuucguua

SEQ ID NO: 478406 - RNA, 14 nt, Chlamydia trachomatis
cuucaacuucucca

SEQ ID NO: 478407 - RNA, 17 nt, Chlamydia trachomatis
cuucacccauaaaaaag

SEQ ID NO: 478408 - RNA, 21 nt, Chlamydia trachomatis
cuucaauagcaggaacuucuu

SEQ ID NO: 478409 - RNA, 23 nt, Chlamydia trachomatis
cuucaauagcaggaacuucuuca

SEQ ID NO: 478410 - RNA, 20 nt, Chlamydia trachomatis
cuucaaucacuccuccuccu

SEQ ID NO: 478411 - RNA, 20 nt, Chlamydia trachomatis
cuucaauucuugcuucaugu

SEQ ID NO: 478412 - RNA, 15 nt, Chlamydia trachomatis
cuuccaaaucugcaa

SEQ ID NO: 478413 - RNA, 16 nt, Chlamydia trachomatis
cuuccaaauuucccuc

SEQ ID NO: 478414 - RNA, 22 nt, Chlamydia trachomatis
cuuccaaauuucccucuucccg

SEQ ID NO: 478415 - RNA, 13 nt, Chlamydia trachomatis
cuucacugccuuu

SEQ ID NO: 478416 - RNA, 15 nt, Chlamydia trachomatis
cuucacuuccucucu

SEQ ID NO: 478417 - RNA, 17 nt, Chlamydia trachomatis
cuuccagacaaaaagaa

SEQ ID NO: 478418 - RNA, 21 nt, Chlamydia trachomatis
cuuccaccuugcuuaacacuu

SEQ ID NO: 478419 - RNA, 19 nt, Chlamydia trachomatis
cuuccagccuacaaauaaa

SEQ ID NO: 478420 - RNA, 20 nt, Chlamydia trachomatis
cuuccagccuacaaauaaag

SEQ ID NO: 478421 - RNA, 13 nt, Chlamydia trachomatis
cuuccccaaagca

SEQ ID NO: 478422 - RNA, 16 nt, Chlamydia trachomatis
cuuccccauucuucuc

SEQ ID NO: 478423 - RNA, 18 nt, Chlamydia trachomatis
cuucccuccuagaaagaa

SEQ ID NO: 478424 - RNA, 21 nt, Chlamydia trachomatis
cuucccuccuagaaagaacca

SEQ ID NO: 478425 - RNA, 22 nt, Chlamydia trachomatis
cuucccuaagaaccgcaagcaa

SEQ ID NO: 478426 - RNA, 16 nt, Chlamydia trachomatis
cuuccguaacaauauu

SEQ ID NO: 478427 - RNA, 11 nt, Chlamydia trachomatis
cuuccugcuuc

SEQ ID NO: 478428 - RNA, 12 nt, Chlamydia trachomatis
cuuccugcuuca

SEQ ID NO: 478429 - RNA, 12 nt, Chlamydia trachomatis
cuuccuucauac

SEQ ID NO: 478430 - RNA, 13 nt, Chlamydia trachomatis
cuuccuucccuuc

SEQ ID NO: 478431 - RNA, 12 nt, Chlamydia trachomatis
cuuccuugacuc

SEQ ID NO: 478432 - RNA, 18 nt, Chlamydia trachomatis
cuuccuugacucuaaaga

SEQ ID NO: 478433 - RNA, 13 nt, Chlamydia trachomatis
cuucgaaauauug

SEQ ID NO: 478434 - RNA, 16 nt, Chlamydia trachomatis
cuucgaggcuccccag

SEQ ID NO: 478435 - RNA, 21 nt, Chlamydia trachomatis
cuucggacauugaacauuuuc

SEQ ID NO: 478436 - RNA, 18 nt, Chlamydia trachomatis
cuucuaaguauucuucug

SEQ ID NO: 478437 - RNA, 20 nt, Chlamydia trachomatis
cuucuaaaugcuguaaaaca

SEQ ID NO: 478438 - RNA, 14 nt, Chlamydia trachomatis
cuucuaacuuuuca

SEQ ID NO: 478439 - RNA, 13 nt, Chlamydia trachomatis
cuucuaagaacaa

SEQ ID NO: 478440 - RNA, 15 nt, Chlamydia trachomatis
cuucuaagcuagaaa

SEQ ID NO: 478441 - RNA, 18 nt, Chlamydia trachomatis
cuucuagaagaccaaaaa

SEQ ID NO: 478442 - RNA, 19 nt, Chlamydia trachomatis
cuucuagaagaccaaaaau

SEQ ID NO: 478443 - RNA, 22 nt, Chlamydia trachomatis
cuucuagaagaccaaaaaugaa

SEQ ID NO: 478444 - RNA, 13 nt, Chlamydia trachomatis
cuucuagaggagu

SEQ ID NO: 478445 - RNA, 15 nt, Chlamydia trachomatis
cuucuauagaaacac

SEQ ID NO: 478446 - RNA, 22 nt, Chlamydia trachomatis
cuucuauccggaguaccaaaaa

SEQ ID NO: 478447 - RNA, 12 nt, Chlamydia trachomatis
cuucuauuucca

SEQ ID NO: 478448 - RNA, 16 nt, Chlamydia trachomatis
cuucuauuucucuucc

SEQ ID NO: 478449 - RNA, 17 nt, Chlamydia trachomatis
cuucuuuggaaaaaaaa

SEQ ID NO: 478450 - RNA, 20 nt, Chlamydia trachomatis
cuugaagauauucaugugaa

SEQ ID NO: 478451 - RNA, 21 nt, Chlamydia trachomatis
cuugaacguaggccacaagau

SEQ ID NO: 478452 - RNA, 20 nt, Chlamydia trachomatis
cuucuuuuucucuggaacag

SEQ ID NO: 478453 - RNA, 14 nt, Chlamydia trachomatis
cuucucauaaggag

SEQ ID NO: 478454 - RNA, 17 nt, Chlamydia trachomatis
cuucucaacacugaaaa

SEQ ID NO: 478455 - RNA, 22 nt, Chlamydia trachomatis
cuucuuucuggaaucauucauc

SEQ ID NO: 478456 - RNA, 13 nt, Chlamydia trachomatis
cuugaaucaaaaa

SEQ ID NO: 478457 - RNA, 16 nt, Chlamydia trachomatis
cuugaaucaaaaaguu

SEQ ID NO: 478458 - RNA, 20 nt, Chlamydia trachomatis
cuugaaucaaaaaguucaua

SEQ ID NO: 478459 - RNA, 23 nt, Chlamydia trachomatis
cuugagagccuaugcgugucaca

SEQ ID NO: 478460 - RNA, 13 nt, Chlamydia trachomatis
cuugagauacaac

SEQ ID NO: 478461 - RNA, 19 nt, Chlamydia trachomatis
cuugagaacaaaccaucug

SEQ ID NO: 478462 - RNA, 18 nt, Chlamydia trachomatis
cuugaucuguggagugcc

SEQ ID NO: 478463 - RNA, 15 nt, Chlamydia trachomatis
cuugaucugaaaaga

SEQ ID NO: 478464 - RNA, 21 nt, Chlamydia trachomatis
cuugaucugaaaagagaagaa

SEQ ID NO: 478465 - RNA, 13 nt, Chlamydia trachomatis
cuugauuucuuuc

SEQ ID NO: 478466 - RNA, 21 nt, Chlamydia trachomatis
cuugcaaaaaucucuuuagca

SEQ ID NO: 478467 - RNA, 14 nt, Chlamydia trachomatis
cuugcaacucuuau

SEQ ID NO: 478468 - RNA, 14 nt, Chlamydia trachomatis
cuugcauggaauca

SEQ ID NO: 478469 - RNA, 15 nt, Chlamydia trachomatis
cuugcauggaaucau

SEQ ID NO: 478470 - RNA, 21 nt, Chlamydia trachomatis
cuugcauuugggagauacaga

SEQ ID NO: 478471 - RNA, 17 nt, Chlamydia trachomatis
cuugccaucauuaucuu

SEQ ID NO: 478472 - RNA, 16 nt, Chlamydia trachomatis
cuugcccgacaguaua

SEQ ID NO: 478473 - RNA, 13 nt, Chlamydia trachomatis
cuugcgaugccuc

SEQ ID NO: 478474 - RNA, 22 nt, Chlamydia trachomatis
cuugcgaugccucuaacacuuu

SEQ ID NO: 478475 - RNA, 15 nt, Chlamydia trachomatis
cuuggaucgcuucga

SEQ ID NO: 478476 - RNA, 17 nt, Chlamydia trachomatis
cuugcugguccauggaa

SEQ ID NO: 478477 - RNA, 21 nt, Chlamydia trachomatis
cuugcugguccauggaacgau

SEQ ID NO: 478478 - RNA, 13 nt, Chlamydia trachomatis
cuugcuuaacacu

SEQ ID NO: 478479 - RNA, 20 nt, Chlamydia trachomatis
cuuggccuuuuagcccuccu

SEQ ID NO: 478480 - RNA, 18 nt, Chlamydia trachomatis
cuuggcggauaucuucuu

SEQ ID NO: 478481 - RNA, 19 nt, Chlamydia trachomatis
cuuggcggauaucuucuug

SEQ ID NO: 478482 - RNA, 20 nt, Chlamydia trachomatis
cuuggcggauaucuucuuga

SEQ ID NO: 478483 - RNA, 17 nt, Chlamydia trachomatis
cuuggcgguuuuuuucg

SEQ ID NO: 478484 - RNA, 22 nt, Chlamydia trachomatis
cuugguaaaguaguugaauaua

SEQ ID NO: 478485 - RNA, 16 nt, Chlamydia trachomatis
cuuggguaagaccaaa

SEQ ID NO: 478486 - RNA, 18 nt, Chlamydia trachomatis
cuuguagagaggcaaaca

SEQ ID NO: 478487 - RNA, 20 nt, Chlamydia trachomatis
cuugguuauacagagcaagg

SEQ ID NO: 478488 - RNA, 14 nt, Chlamydia trachomatis
cuuguauagcuuca

SEQ ID NO: 478489 - RNA, 17 nt, Chlamydia trachomatis
cuuguaucauauucuuu

SEQ ID NO: 478490 - RNA, 18 nt, Chlamydia trachomatis
cuuguaucauauucuuug

SEQ ID NO: 478491 - RNA, 15 nt, Chlamydia trachomatis
cuuggucgcauuuga

SEQ ID NO: 478492 - RNA, 19 nt, Chlamydia trachomatis
cuuggucgcauuugaaaga

SEQ ID NO: 478493 - RNA, 23 nt, Chlamydia trachomatis
cuuggugagggacgcgucucccu

SEQ ID NO: 478494 - RNA, 17 nt, Chlamydia trachomatis
cuuuaagaaaaaugcca

SEQ ID NO: 478495 - RNA, 16 nt, Chlamydia trachomatis
cuugucguuccucuag

SEQ ID NO: 478496 - RNA, 14 nt, Chlamydia trachomatis
cuugucuaaaagaa

SEQ ID NO: 478497 - RNA, 18 nt, Chlamydia trachomatis
cuugucggucgcauucca

SEQ ID NO: 478498 - RNA, 13 nt, Chlamydia trachomatis
cuugucuccuucu

SEQ ID NO: 478499 - RNA, 16 nt, Chlamydia trachomatis
cuugucuccuucuuug

SEQ ID NO: 478500 - RNA, 18 nt, Chlamydia trachomatis
cuuuacaaugaugagaau

SEQ ID NO: 478501 - RNA, 20 nt, Chlamydia trachomatis
cuuuacaaugaugagaaugu

SEQ ID NO: 478502 - RNA, 20 nt, Chlamydia trachomatis
cuuuacuaggagcaaaaagu

SEQ ID NO: 478503 - RNA, 18 nt, Chlamydia trachomatis
cuuuacucuuuucuuuau

SEQ ID NO: 478504 - RNA, 16 nt, Chlamydia trachomatis
cuuuagaaauaguaaa

SEQ ID NO: 478505 - RNA, 14 nt, Chlamydia trachomatis
cuuuagaagaaaag

SEQ ID NO: 478506 - RNA, 17 nt, Chlamydia trachomatis
cuuuagauuuguuuaaa

SEQ ID NO: 478507 - RNA, 21 nt, Chlamydia trachomatis
cuuuagcagccccccuuuuuu

SEQ ID NO: 478508 - RNA, 16 nt, Chlamydia trachomatis
cuuuagcgcacuuaau

SEQ ID NO: 478509 - RNA, 17 nt, Chlamydia trachomatis
cuuuagcugcuuuaaau

SEQ ID NO: 478510 - RNA, 20 nt, Chlamydia trachomatis
cuuucagagaaaauuucucu

SEQ ID NO: 478511 - RNA, 11 nt, Chlamydia trachomatis
cuuucaaagag

SEQ ID NO: 478512 - RNA, 19 nt, Chlamydia trachomatis
cuuuaugacuguugaugau

SEQ ID NO: 478513 - RNA, 20 nt, Chlamydia trachomatis
cuuuaugacuguugaugaug

SEQ ID NO: 478514 - RNA, 14 nt, Chlamydia trachomatis
cuuuaucucccccu

SEQ ID NO: 478515 - RNA, 22 nt, Chlamydia trachomatis
cuuuaucucccccuguacccgu

SEQ ID NO: 478516 - RNA, 22 nt, Chlamydia trachomatis
cuuuauugaacccauagauuca

SEQ ID NO: 478517 - RNA, 22 nt, Chlamydia trachomatis
cuuuauggguagcgauacaaga

SEQ ID NO: 478518 - RNA, 17 nt, Chlamydia trachomatis
cuuuaggcgaauaagcu

SEQ ID NO: 478519 - RNA, 23 nt, Chlamydia trachomatis
cuuuaggcgaauaagcucgcccu

SEQ ID NO: 478520 - RNA, 22 nt, Chlamydia trachomatis
cuuuauaaucgaucacagaaac

SEQ ID NO: 478521 - RNA, 15 nt, Chlamydia trachomatis
cuuucguuagaaagg

SEQ ID NO: 478522 - RNA, 13 nt, Chlamydia trachomatis
cuuucguugauca

SEQ ID NO: 478523 - RNA, 16 nt, Chlamydia trachomatis
cuuucguuucuccaga

SEQ ID NO: 478524 - RNA, 15 nt, Chlamydia trachomatis
cuuucuaauuucccu

SEQ ID NO: 478525 - RNA, 23 nt, Chlamydia trachomatis
cuuucuacauggccaaacaucau

SEQ ID NO: 478526 - RNA, 20 nt, Chlamydia trachomatis
cuuuccaagaaucaaaaagu

SEQ ID NO: 478527 - RNA, 21 nt, Chlamydia trachomatis
cuuuccaauaucuucagaagc

SEQ ID NO: 478528 - RNA, 14 nt, Chlamydia trachomatis
cuuucuuacuccuu

SEQ ID NO: 478529 - RNA, 21 nt, Chlamydia trachomatis
cuuucuuaguuugugaugagg

SEQ ID NO: 478530 - RNA, 22 nt, Chlamydia trachomatis
cuuucuuaguuugugaugaggc

SEQ ID NO: 478531 - RNA, 15 nt, Chlamydia trachomatis
cuuucuuccaucacu

SEQ ID NO: 478532 - RNA, 13 nt, Chlamydia trachomatis
cuuugaacauuua

SEQ ID NO: 478533 - RNA, 15 nt, Chlamydia trachomatis
cuuugaacauuuauc

SEQ ID NO: 478534 - RNA, 16 nt, Chlamydia trachomatis
cuuugaacauuuaucg

SEQ ID NO: 478535 - RNA, 17 nt, Chlamydia trachomatis
cuuugaagccucgcuuu

SEQ ID NO: 478536 - RNA, 21 nt, Chlamydia trachomatis
cuuugaagccucgcuuuugcg

SEQ ID NO: 478537 - RNA, 13 nt, Chlamydia trachomatis
cuuugaacuucaa

SEQ ID NO: 478538 - RNA, 20 nt, Chlamydia trachomatis
cuuugaauauccgaaugaau

SEQ ID NO: 478539 - RNA, 16 nt, Chlamydia trachomatis
cuuugacgacaacaug

SEQ ID NO: 478540 - RNA, 21 nt, Chlamydia trachomatis
cuuugauaauacucuucuauc

SEQ ID NO: 478541 - RNA, 21 nt, Chlamydia trachomatis
cuuugcauuuaaaugaaugug

SEQ ID NO: 478542 - RNA, 15 nt, Chlamydia trachomatis
cuuugcuaacaaaga

SEQ ID NO: 478543 - RNA, 20 nt, Chlamydia trachomatis
cuuugcucuuggucuuuauu

SEQ ID NO: 478544 - RNA, 17 nt, Chlamydia trachomatis
cuuuggcaugcccuaaa

SEQ ID NO: 478545 - RNA, 22 nt, Chlamydia trachomatis
cuuuggaagcagaaagaaugcu

SEQ ID NO: 478546 - RNA, 23 nt, Chlamydia trachomatis
cuuuggauuugugugcaaaucac

SEQ ID NO: 478547 - RNA, 18 nt, Chlamydia trachomatis
gacaauauuccauaauag

SEQ ID NO: 478548 - RNA, 18 nt, Chlamydia trachomatis
gacaacgauauaaagaag

SEQ ID NO: 478549 - RNA, 18 nt, Chlamydia trachomatis
gacaacguuuaaugaaua

SEQ ID NO: 478550 - RNA, 20 nt, Chlamydia trachomatis
gacaacaaguugauacaaga

SEQ ID NO: 478551 - RNA, 12 nt, Chlamydia trachomatis
gacaaaugcagg

SEQ ID NO: 478552 - RNA, 14 nt, Chlamydia trachomatis
gacaaauggauacg

SEQ ID NO: 478553 - RNA, 17 nt, Chlamydia trachomatis
gacaaagguguuuucua

SEQ ID NO: 478554 - RNA, 14 nt, Chlamydia trachomatis
gacaaagucagaga

SEQ ID NO: 478555 - RNA, 22 nt, Chlamydia trachomatis
gacaaagucagagauauugucu

SEQ ID NO: 478556 - RNA, 21 nt, Chlamydia trachomatis
gacaaagaucguaaaauagca

SEQ ID NO: 478557 - RNA, 19 nt, Chlamydia trachomatis
cuuugggauagauagcucc

SEQ ID NO: 478558 - RNA, 13 nt, Chlamydia trachomatis
cuuugguaagauc

SEQ ID NO: 478559 - RNA, 17 nt, Chlamydia trachomatis
cuuugguaagaucucua

SEQ ID NO: 478560 - RNA, 17 nt, Chlamydia trachomatis
cuuugguagcucguuuu

SEQ ID NO: 478561 - RNA, 23 nt, Chlamydia trachomatis
cuuuguaaaauaccuaaagaagc

SEQ ID NO: 478562 - RNA, 13 nt, Chlamydia trachomatis
gaauuuucucucu

SEQ ID NO: 478563 - RNA, 13 nt, Chlamydia trachomatis
gaauuuuucucac

SEQ ID NO: 478564 - RNA, 13 nt, Chlamydia trachomatis
gacaaaaaaugcg

SEQ ID NO: 478565 - RNA, 18 nt, Chlamydia trachomatis
gacaaaacuucuucgucu

SEQ ID NO: 478566 - RNA, 20 nt, Chlamydia trachomatis
gacacgcggauuaugauucc

SEQ ID NO: 478567 - RNA, 12 nt, Chlamydia trachomatis
gacacguuuucc

SEQ ID NO: 478568 - RNA, 17 nt, Chlamydia trachomatis
gacaccauucguucuuu

SEQ ID NO: 478569 - RNA, 22 nt, Chlamydia trachomatis
gacagcuucuuguagauagacu

SEQ ID NO: 478570 - RNA, 15 nt, Chlamydia trachomatis
gacagcccaagaucu

SEQ ID NO: 478571 - RNA, 22 nt, Chlamydia trachomatis
gacagcacuucuucuuuggaaa

SEQ ID NO: 478572 - RNA, 18 nt, Chlamydia trachomatis
gacagcaccaagcuccac

SEQ ID NO: 478573 - RNA, 18 nt, Chlamydia trachomatis
gacagagcccuucuuuuc

SEQ ID NO: 478574 - RNA, 21 nt, Chlamydia trachomatis
gacagagcccuucuuuuccug

SEQ ID NO: 478575 - RNA, 23 nt, Chlamydia trachomatis
gacacuggcaccuuuuuugcuaa

SEQ ID NO: 478576 - RNA, 15 nt, Chlamydia trachomatis
gacaggcuauugaua

SEQ ID NO: 478577 - RNA, 18 nt, Chlamydia trachomatis
gacagcuuucacagggac

SEQ ID NO: 478578 - RNA, 14 nt, Chlamydia trachomatis
gacauaaaagcugu

SEQ ID NO: 478579 - RNA, 21 nt, Chlamydia trachomatis
gacauagggguuauccagauc

SEQ ID NO: 478580 - RNA, 18 nt, Chlamydia trachomatis
gacaucuauugagaagac

SEQ ID NO: 478581 - RNA, 16 nt, Chlamydia trachomatis
gacaucuccugcagcu

SEQ ID NO: 478582 - RNA, 20 nt, Chlamydia trachomatis
gacaugccagaagcuaugag

SEQ ID NO: 478583 - RNA, 15 nt, Chlamydia trachomatis
gacauuccaaaccca

SEQ ID NO: 478584 - RNA, 18 nt, Chlamydia trachomatis
gaccagaucauagaaaug

SEQ ID NO: 478585 - RNA, 16 nt, Chlamydia trachomatis
gaccaugaaugacugc

SEQ ID NO: 478586 - RNA, 13 nt, Chlamydia trachomatis
gacccauaagaua

SEQ ID NO: 478587 - RNA, 15 nt, Chlamydia trachomatis
gacccagcucauuag

SEQ ID NO: 478588 - RNA, 14 nt, Chlamydia trachomatis
gacccgcuauugua

SEQ ID NO: 478589 - RNA, 20 nt, Chlamydia trachomatis
gaccgagauuaucauucaaa

SEQ ID NO: 478590 - RNA, 13 nt, Chlamydia trachomatis
gaccuuaggaaua

SEQ ID NO: 478591 - RNA, 15 nt, Chlamydia trachomatis
gaccuaguaagugca

SEQ ID NO: 478592 - RNA, 22 nt, Chlamydia trachomatis
gaccguuaauaucccacucuuc

SEQ ID NO: 478593 - RNA, 14 nt, Chlamydia trachomatis
gaccuacaaagaua

SEQ ID NO: 478594 - RNA, 13 nt, Chlamydia trachomatis
gaccuugaacccc

SEQ ID NO: 478595 - RNA, 14 nt, Chlamydia trachomatis
gacgaacgcuagaa

SEQ ID NO: 478596 - RNA, 14 nt, Chlamydia trachomatis
gacgacaacaugaa

SEQ ID NO: 478597 - RNA, 18 nt, Chlamydia trachomatis
gacgauauuguccaaacg

SEQ ID NO: 478598 - RNA, 16 nt, Chlamydia trachomatis
gacgauauuuaagaua

SEQ ID NO: 478599 - RNA, 12 nt, Chlamydia trachomatis
gacgauuaauag

SEQ ID NO: 478600 - RNA, 14 nt, Chlamydia trachomatis
gacgcccuccuccu

SEQ ID NO: 478601 - RNA, 17 nt, Chlamydia trachomatis
gacgcccuccuccucgc

SEQ ID NO: 478602 - RNA, 21 nt, Chlamydia trachomatis
gacgcaucacggcuucugucc

SEQ ID NO: 478603 - RNA, 18 nt, Chlamydia trachomatis
gacgcuagcuuuccucac

SEQ ID NO: 478604 - RNA, 17 nt, Chlamydia trachomatis
gacggaauuuuucucac

SEQ ID NO: 478605 - RNA, 16 nt, Chlamydia trachomatis
gacguucuugcugaga

SEQ ID NO: 478606 - RNA, 12 nt, Chlamydia trachomatis
gacuaaagacug

SEQ ID NO: 478607 - RNA, 13 nt, Chlamydia trachomatis
gacuacagucuuc

SEQ ID NO: 478608 - RNA, 12 nt, Chlamydia trachomatis
gacuauuuccua

SEQ ID NO: 478609 - RNA, 20 nt, Chlamydia trachomatis
gacuauuucuucuagauaga

SEQ ID NO: 478610 - RNA, 15 nt, Chlamydia trachomatis
gacuccuucucgcaa

SEQ ID NO: 478611 - RNA, 15 nt, Chlamydia trachomatis
gacuccagcuucucc

SEQ ID NO: 478612 - RNA, 20 nt, Chlamydia trachomatis
gacugcaagaucaugggaaa

SEQ ID NO: 478613 - RNA, 17 nt, Chlamydia trachomatis
gacugcggcagcugcuu

SEQ ID NO: 478614 - RNA, 13 nt, Chlamydia trachomatis
gacucuaaagaau

SEQ ID NO: 478615 - RNA, 20 nt, Chlamydia trachomatis
gacucucauaagaauacaaa

SEQ ID NO: 478616 - RNA, 11 nt, Chlamydia trachomatis
gacucuuucaa

SEQ ID NO: 478617 - RNA, 16 nt, Chlamydia trachomatis
gacuugagcgucuuua

SEQ ID NO: 478618 - RNA, 23 nt, Chlamydia trachomatis
gacugguuguucccgauuacuug

SEQ ID NO: 478619 - RNA, 18 nt, Chlamydia trachomatis
gacuuagcacucaaacac

SEQ ID NO: 478620 - RNA, 16 nt, Chlamydia trachomatis
gacuuucuuuaagcaa

SEQ ID NO: 478621 - RNA, 15 nt, Chlamydia trachomatis
gacuuugugcaaccu

SEQ ID NO: 478622 - RNA, 20 nt, Chlamydia trachomatis
gacuuugugcaaccucuaua

SEQ ID NO: 478623 - RNA, 18 nt, Chlamydia trachomatis
gagaaaaagguauuagau

SEQ ID NO: 478624 - RNA, 21 nt, Chlamydia trachomatis
gagaacaucucggucuuagaa

SEQ ID NO: 478625 - RNA, 15 nt, Chlamydia trachomatis
gagaaaguuaaagaa

SEQ ID NO: 478626 - RNA, 23 nt, Chlamydia trachomatis
gagaaaguucguucaauuaaaga

SEQ ID NO: 478627 - RNA, 13 nt, Chlamydia trachomatis
gagaaauaaaaac

SEQ ID NO: 478628 - RNA, 12 nt, Chlamydia trachomatis
gagaaagagcca

SEQ ID NO: 478629 - RNA, 14 nt, Chlamydia trachomatis
gagaaagagggguu

SEQ ID NO: 478630 - RNA, 16 nt, Chlamydia trachomatis
gagaaaagaaaagggg

SEQ ID NO: 478631 - RNA, 19 nt, Chlamydia trachomatis
gagaaaagaggaguugguu

SEQ ID NO: 478632 - RNA, 21 nt, Chlamydia trachomatis
gagaaaaucccgguaauagaa

SEQ ID NO: 478633 - RNA, 20 nt, Chlamydia trachomatis
gagaacggcuguuguccuua

SEQ ID NO: 478634 - RNA, 17 nt, Chlamydia trachomatis
gagaacggcaauaaaga

SEQ ID NO: 478635 - RNA, 11 nt, Chlamydia trachomatis
gagaagaaaaa

SEQ ID NO: 478636 - RNA, 12 nt, Chlamydia trachomatis
gagaagaagagg

SEQ ID NO: 478637 - RNA, 12 nt, Chlamydia trachomatis
gagaagaaggcu

SEQ ID NO: 478638 - RNA, 19 nt, Chlamydia trachomatis
gagaaggucgucagugcag

SEQ ID NO: 478639 - RNA, 14 nt, Chlamydia trachomatis
gagaagcgauuuga

SEQ ID NO: 478640 - RNA, 19 nt, Chlamydia trachomatis
gagaagcugauauaaguau

SEQ ID NO: 478641 - RNA, 13 nt, Chlamydia trachomatis
gagacaucuccug

SEQ ID NO: 478642 - RNA, 17 nt, Chlamydia trachomatis
gagaccgagccuccgcu

SEQ ID NO: 478643 - RNA, 18 nt, Chlamydia trachomatis
gagacgagaaaucuuuua

SEQ ID NO: 478644 - RNA, 19 nt, Chlamydia trachomatis
gagacgcuuggugagggac

SEQ ID NO: 478645 - RNA, 15 nt, Chlamydia trachomatis
gagacuccagcuucu

SEQ ID NO: 478646 - RNA, 14 nt, Chlamydia trachomatis
gagagcagcuacaa

SEQ ID NO: 478647 - RNA, 21 nt, Chlamydia trachomatis
gagagcaguuguuuucuugcu

SEQ ID NO: 478648 - RNA, 18 nt, Chlamydia trachomatis
gagagcauucuucugaac

SEQ ID NO: 478649 - RNA, 15 nt, Chlamydia trachomatis
gagagcaacgagcaa

SEQ ID NO: 478650 - RNA, 17 nt, Chlamydia trachomatis
gagagcaacgagcaaua

SEQ ID NO: 478651 - RNA, 14 nt, Chlamydia trachomatis
gagagcaagccugg

SEQ ID NO: 478652 - RNA, 16 nt, Chlamydia trachomatis
gagagaggagaaaaac

SEQ ID NO: 478653 - RNA, 16 nt, Chlamydia trachomatis
gagagaucuaugaaaa

SEQ ID NO: 478654 - RNA, 18 nt, Chlamydia trachomatis
gagagaucuaugaaaaaa

SEQ ID NO: 478655 - RNA, 19 nt, Chlamydia trachomatis
gagagaucuaugaaaaaag

SEQ ID NO: 478656 - RNA, 20 nt, Chlamydia trachomatis
gagagaucuaugaaaaaagc

SEQ ID NO: 478657 - RNA, 20 nt, Chlamydia trachomatis
gagaggauuaaggaaugaua

SEQ ID NO: 478658 - RNA, 17 nt, Chlamydia trachomatis
gagaggcgucugcauaa

SEQ ID NO: 478659 - RNA, 18 nt, Chlamydia trachomatis
gagaggugugauaggaga

SEQ ID NO: 478660 - RNA, 23 nt, Chlamydia trachomatis
gagagcuuugaucuuuguucucu

SEQ ID NO: 478661 - RNA, 19 nt, Chlamydia trachomatis
gagaguucguuaggauucg

SEQ ID NO: 478662 - RNA, 15 nt, Chlamydia trachomatis
gagauaugaguggca

SEQ ID NO: 478663 - RNA, 19 nt, Chlamydia trachomatis
gagauaucacuaccagccc

SEQ ID NO: 478664 - RNA, 16 nt, Chlamydia trachomatis
gagauugcaacucuug

SEQ ID NO: 478665 - RNA, 17 nt, Chlamydia trachomatis
gagauugccuuuucuau

SEQ ID NO: 478666 - RNA, 19 nt, Chlamydia trachomatis
gagauguuuacgaggaggu

SEQ ID NO: 478667 - RNA, 15 nt, Chlamydia trachomatis
gagauguaggauuca

SEQ ID NO: 478668 - RNA, 13 nt, Chlamydia trachomatis
gagaucuaauugg

SEQ ID NO: 478669 - RNA, 15 nt, Chlamydia trachomatis
gagaucuaugaaaaa

SEQ ID NO: 478670 - RNA, 12 nt, Chlamydia trachomatis
gagaucugcauc

SEQ ID NO: 478671 - RNA, 13 nt, Chlamydia trachomatis
gagaucuucugaa

SEQ ID NO: 478672 - RNA, 17 nt, Chlamydia trachomatis
gagcaagcugaggaagc

SEQ ID NO: 478673 - RNA, 16 nt, Chlamydia trachomatis
gagcaaggugaccucu

SEQ ID NO: 478674 - RNA, 16 nt, Chlamydia trachomatis
gagauuuccucuucua

SEQ ID NO: 478675 - RNA, 14 nt, Chlamydia trachomatis
gagcaaaaaaagag

SEQ ID NO: 478676 - RNA, 23 nt, Chlamydia trachomatis
gagcagaacuuaucuguucugcu

SEQ ID NO: 478677 - RNA, 18 nt, Chlamydia trachomatis
gagcagcuaacagcucuu

SEQ ID NO: 478678 - RNA, 22 nt, Chlamydia trachomatis
gagcaugaaucagcuuuuccac

SEQ ID NO: 478679 - RNA, 16 nt, Chlamydia trachomatis
gagcauccauauauuc

SEQ ID NO: 478680 - RNA, 24 nt, Chlamydia trachomatis
gagcauccauauauucagaagaag

SEQ ID NO: 478681 - RNA, 23 nt, Chlamydia trachomatis
gagcauaaagaaucccucuagca

SEQ ID NO: 478682 - RNA, 16 nt, Chlamydia trachomatis
gagcauaagaauaaac

SEQ ID NO: 478683 - RNA, 15 nt, Chlamydia trachomatis
gagcaugguauucua

SEQ ID NO: 478684 - RNA, 20 nt, Chlamydia trachomatis
gagcauguguuucuggaaag

SEQ ID NO: 478685 - RNA, 19 nt, Chlamydia trachomatis
gagccaacgaaucgcccuu

SEQ ID NO: 478686 - RNA, 16 nt, Chlamydia trachomatis
gagcauuuuccaagaa

SEQ ID NO: 478687 - RNA, 14 nt, Chlamydia trachomatis
gagccaugaucaaa

SEQ ID NO: 478688 - RNA, 18 nt, Chlamydia trachomatis
gagccaugaucaaagaaa

SEQ ID NO: 478689 - RNA, 20 nt, Chlamydia trachomatis
gagccaugaucaaagaaagc

SEQ ID NO: 478690 - RNA, 14 nt, Chlamydia trachomatis
gagcccaaggagaa

SEQ ID NO: 478691 - RNA, 21 nt, Chlamydia trachomatis
gagcccaaggagaauaccacc

SEQ ID NO: 478692 - RNA, 22 nt, Chlamydia trachomatis
gagcccaaggagaauaccacca

SEQ ID NO: 478693 - RNA, 17 nt, Chlamydia trachomatis
gagccuguuuagaaaga

SEQ ID NO: 478694 - RNA, 13 nt, Chlamydia trachomatis
gagccuguuuugc

SEQ ID NO: 478695 - RNA, 22 nt, Chlamydia trachomatis
gagccuccgcuuagaaugggaa

SEQ ID NO: 478696 - RNA, 13 nt, Chlamydia trachomatis
gagccucuaacuc

SEQ ID NO: 478697 - RNA, 18 nt, Chlamydia trachomatis
gagccguucguacugaua

SEQ ID NO: 478698 - RNA, 13 nt, Chlamydia trachomatis
gagccuacguccu

SEQ ID NO: 478699 - RNA, 16 nt, Chlamydia trachomatis
gagcgaguuuguggaa

SEQ ID NO: 478700 - RNA, 13 nt, Chlamydia trachomatis
gagcuaagaaaau

SEQ ID NO: 478701 - RNA, 14 nt, Chlamydia trachomatis
gagcuaagaaaaua

SEQ ID NO: 478702 - RNA, 18 nt, Chlamydia trachomatis
gagcucauuuucuauuuc

SEQ ID NO: 478703 - RNA, 13 nt, Chlamydia trachomatis
gagcucccauuuc

SEQ ID NO: 478704 - RNA, 12 nt, Chlamydia trachomatis
gagcugagucuu

SEQ ID NO: 478705 - RNA, 12 nt, Chlamydia trachomatis
gagcuucucuaa

SEQ ID NO: 478706 - RNA, 18 nt, Chlamydia trachomatis
gagcuucuucuaaagaau

SEQ ID NO: 478707 - RNA, 21 nt, Chlamydia trachomatis
gagcuucuuuauccggagcuu

SEQ ID NO: 478708 - RNA, 20 nt, Chlamydia trachomatis
gagcuuugaggacugacaga

SEQ ID NO: 478709 - RNA, 14 nt, Chlamydia trachomatis
gagcuuugaucuuu

SEQ ID NO: 478710 - RNA, 23 nt, Chlamydia trachomatis
gagcuuugaucuuuguucucuaa

SEQ ID NO: 478711 - RNA, 17 nt, Chlamydia trachomatis
gagcuuaacuuuguuau

SEQ ID NO: 478712 - RNA, 18 nt, Chlamydia trachomatis
gagcuuagguaagggaca

SEQ ID NO: 478713 - RNA, 19 nt, Chlamydia trachomatis
gagcuucccuuaaauauuc

SEQ ID NO: 478714 - RNA, 15 nt, Chlamydia trachomatis
gaggagacuuuagcu

SEQ ID NO: 478715 - RNA, 22 nt, Chlamydia trachomatis
gaggaauugaucuuguguagua

SEQ ID NO: 478716 - RNA, 14 nt, Chlamydia trachomatis
gaggaauauuaaac

SEQ ID NO: 478717 - RNA, 15 nt, Chlamydia trachomatis
gaggaagagagaaca

SEQ ID NO: 478718 - RNA, 19 nt, Chlamydia trachomatis
gaggaagaaauguuuggau

SEQ ID NO: 478719 - RNA, 19 nt, Chlamydia trachomatis
gaggaacccuuuguaguua

SEQ ID NO: 478720 - RNA, 22 nt, Chlamydia trachomatis
gagcuuuuuuuuucagcaauaa

SEQ ID NO: 478721 - RNA, 14 nt, Chlamydia trachomatis
gaggaucuccagaa

SEQ ID NO: 478722 - RNA, 14 nt, Chlamydia trachomatis
gaggagucucugca

SEQ ID NO: 478723 - RNA, 23 nt, Chlamydia trachomatis
gaggauaaaucaguggaacugcu

SEQ ID NO: 478724 - RNA, 15 nt, Chlamydia trachomatis
gaggcagucucugag

SEQ ID NO: 478725 - RNA, 21 nt, Chlamydia trachomatis
gaggcagucucugaggcaaag

SEQ ID NO: 478726 - RNA, 23 nt, Chlamydia trachomatis
gaggcagugguuaacaggcuucc

SEQ ID NO: 478727 - RNA, 21 nt, Chlamydia trachomatis
gaggauguugcgaguuuugau

SEQ ID NO: 478728 - RNA, 17 nt, Chlamydia trachomatis
gaggauuccaagggaga

SEQ ID NO: 478729 - RNA, 22 nt, Chlamydia trachomatis
gaggccauagaauggcgcucuc

SEQ ID NO: 478730 - RNA, 17 nt, Chlamydia trachomatis
gaggccuccauuuccau

SEQ ID NO: 478731 - RNA, 23 nt, Chlamydia trachomatis
gaggcuccgccuucugcaaugag

SEQ ID NO: 478732 - RNA, 16 nt, Chlamydia trachomatis
gagggagauauagcca

SEQ ID NO: 478733 - RNA, 14 nt, Chlamydia trachomatis
gagggacuucuucu

SEQ ID NO: 478734 - RNA, 20 nt, Chlamydia trachomatis
gagggaaauauugcucuaaa

SEQ ID NO: 478735 - RNA, 12 nt, Chlamydia trachomatis
gagggaagagaa

SEQ ID NO: 478736 - RNA, 21 nt, Chlamydia trachomatis
gaggcuuaaagauaacacucu

SEQ ID NO: 478737 - RNA, 14 nt, Chlamydia trachomatis
gaggcuugagaauc

SEQ ID NO: 478738 - RNA, 14 nt, Chlamydia trachomatis
gagggugaggucca

SEQ ID NO: 478739 - RNA, 21 nt, Chlamydia trachomatis
gaggguuucuucuuuugagau

SEQ ID NO: 478740 - RNA, 21 nt, Chlamydia trachomatis
gagguccaaaauuucagggaa

SEQ ID NO: 478741 - RNA, 19 nt, Chlamydia trachomatis
gagguagccagguaaacuc

SEQ ID NO: 478742 - RNA, 14 nt, Chlamydia trachomatis
gagguauuccugua

SEQ ID NO: 478743 - RNA, 18 nt, Chlamydia trachomatis
gagguauuccuguagaaa

SEQ ID NO: 478744 - RNA, 16 nt, Chlamydia trachomatis
gagguauuuaggaacu

SEQ ID NO: 478745 - RNA, 17 nt, Chlamydia trachomatis
gaggucugugcuauuug

SEQ ID NO: 478746 - RNA, 18 nt, Chlamydia trachomatis
gaggugugaauaggaaga

SEQ ID NO: 478747 - RNA, 24 nt, Chlamydia trachomatis
gaggugugaauaggaagaauaaua

SEQ ID NO: 478748 - RNA, 18 nt, Chlamydia trachomatis
gagguuguuacagucugu

SEQ ID NO: 478749 - RNA, 15 nt, Chlamydia trachomatis
gaguaauuccaaaua

SEQ ID NO: 478750 - RNA, 22 nt, Chlamydia trachomatis
gaguuuguagauguagcagaau

SEQ ID NO: 478751 - RNA, 19 nt, Chlamydia trachomatis
gaguuuuuuuguuuccauu

SEQ ID NO: 478752 - RNA, 18 nt, Chlamydia trachomatis
gauaaacagaucuaggau

SEQ ID NO: 478753 - RNA, 20 nt, Chlamydia trachomatis
gauaaacguuuggaaauccu

SEQ ID NO: 478754 - RNA, 14 nt, Chlamydia trachomatis
gauaaauauuuuag

SEQ ID NO: 478755 - RNA, 15 nt, Chlamydia trachomatis
gauaacaaacaacac

SEQ ID NO: 478756 - RNA, 15 nt, Chlamydia trachomatis
gauaacaacaauaaa

SEQ ID NO: 478757 - RNA, 17 nt, Chlamydia trachomatis
gauaacaacucuccuaa

SEQ ID NO: 478758 - RNA, 18 nt, Chlamydia trachomatis
gauaaccagaauccuuuu

SEQ ID NO: 478759 - RNA, 18 nt, Chlamydia trachomatis
gauaacuuugaacaaauu

SEQ ID NO: 478760 - RNA, 13 nt, Chlamydia trachomatis
gauaagaaaucuu

SEQ ID NO: 478761 - RNA, 14 nt, Chlamydia trachomatis
gauaagaaaucuuc

SEQ ID NO: 478762 - RNA, 17 nt, Chlamydia trachomatis
gauaagaagguugaauu

SEQ ID NO: 478763 - RNA, 17 nt, Chlamydia trachomatis
gaguuguuugggcugcu

SEQ ID NO: 478764 - RNA, 23 nt, Chlamydia trachomatis
gaguuguagaaccacaaaccauc

SEQ ID NO: 478765 - RNA, 15 nt, Chlamydia trachomatis
gaguggcaaggggga

SEQ ID NO: 478766 - RNA, 12 nt, Chlamydia trachomatis
gagugugcuucu

SEQ ID NO: 478767 - RNA, 12 nt, Chlamydia trachomatis
gaguguuuucug

SEQ ID NO: 478768 - RNA, 13 nt, Chlamydia trachomatis
gaguacuucuaaa

SEQ ID NO: 478769 - RNA, 14 nt, Chlamydia trachomatis
gaguaggucccugu

SEQ ID NO: 478770 - RNA, 13 nt, Chlamydia trachomatis
gaguccugagcca

SEQ ID NO: 478771 - RNA, 22 nt, Chlamydia trachomatis
gagugacuagccaauacgaaca

SEQ ID NO: 478772 - RNA, 17 nt, Chlamydia trachomatis
gauaagggaaucauaag

SEQ ID NO: 478773 - RNA, 20 nt, Chlamydia trachomatis
gauaagggaaucauaaggaa

SEQ ID NO: 478774 - RNA, 14 nt, Chlamydia trachomatis
gauaaggaggcuuc

SEQ ID NO: 478775 - RNA, 14 nt, Chlamydia trachomatis
gauaaggaagaaga

SEQ ID NO: 478776 - RNA, 21 nt, Chlamydia trachomatis
gauaaggacguuuggagcaug

SEQ ID NO: 478777 - RNA, 22 nt, Chlamydia trachomatis
gauaaguccaucuaaagggaga

SEQ ID NO: 478778 - RNA, 17 nt, Chlamydia trachomatis
gauaccugucccugcuc

SEQ ID NO: 478779 - RNA, 19 nt, Chlamydia trachomatis
gauacucaacgucuugucu

SEQ ID NO: 478780 - RNA, 16 nt, Chlamydia trachomatis
gauagagaagaauuga

SEQ ID NO: 478781 - RNA, 12 nt, Chlamydia trachomatis
gauagagaacau

SEQ ID NO: 478782 - RNA, 19 nt, Chlamydia trachomatis
gauagaauuucuuccucua

SEQ ID NO: 478783 - RNA, 13 nt, Chlamydia trachomatis
gauagacaagacu

SEQ ID NO: 478784 - RNA, 12 nt, Chlamydia trachomatis
gauagacuggca

SEQ ID NO: 478785 - RNA, 21 nt, Chlamydia trachomatis
gauaggaaaaaagaagcuuuu

SEQ ID NO: 478786 - RNA, 17 nt, Chlamydia trachomatis
gauaggacuugaaccua

SEQ ID NO: 478787 - RNA, 15 nt, Chlamydia trachomatis
gauaguaaaaacuau

SEQ ID NO: 478788 - RNA, 23 nt, Chlamydia trachomatis
gauaguacccacugcacaggauu

SEQ ID NO: 478789 - RNA, 13 nt, Chlamydia trachomatis
gauagccuuaaua

SEQ ID NO: 478790 - RNA, 15 nt, Chlamydia trachomatis
gauauacagaacauu

SEQ ID NO: 478791 - RNA, 19 nt, Chlamydia trachomatis
gauagucugcauuaaacac

SEQ ID NO: 478792 - RNA, 19 nt, Chlamydia trachomatis
gauaggcugaggauuccaa

SEQ ID NO: 478793 - RNA, 15 nt, Chlamydia trachomatis
gauaguuucuuucuu

SEQ ID NO: 478794 - RNA, 22 nt, Chlamydia trachomatis
gaucaauaagugcuccugcaga

SEQ ID NO: 478795 - RNA, 17 nt, Chlamydia trachomatis
gaucaccggaccuccuc

SEQ ID NO: 478796 - RNA, 15 nt, Chlamydia trachomatis
gauauuucuuccugu

SEQ ID NO: 478797 - RNA, 19 nt, Chlamydia trachomatis
gauauuuucacauacaggc

SEQ ID NO: 478798 - RNA, 21 nt, Chlamydia trachomatis
gaucauauccuuaacgauguu

SEQ ID NO: 478799 - RNA, 13 nt, Chlamydia trachomatis
gaucauaaagucu

SEQ ID NO: 478800 - RNA, 17 nt, Chlamydia trachomatis
gaucagagggacgagca

SEQ ID NO: 478801 - RNA, 20 nt, Chlamydia trachomatis
gaucagagggacgagcagcc

SEQ ID NO: 478802 - RNA, 21 nt, Chlamydia trachomatis
gaucaugcagaugaagaaucu

SEQ ID NO: 478803 - RNA, 21 nt, Chlamydia trachomatis
gauccaguucuggagcaacaa

SEQ ID NO: 478804 - RNA, 14 nt, Chlamydia trachomatis
gauccaucucuccg

SEQ ID NO: 478805 - RNA, 17 nt, Chlamydia trachomatis
gauccaggagauguagg

SEQ ID NO: 478806 - RNA, 14 nt, Chlamydia trachomatis
gaucuccaugaucc

SEQ ID NO: 478807 - RNA, 14 nt, Chlamydia trachomatis
gaucucccucauuu

SEQ ID NO: 478808 - RNA, 20 nt, Chlamydia trachomatis
gaucucccucauuuaaaagu

SEQ ID NO: 478809 - RNA, 17 nt, Chlamydia trachomatis
gaucuagaaguuuuccc

SEQ ID NO: 478810 - RNA, 18 nt, Chlamydia trachomatis
gaucuagaaguuuuccca

SEQ ID NO: 478811 - RNA, 20 nt, Chlamydia trachomatis
gaucuagauccgcagccacu

SEQ ID NO: 478812 - RNA, 22 nt, Chlamydia trachomatis
gaucuaucgcuugaaaagaacc

SEQ ID NO: 478813 - RNA, 18 nt, Chlamydia trachomatis
gaucuacagcaaaaccuu

SEQ ID NO: 478814 - RNA, 16 nt, Chlamydia trachomatis
gaucccagggagagag

SEQ ID NO: 478815 - RNA, 17 nt, Chlamydia trachomatis
gaucugaaaagagaaga

SEQ ID NO: 478816 - RNA, 15 nt, Chlamydia trachomatis
gaucucugcagaaga

SEQ ID NO: 478817 - RNA, 20 nt, Chlamydia trachomatis
gaucucuuagacccucuaau

SEQ ID NO: 478818 - RNA, 17 nt, Chlamydia trachomatis
gaucuccucauccuuuu

SEQ ID NO: 478819 - RNA, 13 nt, Chlamydia trachomatis
gaucuccuuccuc

SEQ ID NO: 478820 - RNA, 14 nt, Chlamydia trachomatis
gaucuccuuccucu

SEQ ID NO: 478821 - RNA, 23 nt, Chlamydia trachomatis
gaugaaaccuaauagaaauagcu

SEQ ID NO: 478822 - RNA, 16 nt, Chlamydia trachomatis
gaucuuuaagcucuuc

SEQ ID NO: 478823 - RNA, 20 nt, Chlamydia trachomatis
gaucuuuccaauaucuucag

SEQ ID NO: 478824 - RNA, 22 nt, Chlamydia trachomatis
gaucuuuccagcaggccucugu

SEQ ID NO: 478825 - RNA, 17 nt, Chlamydia trachomatis
gaucuuuuuaggaggaa

SEQ ID NO: 478826 - RNA, 12 nt, Chlamydia trachomatis
gaugaaaaagaa

SEQ ID NO: 478827 - RNA, 18 nt, Chlamydia trachomatis
gaucuguuagugaagagc

SEQ ID NO: 478828 - RNA, 19 nt, Chlamydia trachomatis
gaucuguuagugaagagca

SEQ ID NO: 478829 - RNA, 18 nt, Chlamydia trachomatis
gaucuuccagccuacaaa

SEQ ID NO: 478830 - RNA, 18 nt, Chlamydia trachomatis
gaucuuccucuugaaaga

SEQ ID NO: 478831 - RNA, 12 nt, Chlamydia trachomatis
gaucuucaacaa

SEQ ID NO: 478832 - RNA, 20 nt, Chlamydia trachomatis
gaucuugaucugaaaagaga

SEQ ID NO: 478833 - RNA, 20 nt, Chlamydia trachomatis
gaucuucgucagggagaaaa

SEQ ID NO: 478834 - RNA, 16 nt, Chlamydia trachomatis
gaugacgcagcaacaa

SEQ ID NO: 478835 - RNA, 16 nt, Chlamydia trachomatis
gaugcaaauaagaaag

SEQ ID NO: 478836 - RNA, 21 nt, Chlamydia trachomatis
gaugcacauccguuucuagaa

SEQ ID NO: 478837 - RNA, 14 nt, Chlamydia trachomatis
gaugcaccauaaua

SEQ ID NO: 478838 - RNA, 22 nt, Chlamydia trachomatis
gaugccccaauuccucguccau

SEQ ID NO: 478839 - RNA, 16 nt, Chlamydia trachomatis
gaugcccaagaaacug

SEQ ID NO: 478840 - RNA, 13 nt, Chlamydia trachomatis
gaugccucuaaca

SEQ ID NO: 478841 - RNA, 18 nt, Chlamydia trachomatis
gauguuguuaaagcuuuu

SEQ ID NO: 478842 - RNA, 21 nt, Chlamydia trachomatis
gauucagcaagauucuccuua

SEQ ID NO: 478843 - RNA, 14 nt, Chlamydia trachomatis
gauuaggguagucg

SEQ ID NO: 478844 - RNA, 20 nt, Chlamydia trachomatis
gauucaaaagcuaucuuugc

SEQ ID NO: 478845 - RNA, 19 nt, Chlamydia trachomatis
gauuccacuaccccaccua

SEQ ID NO: 478846 - RNA, 23 nt, Chlamydia trachomatis
gauucauauguucuuugaagccu

SEQ ID NO: 478847 - RNA, 18 nt, Chlamydia trachomatis
gauucaucaaaauauuuu

SEQ ID NO: 478848 - RNA, 19 nt, Chlamydia trachomatis
gauucaucaaaauauuuug

SEQ ID NO: 478849 - RNA, 15 nt, Chlamydia trachomatis
gauucgaaggaaaug

SEQ ID NO: 478850 - RNA, 15 nt, Chlamydia trachomatis
gauucuaugagaaga

SEQ ID NO: 478851 - RNA, 15 nt, Chlamydia trachomatis
gauucgcugcugucu

SEQ ID NO: 478852 - RNA, 22 nt, Chlamydia trachomatis
gauucgcugcugucuugucuuu

SEQ ID NO: 478853 - RNA, 23 nt, Chlamydia trachomatis
gauucguuugugcuaaaucucca

SEQ ID NO: 478854 - RNA, 21 nt, Chlamydia trachomatis
gcaaaaauuuucacacauccu

SEQ ID NO: 478855 - RNA, 22 nt, Chlamydia trachomatis
gcaaaacauccaugucuaagga

SEQ ID NO: 478856 - RNA, 15 nt, Chlamydia trachomatis
gauuuuuuucugcaa

SEQ ID NO: 478857 - RNA, 19 nt, Chlamydia trachomatis
gauuuuuuaauaauaaaga

SEQ ID NO: 478858 - RNA, 18 nt, Chlamydia trachomatis
gauuuucugaaguucuuu

SEQ ID NO: 478859 - RNA, 21 nt, Chlamydia trachomatis
gauuuugaauacgauccucug

SEQ ID NO: 478860 - RNA, 10 nt, Chlamydia trachomatis
gauuucuccu

SEQ ID NO: 478861 - RNA, 11 nt, Chlamydia trachomatis
gauuucugcag

SEQ ID NO: 478862 - RNA, 16 nt, Chlamydia trachomatis
gauuuccccuuuucaa

SEQ ID NO: 478863 - RNA, 17 nt, Chlamydia trachomatis
gauuuccucuucuagaa

SEQ ID NO: 478864 - RNA, 14 nt, Chlamydia trachomatis
gauuuccucuucuu

SEQ ID NO: 478865 - RNA, 15 nt, Chlamydia trachomatis
gauuuccucuucuuc

SEQ ID NO: 478866 - RNA, 16 nt, Chlamydia trachomatis
gauuuccucuucuucg

SEQ ID NO: 478867 - RNA, 16 nt, Chlamydia trachomatis
gauuuccccaagaugc

SEQ ID NO: 478868 - RNA, 15 nt, Chlamydia trachomatis
gcaacaguuuugaug

SEQ ID NO: 478869 - RNA, 23 nt, Chlamydia trachomatis
gcaaccaauucucugccuauagc

SEQ ID NO: 478870 - RNA, 18 nt, Chlamydia trachomatis
gcaacacaacuucugcua

SEQ ID NO: 478871 - RNA, 17 nt, Chlamydia trachomatis
gcaacaauauccuccau

SEQ ID NO: 478872 - RNA, 15 nt, Chlamydia trachomatis
gcaaaagaaaaaucu

SEQ ID NO: 478873 - RNA, 22 nt, Chlamydia trachomatis
gcaaaagaugauagcagcaguu

SEQ ID NO: 478874 - RNA, 17 nt, Chlamydia trachomatis
gcaaaagauuuccccaa

SEQ ID NO: 478875 - RNA, 16 nt, Chlamydia trachomatis
gcaaaagauuuugaau

SEQ ID NO: 478876 - RNA, 22 nt, Chlamydia trachomatis
gcaaaaccuuuugaaacaucuu

SEQ ID NO: 478877 - RNA, 15 nt, Chlamydia trachomatis
gcaacaaauaccaaa

SEQ ID NO: 478878 - RNA, 15 nt, Chlamydia trachomatis
gcaacaagaacgcuu

SEQ ID NO: 478879 - RNA, 18 nt, Chlamydia trachomatis
gcaacaagaacgcuuucc

SEQ ID NO: 478880 - RNA, 21 nt, Chlamydia trachomatis
gcaaccccgcauaccaaagca

SEQ ID NO: 478881 - RNA, 16 nt, Chlamydia trachomatis
gcaaccauucaucuag

SEQ ID NO: 478882 - RNA, 20 nt, Chlamydia trachomatis
gcaacccuaaaucuccuccu

SEQ ID NO: 478883 - RNA, 20 nt, Chlamydia trachomatis
gcaacccucgcagagaaaga

SEQ ID NO: 478884 - RNA, 22 nt, Chlamydia trachomatis
gcaacccucgcagagaaagagc

SEQ ID NO: 478885 - RNA, 15 nt, Chlamydia trachomatis
gcaaccuuaucuugg

SEQ ID NO: 478886 - RNA, 16 nt, Chlamydia trachomatis
gcaacugcuuucuuug

SEQ ID NO: 478887 - RNA, 17 nt, Chlamydia trachomatis
gcaagaauacaagaaag

SEQ ID NO: 478888 - RNA, 13 nt, Chlamydia trachomatis
gcaagaacuguau

SEQ ID NO: 478889 - RNA, 12 nt, Chlamydia trachomatis
gcaagaagaaga

SEQ ID NO: 478890 - RNA, 16 nt, Chlamydia trachomatis
gcaauaauuuccccua

SEQ ID NO: 478891 - RNA, 22 nt, Chlamydia trachomatis
gcaauaaggggaagaaauauuc

SEQ ID NO: 478892 - RNA, 18 nt, Chlamydia trachomatis
gcaaguucuccuucuugu

SEQ ID NO: 478893 - RNA, 17 nt, Chlamydia trachomatis
gcaaucauaucaagaau

SEQ ID NO: 478894 - RNA, 22 nt, Chlamydia trachomatis
gcaauccaguagacagcucuug

SEQ ID NO: 478895 - RNA, 20 nt, Chlamydia trachomatis
gcaaucauuugugugccaau

SEQ ID NO: 478896 - RNA, 22 nt, Chlamydia trachomatis
gcaauccuuuugauucugcucc

SEQ ID NO: 478897 - RNA, 23 nt, Chlamydia trachomatis
gcaauccuuuugauucugcucca

SEQ ID NO: 478898 - RNA, 17 nt, Chlamydia trachomatis
gcaaugccgaaaccaac

SEQ ID NO: 478899 - RNA, 16 nt, Chlamydia trachomatis
gcacaaaaucccuucc

SEQ ID NO: 478900 - RNA, 12 nt, Chlamydia trachomatis
gcacaacgccca

SEQ ID NO: 478901 - RNA, 14 nt, Chlamydia trachomatis
gcacaaauccagcu

SEQ ID NO: 478902 - RNA, 16 nt, Chlamydia trachomatis
gcacaaauccagcugc

SEQ ID NO: 478903 - RNA, 18 nt, Chlamydia trachomatis
gcacaaaucuuucuuucu

SEQ ID NO: 478904 - RNA, 22 nt, Chlamydia trachomatis
gcacaaaucuuucuuucuaaga

SEQ ID NO: 478905 - RNA, 17 nt, Chlamydia trachomatis
gcacagcaugaacagcu

SEQ ID NO: 478906 - RNA, 18 nt, Chlamydia trachomatis
gcacagguguaguaggga

SEQ ID NO: 478907 - RNA, 18 nt, Chlamydia trachomatis
gcacauccgcuucuucau

SEQ ID NO: 478908 - RNA, 22 nt, Chlamydia trachomatis
gcacauccguuucuagaagaac

SEQ ID NO: 478909 - RNA, 16 nt, Chlamydia trachomatis
gcacauuacuguacuc

SEQ ID NO: 478910 - RNA, 19 nt, Chlamydia trachomatis
gcacauuacuguacuccuc

SEQ ID NO: 478911 - RNA, 15 nt, Chlamydia trachomatis
gcaccaaguucuucu

SEQ ID NO: 478912 - RNA, 18 nt, Chlamydia trachomatis
gcaccauccauagugcca

SEQ ID NO: 478913 - RNA, 13 nt, Chlamydia trachomatis
gcacccacauuac

SEQ ID NO: 478914 - RNA, 24 nt, Chlamydia trachomatis
gcacuuccucuggcuuaucaacaa

SEQ ID NO: 478915 - RNA, 19 nt, Chlamydia trachomatis
gcacuuuguauaaugcaac

SEQ ID NO: 478916 - RNA, 13 nt, Chlamydia trachomatis
gcagaaccuucca

SEQ ID NO: 478917 - RNA, 21 nt, Chlamydia trachomatis
gcagaaacagcuucuucuucu

SEQ ID NO: 478918 - RNA, 22 nt, Chlamydia trachomatis
gcagaaacagcuucuucuucuc

SEQ ID NO: 478919 - RNA, 22 nt, Chlamydia trachomatis
gcagaaacaaauaacuuuuucu

SEQ ID NO: 478920 - RNA, 15 nt, Chlamydia trachomatis
gcagaaacaauuuca

SEQ ID NO: 478921 - RNA, 22 nt, Chlamydia trachomatis
gcagacaagccuucaggauucc

SEQ ID NO: 478922 - RNA, 19 nt, Chlamydia trachomatis
gcagagcacaaaucuuucu

SEQ ID NO: 478923 - RNA, 19 nt, Chlamydia trachomatis
gcagagaugauauuuucau

SEQ ID NO: 478924 - RNA, 18 nt, Chlamydia trachomatis
gcagagauaugaguggca

SEQ ID NO: 478925 - RNA, 17 nt, Chlamydia trachomatis
gcagaggauuuauaaag

SEQ ID NO: 478926 - RNA, 17 nt, Chlamydia trachomatis
gcagaggggggcuugca

SEQ ID NO: 478927 - RNA, 22 nt, Chlamydia trachomatis
gcagauaauucucgcaaagaau

SEQ ID NO: 478928 - RNA, 15 nt, Chlamydia trachomatis
gcagaucccagccug

SEQ ID NO: 478929 - RNA, 19 nt, Chlamydia trachomatis
gcagaugcuucugccuuuu

SEQ ID NO: 478930 - RNA, 19 nt, Chlamydia trachomatis
gcagccacuugcuccacac

SEQ ID NO: 478931 - RNA, 21 nt, Chlamydia trachomatis
gcagccacuccugcagcuaaa

SEQ ID NO: 478932 - RNA, 13 nt, Chlamydia trachomatis
gcagccccccuuu

SEQ ID NO: 478933 - RNA, 16 nt, Chlamydia trachomatis
gcagccuacauacaug

SEQ ID NO: 478934 - RNA, 13 nt, Chlamydia trachomatis
gcagcuaacagcu

SEQ ID NO: 478935 - RNA, 14 nt, Chlamydia trachomatis
gcagcuaacagcuc

SEQ ID NO: 478936 - RNA, 19 nt, Chlamydia trachomatis
gcagcuaaccaugcuccuu

SEQ ID NO: 478937 - RNA, 21 nt, Chlamydia trachomatis
gcagcuagaacauacccuaaa

SEQ ID NO: 478938 - RNA, 23 nt, Chlamydia trachomatis
gcaggcucaugaacagcaagagg

SEQ ID NO: 478939 - RNA, 20 nt, Chlamydia trachomatis
gcagguaccuauaauaauga

SEQ ID NO: 478940 - RNA, 17 nt, Chlamydia trachomatis
gcagguaucuagacaaa

SEQ ID NO: 478941 - RNA, 17 nt, Chlamydia trachomatis
gcaguuacauuuuucgc

SEQ ID NO: 478942 - RNA, 14 nt, Chlamydia trachomatis
gcaguuguuuucuu

SEQ ID NO: 478943 - RNA, 13 nt, Chlamydia trachomatis
gcauaaauuugcu

SEQ ID NO: 478944 - RNA, 21 nt, Chlamydia trachomatis
gcauaagcacuauaucuccaa

SEQ ID NO: 478945 - RNA, 18 nt, Chlamydia trachomatis
gcaguugaucauugauaa

SEQ ID NO: 478946 - RNA, 14 nt, Chlamydia trachomatis
gcauaccaaagcau

SEQ ID NO: 478947 - RNA, 14 nt, Chlamydia trachomatis
gcauacacaucaaa

SEQ ID NO: 478948 - RNA, 15 nt, Chlamydia trachomatis
gccacgauaagaucu

SEQ ID NO: 478949 - RNA, 18 nt, Chlamydia trachomatis
gccagaagcuaugagaau

SEQ ID NO: 478950 - RNA, 22 nt, Chlamydia trachomatis
gccagugcucaaagauuuuaug

SEQ ID NO: 478951 - RNA, 13 nt, Chlamydia trachomatis
gccaguucuucac

SEQ ID NO: 478952 - RNA, 23 nt, Chlamydia trachomatis
gcccagauuuuucaaaaauagca

SEQ ID NO: 478953 - RNA, 11 nt, Chlamydia trachomatis
gcccaucaucg

SEQ ID NO: 478954 - RNA, 14 nt, Chlamydia trachomatis
gcccaugagaaacc

SEQ ID NO: 478955 - RNA, 17 nt, Chlamydia trachomatis
gccgaugcccaagaaac

SEQ ID NO: 478956 - RNA, 23 nt, Chlamydia trachomatis
gccgaugguucuugugaggagcu

SEQ ID NO: 478957 - RNA, 19 nt, Chlamydia trachomatis
gccgcagaaaaaaccacag

SEQ ID NO: 478958 - RNA, 13 nt, Chlamydia trachomatis
gccuacaaauaaa

SEQ ID NO: 478959 - RNA, 13 nt, Chlamydia trachomatis
gccuacaagaccu

SEQ ID NO: 478960 - RNA, 14 nt, Chlamydia trachomatis
gccuauagaagacu

SEQ ID NO: 478961 - RNA, 16 nt, Chlamydia trachomatis
gccuauagaagacuaa

SEQ ID NO: 478962 - RNA, 18 nt, Chlamydia trachomatis
gccuauagagcaaucucu

SEQ ID NO: 478963 - RNA, 15 nt, Chlamydia trachomatis
gccuaucgcacacaa

SEQ ID NO: 478964 - RNA, 23 nt, Chlamydia trachomatis
gccuaucgcacacaauaaaucau

SEQ ID NO: 478965 - RNA, 14 nt, Chlamydia trachomatis
gccuccauuuccau

SEQ ID NO: 478966 - RNA, 17 nt, Chlamydia trachomatis
gccuccaucucugcuuc

SEQ ID NO: 478967 - RNA, 17 nt, Chlamydia trachomatis
gccuccggcucccaaca

SEQ ID NO: 478968 - RNA, 15 nt, Chlamydia trachomatis
gccucuaagcaccuu

SEQ ID NO: 478969 - RNA, 14 nt, Chlamydia trachomatis
gccucuaucucuuc

SEQ ID NO: 478970 - RNA, 16 nt, Chlamydia trachomatis
gccucuucucuuuuag

SEQ ID NO: 478971 - RNA, 20 nt, Chlamydia trachomatis
gccugcuccggcaaauccug

SEQ ID NO: 478972 - RNA, 14 nt, Chlamydia trachomatis
gccugcuuucuucu

SEQ ID NO: 478973 - RNA, 20 nt, Chlamydia trachomatis
gccuggagcacucucaacga

SEQ ID NO: 478974 - RNA, 21 nt, Chlamydia trachomatis
gccuguggcaacuaauuuuug

SEQ ID NO: 478975 - RNA, 13 nt, Chlamydia trachomatis
gccuguuucuuau

SEQ ID NO: 478976 - RNA, 14 nt, Chlamydia trachomatis
gccuguuucuuauc

SEQ ID NO: 478977 - RNA, 21 nt, Chlamydia trachomatis
gccuguuuucuuguagaaaaa

SEQ ID NO: 478978 - RNA, 16 nt, Chlamydia trachomatis
gccuucaauucuugcu

SEQ ID NO: 478979 - RNA, 17 nt, Chlamydia trachomatis
gccuucaauucuugcuu

SEQ ID NO: 478980 - RNA, 22 nt, Chlamydia trachomatis
gccuucaauucuugcuucaugu

SEQ ID NO: 478981 - RNA, 16 nt, Chlamydia trachomatis
gccuuacucaugacga

SEQ ID NO: 478982 - RNA, 16 nt, Chlamydia trachomatis
gccuucuuuuuccuca

SEQ ID NO: 478983 - RNA, 17 nt, Chlamydia trachomatis
gccuucuuuuuccucag

SEQ ID NO: 478984 - RNA, 19 nt, Chlamydia trachomatis
gccuucuuuuuccucagca

SEQ ID NO: 478985 - RNA, 18 nt, Chlamydia trachomatis
gccuuuuguuuucaaaag

SEQ ID NO: 478986 - RNA, 20 nt, Chlamydia trachomatis
gccuuuuguuuucaaaagcu

SEQ ID NO: 478987 - RNA, 16 nt, Chlamydia trachomatis
gccuuuuguuuucuug

SEQ ID NO: 478988 - RNA, 13 nt, Chlamydia trachomatis
gccuuuuauucuu

SEQ ID NO: 478989 - RNA, 16 nt, Chlamydia trachomatis
gccuuuuauucuucag

SEQ ID NO: 478990 - RNA, 16 nt, Chlamydia trachomatis
gccuuuaaccucugca

SEQ ID NO: 478991 - RNA, 11 nt, Chlamydia trachomatis
gcgaaaaaaaa

SEQ ID NO: 478992 - RNA, 18 nt, Chlamydia trachomatis
gcgacagcccaagaucuu

SEQ ID NO: 478993 - RNA, 17 nt, Chlamydia trachomatis
gcgaauuucucuaucug

SEQ ID NO: 478994 - RNA, 15 nt, Chlamydia trachomatis
gcgacugaucauggg

SEQ ID NO: 478995 - RNA, 21 nt, Chlamydia trachomatis
gcgaggcuuuuuuuuucauaa

SEQ ID NO: 478996 - RNA, 12 nt, Chlamydia trachomatis
gcgauaguucua

SEQ ID NO: 478997 - RNA, 18 nt, Chlamydia trachomatis
gcgauagaauuucuuccu

SEQ ID NO: 478998 - RNA, 15 nt, Chlamydia trachomatis
gcgauguaaaugaug

SEQ ID NO: 478999 - RNA, 18 nt, Chlamydia trachomatis
gcgcuagggucuucucug

SEQ ID NO: 479000 - RNA, 13 nt, Chlamydia trachomatis
gcgcucccauuuu

SEQ ID NO: 479001 - RNA, 15 nt, Chlamydia trachomatis
gcgcucccauuuuua

SEQ ID NO: 479002 - RNA, 22 nt, Chlamydia trachomatis
gcggcaguuguugggagagggu

SEQ ID NO: 479003 - RNA, 23 nt, Chlamydia trachomatis
gcggcauggaucuccagcuuaag

SEQ ID NO: 479004 - RNA, 15 nt, Chlamydia trachomatis
gcguaauuuucuagc

SEQ ID NO: 479005 - RNA, 21 nt, Chlamydia trachomatis
gcguaauuuucuagcuucuug

SEQ ID NO: 479006 - RNA, 17 nt, Chlamydia trachomatis
gcgucugcauaaaacuc

SEQ ID NO: 479007 - RNA, 14 nt, Chlamydia trachomatis
gcgucuuguuuaga

SEQ ID NO: 479008 - RNA, 15 nt, Chlamydia trachomatis
gcguuacagaugccu

SEQ ID NO: 479009 - RNA, 19 nt, Chlamydia trachomatis
gcguucgcgucuagcuuuu

SEQ ID NO: 479010 - RNA, 21 nt, Chlamydia trachomatis
gcguucgcgucuagcuuuuuu

SEQ ID NO: 479011 - RNA, 18 nt, Chlamydia trachomatis
gcguuuccgcggcugcgu

SEQ ID NO: 479012 - RNA, 22 nt, Chlamydia trachomatis
gcguucuucuauuaaagcuuua

SEQ ID NO: 479013 - RNA, 17 nt, Chlamydia trachomatis
gcguucuucugugaggc

SEQ ID NO: 479014 - RNA, 15 nt, Chlamydia trachomatis
gcuaaaaaauccagg

SEQ ID NO: 479015 - RNA, 10 nt, Chlamydia trachomatis
gcuacaccag

SEQ ID NO: 479016 - RNA, 14 nt, Chlamydia trachomatis
gcuacagucugucc

SEQ ID NO: 479017 - RNA, 18 nt, Chlamydia trachomatis
gcuaacagcucuucuucu

SEQ ID NO: 479018 - RNA, 19 nt, Chlamydia trachomatis
gcuaaccaugcuccuuuca

SEQ ID NO: 479019 - RNA, 16 nt, Chlamydia trachomatis
gcuaaccguucuugac

SEQ ID NO: 479020 - RNA, 12 nt, Chlamydia trachomatis
gcuaaaaccuua

SEQ ID NO: 479021 - RNA, 16 nt, Chlamydia trachomatis
gcuaaagcagaaacag

SEQ ID NO: 479022 - RNA, 22 nt, Chlamydia trachomatis
gcuaaagcagaaacagcuucuu

SEQ ID NO: 479023 - RNA, 13 nt, Chlamydia trachomatis
gcuaaagaaaaac

SEQ ID NO: 479024 - RNA, 19 nt, Chlamydia trachomatis
gcuaacucuugaaauucaa

SEQ ID NO: 479025 - RNA, 15 nt, Chlamydia trachomatis
gcuaacuuucuucca

SEQ ID NO: 479026 - RNA, 16 nt, Chlamydia trachomatis
gcuaacuuucuuccau

SEQ ID NO: 479027 - RNA, 13 nt, Chlamydia trachomatis
gcuaagagaagca

SEQ ID NO: 479028 - RNA, 13 nt, Chlamydia trachomatis
gcuaagaaaauaa

SEQ ID NO: 479029 - RNA, 12 nt, Chlamydia trachomatis
gcuaagaacaua

SEQ ID NO: 479030 - RNA, 22 nt, Chlamydia trachomatis
gcuaaggccuuauccaagcacu

SEQ ID NO: 479031 - RNA, 15 nt, Chlamydia trachomatis
gcuaaguauagaagc

SEQ ID NO: 479032 - RNA, 18 nt, Chlamydia trachomatis
gcuaaguauagaagccuc

SEQ ID NO: 479033 - RNA, 21 nt, Chlamydia trachomatis
gcuaaguuggcucguagagaa

SEQ ID NO: 479034 - RNA, 22 nt, Chlamydia trachomatis
gcuaaguuggcucguagagaac

SEQ ID NO: 479035 - RNA, 22 nt, Chlamydia trachomatis
gcuaauaacccgcuuugaaagu

SEQ ID NO: 479036 - RNA, 13 nt, Chlamydia trachomatis
gcuaaucaugaug

SEQ ID NO: 479037 - RNA, 22 nt, Chlamydia trachomatis
gcuaaucuuuuugauuuuucuu

SEQ ID NO: 479038 - RNA, 20 nt, Chlamydia trachomatis
gcuacugucgaacgcuucuu

SEQ ID NO: 479039 - RNA, 19 nt, Chlamydia trachomatis
gcuaggcaaauauccuaaa

SEQ ID NO: 479040 - RNA, 18 nt, Chlamydia trachomatis
gcuaggguucuaaagaaa

SEQ ID NO: 479041 - RNA, 19 nt, Chlamydia trachomatis
gcucaggaaucacaguaau

SEQ ID NO: 479042 - RNA, 11 nt, Chlamydia trachomatis
gcucagaaaac

SEQ ID NO: 479043 - RNA, 19 nt, Chlamydia trachomatis
gcucauuuuguaggagaaa

SEQ ID NO: 479044 - RNA, 13 nt, Chlamydia trachomatis
gcuccaaauaaaa

SEQ ID NO: 479045 - RNA, 17 nt, Chlamydia trachomatis
gcucauaaagagccguu

SEQ ID NO: 479046 - RNA, 14 nt, Chlamydia trachomatis
gcucaucaaacucu

SEQ ID NO: 479047 - RNA, 15 nt, Chlamydia trachomatis
gcucaucaaauagca

SEQ ID NO: 479048 - RNA, 15 nt, Chlamydia trachomatis
gcucaggcuaucaca

SEQ ID NO: 479049 - RNA, 17 nt, Chlamydia trachomatis
gcuccgagauuuucauc

SEQ ID NO: 479050 - RNA, 15 nt, Chlamydia trachomatis
gcuccguggcaagca

SEQ ID NO: 479051 - RNA, 17 nt, Chlamydia trachomatis
gcuccugcaagggaaca

SEQ ID NO: 479052 - RNA, 19 nt, Chlamydia trachomatis
gcucgaaaguugcucccaa

SEQ ID NO: 479053 - RNA, 16 nt, Chlamydia trachomatis
gcuccuaagcagugaa

SEQ ID NO: 479054 - RNA, 20 nt, Chlamydia trachomatis
gcuccuagagccaauccauu

SEQ ID NO: 479055 - RNA, 15 nt, Chlamydia trachomatis
gcuccuuucacuuca

SEQ ID NO: 479056 - RNA, 16 nt, Chlamydia trachomatis
gcucgcaauagauagu

SEQ ID NO: 479057 - RNA, 24 nt, Chlamydia trachomatis
gcucgcaguacuuuaccuguagga

SEQ ID NO: 479058 - RNA, 14 nt, Chlamydia trachomatis
ggaaugacauuccu

SEQ ID NO: 479059 - RNA, 16 nt, Chlamydia trachomatis
ggacaaacguccuccu

SEQ ID NO: 479060 - RNA, 21 nt, Chlamydia trachomatis
ggaauaaugauuuuuuuauuu

SEQ ID NO: 479061 - RNA, 18 nt, Chlamydia trachomatis
ggaauaauuuuccacaaa

SEQ ID NO: 479062 - RNA, 19 nt, Chlamydia trachomatis
ggaauagcuacuagauaga

SEQ ID NO: 479063 - RNA, 17 nt, Chlamydia trachomatis
ggaauagcuagagcaug

SEQ ID NO: 479064 - RNA, 22 nt, Chlamydia trachomatis
ggaauccuaagcgaugagcgag

SEQ ID NO: 479065 - RNA, 15 nt, Chlamydia trachomatis
ggaagugguuaaugu

SEQ ID NO: 479066 - RNA, 16 nt, Chlamydia trachomatis
ggaauaaaaguacuuc

SEQ ID NO: 479067 - RNA, 15 nt, Chlamydia trachomatis
ggaauaaacagguaa

SEQ ID NO: 479068 - RNA, 22 nt, Chlamydia trachomatis
ggaccagaucauagaaaugaug

SEQ ID NO: 479069 - RNA, 24 nt, Chlamydia trachomatis
ggaccucuugaggaagagagaaca

SEQ ID NO: 479070 - RNA, 14 nt, Chlamydia trachomatis
ggacugguuguucc

SEQ ID NO: 479071 - RNA, 14 nt, Chlamydia trachomatis
ggagauuccacaac

SEQ ID NO: 479072 - RNA, 17 nt, Chlamydia trachomatis
ggagauugccuuuucua

SEQ ID NO: 479073 - RNA, 15 nt, Chlamydia trachomatis
ggagauacagaaucu

SEQ ID NO: 479074 - RNA, 23 nt, Chlamydia trachomatis
ggagaguguuugcauucuuuuaa

SEQ ID NO: 479075 - RNA, 21 nt, Chlamydia trachomatis
ggagaacaagauaaagacccu

SEQ ID NO: 479076 - RNA, 14 nt, Chlamydia trachomatis
ggaguaagcuaauu

SEQ ID NO: 479077 - RNA, 12 nt, Chlamydia trachomatis
ggaguaaugauu

SEQ ID NO: 479078 - RNA, 14 nt, Chlamydia trachomatis
ggaguaccaaaaaa

SEQ ID NO: 479079 - RNA, 14 nt, Chlamydia trachomatis
ggaguacuucuaaa

SEQ ID NO: 479080 - RNA, 14 nt, Chlamydia trachomatis
ggaguaggaaggua

SEQ ID NO: 479081 - RNA, 15 nt, Chlamydia trachomatis
ggauagauagcucca

SEQ ID NO: 479082 - RNA, 22 nt, Chlamydia trachomatis
ggauagauagcuccaagggagg

SEQ ID NO: 479083 - RNA, 16 nt, Chlamydia trachomatis
ggaguuagccuaaaua

SEQ ID NO: 479084 - RNA, 18 nt, Chlamydia trachomatis
ggauaggcugaggauucc

SEQ ID NO: 479085 - RNA, 16 nt, Chlamydia trachomatis
ggagucugcuccaccu

SEQ ID NO: 479086 - RNA, 14 nt, Chlamydia trachomatis
ggaucucagcuggc

SEQ ID NO: 479087 - RNA, 14 nt, Chlamydia trachomatis
ggaucaauccccaa

SEQ ID NO: 479088 - RNA, 15 nt, Chlamydia trachomatis
ggauuacaaaagauu

SEQ ID NO: 479089 - RNA, 18 nt, Chlamydia trachomatis
ggauuacagcaagaagaa

SEQ ID NO: 479090 - RNA, 21 nt, Chlamydia trachomatis
ggauuuuaugaagcaaauaga

SEQ ID NO: 479091 - RNA, 22 nt, Chlamydia trachomatis
ggauuuucuucuuuuuuacaua

SEQ ID NO: 479092 - RNA, 18 nt, Chlamydia trachomatis
ggcaaaaauaccaaaaaa

SEQ ID NO: 479093 - RNA, 14 nt, Chlamydia trachomatis
ggcaaagagcuucu

SEQ ID NO: 479094 - RNA, 22 nt, Chlamydia trachomatis
ggcaaauccugcauuuauccac

SEQ ID NO: 479095 - RNA, 18 nt, Chlamydia trachomatis
ggcaacucucucucccca

SEQ ID NO: 479096 - RNA, 21 nt, Chlamydia trachomatis
ggcaacucucucuccccauaa

SEQ ID NO: 479097 - RNA, 18 nt, Chlamydia trachomatis
ggcaacuugagcaucugg

SEQ ID NO: 479098 - RNA, 19 nt, Chlamydia trachomatis
ggcaacuugagcaucugga

SEQ ID NO: 479099 - RNA, 22 nt, Chlamydia trachomatis
ggcaagaagcugcaguuucuga

SEQ ID NO: 479100 - RNA, 15 nt, Chlamydia trachomatis
ggcaauaaaagcugg

SEQ ID NO: 479101 - RNA, 14 nt, Chlamydia trachomatis
ggcaagucuaggag

SEQ ID NO: 479102 - RNA, 15 nt, Chlamydia trachomatis
ggcaagucuaggaga

SEQ ID NO: 479103 - RNA, 19 nt, Chlamydia trachomatis
ggcaaggcuuucaaaaaga

SEQ ID NO: 479104 - RNA, 22 nt, Chlamydia trachomatis
ggcaaggcuuucaaaaagagcu

SEQ ID NO: 479105 - RNA, 12 nt, Chlamydia trachomatis
ggcaaucugcau

SEQ ID NO: 479106 - RNA, 19 nt, Chlamydia trachomatis
ggcaauggcaaaaucuuca

SEQ ID NO: 479107 - RNA, 15 nt, Chlamydia trachomatis
ggcaccccuaaaaga

SEQ ID NO: 479108 - RNA, 21 nt, Chlamydia trachomatis
ggcaguucgcgucaguucgga

SEQ ID NO: 479109 - RNA, 20 nt, Chlamydia trachomatis
ggcaguuguugggagagggu

SEQ ID NO: 479110 - RNA, 13 nt, Chlamydia trachomatis
ggcauaaaagaga

SEQ ID NO: 479111 - RNA, 19 nt, Chlamydia trachomatis
ggcauaaaagagaagaacc

SEQ ID NO: 479112 - RNA, 19 nt, Chlamydia trachomatis
ggcaugagcgauaugcuuu

SEQ ID NO: 479113 - RNA, 21 nt, Chlamydia trachomatis
ggcauuccuuggcaaagagcu

SEQ ID NO: 479114 - RNA, 13 nt, Chlamydia trachomatis
ggccacaccauuc

SEQ ID NO: 479115 - RNA, 22 nt, Chlamydia trachomatis
ggccuucuuuuuccucagcaug

SEQ ID NO: 479116 - RNA, 14 nt, Chlamydia trachomatis
ggccuuuucuagag

SEQ ID NO: 479117 - RNA, 21 nt, Chlamydia trachomatis
ggccuuuuagcccuccuacuc

SEQ ID NO: 479118 - RNA, 20 nt, Chlamydia trachomatis
ggcgccuacuucuggaggag

SEQ ID NO: 479119 - RNA, 12 nt, Chlamydia trachomatis
ggcuaaagaaga

SEQ ID NO: 479120 - RNA, 14 nt, Chlamydia trachomatis
ggcguuguuucuaa

SEQ ID NO: 479121 - RNA, 15 nt, Chlamydia trachomatis
ggcuaucgucuuuaa

SEQ ID NO: 479122 - RNA, 19 nt, Chlamydia trachomatis
ggcucaugaacagcaagag

SEQ ID NO: 479123 - RNA, 13 nt, Chlamydia trachomatis
ggcuccuuaguua

SEQ ID NO: 479124 - RNA, 19 nt, Chlamydia trachomatis
ggcuccuaacaaagcucua

SEQ ID NO: 479125 - RNA, 17 nt, Chlamydia trachomatis
ggcucuuuaauauuucc

SEQ ID NO: 479126 - RNA, 16 nt, Chlamydia trachomatis
ggcucuccuaaugaug

SEQ ID NO: 479127 - RNA, 14 nt, Chlamydia trachomatis
ggcugcugcuugga

SEQ ID NO: 479128 - RNA, 23 nt, Chlamydia trachomatis
ggcuucgagcuguuuuugcaaca

SEQ ID NO: 479129 - RNA, 22 nt, Chlamydia trachomatis
ggcuucgggacgcccuacagga

SEQ ID NO: 479130 - RNA, 16 nt, Chlamydia trachomatis
gggaaaaaacuagaag

SEQ ID NO: 479131 - RNA, 11 nt, Chlamydia trachomatis
gggaaaaaauu

SEQ ID NO: 479132 - RNA, 15 nt, Chlamydia trachomatis
gggaaaaaguuugga

SEQ ID NO: 479133 - RNA, 19 nt, Chlamydia trachomatis
gggaacaaaaccaaaauca

SEQ ID NO: 479134 - RNA, 11 nt, Chlamydia trachomatis
gggaaagcugc

SEQ ID NO: 479135 - RNA, 11 nt, Chlamydia trachomatis
gggauggaaau

SEQ ID NO: 479136 - RNA, 22 nt, Chlamydia trachomatis
gggauaucuggauugugaagaa

SEQ ID NO: 479137 - RNA, 21 nt, Chlamydia trachomatis
gggcauacaccugcaagagau

SEQ ID NO: 479138 - RNA, 13 nt, Chlamydia trachomatis
gggccuugauauc

SEQ ID NO: 479139 - RNA, 14 nt, Chlamydia trachomatis
gggcugcugcuugg

SEQ ID NO: 479140 - RNA, 23 nt, Chlamydia trachomatis
ggggaaaucuuaucgagagaggg

SEQ ID NO: 479141 - RNA, 17 nt, Chlamydia trachomatis
gggcuuuugcaaacaau

SEQ ID NO: 479142 - RNA, 14 nt, Chlamydia trachomatis
ggggaccaaaaaag

SEQ ID NO: 479143 - RNA, 15 nt, Chlamydia trachomatis
gggucauaaacauau

SEQ ID NO: 479144 - RNA, 18 nt, Chlamydia trachomatis
ggguucuucugagcuaga

SEQ ID NO: 479145 - RNA, 23 nt, Chlamydia trachomatis
gguaacaaugcugauaaaaauaa

SEQ ID NO: 479146 - RNA, 16 nt, Chlamydia trachomatis
gguaccuauaauaaug

SEQ ID NO: 479147 - RNA, 12 nt, Chlamydia trachomatis
gguagaaaaaga

SEQ ID NO: 479148 - RNA, 14 nt, Chlamydia trachomatis
gguagaaaguccaa

SEQ ID NO: 479149 - RNA, 13 nt, Chlamydia trachomatis
gguaaucuucuau

SEQ ID NO: 479150 - RNA, 22 nt, Chlamydia trachomatis
gguaaugccuuuuguuuucaaa

SEQ ID NO: 479151 - RNA, 19 nt, Chlamydia trachomatis
ggucagcucauuagaauga

SEQ ID NO: 479152 - RNA, 19 nt, Chlamydia trachomatis
ggucgcuugauucuugaau

SEQ ID NO: 479153 - RNA, 21 nt, Chlamydia trachomatis
ggucggagguucgaauccuuc

SEQ ID NO: 479154 - RNA, 19 nt, Chlamydia trachomatis
ggugaaagcuagaagaauc

SEQ ID NO: 479155 - RNA, 21 nt, Chlamydia trachomatis
ggucuuuuaauaagaccucuu

SEQ ID NO: 479156 - RNA, 20 nt, Chlamydia trachomatis
ggugaguuucccuucguccc

SEQ ID NO: 479157 - RNA, 14 nt, Chlamydia trachomatis
ggugagugcauaga

SEQ ID NO: 479158 - RNA, 16 nt, Chlamydia trachomatis
ggugagugcauagaga

SEQ ID NO: 479159 - RNA, 18 nt, Chlamydia trachomatis
ggugcagaagaauaggaa

SEQ ID NO: 479160 - RNA, 21 nt, Chlamydia trachomatis
gguguccgcuaccugacuaca

SEQ ID NO: 479161 - RNA, 16 nt, Chlamydia trachomatis
gguggacuuaacuacu

SEQ ID NO: 479162 - RNA, 15 nt, Chlamydia trachomatis
guaaucaaaaaagga

SEQ ID NO: 479163 - RNA, 11 nt, Chlamydia trachomatis
guaauagcuac

SEQ ID NO: 479164 - RNA, 15 nt, Chlamydia trachomatis
guaauaaacccugga

SEQ ID NO: 479165 - RNA, 17 nt, Chlamydia trachomatis
guaagggacaacagggu

SEQ ID NO: 479166 - RNA, 13 nt, Chlamydia trachomatis
guaagggagguuu

SEQ ID NO: 479167 - RNA, 20 nt, Chlamydia trachomatis
guaagggagguuuuuggcuu

SEQ ID NO: 479168 - RNA, 14 nt, Chlamydia trachomatis
guaaggagagaaaa

SEQ ID NO: 479169 - RNA, 11 nt, Chlamydia trachomatis
guaagagcaga

SEQ ID NO: 479170 - RNA, 20 nt, Chlamydia trachomatis
guaagaccgagauuaucauu

SEQ ID NO: 479171 - RNA, 20 nt, Chlamydia trachomatis
guaagaucuguagcaagaag

SEQ ID NO: 479172 - RNA, 13 nt, Chlamydia trachomatis
guaagaauaaagg

SEQ ID NO: 479173 - RNA, 15 nt, Chlamydia trachomatis
guaacuacaucuaaa

SEQ ID NO: 479174 - RNA, 20 nt, Chlamydia trachomatis
guaaccagcggcaaaaauau

SEQ ID NO: 479175 - RNA, 21 nt, Chlamydia trachomatis
guaaacaauauucuuuuccau

SEQ ID NO: 479176 - RNA, 16 nt, Chlamydia trachomatis
guaaaaucuaaaauau

SEQ ID NO: 479177 - RNA, 13 nt, Chlamydia trachomatis
guaaacaaaagau

SEQ ID NO: 479178 - RNA, 16 nt, Chlamydia trachomatis
guaaacaagaauaaua

SEQ ID NO: 479179 - RNA, 14 nt, Chlamydia trachomatis
guaacaccaaaaaa

SEQ ID NO: 479180 - RNA, 21 nt, Chlamydia trachomatis
guaaauuucaucccacaugcu

SEQ ID NO: 479181 - RNA, 19 nt, Chlamydia trachomatis
guaacacggccauuauaaa

SEQ ID NO: 479182 - RNA, 20 nt, Chlamydia trachomatis
guaaaguaacuacggaaaaa

SEQ ID NO: 479183 - RNA, 16 nt, Chlamydia trachomatis
guaaauauuuugccau

SEQ ID NO: 479184 - RNA, 22 nt, Chlamydia trachomatis
guaaucguauaaguuuuaagaa

SEQ ID NO: 479185 - RNA, 13 nt, Chlamydia trachomatis
guaauguccucuu

SEQ ID NO: 479186 - RNA, 22 nt, Chlamydia trachomatis
guaccaaggauuuuuuucccac

SEQ ID NO: 479187 - RNA, 19 nt, Chlamydia trachomatis
guaccauuacuacaacagg

SEQ ID NO: 479188 - RNA, 16 nt, Chlamydia trachomatis
guaccucgagcaacga

SEQ ID NO: 479189 - RNA, 14 nt, Chlamydia trachomatis
guacucaucuuuuu

SEQ ID NO: 479190 - RNA, 17 nt, Chlamydia trachomatis
guagagcauacucuaaa

SEQ ID NO: 479191 - RNA, 14 nt, Chlamydia trachomatis
guacuucuaaaauu

SEQ ID NO: 479192 - RNA, 15 nt, Chlamydia trachomatis
guaggccacaagaug

SEQ ID NO: 479193 - RNA, 14 nt, Chlamydia trachomatis
guagcugaugaagc

SEQ ID NO: 479194 - RNA, 15 nt, Chlamydia trachomatis
guagauaucuuuacu

SEQ ID NO: 479195 - RNA, 22 nt, Chlamydia trachomatis
guagaucuguuagugaagagca

SEQ ID NO: 479196 - RNA, 14 nt, Chlamydia trachomatis
guaguguuuccuga

SEQ ID NO: 479197 - RNA, 13 nt, Chlamydia trachomatis
guauaagaaaaag

SEQ ID NO: 479198 - RNA, 17 nt, Chlamydia trachomatis
guauaaguuuuaagaag

SEQ ID NO: 479199 - RNA, 18 nt, Chlamydia trachomatis
guauaaguuuuaagaaga

SEQ ID NO: 479200 - RNA, 23 nt, Chlamydia trachomatis
guaguccacauucacuucaacuc

SEQ ID NO: 479201 - RNA, 14 nt, Chlamydia trachomatis
guagguugucacug

SEQ ID NO: 479202 - RNA, 20 nt, Chlamydia trachomatis
guagguuucugcuaaaucca

SEQ ID NO: 479203 - RNA, 20 nt, Chlamydia trachomatis
gucaaaaagaucuucaacaa

SEQ ID NO: 479204 - RNA, 14 nt, Chlamydia trachomatis
guauuuuuguuucu

SEQ ID NO: 479205 - RNA, 22 nt, Chlamydia trachomatis
gucaacaucauaaccaaucgau

SEQ ID NO: 479206 - RNA, 15 nt, Chlamydia trachomatis
gucaauuucuggaga

SEQ ID NO: 479207 - RNA, 21 nt, Chlamydia trachomatis
gucagaauaauauuuuuuccc

SEQ ID NO: 479208 - RNA, 19 nt, Chlamydia trachomatis
gucagaccuacaaagauaa

SEQ ID NO: 479209 - RNA, 18 nt, Chlamydia trachomatis
gucagaagauacuuuaau

SEQ ID NO: 479210 - RNA, 16 nt, Chlamydia trachomatis
gucagaucauuuuaau

SEQ ID NO: 479211 - RNA, 23 nt, Chlamydia trachomatis
gucacugcuuccgaaagcauguu

SEQ ID NO: 479212 - RNA, 15 nt, Chlamydia trachomatis
gucaggauuuucuag

SEQ ID NO: 479213 - RNA, 21 nt, Chlamydia trachomatis
gucauagaaaauggcugcuug

SEQ ID NO: 479214 - RNA, 20 nt, Chlamydia trachomatis
gucauagaucgguugcaucc

SEQ ID NO: 479215 - RNA, 20 nt, Chlamydia trachomatis
guccauacaaagguaaaugg

SEQ ID NO: 479216 - RNA, 13 nt, Chlamydia trachomatis
gucauugauucua

SEQ ID NO: 479217 - RNA, 15 nt, Chlamydia trachomatis
gucauugcuugcucg

SEQ ID NO: 479218 - RNA, 14 nt, Chlamydia trachomatis
gucccaucuugcac

SEQ ID NO: 479219 - RNA, 19 nt, Chlamydia trachomatis
guccaugauuucuuuaaca

SEQ ID NO: 479220 - RNA, 14 nt, Chlamydia trachomatis
guccggacuuuccu

SEQ ID NO: 479221 - RNA, 17 nt, Chlamydia trachomatis
guccugcuucuuuuucc

SEQ ID NO: 479222 - RNA, 12 nt, Chlamydia trachomatis
guccugagccaa

SEQ ID NO: 479223 - RNA, 13 nt, Chlamydia trachomatis
guccugaagcaau

SEQ ID NO: 479224 - RNA, 14 nt, Chlamydia trachomatis
guccucuauuuccu

SEQ ID NO: 479225 - RNA, 23 nt, Chlamydia trachomatis
guccuucuuuaccgauaauuuua

SEQ ID NO: 479226 - RNA, 19 nt, Chlamydia trachomatis
guccuuccauggauaaaau

SEQ ID NO: 479227 - RNA, 14 nt, Chlamydia trachomatis
guccuuccauggcc

SEQ ID NO: 479228 - RNA, 23 nt, Chlamydia trachomatis
guccuuaucuucuugagaaaacu

SEQ ID NO: 479229 - RNA, 22 nt, Chlamydia trachomatis
gucgauuggaucagcuccuauc

SEQ ID NO: 479230 - RNA, 18 nt, Chlamydia trachomatis
gucgauuuuuaaaagacc

SEQ ID NO: 479231 - RNA, 20 nt, Chlamydia trachomatis
gucgcauuccaagaagaacu

SEQ ID NO: 479232 - RNA, 20 nt, Chlamydia trachomatis
gugccaccgaagggacuuuu

SEQ ID NO: 479233 - RNA, 17 nt, Chlamydia trachomatis
gugcagaggauuuauaa

SEQ ID NO: 479234 - RNA, 21 nt, Chlamydia trachomatis
gugaugcggagcgaugagcuu

SEQ ID NO: 479235 - RNA, 12 nt, Chlamydia trachomatis
gugaugaaauug

SEQ ID NO: 479236 - RNA, 19 nt, Chlamydia trachomatis
gucgcuuagauauuuucac

SEQ ID NO: 479237 - RNA, 13 nt, Chlamydia trachomatis
gugaucuuuugcu

SEQ ID NO: 479238 - RNA, 15 nt, Chlamydia trachomatis
gugcgaggaauucuu

SEQ ID NO: 479239 - RNA, 15 nt, Chlamydia trachomatis
gugcuaaaucuccaa

SEQ ID NO: 479240 - RNA, 15 nt, Chlamydia trachomatis
gugcuaacuuucuuc

SEQ ID NO: 479241 - RNA, 14 nt, Chlamydia trachomatis
guggcaagggggag

SEQ ID NO: 479242 - RNA, 18 nt, Chlamydia trachomatis
gugcuugcauagauagau

SEQ ID NO: 479243 - RNA, 22 nt, Chlamydia trachomatis
gugcuguauuauuagguuuaua

SEQ ID NO: 479244 - RNA, 17 nt, Chlamydia trachomatis
gugguaacaccaaaaaa

SEQ ID NO: 479245 - RNA, 16 nt, Chlamydia trachomatis
gugguuguagaggaga

SEQ ID NO: 479246 - RNA, 17 nt, Chlamydia trachomatis
gugguguugcaccacgu

SEQ ID NO: 479247 - RNA, 20 nt, Chlamydia trachomatis
guuaauaucccacucuuccc

SEQ ID NO: 479248 - RNA, 18 nt, Chlamydia trachomatis
guuaauuaauaagccuuu

SEQ ID NO: 479249 - RNA, 14 nt, Chlamydia trachomatis
guuacaagacaaua

SEQ ID NO: 479250 - RNA, 23 nt, Chlamydia trachomatis
gugugacuguaaguuuauuccaa

SEQ ID NO: 479251 - RNA, 23 nt, Chlamydia trachomatis
guguacuuuugguucugccaguu

SEQ ID NO: 479252 - RNA, 22 nt, Chlamydia trachomatis
guguaauuuccuauuucuucgc

SEQ ID NO: 479253 - RNA, 14 nt, Chlamydia trachomatis
guguacauuagcaa

SEQ ID NO: 479254 - RNA, 14 nt, Chlamydia trachomatis
guguaaucauuuuc

SEQ ID NO: 479255 - RNA, 15 nt, Chlamydia trachomatis
guguguaaccuuccc

SEQ ID NO: 479256 - RNA, 17 nt, Chlamydia trachomatis
guguugaaugucuuuuu

SEQ ID NO: 479257 - RNA, 11 nt, Chlamydia trachomatis
guguuuccaaa

SEQ ID NO: 479258 - RNA, 17 nt, Chlamydia trachomatis
guguuugcauucuuuua

SEQ ID NO: 479259 - RNA, 16 nt, Chlamydia trachomatis
guuccuaauagaucua

SEQ ID NO: 479260 - RNA, 19 nt, Chlamydia trachomatis
guuccugcauacuuuucaa

SEQ ID NO: 479261 - RNA, 23 nt, Chlamydia trachomatis
guuccucguuuuuuuagauaaga

SEQ ID NO: 479262 - RNA, 21 nt, Chlamydia trachomatis
guucaucaagguggccauucu

SEQ ID NO: 479263 - RNA, 20 nt, Chlamydia trachomatis
guucacugacuguagaaaau

SEQ ID NO: 479264 - RNA, 19 nt, Chlamydia trachomatis
guuacuugcuccguggcaa

SEQ ID NO: 479265 - RNA, 16 nt, Chlamydia trachomatis
guuacuuuucucaaaa

SEQ ID NO: 479266 - RNA, 20 nt, Chlamydia trachomatis
guuacuuuucucaaaacgcu

SEQ ID NO: 479267 - RNA, 14 nt, Chlamydia trachomatis
guuagaaaugcaaa

SEQ ID NO: 479268 - RNA, 13 nt, Chlamydia trachomatis
guuagcaucaucc

SEQ ID NO: 479269 - RNA, 14 nt, Chlamydia trachomatis
guucacuaugaaca

SEQ ID NO: 479270 - RNA, 12 nt, Chlamydia trachomatis
guucuaaagaaa

SEQ ID NO: 479271 - RNA, 15 nt, Chlamydia trachomatis
guucuaaagaaaagc

SEQ ID NO: 479272 - RNA, 18 nt, Chlamydia trachomatis
guucuaaacccucugcau

SEQ ID NO: 479273 - RNA, 20 nt, Chlamydia trachomatis
guucuaacacuuuuuuuucu

SEQ ID NO: 479274 - RNA, 21 nt, Chlamydia trachomatis
guucuaacacuuuuuuuucuu

SEQ ID NO: 479275 - RNA, 17 nt, Chlamydia trachomatis
guucuucugagcuagaa

SEQ ID NO: 479276 - RNA, 15 nt, Chlamydia trachomatis
guucuucuuccacag

SEQ ID NO: 479277 - RNA, 13 nt, Chlamydia trachomatis
guucuugcugaga

SEQ ID NO: 479278 - RNA, 19 nt, Chlamydia trachomatis
guucuuuuaggcaacagcu

SEQ ID NO: 479279 - RNA, 15 nt, Chlamydia trachomatis
guucuuuugcaaaaa

SEQ ID NO: 479280 - RNA, 20 nt, Chlamydia trachomatis
guugaauaacguuuuaaaca

SEQ ID NO: 479281 - RNA, 14 nt, Chlamydia trachomatis
guugaauuucagga

SEQ ID NO: 479282 - RNA, 15 nt, Chlamydia trachomatis
guugagcagcaaaga

SEQ ID NO: 479283 - RNA, 23 nt, Chlamydia trachomatis
guugauaaacucggguuuuaaau

SEQ ID NO: 479284 - RNA, 12 nt, Chlamydia trachomatis
guugaugguuuc

SEQ ID NO: 479285 - RNA, 22 nt, Chlamydia trachomatis
guugcaaacgguagcgauuuuc

SEQ ID NO: 479286 - RNA, 15 nt, Chlamydia trachomatis
guugcaucaacaaua

SEQ ID NO: 479287 - RNA, 14 nt, Chlamydia trachomatis
guugcaccacgugc

SEQ ID NO: 479288 - RNA, 13 nt, Chlamydia trachomatis
guugcacuuuccg

SEQ ID NO: 479289 - RNA, 19 nt, Chlamydia trachomatis
guugccuuuaucucccccu

SEQ ID NO: 479290 - RNA, 18 nt, Chlamydia trachomatis
guugcucccaucaacucu

SEQ ID NO: 479291 - RNA, 13 nt, Chlamydia trachomatis
guugcugagcuuu

SEQ ID NO: 479292 - RNA, 15 nt, Chlamydia trachomatis
guuggcauuuugggc

SEQ ID NO: 479293 - RNA, 24 nt, Chlamydia trachomatis
guugggagaggguguugaauauuu

SEQ ID NO: 479294 - RNA, 20 nt, Chlamydia trachomatis
guugguagaggagaacaaga

SEQ ID NO: 479295 - RNA, 18 nt, Chlamydia trachomatis
guuuaucuaauuuuagau

SEQ ID NO: 479296 - RNA, 20 nt, Chlamydia trachomatis
guuuaucauugaaaucagaa

SEQ ID NO: 479297 - RNA, 20 nt, Chlamydia trachomatis
guuucugagaaaucuaaaac

SEQ ID NO: 479298 - RNA, 13 nt, Chlamydia trachomatis
guuucuacuuuuu

SEQ ID NO: 479299 - RNA, 19 nt, Chlamydia trachomatis
guuucuccuaaaguuggua

SEQ ID NO: 479300 - RNA, 19 nt, Chlamydia trachomatis
guuucuagaagaacucccc

SEQ ID NO: 479301 - RNA, 17 nt, Chlamydia trachomatis
guuucuaggucugaaga

SEQ ID NO: 479302 - RNA, 14 nt, Chlamydia trachomatis
guuuaaaagcccac

SEQ ID NO: 479303 - RNA, 15 nt, Chlamydia trachomatis
guuguagaggagaag

SEQ ID NO: 479304 - RNA, 22 nt, Chlamydia trachomatis
guuguaucagcaaccauauauu

SEQ ID NO: 479305 - RNA, 14 nt, Chlamydia trachomatis
guuuagcaagacau

SEQ ID NO: 479306 - RNA, 20 nt, Chlamydia trachomatis
guuuagggugaucuuuugcu

SEQ ID NO: 479307 - RNA, 17 nt, Chlamydia trachomatis
guuuauaaauuucuaaa

SEQ ID NO: 479308 - RNA, 17 nt, Chlamydia trachomatis
uaaaaggcguaaaccuu

SEQ ID NO: 479309 - RNA, 22 nt, Chlamydia trachomatis
uaaaaggcuuauucucuuuaua

SEQ ID NO: 479310 - RNA, 17 nt, Chlamydia trachomatis
uaaaauaaucuuguaau

SEQ ID NO: 479311 - RNA, 14 nt, Chlamydia trachomatis
uaaaaucuaaaaua

SEQ ID NO: 479312 - RNA, 20 nt, Chlamydia trachomatis
uaaaauggaaauaaaaagcc

SEQ ID NO: 479313 - RNA, 17 nt, Chlamydia trachomatis
uaaaauuccuacgcaga

SEQ ID NO: 479314 - RNA, 19 nt, Chlamydia trachomatis
uaaaauuucauacgcacag

SEQ ID NO: 479315 - RNA, 15 nt, Chlamydia trachomatis
uaaaauuuuacguaa

SEQ ID NO: 479316 - RNA, 17 nt, Chlamydia trachomatis
uaaacaaaaacucucaa

SEQ ID NO: 479317 - RNA, 21 nt, Chlamydia trachomatis
uaaacaaaaacucucaaaucg

SEQ ID NO: 479318 - RNA, 18 nt, Chlamydia trachomatis
uaaacaagguucuucaac

SEQ ID NO: 479319 - RNA, 13 nt, Chlamydia trachomatis
uaaacaauauucu

SEQ ID NO: 479320 - RNA, 19 nt, Chlamydia trachomatis
uaaacaauauucuuuucca

SEQ ID NO: 479321 - RNA, 23 nt, Chlamydia trachomatis
uaaacacaaguaugagaggaaga

SEQ ID NO: 479322 - RNA, 18 nt, Chlamydia trachomatis
uaaacagaucuuuuucau

SEQ ID NO: 479323 - RNA, 19 nt, Chlamydia trachomatis
uaaacagaucuuuuucauu

SEQ ID NO: 479324 - RNA, 19 nt, Chlamydia trachomatis
uaaaaaccuugauaagagu

SEQ ID NO: 479325 - RNA, 17 nt, Chlamydia trachomatis
uaaaaacuauaaggaau

SEQ ID NO: 479326 - RNA, 23 nt, Chlamydia trachomatis
uaaaaacuggagaauccauaacg

SEQ ID NO: 479327 - RNA, 15 nt, Chlamydia trachomatis
uaaaaagaaacaaaa

SEQ ID NO: 479328 - RNA, 18 nt, Chlamydia trachomatis
guuugauuuccucuucuu

SEQ ID NO: 479329 - RNA, 17 nt, Chlamydia trachomatis
uaaaaagcccagaacaa

SEQ ID NO: 479330 - RNA, 23 nt, Chlamydia trachomatis
uaaaaagcccuuuccucauaaag

SEQ ID NO: 479331 - RNA, 15 nt, Chlamydia trachomatis
uaaaaagccauacaa

SEQ ID NO: 479332 - RNA, 18 nt, Chlamydia trachomatis
uaaaaagcugggcagcaa

SEQ ID NO: 479333 - RNA, 22 nt, Chlamydia trachomatis
uaaaaagcugggcagcaagaga

SEQ ID NO: 479334 - RNA, 17 nt, Chlamydia trachomatis
uaaaaauaauuuaauua

SEQ ID NO: 479335 - RNA, 15 nt, Chlamydia trachomatis
uaaaaauagaaaacg

SEQ ID NO: 479336 - RNA, 17 nt, Chlamydia trachomatis
uaaaaauagaaaacguc

SEQ ID NO: 479337 - RNA, 20 nt, Chlamydia trachomatis
uaaaaauuccauguugucau

SEQ ID NO: 479338 - RNA, 14 nt, Chlamydia trachomatis
uaaaacaaccauaa

SEQ ID NO: 479339 - RNA, 15 nt, Chlamydia trachomatis
uaaaacauuucugca

SEQ ID NO: 479340 - RNA, 17 nt, Chlamydia trachomatis
uaaaacuacagaaagag

SEQ ID NO: 479341 - RNA, 22 nt, Chlamydia trachomatis
uaaaagaagcagcgcuuaucag

SEQ ID NO: 479342 - RNA, 17 nt, Chlamydia trachomatis
uaaaagacagaacaaac

SEQ ID NO: 479343 - RNA, 19 nt, Chlamydia trachomatis
uaaaagacagaacaaacga

SEQ ID NO: 479344 - RNA, 20 nt, Chlamydia trachomatis
uaaaagacagaacaaacgaa

SEQ ID NO: 479345 - RNA, 17 nt, Chlamydia trachomatis
uaaaagagcuucuucua

SEQ ID NO: 479346 - RNA, 23 nt, Chlamydia trachomatis
uaaaagagcuucuucuaaagaau

SEQ ID NO: 479347 - RNA, 13 nt, Chlamydia trachomatis
uaaaagaguaagu

SEQ ID NO: 479348 - RNA, 23 nt, Chlamydia trachomatis
uaaaagcugcuuuauccaaagau

SEQ ID NO: 479349 - RNA, 16 nt, Chlamydia trachomatis
uaaaagcuguaugcca

SEQ ID NO: 479350 - RNA, 18 nt, Chlamydia trachomatis
uaaaagcuguaugccaau

SEQ ID NO: 479351 - RNA, 15 nt, Chlamydia trachomatis
uaaacccucugcaua

SEQ ID NO: 479352 - RNA, 17 nt, Chlamydia trachomatis
uaaagcugcuuuacauc

SEQ ID NO: 479353 - RNA, 21 nt, Chlamydia trachomatis
uaaagcugcuuuacaucccuu

SEQ ID NO: 479354 - RNA, 17 nt, Chlamydia trachomatis
uaaagcuuuuguuaacc

SEQ ID NO: 479355 - RNA, 14 nt, Chlamydia trachomatis
uaaagcuuuuucca

SEQ ID NO: 479356 - RNA, 21 nt, Chlamydia trachomatis
uaaaggaauaauuuuccacaa

SEQ ID NO: 479357 - RNA, 16 nt, Chlamydia trachomatis
uaaaggauaaggaaga

SEQ ID NO: 479358 - RNA, 17 nt, Chlamydia trachomatis
uaaaggauaaggaagaa

SEQ ID NO: 479359 - RNA, 20 nt, Chlamydia trachomatis
uaaaggauaaggaagaagau

SEQ ID NO: 479360 - RNA, 21 nt, Chlamydia trachomatis
uaaagcucgaaucgaaccuuc

SEQ ID NO: 479361 - RNA, 12 nt, Chlamydia trachomatis
uaaagauucugu

SEQ ID NO: 479362 - RNA, 14 nt, Chlamydia trachomatis
uaaagaagacuucg

SEQ ID NO: 479363 - RNA, 22 nt, Chlamydia trachomatis
uaaagaagacuucgaggcuccc

SEQ ID NO: 479364 - RNA, 22 nt, Chlamydia trachomatis
uaaagauaacacucucaucuaa

SEQ ID NO: 479365 - RNA, 23 nt, Chlamydia trachomatis
uaaagaaauaaccggaacaauca

SEQ ID NO: 479366 - RNA, 19 nt, Chlamydia trachomatis
uaaauauucauauguuaca

SEQ ID NO: 479367 - RNA, 15 nt, Chlamydia trachomatis
uaaaucauggaugua

SEQ ID NO: 479368 - RNA, 15 nt, Chlamydia trachomatis
uaaauccuauacccg

SEQ ID NO: 479369 - RNA, 19 nt, Chlamydia trachomatis
uaaagucacuacuucaucg

SEQ ID NO: 479370 - RNA, 16 nt, Chlamydia trachomatis
uaaaggcucuguuaac

SEQ ID NO: 479371 - RNA, 12 nt, Chlamydia trachomatis
uaaagggaaaaa

SEQ ID NO: 479372 - RNA, 13 nt, Chlamydia trachomatis
uaaagggaaaaaa

SEQ ID NO: 479373 - RNA, 21 nt, Chlamydia trachomatis
uaaauaaguccuuaucuucuu

SEQ ID NO: 479374 - RNA, 16 nt, Chlamydia trachomatis
uaaauaauacaaagga

SEQ ID NO: 479375 - RNA, 15 nt, Chlamydia trachomatis
uaacaucaaagaucu

SEQ ID NO: 479376 - RNA, 14 nt, Chlamydia trachomatis
uaacaucaacugau

SEQ ID NO: 479377 - RNA, 19 nt, Chlamydia trachomatis
uaacaucaacugauucguu

SEQ ID NO: 479378 - RNA, 20 nt, Chlamydia trachomatis
uaacagcucuucuucugaag

SEQ ID NO: 479379 - RNA, 18 nt, Chlamydia trachomatis
uaacacuuuuuuuucuuu

SEQ ID NO: 479380 - RNA, 10 nt, Chlamydia trachomatis
uaacaggaag

SEQ ID NO: 479381 - RNA, 22 nt, Chlamydia trachomatis
uaacagggauggucucacacaa

SEQ ID NO: 479382 - RNA, 23 nt, Chlamydia trachomatis
uaacaucuacgaguuucucgcag

SEQ ID NO: 479383 - RNA, 13 nt, Chlamydia trachomatis
uaaccaaacagga

SEQ ID NO: 479384 - RNA, 15 nt, Chlamydia trachomatis
uaaccaaauagguau

SEQ ID NO: 479385 - RNA, 11 nt, Chlamydia trachomatis
uaaauguggag

SEQ ID NO: 479386 - RNA, 15 nt, Chlamydia trachomatis
uaaauguucaugaaa

SEQ ID NO: 479387 - RNA, 23 nt, Chlamydia trachomatis
uaacaacaaugucaacauaauag

SEQ ID NO: 479388 - RNA, 13 nt, Chlamydia trachomatis
uaacaaccaucaa

SEQ ID NO: 479389 - RNA, 23 nt, Chlamydia trachomatis
uaacaacucuccuaauucaacau

SEQ ID NO: 479390 - RNA, 15 nt, Chlamydia trachomatis
uaacaaggcuuuucc

SEQ ID NO: 479391 - RNA, 16 nt, Chlamydia trachomatis
uaacaaggcuuuucca

SEQ ID NO: 479392 - RNA, 21 nt, Chlamydia trachomatis
uaacaaggcuuuuccauuccu

SEQ ID NO: 479393 - RNA, 21 nt, Chlamydia trachomatis
uaacaauauuacgaauuucug

SEQ ID NO: 479394 - RNA, 13 nt, Chlamydia trachomatis
uaacaauccccaa

SEQ ID NO: 479395 - RNA, 21 nt, Chlamydia trachomatis
uaacaauccccaaaccaguuu

SEQ ID NO: 479396 - RNA, 14 nt, Chlamydia trachomatis
uaacaccucuucug

SEQ ID NO: 479397 - RNA, 22 nt, Chlamydia trachomatis
uaacgcaucccgaaucccaucu

SEQ ID NO: 479398 - RNA, 15 nt, Chlamydia trachomatis
uaaccccauguuuuu

SEQ ID NO: 479399 - RNA, 18 nt, Chlamydia trachomatis
uaaccucuacgaaaaagu

SEQ ID NO: 479400 - RNA, 13 nt, Chlamydia trachomatis
uaacgguuccauu

SEQ ID NO: 479401 - RNA, 14 nt, Chlamydia trachomatis
uaacguagauaucu

SEQ ID NO: 479402 - RNA, 15 nt, Chlamydia trachomatis
uaacuacggaaaaag

SEQ ID NO: 479403 - RNA, 18 nt, Chlamydia trachomatis
uaacuacucccaaaucaa

SEQ ID NO: 479404 - RNA, 19 nt, Chlamydia trachomatis
uaacuacucccaaaucaaa

SEQ ID NO: 479405 - RNA, 12 nt, Chlamydia trachomatis
uaacuaggguug

SEQ ID NO: 479406 - RNA, 22 nt, Chlamydia trachomatis
uaacucaccuaaauucagaucc

SEQ ID NO: 479407 - RNA, 16 nt, Chlamydia trachomatis
uaacuccaucaggaau

SEQ ID NO: 479408 - RNA, 13 nt, Chlamydia trachomatis
uaacucuucugga

SEQ ID NO: 479409 - RNA, 13 nt, Chlamydia trachomatis
uaacuggaguuuu

SEQ ID NO: 479410 - RNA, 22 nt, Chlamydia trachomatis
uaacuuccguaccaaggauuuu

SEQ ID NO: 479411 - RNA, 12 nt, Chlamydia trachomatis
uaacuuaugaaa

SEQ ID NO: 479412 - RNA, 13 nt, Chlamydia trachomatis
uaacuuuuucucu

SEQ ID NO: 479413 - RNA, 21 nt, Chlamydia trachomatis
uaagaaacacaccgggagcau

SEQ ID NO: 479414 - RNA, 14 nt, Chlamydia trachomatis
uaagaaauuaacac

SEQ ID NO: 479415 - RNA, 15 nt, Chlamydia trachomatis
uaagaaccgcaagca

SEQ ID NO: 479416 - RNA, 10 nt, Chlamydia trachomatis
uaagaagaga

SEQ ID NO: 479417 - RNA, 20 nt, Chlamydia trachomatis
uaagaagucuuguccuuccc

SEQ ID NO: 479418 - RNA, 15 nt, Chlamydia trachomatis
uaagaauaaacaaca

SEQ ID NO: 479419 - RNA, 15 nt, Chlamydia trachomatis
uaagaauaaagauga

SEQ ID NO: 479420 - RNA, 13 nt, Chlamydia trachomatis
uaagaauacaaag

SEQ ID NO: 479421 - RNA, 23 nt, Chlamydia trachomatis
uaagaauuaacccaaaagaucca

SEQ ID NO: 479422 - RNA, 20 nt, Chlamydia trachomatis
uaagaccgaaauuaguaaua

SEQ ID NO: 479423 - RNA, 18 nt, Chlamydia trachomatis
uaagaccgagauuaucau

SEQ ID NO: 479424 - RNA, 19 nt, Chlamydia trachomatis
uaagaccgagauuaucauu

SEQ ID NO: 479425 - RNA, 15 nt, Chlamydia trachomatis
uaagaccuaguaagu

SEQ ID NO: 479426 - RNA, 20 nt, Chlamydia trachomatis
uaagaccuaguaagugcaua

SEQ ID NO: 479427 - RNA, 22 nt, Chlamydia trachomatis
uaagacucaaauuuucaugaaa

SEQ ID NO: 479428 - RNA, 18 nt, Chlamydia trachomatis
uaagacuuucucuaacaa

SEQ ID NO: 479429 - RNA, 18 nt, Chlamydia trachomatis
uaagacuuugugcaaccu

SEQ ID NO: 479430 - RNA, 18 nt, Chlamydia trachomatis
uaagagcagagcuuuuac

SEQ ID NO: 479431 - RNA, 21 nt, Chlamydia trachomatis
uaagagcagagcuuuuacuuc

SEQ ID NO: 479432 - RNA, 17 nt, Chlamydia trachomatis
uaagaguccuaauaguc

SEQ ID NO: 479433 - RNA, 22 nt, Chlamydia trachomatis
uaagauauugccaaaaagaaaa

SEQ ID NO: 479434 - RNA, 12 nt, Chlamydia trachomatis
uaagauuauaau

SEQ ID NO: 479435 - RNA, 18 nt, Chlamydia trachomatis
uaagaucuuuacuuucuu

SEQ ID NO: 479436 - RNA, 20 nt, Chlamydia trachomatis
uaagaucucuacauaagucu

SEQ ID NO: 479437 - RNA, 14 nt, Chlamydia trachomatis
uaagaucuguagca

SEQ ID NO: 479438 - RNA, 14 nt, Chlamydia trachomatis
uaagauuccucuug

SEQ ID NO: 479439 - RNA, 15 nt, Chlamydia trachomatis
uaagauugaugacaa

SEQ ID NO: 479440 - RNA, 18 nt, Chlamydia trachomatis
uaagauuuucaucuucca

SEQ ID NO: 479441 - RNA, 11 nt, Chlamydia trachomatis
uaagcaacaac

SEQ ID NO: 479442 - RNA, 23 nt, Chlamydia trachomatis
uaagcaacaacugcucugccaua

SEQ ID NO: 479443 - RNA, 18 nt, Chlamydia trachomatis
uaagcacuauaucuccaa

SEQ ID NO: 479444 - RNA, 17 nt, Chlamydia trachomatis
uaagcuucucaacacug

SEQ ID NO: 479445 - RNA, 16 nt, Chlamydia trachomatis
uaagccucauccccuu

SEQ ID NO: 479446 - RNA, 15 nt, Chlamydia trachomatis
uaagccgcucuguca

SEQ ID NO: 479447 - RNA, 13 nt, Chlamydia trachomatis
uaagcgaaaaaaa

SEQ ID NO: 479448 - RNA, 18 nt, Chlamydia trachomatis
uaagcgaaaaaaaaagaa

SEQ ID NO: 479449 - RNA, 20 nt, Chlamydia trachomatis
uaagcgaaaaaaaaagaaca

SEQ ID NO: 479450 - RNA, 14 nt, Chlamydia trachomatis
uaagcgcaagaaac

SEQ ID NO: 479451 - RNA, 22 nt, Chlamydia trachomatis
uaagcgcaagaaacugaaagau

SEQ ID NO: 479452 - RNA, 18 nt, Chlamydia trachomatis
uaaucgaucacagaaacg

SEQ ID NO: 479453 - RNA, 20 nt, Chlamydia trachomatis
uaaucccauaaaagccauag

SEQ ID NO: 479454 - RNA, 14 nt, Chlamydia trachomatis
uaaucgcuucugcu

SEQ ID NO: 479455 - RNA, 23 nt, Chlamydia trachomatis
uaaucggauagagaagaauugaa

SEQ ID NO: 479456 - RNA, 22 nt, Chlamydia trachomatis
uaaucggcaaaagaucucauag

SEQ ID NO: 479457 - RNA, 14 nt, Chlamydia trachomatis
uaaucuaucuggau

SEQ ID NO: 479458 - RNA, 23 nt, Chlamydia trachomatis
uaaucuccuaaccgguaaucaaa

SEQ ID NO: 479459 - RNA, 16 nt, Chlamydia trachomatis
uaaucucguuucuguu

SEQ ID NO: 479460 - RNA, 17 nt, Chlamydia trachomatis
uaaucugcuuaucuccg

SEQ ID NO: 479461 - RNA, 21 nt, Chlamydia trachomatis
uaauauuuuuucccuuucaua

SEQ ID NO: 479462 - RNA, 22 nt, Chlamydia trachomatis
uaauauuuuuucccuuucauaa

SEQ ID NO: 479463 - RNA, 17 nt, Chlamydia trachomatis
uaauauuuuuugcgaag

SEQ ID NO: 479464 - RNA, 21 nt, Chlamydia trachomatis
uaauauuagauagcuucuuaa

SEQ ID NO: 479465 - RNA, 17 nt, Chlamydia trachomatis
uaaucaauugaaagucu

SEQ ID NO: 479466 - RNA, 19 nt, Chlamydia trachomatis
uaaucaguugaaagacuug

SEQ ID NO: 479467 - RNA, 21 nt, Chlamydia trachomatis
uaaucaguuguggggcuccua

SEQ ID NO: 479468 - RNA, 20 nt, Chlamydia trachomatis
uaaucuuguaauaucaaaga

SEQ ID NO: 479469 - RNA, 15 nt, Chlamydia trachomatis
uaauggaugaucugu

SEQ ID NO: 479470 - RNA, 19 nt, Chlamydia trachomatis
uaauuaaagguuucccaaa

SEQ ID NO: 479471 - RNA, 22 nt, Chlamydia trachomatis
uaauuaauaacgcccucuuuuc

SEQ ID NO: 479472 - RNA, 17 nt, Chlamydia trachomatis
uaauuccaaauaauacu

SEQ ID NO: 479473 - RNA, 19 nt, Chlamydia trachomatis
uaauuccaaugaggaugug

SEQ ID NO: 479474 - RNA, 16 nt, Chlamydia trachomatis
uaauuccaucuuuucg

SEQ ID NO: 479475 - RNA, 18 nt, Chlamydia trachomatis
uaauucgaacaucaacca

SEQ ID NO: 479476 - RNA, 19 nt, Chlamydia trachomatis
uaauugcuguuaagauaag

SEQ ID NO: 479477 - RNA, 20 nt, Chlamydia trachomatis
uaagggaaucauaaggaaga

SEQ ID NO: 479478 - RNA, 15 nt, Chlamydia trachomatis
uaaggggaagauuga

SEQ ID NO: 479479 - RNA, 18 nt, Chlamydia trachomatis
uaaggacguuuggagcau

SEQ ID NO: 479480 - RNA, 20 nt, Chlamydia trachomatis
uaaggacuaguccugaagca

SEQ ID NO: 479481 - RNA, 18 nt, Chlamydia trachomatis
uaaggauggugcggagca

SEQ ID NO: 479482 - RNA, 17 nt, Chlamydia trachomatis
uaagguggcacacucca

SEQ ID NO: 479483 - RNA, 19 nt, Chlamydia trachomatis
uaagucaccauuuucucga

SEQ ID NO: 479484 - RNA, 15 nt, Chlamydia trachomatis
uaagucucuugccuu

SEQ ID NO: 479485 - RNA, 15 nt, Chlamydia trachomatis
uaagucugccacuac

SEQ ID NO: 479486 - RNA, 20 nt, Chlamydia trachomatis
uaaguuaacccuaccccuaa

SEQ ID NO: 479487 - RNA, 12 nt, Chlamydia trachomatis
uaaguuccuuag

SEQ ID NO: 479488 - RNA, 15 nt, Chlamydia trachomatis
uaaguuuuaagaaga

SEQ ID NO: 479489 - RNA, 17 nt, Chlamydia trachomatis
uaauaaaagcuccuaaa

SEQ ID NO: 479490 - RNA, 21 nt, Chlamydia trachomatis
uaauaaaaggcuuauucucuu

SEQ ID NO: 479491 - RNA, 19 nt, Chlamydia trachomatis
uaauaaaagggcucucucc

SEQ ID NO: 479492 - RNA, 21 nt, Chlamydia trachomatis
uaauaaauauuaucagaccuu

SEQ ID NO: 479493 - RNA, 11 nt, Chlamydia trachomatis
uaauaacugca

SEQ ID NO: 479494 - RNA, 18 nt, Chlamydia trachomatis
uaauaagaccucuuuuuu

SEQ ID NO: 479495 - RNA, 14 nt, Chlamydia trachomatis
uaauaaguuuuuca

SEQ ID NO: 479496 - RNA, 22 nt, Chlamydia trachomatis
uaauaauaagagcuacaggaac

SEQ ID NO: 479497 - RNA, 13 nt, Chlamydia trachomatis
uaauacaaagcac

SEQ ID NO: 479498 - RNA, 15 nt, Chlamydia trachomatis
uaauacgaauaagag

SEQ ID NO: 479499 - RNA, 16 nt, Chlamydia trachomatis
uaauacgaauaagagu

SEQ ID NO: 479500 - RNA, 14 nt, Chlamydia trachomatis
uaauacuaaacuau

SEQ ID NO: 479501 - RNA, 13 nt, Chlamydia trachomatis
uaauacucuucua

SEQ ID NO: 479502 - RNA, 20 nt, Chlamydia trachomatis
uaauacugacccauccaaaa

SEQ ID NO: 479503 - RNA, 22 nt, Chlamydia trachomatis
uaauacugacccauccaaaaca

SEQ ID NO: 479504 - RNA, 18 nt, Chlamydia trachomatis
uacaacaaguuccuggau

SEQ ID NO: 479505 - RNA, 23 nt, Chlamydia trachomatis
uacaaagguaaauggugaaacuu

SEQ ID NO: 479506 - RNA, 23 nt, Chlamydia trachomatis
uacaaaguggcguuguuucuaau

SEQ ID NO: 479507 - RNA, 19 nt, Chlamydia trachomatis
uacaaccugggcauacacc

SEQ ID NO: 479508 - RNA, 19 nt, Chlamydia trachomatis
uacaauagguuuaaauaag

SEQ ID NO: 479509 - RNA, 14 nt, Chlamydia trachomatis
uacaaucaguaagu

SEQ ID NO: 479510 - RNA, 22 nt, Chlamydia trachomatis
uacaaugaccgaagguucuucu

SEQ ID NO: 479511 - RNA, 17 nt, Chlamydia trachomatis
uacagauuuuucgaaaa

SEQ ID NO: 479512 - RNA, 18 nt, Chlamydia trachomatis
uacagauuuuucgaaaau

SEQ ID NO: 479513 - RNA, 13 nt, Chlamydia trachomatis
uacagcaagaaga

SEQ ID NO: 479514 - RNA, 22 nt, Chlamydia trachomatis
uacagcaaaaccuuuugaaaca

SEQ ID NO: 479515 - RNA, 21 nt, Chlamydia trachomatis
uacagaucauaggcuccugca

SEQ ID NO: 479516 - RNA, 16 nt, Chlamydia trachomatis
uacagagagcuuuuuu

SEQ ID NO: 479517 - RNA, 19 nt, Chlamydia trachomatis
uacagaguuaccaaucacg

SEQ ID NO: 479518 - RNA, 14 nt, Chlamydia trachomatis
uacaauguaaacaa

SEQ ID NO: 479519 - RNA, 17 nt, Chlamydia trachomatis
uacaauguacgcuaaaa

SEQ ID NO: 479520 - RNA, 19 nt, Chlamydia trachomatis
uacaauguacgcuaaaaac

SEQ ID NO: 479521 - RNA, 22 nt, Chlamydia trachomatis
uacacagaaagaaccuccuuua

SEQ ID NO: 479522 - RNA, 18 nt, Chlamydia trachomatis
uacagaacauuucucguc

SEQ ID NO: 479523 - RNA, 16 nt, Chlamydia trachomatis
uacagacaucuaaagu

SEQ ID NO: 479524 - RNA, 20 nt, Chlamydia trachomatis
uacagacaucuaaagucuga

SEQ ID NO: 479525 - RNA, 13 nt, Chlamydia trachomatis
uacagacgaaaac

SEQ ID NO: 479526 - RNA, 16 nt, Chlamydia trachomatis
uacagacgcauagaau

SEQ ID NO: 479527 - RNA, 19 nt, Chlamydia trachomatis
uaccaaaaaacauuccugc

SEQ ID NO: 479528 - RNA, 17 nt, Chlamydia trachomatis
uacauucgccucuucuc

SEQ ID NO: 479529 - RNA, 21 nt, Chlamydia trachomatis
uacauucgccucuucucuuuu

SEQ ID NO: 479530 - RNA, 17 nt, Chlamydia trachomatis
uaccaagccauuuccag

SEQ ID NO: 479531 - RNA, 24 nt, Chlamydia trachomatis
uaccaaucacgcuacaugcaggau

SEQ ID NO: 479532 - RNA, 21 nt, Chlamydia trachomatis
uaccaauggaccagaucauag

SEQ ID NO: 479533 - RNA, 20 nt, Chlamydia trachomatis
uaccaacugagcuauuuagg

SEQ ID NO: 479534 - RNA, 17 nt, Chlamydia trachomatis
uaccaaaauaucauaau

SEQ ID NO: 479535 - RNA, 12 nt, Chlamydia trachomatis
uaccaaaccuuu

SEQ ID NO: 479536 - RNA, 16 nt, Chlamydia trachomatis
uaccaaagaauucuug

SEQ ID NO: 479537 - RNA, 22 nt, Chlamydia trachomatis
uacaugauagucagaauaauau

SEQ ID NO: 479538 - RNA, 10 nt, Chlamydia trachomatis
uacaucaucu

SEQ ID NO: 479539 - RNA, 15 nt, Chlamydia trachomatis
uacaucaucucucag

SEQ ID NO: 479540 - RNA, 18 nt, Chlamydia trachomatis
uacaucaucucucagcag

SEQ ID NO: 479541 - RNA, 19 nt, Chlamydia trachomatis
uacaucaucucucagcaga

SEQ ID NO: 479542 - RNA, 20 nt, Chlamydia trachomatis
uacaucccuugaacuagaaa

SEQ ID NO: 479543 - RNA, 17 nt, Chlamydia trachomatis
uacaucgguguugaacc

SEQ ID NO: 479544 - RNA, 24 nt, Chlamydia trachomatis
uacauaggcauacaggagagacau

SEQ ID NO: 479545 - RNA, 14 nt, Chlamydia trachomatis
uacaucacugcaac

SEQ ID NO: 479546 - RNA, 19 nt, Chlamydia trachomatis
uacaucacugcaacuaaua

SEQ ID NO: 479547 - RNA, 21 nt, Chlamydia trachomatis
uacaggucaagccuacagcua

SEQ ID NO: 479548 - RNA, 17 nt, Chlamydia trachomatis
uacagcggauuagucgu

SEQ ID NO: 479549 - RNA, 21 nt, Chlamydia trachomatis
uaccgucucuugucagaagag

SEQ ID NO: 479550 - RNA, 15 nt, Chlamydia trachomatis
uaccgauaauuuuac

SEQ ID NO: 479551 - RNA, 15 nt, Chlamydia trachomatis
uaccgacuucaacuu

SEQ ID NO: 479552 - RNA, 21 nt, Chlamydia trachomatis
uaccuaaacaaggauuuucuu

SEQ ID NO: 479553 - RNA, 16 nt, Chlamydia trachomatis
uaccuaaagaagccau

SEQ ID NO: 479554 - RNA, 15 nt, Chlamydia trachomatis
uaccugcuucuauag

SEQ ID NO: 479555 - RNA, 23 nt, Chlamydia trachomatis
uaccuggaaaggagaaaguaauu

SEQ ID NO: 479556 - RNA, 19 nt, Chlamydia trachomatis
uaccucuaaagauccucuu

SEQ ID NO: 479557 - RNA, 15 nt, Chlamydia trachomatis
uaccugauagagucc

SEQ ID NO: 479558 - RNA, 16 nt, Chlamydia trachomatis
uacccgauucaaaaau

SEQ ID NO: 479559 - RNA, 14 nt, Chlamydia trachomatis
uaccauucacaccg

SEQ ID NO: 479560 - RNA, 16 nt, Chlamydia trachomatis
uacccaggcuuuucuu

SEQ ID NO: 479561 - RNA, 17 nt, Chlamydia trachomatis
uacccaggcuuuucuuu

SEQ ID NO: 479562 - RNA, 16 nt, Chlamydia trachomatis
uaccacauucucuuuu

SEQ ID NO: 479563 - RNA, 18 nt, Chlamydia trachomatis
uaccacaauuuuucuugu

SEQ ID NO: 479564 - RNA, 14 nt, Chlamydia trachomatis
uaccaguucuugga

SEQ ID NO: 479565 - RNA, 14 nt, Chlamydia trachomatis
uaccauagguucuu

SEQ ID NO: 479566 - RNA, 16 nt, Chlamydia trachomatis
uacgcucuuucuuacg

SEQ ID NO: 479567 - RNA, 19 nt, Chlamydia trachomatis
uacgcuuccuacagcuaga

SEQ ID NO: 479568 - RNA, 15 nt, Chlamydia trachomatis
uacguuagcaaagac

SEQ ID NO: 479569 - RNA, 18 nt, Chlamydia trachomatis
uacuaaacuaucuaaaau

SEQ ID NO: 479570 - RNA, 19 nt, Chlamydia trachomatis
uacuaacaaauagggaggu

SEQ ID NO: 479571 - RNA, 20 nt, Chlamydia trachomatis
uacuacaacaggaccagaga

SEQ ID NO: 479572 - RNA, 18 nt, Chlamydia trachomatis
uacgcaaagugcuaauaa

SEQ ID NO: 479573 - RNA, 21 nt, Chlamydia trachomatis
uacgcaaguauuggagacaac

SEQ ID NO: 479574 - RNA, 15 nt, Chlamydia trachomatis
uaccugggaaaacuu

SEQ ID NO: 479575 - RNA, 14 nt, Chlamydia trachomatis
uaccuguaggagga

SEQ ID NO: 479576 - RNA, 23 nt, Chlamydia trachomatis
uaccuguaggaggacaagcgacu

SEQ ID NO: 479577 - RNA, 14 nt, Chlamydia trachomatis
uaccugugaagaaa

SEQ ID NO: 479578 - RNA, 20 nt, Chlamydia trachomatis
uacgagcugaccuuuuacuu

SEQ ID NO: 479579 - RNA, 15 nt, Chlamydia trachomatis
uacgaguaucuguua

SEQ ID NO: 479580 - RNA, 18 nt, Chlamydia trachomatis
uacuagauagauggcauu

SEQ ID NO: 479581 - RNA, 23 nt, Chlamydia trachomatis
uacuaucaggaauaaugauuuuu

SEQ ID NO: 479582 - RNA, 13 nt, Chlamydia trachomatis
uagaaacagccug

SEQ ID NO: 479583 - RNA, 14 nt, Chlamydia trachomatis
uagaaacuuacuuu

SEQ ID NO: 479584 - RNA, 18 nt, Chlamydia trachomatis
uagaaacuuacuuuucuu

SEQ ID NO: 479585 - RNA, 11 nt, Chlamydia trachomatis
uagaaagaauu

SEQ ID NO: 479586 - RNA, 13 nt, Chlamydia trachomatis
uagaaagaggcuu

SEQ ID NO: 479587 - RNA, 16 nt, Chlamydia trachomatis
uagaaagggcuuuaua

SEQ ID NO: 479588 - RNA, 18 nt, Chlamydia trachomatis
uagaaaugcaaauuugca

SEQ ID NO: 479589 - RNA, 21 nt, Chlamydia trachomatis
uagaacagauuuagagaauaa

SEQ ID NO: 479590 - RNA, 18 nt, Chlamydia trachomatis
uagaaguagucuacucca

SEQ ID NO: 479591 - RNA, 16 nt, Chlamydia trachomatis
uagaagccaauguucu

SEQ ID NO: 479592 - RNA, 12 nt, Chlamydia trachomatis
uagaaggucuga

SEQ ID NO: 479593 - RNA, 13 nt, Chlamydia trachomatis
uagaagaagagga

SEQ ID NO: 479594 - RNA, 17 nt, Chlamydia trachomatis
uagaagauaacaacucu

SEQ ID NO: 479595 - RNA, 23 nt, Chlamydia trachomatis
uagaagauccuucgcaggggaau

SEQ ID NO: 479596 - RNA, 17 nt, Chlamydia trachomatis
uagaagaaaagagcuuu

SEQ ID NO: 479597 - RNA, 15 nt, Chlamydia trachomatis
uagaacggcauuccc

SEQ ID NO: 479598 - RNA, 14 nt, Chlamydia trachomatis
uagaauuucuucuu

SEQ ID NO: 479599 - RNA, 12 nt, Chlamydia trachomatis
uagagaaaagaa

SEQ ID NO: 479600 - RNA, 11 nt, Chlamydia trachomatis
uagagaauaau

SEQ ID NO: 479601 - RNA, 20 nt, Chlamydia trachomatis
uagagaauggguaaggggaa

SEQ ID NO: 479602 - RNA, 18 nt, Chlamydia trachomatis
uagacgauccgcuuccug

SEQ ID NO: 479603 - RNA, 19 nt, Chlamydia trachomatis
uagacgauccgcuuccugc

SEQ ID NO: 479604 - RNA, 19 nt, Chlamydia trachomatis
uagacugcgcauccacuac

SEQ ID NO: 479605 - RNA, 16 nt, Chlamydia trachomatis
uagacuggcauagucu

SEQ ID NO: 479606 - RNA, 20 nt, Chlamydia trachomatis
uagaccaggauuccccguca

SEQ ID NO: 479607 - RNA, 18 nt, Chlamydia trachomatis
uagacaacguuuaaugaa

SEQ ID NO: 479608 - RNA, 13 nt, Chlamydia trachomatis
uagacagcucuug

SEQ ID NO: 479609 - RNA, 16 nt, Chlamydia trachomatis
uagauacugguaacug

SEQ ID NO: 479610 - RNA, 14 nt, Chlamydia trachomatis
uagauagagauucc

SEQ ID NO: 479611 - RNA, 19 nt, Chlamydia trachomatis
uagauagagauuccacuac

SEQ ID NO: 479612 - RNA, 15 nt, Chlamydia trachomatis
uagauagaagagcuu

SEQ ID NO: 479613 - RNA, 16 nt, Chlamydia trachomatis
uagaguccugagccaa

SEQ ID NO: 479614 - RNA, 15 nt, Chlamydia trachomatis
uagagucucuaaaau

SEQ ID NO: 479615 - RNA, 14 nt, Chlamydia trachomatis
uagaguuuuaaguu

SEQ ID NO: 479616 - RNA, 20 nt, Chlamydia trachomatis
uagagaguucguuaggauuc

SEQ ID NO: 479617 - RNA, 15 nt, Chlamydia trachomatis
uagagauaaaaucag

SEQ ID NO: 479618 - RNA, 22 nt, Chlamydia trachomatis
uagagauaucccuaaagaggca

SEQ ID NO: 479619 - RNA, 15 nt, Chlamydia trachomatis
uagaggaaacacugu

SEQ ID NO: 479620 - RNA, 17 nt, Chlamydia trachomatis
uagaggaaugugaagaa

SEQ ID NO: 479621 - RNA, 16 nt, Chlamydia trachomatis
uagaggcuauugauuu

SEQ ID NO: 479622 - RNA, 16 nt, Chlamydia trachomatis
uagaggcauggaaugg

SEQ ID NO: 479623 - RNA, 13 nt, Chlamydia trachomatis
uagagcucuucuc

SEQ ID NO: 479624 - RNA, 19 nt, Chlamydia trachomatis
uagagccccuauguaaaca

SEQ ID NO: 479625 - RNA, 23 nt, Chlamydia trachomatis
uagagccccuauguaaacaagaa

SEQ ID NO: 479626 - RNA, 12 nt, Chlamydia trachomatis
uagccaucaucg

SEQ ID NO: 479627 - RNA, 13 nt, Chlamydia trachomatis
uagccauccgguc

SEQ ID NO: 479628 - RNA, 16 nt, Chlamydia trachomatis
uagccauaccaaugga

SEQ ID NO: 479629 - RNA, 13 nt, Chlamydia trachomatis
uagccaaggaaga

SEQ ID NO: 479630 - RNA, 20 nt, Chlamydia trachomatis
uagccacugcacaucacaga

SEQ ID NO: 479631 - RNA, 22 nt, Chlamydia trachomatis
uagccuuuagauaguuacuucc

SEQ ID NO: 479632 - RNA, 19 nt, Chlamydia trachomatis
uagcgaagucuucuaucac

SEQ ID NO: 479633 - RNA, 16 nt, Chlamydia trachomatis
uagccuggcugcagaa

SEQ ID NO: 479634 - RNA, 20 nt, Chlamydia trachomatis
uagccuccaaacauuuugag

SEQ ID NO: 479635 - RNA, 19 nt, Chlamydia trachomatis
uagccuccgcuaauuuuug

SEQ ID NO: 479636 - RNA, 21 nt, Chlamydia trachomatis
uagcaccagcuaauaaguuca

SEQ ID NO: 479637 - RNA, 15 nt, Chlamydia trachomatis
uagcacgcaaaacau

SEQ ID NO: 479638 - RNA, 18 nt, Chlamydia trachomatis
uagcauuugucuucgcaa

SEQ ID NO: 479639 - RNA, 17 nt, Chlamydia trachomatis
uagaucaagaaaagaua

SEQ ID NO: 479640 - RNA, 21 nt, Chlamydia trachomatis
uagaucccuuucauucuuucg

SEQ ID NO: 479641 - RNA, 22 nt, Chlamydia trachomatis
uagaucuaaagcagaaacaauu

SEQ ID NO: 479642 - RNA, 23 nt, Chlamydia trachomatis
uagaucuaaggaauguggagcua

SEQ ID NO: 479643 - RNA, 17 nt, Chlamydia trachomatis
uagauaucuuuacucuu

SEQ ID NO: 479644 - RNA, 22 nt, Chlamydia trachomatis
uagcaauaaccugaccuugaac

SEQ ID NO: 479645 - RNA, 23 nt, Chlamydia trachomatis
uagcaaugaaggcgcuagggucu

SEQ ID NO: 479646 - RNA, 20 nt, Chlamydia trachomatis
uagcaaugcgaucagaaacg

SEQ ID NO: 479647 - RNA, 21 nt, Chlamydia trachomatis
uagcacaaguugguagcagcu

SEQ ID NO: 479648 - RNA, 24 nt, Chlamydia trachomatis
uagcuucuaauuucuuucucaugc

SEQ ID NO: 479649 - RNA, 13 nt, Chlamydia trachomatis
uagcuucugacuc

SEQ ID NO: 479650 - RNA, 20 nt, Chlamydia trachomatis
uagcuuuccucacacacaaa

SEQ ID NO: 479651 - RNA, 22 nt, Chlamydia trachomatis
uagcuuuccucacacacaaaaa

SEQ ID NO: 479652 - RNA, 15 nt, Chlamydia trachomatis
uagcuuuuuucagaa

SEQ ID NO: 479653 - RNA, 17 nt, Chlamydia trachomatis
uaggaaaauacacagca

SEQ ID NO: 479654 - RNA, 18 nt, Chlamydia trachomatis
uagcuucguagagcaaga

SEQ ID NO: 479655 - RNA, 15 nt, Chlamydia trachomatis
uagcugaugaagcga

SEQ ID NO: 479656 - RNA, 21 nt, Chlamydia trachomatis
uagcucguuuuuuuguuguug

SEQ ID NO: 479657 - RNA, 15 nt, Chlamydia trachomatis
uagcugaacccuuca

SEQ ID NO: 479658 - RNA, 21 nt, Chlamydia trachomatis
uagcugacuuugaagauucua

SEQ ID NO: 479659 - RNA, 14 nt, Chlamydia trachomatis
uagcuccaagggag

SEQ ID NO: 479660 - RNA, 13 nt, Chlamydia trachomatis
uagcucagagauu

SEQ ID NO: 479661 - RNA, 14 nt, Chlamydia trachomatis
uagcuaaacccaau

SEQ ID NO: 479662 - RNA, 16 nt, Chlamydia trachomatis
uagcgauuuucugaag

SEQ ID NO: 479663 - RNA, 22 nt, Chlamydia trachomatis
uaggagcuuuuugcaaugcaaa

SEQ ID NO: 479664 - RNA, 17 nt, Chlamydia trachomatis
uaggaggucgcccucuu

SEQ ID NO: 479665 - RNA, 14 nt, Chlamydia trachomatis
uaggaaugcccaaa

SEQ ID NO: 479666 - RNA, 19 nt, Chlamydia trachomatis
uaggaacuacauucgccuc

SEQ ID NO: 479667 - RNA, 23 nt, Chlamydia trachomatis
uaggaacucccucauuaagaaua

SEQ ID NO: 479668 - RNA, 18 nt, Chlamydia trachomatis
uaggaaggguuuugaagc

SEQ ID NO: 479669 - RNA, 21 nt, Chlamydia trachomatis
uaggaaggguuuugaagcuug

SEQ ID NO: 479670 - RNA, 21 nt, Chlamydia trachomatis
uaggcgacacgcuucuucaaa

SEQ ID NO: 479671 - RNA, 17 nt, Chlamydia trachomatis
uaggauaggaaaugaga

SEQ ID NO: 479672 - RNA, 14 nt, Chlamydia trachomatis
uaggaucccaagga

SEQ ID NO: 479673 - RNA, 17 nt, Chlamydia trachomatis
uaggaucccaaggaaau

SEQ ID NO: 479674 - RNA, 21 nt, Chlamydia trachomatis
uaggauccccacgaccacaaa

SEQ ID NO: 479675 - RNA, 21 nt, Chlamydia trachomatis
uagggaauaaaaguacuucua

SEQ ID NO: 479676 - RNA, 22 nt, Chlamydia trachomatis
uagggagcacauuacuguacuc

SEQ ID NO: 479677 - RNA, 15 nt, Chlamydia trachomatis
uagggagguuuuguu

SEQ ID NO: 479678 - RNA, 16 nt, Chlamydia trachomatis
uaggggaagaaucaau

SEQ ID NO: 479679 - RNA, 19 nt, Chlamydia trachomatis
uagggggaguucuauuuau

SEQ ID NO: 479680 - RNA, 12 nt, Chlamydia trachomatis
uaggguuguuuu

SEQ ID NO: 479681 - RNA, 15 nt, Chlamydia trachomatis
uaggguuguuuuaga

SEQ ID NO: 479682 - RNA, 20 nt, Chlamydia trachomatis
uaguuuuaauuccaucuuuu

SEQ ID NO: 479683 - RNA, 22 nt, Chlamydia trachomatis
uaguuuucccaucuacaaaacc

SEQ ID NO: 479684 - RNA, 17 nt, Chlamydia trachomatis
uaguuuuguaaacgaga

SEQ ID NO: 479685 - RNA, 18 nt, Chlamydia trachomatis
uauaaauccugcgcuguu

SEQ ID NO: 479686 - RNA, 20 nt, Chlamydia trachomatis
uagucuauagacgauauugu

SEQ ID NO: 479687 - RNA, 23 nt, Chlamydia trachomatis
uagucucccaaauuucugucacu

SEQ ID NO: 479688 - RNA, 21 nt, Chlamydia trachomatis
uagucugcaauccaauuacca

SEQ ID NO: 479689 - RNA, 20 nt, Chlamydia trachomatis
uagucuuuguugcuauaugg

SEQ ID NO: 479690 - RNA, 18 nt, Chlamydia trachomatis
uaguuaaaacuccagaaa

SEQ ID NO: 479691 - RNA, 13 nt, Chlamydia trachomatis
uaguuaaauguug

SEQ ID NO: 479692 - RNA, 14 nt, Chlamydia trachomatis
uaguuacauacuuu

SEQ ID NO: 479693 - RNA, 19 nt, Chlamydia trachomatis
uaguuacauacuuuucucc

SEQ ID NO: 479694 - RNA, 16 nt, Chlamydia trachomatis
uaguuaccaaaaagga

SEQ ID NO: 479695 - RNA, 11 nt, Chlamydia trachomatis
uauagcaugau

SEQ ID NO: 479696 - RNA, 20 nt, Chlamydia trachomatis
uauagaauuuuucuaaaauc

SEQ ID NO: 479697 - RNA, 21 nt, Chlamydia trachomatis
uauagaauuuuucuaaaaucu

SEQ ID NO: 479698 - RNA, 21 nt, Chlamydia trachomatis
uauagagaauugccgaaucaa

SEQ ID NO: 479699 - RNA, 17 nt, Chlamydia trachomatis
uauagagcaaucucuua

SEQ ID NO: 479700 - RNA, 17 nt, Chlamydia trachomatis
uauacuuuagauuuguu

SEQ ID NO: 479701 - RNA, 21 nt, Chlamydia trachomatis
uauacguuuaccgcucuucca

SEQ ID NO: 479702 - RNA, 19 nt, Chlamydia trachomatis
uauacuagggaauaaaagu

SEQ ID NO: 479703 - RNA, 17 nt, Chlamydia trachomatis
uauacccgacuaaaaaa

SEQ ID NO: 479704 - RNA, 16 nt, Chlamydia trachomatis
uauaccgccucaaaca

SEQ ID NO: 479705 - RNA, 19 nt, Chlamydia trachomatis
uauaccgccucaaacaauc

SEQ ID NO: 479706 - RNA, 15 nt, Chlamydia trachomatis
uauaccggaacguga

SEQ ID NO: 479707 - RNA, 19 nt, Chlamydia trachomatis
uauacgaaauaacaaagca

SEQ ID NO: 479708 - RNA, 14 nt, Chlamydia trachomatis
uauacgcucuuuca

SEQ ID NO: 479709 - RNA, 15 nt, Chlamydia trachomatis
uauacaagaaaacag

SEQ ID NO: 479710 - RNA, 20 nt, Chlamydia trachomatis
uauacaagaaaacagccaag

SEQ ID NO: 479711 - RNA, 18 nt, Chlamydia trachomatis
uauacaaguauuucuugu

SEQ ID NO: 479712 - RNA, 19 nt, Chlamydia trachomatis
uauacaucagagcaauaga

SEQ ID NO: 479713 - RNA, 19 nt, Chlamydia trachomatis
uauauugcuucauaaaaaa

SEQ ID NO: 479714 - RNA, 19 nt, Chlamydia trachomatis
uauauuggaagauaacaau

SEQ ID NO: 479715 - RNA, 13 nt, Chlamydia trachomatis
uaucaauaaaaac

SEQ ID NO: 479716 - RNA, 21 nt, Chlamydia trachomatis
uaucacaaaccagcucaucaa

SEQ ID NO: 479717 - RNA, 12 nt, Chlamydia trachomatis
uauaucuguaac

SEQ ID NO: 479718 - RNA, 19 nt, Chlamydia trachomatis
uauaucuuaauugaaauau

SEQ ID NO: 479719 - RNA, 21 nt, Chlamydia trachomatis
uauauucggagauuucggaua

SEQ ID NO: 479720 - RNA, 22 nt, Chlamydia trachomatis
uauaggguccaaacauaagagg

SEQ ID NO: 479721 - RNA, 19 nt, Chlamydia trachomatis
uauauagaccagagucucc

SEQ ID NO: 479722 - RNA, 16 nt, Chlamydia trachomatis
uauaucggaaagauag

SEQ ID NO: 479723 - RNA, 19 nt, Chlamydia trachomatis
uaucccugcauaauagcuu

SEQ ID NO: 479724 - RNA, 17 nt, Chlamydia trachomatis
uaucccgcgguagaaag

SEQ ID NO: 479725 - RNA, 14 nt, Chlamydia trachomatis
uauccuucuguguu

SEQ ID NO: 479726 - RNA, 13 nt, Chlamydia trachomatis
uaucauguagccc

SEQ ID NO: 479727 - RNA, 14 nt, Chlamydia trachomatis
uaucauguagcccu

SEQ ID NO: 479728 - RNA, 21 nt, Chlamydia trachomatis
uaucauguggguaugucugug

SEQ ID NO: 479729 - RNA, 21 nt, Chlamydia trachomatis
uauccagaaguuuuaacauga

SEQ ID NO: 479730 - RNA, 21 nt, Chlamydia trachomatis
uaucauuaucguucucuaaag

SEQ ID NO: 479731 - RNA, 13 nt, Chlamydia trachomatis
uaucuaaaucuaa

SEQ ID NO: 479732 - RNA, 15 nt, Chlamydia trachomatis
uaucuaacaauacua

SEQ ID NO: 479733 - RNA, 20 nt, Chlamydia trachomatis
uaucuaagcgacuacccuaa

SEQ ID NO: 479734 - RNA, 12 nt, Chlamydia trachomatis
uaucuaaucucg

SEQ ID NO: 479735 - RNA, 23 nt, Chlamydia trachomatis
uaucuaauuuuagauaaaagaag

SEQ ID NO: 479736 - RNA, 15 nt, Chlamydia trachomatis
uaucuauaaucuauu

SEQ ID NO: 479737 - RNA, 14 nt, Chlamydia trachomatis
uaucuguucugcuc

SEQ ID NO: 479738 - RNA, 15 nt, Chlamydia trachomatis
uaucuucaaagaaca

SEQ ID NO: 479739 - RNA, 17 nt, Chlamydia trachomatis
ucagcgcucauaggaca

SEQ ID NO: 479740 - RNA, 16 nt, Chlamydia trachomatis
ucagcguugggauaga

SEQ ID NO: 479741 - RNA, 16 nt, Chlamydia trachomatis
ucagcuuuucuuuccu

SEQ ID NO: 479742 - RNA, 22 nt, Chlamydia trachomatis
ucagcuuccuuggcuuuuacaa

SEQ ID NO: 479743 - RNA, 20 nt, Chlamydia trachomatis
ucaggaaucacuaagucugu

SEQ ID NO: 479744 - RNA, 14 nt, Chlamydia trachomatis
ucaggaauagcuac

SEQ ID NO: 479745 - RNA, 20 nt, Chlamydia trachomatis
ucagcuaacgacgagaacgu

SEQ ID NO: 479746 - RNA, 14 nt, Chlamydia trachomatis
ucagcucuccucgu

SEQ ID NO: 479747 - RNA, 16 nt, Chlamydia trachomatis
ucagcuguuccuuuua

SEQ ID NO: 479748 - RNA, 17 nt, Chlamydia trachomatis
ucaggaucuaauucuag

SEQ ID NO: 479749 - RNA, 22 nt, Chlamydia trachomatis
ucaggaucagcauguacuucgc

SEQ ID NO: 479750 - RNA, 16 nt, Chlamydia trachomatis
ucaggauuggaaaauc

SEQ ID NO: 479751 - RNA, 15 nt, Chlamydia trachomatis
ucaggagcaugaauc

SEQ ID NO: 479752 - RNA, 17 nt, Chlamydia trachomatis
ucaggagcaugaaucag

SEQ ID NO: 479753 - RNA, 15 nt, Chlamydia trachomatis
ucagggauagaaacu

SEQ ID NO: 479754 - RNA, 19 nt, Chlamydia trachomatis
ucagggaucgagucccuuc

SEQ ID NO: 479755 - RNA, 21 nt, Chlamydia trachomatis
ucagggcugacuaaauacaaa

SEQ ID NO: 479756 - RNA, 20 nt, Chlamydia trachomatis
ucaggggaucuguaccgaac

SEQ ID NO: 479757 - RNA, 12 nt, Chlamydia trachomatis
ucaggugaucuc

SEQ ID NO: 479758 - RNA, 17 nt, Chlamydia trachomatis
ucaguaagucaccauuu

SEQ ID NO: 479759 - RNA, 16 nt, Chlamydia trachomatis
ucagucgcucugccug

SEQ ID NO: 479760 - RNA, 17 nt, Chlamydia trachomatis
ucagucuucuuuucuga

SEQ ID NO: 479761 - RNA, 16 nt, Chlamydia trachomatis
ucaguugaaagacuug

SEQ ID NO: 479762 - RNA, 17 nt, Chlamydia trachomatis
ucaguugcuccuccgug

SEQ ID NO: 479763 - RNA, 14 nt, Chlamydia trachomatis
ucaguuaggaaaug

SEQ ID NO: 479764 - RNA, 14 nt, Chlamydia trachomatis
ucaguuugaaucac

SEQ ID NO: 479765 - RNA, 15 nt, Chlamydia trachomatis
ucaguuugaaucaca

SEQ ID NO: 479766 - RNA, 11 nt, Chlamydia trachomatis
ucauaaaaaag

SEQ ID NO: 479767 - RNA, 22 nt, Chlamydia trachomatis
ucauaaaaagauagugcagaag

SEQ ID NO: 479768 - RNA, 23 nt, Chlamydia trachomatis
ucauaaagagccguucucucuaa

SEQ ID NO: 479769 - RNA, 16 nt, Chlamydia trachomatis
ucauaaaggaaagggc

SEQ ID NO: 479770 - RNA, 23 nt, Chlamydia trachomatis
ucauagauugugguuagaaauuc

SEQ ID NO: 479771 - RNA, 13 nt, Chlamydia trachomatis
ucauagauaauga

SEQ ID NO: 479772 - RNA, 14 nt, Chlamydia trachomatis
ucauagcuucuaau

SEQ ID NO: 479773 - RNA, 13 nt, Chlamydia trachomatis
ucauaggcuccug

SEQ ID NO: 479774 - RNA, 23 nt, Chlamydia trachomatis
ucauaggcuccugcaagggaaca

SEQ ID NO: 479775 - RNA, 17 nt, Chlamydia trachomatis
ucauaguauaacgauua

SEQ ID NO: 479776 - RNA, 23 nt, Chlamydia trachomatis
ucauacgagccuguuucuuauca

SEQ ID NO: 479777 - RNA, 24 nt, Chlamydia trachomatis
ucauacgagccuguuucuuaucag

SEQ ID NO: 479778 - RNA, 22 nt, Chlamydia trachomatis
ucauagaaaauggcugcuuggc

SEQ ID NO: 479779 - RNA, 14 nt, Chlamydia trachomatis
ucauagaaaugaug

SEQ ID NO: 479780 - RNA, 23 nt, Chlamydia trachomatis
ucauaagcagggcuguauucauc

SEQ ID NO: 479781 - RNA, 18 nt, Chlamydia trachomatis
ucauaagcucuaacucuu

SEQ ID NO: 479782 - RNA, 13 nt, Chlamydia trachomatis
ucauaauccgcgu

SEQ ID NO: 479783 - RNA, 17 nt, Chlamydia trachomatis
ucauaauuacauugcag

SEQ ID NO: 479784 - RNA, 13 nt, Chlamydia trachomatis
ucauaucugcagc

SEQ ID NO: 479785 - RNA, 18 nt, Chlamydia trachomatis
ucaucaaaauauuuugcu

SEQ ID NO: 479786 - RNA, 23 nt, Chlamydia trachomatis
ucaucaaauagcaaagcgaucag

SEQ ID NO: 479787 - RNA, 19 nt, Chlamydia trachomatis
ucaucaaccgcgacagcca

SEQ ID NO: 479788 - RNA, 23 nt, Chlamydia trachomatis
ucaucaguaaacacuuuauuaga

SEQ ID NO: 479789 - RNA, 15 nt, Chlamydia trachomatis
ucaucauggaaaaua

SEQ ID NO: 479790 - RNA, 16 nt, Chlamydia trachomatis
ucaucauggaaaauau

SEQ ID NO: 479791 - RNA, 21 nt, Chlamydia trachomatis
ucauccccagaagccauaaua

SEQ ID NO: 479792 - RNA, 20 nt, Chlamydia trachomatis
ucaucgagaacggcaauaaa

SEQ ID NO: 479793 - RNA, 22 nt, Chlamydia trachomatis
ucaucgagaagaucuuuccuug

SEQ ID NO: 479794 - RNA, 13 nt, Chlamydia trachomatis
ucaucgaaaacaa

SEQ ID NO: 479795 - RNA, 16 nt, Chlamydia trachomatis
ucaucgaaaacaaaga

SEQ ID NO: 479796 - RNA, 22 nt, Chlamydia trachomatis
ucauccuuuuggaagaucucuu

SEQ ID NO: 479797 - RNA, 16 nt, Chlamydia trachomatis
ucaucuccuuugcuaa

SEQ ID NO: 479798 - RNA, 22 nt, Chlamydia trachomatis
ucaucuccuuugcuaacaaaga

SEQ ID NO: 479799 - RNA, 21 nt, Chlamydia trachomatis
ucaucucuaccagggauaaau

SEQ ID NO: 479800 - RNA, 16 nt, Chlamydia trachomatis
ucaucucucagcagau

SEQ ID NO: 479801 - RNA, 21 nt, Chlamydia trachomatis
ucaucucucagcagaucaucc

SEQ ID NO: 479802 - RNA, 16 nt, Chlamydia trachomatis
ucaucugguauucuaa

SEQ ID NO: 479803 - RNA, 17 nt, Chlamydia trachomatis
ucaucugguauucuaaa

SEQ ID NO: 479804 - RNA, 22 nt, Chlamydia trachomatis
ucaucggcuugcccaaacucca

SEQ ID NO: 479805 - RNA, 22 nt, Chlamydia trachomatis
ucaugcaaaggauaaauauuuu

SEQ ID NO: 479806 - RNA, 14 nt, Chlamydia trachomatis
ucaugcaccaacuu

SEQ ID NO: 479807 - RNA, 21 nt, Chlamydia trachomatis
ucauggaaaauauggcuccca

SEQ ID NO: 479808 - RNA, 20 nt, Chlamydia trachomatis
ucaugagccucuaacucuuc

SEQ ID NO: 479809 - RNA, 18 nt, Chlamydia trachomatis
ucaucuuuugccuauaga

SEQ ID NO: 479810 - RNA, 16 nt, Chlamydia trachomatis
ucaugaacagcaagag

SEQ ID NO: 479811 - RNA, 19 nt, Chlamydia trachomatis
ucauugaaaucagaaacaa

SEQ ID NO: 479812 - RNA, 18 nt, Chlamydia trachomatis
ucauugauucuaugagaa

SEQ ID NO: 479813 - RNA, 14 nt, Chlamydia trachomatis
ucauuauccauaaa

SEQ ID NO: 479814 - RNA, 15 nt, Chlamydia trachomatis
ucauucaagugacuu

SEQ ID NO: 479815 - RNA, 18 nt, Chlamydia trachomatis
ucauguugcguuuguaag

SEQ ID NO: 479816 - RNA, 17 nt, Chlamydia trachomatis
ucauuaaaggaauaauu

SEQ ID NO: 479817 - RNA, 18 nt, Chlamydia trachomatis
ucauuaaagacuacaaaa

SEQ ID NO: 479818 - RNA, 20 nt, Chlamydia trachomatis
ucaugucggccgacuaccug

SEQ ID NO: 479819 - RNA, 15 nt, Chlamydia trachomatis
ucauuuuaauaagau

SEQ ID NO: 479820 - RNA, 15 nt, Chlamydia trachomatis
ucauuuuauguaaau

SEQ ID NO: 479821 - RNA, 19 nt, Chlamydia trachomatis
ucauuuuauguaaauauuu

SEQ ID NO: 479822 - RNA, 12 nt, Chlamydia trachomatis
ucauuuaaaagu

SEQ ID NO: 479823 - RNA, 12 nt, Chlamydia trachomatis
ucauuuaauaag

SEQ ID NO: 479824 - RNA, 14 nt, Chlamydia trachomatis
ucauuuaauaaguu

SEQ ID NO: 479825 - RNA, 15 nt, Chlamydia trachomatis
ucauuuaauaaguuu

SEQ ID NO: 479826 - RNA, 17 nt, Chlamydia trachomatis
uccaaaacaucccagca

SEQ ID NO: 479827 - RNA, 14 nt, Chlamydia trachomatis
uccaaaaaagaauc

SEQ ID NO: 479828 - RNA, 12 nt, Chlamydia trachomatis
uccaaaaaagag

SEQ ID NO: 479829 - RNA, 20 nt, Chlamydia trachomatis
uccaaaaagcgugucaauga

SEQ ID NO: 479830 - RNA, 21 nt, Chlamydia trachomatis
ucauuuuuucuuggaccucuu

SEQ ID NO: 479831 - RNA, 15 nt, Chlamydia trachomatis
uccaaaccaguucug

SEQ ID NO: 479832 - RNA, 14 nt, Chlamydia trachomatis
uccaaagaauagaa

SEQ ID NO: 479833 - RNA, 17 nt, Chlamydia trachomatis
uccaaagagauuguaau

SEQ ID NO: 479834 - RNA, 18 nt, Chlamydia trachomatis
uccaaagauauagguucc

SEQ ID NO: 479835 - RNA, 22 nt, Chlamydia trachomatis
uccaaagauauagguuccaucu

SEQ ID NO: 479836 - RNA, 23 nt, Chlamydia trachomatis
uccaaagaugcuccuacaaaaua

SEQ ID NO: 479837 - RNA, 22 nt, Chlamydia trachomatis
uccaaagcuuuaauaauaagag

SEQ ID NO: 479838 - RNA, 19 nt, Chlamydia trachomatis
uccaaaggauauacagaac

SEQ ID NO: 479839 - RNA, 14 nt, Chlamydia trachomatis
uccaaagguaacug

SEQ ID NO: 479840 - RNA, 14 nt, Chlamydia trachomatis
uccaaaguaaucuc

SEQ ID NO: 479841 - RNA, 18 nt, Chlamydia trachomatis
uccaaaguacucagucaa

SEQ ID NO: 479842 - RNA, 19 nt, Chlamydia trachomatis
uccaaaguacucagucaau

SEQ ID NO: 479843 - RNA, 23 nt, Chlamydia trachomatis
uccaaauaggauccccacgacca

SEQ ID NO: 479844 - RNA, 22 nt, Chlamydia trachomatis
uccaaauuuuguuuaaucagug

SEQ ID NO: 479845 - RNA, 15 nt, Chlamydia trachomatis
uccaacaauuuucgu

SEQ ID NO: 479846 - RNA, 15 nt, Chlamydia trachomatis
uccaacaagagagac

SEQ ID NO: 479847 - RNA, 16 nt, Chlamydia trachomatis
uccaacacgaaugccu

SEQ ID NO: 479848 - RNA, 11 nt, Chlamydia trachomatis
uccacagaucu

SEQ ID NO: 479849 - RNA, 18 nt, Chlamydia trachomatis
uccacauucacuucaacu

SEQ ID NO: 479850 - RNA, 16 nt, Chlamydia trachomatis
uccaccguagaacaau

SEQ ID NO: 479851 - RNA, 21 nt, Chlamydia trachomatis
uccaccagcagucgcgcagcu

SEQ ID NO: 479852 - RNA, 24 nt, Chlamydia trachomatis
uccaccagacuauuucuucuagau

SEQ ID NO: 479853 - RNA, 15 nt, Chlamydia trachomatis
uccaaggaaaccaag

SEQ ID NO: 479854 - RNA, 15 nt, Chlamydia trachomatis
uccaagggaggcggc

SEQ ID NO: 479855 - RNA, 20 nt, Chlamydia trachomatis
uccaagggaugaagcuaaaa

SEQ ID NO: 479856 - RNA, 17 nt, Chlamydia trachomatis
uccaaguuuuguaaagu

SEQ ID NO: 479857 - RNA, 21 nt, Chlamydia trachomatis
uccaagaaucaaaaaguucuc

SEQ ID NO: 479858 - RNA, 21 nt, Chlamydia trachomatis
uccaagauuaucacauucuua

SEQ ID NO: 479859 - RNA, 15 nt, Chlamydia trachomatis
uccaagcacuccuca

SEQ ID NO: 479860 - RNA, 13 nt, Chlamydia trachomatis
uccaauaucuuca

SEQ ID NO: 479861 - RNA, 14 nt, Chlamydia trachomatis
uccaaucacagcaa

SEQ ID NO: 479862 - RNA, 13 nt, Chlamydia trachomatis
uccaauccuuggc

SEQ ID NO: 479863 - RNA, 18 nt, Chlamydia trachomatis
uccaaucguauaauaaug

SEQ ID NO: 479864 - RNA, 16 nt, Chlamydia trachomatis
uccaauggaaauaaga

SEQ ID NO: 479865 - RNA, 17 nt, Chlamydia trachomatis
uccacaacggcccuucc

SEQ ID NO: 479866 - RNA, 13 nt, Chlamydia trachomatis
uccacaagaagua

SEQ ID NO: 479867 - RNA, 20 nt, Chlamydia trachomatis
uccacaagauuuugaauacg

SEQ ID NO: 479868 - RNA, 17 nt, Chlamydia trachomatis
uccacaaggagauauuu

SEQ ID NO: 479869 - RNA, 18 nt, Chlamydia trachomatis
uccacgaagagcaaaauc

SEQ ID NO: 479870 - RNA, 17 nt, Chlamydia trachomatis
uccaccuucauuucaag

SEQ ID NO: 479871 - RNA, 17 nt, Chlamydia trachomatis
uccaccuaauuccccaa

SEQ ID NO: 479872 - RNA, 17 nt, Chlamydia trachomatis
uccacgagaagagguuu

SEQ ID NO: 479873 - RNA, 16 nt, Chlamydia trachomatis
uccacgaauuuucucu

SEQ ID NO: 479874 - RNA, 19 nt, Chlamydia trachomatis
uccacgaauuuucucucua

SEQ ID NO: 479875 - RNA, 16 nt, Chlamydia trachomatis
uccacuaccccaccua

SEQ ID NO: 479876 - RNA, 16 nt, Chlamydia trachomatis
uccagaagcacacagc

SEQ ID NO: 479877 - RNA, 20 nt, Chlamydia trachomatis
uccagaaaaaauaauggacu

SEQ ID NO: 479878 - RNA, 20 nt, Chlamydia trachomatis
uccagaaaauucuacaacag

SEQ ID NO: 479879 - RNA, 19 nt, Chlamydia trachomatis
uccagaaacaggagaaaga

SEQ ID NO: 479880 - RNA, 13 nt, Chlamydia trachomatis
uccagaaauaagg

SEQ ID NO: 479881 - RNA, 20 nt, Chlamydia trachomatis
uccagagcaaauagaauaaa

SEQ ID NO: 479882 - RNA, 17 nt, Chlamydia trachomatis
uccagcaggccucuguu

SEQ ID NO: 479883 - RNA, 22 nt, Chlamydia trachomatis
uccagcauuuuaaaaucacuuu

SEQ ID NO: 479884 - RNA, 16 nt, Chlamydia trachomatis
uccagcaucuuuucuu

SEQ ID NO: 479885 - RNA, 19 nt, Chlamydia trachomatis
uccagccucuccagaaaaa

SEQ ID NO: 479886 - RNA, 17 nt, Chlamydia trachomatis
uccagcgcacacuuuuc

SEQ ID NO: 479887 - RNA, 22 nt, Chlamydia trachomatis
uccagcuucugaacgagaaaaa

SEQ ID NO: 479888 - RNA, 23 nt, Chlamydia trachomatis
uccaggagauguaggauucagag

SEQ ID NO: 479889 - RNA, 19 nt, Chlamydia trachomatis
uccaggagucucuagguau

SEQ ID NO: 479890 - RNA, 18 nt, Chlamydia trachomatis
uccagggaaaagagcuag

SEQ ID NO: 479891 - RNA, 21 nt, Chlamydia trachomatis
uccaggggugacagcuuucac

SEQ ID NO: 479892 - RNA, 11 nt, Chlamydia trachomatis
uccauccugcg

SEQ ID NO: 479893 - RNA, 16 nt, Chlamydia trachomatis
uccauauauucagaag

SEQ ID NO: 479894 - RNA, 15 nt, Chlamydia trachomatis
uccaucaacuguucu

SEQ ID NO: 479895 - RNA, 21 nt, Chlamydia trachomatis
uccauaauuuucuucacuucc

SEQ ID NO: 479896 - RNA, 23 nt, Chlamydia trachomatis
uccauacaucaucucucagcaga

SEQ ID NO: 479897 - RNA, 20 nt, Chlamydia trachomatis
uccauagcaugggcugcauc

SEQ ID NO: 479898 - RNA, 22 nt, Chlamydia trachomatis
uccaugaagacccguuuucucu

SEQ ID NO: 479899 - RNA, 17 nt, Chlamydia trachomatis
uccaucuuuaaagagga

SEQ ID NO: 479900 - RNA, 19 nt, Chlamydia trachomatis
uccaucuuuaaagaggauc

SEQ ID NO: 479901 - RNA, 16 nt, Chlamydia trachomatis
uccaucuugacuuccc

SEQ ID NO: 479902 - RNA, 20 nt, Chlamydia trachomatis
uccaucguaagcaacaauau

SEQ ID NO: 479903 - RNA, 16 nt, Chlamydia trachomatis
uccaucguuuaugaag

SEQ ID NO: 479904 - RNA, 17 nt, Chlamydia trachomatis
uccaucguuuaugaagc

SEQ ID NO: 479905 - RNA, 13 nt, Chlamydia trachomatis
uccaucuaaaggc

SEQ ID NO: 479906 - RNA, 22 nt, Chlamydia trachomatis
uccaucuaaaggcaacucucuc

SEQ ID NO: 479907 - RNA, 14 nt, Chlamydia trachomatis
uccaucucuccgga

SEQ ID NO: 479908 - RNA, 13 nt, Chlamydia trachomatis
uccaucucugcuu

SEQ ID NO: 479909 - RNA, 14 nt, Chlamydia trachomatis
uccaucucugcuuc

SEQ ID NO: 479910 - RNA, 21 nt, Chlamydia trachomatis
uccaugauccccuacgcuacg

SEQ ID NO: 479911 - RNA, 13 nt, Chlamydia trachomatis
uccaugauuucuu

SEQ ID NO: 479912 - RNA, 14 nt, Chlamydia trachomatis
uccaugauuucuuu

SEQ ID NO: 479913 - RNA, 23 nt, Chlamydia trachomatis
uccaugauuucuuuaacaucuuu

SEQ ID NO: 479914 - RNA, 13 nt, Chlamydia trachomatis
uccaugcauguua

SEQ ID NO: 479915 - RNA, 16 nt, Chlamydia trachomatis
uccaugcauguuagua

SEQ ID NO: 479916 - RNA, 21 nt, Chlamydia trachomatis
uccauggcguuagaauaccaa

SEQ ID NO: 479917 - RNA, 23 nt, Chlamydia trachomatis
uccauggcaauggcuaagccauu

SEQ ID NO: 479918 - RNA, 18 nt, Chlamydia trachomatis
uccauucgcauuaaauaa

SEQ ID NO: 479919 - RNA, 16 nt, Chlamydia trachomatis
uccauugcaggagauc

SEQ ID NO: 479920 - RNA, 13 nt, Chlamydia trachomatis
uccauguauucuc

SEQ ID NO: 479921 - RNA, 23 nt, Chlamydia trachomatis
ucccacaacuugcguuuucuugu

SEQ ID NO: 479922 - RNA, 18 nt, Chlamydia trachomatis
ucccacuacauucuuuuu

SEQ ID NO: 479923 - RNA, 13 nt, Chlamydia trachomatis
ucccacucuucuu

SEQ ID NO: 479924 - RNA, 13 nt, Chlamydia trachomatis
ucccagaauaaag

SEQ ID NO: 479925 - RNA, 11 nt, Chlamydia trachomatis
ucccagagaau

SEQ ID NO: 479926 - RNA, 21 nt, Chlamydia trachomatis
uccauuuacgucaauuuuucc

SEQ ID NO: 479927 - RNA, 22 nt, Chlamydia trachomatis
uccauuuucguaagcauagcuu

SEQ ID NO: 479928 - RNA, 13 nt, Chlamydia trachomatis
ucccaaaaacaau

SEQ ID NO: 479929 - RNA, 15 nt, Chlamydia trachomatis
ucccaaaauagcagg

SEQ ID NO: 479930 - RNA, 15 nt, Chlamydia trachomatis
ucccaaaucaaacca

SEQ ID NO: 479931 - RNA, 17 nt, Chlamydia trachomatis
ucccaaaucaaaccaaa

SEQ ID NO: 479932 - RNA, 20 nt, Chlamydia trachomatis
ucccaaauuucugucacucg

SEQ ID NO: 479933 - RNA, 15 nt, Chlamydia trachomatis
ucccaauauauuccu

SEQ ID NO: 479934 - RNA, 13 nt, Chlamydia trachomatis
ucccauggcaguu

SEQ ID NO: 479935 - RNA, 18 nt, Chlamydia trachomatis
ucccaucuugcacauuuu

SEQ ID NO: 479936 - RNA, 14 nt, Chlamydia trachomatis
ucccauacaaaagc

SEQ ID NO: 479937 - RNA, 17 nt, Chlamydia trachomatis
ucccauagcuucuuagu

SEQ ID NO: 479938 - RNA, 17 nt, Chlamydia trachomatis
uccccaaaccaguuucu

SEQ ID NO: 479939 - RNA, 19 nt, Chlamydia trachomatis
uccccaaaccaguuucuuc

SEQ ID NO: 479940 - RNA, 18 nt, Chlamydia trachomatis
ucccaggaucccucuguc

SEQ ID NO: 479941 - RNA, 13 nt, Chlamydia trachomatis
ucccaguuauaac

SEQ ID NO: 479942 - RNA, 18 nt, Chlamydia trachomatis
ucccauaaaagccauagc

SEQ ID NO: 479943 - RNA, 14 nt, Chlamydia trachomatis
uccccauaaagcua

SEQ ID NO: 479944 - RNA, 16 nt, Chlamydia trachomatis
uccccauaaagcuagu

SEQ ID NO: 479945 - RNA, 15 nt, Chlamydia trachomatis
uccccagucucucca

SEQ ID NO: 479946 - RNA, 20 nt, Chlamydia trachomatis
uccccagucucuccaucgcu

SEQ ID NO: 479947 - RNA, 18 nt, Chlamydia trachomatis
uccccgccagaaacuuca

SEQ ID NO: 479948 - RNA, 23 nt, Chlamydia trachomatis
uccccuuacccaaacaucuacac

SEQ ID NO: 479949 - RNA, 16 nt, Chlamydia trachomatis
ucccgauuacuugaga

SEQ ID NO: 479950 - RNA, 16 nt, Chlamydia trachomatis
ucccuaguacaaaaau

SEQ ID NO: 479951 - RNA, 15 nt, Chlamydia trachomatis
ucccuacugaaguag

SEQ ID NO: 479952 - RNA, 22 nt, Chlamydia trachomatis
ucccuaccuaaagggugcacaa

SEQ ID NO: 479953 - RNA, 22 nt, Chlamydia trachomatis
ucccuacggaauagccuccaaa

SEQ ID NO: 479954 - RNA, 14 nt, Chlamydia trachomatis
ucccuaagaucucu

SEQ ID NO: 479955 - RNA, 15 nt, Chlamydia trachomatis
ucccuaaagcagcua

SEQ ID NO: 479956 - RNA, 18 nt, Chlamydia trachomatis
ucccguuuuucacaagac

SEQ ID NO: 479957 - RNA, 13 nt, Chlamydia trachomatis
ucccuccaaaaaa

SEQ ID NO: 479958 - RNA, 17 nt, Chlamydia trachomatis
ucccucguaauaacuga

SEQ ID NO: 479959 - RNA, 12 nt, Chlamydia trachomatis
ucccucuuguaa

SEQ ID NO: 479960 - RNA, 20 nt, Chlamydia trachomatis
ucccugcaauuuacuaucag

SEQ ID NO: 479961 - RNA, 18 nt, Chlamydia trachomatis
ucccugcaccucuuucag

SEQ ID NO: 479962 - RNA, 19 nt, Chlamydia trachomatis
ucccuugcguguucuaaac

SEQ ID NO: 479963 - RNA, 17 nt, Chlamydia trachomatis
ucccuucuuucuucuaa

SEQ ID NO: 479964 - RNA, 17 nt, Chlamydia trachomatis
ucccuugcaaaaaucuc

SEQ ID NO: 479965 - RNA, 16 nt, Chlamydia trachomatis
ucccuuucauaauagu

SEQ ID NO: 479966 - RNA, 18 nt, Chlamydia trachomatis
ucccuuuccauacaucau

SEQ ID NO: 479967 - RNA, 22 nt, Chlamydia trachomatis
ucccuuuccauacaucaucucu

SEQ ID NO: 479968 - RNA, 16 nt, Chlamydia trachomatis
ucccuuuuuucuguuu

SEQ ID NO: 479969 - RNA, 22 nt, Chlamydia trachomatis
ucccugugucucgguuuucuuu

SEQ ID NO: 479970 - RNA, 23 nt, Chlamydia trachomatis
ucccugugucucgguuuucuuua

SEQ ID NO: 479971 - RNA, 14 nt, Chlamydia trachomatis
ucccugucauacca

SEQ ID NO: 479972 - RNA, 23 nt, Chlamydia trachomatis
uccgauaaacguuuggaaauccu

SEQ ID NO: 479973 - RNA, 21 nt, Chlamydia trachomatis
uccgauaauuuuccuuuuucc

SEQ ID NO: 479974 - RNA, 16 nt, Chlamydia trachomatis
uccgaucauaauuaaa

SEQ ID NO: 479975 - RNA, 17 nt, Chlamydia trachomatis
uccgauccaaggagcuc

SEQ ID NO: 479976 - RNA, 17 nt, Chlamydia trachomatis
uccgcaaacaaaauaau

SEQ ID NO: 479977 - RNA, 20 nt, Chlamydia trachomatis
uccgagagaagcuccucuuc

SEQ ID NO: 479978 - RNA, 17 nt, Chlamydia trachomatis
uccgaauaaguccacaa

SEQ ID NO: 479979 - RNA, 19 nt, Chlamydia trachomatis
uccgaauucuucuccuaua

SEQ ID NO: 479980 - RNA, 22 nt, Chlamydia trachomatis
uccgcacccaaucuucuaaaug

SEQ ID NO: 479981 - RNA, 20 nt, Chlamydia trachomatis
uccgcaguaaaaucuaaaau

SEQ ID NO: 479982 - RNA, 12 nt, Chlamydia trachomatis
uccgcuucuuca

SEQ ID NO: 479983 - RNA, 14 nt, Chlamydia trachomatis
uccgcuuaaaacua

SEQ ID NO: 479984 - RNA, 22 nt, Chlamydia trachomatis
uccgcuuagaaugggaagcucg

SEQ ID NO: 479985 - RNA, 14 nt, Chlamydia trachomatis
uccggaauuuuaag

SEQ ID NO: 479986 - RNA, 19 nt, Chlamydia trachomatis
uccggacacacucucccug

SEQ ID NO: 479987 - RNA, 17 nt, Chlamydia trachomatis
uccgcuaggcaaauauc

SEQ ID NO: 479988 - RNA, 23 nt, Chlamydia trachomatis
uccggagaacaguguccuuccau

SEQ ID NO: 479989 - RNA, 17 nt, Chlamydia trachomatis
uccgguauauucuucac

SEQ ID NO: 479990 - RNA, 20 nt, Chlamydia trachomatis
uccguaaugaucagcaaaaa

SEQ ID NO: 479991 - RNA, 23 nt, Chlamydia trachomatis
uccguaaugaucagcaaaaagag

SEQ ID NO: 479992 - RNA, 19 nt, Chlamydia trachomatis
uccguacucugauuagaag

SEQ ID NO: 479993 - RNA, 13 nt, Chlamydia trachomatis
uccguaguccaca

SEQ ID NO: 479994 - RNA, 20 nt, Chlamydia trachomatis
uccguuaaagagucuucauc

SEQ ID NO: 479995 - RNA, 20 nt, Chlamydia trachomatis
uccgugauuuccguaaugau

SEQ ID NO: 479996 - RNA, 14 nt, Chlamydia trachomatis
uccuaaaaaaaacc

SEQ ID NO: 479997 - RNA, 19 nt, Chlamydia trachomatis
uccuaaacaaaaacucuca

SEQ ID NO: 479998 - RNA, 14 nt, Chlamydia trachomatis
uccuaaaggaagau

SEQ ID NO: 479999 - RNA, 19 nt, Chlamydia trachomatis
uccuaaaggaagauuccuu

SEQ ID NO: 480000 - RNA, 16 nt, Chlamydia trachomatis
uccuaaauuauaauga

SEQ ID NO: 480001 - RNA, 12 nt, Chlamydia trachomatis
uccuaacaaagc

SEQ ID NO: 480002 - RNA, 21 nt, Chlamydia trachomatis
uccuaaccaaguuuuuuucau

SEQ ID NO: 480003 - RNA, 13 nt, Chlamydia trachomatis
uccuaacccuaaa

SEQ ID NO: 480004 - RNA, 21 nt, Chlamydia trachomatis
uccuaauuuucuaggagaaga

SEQ ID NO: 480005 - RNA, 14 nt, Chlamydia trachomatis
uccuaauuuaaaau

SEQ ID NO: 480006 - RNA, 15 nt, Chlamydia trachomatis
uccuaccaucaaucc

SEQ ID NO: 480007 - RNA, 14 nt, Chlamydia trachomatis
uccuacucaauccu

SEQ ID NO: 480008 - RNA, 20 nt, Chlamydia trachomatis
uccuacucggccagagcuca

SEQ ID NO: 480009 - RNA, 15 nt, Chlamydia trachomatis
uccuagaaagaacca

SEQ ID NO: 480010 - RNA, 18 nt, Chlamydia trachomatis
uccuagaaagaaccacaa

SEQ ID NO: 480011 - RNA, 21 nt, Chlamydia trachomatis
uccuauugagcgcaaagcgga

SEQ ID NO: 480012 - RNA, 14 nt, Chlamydia trachomatis
uccucaaaaaaggc

SEQ ID NO: 480013 - RNA, 20 nt, Chlamydia trachomatis
uccucagcauagcgcuuccc

SEQ ID NO: 480014 - RNA, 19 nt, Chlamydia trachomatis
uccuaucacucccugcaau

SEQ ID NO: 480015 - RNA, 22 nt, Chlamydia trachomatis
uccuaucuucaacccuuuuaau

SEQ ID NO: 480016 - RNA, 22 nt, Chlamydia trachomatis
uccuauaauugcuaaggaaaga

SEQ ID NO: 480017 - RNA, 21 nt, Chlamydia trachomatis
uccuauagguagagacgagaa

SEQ ID NO: 480018 - RNA, 19 nt, Chlamydia trachomatis
uccuccagauacugcucca

SEQ ID NO: 480019 - RNA, 20 nt, Chlamydia trachomatis
uccuccauaacgauccucuu

SEQ ID NO: 480020 - RNA, 14 nt, Chlamydia trachomatis
uccucauccuuuug

SEQ ID NO: 480021 - RNA, 16 nt, Chlamydia trachomatis
uccucaguauaaaaaa

SEQ ID NO: 480022 - RNA, 15 nt, Chlamydia trachomatis
uccucccaaaauacc

SEQ ID NO: 480023 - RNA, 17 nt, Chlamydia trachomatis
uccucguccaugagcaa

SEQ ID NO: 480024 - RNA, 15 nt, Chlamydia trachomatis
uccucgugaggcaug

SEQ ID NO: 480025 - RNA, 17 nt, Chlamydia trachomatis
uccucguuuuuuuagau

SEQ ID NO: 480026 - RNA, 20 nt, Chlamydia trachomatis
uccucguuuuuuuagauaag

SEQ ID NO: 480027 - RNA, 21 nt, Chlamydia trachomatis
uccucguuuuuuuagauaaga

SEQ ID NO: 480028 - RNA, 17 nt, Chlamydia trachomatis
uccucggacaaacgucc

SEQ ID NO: 480029 - RNA, 12 nt, Chlamydia trachomatis
uccucuucuucu

SEQ ID NO: 480030 - RNA, 17 nt, Chlamydia trachomatis
uccucuucacagagcuu

SEQ ID NO: 480031 - RNA, 13 nt, Chlamydia trachomatis
uccucuucuagaa

SEQ ID NO: 480032 - RNA, 14 nt, Chlamydia trachomatis
uccucuucuagaag

SEQ ID NO: 480033 - RNA, 15 nt, Chlamydia trachomatis
uccucuucuagaaga

SEQ ID NO: 480034 - RNA, 11 nt, Chlamydia trachomatis
uccucuucuuc

SEQ ID NO: 480035 - RNA, 19 nt, Chlamydia trachomatis
uccucuugaaccaguuucu

SEQ ID NO: 480036 - RNA, 21 nt, Chlamydia trachomatis
uccucuggcuuaucaacaaga

SEQ ID NO: 480037 - RNA, 13 nt, Chlamydia trachomatis
uccucuuccgaag

SEQ ID NO: 480038 - RNA, 12 nt, Chlamydia trachomatis
uccucucuucuu

SEQ ID NO: 480039 - RNA, 16 nt, Chlamydia trachomatis
uccucugaauccauuc

SEQ ID NO: 480040 - RNA, 15 nt, Chlamydia trachomatis
uccugaagcaaugcu

SEQ ID NO: 480041 - RNA, 16 nt, Chlamydia trachomatis
uccugaagcaaugcua

SEQ ID NO: 480042 - RNA, 20 nt, Chlamydia trachomatis
uccugagcccaaggagaaua

SEQ ID NO: 480043 - RNA, 13 nt, Chlamydia trachomatis
uccugcaagcaca

SEQ ID NO: 480044 - RNA, 23 nt, Chlamydia trachomatis
uccuguuuguuuguuuuuuucaa

SEQ ID NO: 480045 - RNA, 22 nt, Chlamydia trachomatis
ucgaaggaauacccagaaguau

SEQ ID NO: 480046 - RNA, 12 nt, Chlamydia trachomatis
ucgaagcuacug

SEQ ID NO: 480047 - RNA, 19 nt, Chlamydia trachomatis
ucgaauuuuuuucuuugcu

SEQ ID NO: 480048 - RNA, 21 nt, Chlamydia trachomatis
ucgagagaugauuguuuugau

SEQ ID NO: 480049 - RNA, 17 nt, Chlamydia trachomatis
ucgagaagaucuuuccu

SEQ ID NO: 480050 - RNA, 18 nt, Chlamydia trachomatis
ucgagaagaucuuuccuu

SEQ ID NO: 480051 - RNA, 14 nt, Chlamydia trachomatis
ucgagaaaugaauu

SEQ ID NO: 480052 - RNA, 17 nt, Chlamydia trachomatis
ucgagaagagccaucaa

SEQ ID NO: 480053 - RNA, 16 nt, Chlamydia trachomatis
ucgagcuaagaaaaua

SEQ ID NO: 480054 - RNA, 17 nt, Chlamydia trachomatis
ucgagcuaagaaaauaa

SEQ ID NO: 480055 - RNA, 20 nt, Chlamydia trachomatis
ucgauaaugcuuagaaacug

SEQ ID NO: 480056 - RNA, 14 nt, Chlamydia trachomatis
ucgauccagcaucu

SEQ ID NO: 480057 - RNA, 13 nt, Chlamydia trachomatis
ucgauccaaagcc

SEQ ID NO: 480058 - RNA, 16 nt, Chlamydia trachomatis
ucgaucccuuuuucag

SEQ ID NO: 480059 - RNA, 17 nt, Chlamydia trachomatis
ucgauccgguucuuuug

SEQ ID NO: 480060 - RNA, 17 nt, Chlamydia trachomatis
ucgaugauaucuucuga

SEQ ID NO: 480061 - RNA, 15 nt, Chlamydia trachomatis
ucgauuuuuaaaaga

SEQ ID NO: 480062 - RNA, 21 nt, Chlamydia trachomatis
ucgcaaaagauuuccccaaga

SEQ ID NO: 480063 - RNA, 19 nt, Chlamydia trachomatis
ucgcagcuuucuuuuccau

SEQ ID NO: 480064 - RNA, 17 nt, Chlamydia trachomatis
ucgcauuccaagaagaa

SEQ ID NO: 480065 - RNA, 15 nt, Chlamydia trachomatis
ucgcauuugagauga

SEQ ID NO: 480066 - RNA, 19 nt, Chlamydia trachomatis
ucgcgcuccagcucuucca

SEQ ID NO: 480067 - RNA, 20 nt, Chlamydia trachomatis
ucgcuacauguaguaaucug

SEQ ID NO: 480068 - RNA, 13 nt, Chlamydia trachomatis
ucgcuaucuucaa

SEQ ID NO: 480069 - RNA, 14 nt, Chlamydia trachomatis
ucgcuaucuucaau

SEQ ID NO: 480070 - RNA, 18 nt, Chlamydia trachomatis
ucgcugacggauccugcu

SEQ ID NO: 480071 - RNA, 17 nt, Chlamydia trachomatis
ucgcuucaaaacuaaaa

SEQ ID NO: 480072 - RNA, 13 nt, Chlamydia trachomatis
ucgcuucugcuga

SEQ ID NO: 480073 - RNA, 23 nt, Chlamydia trachomatis
ucggaaggagacaaguucaucaa

SEQ ID NO: 480074 - RNA, 14 nt, Chlamydia trachomatis
ucggaauaagagga

SEQ ID NO: 480075 - RNA, 20 nt, Chlamydia trachomatis
ucggaauaagcgaaaaaaaa

SEQ ID NO: 480076 - RNA, 17 nt, Chlamydia trachomatis
ucggcaagacucuuuca

SEQ ID NO: 480077 - RNA, 20 nt, Chlamydia trachomatis
ucggcaggccuuccaccuug

SEQ ID NO: 480078 - RNA, 13 nt, Chlamydia trachomatis
ucgguuguauaaa

SEQ ID NO: 480079 - RNA, 18 nt, Chlamydia trachomatis
ucgguuugauuuccucuu

SEQ ID NO: 480080 - RNA, 17 nt, Chlamydia trachomatis
ucguagacagagaauag

SEQ ID NO: 480081 - RNA, 23 nt, Chlamydia trachomatis
ucguagacagagaauagcugcca

SEQ ID NO: 480082 - RNA, 14 nt, Chlamydia trachomatis
ucguagagaucuuc

SEQ ID NO: 480083 - RNA, 14 nt, Chlamydia trachomatis
ucgucaaagaagua

SEQ ID NO: 480084 - RNA, 15 nt, Chlamydia trachomatis
ucgucaaagaaguaa

SEQ ID NO: 480085 - RNA, 18 nt, Chlamydia trachomatis
ucgucuuuagaagaaaag

SEQ ID NO: 480086 - RNA, 23 nt, Chlamydia trachomatis
ucgucugcgaaaaagaaauaacc

SEQ ID NO: 480087 - RNA, 14 nt, Chlamydia trachomatis
ucguggaggggaau

SEQ ID NO: 480088 - RNA, 15 nt, Chlamydia trachomatis
ucguggaggggaaua

SEQ ID NO: 480089 - RNA, 14 nt, Chlamydia trachomatis
ucgugucuuuaugc

SEQ ID NO: 480090 - RNA, 21 nt, Chlamydia trachomatis
ucgugcagggagaaggggaag

SEQ ID NO: 480091 - RNA, 18 nt, Chlamydia trachomatis
ucguuuucggagaagaag

SEQ ID NO: 480092 - RNA, 23 nt, Chlamydia trachomatis
ucguuuugaagaagaucuguaac

SEQ ID NO: 480093 - RNA, 21 nt, Chlamydia trachomatis
ucguugcucccaucaacucuc

SEQ ID NO: 480094 - RNA, 20 nt, Chlamydia trachomatis
ucguuucuaugauucuucua

SEQ ID NO: 480095 - RNA, 24 nt, Chlamydia trachomatis
ucguugauuaaaguuucuaauaau

SEQ ID NO: 480096 - RNA, 19 nt, Chlamydia trachomatis
ucgugugggugaugccuau

SEQ ID NO: 480097 - RNA, 15 nt, Chlamydia trachomatis
ucguguguaggaaug

SEQ ID NO: 480098 - RNA, 21 nt, Chlamydia trachomatis
ucguucuuuaagaaaaaugcc

SEQ ID NO: 480099 - RNA, 22 nt, Chlamydia trachomatis
ucuaaaaguuuucuugguuucu

SEQ ID NO: 480100 - RNA, 21 nt, Chlamydia trachomatis
ucuaaacaagguucuucaaca

SEQ ID NO: 480101 - RNA, 20 nt, Chlamydia trachomatis
ucuaaacccucugcauagcu

SEQ ID NO: 480102 - RNA, 12 nt, Chlamydia trachomatis
ucuaaagaaaug

SEQ ID NO: 480103 - RNA, 21 nt, Chlamydia trachomatis
ucuaaagacaaaacuucuucg

SEQ ID NO: 480104 - RNA, 18 nt, Chlamydia trachomatis
ucuaaagagccaaaauau

SEQ ID NO: 480105 - RNA, 14 nt, Chlamydia trachomatis
ucuaaagauccucu

SEQ ID NO: 480106 - RNA, 16 nt, Chlamydia trachomatis
ucuaaagaucggcuua

SEQ ID NO: 480107 - RNA, 12 nt, Chlamydia trachomatis
ucuaaagccaua

SEQ ID NO: 480108 - RNA, 21 nt, Chlamydia trachomatis
ucuaaagccauaagacuuugu

SEQ ID NO: 480109 - RNA, 21 nt, Chlamydia trachomatis
ucuacgaaaaagucaagacag

SEQ ID NO: 480110 - RNA, 23 nt, Chlamydia trachomatis
ucuacacgcucaggcuaucacaa

SEQ ID NO: 480111 - RNA, 13 nt, Chlamydia trachomatis
ucuacagcaaaac

SEQ ID NO: 480112 - RNA, 19 nt, Chlamydia trachomatis
ucuacagcuguauuuacag

SEQ ID NO: 480113 - RNA, 17 nt, Chlamydia trachomatis
ucuaacgcuuccucucc

SEQ ID NO: 480114 - RNA, 19 nt, Chlamydia trachomatis
ucuaauaguugcaaaaaga

SEQ ID NO: 480115 - RNA, 13 nt, Chlamydia trachomatis
ucuaaugcuuugu

SEQ ID NO: 480116 - RNA, 19 nt, Chlamydia trachomatis
ucuaauugaaacaguagaa

SEQ ID NO: 480117 - RNA, 21 nt, Chlamydia trachomatis
ucuaauuggacgagaggcgaa

SEQ ID NO: 480118 - RNA, 15 nt, Chlamydia trachomatis
ucucagagcuuugca

SEQ ID NO: 480119 - RNA, 15 nt, Chlamydia trachomatis
ucuauuuucucuuua

SEQ ID NO: 480120 - RNA, 14 nt, Chlamydia trachomatis
ucuauugagaagac

SEQ ID NO: 480121 - RNA, 16 nt, Chlamydia trachomatis
ucuccuaacccuaaaa

SEQ ID NO: 480122 - RNA, 15 nt, Chlamydia trachomatis
ucuccgugaagauua

SEQ ID NO: 480123 - RNA, 23 nt, Chlamydia trachomatis
ucuccuaauucaacauaauaaau

SEQ ID NO: 480124 - RNA, 14 nt, Chlamydia trachomatis
ucuccuagagaaac

SEQ ID NO: 480125 - RNA, 14 nt, Chlamydia trachomatis
ucuccuuccucuuu

SEQ ID NO: 480126 - RNA, 16 nt, Chlamydia trachomatis
ucuccuuccucuuuaa

SEQ ID NO: 480127 - RNA, 19 nt, Chlamydia trachomatis
ucuccuugaacaauuugug

SEQ ID NO: 480128 - RNA, 14 nt, Chlamydia trachomatis
ucuccaucugacuu

SEQ ID NO: 480129 - RNA, 20 nt, Chlamydia trachomatis
ucucccaagaaacuuuucug

SEQ ID NO: 480130 - RNA, 18 nt, Chlamydia trachomatis
ucucagauucgaauaauc

SEQ ID NO: 480131 - RNA, 21 nt, Chlamydia trachomatis
ucucauaagaucuuuacuuuc

SEQ ID NO: 480132 - RNA, 14 nt, Chlamydia trachomatis
ucuccaaauaaucc

SEQ ID NO: 480133 - RNA, 16 nt, Chlamydia trachomatis
ucuccaaauaauccca

SEQ ID NO: 480134 - RNA, 14 nt, Chlamydia trachomatis
ucuccaaacucuau

SEQ ID NO: 480135 - RNA, 13 nt, Chlamydia trachomatis
ucuccaacaguga

SEQ ID NO: 480136 - RNA, 15 nt, Chlamydia trachomatis
ucuccaaucacagca

SEQ ID NO: 480137 - RNA, 15 nt, Chlamydia trachomatis
ucuauggcaaaaggu

SEQ ID NO: 480138 - RNA, 20 nt, Chlamydia trachomatis
ucuauguaaaaauucuaaag

SEQ ID NO: 480139 - RNA, 19 nt, Chlamydia trachomatis
ucuauuaagaaucuuugaa

SEQ ID NO: 480140 - RNA, 14 nt, Chlamydia trachomatis
ucuauuaaagcuuu

SEQ ID NO: 480141 - RNA, 12 nt, Chlamydia trachomatis
ucuaugaaaaaa

SEQ ID NO: 480142 - RNA, 14 nt, Chlamydia trachomatis
ucuaucaacaucug

SEQ ID NO: 480143 - RNA, 19 nt, Chlamydia trachomatis
ucuauccggaguaccaaaa

SEQ ID NO: 480144 - RNA, 17 nt, Chlamydia trachomatis
ucuauagccaaaugcac

SEQ ID NO: 480145 - RNA, 22 nt, Chlamydia trachomatis
ucuauaggauaaauuaauguaa

SEQ ID NO: 480146 - RNA, 22 nt, Chlamydia trachomatis
ucuauaggaugguauucgcugu

SEQ ID NO: 480147 - RNA, 15 nt, Chlamydia trachomatis
ucuagcuuuuuucag

SEQ ID NO: 480148 - RNA, 22 nt, Chlamydia trachomatis
ucuaggaagaagaagaacugca

SEQ ID NO: 480149 - RNA, 22 nt, Chlamydia trachomatis
ucuaggagauaagcaagcauaa

SEQ ID NO: 480150 - RNA, 17 nt, Chlamydia trachomatis
ucuaggcugacuuucac

SEQ ID NO: 480151 - RNA, 18 nt, Chlamydia trachomatis
ucuaggcugacuuucaca

SEQ ID NO: 480152 - RNA, 22 nt, Chlamydia trachomatis
ucuaguuauauugcuucauaaa

SEQ ID NO: 480153 - RNA, 16 nt, Chlamydia trachomatis
ucuauaaauuauacaa

SEQ ID NO: 480154 - RNA, 13 nt, Chlamydia trachomatis
ucuacuuucccua

SEQ ID NO: 480155 - RNA, 15 nt, Chlamydia trachomatis
ucuagaaaagagcag

SEQ ID NO: 480156 - RNA, 17 nt, Chlamydia trachomatis
ucuagaagaacuccccc

SEQ ID NO: 480157 - RNA, 23 nt, Chlamydia trachomatis
ucuagacaaacaccuauggguau

SEQ ID NO: 480158 - RNA, 15 nt, Chlamydia trachomatis
ucuagacauagcuug

SEQ ID NO: 480159 - RNA, 23 nt, Chlamydia trachomatis
ucuagagauaucccuaaagaggc

SEQ ID NO: 480160 - RNA, 14 nt, Chlamydia trachomatis
ucuagauagaagag

SEQ ID NO: 480161 - RNA, 21 nt, Chlamydia trachomatis
ucuagauggauaaucucugaa

SEQ ID NO: 480162 - RNA, 15 nt, Chlamydia trachomatis
ucuagcgcacuauua

SEQ ID NO: 480163 - RNA, 17 nt, Chlamydia trachomatis
ucuagcgcacuauuagg

SEQ ID NO: 480164 - RNA, 14 nt, Chlamydia trachomatis
ucuagcuagaagcc

SEQ ID NO: 480165 - RNA, 19 nt, Chlamydia trachomatis
ucuagcugauaaggaggcu

SEQ ID NO: 480166 - RNA, 14 nt, Chlamydia trachomatis
ucugagcuuugagg

SEQ ID NO: 480167 - RNA, 17 nt, Chlamydia trachomatis
ucugaguauuaaggaaa

SEQ ID NO: 480168 - RNA, 18 nt, Chlamydia trachomatis
ucugauguuccaucuuuu

SEQ ID NO: 480169 - RNA, 13 nt, Chlamydia trachomatis
ucugaaaggccag

SEQ ID NO: 480170 - RNA, 13 nt, Chlamydia trachomatis
ucugaacaagaag

SEQ ID NO: 480171 - RNA, 13 nt, Chlamydia trachomatis
ucugaacauacaa

SEQ ID NO: 480172 - RNA, 16 nt, Chlamydia trachomatis
ucucgcgcuaaaaccu

SEQ ID NO: 480173 - RNA, 17 nt, Chlamydia trachomatis
ucucgaacucagcuucc

SEQ ID NO: 480174 - RNA, 22 nt, Chlamydia trachomatis
ucucgaacucagcuuccuuggc

SEQ ID NO: 480175 - RNA, 19 nt, Chlamydia trachomatis
ucugcauuaaacacuagcc

SEQ ID NO: 480176 - RNA, 13 nt, Chlamydia trachomatis
ucugcauugguau

SEQ ID NO: 480177 - RNA, 12 nt, Chlamydia trachomatis
ucugcauauuua

SEQ ID NO: 480178 - RNA, 13 nt, Chlamydia trachomatis
ucugcauauuuaa

SEQ ID NO: 480179 - RNA, 16 nt, Chlamydia trachomatis
ucugcauauuuaauug

SEQ ID NO: 480180 - RNA, 19 nt, Chlamydia trachomatis
ucugcaggucuaggggaag

SEQ ID NO: 480181 - RNA, 21 nt, Chlamydia trachomatis
ucugcauaacagcaagacaac

SEQ ID NO: 480182 - RNA, 16 nt, Chlamydia trachomatis
ucugccauuucuaaag

SEQ ID NO: 480183 - RNA, 13 nt, Chlamydia trachomatis
ucugccgagcauu

SEQ ID NO: 480184 - RNA, 15 nt, Chlamydia trachomatis
ucugcgaaagaaacu

SEQ ID NO: 480185 - RNA, 18 nt, Chlamydia trachomatis
ucugcuuccguaacaaua

SEQ ID NO: 480186 - RNA, 17 nt, Chlamydia trachomatis
ucuggauauaccacgga

SEQ ID NO: 480187 - RNA, 19 nt, Chlamydia trachomatis
ucugcuugcgaauaacuaa

SEQ ID NO: 480188 - RNA, 17 nt, Chlamydia trachomatis
ucugcuuugucucugug

SEQ ID NO: 480189 - RNA, 20 nt, Chlamydia trachomatis
ucugggaaaauuaaaaggcg

SEQ ID NO: 480190 - RNA, 22 nt, Chlamydia trachomatis
ucugggaggagaacucuuuccu

SEQ ID NO: 480191 - RNA, 21 nt, Chlamydia trachomatis
ucugggacuuggguaagagca

SEQ ID NO: 480192 - RNA, 15 nt, Chlamydia trachomatis
ucuguaucaaauuuu

SEQ ID NO: 480193 - RNA, 22 nt, Chlamydia trachomatis
ucuguaucaaauuuuucagaaa

SEQ ID NO: 480194 - RNA, 18 nt, Chlamydia trachomatis
ucugucuggauaccagua

SEQ ID NO: 480195 - RNA, 16 nt, Chlamydia trachomatis
ucuguagagagcccca

SEQ ID NO: 480196 - RNA, 22 nt, Chlamydia trachomatis
ucuguagagccaugaucaaaga

SEQ ID NO: 480197 - RNA, 23 nt, Chlamydia trachomatis
ucuguagauucagcaagauucuc

SEQ ID NO: 480198 - RNA, 21 nt, Chlamydia trachomatis
ucugguacucaucuuuuuuaa

SEQ ID NO: 480199 - RNA, 22 nt, Chlamydia trachomatis
ucuguuuuuucagggauagaaa

SEQ ID NO: 480200 - RNA, 15 nt, Chlamydia trachomatis
ucuuaaacaaaaaua

SEQ ID NO: 480201 - RNA, 22 nt, Chlamydia trachomatis
ucuuaaaggucgagcucccauu

SEQ ID NO: 480202 - RNA, 17 nt, Chlamydia trachomatis
ucuucauguucugugaa

SEQ ID NO: 480203 - RNA, 15 nt, Chlamydia trachomatis
ucuuccaaaggauau

SEQ ID NO: 480204 - RNA, 19 nt, Chlamydia trachomatis
ucuuccaacaauuuucguu

SEQ ID NO: 480205 - RNA, 23 nt, Chlamydia trachomatis
ucuucccugagaaauugcucagg

SEQ ID NO: 480206 - RNA, 21 nt, Chlamydia trachomatis
ucuuccgaagauucgcugcug

SEQ ID NO: 480207 - RNA, 13 nt, Chlamydia trachomatis
ucuuccgauuagu

SEQ ID NO: 480208 - RNA, 19 nt, Chlamydia trachomatis
ucuuccucaguauaaaaaa

SEQ ID NO: 480209 - RNA, 16 nt, Chlamydia trachomatis
ucuucaggauuggaaa

SEQ ID NO: 480210 - RNA, 18 nt, Chlamydia trachomatis
ucuucaggugaucucuuu

SEQ ID NO: 480211 - RNA, 18 nt, Chlamydia trachomatis
ucuucagguugcuugaau

SEQ ID NO: 480212 - RNA, 20 nt, Chlamydia trachomatis
ucuucagguugcuugaauaa

SEQ ID NO: 480213 - RNA, 12 nt, Chlamydia trachomatis
ucuucauaaaac

SEQ ID NO: 480214 - RNA, 21 nt, Chlamydia trachomatis
ucuucauaaaacuauggagag

SEQ ID NO: 480215 - RNA, 22 nt, Chlamydia trachomatis
ucuucauaaaacuauggagagg

SEQ ID NO: 480216 - RNA, 16 nt, Chlamydia trachomatis
ucuucauagcuucuaa

SEQ ID NO: 480217 - RNA, 21 nt, Chlamydia trachomatis
ucuucgcaaacugcucuucua

SEQ ID NO: 480218 - RNA, 22 nt, Chlamydia trachomatis
ucuucgcaaacugcucuucuaa

SEQ ID NO: 480219 - RNA, 20 nt, Chlamydia trachomatis
ucuucgaugcuauuuucagc

SEQ ID NO: 480220 - RNA, 16 nt, Chlamydia trachomatis
ucuucgagucuucccu

SEQ ID NO: 480221 - RNA, 15 nt, Chlamydia trachomatis
ucuucgaaauauugu

SEQ ID NO: 480222 - RNA, 15 nt, Chlamydia trachomatis
ucuucgaauccuaaa

SEQ ID NO: 480223 - RNA, 13 nt, Chlamydia trachomatis
ucuuccuguaaga

SEQ ID NO: 480224 - RNA, 20 nt, Chlamydia trachomatis
ucuucuaaagaaucuaccac

SEQ ID NO: 480225 - RNA, 13 nt, Chlamydia trachomatis
ucuucuaaaggau

SEQ ID NO: 480226 - RNA, 16 nt, Chlamydia trachomatis
ucuucuaaaugcugua

SEQ ID NO: 480227 - RNA, 16 nt, Chlamydia trachomatis
ucuucuaacuuuucaa

SEQ ID NO: 480228 - RNA, 13 nt, Chlamydia trachomatis
ucuucuaagaagu

SEQ ID NO: 480229 - RNA, 16 nt, Chlamydia trachomatis
ucuucuaaguauucuu

SEQ ID NO: 480230 - RNA, 22 nt, Chlamydia trachomatis
ucuucuagaggaguucccguua

SEQ ID NO: 480231 - RNA, 23 nt, Chlamydia trachomatis
ucuucuagauagagauuccacua

SEQ ID NO: 480232 - RNA, 19 nt, Chlamydia trachomatis
ucuucuagagauaucccua

SEQ ID NO: 480233 - RNA, 22 nt, Chlamydia trachomatis
ucuucuauccauuguagaugcu

SEQ ID NO: 480234 - RNA, 16 nt, Chlamydia trachomatis
ucuucucgaaagagaa

SEQ ID NO: 480235 - RNA, 22 nt, Chlamydia trachomatis
ucuucucgagaagaaaaacggu

SEQ ID NO: 480236 - RNA, 17 nt, Chlamydia trachomatis
ucuucuuuggaaaaaaa

SEQ ID NO: 480237 - RNA, 13 nt, Chlamydia trachomatis
ucuucuuucucuu

SEQ ID NO: 480238 - RNA, 13 nt, Chlamydia trachomatis
ucuucuucgaaau

SEQ ID NO: 480239 - RNA, 19 nt, Chlamydia trachomatis
ucuucuugaauggcaagga

SEQ ID NO: 480240 - RNA, 22 nt, Chlamydia trachomatis
ucuucuugaauggcaaggacaa

SEQ ID NO: 480241 - RNA, 15 nt, Chlamydia trachomatis
ucuucuggagcaacu

SEQ ID NO: 480242 - RNA, 23 nt, Chlamydia trachomatis
ucuucuggcgaaucaauuucuag

SEQ ID NO: 480243 - RNA, 18 nt, Chlamydia trachomatis
ucuucuguagccccaguc

SEQ ID NO: 480244 - RNA, 19 nt, Chlamydia trachomatis
ucuucugaaaaaucaagga

SEQ ID NO: 480245 - RNA, 22 nt, Chlamydia trachomatis
ucuucugaacaacauccuuuau

SEQ ID NO: 480246 - RNA, 16 nt, Chlamydia trachomatis
ucuucugaagagaaaa

SEQ ID NO: 480247 - RNA, 17 nt, Chlamydia trachomatis
ucuugaggaagagagaa

SEQ ID NO: 480248 - RNA, 19 nt, Chlamydia trachomatis
ucuugagcauugacaugcc

SEQ ID NO: 480249 - RNA, 21 nt, Chlamydia trachomatis
ucuugaucugaaaagagaaga

SEQ ID NO: 480250 - RNA, 23 nt, Chlamydia trachomatis
ucuugaucugaaaagagaagaag

SEQ ID NO: 480251 - RNA, 17 nt, Chlamydia trachomatis
ucuugauagucuugcau

SEQ ID NO: 480252 - RNA, 16 nt, Chlamydia trachomatis
ucuugaaucagaaguu

SEQ ID NO: 480253 - RNA, 13 nt, Chlamydia trachomatis
ucuugaauggcaa

SEQ ID NO: 480254 - RNA, 18 nt, Chlamydia trachomatis
ucuugaauggcaaggaca

SEQ ID NO: 480255 - RNA, 18 nt, Chlamydia trachomatis
ucuugaagauauucaugu

SEQ ID NO: 480256 - RNA, 16 nt, Chlamydia trachomatis
ucuucuuuugagauga

SEQ ID NO: 480257 - RNA, 13 nt, Chlamydia trachomatis
ucuucuuuuucuc

SEQ ID NO: 480258 - RNA, 14 nt, Chlamydia trachomatis
ucuucuuuuucucu

SEQ ID NO: 480259 - RNA, 23 nt, Chlamydia trachomatis
ucuugaaaaggagccuuguaucu

SEQ ID NO: 480260 - RNA, 15 nt, Chlamydia trachomatis
ucuuguaauugcagu

SEQ ID NO: 480261 - RNA, 16 nt, Chlamydia trachomatis
ucuugucuuugcucuu

SEQ ID NO: 480262 - RNA, 22 nt, Chlamydia trachomatis
ucuuuacuaggagcaaaaagug

SEQ ID NO: 480263 - RNA, 14 nt, Chlamydia trachomatis
ucuuuagaaacuaa

SEQ ID NO: 480264 - RNA, 15 nt, Chlamydia trachomatis
ucuuuagaagaaaag

SEQ ID NO: 480265 - RNA, 19 nt, Chlamydia trachomatis
ucuuuagaagaaaagagcu

SEQ ID NO: 480266 - RNA, 17 nt, Chlamydia trachomatis
ugaauuccaaguugcuu

SEQ ID NO: 480267 - RNA, 18 nt, Chlamydia trachomatis
ugaauuggcguuccauua

SEQ ID NO: 480268 - RNA, 15 nt, Chlamydia trachomatis
ugaauuucaggagua

SEQ ID NO: 480269 - RNA, 19 nt, Chlamydia trachomatis
ugaauaucguaaacaacca

SEQ ID NO: 480270 - RNA, 15 nt, Chlamydia trachomatis
ugaaugagcuuagau

SEQ ID NO: 480271 - RNA, 12 nt, Chlamydia trachomatis
ugaaugaauuca

SEQ ID NO: 480272 - RNA, 12 nt, Chlamydia trachomatis
ucuuucaaagag

SEQ ID NO: 480273 - RNA, 23 nt, Chlamydia trachomatis
ucuuuauagaaggucugaacaac

SEQ ID NO: 480274 - RNA, 16 nt, Chlamydia trachomatis
ucuuuauagaauuuuu

SEQ ID NO: 480275 - RNA, 23 nt, Chlamydia trachomatis
ucuuuauagaauuuuucuaaaau

SEQ ID NO: 480276 - RNA, 16 nt, Chlamydia trachomatis
ucuuucacaacccaag

SEQ ID NO: 480277 - RNA, 22 nt, Chlamydia trachomatis
ugaauacagucaugcaucccuu

SEQ ID NO: 480278 - RNA, 21 nt, Chlamydia trachomatis
ugaauauaccccgaacaaucu

SEQ ID NO: 480279 - RNA, 20 nt, Chlamydia trachomatis
ugacagcuuucacagggaca

SEQ ID NO: 480280 - RNA, 13 nt, Chlamydia trachomatis
ugacauaagcaaa

SEQ ID NO: 480281 - RNA, 12 nt, Chlamydia trachomatis
ugaccaauaccu

SEQ ID NO: 480282 - RNA, 17 nt, Chlamydia trachomatis
ugacagguuucaugaca

SEQ ID NO: 480283 - RNA, 18 nt, Chlamydia trachomatis
ugacccauccaaaacauc

SEQ ID NO: 480284 - RNA, 22 nt, Chlamydia trachomatis
ugaccucagauuuaucugcuau

SEQ ID NO: 480285 - RNA, 14 nt, Chlamydia trachomatis
ugacugcgcuauga

SEQ ID NO: 480286 - RNA, 18 nt, Chlamydia trachomatis
ugacuccuucucgcaaaa

SEQ ID NO: 480287 - RNA, 14 nt, Chlamydia trachomatis
ugacucccauaauc

SEQ ID NO: 480288 - RNA, 15 nt, Chlamydia trachomatis
ugacucccauaauca

SEQ ID NO: 480289 - RNA, 14 nt, Chlamydia trachomatis
ugacggauccugcu

SEQ ID NO: 480290 - RNA, 22 nt, Chlamydia trachomatis
ugacuuuuauucacccaaauau

SEQ ID NO: 480291 - RNA, 17 nt, Chlamydia trachomatis
ugacuugaguaaucagu

SEQ ID NO: 480292 - RNA, 18 nt, Chlamydia trachomatis
ugacuguaaguuuauucc

SEQ ID NO: 480293 - RNA, 14 nt, Chlamydia trachomatis
ugagaugaaaauau

SEQ ID NO: 480294 - RNA, 21 nt, Chlamydia trachomatis
ugagauguuuacgaggagguu

SEQ ID NO: 480295 - RNA, 12 nt, Chlamydia trachomatis
ugagaagcuuag

SEQ ID NO: 480296 - RNA, 16 nt, Chlamydia trachomatis
ugagaagcaucucaau

SEQ ID NO: 480297 - RNA, 16 nt, Chlamydia trachomatis
ugagaauccaaauuuu

SEQ ID NO: 480298 - RNA, 15 nt, Chlamydia trachomatis
ugagcagcaaagauc

SEQ ID NO: 480299 - RNA, 17 nt, Chlamydia trachomatis
ugagccuugccuacaga

SEQ ID NO: 480300 - RNA, 14 nt, Chlamydia trachomatis
ugagccucuaacuc

SEQ ID NO: 480301 - RNA, 17 nt, Chlamydia trachomatis
ugagccuucaauucuug

SEQ ID NO: 480302 - RNA, 15 nt, Chlamydia trachomatis
ugagcccaaggagaa

SEQ ID NO: 480303 - RNA, 19 nt, Chlamydia trachomatis
ugagcugucucugauguaa

SEQ ID NO: 480304 - RNA, 22 nt, Chlamydia trachomatis
ugagcuucucgcuacaaauccu

SEQ ID NO: 480305 - RNA, 14 nt, Chlamydia trachomatis
ugagcuuuauugaa

SEQ ID NO: 480306 - RNA, 17 nt, Chlamydia trachomatis
ugagcuuuauuuucaua

SEQ ID NO: 480307 - RNA, 14 nt, Chlamydia trachomatis
ugaggauccuuagu

SEQ ID NO: 480308 - RNA, 13 nt, Chlamydia trachomatis
ugagcuuugagga

SEQ ID NO: 480309 - RNA, 16 nt, Chlamydia trachomatis
ugagcuuuuuuucacu

SEQ ID NO: 480310 - RNA, 21 nt, Chlamydia trachomatis
ugaggaagauaaguccuccua

SEQ ID NO: 480311 - RNA, 15 nt, Chlamydia trachomatis
ugaggcuuguugcca

SEQ ID NO: 480312 - RNA, 23 nt, Chlamydia trachomatis
ugaggcuuuguccuggccaaaaa

SEQ ID NO: 480313 - RNA, 24 nt, Chlamydia trachomatis
ugagggagcaguuuaggacgcuuc

SEQ ID NO: 480314 - RNA, 16 nt, Chlamydia trachomatis
ugagguccaaaauuuc

SEQ ID NO: 480315 - RNA, 22 nt, Chlamydia trachomatis
ugagguccaaaauuucagggaa

SEQ ID NO: 480316 - RNA, 15 nt, Chlamydia trachomatis
ugaguauuaaggaaa

SEQ ID NO: 480317 - RNA, 20 nt, Chlamydia trachomatis
ugagugcagaggauuuauaa

SEQ ID NO: 480318 - RNA, 20 nt, Chlamydia trachomatis
ugaguggcaagggggagcau

SEQ ID NO: 480319 - RNA, 15 nt, Chlamydia trachomatis
ugaguggggcucgau

SEQ ID NO: 480320 - RNA, 14 nt, Chlamydia trachomatis
ugaguguagucuuu

SEQ ID NO: 480321 - RNA, 14 nt, Chlamydia trachomatis
ugagugugagucua

SEQ ID NO: 480322 - RNA, 16 nt, Chlamydia trachomatis
ugauaucccuuuccaa

SEQ ID NO: 480323 - RNA, 23 nt, Chlamydia trachomatis
ugauaucccuuuccaagaaucaa

SEQ ID NO: 480324 - RNA, 14 nt, Chlamydia trachomatis
ugauauuaguuagu

SEQ ID NO: 480325 - RNA, 21 nt, Chlamydia trachomatis
ugauauuaguuagugaagucu

SEQ ID NO: 480326 - RNA, 22 nt, Chlamydia trachomatis
ugauauucccuucuauuucucu

SEQ ID NO: 480327 - RNA, 15 nt, Chlamydia trachomatis
ugauccccuacgcua

SEQ ID NO: 480328 - RNA, 22 nt, Chlamydia trachomatis
ugauccaguucuggagcaacaa

SEQ ID NO: 480329 - RNA, 12 nt, Chlamydia trachomatis
ugauauuuugaa

SEQ ID NO: 480330 - RNA, 17 nt, Chlamydia trachomatis
ugaucacuaauauagaa

SEQ ID NO: 480331 - RNA, 18 nt, Chlamydia trachomatis
ugaucacuaauauagaau

SEQ ID NO: 480332 - RNA, 21 nt, Chlamydia trachomatis
ugaucgcaaaugcguuaaacu

SEQ ID NO: 480333 - RNA, 15 nt, Chlamydia trachomatis
ugaugcaccauaaua

SEQ ID NO: 480334 - RNA, 13 nt, Chlamydia trachomatis
ugauuuuucuuuc

SEQ ID NO: 480335 - RNA, 15 nt, Chlamydia trachomatis
ugauuuuucuuucaa

SEQ ID NO: 480336 - RNA, 15 nt, Chlamydia trachomatis
ugauuuuuucgcuuu

SEQ ID NO: 480337 - RNA, 12 nt, Chlamydia trachomatis
ugauuuuaaacc

SEQ ID NO: 480338 - RNA, 16 nt, Chlamydia trachomatis
ugauuuuaaaccaauc

SEQ ID NO: 480339 - RNA, 18 nt, Chlamydia trachomatis
ugauuguugguugcucca

SEQ ID NO: 480340 - RNA, 15 nt, Chlamydia trachomatis
ugauguuccaucuuu

SEQ ID NO: 480341 - RNA, 20 nt, Chlamydia trachomatis
ugcaaacgguagcgauuuuc

SEQ ID NO: 480342 - RNA, 15 nt, Chlamydia trachomatis
ugcaaagaguaggga

SEQ ID NO: 480343 - RNA, 17 nt, Chlamydia trachomatis
ugcaaaggauaaauauu

SEQ ID NO: 480344 - RNA, 15 nt, Chlamydia trachomatis
ugcaagggaacaaac

SEQ ID NO: 480345 - RNA, 22 nt, Chlamydia trachomatis
ugcaauaaggggaagaaauauu

SEQ ID NO: 480346 - RNA, 16 nt, Chlamydia trachomatis
ugcaauccuuuuuccu

SEQ ID NO: 480347 - RNA, 17 nt, Chlamydia trachomatis
ugcaauccuuuuuccuu

SEQ ID NO: 480348 - RNA, 21 nt, Chlamydia trachomatis
ugcaaucauuugugugccaau

SEQ ID NO: 480349 - RNA, 19 nt, Chlamydia trachomatis
ugcaaucuagcgccuacac

SEQ ID NO: 480350 - RNA, 17 nt, Chlamydia trachomatis
ugcacaaaaaaaaagag

SEQ ID NO: 480351 - RNA, 18 nt, Chlamydia trachomatis
ugcacaaguuuauggaaa

SEQ ID NO: 480352 - RNA, 13 nt, Chlamydia trachomatis
ugcacaaucucuu

SEQ ID NO: 480353 - RNA, 14 nt, Chlamydia trachomatis
ugcacaccugcuuu

SEQ ID NO: 480354 - RNA, 12 nt, Chlamydia trachomatis
ugcagaaauccc

SEQ ID NO: 480355 - RNA, 19 nt, Chlamydia trachomatis
ugcagaagaauaggaaucc

SEQ ID NO: 480356 - RNA, 18 nt, Chlamydia trachomatis
ugcagacaagccuucagg

SEQ ID NO: 480357 - RNA, 20 nt, Chlamydia trachomatis
ugcagagggggguguuuuuu

SEQ ID NO: 480358 - RNA, 22 nt, Chlamydia trachomatis
ugcagcaucuauuuucucuuua

SEQ ID NO: 480359 - RNA, 17 nt, Chlamydia trachomatis
ugcaggauauccaucaa

SEQ ID NO: 480360 - RNA, 20 nt, Chlamydia trachomatis
ugcaggauauccaucaauca

SEQ ID NO: 480361 - RNA, 18 nt, Chlamydia trachomatis
ugcaggcgagucuuucua

SEQ ID NO: 480362 - RNA, 18 nt, Chlamydia trachomatis
ugcaguaccauuacuaca

SEQ ID NO: 480363 - RNA, 14 nt, Chlamydia trachomatis
ugccacuacuucag

SEQ ID NO: 480364 - RNA, 17 nt, Chlamydia trachomatis
ugccacuacuucaggau

SEQ ID NO: 480365 - RNA, 23 nt, Chlamydia trachomatis
ugccaauaguaacggaacucuac

SEQ ID NO: 480366 - RNA, 22 nt, Chlamydia trachomatis
ugccaaucuguaauaaacccug

SEQ ID NO: 480367 - RNA, 14 nt, Chlamydia trachomatis
ugcccaaacuccau

SEQ ID NO: 480368 - RNA, 18 nt, Chlamydia trachomatis
ugcccaugagaaaccaau

SEQ ID NO: 480369 - RNA, 13 nt, Chlamydia trachomatis
ugcccagucaaga

SEQ ID NO: 480370 - RNA, 16 nt, Chlamydia trachomatis
ugccgaacucuccucu

SEQ ID NO: 480371 - RNA, 14 nt, Chlamydia trachomatis
ugccuguugcaaca

SEQ ID NO: 480372 - RNA, 16 nt, Chlamydia trachomatis
ugccuguugcaacaga

SEQ ID NO: 480373 - RNA, 22 nt, Chlamydia trachomatis
ugccuuuaucucccccuguacc

SEQ ID NO: 480374 - RNA, 21 nt, Chlamydia trachomatis
ugccuugaggauaguauucuu

SEQ ID NO: 480375 - RNA, 21 nt, Chlamydia trachomatis
ugcgacaguaccgucacucuu

SEQ ID NO: 480376 - RNA, 20 nt, Chlamydia trachomatis
ugcgaggcuuuuuuuuucau

SEQ ID NO: 480377 - RNA, 15 nt, Chlamydia trachomatis
ugcgaugccucuaac

SEQ ID NO: 480378 - RNA, 18 nt, Chlamydia trachomatis
ugcgaugccucuaacacu

SEQ ID NO: 480379 - RNA, 13 nt, Chlamydia trachomatis
ugcgauagaugua

SEQ ID NO: 480380 - RNA, 18 nt, Chlamydia trachomatis
ugcgauaacaacaauaaa

SEQ ID NO: 480381 - RNA, 14 nt, Chlamydia trachomatis
ugcgauuuuuuuua

SEQ ID NO: 480382 - RNA, 21 nt, Chlamydia trachomatis
ugcgcaaucauaucaagaauu

SEQ ID NO: 480383 - RNA, 14 nt, Chlamydia trachomatis
ugcgcaucacgaag

SEQ ID NO: 480384 - RNA, 18 nt, Chlamydia trachomatis
ugcggcuccuucuugaug

SEQ ID NO: 480385 - RNA, 18 nt, Chlamydia trachomatis
ugcguauagagcauauca

SEQ ID NO: 480386 - RNA, 16 nt, Chlamydia trachomatis
ugcguauuugaaauca

SEQ ID NO: 480387 - RNA, 23 nt, Chlamydia trachomatis
ugcguauuugaaaucaaaaggcc

SEQ ID NO: 480388 - RNA, 19 nt, Chlamydia trachomatis
ugcuauuacauauaggcug

SEQ ID NO: 480389 - RNA, 23 nt, Chlamydia trachomatis
ugcucaaagauuuuaugacccag

SEQ ID NO: 480390 - RNA, 19 nt, Chlamydia trachomatis
ugcuauccugcucaacaua

SEQ ID NO: 480391 - RNA, 16 nt, Chlamydia trachomatis
ugcuaggguucuaaag

SEQ ID NO: 480392 - RNA, 18 nt, Chlamydia trachomatis
ugcuaggucucccuagca

SEQ ID NO: 480393 - RNA, 14 nt, Chlamydia trachomatis
ugcuaaaaaugcuu

SEQ ID NO: 480394 - RNA, 13 nt, Chlamydia trachomatis
ugcuaacaaagaa

SEQ ID NO: 480395 - RNA, 14 nt, Chlamydia trachomatis
ugcuaacaaagaau

SEQ ID NO: 480396 - RNA, 19 nt, Chlamydia trachomatis
ugcuaacaaagaauuuucc

SEQ ID NO: 480397 - RNA, 16 nt, Chlamydia trachomatis
ugcuaacgcuucuucu

SEQ ID NO: 480398 - RNA, 18 nt, Chlamydia trachomatis
ugcuaagaacauaacaag

SEQ ID NO: 480399 - RNA, 16 nt, Chlamydia trachomatis
ugcuaaggagaauucu

SEQ ID NO: 480400 - RNA, 22 nt, Chlamydia trachomatis
ugcuacaagggugcuaacuuuc

SEQ ID NO: 480401 - RNA, 22 nt, Chlamydia trachomatis
ugcuacaguaucugcuaguccu

SEQ ID NO: 480402 - RNA, 15 nt, Chlamydia trachomatis
ugcuacggaaaccaa

SEQ ID NO: 480403 - RNA, 17 nt, Chlamydia trachomatis
ugcucagagaucccagg

SEQ ID NO: 480404 - RNA, 22 nt, Chlamydia trachomatis
ugcucccaauauacaaguauuu

SEQ ID NO: 480405 - RNA, 13 nt, Chlamydia trachomatis
ugcucuugaagau

SEQ ID NO: 480406 - RNA, 17 nt, Chlamydia trachomatis
ugcucuugaagauauuc

SEQ ID NO: 480407 - RNA, 18 nt, Chlamydia trachomatis
ugcugaauauucccgaac

SEQ ID NO: 480408 - RNA, 16 nt, Chlamydia trachomatis
ugcucuauaacauucu

SEQ ID NO: 480409 - RNA, 14 nt, Chlamydia trachomatis
ugcucuaccaacug

SEQ ID NO: 480410 - RNA, 19 nt, Chlamydia trachomatis
ugcucuaccaacugagcua

SEQ ID NO: 480411 - RNA, 13 nt, Chlamydia trachomatis
ugcucuaaaggau

SEQ ID NO: 480412 - RNA, 20 nt, Chlamydia trachomatis
ugcucuaaccaccugagcua

SEQ ID NO: 480413 - RNA, 15 nt, Chlamydia trachomatis
ugcugucagaagaau

SEQ ID NO: 480414 - RNA, 15 nt, Chlamydia trachomatis
ugcugucuugucuuu

SEQ ID NO: 480415 - RNA, 21 nt, Chlamydia trachomatis
ugcugcuaucaucuuuugccu

SEQ ID NO: 480416 - RNA, 18 nt, Chlamydia trachomatis
ugcugcguuacccuucca

SEQ ID NO: 480417 - RNA, 14 nt, Chlamydia trachomatis
ugcugaaugguggc

SEQ ID NO: 480418 - RNA, 15 nt, Chlamydia trachomatis
ugcuuccgaaagcau

SEQ ID NO: 480419 - RNA, 24 nt, Chlamydia trachomatis
ugcuucgccaaacacugcaacagu

SEQ ID NO: 480420 - RNA, 16 nt, Chlamydia trachomatis
ugcuuggcaaucugca

SEQ ID NO: 480421 - RNA, 20 nt, Chlamydia trachomatis
ugcuuguccauauauuggag

SEQ ID NO: 480422 - RNA, 16 nt, Chlamydia trachomatis
ugcuuucuuuguuccu

SEQ ID NO: 480423 - RNA, 20 nt, Chlamydia trachomatis
ugcuuuuuaauauccuccaa

SEQ ID NO: 480424 - RNA, 21 nt, Chlamydia trachomatis
uggaaaguacucgauggcagg

SEQ ID NO: 480425 - RNA, 21 nt, Chlamydia trachomatis
uggaagcagaaagaaugcuug

SEQ ID NO: 480426 - RNA, 24 nt, Chlamydia trachomatis
uggaagaucucuuucucuagaauu

SEQ ID NO: 480427 - RNA, 14 nt, Chlamydia trachomatis
uggaagaucuucag

SEQ ID NO: 480428 - RNA, 15 nt, Chlamydia trachomatis
uggaaguagcauaag

SEQ ID NO: 480429 - RNA, 17 nt, Chlamydia trachomatis
uggaauuuucaucaaaa

SEQ ID NO: 480430 - RNA, 14 nt, Chlamydia trachomatis
uggaauuguaucca

SEQ ID NO: 480431 - RNA, 17 nt, Chlamydia trachomatis
uggaaugcgcaauccuu

SEQ ID NO: 480432 - RNA, 13 nt, Chlamydia trachomatis
uggaauagcuucu

SEQ ID NO: 480433 - RNA, 19 nt, Chlamydia trachomatis
uggaauagcuucugacucu

SEQ ID NO: 480434 - RNA, 15 nt, Chlamydia trachomatis
uggaaucauauccuu

SEQ ID NO: 480435 - RNA, 21 nt, Chlamydia trachomatis
uggaccagcgcuuucuaaagc

SEQ ID NO: 480436 - RNA, 17 nt, Chlamydia trachomatis
uggagaauuggaaacuc

SEQ ID NO: 480437 - RNA, 17 nt, Chlamydia trachomatis
uggagaggguucucuuu

SEQ ID NO: 480438 - RNA, 17 nt, Chlamydia trachomatis
uggagaggcuauauagu

SEQ ID NO: 480439 - RNA, 19 nt, Chlamydia trachomatis
uggagagucuggacgaugc

SEQ ID NO: 480440 - RNA, 17 nt, Chlamydia trachomatis
uggacuucccuaauaca

SEQ ID NO: 480441 - RNA, 17 nt, Chlamydia trachomatis
uggacuuucuaccgcgg

SEQ ID NO: 480442 - RNA, 14 nt, Chlamydia trachomatis
uggagcaacaacca

SEQ ID NO: 480443 - RNA, 18 nt, Chlamydia trachomatis
uggagauggaguagggga

SEQ ID NO: 480444 - RNA, 18 nt, Chlamydia trachomatis
uggagcuaucauuuccaa

SEQ ID NO: 480445 - RNA, 15 nt, Chlamydia trachomatis
uggaguauuuucaaa

SEQ ID NO: 480446 - RNA, 21 nt, Chlamydia trachomatis
uggaggaggaccucugucaau

SEQ ID NO: 480447 - RNA, 21 nt, Chlamydia trachomatis
uggaggaguauccagaaguuu

SEQ ID NO: 480448 - RNA, 14 nt, Chlamydia trachomatis
uggauaguuucuuu

SEQ ID NO: 480449 - RNA, 15 nt, Chlamydia trachomatis
uggauacuuuuccga

SEQ ID NO: 480450 - RNA, 22 nt, Chlamydia trachomatis
uggauacuuuuccgaauucuuu

SEQ ID NO: 480451 - RNA, 16 nt, Chlamydia trachomatis
uggauaagaacuucuc

SEQ ID NO: 480452 - RNA, 14 nt, Chlamydia trachomatis
uggauaaucucuga

SEQ ID NO: 480453 - RNA, 13 nt, Chlamydia trachomatis
uggaugcacaucc

SEQ ID NO: 480454 - RNA, 20 nt, Chlamydia trachomatis
uggaucgcaugaaugagcuu

SEQ ID NO: 480455 - RNA, 20 nt, Chlamydia trachomatis
uggaucaccgaacaaccuuc

SEQ ID NO: 480456 - RNA, 23 nt, Chlamydia trachomatis
uggaucaccgaacaaccuucuga

SEQ ID NO: 480457 - RNA, 22 nt, Chlamydia trachomatis
uggauccaaaaaagaaucuaaa

SEQ ID NO: 480458 - RNA, 15 nt, Chlamydia trachomatis
uggcacacuccaucu

SEQ ID NO: 480459 - RNA, 16 nt, Chlamydia trachomatis
uggcacacuccaucuc

SEQ ID NO: 480460 - RNA, 23 nt, Chlamydia trachomatis
uggcaccuuuuuugcuaaaagaa

SEQ ID NO: 480461 - RNA, 17 nt, Chlamydia trachomatis
uggcagaugcaucuauu

SEQ ID NO: 480462 - RNA, 12 nt, Chlamydia trachomatis
uggcagaacucg

SEQ ID NO: 480463 - RNA, 21 nt, Chlamydia trachomatis
uggcauagggaucucagcugg

SEQ ID NO: 480464 - RNA, 13 nt, Chlamydia trachomatis
uggcauagucuug

SEQ ID NO: 480465 - RNA, 21 nt, Chlamydia trachomatis
uggcaguuaagccuucuccag

SEQ ID NO: 480466 - RNA, 21 nt, Chlamydia trachomatis
uggcaaggcuuucaaaaagag

SEQ ID NO: 480467 - RNA, 15 nt, Chlamydia trachomatis
uggcaauggcaaaau

SEQ ID NO: 480468 - RNA, 16 nt, Chlamydia trachomatis
uggcaauggcaaaauc

SEQ ID NO: 480469 - RNA, 22 nt, Chlamydia trachomatis
uggauuagaaaaagggagagga

SEQ ID NO: 480470 - RNA, 13 nt, Chlamydia trachomatis
uggauuucuucug

SEQ ID NO: 480471 - RNA, 21 nt, Chlamydia trachomatis
uggauuucuucuguuuuuuca

SEQ ID NO: 480472 - RNA, 20 nt, Chlamydia trachomatis
uggauuugcguuacagaugc

SEQ ID NO: 480473 - RNA, 18 nt, Chlamydia trachomatis
uggcaaaaucuucauaag

SEQ ID NO: 480474 - RNA, 17 nt, Chlamydia trachomatis
uggccauucuuacuaaa

SEQ ID NO: 480475 - RNA, 13 nt, Chlamydia trachomatis
ugggaaaauuaaa

SEQ ID NO: 480476 - RNA, 15 nt, Chlamydia trachomatis
ugggauaagaaaucu

SEQ ID NO: 480477 - RNA, 13 nt, Chlamydia trachomatis
ugggauagauagc

SEQ ID NO: 480478 - RNA, 19 nt, Chlamydia trachomatis
ugggauaugccucuaagca

SEQ ID NO: 480479 - RNA, 13 nt, Chlamydia trachomatis
uggcuuuuggaug

SEQ ID NO: 480480 - RNA, 17 nt, Chlamydia trachomatis
ugggcaaucaagcuaau

SEQ ID NO: 480481 - RNA, 15 nt, Chlamydia trachomatis
ugggaucuucgucag

SEQ ID NO: 480482 - RNA, 21 nt, Chlamydia trachomatis
ugggaucuucgucagggagaa

SEQ ID NO: 480483 - RNA, 18 nt, Chlamydia trachomatis
ugggauggaaauaauuuc

SEQ ID NO: 480484 - RNA, 22 nt, Chlamydia trachomatis
ugggauuucgauuaaugagguu

SEQ ID NO: 480485 - RNA, 15 nt, Chlamydia trachomatis
ugggcagcaagagag

SEQ ID NO: 480486 - RNA, 18 nt, Chlamydia trachomatis
ugggccguuuuucuccau

SEQ ID NO: 480487 - RNA, 16 nt, Chlamydia trachomatis
ugggccugauuucucu

SEQ ID NO: 480488 - RNA, 18 nt, Chlamydia trachomatis
ugggcugcaucagcaaga

SEQ ID NO: 480489 - RNA, 17 nt, Chlamydia trachomatis
ugggcugcugcuuggaa

SEQ ID NO: 480490 - RNA, 17 nt, Chlamydia trachomatis
ugggcucguggagggga

SEQ ID NO: 480491 - RNA, 15 nt, Chlamydia trachomatis
uggugagugcauaga

SEQ ID NO: 480492 - RNA, 19 nt, Chlamydia trachomatis
ugguggcgagauuuccagc

SEQ ID NO: 480493 - RNA, 17 nt, Chlamydia trachomatis
ugguguggaguaucuaa

SEQ ID NO: 480494 - RNA, 22 nt, Chlamydia trachomatis
uggucuacuccgaucaauucau

SEQ ID NO: 480495 - RNA, 18 nt, Chlamydia trachomatis
uggucucuguagugggcu

SEQ ID NO: 480496 - RNA, 21 nt, Chlamydia trachomatis
ugguauucuaaauaggaugga

SEQ ID NO: 480497 - RNA, 19 nt, Chlamydia trachomatis
uguacgauggaaauaggac

SEQ ID NO: 480498 - RNA, 22 nt, Chlamydia trachomatis
uguacccguuaagaccugugca

SEQ ID NO: 480499 - RNA, 15 nt, Chlamydia trachomatis
uguacuuuugguucu

SEQ ID NO: 480500 - RNA, 12 nt, Chlamydia trachomatis
uguacaaacacu

SEQ ID NO: 480501 - RNA, 21 nt, Chlamydia trachomatis
uguaauugggggacuucauua

SEQ ID NO: 480502 - RNA, 16 nt, Chlamydia trachomatis
uguaauuuuaaauccu

SEQ ID NO: 480503 - RNA, 17 nt, Chlamydia trachomatis
uguaaaaauucuaaagu

SEQ ID NO: 480504 - RNA, 17 nt, Chlamydia trachomatis
uguaaaaggaauucuuc

SEQ ID NO: 480505 - RNA, 19 nt, Chlamydia trachomatis
uguaaagcauucguuauca

SEQ ID NO: 480506 - RNA, 13 nt, Chlamydia trachomatis
uguaaagcugcuu

SEQ ID NO: 480507 - RNA, 22 nt, Chlamydia trachomatis
uguaaaguaacuacggaaaaag

SEQ ID NO: 480508 - RNA, 13 nt, Chlamydia trachomatis
uguaaccuucccg

SEQ ID NO: 480509 - RNA, 16 nt, Chlamydia trachomatis
uguaacgaaguuagca

SEQ ID NO: 480510 - RNA, 20 nt, Chlamydia trachomatis
uguaacgcagcucaccagcu

SEQ ID NO: 480511 - RNA, 15 nt, Chlamydia trachomatis
uguaacuacaucuaa

SEQ ID NO: 480512 - RNA, 21 nt, Chlamydia trachomatis
uguagagaggcaaacaccuca

SEQ ID NO: 480513 - RNA, 16 nt, Chlamydia trachomatis
uguagaaauuuuaaau

SEQ ID NO: 480514 - RNA, 21 nt, Chlamydia trachomatis
uguagaaagcugggaaaucuu

SEQ ID NO: 480515 - RNA, 19 nt, Chlamydia trachomatis
uguagauacugguaacugu

SEQ ID NO: 480516 - RNA, 17 nt, Chlamydia trachomatis
uguagaugcuguacgaa

SEQ ID NO: 480517 - RNA, 18 nt, Chlamydia trachomatis
uguagaugcuguacgaac

SEQ ID NO: 480518 - RNA, 14 nt, Chlamydia trachomatis
uguagauguagcag

SEQ ID NO: 480519 - RNA, 17 nt, Chlamydia trachomatis
uguaguugccccuuauu

SEQ ID NO: 480520 - RNA, 19 nt, Chlamydia trachomatis
uguagugaucuuuuuagga

SEQ ID NO: 480521 - RNA, 14 nt, Chlamydia trachomatis
uguaggguagaaca

SEQ ID NO: 480522 - RNA, 16 nt, Chlamydia trachomatis
uguauaagaaaaaggu

SEQ ID NO: 480523 - RNA, 20 nt, Chlamydia trachomatis
uguauaagaaaaaggucucc

SEQ ID NO: 480524 - RNA, 21 nt, Chlamydia trachomatis
uguauaacaauuuuaaaaucu

SEQ ID NO: 480525 - RNA, 21 nt, Chlamydia trachomatis
uguauagaguaaguuucuaua

SEQ ID NO: 480526 - RNA, 13 nt, Chlamydia trachomatis
uguauuaacgauu

SEQ ID NO: 480527 - RNA, 21 nt, Chlamydia trachomatis
ugucacagacuccuuacccug

SEQ ID NO: 480528 - RNA, 17 nt, Chlamydia trachomatis
ugucacugcuuccgaaa

SEQ ID NO: 480529 - RNA, 14 nt, Chlamydia trachomatis
ugucagaccuacaa

SEQ ID NO: 480530 - RNA, 22 nt, Chlamydia trachomatis
ugugacguauauuucacaacua

SEQ ID NO: 480531 - RNA, 20 nt, Chlamydia trachomatis
ugugccucuaggcauaguug

SEQ ID NO: 480532 - RNA, 21 nt, Chlamydia trachomatis
ugugcgaggaauucuucuucu

SEQ ID NO: 480533 - RNA, 22 nt, Chlamydia trachomatis
ugugcagaucccggcuugccug

SEQ ID NO: 480534 - RNA, 13 nt, Chlamydia trachomatis
ugugacuccuucu

SEQ ID NO: 480535 - RNA, 12 nt, Chlamydia trachomatis
ugugaggaaagc

SEQ ID NO: 480536 - RNA, 22 nt, Chlamydia trachomatis
ugugcaccgugcucgaaacuca

SEQ ID NO: 480537 - RNA, 17 nt, Chlamydia trachomatis
ugugcuaaaucuccaaa

SEQ ID NO: 480538 - RNA, 23 nt, Chlamydia trachomatis
uguggcauuauuaacaggaagaa

SEQ ID NO: 480539 - RNA, 17 nt, Chlamydia trachomatis
ugugggauagaaacuca

SEQ ID NO: 480540 - RNA, 15 nt, Chlamydia trachomatis
uguuaaagcuuuuuc

SEQ ID NO: 480541 - RNA, 12 nt, Chlamydia trachomatis
uguuaaaucauu

SEQ ID NO: 480542 - RNA, 15 nt, Chlamydia trachomatis
uguuaacaucuuccc

SEQ ID NO: 480543 - RNA, 20 nt, Chlamydia trachomatis
uguuauuuguucucuuagaa

SEQ ID NO: 480544 - RNA, 13 nt, Chlamydia trachomatis
uguucacagaaag

SEQ ID NO: 480545 - RNA, 21 nt, Chlamydia trachomatis
uguucacagaaaguccugcuu

SEQ ID NO: 480546 - RNA, 18 nt, Chlamydia trachomatis
uguucuaaacccucugca

SEQ ID NO: 480547 - RNA, 15 nt, Chlamydia trachomatis
uguuccagaaaaaau

SEQ ID NO: 480548 - RNA, 18 nt, Chlamydia trachomatis
uguucccgcauuuguugu

SEQ ID NO: 480549 - RNA, 21 nt, Chlamydia trachomatis
uguuguuaaagcuuuuuccaa

SEQ ID NO: 480550 - RNA, 15 nt, Chlamydia trachomatis
uguucucuaaagauu

SEQ ID NO: 480551 - RNA, 14 nt, Chlamydia trachomatis
uguucuacacaucu

SEQ ID NO: 480552 - RNA, 15 nt, Chlamydia trachomatis
uguugcagcccggua

SEQ ID NO: 480553 - RNA, 13 nt, Chlamydia trachomatis
uuaaacuuucuug

SEQ ID NO: 480554 - RNA, 18 nt, Chlamydia trachomatis
uuaaaguuucuaauaaua

SEQ ID NO: 480555 - RNA, 14 nt, Chlamydia trachomatis
uuaaaacuccagaa

SEQ ID NO: 480556 - RNA, 23 nt, Chlamydia trachomatis
uuaaaaggccguuuaccaaugaa

SEQ ID NO: 480557 - RNA, 19 nt, Chlamydia trachomatis
uuaaaaggguagaaaaaga

SEQ ID NO: 480558 - RNA, 12 nt, Chlamydia trachomatis
uguuuuguaguu

SEQ ID NO: 480559 - RNA, 14 nt, Chlamydia trachomatis
uuaaaaaacaaaac

SEQ ID NO: 480560 - RNA, 16 nt, Chlamydia trachomatis
uguuuucuuguagaaa

SEQ ID NO: 480561 - RNA, 14 nt, Chlamydia trachomatis
uguuuguauagaac

SEQ ID NO: 480562 - RNA, 19 nt, Chlamydia trachomatis
uguuucggaauucauagaa

SEQ ID NO: 480563 - RNA, 20 nt, Chlamydia trachomatis
uguuucggaauucauagaag

SEQ ID NO: 480564 - RNA, 18 nt, Chlamydia trachomatis
uguuucuacuuuuugaca

SEQ ID NO: 480565 - RNA, 22 nt, Chlamydia trachomatis
uguuucuacuuuuugacauucu

SEQ ID NO: 480566 - RNA, 23 nt, Chlamydia trachomatis
uguuucugaaucaaacagaaccu

SEQ ID NO: 480567 - RNA, 22 nt, Chlamydia trachomatis
uguuucuggaaagagagaaagc

SEQ ID NO: 480568 - RNA, 16 nt, Chlamydia trachomatis
uguuucugggaauuca

SEQ ID NO: 480569 - RNA, 15 nt, Chlamydia trachomatis
uguuuggauaagaac

SEQ ID NO: 480570 - RNA, 21 nt, Chlamydia trachomatis
uguuucgccaaugaucuuuaa

SEQ ID NO: 480571 - RNA, 20 nt, Chlamydia trachomatis
uguuucccuuugguuuugau

SEQ ID NO: 480572 - RNA, 19 nt, Chlamydia trachomatis
uguuuccaaagcuuuaaua

SEQ ID NO: 480573 - RNA, 14 nt, Chlamydia trachomatis
uguuuaugaaugca

SEQ ID NO: 480574 - RNA, 14 nt, Chlamydia trachomatis
uguuuauucucacc

SEQ ID NO: 480575 - RNA, 18 nt, Chlamydia trachomatis
uguuucagaaacuuccca

SEQ ID NO: 480576 - RNA, 12 nt, Chlamydia trachomatis
uguuuaaucagu

SEQ ID NO: 480577 - RNA, 18 nt, Chlamydia trachomatis
uguuuacugacaaggcug

SEQ ID NO: 480578 - RNA, 15 nt, Chlamydia trachomatis
uguuuagaaaauacg

SEQ ID NO: 480579 - RNA, 11 nt, Chlamydia trachomatis
uguuuaggagg

SEQ ID NO: 480580 - RNA, 19 nt, Chlamydia trachomatis
uuaguaccauaacaucuaa

SEQ ID NO: 480581 - RNA, 21 nt, Chlamydia trachomatis
uuagugaagagcagagguaug

SEQ ID NO: 480582 - RNA, 19 nt, Chlamydia trachomatis
uuauaacuaagaucuccau

SEQ ID NO: 480583 - RNA, 13 nt, Chlamydia trachomatis
uuauacucuaaaa

SEQ ID NO: 480584 - RNA, 22 nt, Chlamydia trachomatis
uuauaggggugauaacaaccau

SEQ ID NO: 480585 - RNA, 18 nt, Chlamydia trachomatis
uuauauugcuucauaaaa

SEQ ID NO: 480586 - RNA, 21 nt, Chlamydia trachomatis
uuaucacaaaccagcucauca

SEQ ID NO: 480587 - RNA, 15 nt, Chlamydia trachomatis
uuagaaauucaucau

SEQ ID NO: 480588 - RNA, 17 nt, Chlamydia trachomatis
uuagaacagauuuagag

SEQ ID NO: 480589 - RNA, 21 nt, Chlamydia trachomatis
uuagaacagauuuagagaaua

SEQ ID NO: 480590 - RNA, 14 nt, Chlamydia trachomatis
uuacgaaauaggau

SEQ ID NO: 480591 - RNA, 18 nt, Chlamydia trachomatis
uuacgaacaagaugacuu

SEQ ID NO: 480592 - RNA, 19 nt, Chlamydia trachomatis
uuacgaagucgugucaggc

SEQ ID NO: 480593 - RNA, 20 nt, Chlamydia trachomatis
uuagaagaaaagagcuuuuc

SEQ ID NO: 480594 - RNA, 23 nt, Chlamydia trachomatis
uuagaagaaaagagcuuuucuuc

SEQ ID NO: 480595 - RNA, 24 nt, Chlamydia trachomatis
uuagaagauaacaacucuccuaau

SEQ ID NO: 480596 - RNA, 13 nt, Chlamydia trachomatis
uuagcaacaguca

SEQ ID NO: 480597 - RNA, 15 nt, Chlamydia trachomatis
uuagcaaauaauagc

SEQ ID NO: 480598 - RNA, 14 nt, Chlamydia trachomatis
uuagcacuacagau

SEQ ID NO: 480599 - RNA, 18 nt, Chlamydia trachomatis
uuagcacuugaguuguuu

SEQ ID NO: 480600 - RNA, 22 nt, Chlamydia trachomatis
uuagcauaguauuacggaaaag

SEQ ID NO: 480601 - RNA, 18 nt, Chlamydia trachomatis
uuagcauguucagaaucu

SEQ ID NO: 480602 - RNA, 17 nt, Chlamydia trachomatis
uuagccaauuuccaugg

SEQ ID NO: 480603 - RNA, 22 nt, Chlamydia trachomatis
uuagccaauuuccauggagcuu

SEQ ID NO: 480604 - RNA, 16 nt, Chlamydia trachomatis
uuagccuaaauagcuc

SEQ ID NO: 480605 - RNA, 16 nt, Chlamydia trachomatis
uuagcuaaauucaacu

SEQ ID NO: 480606 - RNA, 19 nt, Chlamydia trachomatis
uuagcuagaguagugccag

SEQ ID NO: 480607 - RNA, 13 nt, Chlamydia trachomatis
uuaggaacucuaa

SEQ ID NO: 480608 - RNA, 19 nt, Chlamydia trachomatis
uuaggaacucuaaauaccu

SEQ ID NO: 480609 - RNA, 15 nt, Chlamydia trachomatis
uuaggaauauguugg

SEQ ID NO: 480610 - RNA, 21 nt, Chlamydia trachomatis
uuaggacugccgaacugcuuu

SEQ ID NO: 480611 - RNA, 14 nt, Chlamydia trachomatis
uuaggauccgcuuc

SEQ ID NO: 480612 - RNA, 16 nt, Chlamydia trachomatis
uuaggauuaaaaucca

SEQ ID NO: 480613 - RNA, 13 nt, Chlamydia trachomatis
uuaggcauuccuu

SEQ ID NO: 480614 - RNA, 17 nt, Chlamydia trachomatis
uuaauuuucugcagaga

SEQ ID NO: 480615 - RNA, 18 nt, Chlamydia trachomatis
uuaaugucucuucacaaa

SEQ ID NO: 480616 - RNA, 14 nt, Chlamydia trachomatis
uuaccauaucaaaa

SEQ ID NO: 480617 - RNA, 18 nt, Chlamydia trachomatis
uuacccuuauaagccgcu

SEQ ID NO: 480618 - RNA, 20 nt, Chlamydia trachomatis
uuaccggguagauacaauug

SEQ ID NO: 480619 - RNA, 24 nt, Chlamydia trachomatis
uuaccucaauagcagcauucucua

SEQ ID NO: 480620 - RNA, 14 nt, Chlamydia trachomatis
uuaccucuccauuu

SEQ ID NO: 480621 - RNA, 13 nt, Chlamydia trachomatis
uuacauaagaucc

SEQ ID NO: 480622 - RNA, 19 nt, Chlamydia trachomatis
uuacauaagauccaucucu

SEQ ID NO: 480623 - RNA, 14 nt, Chlamydia trachomatis
uuacaauagcauuu

SEQ ID NO: 480624 - RNA, 17 nt, Chlamydia trachomatis
uuacaauguaaacaaua

SEQ ID NO: 480625 - RNA, 20 nt, Chlamydia trachomatis
uuacaauguacgcuaaaaac

SEQ ID NO: 480626 - RNA, 22 nt, Chlamydia trachomatis
uuacaauguacgcuaaaaacuc

SEQ ID NO: 480627 - RNA, 19 nt, Chlamydia trachomatis
uuacacaacucuuuuccua

SEQ ID NO: 480628 - RNA, 16 nt, Chlamydia trachomatis
uuaaaucugcuccuag

SEQ ID NO: 480629 - RNA, 19 nt, Chlamydia trachomatis
uuaacugcagcaucuauuu

SEQ ID NO: 480630 - RNA, 17 nt, Chlamydia trachomatis
uuaacugggauaagaaa

SEQ ID NO: 480631 - RNA, 12 nt, Chlamydia trachomatis
uuaagaagagag

SEQ ID NO: 480632 - RNA, 13 nt, Chlamydia trachomatis
uuaagaagagagg

SEQ ID NO: 480633 - RNA, 11 nt, Chlamydia trachomatis
uuaagaagucu

SEQ ID NO: 480634 - RNA, 12 nt, Chlamydia trachomatis
uuaagaaucuuu

SEQ ID NO: 480635 - RNA, 18 nt, Chlamydia trachomatis
uuaagaccgaaauuagua

SEQ ID NO: 480636 - RNA, 20 nt, Chlamydia trachomatis
uuaagaccuaguaagugcau

SEQ ID NO: 480637 - RNA, 23 nt, Chlamydia trachomatis
uuaagacucaaauuuucaugaaa

SEQ ID NO: 480638 - RNA, 16 nt, Chlamydia trachomatis
uuaaguccagggaaaa

SEQ ID NO: 480639 - RNA, 20 nt, Chlamydia trachomatis
uuaauaaugaaauugccaug

SEQ ID NO: 480640 - RNA, 21 nt, Chlamydia trachomatis
uuaaucaguuccggaucaauc

SEQ ID NO: 480641 - RNA, 16 nt, Chlamydia trachomatis
uucuauuucucuuccu

SEQ ID NO: 480642 - RNA, 18 nt, Chlamydia trachomatis
uucuauuucucuuccuga

SEQ ID NO: 480643 - RNA, 18 nt, Chlamydia trachomatis
uucuauucgcaguaucuu

SEQ ID NO: 480644 - RNA, 19 nt, Chlamydia trachomatis
uucucaaaacgcucuccaa

SEQ ID NO: 480645 - RNA, 12 nt, Chlamydia trachomatis
uucucaaaucac

SEQ ID NO: 480646 - RNA, 21 nt, Chlamydia trachomatis
uucuacguaguaauuuugaca

SEQ ID NO: 480647 - RNA, 14 nt, Chlamydia trachomatis
uucuaucacagcua

SEQ ID NO: 480648 - RNA, 21 nt, Chlamydia trachomatis
uucuauccggaguaccaaaaa

SEQ ID NO: 480649 - RNA, 22 nt, Chlamydia trachomatis
uucuauccggaguaccaaaaaa

SEQ ID NO: 480650 - RNA, 18 nt, Chlamydia trachomatis
uucuaaagucuuaaaagg

SEQ ID NO: 480651 - RNA, 14 nt, Chlamydia trachomatis
uucuaauuucuuuc

SEQ ID NO: 480652 - RNA, 15 nt, Chlamydia trachomatis
uucuaaaaucugccg

SEQ ID NO: 480653 - RNA, 20 nt, Chlamydia trachomatis
uuaucacuaucugcaaaagc

SEQ ID NO: 480654 - RNA, 21 nt, Chlamydia trachomatis
uuaucacuaucugcaaaagca

SEQ ID NO: 480655 - RNA, 16 nt, Chlamydia trachomatis
uucgggauaagaucuc

SEQ ID NO: 480656 - RNA, 24 nt, Chlamydia trachomatis
uucggcuauagcgucuugcuaaug

SEQ ID NO: 480657 - RNA, 12 nt, Chlamydia trachomatis
uucguagacuuc

SEQ ID NO: 480658 - RNA, 14 nt, Chlamydia trachomatis
uucgucaaagaagu

SEQ ID NO: 480659 - RNA, 21 nt, Chlamydia trachomatis
uucguaggguuguuuuagaau

SEQ ID NO: 480660 - RNA, 19 nt, Chlamydia trachomatis
uucguaguaacuuaugaaa

SEQ ID NO: 480661 - RNA, 23 nt, Chlamydia trachomatis
uucuuauacagcaugccuucuuc

SEQ ID NO: 480662 - RNA, 15 nt, Chlamydia trachomatis
uucuuaucagcaucc

SEQ ID NO: 480663 - RNA, 22 nt, Chlamydia trachomatis
uucuuaucugucagucuucuuu

SEQ ID NO: 480664 - RNA, 19 nt, Chlamydia trachomatis
uucuuaacugcagcaucua

SEQ ID NO: 480665 - RNA, 22 nt, Chlamydia trachomatis
uucuucgcuuccugcaugaagu

SEQ ID NO: 480666 - RNA, 17 nt, Chlamydia trachomatis
uucuucggaaagcacuu

SEQ ID NO: 480667 - RNA, 21 nt, Chlamydia trachomatis
uucuucgucgucguacuccuc

SEQ ID NO: 480668 - RNA, 23 nt, Chlamydia trachomatis
uucuucuaagcuagaaaauagca

SEQ ID NO: 480669 - RNA, 14 nt, Chlamydia trachomatis
uucuucuacaaguu

SEQ ID NO: 480670 - RNA, 15 nt, Chlamydia trachomatis
uucuucugaacaaca

SEQ ID NO: 480671 - RNA, 16 nt, Chlamydia trachomatis
uucuucugaacaacau

SEQ ID NO: 480672 - RNA, 16 nt, Chlamydia trachomatis
uucuucugcaggcuca

SEQ ID NO: 480673 - RNA, 22 nt, Chlamydia trachomatis
uucuucugccgaaggcaauucc

SEQ ID NO: 480674 - RNA, 16 nt, Chlamydia trachomatis
uucuuaaacaaaaaua

SEQ ID NO: 480675 - RNA, 15 nt, Chlamydia trachomatis
uucuguuacacagac

SEQ ID NO: 480676 - RNA, 18 nt, Chlamydia trachomatis
uucuguugacuuuagcaa

SEQ ID NO: 480677 - RNA, 13 nt, Chlamydia trachomatis
uucugcgaaagaa

SEQ ID NO: 480678 - RNA, 16 nt, Chlamydia trachomatis
uucugcuccaaagaua

SEQ ID NO: 480679 - RNA, 20 nt, Chlamydia trachomatis
uucuguaggagagaaucuuu

SEQ ID NO: 480680 - RNA, 17 nt, Chlamydia trachomatis
uucuccagcaucuuuuc

SEQ ID NO: 480681 - RNA, 18 nt, Chlamydia trachomatis
uucucaauccaugaggcu

SEQ ID NO: 480682 - RNA, 21 nt, Chlamydia trachomatis
uucuccgaugccgcagaaaaa

SEQ ID NO: 480683 - RNA, 11 nt, Chlamydia trachomatis
uucuccuaaag

SEQ ID NO: 480684 - RNA, 16 nt, Chlamydia trachomatis
uucucuagaaaaggcc

SEQ ID NO: 480685 - RNA, 14 nt, Chlamydia trachomatis
uucucuagacuauc

SEQ ID NO: 480686 - RNA, 16 nt, Chlamydia trachomatis
uucucucccuuccuga

SEQ ID NO: 480687 - RNA, 23 nt, Chlamydia trachomatis
uucucuccgugaagauuaccgug

SEQ ID NO: 480688 - RNA, 21 nt, Chlamydia trachomatis
uucucucgcugcgagagagcu

SEQ ID NO: 480689 - RNA, 11 nt, Chlamydia trachomatis
uucucucuagc

SEQ ID NO: 480690 - RNA, 13 nt, Chlamydia trachomatis
uucugccaaagac

SEQ ID NO: 480691 - RNA, 18 nt, Chlamydia trachomatis
uucugccauuucuaaagg

SEQ ID NO: 480692 - RNA, 14 nt, Chlamydia trachomatis
uucugcagaaaaau

SEQ ID NO: 480693 - RNA, 15 nt, Chlamydia trachomatis
uucugcagaaaaauu

SEQ ID NO: 480694 - RNA, 17 nt, Chlamydia trachomatis
uucugcaugcaaauaag

SEQ ID NO: 480695 - RNA, 16 nt, Chlamydia trachomatis
uucugcaaugagugcg

SEQ ID NO: 480696 - RNA, 20 nt, Chlamydia trachomatis
uucucuuagaagcucucaag

SEQ ID NO: 480697 - RNA, 15 nt, Chlamydia trachomatis
uucucuuccugaaua

SEQ ID NO: 480698 - RNA, 20 nt, Chlamydia trachomatis
uucucuugaaucaaaaaguu

SEQ ID NO: 480699 - RNA, 13 nt, Chlamydia trachomatis
uucucuugcagaa

SEQ ID NO: 480700 - RNA, 19 nt, Chlamydia trachomatis
uucuuuugcaaaaauuuuc

SEQ ID NO: 480701 - RNA, 14 nt, Chlamydia trachomatis
uucuugugggauug

SEQ ID NO: 480702 - RNA, 12 nt, Chlamydia trachomatis
uucuuguuuuau

SEQ ID NO: 480703 - RNA, 20 nt, Chlamydia trachomatis
uucuuguuuuauacucuaaa

SEQ ID NO: 480704 - RNA, 23 nt, Chlamydia trachomatis
uucuuguuuuauacucuaaaagu

SEQ ID NO: 480705 - RNA, 15 nt, Chlamydia trachomatis
uucuuuaagaaaaau

SEQ ID NO: 480706 - RNA, 14 nt, Chlamydia trachomatis
uucuuuaagaagau

SEQ ID NO: 480707 - RNA, 17 nt, Chlamydia trachomatis
uucuuuaagcaacaacu

SEQ ID NO: 480708 - RNA, 12 nt, Chlamydia trachomatis
uucuucuucugu

SEQ ID NO: 480709 - RNA, 14 nt, Chlamydia trachomatis
uucuuuagccccuu

SEQ ID NO: 480710 - RNA, 14 nt, Chlamydia trachomatis
uugaaguagcauug

SEQ ID NO: 480711 - RNA, 21 nt, Chlamydia trachomatis
uugaauaaaucuauccauaau

SEQ ID NO: 480712 - RNA, 14 nt, Chlamydia trachomatis
uugaauaacguuuu

SEQ ID NO: 480713 - RNA, 16 nt, Chlamydia trachomatis
uugaauaucguaaaca

SEQ ID NO: 480714 - RNA, 22 nt, Chlamydia trachomatis
uugagcuuuauuuucauauagu

SEQ ID NO: 480715 - RNA, 16 nt, Chlamydia trachomatis
uugagcagcaaagauc

SEQ ID NO: 480716 - RNA, 21 nt, Chlamydia trachomatis
uugagagcauucuucugaaca

SEQ ID NO: 480717 - RNA, 20 nt, Chlamydia trachomatis
uugaggcggagauucuaauc

SEQ ID NO: 480718 - RNA, 16 nt, Chlamydia trachomatis
uugauaauacucuucu

SEQ ID NO: 480719 - RNA, 18 nt, Chlamydia trachomatis
uugauacaauuccugcuc

SEQ ID NO: 480720 - RNA, 15 nt, Chlamydia trachomatis
uugauagcuucauac

SEQ ID NO: 480721 - RNA, 14 nt, Chlamydia trachomatis
uugcacaagauaca

SEQ ID NO: 480722 - RNA, 15 nt, Chlamydia trachomatis
uugcacaagauacaa

SEQ ID NO: 480723 - RNA, 20 nt, Chlamydia trachomatis
uugcacaaucucaaaaacac

SEQ ID NO: 480724 - RNA, 15 nt, Chlamydia trachomatis
uugcaccacgugcaa

SEQ ID NO: 480725 - RNA, 11 nt, Chlamydia trachomatis
uugcaaaaauc

SEQ ID NO: 480726 - RNA, 22 nt, Chlamydia trachomatis
uugcaaagagagcaacgagcaa

SEQ ID NO: 480727 - RNA, 13 nt, Chlamydia trachomatis
uugauuaaaguuu

SEQ ID NO: 480728 - RNA, 21 nt, Chlamydia trachomatis
uugcacuaagaauaaagauga

SEQ ID NO: 480729 - RNA, 17 nt, Chlamydia trachomatis
uugccaaucuguaauaa

SEQ ID NO: 480730 - RNA, 16 nt, Chlamydia trachomatis
uugccgaaucaaagac

SEQ ID NO: 480731 - RNA, 19 nt, Chlamydia trachomatis
uugcccuuccgaaaagauu

SEQ ID NO: 480732 - RNA, 17 nt, Chlamydia trachomatis
uugcgagggauauuucu

SEQ ID NO: 480733 - RNA, 21 nt, Chlamydia trachomatis
uugcguagcucagagauuucc

SEQ ID NO: 480734 - RNA, 18 nt, Chlamydia trachomatis
uugcuccacaagaaguaa

SEQ ID NO: 480735 - RNA, 18 nt, Chlamydia trachomatis
uugcuuuucgaaugacau

SEQ ID NO: 480736 - RNA, 21 nt, Chlamydia trachomatis
uuggaaaaaaaaccaaaccag

SEQ ID NO: 480737 - RNA, 15 nt, Chlamydia trachomatis
uuggaaaauccaaag

SEQ ID NO: 480738 - RNA, 22 nt, Chlamydia trachomatis
uuggacgagaggcgaaaguuuc

SEQ ID NO: 480739 - RNA, 23 nt, Chlamydia trachomatis
uuggacuaugcucacaaaccaaa

SEQ ID NO: 480740 - RNA, 22 nt, Chlamydia trachomatis
uuggagaacaucggaccacauu

SEQ ID NO: 480741 - RNA, 18 nt, Chlamydia trachomatis
uuggagagaaugaagaau

SEQ ID NO: 480742 - RNA, 12 nt, Chlamydia trachomatis
uugguauagaaa

SEQ ID NO: 480743 - RNA, 20 nt, Chlamydia trachomatis
uugguagcagcuagaacaua

SEQ ID NO: 480744 - RNA, 20 nt, Chlamydia trachomatis
uuggcguauuucuuguggga

SEQ ID NO: 480745 - RNA, 15 nt, Chlamydia trachomatis
uuggcggcaguuucu

SEQ ID NO: 480746 - RNA, 14 nt, Chlamydia trachomatis
uuuaaccucugcaa

SEQ ID NO: 480747 - RNA, 20 nt, Chlamydia trachomatis
uuuaaccagaauauaagcac

SEQ ID NO: 480748 - RNA, 14 nt, Chlamydia trachomatis
uuuaaccuuugcau

SEQ ID NO: 480749 - RNA, 23 nt, Chlamydia trachomatis
uuuaaguccagggaaaagagcua

SEQ ID NO: 480750 - RNA, 21 nt, Chlamydia trachomatis
uuuaagucguacauuaauagc

SEQ ID NO: 480751 - RNA, 23 nt, Chlamydia trachomatis
uuuaauaaaagcuccuaaagaag

SEQ ID NO: 480752 - RNA, 18 nt, Chlamydia trachomatis
uuuaauaaguuuuucaaa

SEQ ID NO: 480753 - RNA, 15 nt, Chlamydia trachomatis
uuuaauaauaaagau

SEQ ID NO: 480754 - RNA, 18 nt, Chlamydia trachomatis
uuuaauuaugcaaaaaga

SEQ ID NO: 480755 - RNA, 16 nt, Chlamydia trachomatis
uuuaauuccaucuuuu

SEQ ID NO: 480756 - RNA, 23 nt, Chlamydia trachomatis
uuguucugggcugacagaagcug

SEQ ID NO: 480757 - RNA, 17 nt, Chlamydia trachomatis
uuguuuguuuuuuucaa

SEQ ID NO: 480758 - RNA, 13 nt, Chlamydia trachomatis
uuuaaaagaagcu

SEQ ID NO: 480759 - RNA, 23 nt, Chlamydia trachomatis
uuuaaaagugagaugcuccucuc

SEQ ID NO: 480760 - RNA, 13 nt, Chlamydia trachomatis
uuguauagaaccu

SEQ ID NO: 480761 - RNA, 22 nt, Chlamydia trachomatis
uuguaucccuaguacaaaaaua

SEQ ID NO: 480762 - RNA, 16 nt, Chlamydia trachomatis
uuguaugcucgccucu

SEQ ID NO: 480763 - RNA, 22 nt, Chlamydia trachomatis
uugucacugcuuccgaaagcau

SEQ ID NO: 480764 - RNA, 15 nt, Chlamydia trachomatis
uugucagaagaggca

SEQ ID NO: 480765 - RNA, 22 nt, Chlamydia trachomatis
uuguauaaacccacgaaaagac

SEQ ID NO: 480766 - RNA, 20 nt, Chlamydia trachomatis
uuguacacgauguuccccau

SEQ ID NO: 480767 - RNA, 21 nt, Chlamydia trachomatis
uuguaaguccuuacauaaaaa

SEQ ID NO: 480768 - RNA, 14 nt, Chlamydia trachomatis
uuguaauaucaaag

SEQ ID NO: 480769 - RNA, 18 nt, Chlamydia trachomatis
uuguucggauucaucaaa

SEQ ID NO: 480770 - RNA, 18 nt, Chlamydia trachomatis
uuguuaaugacaaacuuu

SEQ ID NO: 480771 - RNA, 14 nt, Chlamydia trachomatis
uuguuagaaaugca

SEQ ID NO: 480772 - RNA, 19 nt, Chlamydia trachomatis
uugugcgcuuucagacucu

SEQ ID NO: 480773 - RNA, 12 nt, Chlamydia trachomatis
uuguuaagaagg

SEQ ID NO: 480774 - RNA, 15 nt, Chlamydia trachomatis
uugugauuucugaau

SEQ ID NO: 480775 - RNA, 21 nt, Chlamydia trachomatis
uugugcagcacugagauguuu

SEQ ID NO: 480776 - RNA, 21 nt, Chlamydia trachomatis
uugucuaaaagaauaugcgac

SEQ ID NO: 480777 - RNA, 17 nt, Chlamydia trachomatis
uuucacaagguguccug

SEQ ID NO: 480778 - RNA, 20 nt, Chlamydia trachomatis
uuucacacauccuucugcua

SEQ ID NO: 480779 - RNA, 21 nt, Chlamydia trachomatis
uuucacacauccuucugcuau

SEQ ID NO: 480780 - RNA, 18 nt, Chlamydia trachomatis
uuucaauagcaaugaagg

SEQ ID NO: 480781 - RNA, 16 nt, Chlamydia trachomatis
uuucaaugcuucuauu

SEQ ID NO: 480782 - RNA, 21 nt, Chlamydia trachomatis
uuuauuuaaguagaaccacuu

SEQ ID NO: 480783 - RNA, 19 nt, Chlamydia trachomatis
uuuauucaaaucuucuucu

SEQ ID NO: 480784 - RNA, 13 nt, Chlamydia trachomatis
uuuauucucaccu

SEQ ID NO: 480785 - RNA, 19 nt, Chlamydia trachomatis
uuuauucucaccuugaacg

SEQ ID NO: 480786 - RNA, 21 nt, Chlamydia trachomatis
uuucaaaagaaggcuuuucua

SEQ ID NO: 480787 - RNA, 22 nt, Chlamydia trachomatis
uuucaaagaagcuccuuuaccu

SEQ ID NO: 480788 - RNA, 23 nt, Chlamydia trachomatis
uuucaaagaagcuccuuuaccuu

SEQ ID NO: 480789 - RNA, 22 nt, Chlamydia trachomatis
uuucaaaaagagcuaaacuucu

SEQ ID NO: 480790 - RNA, 18 nt, Chlamydia trachomatis
uuucagcaagaacagauu

SEQ ID NO: 480791 - RNA, 15 nt, Chlamydia trachomatis
uuucagaauuacccu

SEQ ID NO: 480792 - RNA, 17 nt, Chlamydia trachomatis
uuucagagaaaauuucu

SEQ ID NO: 480793 - RNA, 19 nt, Chlamydia trachomatis
uuucagagaaaauuucucu

SEQ ID NO: 480794 - RNA, 20 nt, Chlamydia trachomatis
uuucagagaaaauuucucuu

SEQ ID NO: 480795 - RNA, 22 nt, Chlamydia trachomatis
uuucagagaggcuguaacuaaa

SEQ ID NO: 480796 - RNA, 23 nt, Chlamydia trachomatis
uuucagagccagcuuuaaagagc

SEQ ID NO: 480797 - RNA, 21 nt, Chlamydia trachomatis
uuucauaaagagagaggagaa

SEQ ID NO: 480798 - RNA, 24 nt, Chlamydia trachomatis
uuucauacccuaacgaggcacaaa

SEQ ID NO: 480799 - RNA, 14 nt, Chlamydia trachomatis
uuucaucuuccaac

SEQ ID NO: 480800 - RNA, 14 nt, Chlamydia trachomatis
uuucaugacauuca

SEQ ID NO: 480801 - RNA, 17 nt, Chlamydia trachomatis
uuucaugcaaguaauuu

SEQ ID NO: 480802 - RNA, 20 nt, Chlamydia trachomatis
uuucauggcugcaauucuua

SEQ ID NO: 480803 - RNA, 15 nt, Chlamydia trachomatis
uuucaucaaaauaua

SEQ ID NO: 480804 - RNA, 22 nt, Chlamydia trachomatis
uuucaucaucauggaaaauaug

SEQ ID NO: 480805 - RNA, 13 nt, Chlamydia trachomatis
uuucauucuuucg

SEQ ID NO: 480806 - RNA, 14 nt, Chlamydia trachomatis
uuucauucguuucu

SEQ ID NO: 480807 - RNA, 18 nt, Chlamydia trachomatis
uuuccacaagauuuugaa

SEQ ID NO: 480808 - RNA, 23 nt, Chlamydia trachomatis
uuuccaagaaaaauacagcggau

SEQ ID NO: 480809 - RNA, 16 nt, Chlamydia trachomatis
uuuccaauaucuucag

SEQ ID NO: 480810 - RNA, 18 nt, Chlamydia trachomatis
uuuccaaagcuucuaacg

SEQ ID NO: 480811 - RNA, 21 nt, Chlamydia trachomatis
uuuacaguuccgcagagaucu

SEQ ID NO: 480812 - RNA, 15 nt, Chlamydia trachomatis
uuuacgcacaaagau

SEQ ID NO: 480813 - RNA, 19 nt, Chlamydia trachomatis
uuuacgcacaaagauuucu

SEQ ID NO: 480814 - RNA, 16 nt, Chlamydia trachomatis
uuuacgcacuucugcu

SEQ ID NO: 480815 - RNA, 20 nt, Chlamydia trachomatis
uuuacgcauuugcucuucca

SEQ ID NO: 480816 - RNA, 11 nt, Chlamydia trachomatis
uuuacuaucag

SEQ ID NO: 480817 - RNA, 13 nt, Chlamydia trachomatis
uuuacucuuuucu

SEQ ID NO: 480818 - RNA, 16 nt, Chlamydia trachomatis
uuuacuugagagccua

SEQ ID NO: 480819 - RNA, 15 nt, Chlamydia trachomatis
uuuacuuucuuugcu

SEQ ID NO: 480820 - RNA, 14 nt, Chlamydia trachomatis
uuuagaaauugucc

SEQ ID NO: 480821 - RNA, 17 nt, Chlamydia trachomatis
uuuagacaauucagaaa

SEQ ID NO: 480822 - RNA, 13 nt, Chlamydia trachomatis
uuuagagaaaaga

SEQ ID NO: 480823 - RNA, 17 nt, Chlamydia trachomatis
uuuagauagucuucuac

SEQ ID NO: 480824 - RNA, 12 nt, Chlamydia trachomatis
uuuagcaucuga

SEQ ID NO: 480825 - RNA, 16 nt, Chlamydia trachomatis
uuuagccaauuuccau

SEQ ID NO: 480826 - RNA, 23 nt, Chlamydia trachomatis
uuuagcgaucucccguacuuucu

SEQ ID NO: 480827 - RNA, 15 nt, Chlamydia trachomatis
uuuagcuaguucaga

SEQ ID NO: 480828 - RNA, 21 nt, Chlamydia trachomatis
uuuagcucgcuucaaaacuaa

SEQ ID NO: 480829 - RNA, 23 nt, Chlamydia trachomatis
uuuaggagauuguuguaugcucg

SEQ ID NO: 480830 - RNA, 23 nt, Chlamydia trachomatis
uuuaggcuaacuccauaaaaagc

SEQ ID NO: 480831 - RNA, 18 nt, Chlamydia trachomatis
uuuaguaccauaacaucu

SEQ ID NO: 480832 - RNA, 15 nt, Chlamydia trachomatis
uuuaguccacagauc

SEQ ID NO: 480833 - RNA, 12 nt, Chlamydia trachomatis
uuuagucuguga

SEQ ID NO: 480834 - RNA, 11 nt, Chlamydia trachomatis
uuuauaaaaag

SEQ ID NO: 480835 - RNA, 13 nt, Chlamydia trachomatis
uuuauaauccagg

SEQ ID NO: 480836 - RNA, 13 nt, Chlamydia trachomatis
uuuauagaauuuu

SEQ ID NO: 480837 - RNA, 22 nt, Chlamydia trachomatis
uuuaucauugaaaucagaaaca

SEQ ID NO: 480838 - RNA, 14 nt, Chlamydia trachomatis
uuuauccaaagaua

SEQ ID NO: 480839 - RNA, 15 nt, Chlamydia trachomatis
uuuaucuucaaagaa

SEQ ID NO: 480840 - RNA, 22 nt, Chlamydia trachomatis
uuuaugaagcaaauagauaacu

SEQ ID NO: 480841 - RNA, 17 nt, Chlamydia trachomatis
uuuauggaaaagaucuu

SEQ ID NO: 480842 - RNA, 22 nt, Chlamydia trachomatis
uuuauuaaaucgugagcgucuu

SEQ ID NO: 480843 - RNA, 21 nt, Chlamydia trachomatis
uuuauuacgaugaugcugagc

SEQ ID NO: 480844 - RNA, 20 nt, Chlamydia trachomatis
uuuccagcaggccucuguuu

SEQ ID NO: 480845 - RNA, 18 nt, Chlamydia trachomatis
uuuccagccucuccagaa

SEQ ID NO: 480846 - RNA, 19 nt, Chlamydia trachomatis
uuuccagccucuccagaaa

SEQ ID NO: 480847 - RNA, 21 nt, Chlamydia trachomatis
uuuccagccucuccagaaaaa

SEQ ID NO: 480848 - RNA, 17 nt, Chlamydia trachomatis
uuuccauacaucaucuc

SEQ ID NO: 480849 - RNA, 18 nt, Chlamydia trachomatis
uuuccauacaucaucucu

SEQ ID NO: 480850 - RNA, 18 nt, Chlamydia trachomatis
uuuccauauucuugcuaa

SEQ ID NO: 480851 - RNA, 21 nt, Chlamydia trachomatis
uuuccauggagcuucaucauu

SEQ ID NO: 480852 - RNA, 15 nt, Chlamydia trachomatis
uuuccauuccuccua

SEQ ID NO: 480853 - RNA, 22 nt, Chlamydia trachomatis
uuuccccuauaugagccuugcc

SEQ ID NO: 480854 - RNA, 14 nt, Chlamydia trachomatis
uuuccccugaacua

SEQ ID NO: 480855 - RNA, 23 nt, Chlamydia trachomatis
uuuccgaagguugaacuagagau

SEQ ID NO: 480856 - RNA, 18 nt, Chlamydia trachomatis
uuuccgaauaaaaucaaa

SEQ ID NO: 480857 - RNA, 15 nt, Chlamydia trachomatis
uuuccgaauuaaauc

SEQ ID NO: 480858 - RNA, 21 nt, Chlamydia trachomatis
uuuccgagagcgaagacagaa

SEQ ID NO: 480859 - RNA, 21 nt, Chlamydia trachomatis
uuuccgcacccaaucuucuaa

SEQ ID NO: 480860 - RNA, 22 nt, Chlamydia trachomatis
uuuccgcacccaaucuucuaaa

SEQ ID NO: 480861 - RNA, 17 nt, Chlamydia trachomatis
uuuccuguucccauuuu

SEQ ID NO: 480862 - RNA, 18 nt, Chlamydia trachomatis
uuuccuacgcgaaucaca

SEQ ID NO: 480863 - RNA, 20 nt, Chlamydia trachomatis
uuuccucugguacucaucuu

SEQ ID NO: 480864 - RNA, 13 nt, Chlamydia trachomatis
uuuccucuucaga

SEQ ID NO: 480865 - RNA, 14 nt, Chlamydia trachomatis
uuuccugaaacgau

SEQ ID NO: 480866 - RNA, 21 nt, Chlamydia trachomatis
uuuccugaaacgaucagcucc

SEQ ID NO: 480867 - RNA, 23 nt, Chlamydia trachomatis
uuuccuuaguuuuaauuccaucu

SEQ ID NO: 480868 - RNA, 13 nt, Chlamydia trachomatis
uuuccuuauaguu

SEQ ID NO: 480869 - RNA, 14 nt, Chlamydia trachomatis
uuucgaacaaaacu

SEQ ID NO: 480870 - RNA, 15 nt, Chlamydia trachomatis
uuucguaguuuucuu

SEQ ID NO: 480871 - RNA, 21 nt, Chlamydia trachomatis
uuucuacaacuaucagaagau

SEQ ID NO: 480872 - RNA, 14 nt, Chlamydia trachomatis
uuucuagaagaacu

SEQ ID NO: 480873 - RNA, 17 nt, Chlamydia trachomatis
uuucuagaagaacuccc

SEQ ID NO: 480874 - RNA, 14 nt, Chlamydia trachomatis
uuucuagauggaua

SEQ ID NO: 480875 - RNA, 15 nt, Chlamydia trachomatis
uuucuagcuucuugu

SEQ ID NO: 480876 - RNA, 16 nt, Chlamydia trachomatis
uuucuaaaaaacuuug

SEQ ID NO: 480877 - RNA, 11 nt, Chlamydia trachomatis
uuucuaaaauc

SEQ ID NO: 480878 - RNA, 15 nt, Chlamydia trachomatis
uuucucgauucucuu

SEQ ID NO: 480879 - RNA, 22 nt, Chlamydia trachomatis
uuucucuacccaggcuuuucuu

SEQ ID NO: 480880 - RNA, 14 nt, Chlamydia trachomatis
uuucugagaaaucu

SEQ ID NO: 480881 - RNA, 17 nt, Chlamydia trachomatis
uuucugacucagaaucu

SEQ ID NO: 480882 - RNA, 13 nt, Chlamydia trachomatis
uuucugagacucc

SEQ ID NO: 480883 - RNA, 23 nt, Chlamydia trachomatis
uuucugcagagaucauaccaaua

SEQ ID NO: 480884 - RNA, 17 nt, Chlamydia trachomatis
uuucugcagagcacaaa

SEQ ID NO: 480885 - RNA, 13 nt, Chlamydia trachomatis
uuucugcuccaaa

SEQ ID NO: 480886 - RNA, 22 nt, Chlamydia trachomatis
uuucuggaaaaucuuucgagga

SEQ ID NO: 480887 - RNA, 18 nt, Chlamydia trachomatis
uuugacucucauaagaau

SEQ ID NO: 480888 - RNA, 22 nt, Chlamydia trachomatis
uuugacuaggauuacagcaaga

SEQ ID NO: 480889 - RNA, 23 nt, Chlamydia trachomatis
uuugaaucacagaaacuucuucu

SEQ ID NO: 480890 - RNA, 21 nt, Chlamydia trachomatis
uuugaauaauagaaaaacuau

SEQ ID NO: 480891 - RNA, 15 nt, Chlamydia trachomatis
uuugacaagcaguag

SEQ ID NO: 480892 - RNA, 19 nt, Chlamydia trachomatis
uuucuugugauaucuccac

SEQ ID NO: 480893 - RNA, 13 nt, Chlamydia trachomatis
uuucuugaggagg

SEQ ID NO: 480894 - RNA, 16 nt, Chlamydia trachomatis
uuucuuuaacaucuuu

SEQ ID NO: 480895 - RNA, 19 nt, Chlamydia trachomatis
uuucuuuaagcaacaacug

SEQ ID NO: 480896 - RNA, 17 nt, Chlamydia trachomatis
uuucuuccagacaaaaa

SEQ ID NO: 480897 - RNA, 22 nt, Chlamydia trachomatis
uuucuuccaucacuccaagaag

SEQ ID NO: 480898 - RNA, 12 nt, Chlamydia trachomatis
uuucuuccucag

SEQ ID NO: 480899 - RNA, 16 nt, Chlamydia trachomatis
uuucuucuaagaaguu

SEQ ID NO: 480900 - RNA, 11 nt, Chlamydia trachomatis
uuucuucuuug

SEQ ID NO: 480901 - RNA, 19 nt, Chlamydia trachomatis
uuucuggcgaaugcccuuu

SEQ ID NO: 480902 - RNA, 14 nt, Chlamydia trachomatis
uuucugucuuagca

SEQ ID NO: 480903 - RNA, 16 nt, Chlamydia trachomatis
uuucuguuugucccac

SEQ ID NO: 480904 - RNA, 18 nt, Chlamydia trachomatis
uuucuuaaacaaaaauaa

SEQ ID NO: 480905 - RNA, 15 nt, Chlamydia trachomatis
uuucuuacuccuucu

SEQ ID NO: 480906 - RNA, 14 nt, Chlamydia trachomatis
uuucuuagaauuuu

SEQ ID NO: 480907 - RNA, 21 nt, Chlamydia trachomatis
uuucuuagccuuguuucucaa

SEQ ID NO: 480908 - RNA, 14 nt, Chlamydia trachomatis
uuucuuaucagcau

SEQ ID NO: 480909 - RNA, 18 nt, Chlamydia trachomatis
uuugauaauacucuucua

SEQ ID NO: 480910 - RNA, 17 nt, Chlamydia trachomatis
uuugauacaauuccugc

SEQ ID NO: 480911 - RNA, 15 nt, Chlamydia trachomatis
uuugauagcaacagu

SEQ ID NO: 480912 - RNA, 15 nt, Chlamydia trachomatis
uuugauagcuucaua

SEQ ID NO: 480913 - RNA, 22 nt, Chlamydia trachomatis
uuugaggacugacagaaguuag

SEQ ID NO: 480914 - RNA, 14 nt, Chlamydia trachomatis
uuugaggcucucua

SEQ ID NO: 480915 - RNA, 15 nt, Chlamydia trachomatis
uuugaggcucucuag

SEQ ID NO: 480916 - RNA, 19 nt, Chlamydia trachomatis
uuugauaucccccuucugg

SEQ ID NO: 480917 - RNA, 16 nt, Chlamydia trachomatis
uuugaucuguaaaaau

SEQ ID NO: 480918 - RNA, 19 nt, Chlamydia trachomatis
uuugaucuuuguucucuaa

SEQ ID NO: 480919 - RNA, 21 nt, Chlamydia trachomatis
uuugaugagcuuuauugaacc

SEQ ID NO: 480920 - RNA, 14 nt, Chlamydia trachomatis
uuugaugaggcuug

SEQ ID NO: 480921 - RNA, 17 nt, Chlamydia trachomatis
uuugauucauuguaucu

SEQ ID NO: 480922 - RNA, 18 nt, Chlamydia trachomatis
uuugauuuuucuuucaaa

SEQ ID NO: 480923 - RNA, 15 nt, Chlamydia trachomatis
uuugcaaugcaaaac

SEQ ID NO: 480924 - RNA, 17 nt, Chlamydia trachomatis
uuugcaaugcaaaacau

SEQ ID NO: 480925 - RNA, 14 nt, Chlamydia trachomatis
uuugcacaaaaaaa

SEQ ID NO: 480926 - RNA, 20 nt, Chlamydia trachomatis
uuugcacaaaaaaaaagagg

SEQ ID NO: 480927 - RNA, 12 nt, Chlamydia trachomatis
uuugcacaagau

SEQ ID NO: 480928 - RNA, 16 nt, Chlamydia trachomatis
uuugcacaagauacaa

SEQ ID NO: 480929 - RNA, 17 nt, Chlamydia trachomatis
uuugcagaagcuccaaa

SEQ ID NO: 480930 - RNA, 23 nt, Chlamydia trachomatis
uuugcagaagcuccaaagaacag

SEQ ID NO: 480931 - RNA, 21 nt, Chlamydia trachomatis
uuugccuauagagcaaucucu

SEQ ID NO: 480932 - RNA, 21 nt, Chlamydia trachomatis
uuugcauuuccauagaaagau

SEQ ID NO: 480933 - RNA, 13 nt, Chlamydia trachomatis
uuugccaaugaaa

SEQ ID NO: 480934 - RNA, 13 nt, Chlamydia trachomatis
uuuucuuccagag

SEQ ID NO: 480935 - RNA, 22 nt, Chlamydia trachomatis
uuuucuuccagagcauguguuu

SEQ ID NO: 480936 - RNA, 22 nt, Chlamydia trachomatis
uuuucuuccugcuucaaaaaag

SEQ ID NO: 480937 - RNA, 12 nt, Chlamydia trachomatis
uuuucuuauaaa

SEQ ID NO: 480938 - RNA, 15 nt, Chlamydia trachomatis
uuuucucccuaagau

SEQ ID NO: 480939 - RNA, 22 nt, Chlamydia trachomatis
uuuugaagaagaucuguaacua

SEQ ID NO: 480940 - RNA, 16 nt, Chlamydia trachomatis
uuuuccauuccuccua

SEQ ID NO: 480941 - RNA, 10 nt, Chlamydia trachomatis
uuuuccccuu

SEQ ID NO: 480942 - RNA, 24 nt, Chlamydia trachomatis
uuuucccgcaacuuuucagcaaga

SEQ ID NO: 480943 - RNA, 19 nt, Chlamydia trachomatis
uuuuccgaauucuuucauu

SEQ ID NO: 480944 - RNA, 18 nt, Chlamydia trachomatis
uuuucggugaggaaggcu

SEQ ID NO: 480945 - RNA, 13 nt, Chlamydia trachomatis
uuuucguuuugaa

SEQ ID NO: 480946 - RNA, 19 nt, Chlamydia trachomatis
uuuuccacaaauauuuuug

SEQ ID NO: 480947 - RNA, 16 nt, Chlamydia trachomatis
uuuucacaaagagaag

SEQ ID NO: 480948 - RNA, 18 nt, Chlamydia trachomatis
uuuucaaaaauagcaaua

SEQ ID NO: 480949 - RNA, 17 nt, Chlamydia trachomatis
uuuuauucaaaucuucu

SEQ ID NO: 480950 - RNA, 12 nt, Chlamydia trachomatis
uuuuauucuuca

SEQ ID NO: 480951 - RNA, 13 nt, Chlamydia trachomatis
uuuuaauccagcu

SEQ ID NO: 480952 - RNA, 15 nt, Chlamydia trachomatis
uuuuaauuccaucuu

SEQ ID NO: 480953 - RNA, 15 nt, Chlamydia trachomatis
uuuuacaagggccac

SEQ ID NO: 480954 - RNA, 23 nt, Chlamydia trachomatis
uuuuacaauguacgcuaaaaacu

SEQ ID NO: 480955 - RNA, 20 nt, Chlamydia trachomatis
uuuuaggauucauauuccaa

SEQ ID NO: 480956 - RNA, 13 nt, Chlamydia trachomatis
uuuuauaaucucc

SEQ ID NO: 480957 - RNA, 15 nt, Chlamydia trachomatis
uuuuaucuaaaaagg

SEQ ID NO: 480958 - RNA, 22 nt, Chlamydia trachomatis
uuuuaacuucccacucauccua

SEQ ID NO: 480959 - RNA, 19 nt, Chlamydia trachomatis
uuuuaagaguuuuuugaau

SEQ ID NO: 480960 - RNA, 12 nt, Chlamydia trachomatis
uuuuaagauauc

SEQ ID NO: 480961 - RNA, 11 nt, Chlamydia trachomatis
uuuguuuuuuu

SEQ ID NO: 480962 - RNA, 23 nt, Chlamydia trachomatis
uuuuaaagggggacaaaaauacu

SEQ ID NO: 480963 - RNA, 22 nt, Chlamydia trachomatis
uuuguuaagaauuaacccaaaa

SEQ ID NO: 480964 - RNA, 15 nt, Chlamydia trachomatis
uuuguuaucuaaauc

SEQ ID NO: 480965 - RNA, 15 nt, Chlamydia trachomatis
uuuguuccagaaaaa

SEQ ID NO: 480966 - RNA, 16 nt, Chlamydia trachomatis
uuuguuccagaaaaaa

SEQ ID NO: 480967 - RNA, 19 nt, Chlamydia trachomatis
uuuguucucuaaagauucu

SEQ ID NO: 480968 - RNA, 17 nt, Chlamydia trachomatis
uuugugauuucugaauc

SEQ ID NO: 480969 - RNA, 19 nt, Chlamydia trachomatis
uuugucuuuagcauaguau

SEQ ID NO: 480970 - RNA, 15 nt, Chlamydia trachomatis
uuuguguagcuuuuc

SEQ ID NO: 480971 - RNA, 18 nt, Chlamydia trachomatis
uuuguccuggccaaaaaa

SEQ ID NO: 480972 - RNA, 21 nt, Chlamydia trachomatis
uuuguccuggccaaaaaauca

SEQ ID NO: 480973 - RNA, 22 nt, Chlamydia trachomatis
uuuguccuggccaaaaaaucag

SEQ ID NO: 480974 - RNA, 17 nt, Chlamydia trachomatis
uuugucccgugcuugcu

SEQ ID NO: 480975 - RNA, 15 nt, Chlamydia trachomatis
uuugguguggaguau

SEQ ID NO: 480976 - RNA, 16 nt, Chlamydia trachomatis
uuugguucuuguaauu

SEQ ID NO: 480977 - RNA, 23 nt, Chlamydia trachomatis
uuuggcaugcccuaaagagaucu

SEQ ID NO: 480978 - RNA, 18 nt, Chlamydia trachomatis
uuugggaaaaaauuaaca

SEQ ID NO: 480979 - RNA, 13 nt, Chlamydia trachomatis
uuuggguuuuaau

SEQ ID NO: 480980 - RNA, 17 nt, Chlamydia trachomatis
uuugguaagaucucuac

SEQ ID NO: 480981 - RNA, 16 nt, Chlamydia trachomatis
uuugguuuuuuuuguu

SEQ ID NO: 480982 - RNA, 20 nt, Chlamydia trachomatis
uuuguacaugauaaugaguu

SEQ ID NO: 480983 - RNA, 19 nt, Chlamydia trachomatis
uuuguagauguagcagaau

SEQ ID NO: 480984 - RNA, 15 nt, Chlamydia trachomatis
uuuguagcaaaagau

SEQ ID NO: 480985 - RNA, 23 nt, Chlamydia trachomatis
uuuguaguugcgccuucugcuga

SEQ ID NO: 480986 - RNA, 15 nt, Chlamydia trachomatis
uuuguauaaugcaac

SEQ ID NO: 480987 - RNA, 13 nt, Chlamydia trachomatis
uuuggaagaucuc

SEQ ID NO: 480988 - RNA, 19 nt, Chlamydia trachomatis
uuuggagcagcuaacagcu

SEQ ID NO: 480989 - RNA, 20 nt, Chlamydia trachomatis
uuuggaucucuuagacccuc

SEQ ID NO: 480990 - RNA, 18 nt, Chlamydia trachomatis
uuugcguagcucagagau

SEQ ID NO: 480991 - RNA, 21 nt, Chlamydia trachomatis
uuugcuaggguucuaaagaaa

SEQ ID NO: 480992 - RNA, 12 nt, Chlamydia trachomatis
uuuuugaaugau

SEQ ID NO: 480993 - RNA, 18 nt, Chlamydia trachomatis
uuuuugggaaaaaauuaa

SEQ ID NO: 480994 - RNA, 19 nt, Chlamydia trachomatis
uuuuuggacgaggguuuaa

SEQ ID NO: 480995 - RNA, 24 nt, Chlamydia trachomatis
uuuugaucccuaauaugaagaacu

SEQ ID NO: 480996 - RNA, 20 nt, Chlamydia trachomatis
uuuuucccacaaacaaaaaa

SEQ ID NO: 480997 - RNA, 17 nt, Chlamydia trachomatis
uuuuucgauagaaaaaa

SEQ ID NO: 480998 - RNA, 21 nt, Chlamydia trachomatis
uuuuucggaaggcgaauucuu

SEQ ID NO: 480999 - RNA, 16 nt, Chlamydia trachomatis
uuuuucguuaaugcua

SEQ ID NO: 481000 - RNA, 10 nt, Chlamydia trachomatis
uuuuucucuu

SEQ ID NO: 481001 - RNA, 12 nt, Chlamydia trachomatis
uuuuucugcucc

SEQ ID NO: 481002 - RNA, 13 nt, Chlamydia trachomatis
uuuuuuauccaaa

SEQ ID NO: 481003 - RNA, 17 nt, Chlamydia trachomatis
aaacgagcuagcucuug

SEQ ID NO: 481004 - RNA, 13 nt, Chlamydia trachomatis
aaacgaggaauau

SEQ ID NO: 481005 - RNA, 22 nt, Chlamydia trachomatis
aaacgaagcugccgaaacuagg

SEQ ID NO: 481006 - RNA, 12 nt, Chlamydia trachomatis
aaaccuuucaaa

SEQ ID NO: 481007 - RNA, 14 nt, Chlamydia trachomatis
aaacgaaaaacaga

SEQ ID NO: 481008 - RNA, 14 nt, Chlamydia trachomatis
aaacaaggauuuuc

SEQ ID NO: 481009 - RNA, 17 nt, Chlamydia trachomatis
aaacaaggauuuucuuc

SEQ ID NO: 481010 - RNA, 13 nt, Chlamydia trachomatis
aaacaagaauaau

SEQ ID NO: 481011 - RNA, 19 nt, Chlamydia trachomatis
aaacgucgaaaagcuucug

SEQ ID NO: 481012 - RNA, 13 nt, Chlamydia trachomatis
aaacggugacugu

SEQ ID NO: 481013 - RNA, 17 nt, Chlamydia trachomatis
aaacgguggaacagcuc

SEQ ID NO: 481014 - RNA, 16 nt, Chlamydia trachomatis
aaacgcucagaaaacu

SEQ ID NO: 481015 - RNA, 16 nt, Chlamydia trachomatis
aaacgcuccaaauaaa

SEQ ID NO: 481016 - RNA, 18 nt, Chlamydia trachomatis
aaacgcuccaaauaaaac

SEQ ID NO: 481017 - RNA, 19 nt, Chlamydia trachomatis
aaacucucaaaucguucua

SEQ ID NO: 481018 - RNA, 20 nt, Chlamydia trachomatis
aaacucuuacgagcuuucuu

SEQ ID NO: 481019 - RNA, 15 nt, Chlamydia trachomatis
aaacucuuuuuaaau

SEQ ID NO: 481020 - RNA, 16 nt, Chlamydia trachomatis
aaacucuuuuuaaauc

SEQ ID NO: 481021 - RNA, 19 nt, Chlamydia trachomatis
aaacucuuuuucagacaaa

SEQ ID NO: 481022 - RNA, 20 nt, Chlamydia trachomatis
aaacucacaaauaacagaaa

SEQ ID NO: 481023 - RNA, 15 nt, Chlamydia trachomatis
aaacuccaagcacuu

SEQ ID NO: 481024 - RNA, 13 nt, Chlamydia trachomatis
aaacuacagaaag

SEQ ID NO: 481025 - RNA, 18 nt, Chlamydia trachomatis
aaacuacccgauucaaaa

SEQ ID NO: 481026 - RNA, 19 nt, Chlamydia trachomatis
aaacuacccgauucaaaaa

SEQ ID NO: 481027 - RNA, 15 nt, Chlamydia trachomatis
aaacuagaagggaac

SEQ ID NO: 481028 - RNA, 21 nt, Chlamydia trachomatis
aaacuagucucuucugugcaa

SEQ ID NO: 481029 - RNA, 18 nt, Chlamydia trachomatis
aaacuaguuugguuuuuu

SEQ ID NO: 481030 - RNA, 12 nt, Chlamydia trachomatis
aaacuauaagga

SEQ ID NO: 481031 - RNA, 20 nt, Chlamydia trachomatis
aaacuaucuaaaaucccuaa

SEQ ID NO: 481032 - RNA, 16 nt, Chlamydia trachomatis
aaacuauggagagggu

SEQ ID NO: 481033 - RNA, 22 nt, Chlamydia trachomatis
aaacuauggagaggguucucuu

SEQ ID NO: 481034 - RNA, 23 nt, Chlamydia trachomatis
aaacuauggagaggguucucuuu

SEQ ID NO: 481035 - RNA, 22 nt, Chlamydia trachomatis
aaacuuagaggccgaugguucu

SEQ ID NO: 481036 - RNA, 21 nt, Chlamydia trachomatis
aaacuuagcuaaauucaacug

SEQ ID NO: 481037 - RNA, 11 nt, Chlamydia trachomatis
aaacuucugga

SEQ ID NO: 481038 - RNA, 23 nt, Chlamydia trachomatis
aaacuucuggagauugaauaaau

SEQ ID NO: 481039 - RNA, 22 nt, Chlamydia trachomatis
aaacuucuuccaaauagggucu

SEQ ID NO: 481040 - RNA, 20 nt, Chlamydia trachomatis
aaacuucuucuaaguauucu

SEQ ID NO: 481041 - RNA, 20 nt, Chlamydia trachomatis
aaacuugucuaaaagaauau

SEQ ID NO: 481042 - RNA, 16 nt, Chlamydia trachomatis
aaacugcucaaggaaa

SEQ ID NO: 481043 - RNA, 18 nt, Chlamydia trachomatis
aaacugcugcuaucaucu

SEQ ID NO: 481044 - RNA, 22 nt, Chlamydia trachomatis
aaacuguccuuuauucaauauc

SEQ ID NO: 481045 - RNA, 22 nt, Chlamydia trachomatis
aaacugucuauuggacucagaa

SEQ ID NO: 481046 - RNA, 23 nt, Chlamydia trachomatis
aaacugucuauuggacucagaau

SEQ ID NO: 481047 - RNA, 15 nt, Chlamydia trachomatis
aaacugugaagaaug

SEQ ID NO: 481048 - RNA, 15 nt, Chlamydia trachomatis
aaagccauagccauc

SEQ ID NO: 481049 - RNA, 17 nt, Chlamydia trachomatis
aaagccauacaaagauu

SEQ ID NO: 481050 - RNA, 20 nt, Chlamydia trachomatis
aaagcacgauaaaagacaga

SEQ ID NO: 481051 - RNA, 23 nt, Chlamydia trachomatis
aaagcacugcguauuugaaauca

SEQ ID NO: 481052 - RNA, 20 nt, Chlamydia trachomatis
aaagcagccacuccugcagc

SEQ ID NO: 481053 - RNA, 21 nt, Chlamydia trachomatis
aaagcagcuaaccaugcuccu

SEQ ID NO: 481054 - RNA, 19 nt, Chlamydia trachomatis
aaagcauguuucggaauuc

SEQ ID NO: 481055 - RNA, 18 nt, Chlamydia trachomatis
aaagcauucguuaucaau

SEQ ID NO: 481056 - RNA, 20 nt, Chlamydia trachomatis
aaagcauucguuaucaauaa

SEQ ID NO: 481057 - RNA, 21 nt, Chlamydia trachomatis
aaagauuuccccuuuucaaua

SEQ ID NO: 481058 - RNA, 15 nt, Chlamydia trachomatis
aaagauuucuucuuu

SEQ ID NO: 481059 - RNA, 23 nt, Chlamydia trachomatis
aaagaguggacuuuagauagucu

SEQ ID NO: 481060 - RNA, 13 nt, Chlamydia trachomatis
aaagaguuucuuu

SEQ ID NO: 481061 - RNA, 23 nt, Chlamydia trachomatis
aaagaguuugugauuuagacaca

SEQ ID NO: 481062 - RNA, 22 nt, Chlamydia trachomatis
aaagagccguucucucuaaaau

SEQ ID NO: 481063 - RNA, 20 nt, Chlamydia trachomatis
aaagagcuaggguguauugg

SEQ ID NO: 481064 - RNA, 18 nt, Chlamydia trachomatis
aaagacuucacugccuuu

SEQ ID NO: 481065 - RNA, 14 nt, Chlamydia trachomatis
aaagacuuguucug

SEQ ID NO: 481066 - RNA, 14 nt, Chlamydia trachomatis
aaagagaagaaggc

SEQ ID NO: 481067 - RNA, 15 nt, Chlamydia trachomatis
aaagagaagaaggcu

SEQ ID NO: 481068 - RNA, 23 nt, Chlamydia trachomatis
aaagagagaggagaaaaacuccu

SEQ ID NO: 481069 - RNA, 17 nt, Chlamydia trachomatis
aaagagagcaacgagca

SEQ ID NO: 481070 - RNA, 16 nt, Chlamydia trachomatis
aaagagaugucagagu

SEQ ID NO: 481071 - RNA, 14 nt, Chlamydia trachomatis
aaagagauucuuug

SEQ ID NO: 481072 - RNA, 15 nt, Chlamydia trachomatis
aaacuuuucuuccuc

SEQ ID NO: 481073 - RNA, 13 nt, Chlamydia trachomatis
aaagaauaguaug

SEQ ID NO: 481074 - RNA, 23 nt, Chlamydia trachomatis
aaaggcaacucucucuccccaua

SEQ ID NO: 481075 - RNA, 13 nt, Chlamydia trachomatis
aaaggaaguagag

SEQ ID NO: 481076 - RNA, 16 nt, Chlamydia trachomatis
aaagcugcuuuacauc

SEQ ID NO: 481077 - RNA, 23 nt, Chlamydia trachomatis
aaagcugcuuuagcugcuuuaaa

SEQ ID NO: 481078 - RNA, 18 nt, Chlamydia trachomatis
aaagcugggcagcaagag

SEQ ID NO: 481079 - RNA, 19 nt, Chlamydia trachomatis
aaagcugggcagcaagaga

SEQ ID NO: 481080 - RNA, 15 nt, Chlamydia trachomatis
aaagcugggaaaucu

SEQ ID NO: 481081 - RNA, 23 nt, Chlamydia trachomatis
aaagcugguuucagcgguugccu

SEQ ID NO: 481082 - RNA, 17 nt, Chlamydia trachomatis
aaaggaacaucgagaaa

SEQ ID NO: 481083 - RNA, 19 nt, Chlamydia trachomatis
aaaggaacaucgagaaaau

SEQ ID NO: 481084 - RNA, 21 nt, Chlamydia trachomatis
aaaggaacaucgagaaaauga

SEQ ID NO: 481085 - RNA, 16 nt, Chlamydia trachomatis
aaaggaaaucacugaa

SEQ ID NO: 481086 - RNA, 17 nt, Chlamydia trachomatis
aaagcccaguuaaccuu

SEQ ID NO: 481087 - RNA, 18 nt, Chlamydia trachomatis
aaagcccaguuaaccuug

SEQ ID NO: 481088 - RNA, 15 nt, Chlamydia trachomatis
aaagccccuacucuu

SEQ ID NO: 481089 - RNA, 21 nt, Chlamydia trachomatis
aaagcuaagauuccucuugaa

SEQ ID NO: 481090 - RNA, 16 nt, Chlamydia trachomatis
aaagggggacaaaaau

SEQ ID NO: 481091 - RNA, 18 nt, Chlamydia trachomatis
aaagggggacaaaaauac

SEQ ID NO: 481092 - RNA, 20 nt, Chlamydia trachomatis
aaagguguuuucuacggaaa

SEQ ID NO: 481093 - RNA, 15 nt, Chlamydia trachomatis
aaagguuucccaaaa

SEQ ID NO: 481094 - RNA, 22 nt, Chlamydia trachomatis
aaagguuuguuuccucucucug

SEQ ID NO: 481095 - RNA, 19 nt, Chlamydia trachomatis
aaaggccuauccaaggaaa

SEQ ID NO: 481096 - RNA, 23 nt, Chlamydia trachomatis
aaagggaggaggaaagaguucuc

SEQ ID NO: 481097 - RNA, 20 nt, Chlamydia trachomatis
aaaguauucuguaaaaggaa

SEQ ID NO: 481098 - RNA, 23 nt, Chlamydia trachomatis
aaagucagagauauugucuacuu

SEQ ID NO: 481099 - RNA, 22 nt, Chlamydia trachomatis
aaaucaguggaacugcuucccu

SEQ ID NO: 481100 - RNA, 18 nt, Chlamydia trachomatis
aaaucacgcacuuuuugu

SEQ ID NO: 481101 - RNA, 15 nt, Chlamydia trachomatis
aaaucacuuucugcu

SEQ ID NO: 481102 - RNA, 16 nt, Chlamydia trachomatis
aaaucacuuucugcuu

SEQ ID NO: 481103 - RNA, 13 nt, Chlamydia trachomatis
aaaucaauaaugu

SEQ ID NO: 481104 - RNA, 19 nt, Chlamydia trachomatis
aaaucaauaaugucuccag

SEQ ID NO: 481105 - RNA, 16 nt, Chlamydia trachomatis
aaaucacaauuuuucu

SEQ ID NO: 481106 - RNA, 13 nt, Chlamydia trachomatis
aaaucacacaagc

SEQ ID NO: 481107 - RNA, 19 nt, Chlamydia trachomatis
aaauaggcgaauuucucua

SEQ ID NO: 481108 - RNA, 19 nt, Chlamydia trachomatis
aaauaguguaaggagagaa

SEQ ID NO: 481109 - RNA, 16 nt, Chlamydia trachomatis
aaauaugacagagccc

SEQ ID NO: 481110 - RNA, 19 nt, Chlamydia trachomatis
aaauauugaucuccccauc

SEQ ID NO: 481111 - RNA, 13 nt, Chlamydia trachomatis
aaauauugcucua

SEQ ID NO: 481112 - RNA, 14 nt, Chlamydia trachomatis
aaauauugcucuaa

SEQ ID NO: 481113 - RNA, 13 nt, Chlamydia trachomatis
aaauauuuugcug

SEQ ID NO: 481114 - RNA, 20 nt, Chlamydia trachomatis
aaauauuuuugggaaaaaau

SEQ ID NO: 481115 - RNA, 14 nt, Chlamydia trachomatis
aaaucaaaccaaaa

SEQ ID NO: 481116 - RNA, 18 nt, Chlamydia trachomatis
aaauacgcgcgcuaagac

SEQ ID NO: 481117 - RNA, 22 nt, Chlamydia trachomatis
aaauacgcgcgcuaagacuuuc

SEQ ID NO: 481118 - RNA, 21 nt, Chlamydia trachomatis
aaauagcuucguagagcaaga

SEQ ID NO: 481119 - RNA, 23 nt, Chlamydia trachomatis
aaauagcucaguugguagagcaa

SEQ ID NO: 481120 - RNA, 16 nt, Chlamydia trachomatis
aaauacuucuuuuugu

SEQ ID NO: 481121 - RNA, 14 nt, Chlamydia trachomatis
aaauacuugauuuu

SEQ ID NO: 481122 - RNA, 16 nt, Chlamydia trachomatis
aaauacuugauuuuuu

SEQ ID NO: 481123 - RNA, 20 nt, Chlamydia trachomatis
aaaguccgcuaauccaugca

SEQ ID NO: 481124 - RNA, 17 nt, Chlamydia trachomatis
aaauaaaacgaaaaaca

SEQ ID NO: 481125 - RNA, 12 nt, Chlamydia trachomatis
aaauaacaaagc

SEQ ID NO: 481126 - RNA, 23 nt, Chlamydia trachomatis
aaauaacgauucuugauaaauaa

SEQ ID NO: 481127 - RNA, 14 nt, Chlamydia trachomatis
aaauaagaaaguuu

SEQ ID NO: 481128 - RNA, 15 nt, Chlamydia trachomatis
aaauaaguaggugag

SEQ ID NO: 481129 - RNA, 21 nt, Chlamydia trachomatis
aaauaagucuuuuacuuugaa

SEQ ID NO: 481130 - RNA, 17 nt, Chlamydia trachomatis
aaauaauacaaaggagc

SEQ ID NO: 481131 - RNA, 23 nt, Chlamydia trachomatis
aaaaagcugggcagcaagagaga

SEQ ID NO: 481132 - RNA, 23 nt, Chlamydia trachomatis
aaaaagccugugccuuucguuag

SEQ ID NO: 481133 - RNA, 18 nt, Chlamydia trachomatis
aaaaaggcauaaaagaga

SEQ ID NO: 481134 - RNA, 16 nt, Chlamydia trachomatis
aaauuaauguaauuuu

SEQ ID NO: 481135 - RNA, 15 nt, Chlamydia trachomatis
aaauggaaauaaaaa

SEQ ID NO: 481136 - RNA, 15 nt, Chlamydia trachomatis
aaauguugaugguuu

SEQ ID NO: 481137 - RNA, 16 nt, Chlamydia trachomatis
aaauuaucgccaaaaa

SEQ ID NO: 481138 - RNA, 17 nt, Chlamydia trachomatis
aaauuaucuaaaaaaau

SEQ ID NO: 481139 - RNA, 19 nt, Chlamydia trachomatis
aaauucagaucccauccuu

SEQ ID NO: 481140 - RNA, 23 nt, Chlamydia trachomatis
aaauuccauguugucauagaucg

SEQ ID NO: 481141 - RNA, 23 nt, Chlamydia trachomatis
aaauucgcuaccaaaaauuuuuu

SEQ ID NO: 481142 - RNA, 22 nt, Chlamydia trachomatis
aaauucuaaacgagcuagcucu

SEQ ID NO: 481143 - RNA, 18 nt, Chlamydia trachomatis
aaauucuacaacagcaaa

SEQ ID NO: 481144 - RNA, 20 nt, Chlamydia trachomatis
aaaugcucucgcauuugaga

SEQ ID NO: 481145 - RNA, 21 nt, Chlamydia trachomatis
aaaugcucucgcauuugagau

SEQ ID NO: 481146 - RNA, 19 nt, Chlamydia trachomatis
aaaugcgugaacuguucau

SEQ ID NO: 481147 - RNA, 15 nt, Chlamydia trachomatis
aaaugcuguaaaaca

SEQ ID NO: 481148 - RNA, 16 nt, Chlamydia trachomatis
aaaugcuguaaaacau

SEQ ID NO: 481149 - RNA, 18 nt, Chlamydia trachomatis
aaaugcuguaaaacauuu

SEQ ID NO: 481150 - RNA, 21 nt, Chlamydia trachomatis
aaaugcgcucuuuaggcaccc

SEQ ID NO: 481151 - RNA, 16 nt, Chlamydia trachomatis
aaaucuucauaagaaa

SEQ ID NO: 481152 - RNA, 18 nt, Chlamydia trachomatis
aaaucuucauaagaaaau

SEQ ID NO: 481153 - RNA, 20 nt, Chlamydia trachomatis
aaaucuuccauaaaauccaa

SEQ ID NO: 481154 - RNA, 13 nt, Chlamydia trachomatis
aaaucuuuuaucu

SEQ ID NO: 481155 - RNA, 20 nt, Chlamydia trachomatis
aaaucuuuuaucuucuuaau

SEQ ID NO: 481156 - RNA, 14 nt, Chlamydia trachomatis
aaaugaacauaugc

SEQ ID NO: 481157 - RNA, 16 nt, Chlamydia trachomatis
aaaucauagauaauga

SEQ ID NO: 481158 - RNA, 15 nt, Chlamydia trachomatis
aaaucgcugagcucu

SEQ ID NO: 481159 - RNA, 15 nt, Chlamydia trachomatis
aaaucuaaaauauca

SEQ ID NO: 481160 - RNA, 12 nt, Chlamydia trachomatis
aaaucuaaaauu

SEQ ID NO: 481161 - RNA, 18 nt, Chlamydia trachomatis
aaaucucaaaguuuuugu

SEQ ID NO: 481162 - RNA, 12 nt, Chlamydia trachomatis
aaacaaaauaau

SEQ ID NO: 481163 - RNA, 12 nt, Chlamydia trachomatis
aaacaaacaaua

SEQ ID NO: 481164 - RNA, 12 nt, Chlamydia trachomatis
aaacaaaaauaa

SEQ ID NO: 481165 - RNA, 15 nt, Chlamydia trachomatis
aaaauuuuucugcuc

SEQ ID NO: 481166 - RNA, 13 nt, Chlamydia trachomatis
aaacaaauguccc

SEQ ID NO: 481167 - RNA, 16 nt, Chlamydia trachomatis
aaacaacaaagaacuc

SEQ ID NO: 481168 - RNA, 22 nt, Chlamydia trachomatis
aaaauuccucauucaagugacu

SEQ ID NO: 481169 - RNA, 15 nt, Chlamydia trachomatis
aaaauuuuacguaau

SEQ ID NO: 481170 - RNA, 19 nt, Chlamydia trachomatis
aaaauccuucugccucuuu

SEQ ID NO: 481171 - RNA, 19 nt, Chlamydia trachomatis
aaaaucgcagcuucggaag

SEQ ID NO: 481172 - RNA, 21 nt, Chlamydia trachomatis
aaaaucgcugagcucuuuccu

SEQ ID NO: 481173 - RNA, 14 nt, Chlamydia trachomatis
aaaaucgugcuaug

SEQ ID NO: 481174 - RNA, 14 nt, Chlamydia trachomatis
aaaaucuaaaauau

SEQ ID NO: 481175 - RNA, 15 nt, Chlamydia trachomatis
aaaaucuaaaauauc

SEQ ID NO: 481176 - RNA, 19 nt, Chlamydia trachomatis
aaaaugaucuaaaggaaaa

SEQ ID NO: 481177 - RNA, 21 nt, Chlamydia trachomatis
aaaaugaucuaaaggaaaaau

SEQ ID NO: 481178 - RNA, 14 nt, Chlamydia trachomatis
aaaaugcaaagcuu

SEQ ID NO: 481179 - RNA, 21 nt, Chlamydia trachomatis
aaaaugcuugcguauagagca

SEQ ID NO: 481180 - RNA, 22 nt, Chlamydia trachomatis
aaaauuagggaaaaacuuuucu

SEQ ID NO: 481181 - RNA, 13 nt, Chlamydia trachomatis
aaaauuaucuaaa

SEQ ID NO: 481182 - RNA, 17 nt, Chlamydia trachomatis
aaaauuaucuaaaaaaa

SEQ ID NO: 481183 - RNA, 14 nt, Chlamydia trachomatis
aaaaguucauagau

SEQ ID NO: 481184 - RNA, 13 nt, Chlamydia trachomatis
aaaauaaguuacc

SEQ ID NO: 481185 - RNA, 18 nt, Chlamydia trachomatis
aaaauaaguuaccucuuu

SEQ ID NO: 481186 - RNA, 21 nt, Chlamydia trachomatis
aaaauaaucggcaaaagaucu

SEQ ID NO: 481187 - RNA, 16 nt, Chlamydia trachomatis
aaaauaaucuuguaau

SEQ ID NO: 481188 - RNA, 15 nt, Chlamydia trachomatis
aaaagccauacaaag

SEQ ID NO: 481189 - RNA, 22 nt, Chlamydia trachomatis
aaaaguaagcgaagaaggagau

SEQ ID NO: 481190 - RNA, 21 nt, Chlamydia trachomatis
aaaaguaguccuaucaccacu

SEQ ID NO: 481191 - RNA, 17 nt, Chlamydia trachomatis
aaaauagguaaagaagu

SEQ ID NO: 481192 - RNA, 18 nt, Chlamydia trachomatis
aaaaucaaggauaugugc

SEQ ID NO: 481193 - RNA, 20 nt, Chlamydia trachomatis
aaaaucacaauuuuucuuug

SEQ ID NO: 481194 - RNA, 18 nt, Chlamydia trachomatis
aaaaucacacaagcugac

SEQ ID NO: 481195 - RNA, 18 nt, Chlamydia trachomatis
aaaauccaauguaaaaug

SEQ ID NO: 481196 - RNA, 11 nt, Chlamydia trachomatis
aaaauccaaag

SEQ ID NO: 481197 - RNA, 11 nt, Chlamydia trachomatis
aaaauccauug

SEQ ID NO: 481198 - RNA, 20 nt, Chlamydia trachomatis
aaaaucccgguaauagaagu

SEQ ID NO: 481199 - RNA, 16 nt, Chlamydia trachomatis
aaaaucccuucccagc

SEQ ID NO: 481200 - RNA, 23 nt, Chlamydia trachomatis
aaaacgguccguugauuucauaa

SEQ ID NO: 481201 - RNA, 22 nt, Chlamydia trachomatis
aaaacggucuauggcaaaaggu

SEQ ID NO: 481202 - RNA, 19 nt, Chlamydia trachomatis
aaaacgguguuagaaaaua

SEQ ID NO: 481203 - RNA, 19 nt, Chlamydia trachomatis
aaaacucuccgguguaucc

SEQ ID NO: 481204 - RNA, 11 nt, Chlamydia trachomatis
aaaacucucuu

SEQ ID NO: 481205 - RNA, 17 nt, Chlamydia trachomatis
aaaacuucgggauaaga

SEQ ID NO: 481206 - RNA, 21 nt, Chlamydia trachomatis
aaaacuugucuaaaagaauau

SEQ ID NO: 481207 - RNA, 13 nt, Chlamydia trachomatis
aaaagaaagccuu

SEQ ID NO: 481208 - RNA, 18 nt, Chlamydia trachomatis
aaaagaaagccuucucuu

SEQ ID NO: 481209 - RNA, 16 nt, Chlamydia trachomatis
aaaagaagaaucuucu

SEQ ID NO: 481210 - RNA, 15 nt, Chlamydia trachomatis
aaaagaaucuaaaaa

SEQ ID NO: 481211 - RNA, 17 nt, Chlamydia trachomatis
aaaagaaucuaaaaagc

SEQ ID NO: 481212 - RNA, 21 nt, Chlamydia trachomatis
aaaagacucucccucuuguaa

SEQ ID NO: 481213 - RNA, 19 nt, Chlamydia trachomatis
aaaagagagcccuaauaaa

SEQ ID NO: 481214 - RNA, 14 nt, Chlamydia trachomatis
aaaagagcuuuucu

SEQ ID NO: 481215 - RNA, 20 nt, Chlamydia trachomatis
aaaagagguauuuaggaacu

SEQ ID NO: 481216 - RNA, 19 nt, Chlamydia trachomatis
aaaagauagugcagaagau

SEQ ID NO: 481217 - RNA, 19 nt, Chlamydia trachomatis
aaaagaucuucaacaagau

SEQ ID NO: 481218 - RNA, 14 nt, Chlamydia trachomatis
aaaagauuucagag

SEQ ID NO: 481219 - RNA, 16 nt, Chlamydia trachomatis
aaaagauuuccccuuu

SEQ ID NO: 481220 - RNA, 18 nt, Chlamydia trachomatis
aaaagauuuucaacggga

SEQ ID NO: 481221 - RNA, 16 nt, Chlamydia trachomatis
aaaacauuccugccaa

SEQ ID NO: 481222 - RNA, 14 nt, Chlamydia trachomatis
aaaacauuucugca

SEQ ID NO: 481223 - RNA, 21 nt, Chlamydia trachomatis
aaaacauccaugucuaaggau

SEQ ID NO: 481224 - RNA, 18 nt, Chlamydia trachomatis
aaaacaaugauauucuaa

SEQ ID NO: 481225 - RNA, 23 nt, Chlamydia trachomatis
aaaacaauuuccuuagaaagaau

SEQ ID NO: 481226 - RNA, 12 nt, Chlamydia trachomatis
aaaaauccuucc

SEQ ID NO: 481227 - RNA, 11 nt, Chlamydia trachomatis
aaaaauguuuu

SEQ ID NO: 481228 - RNA, 21 nt, Chlamydia trachomatis
aaaaauuagggaaaaacuuuu

SEQ ID NO: 481229 - RNA, 14 nt, Chlamydia trachomatis
aaaaauuuucacac

SEQ ID NO: 481230 - RNA, 19 nt, Chlamydia trachomatis
aaaaauuuggcaauggcaa

SEQ ID NO: 481231 - RNA, 13 nt, Chlamydia trachomatis
aaaaauacuucuu

SEQ ID NO: 481232 - RNA, 13 nt, Chlamydia trachomatis
aaaaauacuugau

SEQ ID NO: 481233 - RNA, 13 nt, Chlamydia trachomatis
aaaaauaaaaaua

SEQ ID NO: 481234 - RNA, 15 nt, Chlamydia trachomatis
aaaaauaaaaauagu

SEQ ID NO: 481235 - RNA, 15 nt, Chlamydia trachomatis
aaaaaccaaaccaga

SEQ ID NO: 481236 - RNA, 13 nt, Chlamydia trachomatis
aaaaaccauucca

SEQ ID NO: 481237 - RNA, 14 nt, Chlamydia trachomatis
aaaaacagaaagaa

SEQ ID NO: 481238 - RNA, 11 nt, Chlamydia trachomatis
aaaaacagcag

SEQ ID NO: 481239 - RNA, 11 nt, Chlamydia trachomatis
aaaaacagcuc

SEQ ID NO: 481240 - RNA, 16 nt, Chlamydia trachomatis
aaaaaauccaccguag

SEQ ID NO: 481241 - RNA, 22 nt, Chlamydia trachomatis
aaaaaauccaccguagaacaau

SEQ ID NO: 481242 - RNA, 13 nt, Chlamydia trachomatis
aaaaaauccagga

SEQ ID NO: 481243 - RNA, 16 nt, Chlamydia trachomatis
aaaaaccacagacuca

SEQ ID NO: 481244 - RNA, 21 nt, Chlamydia trachomatis
aaaaaccaccuucugcaugca

SEQ ID NO: 481245 - RNA, 15 nt, Chlamydia trachomatis
aaaaacaaucaaagc

SEQ ID NO: 481246 - RNA, 13 nt, Chlamydia trachomatis
aaaaacagaaaga

SEQ ID NO: 481247 - RNA, 21 nt, Chlamydia trachomatis
aaaaaaguguaaucauuuucu

SEQ ID NO: 481248 - RNA, 15 nt, Chlamydia trachomatis
aaaaaaggcauaaaa

SEQ ID NO: 481249 - RNA, 21 nt, Chlamydia trachomatis
aaaaaaggcuccccucuuuuu

SEQ ID NO: 481250 - RNA, 17 nt, Chlamydia trachomatis
aaaaaaggucucucuuu

SEQ ID NO: 481251 - RNA, 11 nt, Chlamydia trachomatis
aaaaaaccaaa

SEQ ID NO: 481252 - RNA, 12 nt, Chlamydia trachomatis
aaaaaacaaaac

SEQ ID NO: 481253 - RNA, 12 nt, Chlamydia trachomatis
aaaaaaagaggu

SEQ ID NO: 481254 - RNA, 12 nt, Chlamydia trachomatis
aaaaaaaaccaa

SEQ ID NO: 481255 - RNA, 13 nt, Chlamydia trachomatis
aaaaaaaaccaaa

SEQ ID NO: 481256 - RNA, 14 nt, Chlamydia trachomatis
aaaaaaaaccaaac

SEQ ID NO: 481257 - RNA, 12 nt, Chlamydia trachomatis
aaaaaaaaagag

SEQ ID NO: 481258 - RNA, 13 nt, Chlamydia trachomatis
aaaaaaaaagagg

SEQ ID NO: 481259 - RNA, 13 nt, Chlamydia trachomatis
aaaaaaaagaggg

SEQ ID NO: 481260 - RNA, 17 nt, Chlamydia trachomatis
aaaaaggucucucuuua

SEQ ID NO: 481261 - RNA, 17 nt, Chlamydia trachomatis
aacacaagcagacaagc

SEQ ID NO: 481262 - RNA, 13 nt, Chlamydia trachomatis
aacacaauuuuug

SEQ ID NO: 481263 - RNA, 14 nt, Chlamydia trachomatis
aacacaauuuuugu

SEQ ID NO: 481264 - RNA, 19 nt, Chlamydia trachomatis
aaaaaguccgcuaauccau

SEQ ID NO: 481265 - RNA, 21 nt, Chlamydia trachomatis
aaaaagucuguuccuaauacu

SEQ ID NO: 481266 - RNA, 14 nt, Chlamydia trachomatis
aacaccaaaaaauc

SEQ ID NO: 481267 - RNA, 13 nt, Chlamydia trachomatis
aacaccaaauccu

SEQ ID NO: 481268 - RNA, 15 nt, Chlamydia trachomatis
aaauucuucugauaa

SEQ ID NO: 481269 - RNA, 18 nt, Chlamydia trachomatis
aaauucuucugauaaaug

SEQ ID NO: 481270 - RNA, 20 nt, Chlamydia trachomatis
aacaagguucuucaacaacu

SEQ ID NO: 481271 - RNA, 13 nt, Chlamydia trachomatis
aacaagucucuga

SEQ ID NO: 481272 - RNA, 22 nt, Chlamydia trachomatis
aacaaguuccuggauccaaaaa

SEQ ID NO: 481273 - RNA, 20 nt, Chlamydia trachomatis
aacaaguuucuuccagacaa

SEQ ID NO: 481274 - RNA, 14 nt, Chlamydia trachomatis
aacaauaaguuacu

SEQ ID NO: 481275 - RNA, 19 nt, Chlamydia trachomatis
aacaauacuacuaagguga

SEQ ID NO: 481276 - RNA, 15 nt, Chlamydia trachomatis
aacaauauagucccu

SEQ ID NO: 481277 - RNA, 12 nt, Chlamydia trachomatis
aacaauauccuc

SEQ ID NO: 481278 - RNA, 14 nt, Chlamydia trachomatis
aacaaucaaagcac

SEQ ID NO: 481279 - RNA, 15 nt, Chlamydia trachomatis
aacaaucacaggcug

SEQ ID NO: 481280 - RNA, 22 nt, Chlamydia trachomatis
aacaaucacaggcugugaugga

SEQ ID NO: 481281 - RNA, 20 nt, Chlamydia trachomatis
aacaauccccaaaccaguuu

SEQ ID NO: 481282 - RNA, 15 nt, Chlamydia trachomatis
aacaaucuaaaaaau

SEQ ID NO: 481283 - RNA, 17 nt, Chlamydia trachomatis
aacaaucuaaaaaauua

SEQ ID NO: 481284 - RNA, 18 nt, Chlamydia trachomatis
aacaaucuaaaaaauuag

SEQ ID NO: 481285 - RNA, 15 nt, Chlamydia trachomatis
aacaaugacucaaaa

SEQ ID NO: 481286 - RNA, 21 nt, Chlamydia trachomatis
aacaaugccgcccaaggaaaa

SEQ ID NO: 481287 - RNA, 20 nt, Chlamydia trachomatis
aacaaugcugauaaaaauaa

SEQ ID NO: 481288 - RNA, 22 nt, Chlamydia trachomatis
aacaauugguuugauagcuuca

SEQ ID NO: 481289 - RNA, 21 nt, Chlamydia trachomatis
aacaauuuccuuagaaagaau

SEQ ID NO: 481290 - RNA, 19 nt, Chlamydia trachomatis
aacaauuugugauuucuga

SEQ ID NO: 481291 - RNA, 14 nt, Chlamydia trachomatis
aacaauuuuaaaau

SEQ ID NO: 481292 - RNA, 16 nt, Chlamydia trachomatis
aacaauuuuaaaaucu

SEQ ID NO: 481293 - RNA, 22 nt, Chlamydia trachomatis
aacaccguauguaagccuaaaa

SEQ ID NO: 481294 - RNA, 12 nt, Chlamydia trachomatis
aacacccuguaa

SEQ ID NO: 481295 - RNA, 17 nt, Chlamydia trachomatis
aacaccccccucugcac

SEQ ID NO: 481296 - RNA, 14 nt, Chlamydia trachomatis
aacaccucuucugg

SEQ ID NO: 481297 - RNA, 23 nt, Chlamydia trachomatis
aacacucgugaaauaaaucacaa

SEQ ID NO: 481298 - RNA, 17 nt, Chlamydia trachomatis
aacacugacuauuccug

SEQ ID NO: 481299 - RNA, 23 nt, Chlamydia trachomatis
aacacuagagucagaagcuauuc

SEQ ID NO: 481300 - RNA, 20 nt, Chlamydia trachomatis
aacacguagucauugauucu

SEQ ID NO: 481301 - RNA, 16 nt, Chlamydia trachomatis
aacagaucuuuuucau

SEQ ID NO: 481302 - RNA, 12 nt, Chlamydia trachomatis
aacagaugacuc

SEQ ID NO: 481303 - RNA, 13 nt, Chlamydia trachomatis
aacagauucuaua

SEQ ID NO: 481304 - RNA, 14 nt, Chlamydia trachomatis
aacagcagaacuca

SEQ ID NO: 481305 - RNA, 16 nt, Chlamydia trachomatis
aacagcacaaacaaau

SEQ ID NO: 481306 - RNA, 22 nt, Chlamydia trachomatis
aacagcacaaacaaauccuaga

SEQ ID NO: 481307 - RNA, 17 nt, Chlamydia trachomatis
aacagcauuuacuccua

SEQ ID NO: 481308 - RNA, 17 nt, Chlamydia trachomatis
aacagaaagaaaugcgu

SEQ ID NO: 481309 - RNA, 22 nt, Chlamydia trachomatis
aacagacuaaguuguaaaacaa

SEQ ID NO: 481310 - RNA, 23 nt, Chlamydia trachomatis
aacagacuaaguuguaaaacaac

SEQ ID NO: 481311 - RNA, 14 nt, Chlamydia trachomatis
aacauaugcucagg

SEQ ID NO: 481312 - RNA, 20 nt, Chlamydia trachomatis
aacauacacagauacugagu

SEQ ID NO: 481313 - RNA, 20 nt, Chlamydia trachomatis
aacauacaggucaagccuac

SEQ ID NO: 481314 - RNA, 16 nt, Chlamydia trachomatis
aacauccaccagcagu

SEQ ID NO: 481315 - RNA, 23 nt, Chlamydia trachomatis
aacaucugugucauaagcucuaa

SEQ ID NO: 481316 - RNA, 15 nt, Chlamydia trachomatis
aacaucuuuuaaagu

SEQ ID NO: 481317 - RNA, 23 nt, Chlamydia trachomatis
aacaucuuuuaaaguaaguaaaa

SEQ ID NO: 481318 - RNA, 15 nt, Chlamydia trachomatis
aacauuauuccgcuu

SEQ ID NO: 481319 - RNA, 12 nt, Chlamydia trachomatis
aacauuccaaau

SEQ ID NO: 481320 - RNA, 21 nt, Chlamydia trachomatis
aacauuccugccaaaaaccag

SEQ ID NO: 481321 - RNA, 20 nt, Chlamydia trachomatis
aaccaaaugaccuuucccuc

SEQ ID NO: 481322 - RNA, 12 nt, Chlamydia trachomatis
aaccaacucucc

SEQ ID NO: 481323 - RNA, 13 nt, Chlamydia trachomatis
aaccaaguuuuuu

SEQ ID NO: 481324 - RNA, 19 nt, Chlamydia trachomatis
aaccaauuguugagcagca

SEQ ID NO: 481325 - RNA, 20 nt, Chlamydia trachomatis
aaccacaaaaucagcaaaug

SEQ ID NO: 481326 - RNA, 22 nt, Chlamydia trachomatis
aacccaaggcgguaccugcuuc

SEQ ID NO: 481327 - RNA, 17 nt, Chlamydia trachomatis
aaccaucccguucuuga

SEQ ID NO: 481328 - RNA, 18 nt, Chlamydia trachomatis
aaccaucuguaaagcuuc

SEQ ID NO: 481329 - RNA, 19 nt, Chlamydia trachomatis
aaccaucuguaaagcuucg

SEQ ID NO: 481330 - RNA, 16 nt, Chlamydia trachomatis
aaccgaauuuguagau

SEQ ID NO: 481331 - RNA, 19 nt, Chlamydia trachomatis
aaccgaagagggaagagaa

SEQ ID NO: 481332 - RNA, 18 nt, Chlamydia trachomatis
aacccucuucucucaugu

SEQ ID NO: 481333 - RNA, 16 nt, Chlamydia trachomatis
aacccuucaggaaagc

SEQ ID NO: 481334 - RNA, 22 nt, Chlamydia trachomatis
aacccuagucgagaagaagguu

SEQ ID NO: 481335 - RNA, 20 nt, Chlamydia trachomatis
aacccuccgacccaagacac

SEQ ID NO: 481336 - RNA, 18 nt, Chlamydia trachomatis
aacccucgcagagaaaga

SEQ ID NO: 481337 - RNA, 14 nt, Chlamydia trachomatis
aaccgcgcgaaaau

SEQ ID NO: 481338 - RNA, 16 nt, Chlamydia trachomatis
aaccgcgacagccaca

SEQ ID NO: 481339 - RNA, 19 nt, Chlamydia trachomatis
aacgauucaauccagacuc

SEQ ID NO: 481340 - RNA, 18 nt, Chlamydia trachomatis
aacgauuaacucugcacc

SEQ ID NO: 481341 - RNA, 16 nt, Chlamydia trachomatis
aacgauuguuucugua

SEQ ID NO: 481342 - RNA, 21 nt, Chlamydia trachomatis
aacgauuuugucgauaagaag

SEQ ID NO: 481343 - RNA, 19 nt, Chlamydia trachomatis
aacgcuguuggaccagcgc

SEQ ID NO: 481344 - RNA, 14 nt, Chlamydia trachomatis
aacgcuugcacagc

SEQ ID NO: 481345 - RNA, 16 nt, Chlamydia trachomatis
aacgguggaacagcuc

SEQ ID NO: 481346 - RNA, 22 nt, Chlamydia trachomatis
aacggaacucuacaaaauaaaa

SEQ ID NO: 481347 - RNA, 22 nt, Chlamydia trachomatis
aacggaaucucgagcuaagaaa

SEQ ID NO: 481348 - RNA, 12 nt, Chlamydia trachomatis
aacuaauuuuug

SEQ ID NO: 481349 - RNA, 15 nt, Chlamydia trachomatis
aacuacagaaagagu

SEQ ID NO: 481350 - RNA, 17 nt, Chlamydia trachomatis
aacuacagaaagaguca

SEQ ID NO: 481351 - RNA, 18 nt, Chlamydia trachomatis
aacuacagaaagagucac

SEQ ID NO: 481352 - RNA, 15 nt, Chlamydia trachomatis
aacuacggaaaaaga

SEQ ID NO: 481353 - RNA, 17 nt, Chlamydia trachomatis
aacuacggaaaaagaag

SEQ ID NO: 481354 - RNA, 18 nt, Chlamydia trachomatis
aacuacucccaaaucaaa

SEQ ID NO: 481355 - RNA, 22 nt, Chlamydia trachomatis
aacuacucccaaaucaaaccaa

SEQ ID NO: 481356 - RNA, 16 nt, Chlamydia trachomatis
aacuagaagggaacag

SEQ ID NO: 481357 - RNA, 21 nt, Chlamydia trachomatis
aacuagcaaauucgcuaccaa

SEQ ID NO: 481358 - RNA, 15 nt, Chlamydia trachomatis
aacuagucucuucug

SEQ ID NO: 481359 - RNA, 11 nt, Chlamydia trachomatis
aacuaaaaagg

SEQ ID NO: 481360 - RNA, 11 nt, Chlamydia trachomatis
aacuaaacucc

SEQ ID NO: 481361 - RNA, 18 nt, Chlamydia trachomatis
aacuaaaggaaacaagca

SEQ ID NO: 481362 - RNA, 20 nt, Chlamydia trachomatis
aacuaaaggaaacaagcaga

SEQ ID NO: 481363 - RNA, 14 nt, Chlamydia trachomatis
aacuaaaugucucu

SEQ ID NO: 481364 - RNA, 22 nt, Chlamydia trachomatis
aacguguuguuugguucuugua

SEQ ID NO: 481365 - RNA, 15 nt, Chlamydia trachomatis
aacguuccuccucca

SEQ ID NO: 481366 - RNA, 21 nt, Chlamydia trachomatis
aacguagauaucuuuacucuu

SEQ ID NO: 481367 - RNA, 24 nt, Chlamydia trachomatis
aacguacuuuaggagaaagaauga

SEQ ID NO: 481368 - RNA, 16 nt, Chlamydia trachomatis
aacguccgcuccuucu

SEQ ID NO: 481369 - RNA, 18 nt, Chlamydia trachomatis
aacguccgcuccuucuuu

SEQ ID NO: 481370 - RNA, 19 nt, Chlamydia trachomatis
aacguccgcuccuucuuuc

SEQ ID NO: 481371 - RNA, 12 nt, Chlamydia trachomatis
aacgucuccccc

SEQ ID NO: 481372 - RNA, 19 nt, Chlamydia trachomatis
aacucuuuuccuaaacaaa

SEQ ID NO: 481373 - RNA, 13 nt, Chlamydia trachomatis
aacucaaaauaaa

SEQ ID NO: 481374 - RNA, 15 nt, Chlamydia trachomatis
aacucaacgaaagca

SEQ ID NO: 481375 - RNA, 23 nt, Chlamydia trachomatis
aacucuuuccuccucccuuucca

SEQ ID NO: 481376 - RNA, 14 nt, Chlamydia trachomatis
aacugcagugacau

SEQ ID NO: 481377 - RNA, 14 nt, Chlamydia trachomatis
aacugcagcaucua

SEQ ID NO: 481378 - RNA, 14 nt, Chlamydia trachomatis
aacugcucugccau

SEQ ID NO: 481379 - RNA, 15 nt, Chlamydia trachomatis
aacugcucuucuaac

SEQ ID NO: 481380 - RNA, 22 nt, Chlamydia trachomatis
aacugguguggguaagaauaaa

SEQ ID NO: 481381 - RNA, 14 nt, Chlamydia trachomatis
aacuuacuuuucuu

SEQ ID NO: 481382 - RNA, 16 nt, Chlamydia trachomatis
aacuuacuuuucuuag

SEQ ID NO: 481383 - RNA, 18 nt, Chlamydia trachomatis
aacuucugcuaaaaaugc

SEQ ID NO: 481384 - RNA, 19 nt, Chlamydia trachomatis
aacuucugcuaaaaaugcu

SEQ ID NO: 481385 - RNA, 21 nt, Chlamydia trachomatis
aacuucugcuaaaaaugcuug

SEQ ID NO: 481386 - RNA, 21 nt, Chlamydia trachomatis
aacuucuggagauugaauaaa

SEQ ID NO: 481387 - RNA, 18 nt, Chlamydia trachomatis
aacuucuggcaguaacaa

SEQ ID NO: 481388 - RNA, 21 nt, Chlamydia trachomatis
aacuucuggcaguaacaagca

SEQ ID NO: 481389 - RNA, 14 nt, Chlamydia trachomatis
aacuucuucauccu

SEQ ID NO: 481390 - RNA, 22 nt, Chlamydia trachomatis
aacuucuucuaaguauucuucu

SEQ ID NO: 481391 - RNA, 14 nt, Chlamydia trachomatis
aagaaaaauaaaaa

SEQ ID NO: 481392 - RNA, 17 nt, Chlamydia trachomatis
aagaaaaaucuccuccg

SEQ ID NO: 481393 - RNA, 20 nt, Chlamydia trachomatis
aagaaaacagccaagcaaga

SEQ ID NO: 481394 - RNA, 22 nt, Chlamydia trachomatis
aagaaaagagcuuuucuucccu

SEQ ID NO: 481395 - RNA, 15 nt, Chlamydia trachomatis
aagaaaauaaacaca

SEQ ID NO: 481396 - RNA, 15 nt, Chlamydia trachomatis
aagaaacuguaaugu

SEQ ID NO: 481397 - RNA, 22 nt, Chlamydia trachomatis
aagaaacuguaauguccucuuu

SEQ ID NO: 481398 - RNA, 16 nt, Chlamydia trachomatis
aagaaacuuuucugca

SEQ ID NO: 481399 - RNA, 20 nt, Chlamydia trachomatis
aagaaagccguucccaauaa

SEQ ID NO: 481400 - RNA, 14 nt, Chlamydia trachomatis
aagaaagccuucuc

SEQ ID NO: 481401 - RNA, 16 nt, Chlamydia trachomatis
aagaaagcuuauaacu

SEQ ID NO: 481402 - RNA, 17 nt, Chlamydia trachomatis
aagaaauggucucuucu

SEQ ID NO: 481403 - RNA, 21 nt, Chlamydia trachomatis
aagaaauugucgaauuuuucu

SEQ ID NO: 481404 - RNA, 23 nt, Chlamydia trachomatis
aagaaauugucgaauuuuucugc

SEQ ID NO: 481405 - RNA, 22 nt, Chlamydia trachomatis
aagaacaaagaauggaucuccc

SEQ ID NO: 481406 - RNA, 14 nt, Chlamydia trachomatis
aagaacagauugag

SEQ ID NO: 481407 - RNA, 18 nt, Chlamydia trachomatis
aagaacagauugagaaua

SEQ ID NO: 481408 - RNA, 21 nt, Chlamydia trachomatis
aagaacauauuaggagcaaga

SEQ ID NO: 481409 - RNA, 22 nt, Chlamydia trachomatis
aagaacauauuaggagcaagaa

SEQ ID NO: 481410 - RNA, 16 nt, Chlamydia trachomatis
aagaacccuauccccc

SEQ ID NO: 481411 - RNA, 23 nt, Chlamydia trachomatis
aagaacccuuuguacggagcgau

SEQ ID NO: 481412 - RNA, 16 nt, Chlamydia trachomatis
aagaaccuccuuuaua

SEQ ID NO: 481413 - RNA, 16 nt, Chlamydia trachomatis
aagaacgccugaucaa

SEQ ID NO: 481414 - RNA, 16 nt, Chlamydia trachomatis
aagaagauuuuuagaa

SEQ ID NO: 481415 - RNA, 23 nt, Chlamydia trachomatis
aagaagauguuguuaaagcuuuu

SEQ ID NO: 481416 - RNA, 22 nt, Chlamydia trachomatis
aagaagaucccauaaucucaua

SEQ ID NO: 481417 - RNA, 19 nt, Chlamydia trachomatis
aagaagaucuguaacuaca

SEQ ID NO: 481418 - RNA, 23 nt, Chlamydia trachomatis
aagaagcgaagcauucucucaua

SEQ ID NO: 481419 - RNA, 23 nt, Chlamydia trachomatis
aagaagcugcaguuucugagaaa

SEQ ID NO: 481420 - RNA, 18 nt, Chlamydia trachomatis
aagaacucccuccaaaaa

SEQ ID NO: 481421 - RNA, 20 nt, Chlamydia trachomatis
aagaacucccuccaaaaaag

SEQ ID NO: 481422 - RNA, 21 nt, Chlamydia trachomatis
aagaacugucuucuuucaaag

SEQ ID NO: 481423 - RNA, 19 nt, Chlamydia trachomatis
aagaagaacgccugaucaa

SEQ ID NO: 481424 - RNA, 13 nt, Chlamydia trachomatis
aagaagaagagag

SEQ ID NO: 481425 - RNA, 14 nt, Chlamydia trachomatis
aagaaggcuuuucu

SEQ ID NO: 481426 - RNA, 12 nt, Chlamydia trachomatis
aagaagggagug

SEQ ID NO: 481427 - RNA, 12 nt, Chlamydia trachomatis
aagaagguugug

SEQ ID NO: 481428 - RNA, 16 nt, Chlamydia trachomatis
aagaagguugaauuuc

SEQ ID NO: 481429 - RNA, 18 nt, Chlamydia trachomatis
aagaagucuuguccuucc

SEQ ID NO: 481430 - RNA, 21 nt, Chlamydia trachomatis
aagaaguuggucgggaaacau

SEQ ID NO: 481431 - RNA, 19 nt, Chlamydia trachomatis
aagaaguugguuuggguuu

SEQ ID NO: 481432 - RNA, 19 nt, Chlamydia trachomatis
aagaaguuuacgaacaaga

SEQ ID NO: 481433 - RNA, 15 nt, Chlamydia trachomatis
aagaaguuuuuuguc

SEQ ID NO: 481434 - RNA, 15 nt, Chlamydia trachomatis
aagaauaaacaacau

SEQ ID NO: 481435 - RNA, 12 nt, Chlamydia trachomatis
aagaauacaaag

SEQ ID NO: 481436 - RNA, 17 nt, Chlamydia trachomatis
aagaauacaaagcagcc

SEQ ID NO: 481437 - RNA, 14 nt, Chlamydia trachomatis
aagaauacaagaaa

SEQ ID NO: 481438 - RNA, 17 nt, Chlamydia trachomatis
aagaauacaagaaaggc

SEQ ID NO: 481439 - RNA, 13 nt, Chlamydia trachomatis
aagaauaauagag

SEQ ID NO: 481440 - RNA, 21 nt, Chlamydia trachomatis
aagaauagaauauuggagccu

SEQ ID NO: 481441 - RNA, 23 nt, Chlamydia trachomatis
aagaauagcuuuuaacuucccac

SEQ ID NO: 481442 - RNA, 17 nt, Chlamydia trachomatis
aagaauaucaucuucaa

SEQ ID NO: 481443 - RNA, 14 nt, Chlamydia trachomatis
aagaaucaaaaagu

SEQ ID NO: 481444 - RNA, 23 nt, Chlamydia trachomatis
aagaugacuugcccgacaguaua

SEQ ID NO: 481445 - RNA, 16 nt, Chlamydia trachomatis
aagaucucuuucucua

SEQ ID NO: 481446 - RNA, 20 nt, Chlamydia trachomatis
aagaucucuuucucuagaau

SEQ ID NO: 481447 - RNA, 23 nt, Chlamydia trachomatis
aagaucucuuucucuagaauuuc

SEQ ID NO: 481448 - RNA, 22 nt, Chlamydia trachomatis
aagaucuguaacuacaucuaaa

SEQ ID NO: 481449 - RNA, 14 nt, Chlamydia trachomatis
aagaucuguagcaa

SEQ ID NO: 481450 - RNA, 17 nt, Chlamydia trachomatis
aagaucuucagaaaucu

SEQ ID NO: 481451 - RNA, 21 nt, Chlamydia trachomatis
aagaucuuccggaaggauguu

SEQ ID NO: 481452 - RNA, 16 nt, Chlamydia trachomatis
aagaucuuuccuugug

SEQ ID NO: 481453 - RNA, 13 nt, Chlamydia trachomatis
aagaugaagaagu

SEQ ID NO: 481454 - RNA, 14 nt, Chlamydia trachomatis
aagaugaagaaguu

SEQ ID NO: 481455 - RNA, 17 nt, Chlamydia trachomatis
aagaauucgcacuaucu

SEQ ID NO: 481456 - RNA, 14 nt, Chlamydia trachomatis
aagaauucuugcua

SEQ ID NO: 481457 - RNA, 21 nt, Chlamydia trachomatis
aagaauguggguguagguuuu

SEQ ID NO: 481458 - RNA, 17 nt, Chlamydia trachomatis
aagaugcgaucuccuca

SEQ ID NO: 481459 - RNA, 20 nt, Chlamydia trachomatis
aagaugccgaacucuccucu

SEQ ID NO: 481460 - RNA, 18 nt, Chlamydia trachomatis
aagauguuguuaaagcuu

SEQ ID NO: 481461 - RNA, 23 nt, Chlamydia trachomatis
aagauucgauauacgcucuuuca

SEQ ID NO: 481462 - RNA, 15 nt, Chlamydia trachomatis
aagauuucagagcca

SEQ ID NO: 481463 - RNA, 16 nt, Chlamydia trachomatis
aagauuuccccuuuuc

SEQ ID NO: 481464 - RNA, 12 nt, Chlamydia trachomatis
aagauuucuucu

SEQ ID NO: 481465 - RNA, 21 nt, Chlamydia trachomatis
aagauuucuucuguagcccca

SEQ ID NO: 481466 - RNA, 18 nt, Chlamydia trachomatis
aagauuugaucuucugga

SEQ ID NO: 481467 - RNA, 21 nt, Chlamydia trachomatis
aagauuuucaacgggaacaaa

SEQ ID NO: 481468 - RNA, 22 nt, Chlamydia trachomatis
aagauuuucaacgggaacaaaa

SEQ ID NO: 481469 - RNA, 13 nt, Chlamydia trachomatis
aagauuuucaucu

SEQ ID NO: 481470 - RNA, 20 nt, Chlamydia trachomatis
aagauuuucaucuuccaacg

SEQ ID NO: 481471 - RNA, 14 nt, Chlamydia trachomatis
aagauuuugaauac

SEQ ID NO: 481472 - RNA, 18 nt, Chlamydia trachomatis
aagauuuuucagccuguc

SEQ ID NO: 481473 - RNA, 19 nt, Chlamydia trachomatis
aagcaaacuucauauuccc

SEQ ID NO: 481474 - RNA, 12 nt, Chlamydia trachomatis
aagcaacaauau

SEQ ID NO: 481475 - RNA, 19 nt, Chlamydia trachomatis
aagcaacgaaaccaaaaua

SEQ ID NO: 481476 - RNA, 13 nt, Chlamydia trachomatis
aagcacacagcgu

SEQ ID NO: 481477 - RNA, 14 nt, Chlamydia trachomatis
aagcaagaaucaaa

SEQ ID NO: 481478 - RNA, 12 nt, Chlamydia trachomatis
aagcacuccuca

SEQ ID NO: 481479 - RNA, 18 nt, Chlamydia trachomatis
aagcacgauaaaagacag

SEQ ID NO: 481480 - RNA, 17 nt, Chlamydia trachomatis
aagcaccuuuacaauca

SEQ ID NO: 481481 - RNA, 18 nt, Chlamydia trachomatis
aagcaccuuuacaaucau

SEQ ID NO: 481482 - RNA, 23 nt, Chlamydia trachomatis
aagcacugcguauuugaaaucaa

SEQ ID NO: 481483 - RNA, 13 nt, Chlamydia trachomatis
aagcagaaacaau

SEQ ID NO: 481484 - RNA, 15 nt, Chlamydia trachomatis
aagcagaaacagcuu

SEQ ID NO: 481485 - RNA, 21 nt, Chlamydia trachomatis
aagcagaugccggaagauuag

SEQ ID NO: 481486 - RNA, 15 nt, Chlamydia trachomatis
aagcagcuaaccaug

SEQ ID NO: 481487 - RNA, 13 nt, Chlamydia trachomatis
aagcauccccaaa

SEQ ID NO: 481488 - RNA, 15 nt, Chlamydia trachomatis
aagcauccccaaaag

SEQ ID NO: 481489 - RNA, 14 nt, Chlamydia trachomatis
aagcagucuagagg

SEQ ID NO: 481490 - RNA, 22 nt, Chlamydia trachomatis
aagcagugaagaaugaucacuu

SEQ ID NO: 481491 - RNA, 15 nt, Chlamydia trachomatis
aagccaccagccaca

SEQ ID NO: 481492 - RNA, 18 nt, Chlamydia trachomatis
aagccaauguucuauaua

SEQ ID NO: 481493 - RNA, 17 nt, Chlamydia trachomatis
aagcaugauauuuugaa

SEQ ID NO: 481494 - RNA, 20 nt, Chlamydia trachomatis
aagcaugauauuuugaagau

SEQ ID NO: 481495 - RNA, 22 nt, Chlamydia trachomatis
aagcaugucgagauaaaaaccu

SEQ ID NO: 481496 - RNA, 15 nt, Chlamydia trachomatis
aagcauucucucaua

SEQ ID NO: 481497 - RNA, 16 nt, Chlamydia trachomatis
aagcauugaacaccau

SEQ ID NO: 481498 - RNA, 18 nt, Chlamydia trachomatis
aagcauuucgucguguuc

SEQ ID NO: 481499 - RNA, 23 nt, Chlamydia trachomatis
aagccagccccucccugcgaauu

SEQ ID NO: 481500 - RNA, 15 nt, Chlamydia trachomatis
aagccauaguagaaa

SEQ ID NO: 481501 - RNA, 15 nt, Chlamydia trachomatis
aagccauacaaagau

SEQ ID NO: 481502 - RNA, 21 nt, Chlamydia trachomatis
aagccaucucggaucgagaag

SEQ ID NO: 481503 - RNA, 16 nt, Chlamydia trachomatis
aagcucggucucauua

SEQ ID NO: 481504 - RNA, 19 nt, Chlamydia trachomatis
aagcucggucucauuauau

SEQ ID NO: 481505 - RNA, 19 nt, Chlamydia trachomatis
aagcucgucuuuagaagaa

SEQ ID NO: 481506 - RNA, 22 nt, Chlamydia trachomatis
aagcucgucuuuagaagaaaag

SEQ ID NO: 481507 - RNA, 19 nt, Chlamydia trachomatis
aagcucuaacucuucuuua

SEQ ID NO: 481508 - RNA, 15 nt, Chlamydia trachomatis
aagcucgaauacgag

SEQ ID NO: 481509 - RNA, 18 nt, Chlamydia trachomatis
aagcucgaaucgucucuc

SEQ ID NO: 481510 - RNA, 19 nt, Chlamydia trachomatis
aagcucuagcaauagagau

SEQ ID NO: 481511 - RNA, 12 nt, Chlamydia trachomatis
aagcucuucgag

SEQ ID NO: 481512 - RNA, 22 nt, Chlamydia trachomatis
aagcucuugucgauaaaguaaa

SEQ ID NO: 481513 - RNA, 15 nt, Chlamydia trachomatis
aagcugacaaagcuu

SEQ ID NO: 481514 - RNA, 23 nt, Chlamydia trachomatis
aagcguuccuauacaagaaaaca

SEQ ID NO: 481515 - RNA, 17 nt, Chlamydia trachomatis
aagcggauucaagacca

SEQ ID NO: 481516 - RNA, 23 nt, Chlamydia trachomatis
aagcgcuccuagugauaaacagg

SEQ ID NO: 481517 - RNA, 19 nt, Chlamydia trachomatis
aagcguaguaagacccaga

SEQ ID NO: 481518 - RNA, 14 nt, Chlamydia trachomatis
aagcgucuccaaaa

SEQ ID NO: 481519 - RNA, 17 nt, Chlamydia trachomatis
aagcuguucuuccauau

SEQ ID NO: 481520 - RNA, 18 nt, Chlamydia trachomatis
aagcuuagccacugcaca

SEQ ID NO: 481521 - RNA, 21 nt, Chlamydia trachomatis
aagcugagcuucucgcuacaa

SEQ ID NO: 481522 - RNA, 14 nt, Chlamydia trachomatis
aagcugcagagaua

SEQ ID NO: 481523 - RNA, 17 nt, Chlamydia trachomatis
aagcugcagagauauaa

SEQ ID NO: 481524 - RNA, 15 nt, Chlamydia trachomatis
aaggaaacaagcaga

SEQ ID NO: 481525 - RNA, 16 nt, Chlamydia trachomatis
aaggaaacaagcagau

SEQ ID NO: 481526 - RNA, 17 nt, Chlamydia trachomatis
aaggaaaaagaaaaaaa

SEQ ID NO: 481527 - RNA, 21 nt, Chlamydia trachomatis
aaggaaaaagaaaaaaagagg

SEQ ID NO: 481528 - RNA, 14 nt, Chlamydia trachomatis
aagcuuuuuccaaa

SEQ ID NO: 481529 - RNA, 20 nt, Chlamydia trachomatis
aagcuuuuuccaaagcuucu

SEQ ID NO: 481530 - RNA, 23 nt, Chlamydia trachomatis
aagcuuuuucuacuguagcacca

SEQ ID NO: 481531 - RNA, 15 nt, Chlamydia trachomatis
aaggagacaaguuca

SEQ ID NO: 481532 - RNA, 15 nt, Chlamydia trachomatis
aaggauaaggaagaa

SEQ ID NO: 481533 - RNA, 18 nt, Chlamydia trachomatis
aaggagauguuaucucug

SEQ ID NO: 481534 - RNA, 17 nt, Chlamydia trachomatis
aaggagcgacuaauucu

SEQ ID NO: 481535 - RNA, 15 nt, Chlamydia trachomatis
aaggagcuaagaacc

SEQ ID NO: 481536 - RNA, 14 nt, Chlamydia trachomatis
aaggaaauaaagau

SEQ ID NO: 481537 - RNA, 16 nt, Chlamydia trachomatis
aaggauuuuuuuccca

SEQ ID NO: 481538 - RNA, 17 nt, Chlamydia trachomatis
aaggauuuuuuucugca

SEQ ID NO: 481539 - RNA, 23 nt, Chlamydia trachomatis
aaggccuuuuuuuauaaaggugg

SEQ ID NO: 481540 - RNA, 17 nt, Chlamydia trachomatis
aaggcgaauucuuugau

SEQ ID NO: 481541 - RNA, 13 nt, Chlamydia trachomatis
aagggagaggauu

SEQ ID NO: 481542 - RNA, 19 nt, Chlamydia trachomatis
aagggaugaagcuaaaaaa

SEQ ID NO: 481543 - RNA, 13 nt, Chlamydia trachomatis
aagggauguguua

SEQ ID NO: 481544 - RNA, 13 nt, Chlamydia trachomatis
aagggcaaaacuc

SEQ ID NO: 481545 - RNA, 17 nt, Chlamydia trachomatis
aaggguagaaaaagaga

SEQ ID NO: 481546 - RNA, 20 nt, Chlamydia trachomatis
aaggguagaaaaagagaaau

SEQ ID NO: 481547 - RNA, 15 nt, Chlamydia trachomatis
aaggguugcgcuggc

SEQ ID NO: 481548 - RNA, 14 nt, Chlamydia trachomatis
aagggugcacaagu

SEQ ID NO: 481549 - RNA, 17 nt, Chlamydia trachomatis
aaggguuuugaagcuug

SEQ ID NO: 481550 - RNA, 15 nt, Chlamydia trachomatis
aaggucugaacaacu

SEQ ID NO: 481551 - RNA, 16 nt, Chlamydia trachomatis
aaggugaguuucccuu

SEQ ID NO: 481552 - RNA, 20 nt, Chlamydia trachomatis
aaggugaguuucccuucguc

SEQ ID NO: 481553 - RNA, 23 nt, Chlamydia trachomatis
aagguagauccgauaucagcaaa

SEQ ID NO: 481554 - RNA, 18 nt, Chlamydia trachomatis
aagguauuuuagagaaaa

SEQ ID NO: 481555 - RNA, 22 nt, Chlamydia trachomatis
aagguauuuuagagaaaagaaa

SEQ ID NO: 481556 - RNA, 18 nt, Chlamydia trachomatis
aagguguguacgcuuugg

SEQ ID NO: 481557 - RNA, 19 nt, Chlamydia trachomatis
aagguguguucccagagaa

SEQ ID NO: 481558 - RNA, 17 nt, Chlamydia trachomatis
aagguuguuauguagau

SEQ ID NO: 481559 - RNA, 12 nt, Chlamydia trachomatis
aauaaaggaaac

SEQ ID NO: 481560 - RNA, 13 nt, Chlamydia trachomatis
aauaaaggaaaca

SEQ ID NO: 481561 - RNA, 13 nt, Chlamydia trachomatis
aauaaaccaaagg

SEQ ID NO: 481562 - RNA, 14 nt, Chlamydia trachomatis
aauaaaccaaaggc

SEQ ID NO: 481563 - RNA, 21 nt, Chlamydia trachomatis
aauaaacgcgauguaagguuu

SEQ ID NO: 481564 - RNA, 14 nt, Chlamydia trachomatis
aauaaauuagggaa

SEQ ID NO: 481565 - RNA, 18 nt, Chlamydia trachomatis
aauaacagcacaaacaaa

SEQ ID NO: 481566 - RNA, 16 nt, Chlamydia trachomatis
aaguuuuaacaugagu

SEQ ID NO: 481567 - RNA, 24 nt, Chlamydia trachomatis
aaguuuuacuauucgagaaugaau

SEQ ID NO: 481568 - RNA, 12 nt, Chlamydia trachomatis
aauaaaaagccc

SEQ ID NO: 481569 - RNA, 19 nt, Chlamydia trachomatis
aauaaaaagcccagaacaa

SEQ ID NO: 481570 - RNA, 14 nt, Chlamydia trachomatis
aauaaaaagcccuu

SEQ ID NO: 481571 - RNA, 23 nt, Chlamydia trachomatis
aauaaaaacuggagaauccauaa

SEQ ID NO: 481572 - RNA, 16 nt, Chlamydia trachomatis
aauaaaacgaaaaaca

SEQ ID NO: 481573 - RNA, 17 nt, Chlamydia trachomatis
aauaaaacgaaaaacag

SEQ ID NO: 481574 - RNA, 19 nt, Chlamydia trachomatis
aauaaaacgaaaaacagaa

SEQ ID NO: 481575 - RNA, 12 nt, Chlamydia trachomatis
aauaaaagcucc

SEQ ID NO: 481576 - RNA, 19 nt, Chlamydia trachomatis
aauaaaaguacuucuagau

SEQ ID NO: 481577 - RNA, 16 nt, Chlamydia trachomatis
aauaaaaucaaauaaa

SEQ ID NO: 481578 - RNA, 22 nt, Chlamydia trachomatis
aauaaacagaucuuuuucauuu

SEQ ID NO: 481579 - RNA, 16 nt, Chlamydia trachomatis
aauaaacagguaaaaa

SEQ ID NO: 481580 - RNA, 22 nt, Chlamydia trachomatis
aaguuccuuagcuaaaagcucu

SEQ ID NO: 481581 - RNA, 21 nt, Chlamydia trachomatis
aaguucguucaauuaaagaag

SEQ ID NO: 481582 - RNA, 14 nt, Chlamydia trachomatis
aaguucuccuucuu

SEQ ID NO: 481583 - RNA, 18 nt, Chlamydia trachomatis
aaguucuucuuccacaga

SEQ ID NO: 481584 - RNA, 21 nt, Chlamydia trachomatis
aaguucuucuuuagaaacuaa

SEQ ID NO: 481585 - RNA, 23 nt, Chlamydia trachomatis
aaguucuuuuuccucuucagaca

SEQ ID NO: 481586 - RNA, 12 nt, Chlamydia trachomatis
aaguuuccuuaa

SEQ ID NO: 481587 - RNA, 14 nt, Chlamydia trachomatis
aaguuucuaauaau

SEQ ID NO: 481588 - RNA, 19 nt, Chlamydia trachomatis
aaguaagaccgagauuauc

SEQ ID NO: 481589 - RNA, 12 nt, Chlamydia trachomatis
aaguaaccauuc

SEQ ID NO: 481590 - RNA, 19 nt, Chlamydia trachomatis
aaguaacuacggaaaaaga

SEQ ID NO: 481591 - RNA, 21 nt, Chlamydia trachomatis
aaguaacuacggaaaaagaag

SEQ ID NO: 481592 - RNA, 22 nt, Chlamydia trachomatis
aaguaacuacggaaaaagaaga

SEQ ID NO: 481593 - RNA, 17 nt, Chlamydia trachomatis
aaguaagcgaagaagga

SEQ ID NO: 481594 - RNA, 15 nt, Chlamydia trachomatis
aaguaaugaagguuu

SEQ ID NO: 481595 - RNA, 15 nt, Chlamydia trachomatis
aaguaaugacacugg

SEQ ID NO: 481596 - RNA, 19 nt, Chlamydia trachomatis
aagugcuaacgcuucuucu

SEQ ID NO: 481597 - RNA, 17 nt, Chlamydia trachomatis
aagugcuguaugccaag

SEQ ID NO: 481598 - RNA, 18 nt, Chlamydia trachomatis
aagugcuguaugccaaga

SEQ ID NO: 481599 - RNA, 23 nt, Chlamydia trachomatis
aauacgauccucuggauauacca

SEQ ID NO: 481600 - RNA, 15 nt, Chlamydia trachomatis
aauacgguauacacu

SEQ ID NO: 481601 - RNA, 20 nt, Chlamydia trachomatis
aauacgugcccaugagaaac

SEQ ID NO: 481602 - RNA, 20 nt, Chlamydia trachomatis
aauacucuuaucguagagau

SEQ ID NO: 481603 - RNA, 21 nt, Chlamydia trachomatis
aauacugacccauccaaaaca

SEQ ID NO: 481604 - RNA, 17 nt, Chlamydia trachomatis
aauacugggaaaucauu

SEQ ID NO: 481605 - RNA, 17 nt, Chlamydia trachomatis
aauacuuguccccuacu

SEQ ID NO: 481606 - RNA, 16 nt, Chlamydia trachomatis
aauagaaauuuucaua

SEQ ID NO: 481607 - RNA, 20 nt, Chlamydia trachomatis
aauagagaccgcucucuuuu

SEQ ID NO: 481608 - RNA, 20 nt, Chlamydia trachomatis
aauaaccugaagauuuuuua

SEQ ID NO: 481609 - RNA, 15 nt, Chlamydia trachomatis
aauaacgauaguaca

SEQ ID NO: 481610 - RNA, 16 nt, Chlamydia trachomatis
aauaacgauaguacaa

SEQ ID NO: 481611 - RNA, 21 nt, Chlamydia trachomatis
aauaacgauucuugauaaaua

SEQ ID NO: 481612 - RNA, 23 nt, Chlamydia trachomatis
aauaacgauucuugauaaauaau

SEQ ID NO: 481613 - RNA, 16 nt, Chlamydia trachomatis
aauaacgcccucuuuu

SEQ ID NO: 481614 - RNA, 17 nt, Chlamydia trachomatis
aauaacgcccucuuuuc

SEQ ID NO: 481615 - RNA, 17 nt, Chlamydia trachomatis
aauaacguagauaucuu

SEQ ID NO: 481616 - RNA, 13 nt, Chlamydia trachomatis
aauaacguuuuaa

SEQ ID NO: 481617 - RNA, 14 nt, Chlamydia trachomatis
aaaaauaauuuccu

SEQ ID NO: 481618 - RNA, 19 nt, Chlamydia trachomatis
aaaaauaccaaaaaacauu

SEQ ID NO: 481619 - RNA, 15 nt, Chlamydia trachomatis
aaaaaucagcuugau

SEQ ID NO: 481620 - RNA, 21 nt, Chlamydia trachomatis
aaaaaucagcuugauauuccc

SEQ ID NO: 481621 - RNA, 23 nt, Chlamydia trachomatis
aaaaauccaccguagaacaaucu

SEQ ID NO: 481622 - RNA, 19 nt, Chlamydia trachomatis
aauaaucgcucguuccuca

SEQ ID NO: 481623 - RNA, 22 nt, Chlamydia trachomatis
aauaaucgcucguuccucagcu

SEQ ID NO: 481624 - RNA, 18 nt, Chlamydia trachomatis
aauaauguuuuguaguuu

SEQ ID NO: 481625 - RNA, 12 nt, Chlamydia trachomatis
aauaauucaggc

SEQ ID NO: 481626 - RNA, 13 nt, Chlamydia trachomatis
aauaauucaggcu

SEQ ID NO: 481627 - RNA, 20 nt, Chlamydia trachomatis
aauaauucaggcucuuucag

SEQ ID NO: 481628 - RNA, 19 nt, Chlamydia trachomatis
aauacaaaccgaagaggga

SEQ ID NO: 481629 - RNA, 19 nt, Chlamydia trachomatis
aauacaaagcacgauaaaa

SEQ ID NO: 481630 - RNA, 15 nt, Chlamydia trachomatis
aaucacuuucugcuu

SEQ ID NO: 481631 - RNA, 14 nt, Chlamydia trachomatis
aaucacugaaucag

SEQ ID NO: 481632 - RNA, 21 nt, Chlamydia trachomatis
aaucacugagaggaguuuuuu

SEQ ID NO: 481633 - RNA, 17 nt, Chlamydia trachomatis
aaucacagaaacuucuu

SEQ ID NO: 481634 - RNA, 13 nt, Chlamydia trachomatis
aaucacagcaaua

SEQ ID NO: 481635 - RNA, 21 nt, Chlamydia trachomatis
aaucacacaagcugacaaagc

SEQ ID NO: 481636 - RNA, 22 nt, Chlamydia trachomatis
aaucaaaaaguucucucccuuc

SEQ ID NO: 481637 - RNA, 15 nt, Chlamydia trachomatis
aaucaaaccaaaaau

SEQ ID NO: 481638 - RNA, 17 nt, Chlamydia trachomatis
aaucaaaccaaaaauau

SEQ ID NO: 481639 - RNA, 16 nt, Chlamydia trachomatis
aaucaaagacuucacu

SEQ ID NO: 481640 - RNA, 17 nt, Chlamydia trachomatis
aaucaaaggaugucuau

SEQ ID NO: 481641 - RNA, 12 nt, Chlamydia trachomatis
aaucaaauaaag

SEQ ID NO: 481642 - RNA, 21 nt, Chlamydia trachomatis
aaucaauauccacuuuuagga

SEQ ID NO: 481643 - RNA, 14 nt, Chlamydia trachomatis
aaucaauuucuaga

SEQ ID NO: 481644 - RNA, 18 nt, Chlamydia trachomatis
aauauugcucuaaagucu

SEQ ID NO: 481645 - RNA, 23 nt, Chlamydia trachomatis
aauauugagaaauaaucaucuca

SEQ ID NO: 481646 - RNA, 17 nt, Chlamydia trachomatis
aauauugaucuccccau

SEQ ID NO: 481647 - RNA, 17 nt, Chlamydia trachomatis
aauauucgcaauauaga

SEQ ID NO: 481648 - RNA, 21 nt, Chlamydia trachomatis
aauauuuuaggcggcuuuucu

SEQ ID NO: 481649 - RNA, 19 nt, Chlamydia trachomatis
aauauuuuugggaaaaaau

SEQ ID NO: 481650 - RNA, 23 nt, Chlamydia trachomatis
aauauuuuuucccuuucauaaua

SEQ ID NO: 481651 - RNA, 14 nt, Chlamydia trachomatis
aauagcaggaacuu

SEQ ID NO: 481652 - RNA, 15 nt, Chlamydia trachomatis
aauagcaucucugua

SEQ ID NO: 481653 - RNA, 15 nt, Chlamydia trachomatis
aauagcauuucugcc

SEQ ID NO: 481654 - RNA, 21 nt, Chlamydia trachomatis
aauagccauuaacaacaaugu

SEQ ID NO: 481655 - RNA, 16 nt, Chlamydia trachomatis
aauauggacuucccua

SEQ ID NO: 481656 - RNA, 17 nt, Chlamydia trachomatis
aauaugguaauggcugu

SEQ ID NO: 481657 - RNA, 21 nt, Chlamydia trachomatis
aauauguugcgcgucuuguuu

SEQ ID NO: 481658 - RNA, 13 nt, Chlamydia trachomatis
aauauuaaaccac

SEQ ID NO: 481659 - RNA, 20 nt, Chlamydia trachomatis
aauccauucaagacaacuug

SEQ ID NO: 481660 - RNA, 21 nt, Chlamydia trachomatis
aauccauuccggcucucuuca

SEQ ID NO: 481661 - RNA, 17 nt, Chlamydia trachomatis
aauccauucgcauuaaa

SEQ ID NO: 481662 - RNA, 22 nt, Chlamydia trachomatis
aauccauucgcauuaaauaaua

SEQ ID NO: 481663 - RNA, 14 nt, Chlamydia trachomatis
aauccauugauucc

SEQ ID NO: 481664 - RNA, 22 nt, Chlamydia trachomatis
aauccauuuacgagguagccag

SEQ ID NO: 481665 - RNA, 21 nt, Chlamydia trachomatis
aaucccaaaaacaaucaaagc

SEQ ID NO: 481666 - RNA, 14 nt, Chlamydia trachomatis
aaucauuuucugua

SEQ ID NO: 481667 - RNA, 15 nt, Chlamydia trachomatis
aauccagaaagagcg

SEQ ID NO: 481668 - RNA, 16 nt, Chlamydia trachomatis
aauccagaaagagcga

SEQ ID NO: 481669 - RNA, 15 nt, Chlamydia trachomatis
aauccagaauuaauu

SEQ ID NO: 481670 - RNA, 13 nt, Chlamydia trachomatis
aaucaucugguau

SEQ ID NO: 481671 - RNA, 21 nt, Chlamydia trachomatis
aaucaucugguauucuaaaua

SEQ ID NO: 481672 - RNA, 22 nt, Chlamydia trachomatis
aaucaugaugaugagagcagcu

SEQ ID NO: 481673 - RNA, 14 nt, Chlamydia trachomatis
aauccgaagauuau

SEQ ID NO: 481674 - RNA, 18 nt, Chlamydia trachomatis
aauccuugcacuaagaau

SEQ ID NO: 481675 - RNA, 20 nt, Chlamydia trachomatis
aauccuaaaaaaaaccauuc

SEQ ID NO: 481676 - RNA, 13 nt, Chlamydia trachomatis
aauccuaauguag

SEQ ID NO: 481677 - RNA, 22 nt, Chlamydia trachomatis
aauccuauacccgacuaaaaaa

SEQ ID NO: 481678 - RNA, 23 nt, Chlamydia trachomatis
aauccuauacccgacuaaaaaau

SEQ ID NO: 481679 - RNA, 22 nt, Chlamydia trachomatis
aauccuguggucacaagaacau

SEQ ID NO: 481680 - RNA, 20 nt, Chlamydia trachomatis
aauccuuggcaagaagcugc

SEQ ID NO: 481681 - RNA, 15 nt, Chlamydia trachomatis
aaaaauugaaagaga

SEQ ID NO: 481682 - RNA, 14 nt, Chlamydia trachomatis
aaaaauugcaaaga

SEQ ID NO: 481683 - RNA, 21 nt, Chlamydia trachomatis
aaucgugcuaugcauuugcuc

SEQ ID NO: 481684 - RNA, 19 nt, Chlamydia trachomatis
aaucuauuuuauacuucuu

SEQ ID NO: 481685 - RNA, 16 nt, Chlamydia trachomatis
aaucucaaaguuuuug

SEQ ID NO: 481686 - RNA, 17 nt, Chlamydia trachomatis
aaucucaaaguuuuugu

SEQ ID NO: 481687 - RNA, 17 nt, Chlamydia trachomatis
aaucuccaaaauucugu

SEQ ID NO: 481688 - RNA, 12 nt, Chlamydia trachomatis
aaucucugaaag

SEQ ID NO: 481689 - RNA, 16 nt, Chlamydia trachomatis
aaucucugaaagagcu

SEQ ID NO: 481690 - RNA, 17 nt, Chlamydia trachomatis
aaucuguucagaacuca

SEQ ID NO: 481691 - RNA, 21 nt, Chlamydia trachomatis
aaucuguucagaacucaaaau

SEQ ID NO: 481692 - RNA, 23 nt, Chlamydia trachomatis
aaucugugcuugcauagauagau

SEQ ID NO: 481693 - RNA, 20 nt, Chlamydia trachomatis
aaucugucuaagauuuucau

SEQ ID NO: 481694 - RNA, 13 nt, Chlamydia trachomatis
aaucugguuuaau

SEQ ID NO: 481695 - RNA, 20 nt, Chlamydia trachomatis
aaucuguaauaaacccugga

SEQ ID NO: 481696 - RNA, 13 nt, Chlamydia trachomatis
aaucuguagggga

SEQ ID NO: 481697 - RNA, 18 nt, Chlamydia trachomatis
aaucuucacggagagaaa

SEQ ID NO: 481698 - RNA, 21 nt, Chlamydia trachomatis
aaucuucacggagagaaagag

SEQ ID NO: 481699 - RNA, 23 nt, Chlamydia trachomatis
aaucuucacggagagaaagaggg

SEQ ID NO: 481700 - RNA, 18 nt, Chlamydia trachomatis
aaucuucauaagaaaauu

SEQ ID NO: 481701 - RNA, 20 nt, Chlamydia trachomatis
aaucuucggcagaagcugca

SEQ ID NO: 481702 - RNA, 18 nt, Chlamydia trachomatis
aaucugcuuaucuccgcu

SEQ ID NO: 481703 - RNA, 22 nt, Chlamydia trachomatis
aaucuggcugaagaaguugauc

SEQ ID NO: 481704 - RNA, 12 nt, Chlamydia trachomatis
aaucugcuccua

SEQ ID NO: 481705 - RNA, 18 nt, Chlamydia trachomatis
aaucugcaacaaauacca

SEQ ID NO: 481706 - RNA, 21 nt, Chlamydia trachomatis
aaucugcaacaaauaccaaaa

SEQ ID NO: 481707 - RNA, 17 nt, Chlamydia trachomatis
aaucuucuuauacagca

SEQ ID NO: 481708 - RNA, 19 nt, Chlamydia trachomatis
aaucuucuucgaaaucuuc

SEQ ID NO: 481709 - RNA, 20 nt, Chlamydia trachomatis
aaucuucuucggaaagcacu

SEQ ID NO: 481710 - RNA, 21 nt, Chlamydia trachomatis
aaucuucuucggaaagcacuu

SEQ ID NO: 481711 - RNA, 21 nt, Chlamydia trachomatis
aaugauuugccccuuuuguac

SEQ ID NO: 481712 - RNA, 14 nt, Chlamydia trachomatis
aaugcaaauuugca

SEQ ID NO: 481713 - RNA, 13 nt, Chlamydia trachomatis
aaugcaaaacaua

SEQ ID NO: 481714 - RNA, 22 nt, Chlamydia trachomatis
aaugcaccucggauccagaagc

SEQ ID NO: 481715 - RNA, 14 nt, Chlamydia trachomatis
aaugcccaaagccg

SEQ ID NO: 481716 - RNA, 22 nt, Chlamydia trachomatis
aaugccuuuuguuuucaaaagc

SEQ ID NO: 481717 - RNA, 23 nt, Chlamydia trachomatis
aaugccuuuuguuuucaaaagcu

SEQ ID NO: 481718 - RNA, 19 nt, Chlamydia trachomatis
aaugcagaucauaucugca

SEQ ID NO: 481719 - RNA, 17 nt, Chlamydia trachomatis
aaugguuacuugccucu

SEQ ID NO: 481720 - RNA, 16 nt, Chlamydia trachomatis
aauggccgggaaaaag

SEQ ID NO: 481721 - RNA, 18 nt, Chlamydia trachomatis
aaugcggcccacacuacc

SEQ ID NO: 481722 - RNA, 15 nt, Chlamydia trachomatis
aaugcuguaaaacau

SEQ ID NO: 481723 - RNA, 15 nt, Chlamydia trachomatis
aaugcuguuucaggc

SEQ ID NO: 481724 - RNA, 14 nt, Chlamydia trachomatis
aaugcgcucccauu

SEQ ID NO: 481725 - RNA, 13 nt, Chlamydia trachomatis
aauggaaauaaaa

SEQ ID NO: 481726 - RNA, 18 nt, Chlamydia trachomatis
aauggaaauaaaaagccc

SEQ ID NO: 481727 - RNA, 20 nt, Chlamydia trachomatis
aauggaaauaaaaagcccag

SEQ ID NO: 481728 - RNA, 19 nt, Chlamydia trachomatis
aaugugauugacaacuuuc

SEQ ID NO: 481729 - RNA, 22 nt, Chlamydia trachomatis
aaugugauugacaacuuucuuu

SEQ ID NO: 481730 - RNA, 21 nt, Chlamydia trachomatis
aaugugugguuguagaggaga

SEQ ID NO: 481731 - RNA, 18 nt, Chlamydia trachomatis
aauguuaacaucuuccca

SEQ ID NO: 481732 - RNA, 21 nt, Chlamydia trachomatis
aauguuccucguuuuuuuaga

SEQ ID NO: 481733 - RNA, 16 nt, Chlamydia trachomatis
aaugucuccaggagag

SEQ ID NO: 481734 - RNA, 21 nt, Chlamydia trachomatis
aaugucuuuuucagcaggcga

SEQ ID NO: 481735 - RNA, 12 nt, Chlamydia trachomatis
aauguugaaguc

SEQ ID NO: 481736 - RNA, 14 nt, Chlamydia trachomatis
aauuaaaacaauag

SEQ ID NO: 481737 - RNA, 17 nt, Chlamydia trachomatis
aauuaaaacaauaguga

SEQ ID NO: 481738 - RNA, 14 nt, Chlamydia trachomatis
aauuaaagaaguug

SEQ ID NO: 481739 - RNA, 11 nt, Chlamydia trachomatis
aauuaaagaga

SEQ ID NO: 481740 - RNA, 13 nt, Chlamydia trachomatis
aauuaaaggcucu

SEQ ID NO: 481741 - RNA, 16 nt, Chlamydia trachomatis
aauuaaagguuuccca

SEQ ID NO: 481742 - RNA, 17 nt, Chlamydia trachomatis
aauuaaagguuucccaa

SEQ ID NO: 481743 - RNA, 17 nt, Chlamydia trachomatis
aauugucgaauuuuucu

SEQ ID NO: 481744 - RNA, 20 nt, Chlamydia trachomatis
aauugucgaauuuuucugcu

SEQ ID NO: 481745 - RNA, 23 nt, Chlamydia trachomatis
aauuguccaagcucgagucucuu

SEQ ID NO: 481746 - RNA, 19 nt, Chlamydia trachomatis
aauugugaauggagcagca

SEQ ID NO: 481747 - RNA, 22 nt, Chlamydia trachomatis
aauugugaauggagcagcauuc

SEQ ID NO: 481748 - RNA, 23 nt, Chlamydia trachomatis
aauuguacacgauguuccccauu

SEQ ID NO: 481749 - RNA, 14 nt, Chlamydia trachomatis
aauuguugagcagc

SEQ ID NO: 481750 - RNA, 14 nt, Chlamydia trachomatis
aauuguuggacaaa

SEQ ID NO: 481751 - RNA, 14 nt, Chlamydia trachomatis
aaaacaaacaauaa

SEQ ID NO: 481752 - RNA, 21 nt, Chlamydia trachomatis
aaaacaaccauaauacgaaua

SEQ ID NO: 481753 - RNA, 16 nt, Chlamydia trachomatis
aauuggagauugccuu

SEQ ID NO: 481754 - RNA, 15 nt, Chlamydia trachomatis
aauuggcguuccauu

SEQ ID NO: 481755 - RNA, 14 nt, Chlamydia trachomatis
aauuccaaugagga

SEQ ID NO: 481756 - RNA, 13 nt, Chlamydia trachomatis
aauuccaucuuuu

SEQ ID NO: 481757 - RNA, 15 nt, Chlamydia trachomatis
aauuccaucuuuucg

SEQ ID NO: 481758 - RNA, 22 nt, Chlamydia trachomatis
aauucuacuccugcaacaagaa

SEQ ID NO: 481759 - RNA, 23 nt, Chlamydia trachomatis
aauucuagcaaccgauucuucac

SEQ ID NO: 481760 - RNA, 23 nt, Chlamydia trachomatis
aauucuaucaacaucugugucau

SEQ ID NO: 481761 - RNA, 16 nt, Chlamydia trachomatis
aauuaucgccaaaaau

SEQ ID NO: 481762 - RNA, 14 nt, Chlamydia trachomatis
aauuaucuaaaaaa

SEQ ID NO: 481763 - RNA, 16 nt, Chlamydia trachomatis
aauucaggcucuuuca

SEQ ID NO: 481764 - RNA, 20 nt, Chlamydia trachomatis
acaaccaaaugaccuuuccc

SEQ ID NO: 481765 - RNA, 19 nt, Chlamydia trachomatis
acaaccaacucuccuuuaa

SEQ ID NO: 481766 - RNA, 17 nt, Chlamydia trachomatis
acaacacugacuauucc

SEQ ID NO: 481767 - RNA, 14 nt, Chlamydia trachomatis
acaaauuccucugu

SEQ ID NO: 481768 - RNA, 21 nt, Chlamydia trachomatis
acaaauauuuuugggaaaaaa

SEQ ID NO: 481769 - RNA, 18 nt, Chlamydia trachomatis
acaaaucuuucuuucuaa

SEQ ID NO: 481770 - RNA, 20 nt, Chlamydia trachomatis
acaaaucuuucuuucuaaga

SEQ ID NO: 481771 - RNA, 21 nt, Chlamydia trachomatis
acaaaguggcguuguuucuaa

SEQ ID NO: 481772 - RNA, 17 nt, Chlamydia trachomatis
acaaauaacagaaacgu

SEQ ID NO: 481773 - RNA, 16 nt, Chlamydia trachomatis
acaaauaccaaaauau

SEQ ID NO: 481774 - RNA, 21 nt, Chlamydia trachomatis
acaaauaguguaaggagagaa

SEQ ID NO: 481775 - RNA, 15 nt, Chlamydia trachomatis
acaaauauacucuuu

SEQ ID NO: 481776 - RNA, 14 nt, Chlamydia trachomatis
acaaagccccuacu

SEQ ID NO: 481777 - RNA, 17 nt, Chlamydia trachomatis
acaaagaucguaaaaua

SEQ ID NO: 481778 - RNA, 22 nt, Chlamydia trachomatis
acaaagcacgauaaaagacaga

SEQ ID NO: 481779 - RNA, 15 nt, Chlamydia trachomatis
acaaaggagcccaag

SEQ ID NO: 481780 - RNA, 16 nt, Chlamydia trachomatis
acaaaggagcccaagc

SEQ ID NO: 481781 - RNA, 12 nt, Chlamydia trachomatis
acaaaggaacau

SEQ ID NO: 481782 - RNA, 23 nt, Chlamydia trachomatis
acaaaggaacaucgagaaaauga

SEQ ID NO: 481783 - RNA, 20 nt, Chlamydia trachomatis
acaaacuuucucgauucucu

SEQ ID NO: 481784 - RNA, 12 nt, Chlamydia trachomatis
acaaagaaagcc

SEQ ID NO: 481785 - RNA, 20 nt, Chlamydia trachomatis
acaaagagaaggccuuuuuu

SEQ ID NO: 481786 - RNA, 17 nt, Chlamydia trachomatis
acaaagaguuuaccucu

SEQ ID NO: 481787 - RNA, 19 nt, Chlamydia trachomatis
acaaagaguuuaccucucc

SEQ ID NO: 481788 - RNA, 13 nt, Chlamydia trachomatis
acaaacaaauccu

SEQ ID NO: 481789 - RNA, 13 nt, Chlamydia trachomatis
acaaaccaauuaa

SEQ ID NO: 481790 - RNA, 16 nt, Chlamydia trachomatis
acaaaccagcucauca

SEQ ID NO: 481791 - RNA, 16 nt, Chlamydia trachomatis
acaaaccgaagaggga

SEQ ID NO: 481792 - RNA, 18 nt, Chlamydia trachomatis
acaaacgaagcugccgaa

SEQ ID NO: 481793 - RNA, 17 nt, Chlamydia trachomatis
acaaaaucagcaaaugu

SEQ ID NO: 481794 - RNA, 20 nt, Chlamydia trachomatis
acaaaaucagcaaaugugga

SEQ ID NO: 481795 - RNA, 17 nt, Chlamydia trachomatis
acaaaagauuucuucug

SEQ ID NO: 481796 - RNA, 22 nt, Chlamydia trachomatis
acaaaagcauugaacaccauau

SEQ ID NO: 481797 - RNA, 23 nt, Chlamydia trachomatis
acaaaacuugucuaaaagaauau

SEQ ID NO: 481798 - RNA, 10 nt, Chlamydia trachomatis
acaaaaaaga

SEQ ID NO: 481799 - RNA, 14 nt, Chlamydia trachomatis
acaaaaacucucaa

SEQ ID NO: 481800 - RNA, 21 nt, Chlamydia trachomatis
acaaaaagaaagccuucucuu

SEQ ID NO: 481801 - RNA, 12 nt, Chlamydia trachomatis
acaaaaagccua

SEQ ID NO: 481802 - RNA, 21 nt, Chlamydia trachomatis
acaaaaauacuucuuuuuguu

SEQ ID NO: 481803 - RNA, 20 nt, Chlamydia trachomatis
acaaaaauacuugauuuuuu

SEQ ID NO: 481804 - RNA, 14 nt, Chlamydia trachomatis
acaaaacaagccuu

SEQ ID NO: 481805 - RNA, 13 nt, Chlamydia trachomatis
acaaaaccaaaau

SEQ ID NO: 481806 - RNA, 15 nt, Chlamydia trachomatis
acaauuuuaaaaucu

SEQ ID NO: 481807 - RNA, 19 nt, Chlamydia trachomatis
acaauuuuaaaaucuccuc

SEQ ID NO: 481808 - RNA, 20 nt, Chlamydia trachomatis
acaauuuuaaaaucuccucg

SEQ ID NO: 481809 - RNA, 19 nt, Chlamydia trachomatis
acaaugccgcccaaggaaa

SEQ ID NO: 481810 - RNA, 23 nt, Chlamydia trachomatis
acaaugaccgaagguucuucuuc

SEQ ID NO: 481811 - RNA, 15 nt, Chlamydia trachomatis
acaaucaaagcacca

SEQ ID NO: 481812 - RNA, 16 nt, Chlamydia trachomatis
acaaucaaagcaccac

SEQ ID NO: 481813 - RNA, 20 nt, Chlamydia trachomatis
acaaucacacgaucauauuc

SEQ ID NO: 481814 - RNA, 20 nt, Chlamydia trachomatis
acaauccgaagauuauacca

SEQ ID NO: 481815 - RNA, 16 nt, Chlamydia trachomatis
acaaucgagccaagcu

SEQ ID NO: 481816 - RNA, 12 nt, Chlamydia trachomatis
acaaucggaaau

SEQ ID NO: 481817 - RNA, 16 nt, Chlamydia trachomatis
acaaguuuauggaaaa

SEQ ID NO: 481818 - RNA, 21 nt, Chlamydia trachomatis
acaauaauucaggcucuuuca

SEQ ID NO: 481819 - RNA, 22 nt, Chlamydia trachomatis
acaauauuaucuacagugaaac

SEQ ID NO: 481820 - RNA, 17 nt, Chlamydia trachomatis
acaauauucuuuuccau

SEQ ID NO: 481821 - RNA, 23 nt, Chlamydia trachomatis
acaaccuucccuuccaaguuuug

SEQ ID NO: 481822 - RNA, 14 nt, Chlamydia trachomatis
acaaccuugguaau

SEQ ID NO: 481823 - RNA, 17 nt, Chlamydia trachomatis
acaagcucgucuuuaga

SEQ ID NO: 481824 - RNA, 20 nt, Chlamydia trachomatis
acaagcgacuccaacacgaa

SEQ ID NO: 481825 - RNA, 14 nt, Chlamydia trachomatis
acaaggauuuucuu

SEQ ID NO: 481826 - RNA, 20 nt, Chlamydia trachomatis
acaagguucuucaacaacuu

SEQ ID NO: 481827 - RNA, 19 nt, Chlamydia trachomatis
acacaacucuuuuccuaaa

SEQ ID NO: 481828 - RNA, 21 nt, Chlamydia trachomatis
acacaacuucugcuaaaaaug

SEQ ID NO: 481829 - RNA, 12 nt, Chlamydia trachomatis
acacaagcagac

SEQ ID NO: 481830 - RNA, 15 nt, Chlamydia trachomatis
acacaagcugacaaa

SEQ ID NO: 481831 - RNA, 17 nt, Chlamydia trachomatis
acaccgcaucagcccca

SEQ ID NO: 481832 - RNA, 15 nt, Chlamydia trachomatis
acacgauguucccca

SEQ ID NO: 481833 - RNA, 20 nt, Chlamydia trachomatis
acacgauuaucuaaagccau

SEQ ID NO: 481834 - RNA, 18 nt, Chlamydia trachomatis
acacgcucaggcuaucac

SEQ ID NO: 481835 - RNA, 18 nt, Chlamydia trachomatis
acagcaagcuugucuccu

SEQ ID NO: 481836 - RNA, 14 nt, Chlamydia trachomatis
acagcaagaagaag

SEQ ID NO: 481837 - RNA, 15 nt, Chlamydia trachomatis
acagcaagaagaaga

SEQ ID NO: 481838 - RNA, 18 nt, Chlamydia trachomatis
acagcaagaagaagagag

SEQ ID NO: 481839 - RNA, 18 nt, Chlamydia trachomatis
acagcacaaacaaauccu

SEQ ID NO: 481840 - RNA, 21 nt, Chlamydia trachomatis
acacgucguuaggccauuuca

SEQ ID NO: 481841 - RNA, 13 nt, Chlamydia trachomatis
acagcaaaaccuu

SEQ ID NO: 481842 - RNA, 19 nt, Chlamydia trachomatis
acagcaaaaccuuuugaaa

SEQ ID NO: 481843 - RNA, 15 nt, Chlamydia trachomatis
acagcaaauaaagag

SEQ ID NO: 481844 - RNA, 16 nt, Chlamydia trachomatis
acagcaaauaaagagg

SEQ ID NO: 481845 - RNA, 17 nt, Chlamydia trachomatis
acagcaaauaaagaggu

SEQ ID NO: 481846 - RNA, 19 nt, Chlamydia trachomatis
acagccaagcaagauauaa

SEQ ID NO: 481847 - RNA, 18 nt, Chlamydia trachomatis
acagccauaucaggaccu

SEQ ID NO: 481848 - RNA, 15 nt, Chlamydia trachomatis
acagggaaaaacagg

SEQ ID NO: 481849 - RNA, 16 nt, Chlamydia trachomatis
acaggcugugauggaa

SEQ ID NO: 481850 - RNA, 21 nt, Chlamydia trachomatis
acaggccgucaauaucuaggu

SEQ ID NO: 481851 - RNA, 19 nt, Chlamydia trachomatis
acagcuuucacagggacau

SEQ ID NO: 481852 - RNA, 20 nt, Chlamydia trachomatis
acagcuucuucuucucuuuc

SEQ ID NO: 481853 - RNA, 22 nt, Chlamydia trachomatis
acagcucgccggaaaccuguuu

SEQ ID NO: 481854 - RNA, 15 nt, Chlamydia trachomatis
acagcguuuuccccu

SEQ ID NO: 481855 - RNA, 22 nt, Chlamydia trachomatis
acagcgaagaaccgaauuugua

SEQ ID NO: 481856 - RNA, 16 nt, Chlamydia trachomatis
acaggggaccaaaaaa

SEQ ID NO: 481857 - RNA, 17 nt, Chlamydia trachomatis
acaggugaauucuccag

SEQ ID NO: 481858 - RNA, 14 nt, Chlamydia trachomatis
acaggucauaucca

SEQ ID NO: 481859 - RNA, 20 nt, Chlamydia trachomatis
acaggucaagccuacagcua

SEQ ID NO: 481860 - RNA, 13 nt, Chlamydia trachomatis
acagguuucauga

SEQ ID NO: 481861 - RNA, 15 nt, Chlamydia trachomatis
acaguaggucguuga

SEQ ID NO: 481862 - RNA, 18 nt, Chlamydia trachomatis
acaguaggucguugauaa

SEQ ID NO: 481863 - RNA, 15 nt, Chlamydia trachomatis
acaguaucugcuagu

SEQ ID NO: 481864 - RNA, 17 nt, Chlamydia trachomatis
acagucccguaacgcau

SEQ ID NO: 481865 - RNA, 16 nt, Chlamydia trachomatis
acagucuguccagggg

SEQ ID NO: 481866 - RNA, 16 nt, Chlamydia trachomatis
acagucuguguuugca

SEQ ID NO: 481867 - RNA, 19 nt, Chlamydia trachomatis
acaguucuuuauaacucuc

SEQ ID NO: 481868 - RNA, 19 nt, Chlamydia trachomatis
acauaacaaggcuuuucca

SEQ ID NO: 481869 - RNA, 18 nt, Chlamydia trachomatis
acauaacacauaucucca

SEQ ID NO: 481870 - RNA, 17 nt, Chlamydia trachomatis
acauaacacccuguaaa

SEQ ID NO: 481871 - RNA, 17 nt, Chlamydia trachomatis
accaaaagagcgcaacc

SEQ ID NO: 481872 - RNA, 14 nt, Chlamydia trachomatis
accaaaaaugaaca

SEQ ID NO: 481873 - RNA, 14 nt, Chlamydia trachomatis
accaaaaauuuuuu

SEQ ID NO: 481874 - RNA, 14 nt, Chlamydia trachomatis
accaaaaaauccac

SEQ ID NO: 481875 - RNA, 15 nt, Chlamydia trachomatis
accaaaaacaacaau

SEQ ID NO: 481876 - RNA, 16 nt, Chlamydia trachomatis
accaaagcauuuuuaa

SEQ ID NO: 481877 - RNA, 16 nt, Chlamydia trachomatis
accaaaugaccuuucc

SEQ ID NO: 481878 - RNA, 19 nt, Chlamydia trachomatis
accaaaugaccuuucccuc

SEQ ID NO: 481879 - RNA, 14 nt, Chlamydia trachomatis
accaacaagagcca

SEQ ID NO: 481880 - RNA, 17 nt, Chlamydia trachomatis
acauugcaguacaucug

SEQ ID NO: 481881 - RNA, 18 nt, Chlamydia trachomatis
acauugcaguacaucugu

SEQ ID NO: 481882 - RNA, 21 nt, Chlamydia trachomatis
acauuaguggugaguagcaaa

SEQ ID NO: 481883 - RNA, 18 nt, Chlamydia trachomatis
acauuugcgcaacguuuc

SEQ ID NO: 481884 - RNA, 16 nt, Chlamydia trachomatis
acaucacuauaaguca

SEQ ID NO: 481885 - RNA, 22 nt, Chlamydia trachomatis
acaucacuauaagucaaaagaa

SEQ ID NO: 481886 - RNA, 15 nt, Chlamydia trachomatis
acauaagcaaauccu

SEQ ID NO: 481887 - RNA, 17 nt, Chlamydia trachomatis
acauaacuaucccuacu

SEQ ID NO: 481888 - RNA, 18 nt, Chlamydia trachomatis
acaucaacugauucguuu

SEQ ID NO: 481889 - RNA, 20 nt, Chlamydia trachomatis
acauccgcuucuucauguuc

SEQ ID NO: 481890 - RNA, 13 nt, Chlamydia trachomatis
acauccguuucua

SEQ ID NO: 481891 - RNA, 22 nt, Chlamydia trachomatis
acauccuacaacgaguugaucu

SEQ ID NO: 481892 - RNA, 16 nt, Chlamydia trachomatis
acaucucggucuuaga

SEQ ID NO: 481893 - RNA, 23 nt, Chlamydia trachomatis
acaucuaaagucugaauauaccc

SEQ ID NO: 481894 - RNA, 13 nt, Chlamydia trachomatis
acaucuaacagaa

SEQ ID NO: 481895 - RNA, 17 nt, Chlamydia trachomatis
acaucuacgaguuucuc

SEQ ID NO: 481896 - RNA, 19 nt, Chlamydia trachomatis
acaucuauugagaagacuu

SEQ ID NO: 481897 - RNA, 20 nt, Chlamydia trachomatis
accagacuauuucuucuaga

SEQ ID NO: 481898 - RNA, 15 nt, Chlamydia trachomatis
accagaauauaagca

SEQ ID NO: 481899 - RNA, 22 nt, Chlamydia trachomatis
accaacuugcaacucuuauaac

SEQ ID NO: 481900 - RNA, 15 nt, Chlamydia trachomatis
accagagauaaagcu

SEQ ID NO: 481901 - RNA, 20 nt, Chlamydia trachomatis
accagcgcuuucuaaagcag

SEQ ID NO: 481902 - RNA, 12 nt, Chlamydia trachomatis
accaggagcgcc

SEQ ID NO: 481903 - RNA, 17 nt, Chlamydia trachomatis
accaggucacauuuucc

SEQ ID NO: 481904 - RNA, 14 nt, Chlamydia trachomatis
accauaggaucugg

SEQ ID NO: 481905 - RNA, 16 nt, Chlamydia trachomatis
accauaggaucuggaa

SEQ ID NO: 481906 - RNA, 12 nt, Chlamydia trachomatis
accauccuucug

SEQ ID NO: 481907 - RNA, 22 nt, Chlamydia trachomatis
accaguuucuucuacaaguucu

SEQ ID NO: 481908 - RNA, 14 nt, Chlamydia trachomatis
accaguuugucuua

SEQ ID NO: 481909 - RNA, 18 nt, Chlamydia trachomatis
acccauuugccauauccu

SEQ ID NO: 481910 - RNA, 19 nt, Chlamydia trachomatis
accccuccuccacuuacuc

SEQ ID NO: 481911 - RNA, 20 nt, Chlamydia trachomatis
accccuaaaggaaguagaga

SEQ ID NO: 481912 - RNA, 19 nt, Chlamydia trachomatis
acccgauucaaaaaucgcu

SEQ ID NO: 481913 - RNA, 20 nt, Chlamydia trachomatis
acccauaagauauugccaaa

SEQ ID NO: 481914 - RNA, 16 nt, Chlamydia trachomatis
acccaggcuuuucuuu

SEQ ID NO: 481915 - RNA, 15 nt, Chlamydia trachomatis
acccacgaaaagacu

SEQ ID NO: 481916 - RNA, 18 nt, Chlamydia trachomatis
acccgguauauguauacc

SEQ ID NO: 481917 - RNA, 15 nt, Chlamydia trachomatis
acccuggaugcacau

SEQ ID NO: 481918 - RNA, 14 nt, Chlamydia trachomatis
acccuuuuuauaau

SEQ ID NO: 481919 - RNA, 22 nt, Chlamydia trachomatis
acccuuuguaguuagacaaaaa

SEQ ID NO: 481920 - RNA, 17 nt, Chlamydia trachomatis
acccuuuuaauccagcu

SEQ ID NO: 481921 - RNA, 17 nt, Chlamydia trachomatis
accgaagguucuucuuc

SEQ ID NO: 481922 - RNA, 16 nt, Chlamydia trachomatis
accgacuucaacuucu

SEQ ID NO: 481923 - RNA, 20 nt, Chlamydia trachomatis
accgauaccaauaaugacac

SEQ ID NO: 481924 - RNA, 15 nt, Chlamydia trachomatis
accggaacaaucacg

SEQ ID NO: 481925 - RNA, 17 nt, Chlamydia trachomatis
accgggagcauggucuc

SEQ ID NO: 481926 - RNA, 13 nt, Chlamydia trachomatis
accguagaacaau

SEQ ID NO: 481927 - RNA, 14 nt, Chlamydia trachomatis
accguagaauuucu

SEQ ID NO: 481928 - RNA, 19 nt, Chlamydia trachomatis
accguagaauuucuucuuu

SEQ ID NO: 481929 - RNA, 17 nt, Chlamydia trachomatis
accguauuaucugcaac

SEQ ID NO: 481930 - RNA, 12 nt, Chlamydia trachomatis
accgugcagagg

SEQ ID NO: 481931 - RNA, 20 nt, Chlamydia trachomatis
accguuacaggauagccaaa

SEQ ID NO: 481932 - RNA, 13 nt, Chlamydia trachomatis
accguuccaucuu

SEQ ID NO: 481933 - RNA, 17 nt, Chlamydia trachomatis
accguucgacaacgaua

SEQ ID NO: 481934 - RNA, 13 nt, Chlamydia trachomatis
accuaaauucaua

SEQ ID NO: 481935 - RNA, 22 nt, Chlamydia trachomatis
accuaaguagcaaauuaacaga

SEQ ID NO: 481936 - RNA, 20 nt, Chlamydia trachomatis
accuaagcgcaagaaacuga

SEQ ID NO: 481937 - RNA, 21 nt, Chlamydia trachomatis
accuaagcgcaagaaacugaa

SEQ ID NO: 481938 - RNA, 15 nt, Chlamydia trachomatis
accuaauagaaauag

SEQ ID NO: 481939 - RNA, 12 nt, Chlamydia trachomatis
accuaauaugca

SEQ ID NO: 481940 - RNA, 13 nt, Chlamydia trachomatis
accuaauaugcag

SEQ ID NO: 481941 - RNA, 14 nt, Chlamydia trachomatis
accuaauuccccaa

SEQ ID NO: 481942 - RNA, 17 nt, Chlamydia trachomatis
accuaauuccccaauga

SEQ ID NO: 481943 - RNA, 19 nt, Chlamydia trachomatis
accuacaaagauaaucaaa

SEQ ID NO: 481944 - RNA, 23 nt, Chlamydia trachomatis
accugcaagagaucguacaauga

SEQ ID NO: 481945 - RNA, 14 nt, Chlamydia trachomatis
accugcauagcuga

SEQ ID NO: 481946 - RNA, 18 nt, Chlamydia trachomatis
accuggaaaggagaaagu

SEQ ID NO: 481947 - RNA, 11 nt, Chlamydia trachomatis
accugcuucag

SEQ ID NO: 481948 - RNA, 17 nt, Chlamydia trachomatis
accuucuuacauaagau

SEQ ID NO: 481949 - RNA, 17 nt, Chlamydia trachomatis
accuugggaaucuucuu

SEQ ID NO: 481950 - RNA, 13 nt, Chlamydia trachomatis
accugugaagaaa

SEQ ID NO: 481951 - RNA, 16 nt, Chlamydia trachomatis
accugugaagaaacuu

SEQ ID NO: 481952 - RNA, 21 nt, Chlamydia trachomatis
accuguaggaggacaagcgac

SEQ ID NO: 481953 - RNA, 18 nt, Chlamydia trachomatis
acgaauuucugggaaaau

SEQ ID NO: 481954 - RNA, 21 nt, Chlamydia trachomatis
acgaauuucugggaaaauuaa

SEQ ID NO: 481955 - RNA, 12 nt, Chlamydia trachomatis
accuuuucuccg

SEQ ID NO: 481956 - RNA, 18 nt, Chlamydia trachomatis
acgaaucgcaccauuuaa

SEQ ID NO: 481957 - RNA, 18 nt, Chlamydia trachomatis
acgaaucgccuauagaag

SEQ ID NO: 481958 - RNA, 20 nt, Chlamydia trachomatis
acgagaucugcaucuuuaua

SEQ ID NO: 481959 - RNA, 23 nt, Chlamydia trachomatis
acgagcauaagaauaaacaacau

SEQ ID NO: 481960 - RNA, 17 nt, Chlamydia trachomatis
acgagugccgaauaaug

SEQ ID NO: 481961 - RNA, 22 nt, Chlamydia trachomatis
acgaguugaucuuccucuugaa

SEQ ID NO: 481962 - RNA, 16 nt, Chlamydia trachomatis
acgaguuuuaggauua

SEQ ID NO: 481963 - RNA, 13 nt, Chlamydia trachomatis
acgauaaacagau

SEQ ID NO: 481964 - RNA, 15 nt, Chlamydia trachomatis
acgauaaccaguacc

SEQ ID NO: 481965 - RNA, 20 nt, Chlamydia trachomatis
acgauagcuaaucuuuuuga

SEQ ID NO: 481966 - RNA, 14 nt, Chlamydia trachomatis
acgauauaaagaag

SEQ ID NO: 481967 - RNA, 15 nt, Chlamydia trachomatis
acgauauaaagaaga

SEQ ID NO: 481968 - RNA, 21 nt, Chlamydia trachomatis
acgauauccaucauaaaaaga

SEQ ID NO: 481969 - RNA, 19 nt, Chlamydia trachomatis
acgccuguuaguauaugcu

SEQ ID NO: 481970 - RNA, 15 nt, Chlamydia trachomatis
acgccugaucaaauc

SEQ ID NO: 481971 - RNA, 14 nt, Chlamydia trachomatis
acgcgauauccuuu

SEQ ID NO: 481972 - RNA, 20 nt, Chlamydia trachomatis
acgcuccaaauaaaacgaaa

SEQ ID NO: 481973 - RNA, 15 nt, Chlamydia trachomatis
acggcauaggcguga

SEQ ID NO: 481974 - RNA, 22 nt, Chlamydia trachomatis
acgguagcgauuuucugaaguu

SEQ ID NO: 481975 - RNA, 22 nt, Chlamydia trachomatis
acguauacgagggagcagcuuu

SEQ ID NO: 481976 - RNA, 18 nt, Chlamydia trachomatis
acgguguuagaaaauacg

SEQ ID NO: 481977 - RNA, 18 nt, Chlamydia trachomatis
acguccgcuccuucuuuc

SEQ ID NO: 481978 - RNA, 23 nt, Chlamydia trachomatis
acguccuccugauuccugcugau

SEQ ID NO: 481979 - RNA, 14 nt, Chlamydia trachomatis
acgucgaaaagcuu

SEQ ID NO: 481980 - RNA, 20 nt, Chlamydia trachomatis
acgucugaaacuagucucuu

SEQ ID NO: 481981 - RNA, 17 nt, Chlamydia trachomatis
acgugagguacagcgaa

SEQ ID NO: 481982 - RNA, 18 nt, Chlamydia trachomatis
acguuccuccuccaggaa

SEQ ID NO: 481983 - RNA, 16 nt, Chlamydia trachomatis
acguuccagucuuaac

SEQ ID NO: 481984 - RNA, 22 nt, Chlamydia trachomatis
acuacgcuaucgguaaugccuu

SEQ ID NO: 481985 - RNA, 15 nt, Chlamydia trachomatis
acuacugggucuuuu

SEQ ID NO: 481986 - RNA, 19 nt, Chlamydia trachomatis
acuacugggucuuuuuuau

SEQ ID NO: 481987 - RNA, 18 nt, Chlamydia trachomatis
acuacugucagaccuaca

SEQ ID NO: 481988 - RNA, 21 nt, Chlamydia trachomatis
acuagcuguaaauguucauga

SEQ ID NO: 481989 - RNA, 12 nt, Chlamydia trachomatis
acuaucccuacu

SEQ ID NO: 481990 - RNA, 15 nt, Chlamydia trachomatis
acuaucccuacugaa

SEQ ID NO: 481991 - RNA, 17 nt, Chlamydia trachomatis
acuaucccuacugaagu

SEQ ID NO: 481992 - RNA, 12 nt, Chlamydia trachomatis
acuaucugcaaa

SEQ ID NO: 481993 - RNA, 18 nt, Chlamydia trachomatis
acuaugaacaaacagcug

SEQ ID NO: 481994 - RNA, 20 nt, Chlamydia trachomatis
acuaugcucacaaaccaaaa

SEQ ID NO: 481995 - RNA, 16 nt, Chlamydia trachomatis
acucaaaauaaagaaa

SEQ ID NO: 481996 - RNA, 20 nt, Chlamydia trachomatis
acucaaacugugaagaauga

SEQ ID NO: 481997 - RNA, 21 nt, Chlamydia trachomatis
acucaaauuucucuaggaaca

SEQ ID NO: 481998 - RNA, 22 nt, Chlamydia trachomatis
acucaacgaaagcauccccaaa

SEQ ID NO: 481999 - RNA, 22 nt, Chlamydia trachomatis
acucaagggcguuauauuggaa

SEQ ID NO: 482000 - RNA, 20 nt, Chlamydia trachomatis
acucaucuucggacauugaa

SEQ ID NO: 482001 - RNA, 18 nt, Chlamydia trachomatis
acucauccuagcagcuaa

SEQ ID NO: 482002 - RNA, 13 nt, Chlamydia trachomatis
acucaucuuuuuu

SEQ ID NO: 482003 - RNA, 20 nt, Chlamydia trachomatis
acuccaacacgaaugccugu

SEQ ID NO: 482004 - RNA, 13 nt, Chlamydia trachomatis
acuccaagaagag

SEQ ID NO: 482005 - RNA, 15 nt, Chlamydia trachomatis
acuccaagaagaguc

SEQ ID NO: 482006 - RNA, 21 nt, Chlamydia trachomatis
acuccaauauauggacaagca

SEQ ID NO: 482007 - RNA, 19 nt, Chlamydia trachomatis
acucagagauauaagagaa

SEQ ID NO: 482008 - RNA, 20 nt, Chlamydia trachomatis
acucagguuauccaaauaaa

SEQ ID NO: 482009 - RNA, 15 nt, Chlamydia trachomatis
acucccuccaaaaaa

SEQ ID NO: 482010 - RNA, 16 nt, Chlamydia trachomatis
acuccgaucaauucau

SEQ ID NO: 482011 - RNA, 20 nt, Chlamydia trachomatis
acuccgaucaauucaucuac

SEQ ID NO: 482012 - RNA, 16 nt, Chlamydia trachomatis
acuccauaaaaagcca

SEQ ID NO: 482013 - RNA, 15 nt, Chlamydia trachomatis
acuccagagcaaaua

SEQ ID NO: 482014 - RNA, 22 nt, Chlamydia trachomatis
acuccagagcaaauagaauaaa

SEQ ID NO: 482015 - RNA, 21 nt, Chlamydia trachomatis
acucgauccaucauagaagca

SEQ ID NO: 482016 - RNA, 16 nt, Chlamydia trachomatis
acucgcgcuucucuug

SEQ ID NO: 482017 - RNA, 20 nt, Chlamydia trachomatis
acucgcacacgauuaucuaa

SEQ ID NO: 482018 - RNA, 21 nt, Chlamydia trachomatis
acucgcacacgauuaucuaaa

SEQ ID NO: 482019 - RNA, 20 nt, Chlamydia trachomatis
acucgcaucauccuugccca

SEQ ID NO: 482020 - RNA, 18 nt, Chlamydia trachomatis
acugagacgaauaagcau

SEQ ID NO: 482021 - RNA, 21 nt, Chlamydia trachomatis
acugaagguaacgaguacaga

SEQ ID NO: 482022 - RNA, 21 nt, Chlamydia trachomatis
acucucauaagaauacaaagc

SEQ ID NO: 482023 - RNA, 23 nt, Chlamydia trachomatis
acucucauaagaauacaaagcag

SEQ ID NO: 482024 - RNA, 22 nt, Chlamydia trachomatis
acucucaaaucguucuaccaga

SEQ ID NO: 482025 - RNA, 22 nt, Chlamydia trachomatis
acucucaacgaaagcuaagauu

SEQ ID NO: 482026 - RNA, 17 nt, Chlamydia trachomatis
acugcguauuugaaauc

SEQ ID NO: 482027 - RNA, 14 nt, Chlamydia trachomatis
acugcagcaucuau

SEQ ID NO: 482028 - RNA, 18 nt, Chlamydia trachomatis
acugcaguugaucauuga

SEQ ID NO: 482029 - RNA, 14 nt, Chlamydia trachomatis
acugggauaagaaa

SEQ ID NO: 482030 - RNA, 18 nt, Chlamydia trachomatis
acugggucuuuuuuauga

SEQ ID NO: 482031 - RNA, 16 nt, Chlamydia trachomatis
acugguaaaggaaguu

SEQ ID NO: 482032 - RNA, 22 nt, Chlamydia trachomatis
acugguuccccaagggggguua

SEQ ID NO: 482033 - RNA, 21 nt, Chlamydia trachomatis
acugguucucuuuauccuguu

SEQ ID NO: 482034 - RNA, 22 nt, Chlamydia trachomatis
acugcuucccuccuagaaagaa

SEQ ID NO: 482035 - RNA, 16 nt, Chlamydia trachomatis
acugcuuccgaaagca

SEQ ID NO: 482036 - RNA, 19 nt, Chlamydia trachomatis
acugcuuuccuuaguuuua

SEQ ID NO: 482037 - RNA, 20 nt, Chlamydia trachomatis
acugucgaacgcuucuuccc

SEQ ID NO: 482038 - RNA, 21 nt, Chlamydia trachomatis
acugucgaacgcuucuuccca

SEQ ID NO: 482039 - RNA, 22 nt, Chlamydia trachomatis
acuguagaugcuuuguaaaaua

SEQ ID NO: 482040 - RNA, 19 nt, Chlamydia trachomatis
acuuaaaaaacaaaacuac

SEQ ID NO: 482041 - RNA, 21 nt, Chlamydia trachomatis
acuuaauaagggcuuuugcaa

SEQ ID NO: 482042 - RNA, 22 nt, Chlamydia trachomatis
acuuaauaagggcuuuugcaaa

SEQ ID NO: 482043 - RNA, 23 nt, Chlamydia trachomatis
acuuaauaagggcuuuugcaaac

SEQ ID NO: 482044 - RNA, 15 nt, Chlamydia trachomatis
acuugcguuuucuug

SEQ ID NO: 482045 - RNA, 14 nt, Chlamydia trachomatis
acuugcuccacaca

SEQ ID NO: 482046 - RNA, 21 nt, Chlamydia trachomatis
acuugcaggagauaauuuucu

SEQ ID NO: 482047 - RNA, 13 nt, Chlamydia trachomatis
acuugucuaaaag

SEQ ID NO: 482048 - RNA, 15 nt, Chlamydia trachomatis
acuugucuaaaagaa

SEQ ID NO: 482049 - RNA, 13 nt, Chlamydia trachomatis
acuuguucugcug

SEQ ID NO: 482050 - RNA, 23 nt, Chlamydia trachomatis
acuuuagauuuguuuaaaagaag

SEQ ID NO: 482051 - RNA, 14 nt, Chlamydia trachomatis
acuuuaggagaaag

SEQ ID NO: 482052 - RNA, 16 nt, Chlamydia trachomatis
acuuuaggagaaagaa

SEQ ID NO: 482053 - RNA, 14 nt, Chlamydia trachomatis
acuuuauuauugaa

SEQ ID NO: 482054 - RNA, 15 nt, Chlamydia trachomatis
acuuuauuauugaaa

SEQ ID NO: 482055 - RNA, 13 nt, Chlamydia trachomatis
agaaaaaaacagc

SEQ ID NO: 482056 - RNA, 20 nt, Chlamydia trachomatis
agaaaauacggaagagucug

SEQ ID NO: 482057 - RNA, 20 nt, Chlamydia trachomatis
agaaaaugaugaaaaagaag

SEQ ID NO: 482058 - RNA, 14 nt, Chlamydia trachomatis
agaaacaacaaaga

SEQ ID NO: 482059 - RNA, 15 nt, Chlamydia trachomatis
agaaacaacaaagaa

SEQ ID NO: 482060 - RNA, 14 nt, Chlamydia trachomatis
acuuuucaauuaca

SEQ ID NO: 482061 - RNA, 17 nt, Chlamydia trachomatis
acuuuucagcaagaaca

SEQ ID NO: 482062 - RNA, 18 nt, Chlamydia trachomatis
acuuuucagcuuuucuuu

SEQ ID NO: 482063 - RNA, 19 nt, Chlamydia trachomatis
acuuuucugcagagcacaa

SEQ ID NO: 482064 - RNA, 13 nt, Chlamydia trachomatis
acuuuucuuccuc

SEQ ID NO: 482065 - RNA, 20 nt, Chlamydia trachomatis
acuuuugaucccuaauauga

SEQ ID NO: 482066 - RNA, 21 nt, Chlamydia trachomatis
acuuuccucugguacucaucu

SEQ ID NO: 482067 - RNA, 14 nt, Chlamydia trachomatis
acuuuccgaaauaa

SEQ ID NO: 482068 - RNA, 17 nt, Chlamydia trachomatis
acuuucccugcaacauu

SEQ ID NO: 482069 - RNA, 20 nt, Chlamydia trachomatis
acuuucccugcaacauuucc

SEQ ID NO: 482070 - RNA, 19 nt, Chlamydia trachomatis
acuuucucgauucucuugc

SEQ ID NO: 482071 - RNA, 16 nt, Chlamydia trachomatis
acuuucucuucaagau

SEQ ID NO: 482072 - RNA, 22 nt, Chlamydia trachomatis
acuuucucuucaagaucaaagu

SEQ ID NO: 482073 - RNA, 12 nt, Chlamydia trachomatis
acuuugaaaugu

SEQ ID NO: 482074 - RNA, 13 nt, Chlamydia trachomatis
acuuugaaauguc

SEQ ID NO: 482075 - RNA, 14 nt, Chlamydia trachomatis
acuuugacaagcag

SEQ ID NO: 482076 - RNA, 14 nt, Chlamydia trachomatis
acuuuguauuaacg

SEQ ID NO: 482077 - RNA, 15 nt, Chlamydia trachomatis
acuuuguuauuuuuu

SEQ ID NO: 482078 - RNA, 15 nt, Chlamydia trachomatis
agaacggcaauaaag

SEQ ID NO: 482079 - RNA, 18 nt, Chlamydia trachomatis
agaacggcaauaaagaaa

SEQ ID NO: 482080 - RNA, 18 nt, Chlamydia trachomatis
agaacggcuguuguccuu

SEQ ID NO: 482081 - RNA, 24 nt, Chlamydia trachomatis
agaacguacuuuaggagaaagaau

SEQ ID NO: 482082 - RNA, 10 nt, Chlamydia trachomatis
agaagaagag

SEQ ID NO: 482083 - RNA, 11 nt, Chlamydia trachomatis
agaagaagagg

SEQ ID NO: 482084 - RNA, 14 nt, Chlamydia trachomatis
agaagaagaggagg

SEQ ID NO: 482085 - RNA, 22 nt, Chlamydia trachomatis
agaagaaccuccauaagaaauu

SEQ ID NO: 482086 - RNA, 21 nt, Chlamydia trachomatis
agaagaacgccugaucaaauc

SEQ ID NO: 482087 - RNA, 22 nt, Chlamydia trachomatis
agaagaagccccaauagcuaag

SEQ ID NO: 482088 - RNA, 14 nt, Chlamydia trachomatis
agaagaaucauaga

SEQ ID NO: 482089 - RNA, 24 nt, Chlamydia trachomatis
agaagacaaagaucguaaaauagc

SEQ ID NO: 482090 - RNA, 13 nt, Chlamydia trachomatis
agaagacuuugga

SEQ ID NO: 482091 - RNA, 19 nt, Chlamydia trachomatis
agaagacuuuggaagaggc

SEQ ID NO: 482092 - RNA, 14 nt, Chlamydia trachomatis
agaacauuucucgu

SEQ ID NO: 482093 - RNA, 22 nt, Chlamydia trachomatis
agaacauuucucgucaggggau

SEQ ID NO: 482094 - RNA, 21 nt, Chlamydia trachomatis
agaaccaaucgagagguccag

SEQ ID NO: 482095 - RNA, 19 nt, Chlamydia trachomatis
agaacaaacgaaggagcuu

SEQ ID NO: 482096 - RNA, 17 nt, Chlamydia trachomatis
agaaccucaauagcuga

SEQ ID NO: 482097 - RNA, 19 nt, Chlamydia trachomatis
agaacgaagcccaaacccu

SEQ ID NO: 482098 - RNA, 14 nt, Chlamydia trachomatis
agaaacgacaggcu

SEQ ID NO: 482099 - RNA, 22 nt, Chlamydia trachomatis
agaaacaaggcuaagaaagguu

SEQ ID NO: 482100 - RNA, 16 nt, Chlamydia trachomatis
agaaacacgcaacccu

SEQ ID NO: 482101 - RNA, 11 nt, Chlamydia trachomatis
agaaacguuua

SEQ ID NO: 482102 - RNA, 13 nt, Chlamydia trachomatis
aaaacagaaagaa

SEQ ID NO: 482103 - RNA, 22 nt, Chlamydia trachomatis
agaaauccuaaaaaaaaccauu

SEQ ID NO: 482104 - RNA, 20 nt, Chlamydia trachomatis
agaaaucuuuuacuggagaa

SEQ ID NO: 482105 - RNA, 23 nt, Chlamydia trachomatis
agaaauggucucuucuccuagag

SEQ ID NO: 482106 - RNA, 18 nt, Chlamydia trachomatis
agaaauguugugugauga

SEQ ID NO: 482107 - RNA, 22 nt, Chlamydia trachomatis
agaaauugucgaauuuuucugc

SEQ ID NO: 482108 - RNA, 15 nt, Chlamydia trachomatis
agaaucuguuuugau

SEQ ID NO: 482109 - RNA, 17 nt, Chlamydia trachomatis
agaaucuguuuugauua

SEQ ID NO: 482110 - RNA, 15 nt, Chlamydia trachomatis
agaaucuuaaacaag

SEQ ID NO: 482111 - RNA, 17 nt, Chlamydia trachomatis
agaaucuuaaacaagau

SEQ ID NO: 482112 - RNA, 22 nt, Chlamydia trachomatis
agaaucuaccacggauaaagaa

SEQ ID NO: 482113 - RNA, 23 nt, Chlamydia trachomatis
agaaucuaccacggauaaagaaa

SEQ ID NO: 482114 - RNA, 19 nt, Chlamydia trachomatis
agaaucuccuguacaccac

SEQ ID NO: 482115 - RNA, 21 nt, Chlamydia trachomatis
agaaucucugggguagcugau

SEQ ID NO: 482116 - RNA, 16 nt, Chlamydia trachomatis
agaaucugucuaagau

SEQ ID NO: 482117 - RNA, 20 nt, Chlamydia trachomatis
agaaugguccaugauuucuu

SEQ ID NO: 482118 - RNA, 15 nt, Chlamydia trachomatis
agaauauaagcaccc

SEQ ID NO: 482119 - RNA, 23 nt, Chlamydia trachomatis
agaauauagcuguaauaaacacu

SEQ ID NO: 482120 - RNA, 17 nt, Chlamydia trachomatis
agaauaugcgacaguac

SEQ ID NO: 482121 - RNA, 14 nt, Chlamydia trachomatis
agaaucuaaaaagc

SEQ ID NO: 482122 - RNA, 22 nt, Chlamydia trachomatis
agaaucuaaaaagccauacaaa

SEQ ID NO: 482123 - RNA, 13 nt, Chlamydia trachomatis
agaauaccaacuu

SEQ ID NO: 482124 - RNA, 14 nt, Chlamydia trachomatis
agaauacaagaaag

SEQ ID NO: 482125 - RNA, 15 nt, Chlamydia trachomatis
agaauaaaaggcuac

SEQ ID NO: 482126 - RNA, 22 nt, Chlamydia trachomatis
agaauaaaaggcuacuaaagac

SEQ ID NO: 482127 - RNA, 14 nt, Chlamydia trachomatis
agaauaaauauagg

SEQ ID NO: 482128 - RNA, 20 nt, Chlamydia trachomatis
agaauaagguauccaacaau

SEQ ID NO: 482129 - RNA, 22 nt, Chlamydia trachomatis
agaauaauacaggaggucucac

SEQ ID NO: 482130 - RNA, 19 nt, Chlamydia trachomatis
agaauaaucgagugaucua

SEQ ID NO: 482131 - RNA, 16 nt, Chlamydia trachomatis
agaauacaaagcagcc

SEQ ID NO: 482132 - RNA, 15 nt, Chlamydia trachomatis
agaagucgugucuuu

SEQ ID NO: 482133 - RNA, 22 nt, Chlamydia trachomatis
agaaguugguuuggguuuuaau

SEQ ID NO: 482134 - RNA, 12 nt, Chlamydia trachomatis
agaaguuuuaac

SEQ ID NO: 482135 - RNA, 15 nt, Chlamydia trachomatis
agaagccuugagccu

SEQ ID NO: 482136 - RNA, 17 nt, Chlamydia trachomatis
agaagcgaagcauucuc

SEQ ID NO: 482137 - RNA, 22 nt, Chlamydia trachomatis
agaagagcuguuguuaauauca

SEQ ID NO: 482138 - RNA, 20 nt, Chlamydia trachomatis
agaagcaugcaauccuucuu

SEQ ID NO: 482139 - RNA, 22 nt, Chlamydia trachomatis
agaagccauaguagaaauuaca

SEQ ID NO: 482140 - RNA, 15 nt, Chlamydia trachomatis
agaauuucuuccucu

SEQ ID NO: 482141 - RNA, 19 nt, Chlamydia trachomatis
agaauuucuuccucuaauu

SEQ ID NO: 482142 - RNA, 19 nt, Chlamydia trachomatis
agaauucgagucggacagu

SEQ ID NO: 482143 - RNA, 12 nt, Chlamydia trachomatis
agaauuucccua

SEQ ID NO: 482144 - RNA, 13 nt, Chlamydia trachomatis
agaauuuuaaaca

SEQ ID NO: 482145 - RNA, 15 nt, Chlamydia trachomatis
agacccagcucauua

SEQ ID NO: 482146 - RNA, 20 nt, Chlamydia trachomatis
agaccgaaauuaguaauaaa

SEQ ID NO: 482147 - RNA, 13 nt, Chlamydia trachomatis
agacccugcauua

SEQ ID NO: 482148 - RNA, 20 nt, Chlamydia trachomatis
agacccuuccaaauuucccu

SEQ ID NO: 482149 - RNA, 12 nt, Chlamydia trachomatis
agaccuaaucca

SEQ ID NO: 482150 - RNA, 14 nt, Chlamydia trachomatis
agaccuacaaagau

SEQ ID NO: 482151 - RNA, 17 nt, Chlamydia trachomatis
agaccuaguaagugcau

SEQ ID NO: 482152 - RNA, 19 nt, Chlamydia trachomatis
agacgaaguaggagaugcu

SEQ ID NO: 482153 - RNA, 13 nt, Chlamydia trachomatis
agacuccagcuuc

SEQ ID NO: 482154 - RNA, 20 nt, Chlamydia trachomatis
agacuccagcuucuccaucu

SEQ ID NO: 482155 - RNA, 22 nt, Chlamydia trachomatis
agacucagguuauccaaauaaa

SEQ ID NO: 482156 - RNA, 17 nt, Chlamydia trachomatis
agacuauuucuucuaga

SEQ ID NO: 482157 - RNA, 23 nt, Chlamydia trachomatis
agacucacagcaaauaaagaggu

SEQ ID NO: 482158 - RNA, 16 nt, Chlamydia trachomatis
agacuagaugcaauaa

SEQ ID NO: 482159 - RNA, 17 nt, Chlamydia trachomatis
agacuguuugcguagga

SEQ ID NO: 482160 - RNA, 15 nt, Chlamydia trachomatis
agacuucuuguauaa

SEQ ID NO: 482161 - RNA, 16 nt, Chlamydia trachomatis
agacucggaaucucug

SEQ ID NO: 482162 - RNA, 22 nt, Chlamydia trachomatis
agacucuuuguugggcaaucaa

SEQ ID NO: 482163 - RNA, 23 nt, Chlamydia trachomatis
agacucuuuguugggcaaucaag

SEQ ID NO: 482164 - RNA, 13 nt, Chlamydia trachomatis
agacugccuaccu

SEQ ID NO: 482165 - RNA, 20 nt, Chlamydia trachomatis
agacugccuaccugcucugg

SEQ ID NO: 482166 - RNA, 15 nt, Chlamydia trachomatis
agagaauuagagaua

SEQ ID NO: 482167 - RNA, 18 nt, Chlamydia trachomatis
agagaauuagagauaauu

SEQ ID NO: 482168 - RNA, 21 nt, Chlamydia trachomatis
agagaccugcuucagcagcau

SEQ ID NO: 482169 - RNA, 17 nt, Chlamydia trachomatis
agagacggcacaggugu

SEQ ID NO: 482170 - RNA, 19 nt, Chlamydia trachomatis
agagacuuguuuagcaaga

SEQ ID NO: 482171 - RNA, 18 nt, Chlamydia trachomatis
agagaagguaacaaugcu

SEQ ID NO: 482172 - RNA, 15 nt, Chlamydia trachomatis
agacuuguucugcug

SEQ ID NO: 482173 - RNA, 22 nt, Chlamydia trachomatis
agacuuuguuuauuaucuagaa

SEQ ID NO: 482174 - RNA, 19 nt, Chlamydia trachomatis
agagaaaaauugcaaagag

SEQ ID NO: 482175 - RNA, 14 nt, Chlamydia trachomatis
agagaaaagaaaag

SEQ ID NO: 482176 - RNA, 17 nt, Chlamydia trachomatis
agagaaaagaaaagggg

SEQ ID NO: 482177 - RNA, 13 nt, Chlamydia trachomatis
agagaaaagagga

SEQ ID NO: 482178 - RNA, 14 nt, Chlamydia trachomatis
agagaaacaaccau

SEQ ID NO: 482179 - RNA, 12 nt, Chlamydia trachomatis
agagaaaccaac

SEQ ID NO: 482180 - RNA, 12 nt, Chlamydia trachomatis
agagaaagcucg

SEQ ID NO: 482181 - RNA, 23 nt, Chlamydia trachomatis
agagaaagcucgaauacgaggag

SEQ ID NO: 482182 - RNA, 14 nt, Chlamydia trachomatis
agagaacccuaaua

SEQ ID NO: 482183 - RNA, 11 nt, Chlamydia trachomatis
agagauuuccu

SEQ ID NO: 482184 - RNA, 15 nt, Chlamydia trachomatis
agagauucuuugacg

SEQ ID NO: 482185 - RNA, 14 nt, Chlamydia trachomatis
agagauauaagaga

SEQ ID NO: 482186 - RNA, 13 nt, Chlamydia trachomatis
agagagacucuuu

SEQ ID NO: 482187 - RNA, 12 nt, Chlamydia trachomatis
agagagcccuuu

SEQ ID NO: 482188 - RNA, 13 nt, Chlamydia trachomatis
agagagccuugag

SEQ ID NO: 482189 - RNA, 21 nt, Chlamydia trachomatis
agagagcuuugaucuuuguuc

SEQ ID NO: 482190 - RNA, 21 nt, Chlamydia trachomatis
agagaggccuccauuuccaug

SEQ ID NO: 482191 - RNA, 22 nt, Chlamydia trachomatis
agagaggcgucugcauaaaacu

SEQ ID NO: 482192 - RNA, 14 nt, Chlamydia trachomatis
agagaggcuugaga

SEQ ID NO: 482193 - RNA, 22 nt, Chlamydia trachomatis
agagaggggagaguuaggcugc

SEQ ID NO: 482194 - RNA, 16 nt, Chlamydia trachomatis
agagcccuaauaaaag

SEQ ID NO: 482195 - RNA, 21 nt, Chlamydia trachomatis
agagcccuaauaaaagggcuc

SEQ ID NO: 482196 - RNA, 18 nt, Chlamydia trachomatis
agagccaugaucaaagaa

SEQ ID NO: 482197 - RNA, 13 nt, Chlamydia trachomatis
agagccaauccau

SEQ ID NO: 482198 - RNA, 12 nt, Chlamydia trachomatis
agagccagcgag

SEQ ID NO: 482199 - RNA, 21 nt, Chlamydia trachomatis
agagcaucgaagcguuuacaa

SEQ ID NO: 482200 - RNA, 18 nt, Chlamydia trachomatis
agagcucauagucugauc

SEQ ID NO: 482201 - RNA, 18 nt, Chlamydia trachomatis
agagucucuaaaaucgug

SEQ ID NO: 482202 - RNA, 18 nt, Chlamydia trachomatis
agagcuuccacagcagug

SEQ ID NO: 482203 - RNA, 19 nt, Chlamydia trachomatis
agagcuuccacagcaguga

SEQ ID NO: 482204 - RNA, 13 nt, Chlamydia trachomatis
agagcuucucuaa

SEQ ID NO: 482205 - RNA, 13 nt, Chlamydia trachomatis
agaguaucuuuga

SEQ ID NO: 482206 - RNA, 15 nt, Chlamydia trachomatis
agaguaucuuugaua

SEQ ID NO: 482207 - RNA, 15 nt, Chlamydia trachomatis
agaguggacuuuaga

SEQ ID NO: 482208 - RNA, 17 nt, Chlamydia trachomatis
agaguuuaggcccacag

SEQ ID NO: 482209 - RNA, 21 nt, Chlamydia trachomatis
agaguuugugauuuagacaca

SEQ ID NO: 482210 - RNA, 11 nt, Chlamydia trachomatis
agauaaaagaa

SEQ ID NO: 482211 - RNA, 13 nt, Chlamydia trachomatis
agauaaaagaagc

SEQ ID NO: 482212 - RNA, 14 nt, Chlamydia trachomatis
agauaacaauccua

SEQ ID NO: 482213 - RNA, 18 nt, Chlamydia trachomatis
agauaacuuugaacaaau

SEQ ID NO: 482214 - RNA, 19 nt, Chlamydia trachomatis
agauaaucaaaccuaagua

SEQ ID NO: 482215 - RNA, 13 nt, Chlamydia trachomatis
agauaauggcaaa

SEQ ID NO: 482216 - RNA, 19 nt, Chlamydia trachomatis
agauaauucucgcaaagaa

SEQ ID NO: 482217 - RNA, 12 nt, Chlamydia trachomatis
agauagcuccaa

SEQ ID NO: 482218 - RNA, 14 nt, Chlamydia trachomatis
agaucaagaaaaga

SEQ ID NO: 482219 - RNA, 13 nt, Chlamydia trachomatis
agauauuuucaca

SEQ ID NO: 482220 - RNA, 12 nt, Chlamydia trachomatis
agauauaaacaa

SEQ ID NO: 482221 - RNA, 22 nt, Chlamydia trachomatis
agauauuuccauaagagaggcu

SEQ ID NO: 482222 - RNA, 22 nt, Chlamydia trachomatis
agauaggaacuacauucgccuc

SEQ ID NO: 482223 - RNA, 20 nt, Chlamydia trachomatis
agauaggggaaacuagcaaa

SEQ ID NO: 482224 - RNA, 15 nt, Chlamydia trachomatis
agauaggcaggaaga

SEQ ID NO: 482225 - RNA, 14 nt, Chlamydia trachomatis
agauaguagagaau

SEQ ID NO: 482226 - RNA, 19 nt, Chlamydia trachomatis
agauccgauaucagcaaaa

SEQ ID NO: 482227 - RNA, 15 nt, Chlamydia trachomatis
agauccuuaaacucu

SEQ ID NO: 482228 - RNA, 23 nt, Chlamydia trachomatis
agauccauuugauaguuuuguaa

SEQ ID NO: 482229 - RNA, 21 nt, Chlamydia trachomatis
agaucccaaaagauuuucaac

SEQ ID NO: 482230 - RNA, 16 nt, Chlamydia trachomatis
agaucccauaaucuca

SEQ ID NO: 482231 - RNA, 16 nt, Chlamydia trachomatis
agaucgaauaguagga

SEQ ID NO: 482232 - RNA, 18 nt, Chlamydia trachomatis
agaucgguugcauccaau

SEQ ID NO: 482233 - RNA, 16 nt, Chlamydia trachomatis
agaucuaaagcagaaa

SEQ ID NO: 482234 - RNA, 22 nt, Chlamydia trachomatis
agaucuaaggaauguggagcua

SEQ ID NO: 482235 - RNA, 21 nt, Chlamydia trachomatis
agaucuaggaucccaaggaaa

SEQ ID NO: 482236 - RNA, 17 nt, Chlamydia trachomatis
agaucuucaacaagauu

SEQ ID NO: 482237 - RNA, 18 nt, Chlamydia trachomatis
agaucugcauuccaggac

SEQ ID NO: 482238 - RNA, 21 nt, Chlamydia trachomatis
agaucucauagcaccagcuaa

SEQ ID NO: 482239 - RNA, 21 nt, Chlamydia trachomatis
agaucucuccagaguucauuu

SEQ ID NO: 482240 - RNA, 22 nt, Chlamydia trachomatis
agaucucuccagaguucauuuu

SEQ ID NO: 482241 - RNA, 17 nt, Chlamydia trachomatis
agaucuuuacuuucuuu

SEQ ID NO: 482242 - RNA, 14 nt, Chlamydia trachomatis
agaucuuuugaaga

SEQ ID NO: 482243 - RNA, 15 nt, Chlamydia trachomatis
agaucuuuuucauuu

SEQ ID NO: 482244 - RNA, 15 nt, Chlamydia trachomatis
agaugcuuuguaaaa

SEQ ID NO: 482245 - RNA, 19 nt, Chlamydia trachomatis
agauggguuuguagguacu

SEQ ID NO: 482246 - RNA, 17 nt, Chlamydia trachomatis
agauguuuguguuucua

SEQ ID NO: 482247 - RNA, 17 nt, Chlamydia trachomatis
agauuauaauuccaaug

SEQ ID NO: 482248 - RNA, 15 nt, Chlamydia trachomatis
agauuauaccagcag

SEQ ID NO: 482249 - RNA, 22 nt, Chlamydia trachomatis
agauuaucauucaaaauccauu

SEQ ID NO: 482250 - RNA, 14 nt, Chlamydia trachomatis
agcaacuauauuug

SEQ ID NO: 482251 - RNA, 18 nt, Chlamydia trachomatis
agcaacugcuuucuuugu

SEQ ID NO: 482252 - RNA, 17 nt, Chlamydia trachomatis
agcaaguaaaauuacaa

SEQ ID NO: 482253 - RNA, 18 nt, Chlamydia trachomatis
agcaagcuugucuccuuc

SEQ ID NO: 482254 - RNA, 15 nt, Chlamydia trachomatis
agcaagcucaacaag

SEQ ID NO: 482255 - RNA, 14 nt, Chlamydia trachomatis
agcaagcccuugag

SEQ ID NO: 482256 - RNA, 16 nt, Chlamydia trachomatis
agcaagauagucugga

SEQ ID NO: 482257 - RNA, 17 nt, Chlamydia trachomatis
agcaagauauaaacaau

SEQ ID NO: 482258 - RNA, 22 nt, Chlamydia trachomatis
agcaagauauaaacaauaagaa

SEQ ID NO: 482259 - RNA, 15 nt, Chlamydia trachomatis
agcaagauucuccuu

SEQ ID NO: 482260 - RNA, 16 nt, Chlamydia trachomatis
agcaagaagaagagag

SEQ ID NO: 482261 - RNA, 14 nt, Chlamydia trachomatis
agcaagaauacaag

SEQ ID NO: 482262 - RNA, 17 nt, Chlamydia trachomatis
agcaagaauacaagaaa

SEQ ID NO: 482263 - RNA, 17 nt, Chlamydia trachomatis
agcaauaauuuccccua

SEQ ID NO: 482264 - RNA, 21 nt, Chlamydia trachomatis
agcaauaccgaaucuaauaug

SEQ ID NO: 482265 - RNA, 14 nt, Chlamydia trachomatis
agcaauagcaacug

SEQ ID NO: 482266 - RNA, 14 nt, Chlamydia trachomatis
agcaaucacuaaaa

SEQ ID NO: 482267 - RNA, 15 nt, Chlamydia trachomatis
agcaauguuccuugu

SEQ ID NO: 482268 - RNA, 14 nt, Chlamydia trachomatis
agcacaucacuaua

SEQ ID NO: 482269 - RNA, 16 nt, Chlamydia trachomatis
agcacccacauuacca

SEQ ID NO: 482270 - RNA, 16 nt, Chlamydia trachomatis
agcacuggauccuaaa

SEQ ID NO: 482271 - RNA, 18 nt, Chlamydia trachomatis
agcagaacucaacgaaag

SEQ ID NO: 482272 - RNA, 21 nt, Chlamydia trachomatis
agcacccuuucuuacuccuuc

SEQ ID NO: 482273 - RNA, 21 nt, Chlamydia trachomatis
agcagacuuuguuuauuaucu

SEQ ID NO: 482274 - RNA, 15 nt, Chlamydia trachomatis
agcagccucucuuug

SEQ ID NO: 482275 - RNA, 19 nt, Chlamydia trachomatis
aaaaccuuuugaaacaucu

SEQ ID NO: 482276 - RNA, 15 nt, Chlamydia trachomatis
agcaggaacuucuuc

SEQ ID NO: 482277 - RNA, 23 nt, Chlamydia trachomatis
agcagcuuccugagggccuucuu

SEQ ID NO: 482278 - RNA, 13 nt, Chlamydia trachomatis
agcauaauauccc

SEQ ID NO: 482279 - RNA, 15 nt, Chlamydia trachomatis
agcauaauaucccca

SEQ ID NO: 482280 - RNA, 20 nt, Chlamydia trachomatis
agcauaauauccccauccug

SEQ ID NO: 482281 - RNA, 16 nt, Chlamydia trachomatis
agcauaucuccuaaaa

SEQ ID NO: 482282 - RNA, 23 nt, Chlamydia trachomatis
agcaucgagauaauauugagaaa

SEQ ID NO: 482283 - RNA, 13 nt, Chlamydia trachomatis
agcauccugaacc

SEQ ID NO: 482284 - RNA, 23 nt, Chlamydia trachomatis
agcauccauauauucagaagaag

SEQ ID NO: 482285 - RNA, 13 nt, Chlamydia trachomatis
agcauaaauccuu

SEQ ID NO: 482286 - RNA, 19 nt, Chlamydia trachomatis
agccaaaauauacucagag

SEQ ID NO: 482287 - RNA, 18 nt, Chlamydia trachomatis
agcauucaucuauuuuua

SEQ ID NO: 482288 - RNA, 18 nt, Chlamydia trachomatis
agcauucuucugaacaac

SEQ ID NO: 482289 - RNA, 21 nt, Chlamydia trachomatis
agcaugggcugcaucagcaag

SEQ ID NO: 482290 - RNA, 18 nt, Chlamydia trachomatis
agcaucuggaguggcauc

SEQ ID NO: 482291 - RNA, 12 nt, Chlamydia trachomatis
agcaucuucaca

SEQ ID NO: 482292 - RNA, 22 nt, Chlamydia trachomatis
agcaucuucacaguucguugua

SEQ ID NO: 482293 - RNA, 16 nt, Chlamydia trachomatis
agcaucuacugaugcu

SEQ ID NO: 482294 - RNA, 19 nt, Chlamydia trachomatis
agcaucuacugaugcuugg

SEQ ID NO: 482295 - RNA, 13 nt, Chlamydia trachomatis
agcauuaccauau

SEQ ID NO: 482296 - RNA, 22 nt, Chlamydia trachomatis
agcauuaccauaucaaaaauag

SEQ ID NO: 482297 - RNA, 13 nt, Chlamydia trachomatis
agccaaagaauuu

SEQ ID NO: 482298 - RNA, 23 nt, Chlamydia trachomatis
agccacacauguccuaccaauau

SEQ ID NO: 482299 - RNA, 13 nt, Chlamydia trachomatis
agccaauuuccau

SEQ ID NO: 482300 - RNA, 15 nt, Chlamydia trachomatis
agccacaaccacugu

SEQ ID NO: 482301 - RNA, 23 nt, Chlamydia trachomatis
agcccuuuuauuagggcucucuu

SEQ ID NO: 482302 - RNA, 14 nt, Chlamydia trachomatis
agccguguucugaa

SEQ ID NO: 482303 - RNA, 21 nt, Chlamydia trachomatis
agccuaaauagcucaguuggu

SEQ ID NO: 482304 - RNA, 14 nt, Chlamydia trachomatis
agccuacaaauaaa

SEQ ID NO: 482305 - RNA, 17 nt, Chlamydia trachomatis
agccuccgcuaauuuuu

SEQ ID NO: 482306 - RNA, 13 nt, Chlamydia trachomatis
agccuccucuaca

SEQ ID NO: 482307 - RNA, 23 nt, Chlamydia trachomatis
agccuccucuacaccauaaaacu

SEQ ID NO: 482308 - RNA, 15 nt, Chlamydia trachomatis
agccuccaucucugc

SEQ ID NO: 482309 - RNA, 16 nt, Chlamydia trachomatis
agccuaucgcacacaa

SEQ ID NO: 482310 - RNA, 21 nt, Chlamydia trachomatis
agccuaugcgugucacagacu

SEQ ID NO: 482311 - RNA, 16 nt, Chlamydia trachomatis
agccucuaacucuucu

SEQ ID NO: 482312 - RNA, 17 nt, Chlamydia trachomatis
agccucuccagaaaaac

SEQ ID NO: 482313 - RNA, 20 nt, Chlamydia trachomatis
agccuucuuucaaaagaagg

SEQ ID NO: 482314 - RNA, 22 nt, Chlamydia trachomatis
agccuucucuuuucacaaagag

SEQ ID NO: 482315 - RNA, 17 nt, Chlamydia trachomatis
agccuuggauuucuucu

SEQ ID NO: 482316 - RNA, 18 nt, Chlamydia trachomatis
agccuuggauuucuucug

SEQ ID NO: 482317 - RNA, 17 nt, Chlamydia trachomatis
agccuuggguucuucug

SEQ ID NO: 482318 - RNA, 15 nt, Chlamydia trachomatis
agccuuguuucucaa

SEQ ID NO: 482319 - RNA, 22 nt, Chlamydia trachomatis
agcgacagcccaagaucuuccg

SEQ ID NO: 482320 - RNA, 21 nt, Chlamydia trachomatis
agcgacauucucggaaaagau

SEQ ID NO: 482321 - RNA, 20 nt, Chlamydia trachomatis
agcgcuccuagugauaaaca

SEQ ID NO: 482322 - RNA, 23 nt, Chlamydia trachomatis
agcgcuuccauuucgaguuuuuu

SEQ ID NO: 482323 - RNA, 23 nt, Chlamydia trachomatis
agcgcuuuuuuuuuagaacagau

SEQ ID NO: 482324 - RNA, 18 nt, Chlamydia trachomatis
agcggaguguuuucuguu

SEQ ID NO: 482325 - RNA, 15 nt, Chlamydia trachomatis
agcggacauuucacu

SEQ ID NO: 482326 - RNA, 15 nt, Chlamydia trachomatis
agcggcgaaaauuug

SEQ ID NO: 482327 - RNA, 22 nt, Chlamydia trachomatis
agcguauauaucuuaauugaaa

SEQ ID NO: 482328 - RNA, 21 nt, Chlamydia trachomatis
agcgucuaacuaaaugucucu

SEQ ID NO: 482329 - RNA, 16 nt, Chlamydia trachomatis
agcgucuaucuaccuu

SEQ ID NO: 482330 - RNA, 13 nt, Chlamydia trachomatis
agcuccucuucuu

SEQ ID NO: 482331 - RNA, 22 nt, Chlamydia trachomatis
agcuccuaaucuuucuaauuuc

SEQ ID NO: 482332 - RNA, 18 nt, Chlamydia trachomatis
agcucgagucucuugugg

SEQ ID NO: 482333 - RNA, 20 nt, Chlamydia trachomatis
agcuccuuuaccuuucacua

SEQ ID NO: 482334 - RNA, 18 nt, Chlamydia trachomatis
agcucgucuuuagaagaa

SEQ ID NO: 482335 - RNA, 19 nt, Chlamydia trachomatis
agcucgucuuuagaagaaa

SEQ ID NO: 482336 - RNA, 20 nt, Chlamydia trachomatis
agcucggucacgaaguuuuu

SEQ ID NO: 482337 - RNA, 19 nt, Chlamydia trachomatis
agcucugcccccuacagag

SEQ ID NO: 482338 - RNA, 20 nt, Chlamydia trachomatis
agcucugaguuaaaggaagg

SEQ ID NO: 482339 - RNA, 20 nt, Chlamydia trachomatis
agcucuccauuuaagacuac

SEQ ID NO: 482340 - RNA, 22 nt, Chlamydia trachomatis
agcugaggcucuucaguacuua

SEQ ID NO: 482341 - RNA, 14 nt, Chlamydia trachomatis
agcugauaaggagg

SEQ ID NO: 482342 - RNA, 14 nt, Chlamydia trachomatis
agcugacaaagcuu

SEQ ID NO: 482343 - RNA, 12 nt, Chlamydia trachomatis
agcucuuuccuc

SEQ ID NO: 482344 - RNA, 23 nt, Chlamydia trachomatis
agcucuuugauaugcagcaucca

SEQ ID NO: 482345 - RNA, 22 nt, Chlamydia trachomatis
agcucuuacuccuaaaguaaga

SEQ ID NO: 482346 - RNA, 19 nt, Chlamydia trachomatis
agcucuucgagucuucccu

SEQ ID NO: 482347 - RNA, 20 nt, Chlamydia trachomatis
agcucuugucgauaaaguaa

SEQ ID NO: 482348 - RNA, 16 nt, Chlamydia trachomatis
agcuguuucauucacu

SEQ ID NO: 482349 - RNA, 18 nt, Chlamydia trachomatis
agcuguuucauucacuuu

SEQ ID NO: 482350 - RNA, 22 nt, Chlamydia trachomatis
agcuguuguuaauaucagcaga

SEQ ID NO: 482351 - RNA, 20 nt, Chlamydia trachomatis
agcuguuaugaaccagggag

SEQ ID NO: 482352 - RNA, 21 nt, Chlamydia trachomatis
agcuguuaugaaccagggaga

SEQ ID NO: 482353 - RNA, 14 nt, Chlamydia trachomatis
agcuguucuuccau

SEQ ID NO: 482354 - RNA, 22 nt, Chlamydia trachomatis
agcugguaauuggcggagaagc

SEQ ID NO: 482355 - RNA, 15 nt, Chlamydia trachomatis
agcugauauaaguau

SEQ ID NO: 482356 - RNA, 23 nt, Chlamydia trachomatis
agcugauguaagcgagauaagga

SEQ ID NO: 482357 - RNA, 17 nt, Chlamydia trachomatis
agcuucuuuuucaagag

SEQ ID NO: 482358 - RNA, 14 nt, Chlamydia trachomatis
agcuuuuuucagaa

SEQ ID NO: 482359 - RNA, 14 nt, Chlamydia trachomatis
agcuuucacaggga

SEQ ID NO: 482360 - RNA, 20 nt, Chlamydia trachomatis
agcuuucgcugcggaaaucu

SEQ ID NO: 482361 - RNA, 21 nt, Chlamydia trachomatis
agcuuucgcugcggaaaucuu

SEQ ID NO: 482362 - RNA, 23 nt, Chlamydia trachomatis
agcuuuaaagagcaugaccucag

SEQ ID NO: 482363 - RNA, 13 nt, Chlamydia trachomatis
agcuuuagaaaua

SEQ ID NO: 482364 - RNA, 18 nt, Chlamydia trachomatis
aggaaucacaguaauacu

SEQ ID NO: 482365 - RNA, 20 nt, Chlamydia trachomatis
aggaaucacuaagucuguug

SEQ ID NO: 482366 - RNA, 21 nt, Chlamydia trachomatis
aggaauacccagaaguaucua

SEQ ID NO: 482367 - RNA, 17 nt, Chlamydia trachomatis
aggaauacgaaaugaca

SEQ ID NO: 482368 - RNA, 16 nt, Chlamydia trachomatis
aggaauagcuacagca

SEQ ID NO: 482369 - RNA, 20 nt, Chlamydia trachomatis
aggaauaauuuuccacaaau

SEQ ID NO: 482370 - RNA, 13 nt, Chlamydia trachomatis
aggaaaagaugaa

SEQ ID NO: 482371 - RNA, 14 nt, Chlamydia trachomatis
aggaaaagaugaag

SEQ ID NO: 482372 - RNA, 13 nt, Chlamydia trachomatis
aggaaaagcuuug

SEQ ID NO: 482373 - RNA, 23 nt, Chlamydia trachomatis
aggaaacacuguauugcucugca

SEQ ID NO: 482374 - RNA, 18 nt, Chlamydia trachomatis
aggaauccuuaaccguga

SEQ ID NO: 482375 - RNA, 21 nt, Chlamydia trachomatis
aggaauccuuaaccgugaacu

SEQ ID NO: 482376 - RNA, 20 nt, Chlamydia trachomatis
aggaaucuguccaaagagau

SEQ ID NO: 482377 - RNA, 20 nt, Chlamydia trachomatis
aggaauguauaaacacugag

SEQ ID NO: 482378 - RNA, 15 nt, Chlamydia trachomatis
aggaauguggagcua

SEQ ID NO: 482379 - RNA, 18 nt, Chlamydia trachomatis
aggaccuaauaucugcuc

SEQ ID NO: 482380 - RNA, 16 nt, Chlamydia trachomatis
aggaccuagagaggga

SEQ ID NO: 482381 - RNA, 18 nt, Chlamydia trachomatis
aggaccucugucaauaaa

SEQ ID NO: 482382 - RNA, 16 nt, Chlamydia trachomatis
aggauagccaaagguu

SEQ ID NO: 482383 - RNA, 13 nt, Chlamydia trachomatis
aggauacgaagga

SEQ ID NO: 482384 - RNA, 20 nt, Chlamydia trachomatis
aggauacgaaggaucuucca

SEQ ID NO: 482385 - RNA, 14 nt, Chlamydia trachomatis
aggauaaggaagaa

SEQ ID NO: 482386 - RNA, 17 nt, Chlamydia trachomatis
aggauaaggaagaagau

SEQ ID NO: 482387 - RNA, 15 nt, Chlamydia trachomatis
aggaguugguuuguu

SEQ ID NO: 482388 - RNA, 19 nt, Chlamydia trachomatis
aggaguacuucuaaaauuu

SEQ ID NO: 482389 - RNA, 14 nt, Chlamydia trachomatis
aggaguaggaaggu

SEQ ID NO: 482390 - RNA, 15 nt, Chlamydia trachomatis
aggaguaggaaggua

SEQ ID NO: 482391 - RNA, 18 nt, Chlamydia trachomatis
aggaguauccagaaguuu

SEQ ID NO: 482392 - RNA, 20 nt, Chlamydia trachomatis
aggagucggaccaugaauga

SEQ ID NO: 482393 - RNA, 15 nt, Chlamydia trachomatis
aggagucucuaggua

SEQ ID NO: 482394 - RNA, 21 nt, Chlamydia trachomatis
aggaucccucuguccauucua

SEQ ID NO: 482395 - RNA, 17 nt, Chlamydia trachomatis
aggaucuaauucuagca

SEQ ID NO: 482396 - RNA, 13 nt, Chlamydia trachomatis
aggaucuccagaa

SEQ ID NO: 482397 - RNA, 16 nt, Chlamydia trachomatis
aggaugcaaauaagaa

SEQ ID NO: 482398 - RNA, 18 nt, Chlamydia trachomatis
aggaugcaaauaagaaag

SEQ ID NO: 482399 - RNA, 15 nt, Chlamydia trachomatis
aggaucccaaggaaa

SEQ ID NO: 482400 - RNA, 22 nt, Chlamydia trachomatis
aggauccccacgaccacaaaca

SEQ ID NO: 482401 - RNA, 18 nt, Chlamydia trachomatis
aggaucagagacuuguuu

SEQ ID NO: 482402 - RNA, 19 nt, Chlamydia trachomatis
aggauaguuacauacuuuu

SEQ ID NO: 482403 - RNA, 22 nt, Chlamydia trachomatis
aggauaguuucgaguaauucca

SEQ ID NO: 482404 - RNA, 21 nt, Chlamydia trachomatis
aggauguugcgaguuuugauu

SEQ ID NO: 482405 - RNA, 14 nt, Chlamydia trachomatis
aggauguuucccuu

SEQ ID NO: 482406 - RNA, 20 nt, Chlamydia trachomatis
aggauguggacgaacaaaaa

SEQ ID NO: 482407 - RNA, 23 nt, Chlamydia trachomatis
aggauuacaaaucguaaguccuu

SEQ ID NO: 482408 - RNA, 19 nt, Chlamydia trachomatis
aggauuacagcaagaagaa

SEQ ID NO: 482409 - RNA, 21 nt, Chlamydia trachomatis
aggauuacagcaagaagaaga

SEQ ID NO: 482410 - RNA, 16 nt, Chlamydia trachomatis
aggcagucucugaggc

SEQ ID NO: 482411 - RNA, 21 nt, Chlamydia trachomatis
aggcagucucugaggcaaagc

SEQ ID NO: 482412 - RNA, 13 nt, Chlamydia trachomatis
aggcaaugcuaag

SEQ ID NO: 482413 - RNA, 14 nt, Chlamydia trachomatis
aggcauaaaagaga

SEQ ID NO: 482414 - RNA, 15 nt, Chlamydia trachomatis
aggcauaaaagagaa

SEQ ID NO: 482415 - RNA, 18 nt, Chlamydia trachomatis
aggcauaaaagagaagaa

SEQ ID NO: 482416 - RNA, 14 nt, Chlamydia trachomatis
aggcauagccaucc

SEQ ID NO: 482417 - RNA, 15 nt, Chlamydia trachomatis
aggcggcuuuucuau

SEQ ID NO: 482418 - RNA, 16 nt, Chlamydia trachomatis
aggcguaaaccuucuu

SEQ ID NO: 482419 - RNA, 20 nt, Chlamydia trachomatis
aggcuaagaaaaaccuuucu

SEQ ID NO: 482420 - RNA, 20 nt, Chlamydia trachomatis
aggcguuccugcauacuuuu

SEQ ID NO: 482421 - RNA, 19 nt, Chlamydia trachomatis
aggcgugaagagagacacu

SEQ ID NO: 482422 - RNA, 22 nt, Chlamydia trachomatis
aggcucuccuaaugaugagaau

SEQ ID NO: 482423 - RNA, 17 nt, Chlamydia trachomatis
aggcucucgcaguuucu

SEQ ID NO: 482424 - RNA, 16 nt, Chlamydia trachomatis
aggcuccugcaaggga

SEQ ID NO: 482425 - RNA, 15 nt, Chlamydia trachomatis
aggcuccccagaaaa

SEQ ID NO: 482426 - RNA, 16 nt, Chlamydia trachomatis
aggcuccgccuucugc

SEQ ID NO: 482427 - RNA, 21 nt, Chlamydia trachomatis
aggcuccgccuucugcaauga

SEQ ID NO: 482428 - RNA, 22 nt, Chlamydia trachomatis
aggcucuuucagagaaaauuuc

SEQ ID NO: 482429 - RNA, 15 nt, Chlamydia trachomatis
aggcuacuaaagaca

SEQ ID NO: 482430 - RNA, 21 nt, Chlamydia trachomatis
aggcuagagauaucacuacca

SEQ ID NO: 482431 - RNA, 20 nt, Chlamydia trachomatis
aggcuauugauacugggagg

SEQ ID NO: 482432 - RNA, 21 nt, Chlamydia trachomatis
aggcugagcaucggagugagu

SEQ ID NO: 482433 - RNA, 12 nt, Chlamydia trachomatis
aggcugcucccu

SEQ ID NO: 482434 - RNA, 23 nt, Chlamydia trachomatis
aggcuucucuuuucgaacaaaac

SEQ ID NO: 482435 - RNA, 16 nt, Chlamydia trachomatis
aggcuucuucuucuuu

SEQ ID NO: 482436 - RNA, 16 nt, Chlamydia trachomatis
agggauagaaacuccg

SEQ ID NO: 482437 - RNA, 17 nt, Chlamydia trachomatis
agggauauuucuuccug

SEQ ID NO: 482438 - RNA, 19 nt, Chlamydia trachomatis
agggaucccacaaagaaag

SEQ ID NO: 482439 - RNA, 16 nt, Chlamydia trachomatis
agggaucucagcuggc

SEQ ID NO: 482440 - RNA, 22 nt, Chlamydia trachomatis
aggcuguuucgcauacacauaa

SEQ ID NO: 482441 - RNA, 14 nt, Chlamydia trachomatis
aggcuuacagagag

SEQ ID NO: 482442 - RNA, 22 nt, Chlamydia trachomatis
aggcuuaugaacggcucuucuu

SEQ ID NO: 482443 - RNA, 22 nt, Chlamydia trachomatis
aggcuucaauaauguugaaguc

SEQ ID NO: 482444 - RNA, 12 nt, Chlamydia trachomatis
aggcuuccaaau

SEQ ID NO: 482445 - RNA, 18 nt, Chlamydia trachomatis
agggauggucucacacaa

SEQ ID NO: 482446 - RNA, 23 nt, Chlamydia trachomatis
agggccucccauacaaaagcgaa

SEQ ID NO: 482447 - RNA, 14 nt, Chlamydia trachomatis
aggggaagaaucaa

SEQ ID NO: 482448 - RNA, 19 nt, Chlamydia trachomatis
aggggauugcaauccuuuu

SEQ ID NO: 482449 - RNA, 20 nt, Chlamydia trachomatis
agggucuucucugugcacaa

SEQ ID NO: 482450 - RNA, 14 nt, Chlamydia trachomatis
aggguuucuucuuu

SEQ ID NO: 482451 - RNA, 17 nt, Chlamydia trachomatis
agguauuuuagagaaaa

SEQ ID NO: 482452 - RNA, 16 nt, Chlamydia trachomatis
agguaaagaaguuuaa

SEQ ID NO: 482453 - RNA, 18 nt, Chlamydia trachomatis
aggucaagccuacagcua

SEQ ID NO: 482454 - RNA, 14 nt, Chlamydia trachomatis
aggucuuaauaaua

SEQ ID NO: 482455 - RNA, 15 nt, Chlamydia trachomatis
aggucuuauuaaaag

SEQ ID NO: 482456 - RNA, 16 nt, Chlamydia trachomatis
aggugaguuucccuuc

SEQ ID NO: 482457 - RNA, 15 nt, Chlamydia trachomatis
aggugguacuucauu

SEQ ID NO: 482458 - RNA, 18 nt, Chlamydia trachomatis
agguuaccacauucucuu

SEQ ID NO: 482459 - RNA, 18 nt, Chlamydia trachomatis
agguuauccaaauaaaca

SEQ ID NO: 482460 - RNA, 15 nt, Chlamydia trachomatis
aggugugaaagaaaa

SEQ ID NO: 482461 - RNA, 20 nt, Chlamydia trachomatis
aggugugaauaggaagaaua

SEQ ID NO: 482462 - RNA, 15 nt, Chlamydia trachomatis
aguacguguuaucaa

SEQ ID NO: 482463 - RNA, 21 nt, Chlamydia trachomatis
aguaccucgagcaacgaggac

SEQ ID NO: 482464 - RNA, 21 nt, Chlamydia trachomatis
aguacaucuguagagccauga

SEQ ID NO: 482465 - RNA, 16 nt, Chlamydia trachomatis
aguacaaguauauacc

SEQ ID NO: 482466 - RNA, 16 nt, Chlamydia trachomatis
aguaagcgaagaagga

SEQ ID NO: 482467 - RNA, 20 nt, Chlamydia trachomatis
aguaagcuaauuuuucucua

SEQ ID NO: 482468 - RNA, 16 nt, Chlamydia trachomatis
aguaaugacacuggca

SEQ ID NO: 482469 - RNA, 17 nt, Chlamydia trachomatis
aguaaugacacuggcac

SEQ ID NO: 482470 - RNA, 22 nt, Chlamydia trachomatis
aguaaugacacuggcaccuuuu

SEQ ID NO: 482471 - RNA, 16 nt, Chlamydia trachomatis
agguuuuuucuucuuu

SEQ ID NO: 482472 - RNA, 15 nt, Chlamydia trachomatis
agguucuucaacaac

SEQ ID NO: 482473 - RNA, 22 nt, Chlamydia trachomatis
agguucuuugaucaaauccugc

SEQ ID NO: 482474 - RNA, 18 nt, Chlamydia trachomatis
agguugaauuucaggagu

SEQ ID NO: 482475 - RNA, 19 nt, Chlamydia trachomatis
aguaagaccgagauuauca

SEQ ID NO: 482476 - RNA, 20 nt, Chlamydia trachomatis
aguaagcgcuuccauuucga

SEQ ID NO: 482477 - RNA, 18 nt, Chlamydia trachomatis
agucagaugaguuuaucu

SEQ ID NO: 482478 - RNA, 20 nt, Chlamydia trachomatis
aguagaaacuuacuuuucuu

SEQ ID NO: 482479 - RNA, 16 nt, Chlamydia trachomatis
aguagaccauuuagac

SEQ ID NO: 482480 - RNA, 23 nt, Chlamydia trachomatis
agucaacagaaggaguuuuucuc

SEQ ID NO: 482481 - RNA, 23 nt, Chlamydia trachomatis
agucaauccacgaauuuucucuc

SEQ ID NO: 482482 - RNA, 18 nt, Chlamydia trachomatis
aguccagggaaaagagcu

SEQ ID NO: 482483 - RNA, 23 nt, Chlamydia trachomatis
agucaggauuuucuagguaccac

SEQ ID NO: 482484 - RNA, 19 nt, Chlamydia trachomatis
agucaguuaggaaaugagg

SEQ ID NO: 482485 - RNA, 23 nt, Chlamydia trachomatis
agucaguuaggaaaugaggacag

SEQ ID NO: 482486 - RNA, 16 nt, Chlamydia trachomatis
agucccuucaaucaua

SEQ ID NO: 482487 - RNA, 21 nt, Chlamydia trachomatis
agucccuccuacuaaggauuu

SEQ ID NO: 482488 - RNA, 19 nt, Chlamydia trachomatis
aguccuuaucuucuugaga

SEQ ID NO: 482489 - RNA, 16 nt, Chlamydia trachomatis
aguccuucuccaccua

SEQ ID NO: 482490 - RNA, 19 nt, Chlamydia trachomatis
agucgugugaacggaggau

SEQ ID NO: 482491 - RNA, 15 nt, Chlamydia trachomatis
agugacauuuccaac

SEQ ID NO: 482492 - RNA, 15 nt, Chlamydia trachomatis
agugacuaagaucca

SEQ ID NO: 482493 - RNA, 18 nt, Chlamydia trachomatis
agucuguguuugcacaau

SEQ ID NO: 482494 - RNA, 14 nt, Chlamydia trachomatis
agucuuaaaagggu

SEQ ID NO: 482495 - RNA, 18 nt, Chlamydia trachomatis
agucuucaggagcaugaa

SEQ ID NO: 482496 - RNA, 21 nt, Chlamydia trachomatis
agucuucaggagcaugaauca

SEQ ID NO: 482497 - RNA, 18 nt, Chlamydia trachomatis
agucuucccuuaaacaua

SEQ ID NO: 482498 - RNA, 21 nt, Chlamydia trachomatis
agugagaugcuccucucuuug

SEQ ID NO: 482499 - RNA, 15 nt, Chlamydia trachomatis
agugauaaacaggag

SEQ ID NO: 482500 - RNA, 14 nt, Chlamydia trachomatis
agugcguccuucuu

SEQ ID NO: 482501 - RNA, 15 nt, Chlamydia trachomatis
agugcguccuucuuu

SEQ ID NO: 482502 - RNA, 18 nt, Chlamydia trachomatis
agugcguccuucuuuacc

SEQ ID NO: 482503 - RNA, 22 nt, Chlamydia trachomatis
agugcuaacgcuucuucugcag

SEQ ID NO: 482504 - RNA, 16 nt, Chlamydia trachomatis
agugcuaauaacggaa

SEQ ID NO: 482505 - RNA, 16 nt, Chlamydia trachomatis
agugcuccuaaaggaa

SEQ ID NO: 482506 - RNA, 13 nt, Chlamydia trachomatis
aguggaagauaga

SEQ ID NO: 482507 - RNA, 17 nt, Chlamydia trachomatis
aguggacgcugaucaac

SEQ ID NO: 482508 - RNA, 23 nt, Chlamydia trachomatis
aguggcuguaauguuaauggaau

SEQ ID NO: 482509 - RNA, 17 nt, Chlamydia trachomatis
aguguaaggagagaaaa

SEQ ID NO: 482510 - RNA, 19 nt, Chlamydia trachomatis
aguguaaggagagaaaaga

SEQ ID NO: 482511 - RNA, 16 nt, Chlamydia trachomatis
agugugcuucuggacu

SEQ ID NO: 482512 - RNA, 16 nt, Chlamydia trachomatis
agugugccagcucuaa

SEQ ID NO: 482513 - RNA, 22 nt, Chlamydia trachomatis
agugugcgaggaauucuucuuc

SEQ ID NO: 482514 - RNA, 16 nt, Chlamydia trachomatis
aguguuagugagccgc

SEQ ID NO: 482515 - RNA, 20 nt, Chlamydia trachomatis
aguguagucuuuguugcuau

SEQ ID NO: 482516 - RNA, 15 nt, Chlamydia trachomatis
aguguuugcauucuu

SEQ ID NO: 482517 - RNA, 22 nt, Chlamydia trachomatis
aguuaaauguugaugguuucua

SEQ ID NO: 482518 - RNA, 20 nt, Chlamydia trachomatis
aguuaacggaaauaggauuu

SEQ ID NO: 482519 - RNA, 20 nt, Chlamydia trachomatis
aguuaaucaauugaaagucu

SEQ ID NO: 482520 - RNA, 22 nt, Chlamydia trachomatis
aguuaggcauuccuuucuucca

SEQ ID NO: 482521 - RNA, 20 nt, Chlamydia trachomatis
aguucccuuuuguuccagaa

SEQ ID NO: 482522 - RNA, 14 nt, Chlamydia trachomatis
aguuccgaacaaaa

SEQ ID NO: 482523 - RNA, 19 nt, Chlamydia trachomatis
aguuccgguauauucuuca

SEQ ID NO: 482524 - RNA, 20 nt, Chlamydia trachomatis
aguuccgguauauucuucac

SEQ ID NO: 482525 - RNA, 16 nt, Chlamydia trachomatis
aguucuuggaaaaaag

SEQ ID NO: 482526 - RNA, 15 nt, Chlamydia trachomatis
aguucgcgucaguuc

SEQ ID NO: 482527 - RNA, 16 nt, Chlamydia trachomatis
aguucuuuauaacucu

SEQ ID NO: 482528 - RNA, 20 nt, Chlamydia trachomatis
aguucuuuuuccucuucaga

SEQ ID NO: 482529 - RNA, 11 nt, Chlamydia trachomatis
aguugcuccca

SEQ ID NO: 482530 - RNA, 14 nt, Chlamydia trachomatis
aguugcuccuccgu

SEQ ID NO: 482531 - RNA, 22 nt, Chlamydia trachomatis
aguugcuuguauagcuucauac

SEQ ID NO: 482532 - RNA, 17 nt, Chlamydia trachomatis
auaaagcuuuuucuacu

SEQ ID NO: 482533 - RNA, 18 nt, Chlamydia trachomatis
auaaagcuuuuucuacug

SEQ ID NO: 482534 - RNA, 19 nt, Chlamydia trachomatis
auaaaggaaacaaauuccu

SEQ ID NO: 482535 - RNA, 15 nt, Chlamydia trachomatis
auaaaggaaagggcu

SEQ ID NO: 482536 - RNA, 12 nt, Chlamydia trachomatis
auaaagaugaau

SEQ ID NO: 482537 - RNA, 19 nt, Chlamydia trachomatis
auaaagacccucuaaauuc

SEQ ID NO: 482538 - RNA, 22 nt, Chlamydia trachomatis
auaaagagagaggagaaaaacu

SEQ ID NO: 482539 - RNA, 17 nt, Chlamydia trachomatis
auaaacucggguuuuaa

SEQ ID NO: 482540 - RNA, 19 nt, Chlamydia trachomatis
auaaacucggguuuuaaau

SEQ ID NO: 482541 - RNA, 13 nt, Chlamydia trachomatis
auaaagaagacuu

SEQ ID NO: 482542 - RNA, 15 nt, Chlamydia trachomatis
auaaacaggagcgcu

SEQ ID NO: 482543 - RNA, 19 nt, Chlamydia trachomatis
auaaacgguggaacagcuc

SEQ ID NO: 482544 - RNA, 18 nt, Chlamydia trachomatis
auaaacguuuggaaaucc

SEQ ID NO: 482545 - RNA, 18 nt, Chlamydia trachomatis
auaaaugucccugaacau

SEQ ID NO: 482546 - RNA, 19 nt, Chlamydia trachomatis
auaaauuagggaagagcaa

SEQ ID NO: 482547 - RNA, 20 nt, Chlamydia trachomatis
auaaaaggcuacuaaagaca

SEQ ID NO: 482548 - RNA, 18 nt, Chlamydia trachomatis
auaaaaggcuuauucucu

SEQ ID NO: 482549 - RNA, 17 nt, Chlamydia trachomatis
auaaaagcugguuuuuu

SEQ ID NO: 482550 - RNA, 16 nt, Chlamydia trachomatis
auaaaaguacuucuag

SEQ ID NO: 482551 - RNA, 14 nt, Chlamydia trachomatis
auaaaagccugaau

SEQ ID NO: 482552 - RNA, 19 nt, Chlamydia trachomatis
auaaaagcuccuaaagaag

SEQ ID NO: 482553 - RNA, 22 nt, Chlamydia trachomatis
auaaaaagcccuuuccucauaa

SEQ ID NO: 482554 - RNA, 12 nt, Chlamydia trachomatis
auaaaaagcugg

SEQ ID NO: 482555 - RNA, 17 nt, Chlamydia trachomatis
auaaaacccucaaguuc

SEQ ID NO: 482556 - RNA, 16 nt, Chlamydia trachomatis
aguugguagaggagaa

SEQ ID NO: 482557 - RNA, 19 nt, Chlamydia trachomatis
aguuuucccaucuacaaaa

SEQ ID NO: 482558 - RNA, 21 nt, Chlamydia trachomatis
aguuuucgaauuuuuuucuuu

SEQ ID NO: 482559 - RNA, 19 nt, Chlamydia trachomatis
aguuuugaggaagaaaugu

SEQ ID NO: 482560 - RNA, 19 nt, Chlamydia trachomatis
aguuuuguaaaguaacuac

SEQ ID NO: 482561 - RNA, 22 nt, Chlamydia trachomatis
aguuuuucuccucucucuuuau

SEQ ID NO: 482562 - RNA, 16 nt, Chlamydia trachomatis
aguuuuuuuaaaagag

SEQ ID NO: 482563 - RNA, 23 nt, Chlamydia trachomatis
aguuuuuuucaggagaaaggcuu

SEQ ID NO: 482564 - RNA, 12 nt, Chlamydia trachomatis
auaaaaaagagg

SEQ ID NO: 482565 - RNA, 17 nt, Chlamydia trachomatis
auaaucuaaagacaaaa

SEQ ID NO: 482566 - RNA, 15 nt, Chlamydia trachomatis
auaaucuauuuuaua

SEQ ID NO: 482567 - RNA, 20 nt, Chlamydia trachomatis
auaauuaaaggcucuguuaa

SEQ ID NO: 482568 - RNA, 19 nt, Chlamydia trachomatis
auaauaugguaauggcugu

SEQ ID NO: 482569 - RNA, 16 nt, Chlamydia trachomatis
auaaucccaaaaacaa

SEQ ID NO: 482570 - RNA, 20 nt, Chlamydia trachomatis
auaaucccaaaaacaaucaa

SEQ ID NO: 482571 - RNA, 17 nt, Chlamydia trachomatis
auaaguaucguaaacaa

SEQ ID NO: 482572 - RNA, 15 nt, Chlamydia trachomatis
auaagucaaaagaau

SEQ ID NO: 482573 - RNA, 22 nt, Chlamydia trachomatis
auaaguccaucuaaagggagaa

SEQ ID NO: 482574 - RNA, 22 nt, Chlamydia trachomatis
auaauacuccaccuaggauagc

SEQ ID NO: 482575 - RNA, 14 nt, Chlamydia trachomatis
auaauacucuucua

SEQ ID NO: 482576 - RNA, 15 nt, Chlamydia trachomatis
auaauagagacaagu

SEQ ID NO: 482577 - RNA, 18 nt, Chlamydia trachomatis
auaauagcuugcacagca

SEQ ID NO: 482578 - RNA, 20 nt, Chlamydia trachomatis
auaauagcuugcacagcaag

SEQ ID NO: 482579 - RNA, 21 nt, Chlamydia trachomatis
auaauagcuugcacagcaagc

SEQ ID NO: 482580 - RNA, 15 nt, Chlamydia trachomatis
auaagccuuugcuau

SEQ ID NO: 482581 - RNA, 13 nt, Chlamydia trachomatis
auaagcgaaaaaa

SEQ ID NO: 482582 - RNA, 19 nt, Chlamydia trachomatis
auaagcacccuuucuuacu

SEQ ID NO: 482583 - RNA, 15 nt, Chlamydia trachomatis
auaagaucuuuacuu

SEQ ID NO: 482584 - RNA, 22 nt, Chlamydia trachomatis
auaagaucuuuacuuucuuugc

SEQ ID NO: 482585 - RNA, 19 nt, Chlamydia trachomatis
auaagggaaucauaaggaa

SEQ ID NO: 482586 - RNA, 17 nt, Chlamydia trachomatis
auaagguggcacacucc

SEQ ID NO: 482587 - RNA, 20 nt, Chlamydia trachomatis
auaagcugaaaaugcucuaa

SEQ ID NO: 482588 - RNA, 15 nt, Chlamydia trachomatis
auaaggaagcaaaaa

SEQ ID NO: 482589 - RNA, 17 nt, Chlamydia trachomatis
auaacgcccucuuuuca

SEQ ID NO: 482590 - RNA, 21 nt, Chlamydia trachomatis
auaacgauuccgaagcaugau

SEQ ID NO: 482591 - RNA, 22 nt, Chlamydia trachomatis
auaacgauccucuugagcauug

SEQ ID NO: 482592 - RNA, 20 nt, Chlamydia trachomatis
auaaauuucuaaauauuuau

SEQ ID NO: 482593 - RNA, 13 nt, Chlamydia trachomatis
auaacuccaaggg

SEQ ID NO: 482594 - RNA, 18 nt, Chlamydia trachomatis
auaacuuuuucucuugcu

SEQ ID NO: 482595 - RNA, 11 nt, Chlamydia trachomatis
auaagaaaaaa

SEQ ID NO: 482596 - RNA, 22 nt, Chlamydia trachomatis
auaagacuuugugcaaccucua

SEQ ID NO: 482597 - RNA, 15 nt, Chlamydia trachomatis
auaagaggcaccucu

SEQ ID NO: 482598 - RNA, 17 nt, Chlamydia trachomatis
auaagaggcaccucuuu

SEQ ID NO: 482599 - RNA, 19 nt, Chlamydia trachomatis
auaagaguugcaaguuggu

SEQ ID NO: 482600 - RNA, 11 nt, Chlamydia trachomatis
auacaucaucu

SEQ ID NO: 482601 - RNA, 17 nt, Chlamydia trachomatis
auacaucaucucucagc

SEQ ID NO: 482602 - RNA, 14 nt, Chlamydia trachomatis
auacauauaaugcc

SEQ ID NO: 482603 - RNA, 22 nt, Chlamydia trachomatis
auacaucacugcaacuaauauu

SEQ ID NO: 482604 - RNA, 12 nt, Chlamydia trachomatis
auaauuccaccu

SEQ ID NO: 482605 - RNA, 18 nt, Chlamydia trachomatis
auaauucucgcaaagaau

SEQ ID NO: 482606 - RNA, 19 nt, Chlamydia trachomatis
auacaguaaggcucucgca

SEQ ID NO: 482607 - RNA, 22 nt, Chlamydia trachomatis
auaccagcguaauaauuaagga

SEQ ID NO: 482608 - RNA, 11 nt, Chlamydia trachomatis
auaccaaagca

SEQ ID NO: 482609 - RNA, 16 nt, Chlamydia trachomatis
auaccaagcuuucugc

SEQ ID NO: 482610 - RNA, 17 nt, Chlamydia trachomatis
auaccaagccauuucca

SEQ ID NO: 482611 - RNA, 19 nt, Chlamydia trachomatis
auaccacaauuuuucuugu

SEQ ID NO: 482612 - RNA, 19 nt, Chlamydia trachomatis
auacccuaacgaggcacaa

SEQ ID NO: 482613 - RNA, 14 nt, Chlamydia trachomatis
auaccccaaauguu

SEQ ID NO: 482614 - RNA, 15 nt, Chlamydia trachomatis
auaccccaaauguug

SEQ ID NO: 482615 - RNA, 19 nt, Chlamydia trachomatis
auaccccuaaaggaaguag

SEQ ID NO: 482616 - RNA, 16 nt, Chlamydia trachomatis
auacccgacuaaaaaa

SEQ ID NO: 482617 - RNA, 22 nt, Chlamydia trachomatis
auacccaggguagcuguagcaa

SEQ ID NO: 482618 - RNA, 16 nt, Chlamydia trachomatis
auagaaggucugaaca

SEQ ID NO: 482619 - RNA, 18 nt, Chlamydia trachomatis
auagaauuuuucuaaaau

SEQ ID NO: 482620 - RNA, 20 nt, Chlamydia trachomatis
auagaauuuuucuaaaaucu

SEQ ID NO: 482621 - RNA, 12 nt, Chlamydia trachomatis
auagaaacuccg

SEQ ID NO: 482622 - RNA, 20 nt, Chlamydia trachomatis
auaccgaggauccuaaccaa

SEQ ID NO: 482623 - RNA, 20 nt, Chlamydia trachomatis
auacguuuaccgcucuucca

SEQ ID NO: 482624 - RNA, 20 nt, Chlamydia trachomatis
auacuaaacuaucuaaaauc

SEQ ID NO: 482625 - RNA, 14 nt, Chlamydia trachomatis
auacuaacaaauag

SEQ ID NO: 482626 - RNA, 21 nt, Chlamydia trachomatis
auacuacuaaggugaguuucc

SEQ ID NO: 482627 - RNA, 23 nt, Chlamydia trachomatis
auacugacccauccaaaacaucc

SEQ ID NO: 482628 - RNA, 20 nt, Chlamydia trachomatis
auaggaauccaacgcuugca

SEQ ID NO: 482629 - RNA, 19 nt, Chlamydia trachomatis
auaggaauacgaaaugaca

SEQ ID NO: 482630 - RNA, 20 nt, Chlamydia trachomatis
auaggaauacgaaaugacac

SEQ ID NO: 482631 - RNA, 12 nt, Chlamydia trachomatis
auaggaauagcc

SEQ ID NO: 482632 - RNA, 17 nt, Chlamydia trachomatis
auagcuuaucuaggcuu

SEQ ID NO: 482633 - RNA, 19 nt, Chlamydia trachomatis
auagcuucuuaaauauaua

SEQ ID NO: 482634 - RNA, 14 nt, Chlamydia trachomatis
auagcuugcacagc

SEQ ID NO: 482635 - RNA, 19 nt, Chlamydia trachomatis
auagagccccuauguaaac

SEQ ID NO: 482636 - RNA, 22 nt, Chlamydia trachomatis
auagagauaucaaucguagaaa

SEQ ID NO: 482637 - RNA, 16 nt, Chlamydia trachomatis
auagccauuaacaaca

SEQ ID NO: 482638 - RNA, 17 nt, Chlamydia trachomatis
auagccauuaacaacaa

SEQ ID NO: 482639 - RNA, 23 nt, Chlamydia trachomatis
auagcgcaguuuacugcaauaag

SEQ ID NO: 482640 - RNA, 16 nt, Chlamydia trachomatis
auaggcaggagaccac

SEQ ID NO: 482641 - RNA, 16 nt, Chlamydia trachomatis
auaggcccguuuuuag

SEQ ID NO: 482642 - RNA, 21 nt, Chlamydia trachomatis
auaggcuccugcaagggaaca

SEQ ID NO: 482643 - RNA, 16 nt, Chlamydia trachomatis
auaggcuuccaaaucu

SEQ ID NO: 482644 - RNA, 17 nt, Chlamydia trachomatis
auagguaugugcucauu

SEQ ID NO: 482645 - RNA, 18 nt, Chlamydia trachomatis
auagguagaaaaggauag

SEQ ID NO: 482646 - RNA, 17 nt, Chlamydia trachomatis
auagguucgugugacug

SEQ ID NO: 482647 - RNA, 14 nt, Chlamydia trachomatis
auaguaaaaacuau

SEQ ID NO: 482648 - RNA, 16 nt, Chlamydia trachomatis
auaguaacggaacucu

SEQ ID NO: 482649 - RNA, 15 nt, Chlamydia trachomatis
auaguacaaguauau

SEQ ID NO: 482650 - RNA, 16 nt, Chlamydia trachomatis
auaguaccauaauccu

SEQ ID NO: 482651 - RNA, 19 nt, Chlamydia trachomatis
auaguauaacgauuaucca

SEQ ID NO: 482652 - RNA, 22 nt, Chlamydia trachomatis
auaguauuacggaaaagcuuuu

SEQ ID NO: 482653 - RNA, 13 nt, Chlamydia trachomatis
auaguauuuuuga

SEQ ID NO: 482654 - RNA, 19 nt, Chlamydia trachomatis
auagucccuaccuucagca

SEQ ID NO: 482655 - RNA, 12 nt, Chlamydia trachomatis
auagucucccaa

SEQ ID NO: 482656 - RNA, 22 nt, Chlamydia trachomatis
auagucugcauuaaacacuagc

SEQ ID NO: 482657 - RNA, 21 nt, Chlamydia trachomatis
auagucugggcgaucuccuuc

SEQ ID NO: 482658 - RNA, 19 nt, Chlamydia trachomatis
auaguguaaggagagaaaa

SEQ ID NO: 482659 - RNA, 20 nt, Chlamydia trachomatis
auaguguaaggagagaaaag

SEQ ID NO: 482660 - RNA, 19 nt, Chlamydia trachomatis
auaguuacauacuuuucuc

SEQ ID NO: 482661 - RNA, 15 nt, Chlamydia trachomatis
auauagcauggaaga

SEQ ID NO: 482662 - RNA, 21 nt, Chlamydia trachomatis
auauagccacgauaagaucuu

SEQ ID NO: 482663 - RNA, 20 nt, Chlamydia trachomatis
auauagucgaguuuugagga

SEQ ID NO: 482664 - RNA, 15 nt, Chlamydia trachomatis
auauccguaaggaag

SEQ ID NO: 482665 - RNA, 14 nt, Chlamydia trachomatis
auauccuccaaaga

SEQ ID NO: 482666 - RNA, 18 nt, Chlamydia trachomatis
auaucacuaccagcccca

SEQ ID NO: 482667 - RNA, 18 nt, Chlamydia trachomatis
auauauucagaagaagag

SEQ ID NO: 482668 - RNA, 19 nt, Chlamydia trachomatis
auaucaacguuuucacuag

SEQ ID NO: 482669 - RNA, 13 nt, Chlamydia trachomatis
auaucaagaauuu

SEQ ID NO: 482670 - RNA, 14 nt, Chlamydia trachomatis
auauuaguuaguga

SEQ ID NO: 482671 - RNA, 17 nt, Chlamydia trachomatis
auauuaguuagugaagu

SEQ ID NO: 482672 - RNA, 19 nt, Chlamydia trachomatis
auauuauuuacgagagggu

SEQ ID NO: 482673 - RNA, 15 nt, Chlamydia trachomatis
auauuaagauccauu

SEQ ID NO: 482674 - RNA, 19 nt, Chlamydia trachomatis
auaugugccucuaggcaua

SEQ ID NO: 482675 - RNA, 18 nt, Chlamydia trachomatis
auauggcucccagagaau

SEQ ID NO: 482676 - RNA, 14 nt, Chlamydia trachomatis
auauguaagaagcu

SEQ ID NO: 482677 - RNA, 23 nt, Chlamydia trachomatis
auauccugaaccgcgcgaaaauu

SEQ ID NO: 482678 - RNA, 23 nt, Chlamydia trachomatis
auaugcucuuucccgauauguuc

SEQ ID NO: 482679 - RNA, 16 nt, Chlamydia trachomatis
auaugcuuuuuaauau

SEQ ID NO: 482680 - RNA, 19 nt, Chlamydia trachomatis
auaugcuuuuuaauauccu

SEQ ID NO: 482681 - RNA, 19 nt, Chlamydia trachomatis
auauggaagaacagcagca

SEQ ID NO: 482682 - RNA, 17 nt, Chlamydia trachomatis
auauggacaagcaauag

SEQ ID NO: 482683 - RNA, 21 nt, Chlamydia trachomatis
auauggacuucccuaauacaa

SEQ ID NO: 482684 - RNA, 23 nt, Chlamydia trachomatis
auauggacuucccuaauacaauc

SEQ ID NO: 482685 - RNA, 19 nt, Chlamydia trachomatis
aucaaccaggucacauuuu

SEQ ID NO: 482686 - RNA, 20 nt, Chlamydia trachomatis
aucaaauuuuucagaaaaag

SEQ ID NO: 482687 - RNA, 19 nt, Chlamydia trachomatis
aucaaagaaucuuugucuu

SEQ ID NO: 482688 - RNA, 15 nt, Chlamydia trachomatis
aucaaagacuucacu

SEQ ID NO: 482689 - RNA, 17 nt, Chlamydia trachomatis
aucaaagagugugcuuc

SEQ ID NO: 482690 - RNA, 19 nt, Chlamydia trachomatis
aucaaagagugugcuucug

SEQ ID NO: 482691 - RNA, 13 nt, Chlamydia trachomatis
aucaaagaucuuu

SEQ ID NO: 482692 - RNA, 18 nt, Chlamydia trachomatis
aucaaagaucuuucuaca

SEQ ID NO: 482693 - RNA, 20 nt, Chlamydia trachomatis
aucaaagaucuuucuacauu

SEQ ID NO: 482694 - RNA, 20 nt, Chlamydia trachomatis
aucaaaggaugucuaucuag

SEQ ID NO: 482695 - RNA, 20 nt, Chlamydia trachomatis
aucaaaguacgccucuuuug

SEQ ID NO: 482696 - RNA, 16 nt, Chlamydia trachomatis
aucaaaguagcaauca

SEQ ID NO: 482697 - RNA, 13 nt, Chlamydia trachomatis
aucaaaaaguucu

SEQ ID NO: 482698 - RNA, 20 nt, Chlamydia trachomatis
auauuucuuguguugaauaa

SEQ ID NO: 482699 - RNA, 13 nt, Chlamydia trachomatis
auauucuuuucca

SEQ ID NO: 482700 - RNA, 15 nt, Chlamydia trachomatis
aucacagauaaucag

SEQ ID NO: 482701 - RNA, 18 nt, Chlamydia trachomatis
aucacagcaauagccauu

SEQ ID NO: 482702 - RNA, 23 nt, Chlamydia trachomatis
aucacagcaauagccauuaacaa

SEQ ID NO: 482703 - RNA, 14 nt, Chlamydia trachomatis
aucacagaaacuuc

SEQ ID NO: 482704 - RNA, 14 nt, Chlamydia trachomatis
aucacaugguuuuc

SEQ ID NO: 482705 - RNA, 22 nt, Chlamydia trachomatis
aucacauucuuagauuuucaug

SEQ ID NO: 482706 - RNA, 21 nt, Chlamydia trachomatis
aucaauuguucugcgaaagaa

SEQ ID NO: 482707 - RNA, 23 nt, Chlamydia trachomatis
aucaauuguucugcgaaagaaac

SEQ ID NO: 482708 - RNA, 19 nt, Chlamydia trachomatis
aucacaaugcguagucucu

SEQ ID NO: 482709 - RNA, 14 nt, Chlamydia trachomatis
aucacaauuuuucu

SEQ ID NO: 482710 - RNA, 23 nt, Chlamydia trachomatis
aucacaauuuuucuuugagaaag

SEQ ID NO: 482711 - RNA, 16 nt, Chlamydia trachomatis
aucaccgaacaaccuu

SEQ ID NO: 482712 - RNA, 19 nt, Chlamydia trachomatis
aucacuaucugcaaaagca

SEQ ID NO: 482713 - RNA, 15 nt, Chlamydia trachomatis
aucacuccaagaaga

SEQ ID NO: 482714 - RNA, 23 nt, Chlamydia trachomatis
aucacugagaggaguuuuuuuca

SEQ ID NO: 482715 - RNA, 15 nt, Chlamydia trachomatis
aucacugcaacuaau

SEQ ID NO: 482716 - RNA, 19 nt, Chlamydia trachomatis
aucacugcaacuaauauua

SEQ ID NO: 482717 - RNA, 20 nt, Chlamydia trachomatis
aucacugcaacuaauauuag

SEQ ID NO: 482718 - RNA, 20 nt, Chlamydia trachomatis
aucagaaguugagcaacuau

SEQ ID NO: 482719 - RNA, 17 nt, Chlamydia trachomatis
aucacuguugagaaaaa

SEQ ID NO: 482720 - RNA, 20 nt, Chlamydia trachomatis
aucagcacagcggacaauag

SEQ ID NO: 482721 - RNA, 23 nt, Chlamydia trachomatis
aucagcacagcggacaauaggag

SEQ ID NO: 482722 - RNA, 16 nt, Chlamydia trachomatis
aucaggaucagcaugu

SEQ ID NO: 482723 - RNA, 17 nt, Chlamydia trachomatis
aucagcgucaucuuuga

SEQ ID NO: 482724 - RNA, 17 nt, Chlamydia trachomatis
aucagcgaaguuuucuu

SEQ ID NO: 482725 - RNA, 14 nt, Chlamydia trachomatis
aucagccccaaaaa

SEQ ID NO: 482726 - RNA, 22 nt, Chlamydia trachomatis
aucagccccaaaaacagcagaa

SEQ ID NO: 482727 - RNA, 14 nt, Chlamydia trachomatis
aucagucgcucugc

SEQ ID NO: 482728 - RNA, 15 nt, Chlamydia trachomatis
aaaacgaaaaacaga

SEQ ID NO: 482729 - RNA, 14 nt, Chlamydia trachomatis
aucaguaaacacuu

SEQ ID NO: 482730 - RNA, 24 nt, Chlamydia trachomatis
aucaucucucagcagaucauccau

SEQ ID NO: 482731 - RNA, 20 nt, Chlamydia trachomatis
aucaucucaagucuccacug

SEQ ID NO: 482732 - RNA, 17 nt, Chlamydia trachomatis
aucaucuucaagagcug

SEQ ID NO: 482733 - RNA, 18 nt, Chlamydia trachomatis
aucaucuucaagagcugu

SEQ ID NO: 482734 - RNA, 19 nt, Chlamydia trachomatis
aucaucuucccaagacuca

SEQ ID NO: 482735 - RNA, 15 nt, Chlamydia trachomatis
aucauagaaaugaug

SEQ ID NO: 482736 - RNA, 23 nt, Chlamydia trachomatis
aaaacuccaagcacuugaucuau

SEQ ID NO: 482737 - RNA, 15 nt, Chlamydia trachomatis
aaaacuccagaaaau

SEQ ID NO: 482738 - RNA, 16 nt, Chlamydia trachomatis
aucaugggaaauaaau

SEQ ID NO: 482739 - RNA, 18 nt, Chlamydia trachomatis
aucaugggaaauaaauaa

SEQ ID NO: 482740 - RNA, 23 nt, Chlamydia trachomatis
aaaagaacucccuccaaaaaaga

SEQ ID NO: 482741 - RNA, 13 nt, Chlamydia trachomatis
aaaagaacuuccu

SEQ ID NO: 482742 - RNA, 19 nt, Chlamydia trachomatis
aaaagaagcuaauagcuug

SEQ ID NO: 482743 - RNA, 21 nt, Chlamydia trachomatis
aucauugggucugauccacca

SEQ ID NO: 482744 - RNA, 14 nt, Chlamydia trachomatis
auccagagcugugu

SEQ ID NO: 482745 - RNA, 18 nt, Chlamydia trachomatis
auccagcucgaucaauaa

SEQ ID NO: 482746 - RNA, 15 nt, Chlamydia trachomatis
auccaucauaaaaag

SEQ ID NO: 482747 - RNA, 16 nt, Chlamydia trachomatis
auccaucauaaaaaga

SEQ ID NO: 482748 - RNA, 18 nt, Chlamydia trachomatis
auccauaacgaagauuaa

SEQ ID NO: 482749 - RNA, 16 nt, Chlamydia trachomatis
auccagcugcugccca

SEQ ID NO: 482750 - RNA, 22 nt, Chlamydia trachomatis
auccagcugcugcccaagagau

SEQ ID NO: 482751 - RNA, 20 nt, Chlamydia trachomatis
auccaguucuggagcaacaa

SEQ ID NO: 482752 - RNA, 21 nt, Chlamydia trachomatis
auccccaaaccaguuucuucu

SEQ ID NO: 482753 - RNA, 16 nt, Chlamydia trachomatis
auccccagaagccaua

SEQ ID NO: 482754 - RNA, 19 nt, Chlamydia trachomatis
auccaugaggcuccgccuu

SEQ ID NO: 482755 - RNA, 14 nt, Chlamydia trachomatis
aucccaaaaacaau

SEQ ID NO: 482756 - RNA, 15 nt, Chlamydia trachomatis
aucccaaaagaauga

SEQ ID NO: 482757 - RNA, 19 nt, Chlamydia trachomatis
aucccaaagcuuuacugaa

SEQ ID NO: 482758 - RNA, 15 nt, Chlamydia trachomatis
aucccaacaggagau

SEQ ID NO: 482759 - RNA, 13 nt, Chlamydia trachomatis
aucccaaggaaau

SEQ ID NO: 482760 - RNA, 17 nt, Chlamydia trachomatis
auccccaucucuuuugu

SEQ ID NO: 482761 - RNA, 18 nt, Chlamydia trachomatis
auccccaucucuuuuguu

SEQ ID NO: 482762 - RNA, 14 nt, Chlamydia trachomatis
auccguaaggaagc

SEQ ID NO: 482763 - RNA, 17 nt, Chlamydia trachomatis
auccguaugauaaaacu

SEQ ID NO: 482764 - RNA, 15 nt, Chlamydia trachomatis
auccuaacuaaaaag

SEQ ID NO: 482765 - RNA, 23 nt, Chlamydia trachomatis
auccucaaaaaaggcauaaaaga

SEQ ID NO: 482766 - RNA, 15 nt, Chlamydia trachomatis
auccuccauaguuac

SEQ ID NO: 482767 - RNA, 16 nt, Chlamydia trachomatis
auccucuuugaauauc

SEQ ID NO: 482768 - RNA, 17 nt, Chlamydia trachomatis
auccugaacccgcugcu

SEQ ID NO: 482769 - RNA, 11 nt, Chlamydia trachomatis
auccuguucuc

SEQ ID NO: 482770 - RNA, 12 nt, Chlamydia trachomatis
auccuuaaacuc

SEQ ID NO: 482771 - RNA, 21 nt, Chlamydia trachomatis
auccuuaguuagcugaaaugu

SEQ ID NO: 482772 - RNA, 17 nt, Chlamydia trachomatis
auccuuucgucacagau

SEQ ID NO: 482773 - RNA, 17 nt, Chlamydia trachomatis
auccuuuucagaauuac

SEQ ID NO: 482774 - RNA, 14 nt, Chlamydia trachomatis
auccuuuuuccuua

SEQ ID NO: 482775 - RNA, 15 nt, Chlamydia trachomatis
aucgaaaacaaagag

SEQ ID NO: 482776 - RNA, 12 nt, Chlamydia trachomatis
aucgagagaggg

SEQ ID NO: 482777 - RNA, 19 nt, Chlamydia trachomatis
aucgaugauaucuucugaa

SEQ ID NO: 482778 - RNA, 17 nt, Chlamydia trachomatis
aucgcagcugaucgaua

SEQ ID NO: 482779 - RNA, 18 nt, Chlamydia trachomatis
aucgcagcuucggaagga

SEQ ID NO: 482780 - RNA, 15 nt, Chlamydia trachomatis
aucgcaccauuuaau

SEQ ID NO: 482781 - RNA, 14 nt, Chlamydia trachomatis
aucgccgguuaaca

SEQ ID NO: 482782 - RNA, 18 nt, Chlamydia trachomatis
aucgccgguuaacacaau

SEQ ID NO: 482783 - RNA, 18 nt, Chlamydia trachomatis
aucgcugacggauccugc

SEQ ID NO: 482784 - RNA, 13 nt, Chlamydia trachomatis
aucggagucugcu

SEQ ID NO: 482785 - RNA, 20 nt, Chlamydia trachomatis
aucgugagcgucuuuucaca

SEQ ID NO: 482786 - RNA, 16 nt, Chlamydia trachomatis
aucguuagcaucaucc

SEQ ID NO: 482787 - RNA, 20 nt, Chlamydia trachomatis
aucuaaaaaaauucuugcca

SEQ ID NO: 482788 - RNA, 13 nt, Chlamydia trachomatis
aucuaaaaagcca

SEQ ID NO: 482789 - RNA, 11 nt, Chlamydia trachomatis
aucuaaaaagg

SEQ ID NO: 482790 - RNA, 20 nt, Chlamydia trachomatis
aucuaaaagaguuucuuugu

SEQ ID NO: 482791 - RNA, 16 nt, Chlamydia trachomatis
aucuaaaauaucaucc

SEQ ID NO: 482792 - RNA, 21 nt, Chlamydia trachomatis
aucuaaagacaaaacuucuuc

SEQ ID NO: 482793 - RNA, 15 nt, Chlamydia trachomatis
aucuaauucuagcaa

SEQ ID NO: 482794 - RNA, 14 nt, Chlamydia trachomatis
aucuaccuuuuucc

SEQ ID NO: 482795 - RNA, 15 nt, Chlamydia trachomatis
aucuaccuuuuuccc

SEQ ID NO: 482796 - RNA, 15 nt, Chlamydia trachomatis
aucugcaucuuuaua

SEQ ID NO: 482797 - RNA, 18 nt, Chlamydia trachomatis
aucugcaucuuuauagaa

SEQ ID NO: 482798 - RNA, 18 nt, Chlamydia trachomatis
aucugaugcaccauaaua

SEQ ID NO: 482799 - RNA, 19 nt, Chlamydia trachomatis
aucucuuggagagaaugaa

SEQ ID NO: 482800 - RNA, 13 nt, Chlamydia trachomatis
aucugagaaagcu

SEQ ID NO: 482801 - RNA, 14 nt, Chlamydia trachomatis
aucuggaguggcau

SEQ ID NO: 482802 - RNA, 23 nt, Chlamydia trachomatis
aucugcuuccguaacaauauuac

SEQ ID NO: 482803 - RNA, 14 nt, Chlamydia trachomatis
aucucgguauucuc

SEQ ID NO: 482804 - RNA, 13 nt, Chlamydia trachomatis
aucucucagcaga

SEQ ID NO: 482805 - RNA, 16 nt, Chlamydia trachomatis
aucucucagcagauca

SEQ ID NO: 482806 - RNA, 16 nt, Chlamydia trachomatis
aucuccgcuaggcaaa

SEQ ID NO: 482807 - RNA, 23 nt, Chlamydia trachomatis
aucuccgcuaggcaaauauccua

SEQ ID NO: 482808 - RNA, 19 nt, Chlamydia trachomatis
aucucccucaccucuugcc

SEQ ID NO: 482809 - RNA, 12 nt, Chlamydia trachomatis
aucucccgaaac

SEQ ID NO: 482810 - RNA, 15 nt, Chlamydia trachomatis
aucucccgaaacauu

SEQ ID NO: 482811 - RNA, 22 nt, Chlamydia trachomatis
aucucaaugagcgcuuuuucuu

SEQ ID NO: 482812 - RNA, 18 nt, Chlamydia trachomatis
aucuccaugauccccuac

SEQ ID NO: 482813 - RNA, 18 nt, Chlamydia trachomatis
aucuauuuuauacuucuu

SEQ ID NO: 482814 - RNA, 19 nt, Chlamydia trachomatis
aucuauuuuauacuucuua

SEQ ID NO: 482815 - RNA, 15 nt, Chlamydia trachomatis
aucucaaaaacacua

SEQ ID NO: 482816 - RNA, 14 nt, Chlamydia trachomatis
aucuguucagaacu

SEQ ID NO: 482817 - RNA, 19 nt, Chlamydia trachomatis
aucuguuagugaagagcag

SEQ ID NO: 482818 - RNA, 22 nt, Chlamydia trachomatis
aucugucuaagauuuucaucuu

SEQ ID NO: 482819 - RNA, 13 nt, Chlamydia trachomatis
aucuguaaagcuu

SEQ ID NO: 482820 - RNA, 17 nt, Chlamydia trachomatis
aucuucugaaaaaucaa

SEQ ID NO: 482821 - RNA, 15 nt, Chlamydia trachomatis
aucuugagagaccug

SEQ ID NO: 482822 - RNA, 18 nt, Chlamydia trachomatis
aucuucugggcuuucuac

SEQ ID NO: 482823 - RNA, 23 nt, Chlamydia trachomatis
aucuucugggcuuucuacauggc

SEQ ID NO: 482824 - RNA, 13 nt, Chlamydia trachomatis
aucuucuuauaca

SEQ ID NO: 482825 - RNA, 19 nt, Chlamydia trachomatis
aucuucuuauacagcaugc

SEQ ID NO: 482826 - RNA, 20 nt, Chlamydia trachomatis
aucuucuucuaagcuagaaa

SEQ ID NO: 482827 - RNA, 17 nt, Chlamydia trachomatis
aucuugaucugaaaaga

SEQ ID NO: 482828 - RNA, 16 nt, Chlamydia trachomatis
aucuugcacauuuucu

SEQ ID NO: 482829 - RNA, 17 nt, Chlamydia trachomatis
aucuugaggacgagugu

SEQ ID NO: 482830 - RNA, 19 nt, Chlamydia trachomatis
aucuugguuauacagagca

SEQ ID NO: 482831 - RNA, 14 nt, Chlamydia trachomatis
aucuuguguaguau

SEQ ID NO: 482832 - RNA, 13 nt, Chlamydia trachomatis
aucuuuaagcucu

SEQ ID NO: 482833 - RNA, 16 nt, Chlamydia trachomatis
aucuuuagaauccaaa

SEQ ID NO: 482834 - RNA, 19 nt, Chlamydia trachomatis
aucuuuauagaauuuuucu

SEQ ID NO: 482835 - RNA, 21 nt, Chlamydia trachomatis
aucuuugaagguaagaaaguc

SEQ ID NO: 482836 - RNA, 16 nt, Chlamydia trachomatis
augacaacuacaacaa

SEQ ID NO: 482837 - RNA, 19 nt, Chlamydia trachomatis
augaagacccguuuucucu

SEQ ID NO: 482838 - RNA, 22 nt, Chlamydia trachomatis
augaagaaguuuacgaacaaga

SEQ ID NO: 482839 - RNA, 17 nt, Chlamydia trachomatis
augaagaaucucugggg

SEQ ID NO: 482840 - RNA, 14 nt, Chlamydia trachomatis
augaaagagcuuag

SEQ ID NO: 482841 - RNA, 13 nt, Chlamydia trachomatis
augaaagcgugca

SEQ ID NO: 482842 - RNA, 14 nt, Chlamydia trachomatis
augaaacaccucuc

SEQ ID NO: 482843 - RNA, 21 nt, Chlamydia trachomatis
augaaaccuaauagaaauagc

SEQ ID NO: 482844 - RNA, 23 nt, Chlamydia trachomatis
augaaacucuuuuuaaaucaauu

SEQ ID NO: 482845 - RNA, 21 nt, Chlamydia trachomatis
augacgagugccgaaggggau

SEQ ID NO: 482846 - RNA, 15 nt, Chlamydia trachomatis
augagaaauaaaaac

SEQ ID NO: 482847 - RNA, 12 nt, Chlamydia trachomatis
augagaagaaag

SEQ ID NO: 482848 - RNA, 22 nt, Chlamydia trachomatis
augagaaucgcuaugacaggcc

SEQ ID NO: 482849 - RNA, 13 nt, Chlamydia trachomatis
augagagaaaagg

SEQ ID NO: 482850 - RNA, 13 nt, Chlamydia trachomatis
augaccaguuugu

SEQ ID NO: 482851 - RNA, 15 nt, Chlamydia trachomatis
augaugaaaaagaag

SEQ ID NO: 482852 - RNA, 19 nt, Chlamydia trachomatis
augaucuuuccaauaucuu

SEQ ID NO: 482853 - RNA, 20 nt, Chlamydia trachomatis
augaucuuuccaauaucuuc

SEQ ID NO: 482854 - RNA, 22 nt, Chlamydia trachomatis
augaucuucaccccuuacaaug

SEQ ID NO: 482855 - RNA, 23 nt, Chlamydia trachomatis
augaucuucaccccuuacaaugu

SEQ ID NO: 482856 - RNA, 17 nt, Chlamydia trachomatis
augaucucgauaagcuc

SEQ ID NO: 482857 - RNA, 13 nt, Chlamydia trachomatis
augaugagaaugu

SEQ ID NO: 482858 - RNA, 15 nt, Chlamydia trachomatis
augaugagagcagcu

SEQ ID NO: 482859 - RNA, 14 nt, Chlamydia trachomatis
augauguccaaagc

SEQ ID NO: 482860 - RNA, 17 nt, Chlamydia trachomatis
augauguccaaagcucu

SEQ ID NO: 482861 - RNA, 15 nt, Chlamydia trachomatis
augauuaauucuagg

SEQ ID NO: 482862 - RNA, 14 nt, Chlamydia trachomatis
augauugauaaagc

SEQ ID NO: 482863 - RNA, 14 nt, Chlamydia trachomatis
augcaauugauucc

SEQ ID NO: 482864 - RNA, 17 nt, Chlamydia trachomatis
augcaaguaaugacacu

SEQ ID NO: 482865 - RNA, 15 nt, Chlamydia trachomatis
augcaaaacauaaca

SEQ ID NO: 482866 - RNA, 23 nt, Chlamydia trachomatis
augcaaaaagagcauaauauccc

SEQ ID NO: 482867 - RNA, 23 nt, Chlamydia trachomatis
augcaaauuugcagaagcuccaa

SEQ ID NO: 482868 - RNA, 15 nt, Chlamydia trachomatis
augcaacaacauaau

SEQ ID NO: 482869 - RNA, 17 nt, Chlamydia trachomatis
augcagaucauaucugc

SEQ ID NO: 482870 - RNA, 13 nt, Chlamydia trachomatis
augcagaugaaga

SEQ ID NO: 482871 - RNA, 16 nt, Chlamydia trachomatis
augccgcccaaggaaa

SEQ ID NO: 482872 - RNA, 17 nt, Chlamydia trachomatis
augccgcagaaaaaacc

SEQ ID NO: 482873 - RNA, 14 nt, Chlamydia trachomatis
augccauccagagc

SEQ ID NO: 482874 - RNA, 19 nt, Chlamydia trachomatis
augccauccauaacgaaga

SEQ ID NO: 482875 - RNA, 21 nt, Chlamydia trachomatis
augccauccauaacgaagauu

SEQ ID NO: 482876 - RNA, 18 nt, Chlamydia trachomatis
augccugcaaaaaggcuu

SEQ ID NO: 482877 - RNA, 18 nt, Chlamydia trachomatis
augccuuuugcacaaagg

SEQ ID NO: 482878 - RNA, 21 nt, Chlamydia trachomatis
augccuuuugcacaaaggaac

SEQ ID NO: 482879 - RNA, 22 nt, Chlamydia trachomatis
augccuuuuguuuucaaaagcu

SEQ ID NO: 482880 - RNA, 15 nt, Chlamydia trachomatis
augcgcccaucaaua

SEQ ID NO: 482881 - RNA, 15 nt, Chlamydia trachomatis
augcgcggaaggaaa

SEQ ID NO: 482882 - RNA, 17 nt, Chlamydia trachomatis
augcuccgagauuuuca

SEQ ID NO: 482883 - RNA, 23 nt, Chlamydia trachomatis
augcugcgcggaauaagucugcc

SEQ ID NO: 482884 - RNA, 16 nt, Chlamydia trachomatis
augcuuguucucguau

SEQ ID NO: 482885 - RNA, 18 nt, Chlamydia trachomatis
augcugugacuccuucuc

SEQ ID NO: 482886 - RNA, 18 nt, Chlamydia trachomatis
augcuguuucaggcauaa

SEQ ID NO: 482887 - RNA, 13 nt, Chlamydia trachomatis
auggaagaacagc

SEQ ID NO: 482888 - RNA, 15 nt, Chlamydia trachomatis
auggaaauaaaaagc

SEQ ID NO: 482889 - RNA, 15 nt, Chlamydia trachomatis
auggaaauaagagag

SEQ ID NO: 482890 - RNA, 22 nt, Chlamydia trachomatis
augcuuuuuaauauccuccaaa

SEQ ID NO: 482891 - RNA, 22 nt, Chlamydia trachomatis
auggagcagcauucguguguag

SEQ ID NO: 482892 - RNA, 18 nt, Chlamydia trachomatis
auggagauugcaacucuu

SEQ ID NO: 482893 - RNA, 16 nt, Chlamydia trachomatis
auggacaagcaauagc

SEQ ID NO: 482894 - RNA, 15 nt, Chlamydia trachomatis
auggcagacaaaaca

SEQ ID NO: 482895 - RNA, 19 nt, Chlamydia trachomatis
augggcugcaucagcaaga

SEQ ID NO: 482896 - RNA, 19 nt, Chlamydia trachomatis
auggugcggagcaucccac

SEQ ID NO: 482897 - RNA, 17 nt, Chlamydia trachomatis
auggugacgaauccaga

SEQ ID NO: 482898 - RNA, 14 nt, Chlamydia trachomatis
augguauagaagac

SEQ ID NO: 482899 - RNA, 20 nt, Chlamydia trachomatis
auguaaacguauagcaaugc

SEQ ID NO: 482900 - RNA, 22 nt, Chlamydia trachomatis
auguaaacaauauucuuuucca

SEQ ID NO: 482901 - RNA, 23 nt, Chlamydia trachomatis
auguaaauuuucaauagcaauga

SEQ ID NO: 482902 - RNA, 21 nt, Chlamydia trachomatis
auguaacacggccauuauaaa

SEQ ID NO: 482903 - RNA, 16 nt, Chlamydia trachomatis
auuaucuccuaagaca

SEQ ID NO: 482904 - RNA, 13 nt, Chlamydia trachomatis
auuaucuaaaaaa

SEQ ID NO: 482905 - RNA, 15 nt, Chlamydia trachomatis
auuaucuagaaaaga

SEQ ID NO: 482906 - RNA, 16 nt, Chlamydia trachomatis
auuaucuagaaaagag

SEQ ID NO: 482907 - RNA, 17 nt, Chlamydia trachomatis
auuaucuagaaaagagc

SEQ ID NO: 482908 - RNA, 19 nt, Chlamydia trachomatis
auuaucuagaaaagagcag

SEQ ID NO: 482909 - RNA, 22 nt, Chlamydia trachomatis
auuauuaacaggaagaauauca

SEQ ID NO: 482910 - RNA, 14 nt, Chlamydia trachomatis
auuagucgugugaa

SEQ ID NO: 482911 - RNA, 16 nt, Chlamydia trachomatis
auuaguuagugaaguc

SEQ ID NO: 482912 - RNA, 13 nt, Chlamydia trachomatis
auuaguucguuau

SEQ ID NO: 482913 - RNA, 14 nt, Chlamydia trachomatis
auuauauaaagccc

SEQ ID NO: 482914 - RNA, 18 nt, Chlamydia trachomatis
auuaucgccaaaaaucau

SEQ ID NO: 482915 - RNA, 14 nt, Chlamydia trachomatis
auucaaaagcuauc

SEQ ID NO: 482916 - RNA, 18 nt, Chlamydia trachomatis
auucaacuggucuuccag

SEQ ID NO: 482917 - RNA, 17 nt, Chlamydia trachomatis
auucaagaccaaaagua

SEQ ID NO: 482918 - RNA, 20 nt, Chlamydia trachomatis
auucaagguuuuaagaccua

SEQ ID NO: 482919 - RNA, 20 nt, Chlamydia trachomatis
aaaagcgaggcuucaaagaa

SEQ ID NO: 482920 - RNA, 21 nt, Chlamydia trachomatis
aaaagcgaggcuucaaagaac

SEQ ID NO: 482921 - RNA, 18 nt, Chlamydia trachomatis
aaaagccucgcaaaagcg

SEQ ID NO: 482922 - RNA, 20 nt, Chlamydia trachomatis
aaaagccucgcaaaagcgag

SEQ ID NO: 482923 - RNA, 13 nt, Chlamydia trachomatis
auuacuucagcaa

SEQ ID NO: 482924 - RNA, 16 nt, Chlamydia trachomatis
auuacuugagaacaaa

SEQ ID NO: 482925 - RNA, 13 nt, Chlamydia trachomatis
auuacuuuuucua

SEQ ID NO: 482926 - RNA, 20 nt, Chlamydia trachomatis
auuacuuuuucuacuuuccc

SEQ ID NO: 482927 - RNA, 21 nt, Chlamydia trachomatis
auuagaacggcauucccauuu

SEQ ID NO: 482928 - RNA, 15 nt, Chlamydia trachomatis
aaaagcccagaacaa

SEQ ID NO: 482929 - RNA, 16 nt, Chlamydia trachomatis
aaaagcccagaacaac

SEQ ID NO: 482930 - RNA, 23 nt, Chlamydia trachomatis
aaaagcccagaacaacuucucuu

SEQ ID NO: 482931 - RNA, 18 nt, Chlamydia trachomatis
auuaauaccaaggauagg

SEQ ID NO: 482932 - RNA, 16 nt, Chlamydia trachomatis
auuacauugcaguaca

SEQ ID NO: 482933 - RNA, 20 nt, Chlamydia trachomatis
auuacauugcaguacaucug

SEQ ID NO: 482934 - RNA, 23 nt, Chlamydia trachomatis
auuacucguuaucuaggaagaag

SEQ ID NO: 482935 - RNA, 22 nt, Chlamydia trachomatis
augugaugcggagcgaugagcu

SEQ ID NO: 482936 - RNA, 19 nt, Chlamydia trachomatis
auguggguaugucugugau

SEQ ID NO: 482937 - RNA, 20 nt, Chlamydia trachomatis
augugugguuguagaggaga

SEQ ID NO: 482938 - RNA, 16 nt, Chlamydia trachomatis
auguuaacaucuuccc

SEQ ID NO: 482939 - RNA, 14 nt, Chlamydia trachomatis
auguuccaucuuuu

SEQ ID NO: 482940 - RNA, 14 nt, Chlamydia trachomatis
auguuccccauuca

SEQ ID NO: 482941 - RNA, 22 nt, Chlamydia trachomatis
auguuccucguuuuuuuagaua

SEQ ID NO: 482942 - RNA, 19 nt, Chlamydia trachomatis
auguucugugggauagaaa

SEQ ID NO: 482943 - RNA, 22 nt, Chlamydia trachomatis
auguucugugggauagaaacuc

SEQ ID NO: 482944 - RNA, 19 nt, Chlamydia trachomatis
auguuugaucugagaaagc

SEQ ID NO: 482945 - RNA, 23 nt, Chlamydia trachomatis
auuaaaaaggcuagagauaucac

SEQ ID NO: 482946 - RNA, 16 nt, Chlamydia trachomatis
auuaaaacaauaguga

SEQ ID NO: 482947 - RNA, 17 nt, Chlamydia trachomatis
auuaaaagaccucuuuu

SEQ ID NO: 482948 - RNA, 20 nt, Chlamydia trachomatis
auuaaaggaauaauuuucca

SEQ ID NO: 482949 - RNA, 15 nt, Chlamydia trachomatis
auuaagaaucuuuga

SEQ ID NO: 482950 - RNA, 16 nt, Chlamydia trachomatis
auuaaggaaugauaag

SEQ ID NO: 482951 - RNA, 17 nt, Chlamydia trachomatis
auuaauaauuccaccua

SEQ ID NO: 482952 - RNA, 14 nt, Chlamydia trachomatis
auuaauaaugaaau

SEQ ID NO: 482953 - RNA, 15 nt, Chlamydia trachomatis
auucaucaaaauauu

SEQ ID NO: 482954 - RNA, 21 nt, Chlamydia trachomatis
auucaugcuccgagauuuuca

SEQ ID NO: 482955 - RNA, 18 nt, Chlamydia trachomatis
auuccacuaccccaccua

SEQ ID NO: 482956 - RNA, 20 nt, Chlamydia trachomatis
auuccauaaaggguguuuuu

SEQ ID NO: 482957 - RNA, 12 nt, Chlamydia trachomatis
auuccaaauaau

SEQ ID NO: 482958 - RNA, 13 nt, Chlamydia trachomatis
auuccaagggaga

SEQ ID NO: 482959 - RNA, 16 nt, Chlamydia trachomatis
auuccaaucauuugug

SEQ ID NO: 482960 - RNA, 23 nt, Chlamydia trachomatis
auuccacgaagagcaaaaucauu

SEQ ID NO: 482961 - RNA, 15 nt, Chlamydia trachomatis
auucccuaaaugcuc

SEQ ID NO: 482962 - RNA, 15 nt, Chlamydia trachomatis
auuccuacgcagaua

SEQ ID NO: 482963 - RNA, 19 nt, Chlamydia trachomatis
auuccuaggcagaguaauu

SEQ ID NO: 482964 - RNA, 18 nt, Chlamydia trachomatis
auucucggaaaagauauc

SEQ ID NO: 482965 - RNA, 14 nt, Chlamydia trachomatis
auucucgcaaagaa

SEQ ID NO: 482966 - RNA, 21 nt, Chlamydia trachomatis
auucucgcaaagaaucaaaac

SEQ ID NO: 482967 - RNA, 21 nt, Chlamydia trachomatis
auucucaauccaugaggcucc

SEQ ID NO: 482968 - RNA, 19 nt, Chlamydia trachomatis
auucuauaggauaaauuaa

SEQ ID NO: 482969 - RNA, 11 nt, Chlamydia trachomatis
auucuaugaau

SEQ ID NO: 482970 - RNA, 18 nt, Chlamydia trachomatis
auucucaaguugagugca

SEQ ID NO: 482971 - RNA, 23 nt, Chlamydia trachomatis
auucucaaguugagugcagagga

SEQ ID NO: 482972 - RNA, 23 nt, Chlamydia trachomatis
auucuaaugcuuuguagauacug

SEQ ID NO: 482973 - RNA, 15 nt, Chlamydia trachomatis
auucuaucaacaucu

SEQ ID NO: 482974 - RNA, 17 nt, Chlamydia trachomatis
auucuaucaacaucugu

SEQ ID NO: 482975 - RNA, 16 nt, Chlamydia trachomatis
auucgucaaagaagua

SEQ ID NO: 482976 - RNA, 23 nt, Chlamydia trachomatis
auucgcuugcagagggccuccca

SEQ ID NO: 482977 - RNA, 21 nt, Chlamydia trachomatis
auucgcuaaugauucuugaag

SEQ ID NO: 482978 - RNA, 18 nt, Chlamydia trachomatis
auucgcuaccaaaaauuu

SEQ ID NO: 482979 - RNA, 21 nt, Chlamydia trachomatis
auucgcuaccaaaaauuuuuu

SEQ ID NO: 482980 - RNA, 17 nt, Chlamydia trachomatis
auuccuucaaauauuuu

SEQ ID NO: 482981 - RNA, 21 nt, Chlamydia trachomatis
auuccuucagagguagccaaa

SEQ ID NO: 482982 - RNA, 20 nt, Chlamydia trachomatis
auuccuucguccccucucuc

SEQ ID NO: 482983 - RNA, 14 nt, Chlamydia trachomatis
auuccuuggauacg

SEQ ID NO: 482984 - RNA, 19 nt, Chlamydia trachomatis
auuccuuggcaaagagcuu

SEQ ID NO: 482985 - RNA, 12 nt, Chlamydia trachomatis
auucugcagaaa

SEQ ID NO: 482986 - RNA, 17 nt, Chlamydia trachomatis
auucugcagaaaaauuu

SEQ ID NO: 482987 - RNA, 15 nt, Chlamydia trachomatis
auucucucauaagau

SEQ ID NO: 482988 - RNA, 20 nt, Chlamydia trachomatis
auucucucauaagaucuuua

SEQ ID NO: 482989 - RNA, 23 nt, Chlamydia trachomatis
auucucugcacaauauuaucuac

SEQ ID NO: 482990 - RNA, 23 nt, Chlamydia trachomatis
auucugcuaaaggugcgauuacu

SEQ ID NO: 482991 - RNA, 15 nt, Chlamydia trachomatis
auucuggaggaggac

SEQ ID NO: 482992 - RNA, 22 nt, Chlamydia trachomatis
auucuggaggaggaccucuguc

SEQ ID NO: 482993 - RNA, 15 nt, Chlamydia trachomatis
auucuucuucugcaa

SEQ ID NO: 482994 - RNA, 19 nt, Chlamydia trachomatis
auucuugaagauuugcaaa

SEQ ID NO: 482995 - RNA, 18 nt, Chlamydia trachomatis
auucuugauaaauaaucu

SEQ ID NO: 482996 - RNA, 17 nt, Chlamydia trachomatis
auugauuuuuucgcuuu

SEQ ID NO: 482997 - RNA, 14 nt, Chlamydia trachomatis
auugaaacaguaga

SEQ ID NO: 482998 - RNA, 20 nt, Chlamydia trachomatis
auugaucuuguguaguauuu

SEQ ID NO: 482999 - RNA, 18 nt, Chlamydia trachomatis
auugaaaaagcuuucuuc

SEQ ID NO: 483000 - RNA, 15 nt, Chlamydia trachomatis
auugcaacucuugcc

SEQ ID NO: 483001 - RNA, 14 nt, Chlamydia trachomatis
auugccaaaaagaa

SEQ ID NO: 483002 - RNA, 22 nt, Chlamydia trachomatis
auugccaaaaagaaaaucagaa

SEQ ID NO: 483003 - RNA, 15 nt, Chlamydia trachomatis
auugccauguuuuuc

SEQ ID NO: 483004 - RNA, 12 nt, Chlamydia trachomatis
auugcgaagguu

SEQ ID NO: 483005 - RNA, 20 nt, Chlamydia trachomatis
auugcugaugcauagcucgc

SEQ ID NO: 483006 - RNA, 16 nt, Chlamydia trachomatis
auuggugagugcauag

SEQ ID NO: 483007 - RNA, 23 nt, Chlamydia trachomatis
auugguucccugcaccucuuuca

SEQ ID NO: 483008 - RNA, 23 nt, Chlamydia trachomatis
auuguccaaacggcacucaaauu

SEQ ID NO: 483009 - RNA, 19 nt, Chlamydia trachomatis
auugucgaauuuuucugcu

SEQ ID NO: 483010 - RNA, 13 nt, Chlamydia trachomatis
aaaaggguagaaa

SEQ ID NO: 483011 - RNA, 16 nt, Chlamydia trachomatis
auugguuuaauauuuu

SEQ ID NO: 483012 - RNA, 17 nt, Chlamydia trachomatis
auuguuggcgaauuucu

SEQ ID NO: 483013 - RNA, 23 nt, Chlamydia trachomatis
aaaagucgguuuacaauagguuu

SEQ ID NO: 483014 - RNA, 22 nt, Chlamydia trachomatis
aaaagucucuaaagcuuuuguu

SEQ ID NO: 483015 - RNA, 23 nt, Chlamydia trachomatis
auuuauuggcggcaguuucuagg

SEQ ID NO: 483016 - RNA, 19 nt, Chlamydia trachomatis
auuuaauaaguuuuucaaa

SEQ ID NO: 483017 - RNA, 23 nt, Chlamydia trachomatis
auuuauagaaccccucuuuuuuu

SEQ ID NO: 483018 - RNA, 10 nt, Chlamydia trachomatis
auuuauauca

SEQ ID NO: 483019 - RNA, 17 nt, Chlamydia trachomatis
auuuauaucaucgaaug

SEQ ID NO: 483020 - RNA, 17 nt, Chlamydia trachomatis
auuuaucugcuaaagaa

SEQ ID NO: 483021 - RNA, 18 nt, Chlamydia trachomatis
auuuaucugcuaaagaaa

SEQ ID NO: 483022 - RNA, 13 nt, Chlamydia trachomatis
auuucagcaucaa

SEQ ID NO: 483023 - RNA, 15 nt, Chlamydia trachomatis
auuuccguaaaaggu

SEQ ID NO: 483024 - RNA, 21 nt, Chlamydia trachomatis
auuuccguaaugaucagcaaa

SEQ ID NO: 483025 - RNA, 17 nt, Chlamydia trachomatis
auuucggauacaauaca

SEQ ID NO: 483026 - RNA, 13 nt, Chlamydia trachomatis
auuuccccaagau

SEQ ID NO: 483027 - RNA, 15 nt, Chlamydia trachomatis
auuuccccuacaaac

SEQ ID NO: 483028 - RNA, 14 nt, Chlamydia trachomatis
auuuccccugcagc

SEQ ID NO: 483029 - RNA, 14 nt, Chlamydia trachomatis
auuucccucuuccc

SEQ ID NO: 483030 - RNA, 24 nt, Chlamydia trachomatis
auuucguugcuaacacaagcagac

SEQ ID NO: 483031 - RNA, 14 nt, Chlamydia trachomatis
auuucuaaauauuu

SEQ ID NO: 483032 - RNA, 17 nt, Chlamydia trachomatis
auuucucgucaggggau

SEQ ID NO: 483033 - RNA, 13 nt, Chlamydia trachomatis
auuucucuaggaa

SEQ ID NO: 483034 - RNA, 11 nt, Chlamydia trachomatis
auuucucucca

SEQ ID NO: 483035 - RNA, 17 nt, Chlamydia trachomatis
auuucucuuccugaaua

SEQ ID NO: 483036 - RNA, 18 nt, Chlamydia trachomatis
auuucugccaaaggaucc

SEQ ID NO: 483037 - RNA, 18 nt, Chlamydia trachomatis
auuucuguaaggcaggau

SEQ ID NO: 483038 - RNA, 22 nt, Chlamydia trachomatis
auuucuucuggcgaaucaauuu

SEQ ID NO: 483039 - RNA, 12 nt, Chlamydia trachomatis
auuucuuccucu

SEQ ID NO: 483040 - RNA, 15 nt, Chlamydia trachomatis
auuucuuccucuaau

SEQ ID NO: 483041 - RNA, 16 nt, Chlamydia trachomatis
auuugaguuuaucauu

SEQ ID NO: 483042 - RNA, 18 nt, Chlamydia trachomatis
auuugaucuucuggaaug

SEQ ID NO: 483043 - RNA, 14 nt, Chlamydia trachomatis
auuuuaaaaucacu

SEQ ID NO: 483044 - RNA, 16 nt, Chlamydia trachomatis
auuuuaaaaucuccuc

SEQ ID NO: 483045 - RNA, 13 nt, Chlamydia trachomatis
auuuuaauaagau

SEQ ID NO: 483046 - RNA, 18 nt, Chlamydia trachomatis
auuuuacacagauaggaa

SEQ ID NO: 483047 - RNA, 19 nt, Chlamydia trachomatis
auuuuagagaaaagaaaag

SEQ ID NO: 483048 - RNA, 17 nt, Chlamydia trachomatis
auuuuagauaaaagaag

SEQ ID NO: 483049 - RNA, 21 nt, Chlamydia trachomatis
auuuucaaaaccuugaugaau

SEQ ID NO: 483050 - RNA, 18 nt, Chlamydia trachomatis
auuuucauauaguuuucg

SEQ ID NO: 483051 - RNA, 14 nt, Chlamydia trachomatis
auuuucaucuucca

SEQ ID NO: 483052 - RNA, 15 nt, Chlamydia trachomatis
auuuucaucuuccaa

SEQ ID NO: 483053 - RNA, 17 nt, Chlamydia trachomatis
auuuucaugaaaagcuu

SEQ ID NO: 483054 - RNA, 19 nt, Chlamydia trachomatis
auuuuuuacgcucuuucuu

SEQ ID NO: 483055 - RNA, 15 nt, Chlamydia trachomatis
auuuuuccauuucca

SEQ ID NO: 483056 - RNA, 13 nt, Chlamydia trachomatis
caaaaaaucagcu

SEQ ID NO: 483057 - RNA, 18 nt, Chlamydia trachomatis
auuuucguuguuguaaag

SEQ ID NO: 483058 - RNA, 19 nt, Chlamydia trachomatis
auuuucguaagcauagcuu

SEQ ID NO: 483059 - RNA, 14 nt, Chlamydia trachomatis
auuuuccuuuuucc

SEQ ID NO: 483060 - RNA, 16 nt, Chlamydia trachomatis
auuuuguuuaaucagu

SEQ ID NO: 483061 - RNA, 18 nt, Chlamydia trachomatis
auuuuucagccugucuau

SEQ ID NO: 483062 - RNA, 14 nt, Chlamydia trachomatis
caaaagaagaaucu

SEQ ID NO: 483063 - RNA, 16 nt, Chlamydia trachomatis
caaaagaagaaucuuc

SEQ ID NO: 483064 - RNA, 20 nt, Chlamydia trachomatis
caaaagaagaaucuucuucg

SEQ ID NO: 483065 - RNA, 21 nt, Chlamydia trachomatis
caaaagaagaaucuucuucga

SEQ ID NO: 483066 - RNA, 12 nt, Chlamydia trachomatis
caaaagaagcug

SEQ ID NO: 483067 - RNA, 18 nt, Chlamydia trachomatis
caaaagaaggcuuuucua

SEQ ID NO: 483068 - RNA, 19 nt, Chlamydia trachomatis
caaaagaaggcuuuucuau

SEQ ID NO: 483069 - RNA, 15 nt, Chlamydia trachomatis
caaaagagaugggga

SEQ ID NO: 483070 - RNA, 19 nt, Chlamydia trachomatis
caaaagauuucuucuguag

SEQ ID NO: 483071 - RNA, 13 nt, Chlamydia trachomatis
caaaagaaaaauc

SEQ ID NO: 483072 - RNA, 17 nt, Chlamydia trachomatis
caaaacgcucagaaaac

SEQ ID NO: 483073 - RNA, 14 nt, Chlamydia trachomatis
caaaacgcucucca

SEQ ID NO: 483074 - RNA, 18 nt, Chlamydia trachomatis
caaaacgcucuccaaaga

SEQ ID NO: 483075 - RNA, 15 nt, Chlamydia trachomatis
caaaacuaaaaguug

SEQ ID NO: 483076 - RNA, 12 nt, Chlamydia trachomatis
caaaaagaaagc

SEQ ID NO: 483077 - RNA, 16 nt, Chlamydia trachomatis
caaaaagacuacaguc

SEQ ID NO: 483078 - RNA, 20 nt, Chlamydia trachomatis
caaaaagacuacagucuucu

SEQ ID NO: 483079 - RNA, 23 nt, Chlamydia trachomatis
caaaaagagcauaauauccccau

SEQ ID NO: 483080 - RNA, 13 nt, Chlamydia trachomatis
caaaaagaucuuc

SEQ ID NO: 483081 - RNA, 17 nt, Chlamydia trachomatis
caaaaagaucuucaaca

SEQ ID NO: 483082 - RNA, 21 nt, Chlamydia trachomatis
caaaagcgaggcuucaaagaa

SEQ ID NO: 483083 - RNA, 22 nt, Chlamydia trachomatis
caaaagcgaggcuucaaagaac

SEQ ID NO: 483084 - RNA, 23 nt, Chlamydia trachomatis
caaaaguagacgaaguaggagau

SEQ ID NO: 483085 - RNA, 15 nt, Chlamydia trachomatis
caaaauagcaggaau

SEQ ID NO: 483086 - RNA, 15 nt, Chlamydia trachomatis
caaaauccuucgccg

SEQ ID NO: 483087 - RNA, 13 nt, Chlamydia trachomatis
caaaaucuucaua

SEQ ID NO: 483088 - RNA, 23 nt, Chlamydia trachomatis
caaaaucuucauaagaaaauucu

SEQ ID NO: 483089 - RNA, 19 nt, Chlamydia trachomatis
caaaaucuuccauaaaauc

SEQ ID NO: 483090 - RNA, 20 nt, Chlamydia trachomatis
caaaaucuucuggagcaacu

SEQ ID NO: 483091 - RNA, 20 nt, Chlamydia trachomatis
caaaauuaucuaaaaaaauu

SEQ ID NO: 483092 - RNA, 21 nt, Chlamydia trachomatis
caaaauucuguacgucugcaa

SEQ ID NO: 483093 - RNA, 21 nt, Chlamydia trachomatis
caaaauuuuucugcuccaaag

SEQ ID NO: 483094 - RNA, 22 nt, Chlamydia trachomatis
caaaccuuaaaagcaaggcuua

SEQ ID NO: 483095 - RNA, 14 nt, Chlamydia trachomatis
caaaccuuucaaau

SEQ ID NO: 483096 - RNA, 18 nt, Chlamydia trachomatis
caaaccuuucaaauaccc

SEQ ID NO: 483097 - RNA, 13 nt, Chlamydia trachomatis
caaacgaaggagc

SEQ ID NO: 483098 - RNA, 16 nt, Chlamydia trachomatis
caaacggcacucaaau

SEQ ID NO: 483099 - RNA, 14 nt, Chlamydia trachomatis
caaacugugaagaa

SEQ ID NO: 483100 - RNA, 14 nt, Chlamydia trachomatis
caaacaaaaaagaa

SEQ ID NO: 483101 - RNA, 11 nt, Chlamydia trachomatis
caaacaaaaga

SEQ ID NO: 483102 - RNA, 13 nt, Chlamydia trachomatis
caaacaaaauaau

SEQ ID NO: 483103 - RNA, 15 nt, Chlamydia trachomatis
caaacaaauccuaga

SEQ ID NO: 483104 - RNA, 13 nt, Chlamydia trachomatis
caaacauuuugag

SEQ ID NO: 483105 - RNA, 15 nt, Chlamydia trachomatis
caaaccaauuaaguu

SEQ ID NO: 483106 - RNA, 15 nt, Chlamydia trachomatis
caaaccaugaugcug

SEQ ID NO: 483107 - RNA, 22 nt, Chlamydia trachomatis
caaaccuaaguagcaaauuaac

SEQ ID NO: 483108 - RNA, 17 nt, Chlamydia trachomatis
caaagacauaaaagcug

SEQ ID NO: 483109 - RNA, 19 nt, Chlamydia trachomatis
caaagaucguaaaauagca

SEQ ID NO: 483110 - RNA, 19 nt, Chlamydia trachomatis
caaagaucuuucuacauuu

SEQ ID NO: 483111 - RNA, 21 nt, Chlamydia trachomatis
caaagaucuuucuacauuuug

SEQ ID NO: 483112 - RNA, 11 nt, Chlamydia trachomatis
caaagaagcuc

SEQ ID NO: 483113 - RNA, 13 nt, Chlamydia trachomatis
caaagaauagaau

SEQ ID NO: 483114 - RNA, 16 nt, Chlamydia trachomatis
caaagaauucuugcua

SEQ ID NO: 483115 - RNA, 14 nt, Chlamydia trachomatis
caaagaauuuuccg

SEQ ID NO: 483116 - RNA, 17 nt, Chlamydia trachomatis
caaaggcaacaaaggcg

SEQ ID NO: 483117 - RNA, 21 nt, Chlamydia trachomatis
caaagauugcguuacuucuug

SEQ ID NO: 483118 - RNA, 22 nt, Chlamydia trachomatis
caaagauugcguuacuucuugc

SEQ ID NO: 483119 - RNA, 13 nt, Chlamydia trachomatis
caaagcaaacuuc

SEQ ID NO: 483120 - RNA, 18 nt, Chlamydia trachomatis
caaauucuucaugcaauu

SEQ ID NO: 483121 - RNA, 22 nt, Chlamydia trachomatis
caaauucuucaugcaauugauu

SEQ ID NO: 483122 - RNA, 18 nt, Chlamydia trachomatis
caaauuuaucugcuaaag

SEQ ID NO: 483123 - RNA, 21 nt, Chlamydia trachomatis
caaauuuaucugcuaaagaaa

SEQ ID NO: 483124 - RNA, 19 nt, Chlamydia trachomatis
caaauuucuauagaagaau

SEQ ID NO: 483125 - RNA, 19 nt, Chlamydia trachomatis
caaauuucucuaggaacau

SEQ ID NO: 483126 - RNA, 19 nt, Chlamydia trachomatis
caaauuucuucgaucggaa

SEQ ID NO: 483127 - RNA, 12 nt, Chlamydia trachomatis
caaauuccucug

SEQ ID NO: 483128 - RNA, 17 nt, Chlamydia trachomatis
caaauuccucuguagau

SEQ ID NO: 483129 - RNA, 14 nt, Chlamydia trachomatis
caaaucugcaagaa

SEQ ID NO: 483130 - RNA, 21 nt, Chlamydia trachomatis
caaaucugcaagaacaaagaa

SEQ ID NO: 483131 - RNA, 20 nt, Chlamydia trachomatis
caaaucuuucuuucuaagaa

SEQ ID NO: 483132 - RNA, 14 nt, Chlamydia trachomatis
caaaucuucuucua

SEQ ID NO: 483133 - RNA, 19 nt, Chlamydia trachomatis
caaaucuucuucuaagcua

SEQ ID NO: 483134 - RNA, 18 nt, Chlamydia trachomatis
caaaucuuuuaucuucuu

SEQ ID NO: 483135 - RNA, 19 nt, Chlamydia trachomatis
caaaugaugauauugucua

SEQ ID NO: 483136 - RNA, 21 nt, Chlamydia trachomatis
caaauauuuuugggaaaaaau

SEQ ID NO: 483137 - RNA, 22 nt, Chlamydia trachomatis
caaauauuuuugggaaaaaauu

SEQ ID NO: 483138 - RNA, 23 nt, Chlamydia trachomatis
caaauauuuuugggaaaaaauua

SEQ ID NO: 483139 - RNA, 13 nt, Chlamydia trachomatis
caaaucaaaccaa

SEQ ID NO: 483140 - RNA, 15 nt, Chlamydia trachomatis
caaauaguguaagga

SEQ ID NO: 483141 - RNA, 14 nt, Chlamydia trachomatis
caaauauacucuuu

SEQ ID NO: 483142 - RNA, 22 nt, Chlamydia trachomatis
caaauagggagguauuccugua

SEQ ID NO: 483143 - RNA, 18 nt, Chlamydia trachomatis
caaauagguaugugcuca

SEQ ID NO: 483144 - RNA, 19 nt, Chlamydia trachomatis
caaauccagcugcugccca

SEQ ID NO: 483145 - RNA, 22 nt, Chlamydia trachomatis
caaauccuacacaagcuuuuuu

SEQ ID NO: 483146 - RNA, 16 nt, Chlamydia trachomatis
caaauccuagaagagc

SEQ ID NO: 483147 - RNA, 15 nt, Chlamydia trachomatis
caaauccuccauaac

SEQ ID NO: 483148 - RNA, 20 nt, Chlamydia trachomatis
caaauccugcauuuauccac

SEQ ID NO: 483149 - RNA, 12 nt, Chlamydia trachomatis
caaauccugcuu

SEQ ID NO: 483150 - RNA, 12 nt, Chlamydia trachomatis
caacaaauacca

SEQ ID NO: 483151 - RNA, 15 nt, Chlamydia trachomatis
caacaaauaccaaaa

SEQ ID NO: 483152 - RNA, 14 nt, Chlamydia trachomatis
caacaucauaacca

SEQ ID NO: 483153 - RNA, 13 nt, Chlamydia trachomatis
caacaguucuuca

SEQ ID NO: 483154 - RNA, 13 nt, Chlamydia trachomatis
caaccagcgcauu

SEQ ID NO: 483155 - RNA, 15 nt, Chlamydia trachomatis
caaccagcgcauuaa

SEQ ID NO: 483156 - RNA, 20 nt, Chlamydia trachomatis
caacaugggcauagucuccc

SEQ ID NO: 483157 - RNA, 15 nt, Chlamydia trachomatis
caaccaucaaagcag

SEQ ID NO: 483158 - RNA, 16 nt, Chlamydia trachomatis
caaccauaauacgaau

SEQ ID NO: 483159 - RNA, 20 nt, Chlamydia trachomatis
caaccauaauacgaauaaga

SEQ ID NO: 483160 - RNA, 21 nt, Chlamydia trachomatis
caacccaaggcgguaccugcu

SEQ ID NO: 483161 - RNA, 17 nt, Chlamydia trachomatis
caacccuaaaucuccuc

SEQ ID NO: 483162 - RNA, 18 nt, Chlamydia trachomatis
caacccucgcagagaaag

SEQ ID NO: 483163 - RNA, 22 nt, Chlamydia trachomatis
caaccucucaucaguaaacacu

SEQ ID NO: 483164 - RNA, 15 nt, Chlamydia trachomatis
caaccucucuaaaaa

SEQ ID NO: 483165 - RNA, 16 nt, Chlamydia trachomatis
caaccucucuaaaaac

SEQ ID NO: 483166 - RNA, 14 nt, Chlamydia trachomatis
caacuaguuuacgc

SEQ ID NO: 483167 - RNA, 18 nt, Chlamydia trachomatis
caacuaguuuacgcacuu

SEQ ID NO: 483168 - RNA, 21 nt, Chlamydia trachomatis
caacuaguuuacgcacuucug

SEQ ID NO: 483169 - RNA, 18 nt, Chlamydia trachomatis
caacuaucagaagauagu

SEQ ID NO: 483170 - RNA, 18 nt, Chlamydia trachomatis
caacucuuauaacauuau

SEQ ID NO: 483171 - RNA, 21 nt, Chlamydia trachomatis
caacucuuucauaaaacccuc

SEQ ID NO: 483172 - RNA, 16 nt, Chlamydia trachomatis
caacucuuuuccuaaa

SEQ ID NO: 483173 - RNA, 15 nt, Chlamydia trachomatis
caacuggccuuuuuc

SEQ ID NO: 483174 - RNA, 20 nt, Chlamydia trachomatis
caagacaucuauugagaaga

SEQ ID NO: 483175 - RNA, 22 nt, Chlamydia trachomatis
caagacaucuauugagaagacu

SEQ ID NO: 483176 - RNA, 20 nt, Chlamydia trachomatis
caagacacgcaguucgcuau

SEQ ID NO: 483177 - RNA, 21 nt, Chlamydia trachomatis
caagaauugacagcaccaagc

SEQ ID NO: 483178 - RNA, 16 nt, Chlamydia trachomatis
caagauauucccuaaa

SEQ ID NO: 483179 - RNA, 21 nt, Chlamydia trachomatis
caagauauucccuaaaugcuc

SEQ ID NO: 483180 - RNA, 17 nt, Chlamydia trachomatis
caagauacaaggcuccu

SEQ ID NO: 483181 - RNA, 18 nt, Chlamydia trachomatis
caagaucaugggaaauaa

SEQ ID NO: 483182 - RNA, 13 nt, Chlamydia trachomatis
caagacucuuuca

SEQ ID NO: 483183 - RNA, 14 nt, Chlamydia trachomatis
caagacuucuucua

SEQ ID NO: 483184 - RNA, 15 nt, Chlamydia trachomatis
caagagaaaucagau

SEQ ID NO: 483185 - RNA, 16 nt, Chlamydia trachomatis
caagagagaucuauga

SEQ ID NO: 483186 - RNA, 21 nt, Chlamydia trachomatis
caagagagaucuaugaaaaaa

SEQ ID NO: 483187 - RNA, 19 nt, Chlamydia trachomatis
caagaugccgaacucuccu

SEQ ID NO: 483188 - RNA, 19 nt, Chlamydia trachomatis
caagcucgagucucuugug

SEQ ID NO: 483189 - RNA, 22 nt, Chlamydia trachomatis
caagcucgucuuuagaagaaaa

SEQ ID NO: 483190 - RNA, 23 nt, Chlamydia trachomatis
caagcucgucuuuagaagaaaag

SEQ ID NO: 483191 - RNA, 22 nt, Chlamydia trachomatis
caagcgauuaugaaaaagccug

SEQ ID NO: 483192 - RNA, 23 nt, Chlamydia trachomatis
caauaccuacacgauauauccau

SEQ ID NO: 483193 - RNA, 17 nt, Chlamydia trachomatis
caauaagccuccugcgu

SEQ ID NO: 483194 - RNA, 19 nt, Chlamydia trachomatis
caauaaguuacuguggcca

SEQ ID NO: 483195 - RNA, 17 nt, Chlamydia trachomatis
caauaauacaaagcacg

SEQ ID NO: 483196 - RNA, 15 nt, Chlamydia trachomatis
caauaauuuccccua

SEQ ID NO: 483197 - RNA, 21 nt, Chlamydia trachomatis
caauaaaaacuggagaaucca

SEQ ID NO: 483198 - RNA, 20 nt, Chlamydia trachomatis
caauaaacaaggcuaagaaa

SEQ ID NO: 483199 - RNA, 19 nt, Chlamydia trachomatis
caauaaacgaggaauauau

SEQ ID NO: 483200 - RNA, 18 nt, Chlamydia trachomatis
caauaaacgcgauguaag

SEQ ID NO: 483201 - RNA, 13 nt, Chlamydia trachomatis
caaguuccuggau

SEQ ID NO: 483202 - RNA, 21 nt, Chlamydia trachomatis
caaguuuauggaaaagaucuu

SEQ ID NO: 483203 - RNA, 13 nt, Chlamydia trachomatis
caaguuuuguaaa

SEQ ID NO: 483204 - RNA, 13 nt, Chlamydia trachomatis
caaggauucauau

SEQ ID NO: 483205 - RNA, 17 nt, Chlamydia trachomatis
caaggcaggaaaaggca

SEQ ID NO: 483206 - RNA, 13 nt, Chlamydia trachomatis
caaguauuggaga

SEQ ID NO: 483207 - RNA, 18 nt, Chlamydia trachomatis
caaguauuggagacaaca

SEQ ID NO: 483208 - RNA, 14 nt, Chlamydia trachomatis
caagucauuuugag

SEQ ID NO: 483209 - RNA, 18 nt, Chlamydia trachomatis
caagugccaacaucaaaa

SEQ ID NO: 483210 - RNA, 23 nt, Chlamydia trachomatis
caaguccuuugauuucugcagag

SEQ ID NO: 483211 - RNA, 19 nt, Chlamydia trachomatis
caaguccuuccauggccuu

SEQ ID NO: 483212 - RNA, 13 nt, Chlamydia trachomatis
caagucuccacug

SEQ ID NO: 483213 - RNA, 13 nt, Chlamydia trachomatis
caaucacagcaau

SEQ ID NO: 483214 - RNA, 21 nt, Chlamydia trachomatis
caauaucuguuuuuccccaua

SEQ ID NO: 483215 - RNA, 13 nt, Chlamydia trachomatis
caauaucuucaga

SEQ ID NO: 483216 - RNA, 18 nt, Chlamydia trachomatis
caauauuuuuucuaucag

SEQ ID NO: 483217 - RNA, 18 nt, Chlamydia trachomatis
caaucucaaaaacacuac

SEQ ID NO: 483218 - RNA, 22 nt, Chlamydia trachomatis
caauccuuuuaagauauccaua

SEQ ID NO: 483219 - RNA, 19 nt, Chlamydia trachomatis
caauccuuuaacuaggguu

SEQ ID NO: 483220 - RNA, 19 nt, Chlamydia trachomatis
caauccuuuugauucugcu

SEQ ID NO: 483221 - RNA, 18 nt, Chlamydia trachomatis
caaucgaucgauaccuau

SEQ ID NO: 483222 - RNA, 22 nt, Chlamydia trachomatis
caaucgagagguccagucuaca

SEQ ID NO: 483223 - RNA, 15 nt, Chlamydia trachomatis
caaucgcaauuugau

SEQ ID NO: 483224 - RNA, 17 nt, Chlamydia trachomatis
caauguaaaaugagaaa

SEQ ID NO: 483225 - RNA, 23 nt, Chlamydia trachomatis
caauguaaaaugagaaauaaaaa

SEQ ID NO: 483226 - RNA, 16 nt, Chlamydia trachomatis
caauguaaacaauauu

SEQ ID NO: 483227 - RNA, 18 nt, Chlamydia trachomatis
caauguacgcuaaaaacu

SEQ ID NO: 483228 - RNA, 14 nt, Chlamydia trachomatis
caaugucaacauaa

SEQ ID NO: 483229 - RNA, 18 nt, Chlamydia trachomatis
caaugcugauaaaaauaa

SEQ ID NO: 483230 - RNA, 20 nt, Chlamydia trachomatis
caaugcugcuguuuauuuuc

SEQ ID NO: 483231 - RNA, 21 nt, Chlamydia trachomatis
caaucuguaauaaacccugga

SEQ ID NO: 483232 - RNA, 15 nt, Chlamydia trachomatis
caauuccucuaaaca

SEQ ID NO: 483233 - RNA, 12 nt, Chlamydia trachomatis
caauuccugcuc

SEQ ID NO: 483234 - RNA, 14 nt, Chlamydia trachomatis
caauuccugcucag

SEQ ID NO: 483235 - RNA, 22 nt, Chlamydia trachomatis
caauuccugcucagagauccca

SEQ ID NO: 483236 - RNA, 20 nt, Chlamydia trachomatis
caauugguuugauagcuuca

SEQ ID NO: 483237 - RNA, 16 nt, Chlamydia trachomatis
caauuucaucacagau

SEQ ID NO: 483238 - RNA, 16 nt, Chlamydia trachomatis
cacaaccucucuaaaa

SEQ ID NO: 483239 - RNA, 20 nt, Chlamydia trachomatis
cacaacgcguuggguaguac

SEQ ID NO: 483240 - RNA, 16 nt, Chlamydia trachomatis
cacaagcagacaagca

SEQ ID NO: 483241 - RNA, 17 nt, Chlamydia trachomatis
cacaagcagacaagcaa

SEQ ID NO: 483242 - RNA, 17 nt, Chlamydia trachomatis
cacaagaacaucuccaa

SEQ ID NO: 483243 - RNA, 20 nt, Chlamydia trachomatis
cacaagcugacaaagcuucc

SEQ ID NO: 483244 - RNA, 16 nt, Chlamydia trachomatis
cacaagcuuuuuucug

SEQ ID NO: 483245 - RNA, 17 nt, Chlamydia trachomatis
cacaauauuaucuacag

SEQ ID NO: 483246 - RNA, 18 nt, Chlamydia trachomatis
cacacauccuucugcuau

SEQ ID NO: 483247 - RNA, 13 nt, Chlamydia trachomatis
cacacgauuaucu

SEQ ID NO: 483248 - RNA, 16 nt, Chlamydia trachomatis
cacaaucucaaaaaca

SEQ ID NO: 483249 - RNA, 18 nt, Chlamydia trachomatis
cacagcacgacacuccuc

SEQ ID NO: 483250 - RNA, 19 nt, Chlamydia trachomatis
cacagcaaauaaagagguu

SEQ ID NO: 483251 - RNA, 20 nt, Chlamydia trachomatis
cacagauuugaguuuaucau

SEQ ID NO: 483252 - RNA, 16 nt, Chlamydia trachomatis
cacagcaagcgaaaua

SEQ ID NO: 483253 - RNA, 15 nt, Chlamydia trachomatis
cacagaaacuucuuc

SEQ ID NO: 483254 - RNA, 12 nt, Chlamydia trachomatis
cacagaaagucc

SEQ ID NO: 483255 - RNA, 18 nt, Chlamydia trachomatis
cacagaaaguccugcuuc

SEQ ID NO: 483256 - RNA, 19 nt, Chlamydia trachomatis
cacagaaaguccugcuucu

SEQ ID NO: 483257 - RNA, 19 nt, Chlamydia trachomatis
cacagaaguuguuggaguu

SEQ ID NO: 483258 - RNA, 14 nt, Chlamydia trachomatis
cacagcuaagggcu

SEQ ID NO: 483259 - RNA, 20 nt, Chlamydia trachomatis
cacauagcgacuaauacuga

SEQ ID NO: 483260 - RNA, 19 nt, Chlamydia trachomatis
cacauccugagcccaagga

SEQ ID NO: 483261 - RNA, 13 nt, Chlamydia trachomatis
cacaucacagauc

SEQ ID NO: 483262 - RNA, 15 nt, Chlamydia trachomatis
cacaucgaauaaaaa

SEQ ID NO: 483263 - RNA, 18 nt, Chlamydia trachomatis
cacaucgaauaaaaauuc

SEQ ID NO: 483264 - RNA, 14 nt, Chlamydia trachomatis
cacauccuucugcu

SEQ ID NO: 483265 - RNA, 16 nt, Chlamydia trachomatis
cacaucgaugcucgau

SEQ ID NO: 483266 - RNA, 17 nt, Chlamydia trachomatis
cacauuaccauucacac

SEQ ID NO: 483267 - RNA, 14 nt, Chlamydia trachomatis
cacauuauucacac

SEQ ID NO: 483268 - RNA, 15 nt, Chlamydia trachomatis
cacauuauucacacu

SEQ ID NO: 483269 - RNA, 17 nt, Chlamydia trachomatis
cacauucccuaaauaua

SEQ ID NO: 483270 - RNA, 13 nt, Chlamydia trachomatis
caccaaauccucc

SEQ ID NO: 483271 - RNA, 21 nt, Chlamydia trachomatis
caccacgugaguguagucuuu

SEQ ID NO: 483272 - RNA, 18 nt, Chlamydia trachomatis
caccacuaaucccaccuu

SEQ ID NO: 483273 - RNA, 21 nt, Chlamydia trachomatis
caccacuaaucccaccuuaaa

SEQ ID NO: 483274 - RNA, 14 nt, Chlamydia trachomatis
caccagccacaucc

SEQ ID NO: 483275 - RNA, 15 nt, Chlamydia trachomatis
caccagccacauccu

SEQ ID NO: 483276 - RNA, 16 nt, Chlamydia trachomatis
caccagccacauccug

SEQ ID NO: 483277 - RNA, 16 nt, Chlamydia trachomatis
caccagcuaauaaguu

SEQ ID NO: 483278 - RNA, 24 nt, Chlamydia trachomatis
caccagcuaauaaguucacugacu

SEQ ID NO: 483279 - RNA, 20 nt, Chlamydia trachomatis
caccccaucccuugcaaaaa

SEQ ID NO: 483280 - RNA, 20 nt, Chlamydia trachomatis
aaaauaaagaaauaaaaagc

SEQ ID NO: 483281 - RNA, 20 nt, Chlamydia trachomatis
aaaauagcagugaaaucaga

SEQ ID NO: 483282 - RNA, 12 nt, Chlamydia trachomatis
aaaauagaaaac

SEQ ID NO: 483283 - RNA, 16 nt, Chlamydia trachomatis
aaaauagcacgcaaaa

SEQ ID NO: 483284 - RNA, 21 nt, Chlamydia trachomatis
aaaauagcacgcaaaacaucu

SEQ ID NO: 483285 - RNA, 19 nt, Chlamydia trachomatis
aaaauagcaucuggaacau

SEQ ID NO: 483286 - RNA, 22 nt, Chlamydia trachomatis
cacgacuuagcacucaaacacu

SEQ ID NO: 483287 - RNA, 22 nt, Chlamydia trachomatis
aaaauaauuuaauuaaagagau

SEQ ID NO: 483288 - RNA, 23 nt, Chlamydia trachomatis
aaaauacagcggauuagucgugu

SEQ ID NO: 483289 - RNA, 20 nt, Chlamydia trachomatis
aaaauaccaaaaaacauucc

SEQ ID NO: 483290 - RNA, 16 nt, Chlamydia trachomatis
aaaauaccuaaagaag

SEQ ID NO: 483291 - RNA, 16 nt, Chlamydia trachomatis
aaaauacgcgcgcuaa

SEQ ID NO: 483292 - RNA, 20 nt, Chlamydia trachomatis
caccugcuuucugugcccaa

SEQ ID NO: 483293 - RNA, 17 nt, Chlamydia trachomatis
cacggagagaaagaggg

SEQ ID NO: 483294 - RNA, 16 nt, Chlamydia trachomatis
cacgcuacuaacgaag

SEQ ID NO: 483295 - RNA, 22 nt, Chlamydia trachomatis
cacuagagucagaagcuauucc

SEQ ID NO: 483296 - RNA, 20 nt, Chlamydia trachomatis
cacuaggcucaugagccucu

SEQ ID NO: 483297 - RNA, 13 nt, Chlamydia trachomatis
cacuauccaaagc

SEQ ID NO: 483298 - RNA, 13 nt, Chlamydia trachomatis
cacuaugaacaaa

SEQ ID NO: 483299 - RNA, 14 nt, Chlamydia trachomatis
cacuauuaaaaagg

SEQ ID NO: 483300 - RNA, 17 nt, Chlamydia trachomatis
cacucaaauuucucuag

SEQ ID NO: 483301 - RNA, 15 nt, Chlamydia trachomatis
cacuccaagaagagu

SEQ ID NO: 483302 - RNA, 14 nt, Chlamydia trachomatis
cacguuccagucuu

SEQ ID NO: 483303 - RNA, 16 nt, Chlamydia trachomatis
cacguuaggauccgcu

SEQ ID NO: 483304 - RNA, 14 nt, Chlamydia trachomatis
cacgugcaacacaa

SEQ ID NO: 483305 - RNA, 20 nt, Chlamydia trachomatis
cacuaccccaccuauggcau

SEQ ID NO: 483306 - RNA, 16 nt, Chlamydia trachomatis
cacuacgcuacagagu

SEQ ID NO: 483307 - RNA, 11 nt, Chlamydia trachomatis
cacucuucagg

SEQ ID NO: 483308 - RNA, 14 nt, Chlamydia trachomatis
cacugaaucaggaa

SEQ ID NO: 483309 - RNA, 18 nt, Chlamydia trachomatis
cacucgagucaugcaaag

SEQ ID NO: 483310 - RNA, 19 nt, Chlamydia trachomatis
cacucgagucaugcaaagg

SEQ ID NO: 483311 - RNA, 19 nt, Chlamydia trachomatis
cacuccuagggucugaggc

SEQ ID NO: 483312 - RNA, 20 nt, Chlamydia trachomatis
cacuccuccuccuaaacaaa

SEQ ID NO: 483313 - RNA, 14 nt, Chlamydia trachomatis
cacuccucugaauc

SEQ ID NO: 483314 - RNA, 21 nt, Chlamydia trachomatis
cacuccugaaaguuuuuuccc

SEQ ID NO: 483315 - RNA, 16 nt, Chlamydia trachomatis
cacugcaacuaauauu

SEQ ID NO: 483316 - RNA, 17 nt, Chlamydia trachomatis
cacugaccgaagaacuc

SEQ ID NO: 483317 - RNA, 19 nt, Chlamydia trachomatis
cacugaccgaagaacucaa

SEQ ID NO: 483318 - RNA, 22 nt, Chlamydia trachomatis
cacugaccgaagaacucaaaag

SEQ ID NO: 483319 - RNA, 23 nt, Chlamydia trachomatis
cacugaccgaagaacucaaaagc

SEQ ID NO: 483320 - RNA, 18 nt, Chlamydia trachomatis
cacuggguaucugaacaa

SEQ ID NO: 483321 - RNA, 17 nt, Chlamydia trachomatis
cacugcuuccgaaagca

SEQ ID NO: 483322 - RNA, 20 nt, Chlamydia trachomatis
cacuggcaccuuuuuugcua

SEQ ID NO: 483323 - RNA, 21 nt, Chlamydia trachomatis
cacuguccacauuauucacac

SEQ ID NO: 483324 - RNA, 20 nt, Chlamydia trachomatis
cacuuaaaaagaaacaaaac

SEQ ID NO: 483325 - RNA, 18 nt, Chlamydia trachomatis
cacuuccccauucuucuc

SEQ ID NO: 483326 - RNA, 20 nt, Chlamydia trachomatis
cacuuccuugguauuugugu

SEQ ID NO: 483327 - RNA, 18 nt, Chlamydia trachomatis
cacuugaguuguuugggc

SEQ ID NO: 483328 - RNA, 17 nt, Chlamydia trachomatis
cacuugaucuaucuuuc

SEQ ID NO: 483329 - RNA, 19 nt, Chlamydia trachomatis
cacuugaucuaucuuucuu

SEQ ID NO: 483330 - RNA, 21 nt, Chlamydia trachomatis
cacuugaucuaucuuucuuag

SEQ ID NO: 483331 - RNA, 16 nt, Chlamydia trachomatis
cacuucucgaaaaaau

SEQ ID NO: 483332 - RNA, 21 nt, Chlamydia trachomatis
cacuuugauaauacucuucua

SEQ ID NO: 483333 - RNA, 15 nt, Chlamydia trachomatis
cagaaacuucuucua

SEQ ID NO: 483334 - RNA, 23 nt, Chlamydia trachomatis
cagaaaauucuacaacagcaaau

SEQ ID NO: 483335 - RNA, 12 nt, Chlamydia trachomatis
cagaaccuucca

SEQ ID NO: 483336 - RNA, 22 nt, Chlamydia trachomatis
cagaaccuuccacuuuugugaa

SEQ ID NO: 483337 - RNA, 22 nt, Chlamydia trachomatis
cagaacauuucucgucagggga

SEQ ID NO: 483338 - RNA, 15 nt, Chlamydia trachomatis
cagaaaguccugcuu

SEQ ID NO: 483339 - RNA, 20 nt, Chlamydia trachomatis
cagaacagcucuagcuaaac

SEQ ID NO: 483340 - RNA, 23 nt, Chlamydia trachomatis
cagaacagcucuagcuaaaccca

SEQ ID NO: 483341 - RNA, 15 nt, Chlamydia trachomatis
cagaagaaccuccau

SEQ ID NO: 483342 - RNA, 18 nt, Chlamydia trachomatis
cagaagaaccuccauaag

SEQ ID NO: 483343 - RNA, 12 nt, Chlamydia trachomatis
cagaagaagagc

SEQ ID NO: 483344 - RNA, 19 nt, Chlamydia trachomatis
cagaagaagagcugcuguc

SEQ ID NO: 483345 - RNA, 22 nt, Chlamydia trachomatis
cagaagaagagcugcugucaga

SEQ ID NO: 483346 - RNA, 15 nt, Chlamydia trachomatis
cagaagaauaggaau

SEQ ID NO: 483347 - RNA, 20 nt, Chlamydia trachomatis
cagaagaccagucaauuucu

SEQ ID NO: 483348 - RNA, 13 nt, Chlamydia trachomatis
cagaagcugcaga

SEQ ID NO: 483349 - RNA, 14 nt, Chlamydia trachomatis
cagaaguggcugua

SEQ ID NO: 483350 - RNA, 21 nt, Chlamydia trachomatis
cagaaguggcuguaauguuaa

SEQ ID NO: 483351 - RNA, 13 nt, Chlamydia trachomatis
cagaaguuuuaac

SEQ ID NO: 483352 - RNA, 14 nt, Chlamydia trachomatis
cagaaguuuuaaca

SEQ ID NO: 483353 - RNA, 18 nt, Chlamydia trachomatis
cagaaucuuuggaagcag

SEQ ID NO: 483354 - RNA, 21 nt, Chlamydia trachomatis
cagaaucuuuggaagcagaaa

SEQ ID NO: 483355 - RNA, 13 nt, Chlamydia trachomatis
cagacaucuaaag

SEQ ID NO: 483356 - RNA, 19 nt, Chlamydia trachomatis
cagacaucuaaagucugaa

SEQ ID NO: 483357 - RNA, 11 nt, Chlamydia trachomatis
cagacaaaaag

SEQ ID NO: 483358 - RNA, 16 nt, Chlamydia trachomatis
cagacaaaaagaaagc

SEQ ID NO: 483359 - RNA, 13 nt, Chlamydia trachomatis
cagacaaaacaag

SEQ ID NO: 483360 - RNA, 20 nt, Chlamydia trachomatis
cagaauccuuuucagaauua

SEQ ID NO: 483361 - RNA, 16 nt, Chlamydia trachomatis
cagaccuacaaagaua

SEQ ID NO: 483362 - RNA, 18 nt, Chlamydia trachomatis
cagaccuacaaagauaau

SEQ ID NO: 483363 - RNA, 20 nt, Chlamydia trachomatis
cagacgauauuuaagauaga

SEQ ID NO: 483364 - RNA, 23 nt, Chlamydia trachomatis
cagaggggggcuugcacaaucuc

SEQ ID NO: 483365 - RNA, 16 nt, Chlamydia trachomatis
cagagguaugcagacu

SEQ ID NO: 483366 - RNA, 22 nt, Chlamydia trachomatis
cagagcaaauagaauaaaaggc

SEQ ID NO: 483367 - RNA, 14 nt, Chlamydia trachomatis
cagagauauaagag

SEQ ID NO: 483368 - RNA, 18 nt, Chlamydia trachomatis
cagagauauaaucuaaag

SEQ ID NO: 483369 - RNA, 19 nt, Chlamydia trachomatis
cagagaucccagggagaga

SEQ ID NO: 483370 - RNA, 16 nt, Chlamydia trachomatis
cagagaucuaauugga

SEQ ID NO: 483371 - RNA, 24 nt, Chlamydia trachomatis
cagagaugauauuuucauccacuu

SEQ ID NO: 483372 - RNA, 15 nt, Chlamydia trachomatis
aaaaucacuuucugc

SEQ ID NO: 483373 - RNA, 11 nt, Chlamydia trachomatis
cagagaaaauu

SEQ ID NO: 483374 - RNA, 13 nt, Chlamydia trachomatis
aaaaucgcagcuu

SEQ ID NO: 483375 - RNA, 23 nt, Chlamydia trachomatis
cagauauggaagaacagcagcag

SEQ ID NO: 483376 - RNA, 20 nt, Chlamydia trachomatis
cagauaauucucgcaaagaa

SEQ ID NO: 483377 - RNA, 19 nt, Chlamydia trachomatis
cagauaccaagccauuucc

SEQ ID NO: 483378 - RNA, 20 nt, Chlamydia trachomatis
cagauaccaagccauuucca

SEQ ID NO: 483379 - RNA, 21 nt, Chlamydia trachomatis
cagauaccaagccauuuccag

SEQ ID NO: 483380 - RNA, 12 nt, Chlamydia trachomatis
aaaaucuuccau

SEQ ID NO: 483381 - RNA, 17 nt, Chlamydia trachomatis
aaaaucuuccauaaaau

SEQ ID NO: 483382 - RNA, 18 nt, Chlamydia trachomatis
aaaaucuuccauaaaauc

SEQ ID NO: 483383 - RNA, 19 nt, Chlamydia trachomatis
aaaaucuucauaagaaaau

SEQ ID NO: 483384 - RNA, 20 nt, Chlamydia trachomatis
aaaaucuucauaagaaaauu

SEQ ID NO: 483385 - RNA, 14 nt, Chlamydia trachomatis
cagcaaaaagagga

SEQ ID NO: 483386 - RNA, 15 nt, Chlamydia trachomatis
cagcaaaaagaggag

SEQ ID NO: 483387 - RNA, 21 nt, Chlamydia trachomatis
cagcaaaaccuuuugaaacau

SEQ ID NO: 483388 - RNA, 16 nt, Chlamydia trachomatis
cagauuuuucaaaaau

SEQ ID NO: 483389 - RNA, 20 nt, Chlamydia trachomatis
cagaucccggcuugccugga

SEQ ID NO: 483390 - RNA, 20 nt, Chlamydia trachomatis
cagaucccagccugugcauu

SEQ ID NO: 483391 - RNA, 14 nt, Chlamydia trachomatis
cagaucauaucugc

SEQ ID NO: 483392 - RNA, 20 nt, Chlamydia trachomatis
aaaaucguccaaaaucauca

SEQ ID NO: 483393 - RNA, 22 nt, Chlamydia trachomatis
aaaaugaucgccucuaaagcuu

SEQ ID NO: 483394 - RNA, 22 nt, Chlamydia trachomatis
aaaaugaucuaaaggaaaaauu

SEQ ID NO: 483395 - RNA, 16 nt, Chlamydia trachomatis
aaaaugagaaauaaaa

SEQ ID NO: 483396 - RNA, 18 nt, Chlamydia trachomatis
aaaaugaugaaaaagaag

SEQ ID NO: 483397 - RNA, 20 nt, Chlamydia trachomatis
aaaaugaugaaaaagaagcu

SEQ ID NO: 483398 - RNA, 20 nt, Chlamydia trachomatis
aaaaugcgcucuuuaggcac

SEQ ID NO: 483399 - RNA, 23 nt, Chlamydia trachomatis
aaaaugccgcgucgguuguauaa

SEQ ID NO: 483400 - RNA, 13 nt, Chlamydia trachomatis
cagcaagaagaag

SEQ ID NO: 483401 - RNA, 13 nt, Chlamydia trachomatis
cagcaagagagau

SEQ ID NO: 483402 - RNA, 19 nt, Chlamydia trachomatis
cagcaagagagauugauag

SEQ ID NO: 483403 - RNA, 19 nt, Chlamydia trachomatis
cagcagauauggaagaaca

SEQ ID NO: 483404 - RNA, 21 nt, Chlamydia trachomatis
cagcagaucauccauaaaaac

SEQ ID NO: 483405 - RNA, 16 nt, Chlamydia trachomatis
cagccaauuucucuac

SEQ ID NO: 483406 - RNA, 14 nt, Chlamydia trachomatis
cagccacuccugca

SEQ ID NO: 483407 - RNA, 18 nt, Chlamydia trachomatis
cagccacuccugcagcua

SEQ ID NO: 483408 - RNA, 22 nt, Chlamydia trachomatis
cagccacuugcuccacacaaca

SEQ ID NO: 483409 - RNA, 18 nt, Chlamydia trachomatis
cagccccuucaauuucuu

SEQ ID NO: 483410 - RNA, 17 nt, Chlamydia trachomatis
cagcgcuuucuaaagca

SEQ ID NO: 483411 - RNA, 20 nt, Chlamydia trachomatis
cagcgcuuucuaaagcagcu

SEQ ID NO: 483412 - RNA, 14 nt, Chlamydia trachomatis
aaaauguuugagua

SEQ ID NO: 483413 - RNA, 21 nt, Chlamydia trachomatis
aaaauuaacgcuguuggacca

SEQ ID NO: 483414 - RNA, 22 nt, Chlamydia trachomatis
aaaauuacaauaauacaaagca

SEQ ID NO: 483415 - RNA, 13 nt, Chlamydia trachomatis
cagcgucaucuuu

SEQ ID NO: 483416 - RNA, 13 nt, Chlamydia trachomatis
cagcugcuuggaa

SEQ ID NO: 483417 - RNA, 15 nt, Chlamydia trachomatis
cagcugcuuggaaua

SEQ ID NO: 483418 - RNA, 23 nt, Chlamydia trachomatis
cagcuucuucuauaagaaacaca

SEQ ID NO: 483419 - RNA, 15 nt, Chlamydia trachomatis
cagcuuucacaggga

SEQ ID NO: 483420 - RNA, 19 nt, Chlamydia trachomatis
caggaaagugcauaccuuu

SEQ ID NO: 483421 - RNA, 21 nt, Chlamydia trachomatis
caggaccagagaucauaaagu

SEQ ID NO: 483422 - RNA, 19 nt, Chlamydia trachomatis
caggaguaaauccugcuug

SEQ ID NO: 483423 - RNA, 15 nt, Chlamydia trachomatis
caggaguaggaaggu

SEQ ID NO: 483424 - RNA, 17 nt, Chlamydia trachomatis
caggaucccucugucca

SEQ ID NO: 483425 - RNA, 19 nt, Chlamydia trachomatis
caggaucgcuaucaauaaa

SEQ ID NO: 483426 - RNA, 21 nt, Chlamydia trachomatis
caggaucgcuaucaauaaaaa

SEQ ID NO: 483427 - RNA, 20 nt, Chlamydia trachomatis
caggaucuagacaaucuggu

SEQ ID NO: 483428 - RNA, 20 nt, Chlamydia trachomatis
caggauuggaaaauccaaag

SEQ ID NO: 483429 - RNA, 23 nt, Chlamydia trachomatis
caggcauuuccgguauuaauaau

SEQ ID NO: 483430 - RNA, 21 nt, Chlamydia trachomatis
caggcgcuucucuuugaaaga

SEQ ID NO: 483431 - RNA, 18 nt, Chlamydia trachomatis
cagggaaacguaaaagag

SEQ ID NO: 483432 - RNA, 16 nt, Chlamydia trachomatis
caggcuuuucuuuuuu

SEQ ID NO: 483433 - RNA, 17 nt, Chlamydia trachomatis
caggcuuuucuuuuuug

SEQ ID NO: 483434 - RNA, 19 nt, Chlamydia trachomatis
caggcgaacagugacagca

SEQ ID NO: 483435 - RNA, 20 nt, Chlamydia trachomatis
caggcgaacagugacagcau

SEQ ID NO: 483436 - RNA, 18 nt, Chlamydia trachomatis
caggccucccuaucaauu

SEQ ID NO: 483437 - RNA, 18 nt, Chlamydia trachomatis
aaacaaaaacucucaaau

SEQ ID NO: 483438 - RNA, 17 nt, Chlamydia trachomatis
cagggaucgagucccuu

SEQ ID NO: 483439 - RNA, 18 nt, Chlamydia trachomatis
cagggauggucucacaca

SEQ ID NO: 483440 - RNA, 13 nt, Chlamydia trachomatis
aaacaaacaauaa

SEQ ID NO: 483441 - RNA, 19 nt, Chlamydia trachomatis
aaacaaacaauaaguuacu

SEQ ID NO: 483442 - RNA, 13 nt, Chlamydia trachomatis
aaacaaaauaauc

SEQ ID NO: 483443 - RNA, 21 nt, Chlamydia trachomatis
caggggaauucgcuaaugauu

SEQ ID NO: 483444 - RNA, 17 nt, Chlamydia trachomatis
cagguaccuauaauaau

SEQ ID NO: 483445 - RNA, 18 nt, Chlamydia trachomatis
cagguaccuauaauaaug

SEQ ID NO: 483446 - RNA, 21 nt, Chlamydia trachomatis
caguuaaccuugggaaucuuc

SEQ ID NO: 483447 - RNA, 15 nt, Chlamydia trachomatis
caguuacauuuuucg

SEQ ID NO: 483448 - RNA, 14 nt, Chlamydia trachomatis
caguuacccucuuu

SEQ ID NO: 483449 - RNA, 19 nt, Chlamydia trachomatis
caguuaggcauuccuuucu

SEQ ID NO: 483450 - RNA, 22 nt, Chlamydia trachomatis
caguuauaacgauauccuucug

SEQ ID NO: 483451 - RNA, 23 nt, Chlamydia trachomatis
caguucuggagcaacaaccaacu

SEQ ID NO: 483452 - RNA, 22 nt, Chlamydia trachomatis
caguugcuccuccgugacgaau

SEQ ID NO: 483453 - RNA, 15 nt, Chlamydia trachomatis
caguuucuccuaaag

SEQ ID NO: 483454 - RNA, 18 nt, Chlamydia trachomatis
caguuucuccuaaaguug

SEQ ID NO: 483455 - RNA, 23 nt, Chlamydia trachomatis
caguuugaaucacagaaacuucu

SEQ ID NO: 483456 - RNA, 18 nt, Chlamydia trachomatis
caguuugagcuuuauuuu

SEQ ID NO: 483457 - RNA, 17 nt, Chlamydia trachomatis
caguuugucuuagaaga

SEQ ID NO: 483458 - RNA, 18 nt, Chlamydia trachomatis
caguuuuuuggggggauu

SEQ ID NO: 483459 - RNA, 23 nt, Chlamydia trachomatis
caguuucuaggucugaagaaaaa

SEQ ID NO: 483460 - RNA, 14 nt, Chlamydia trachomatis
caguuuaggacgcu

SEQ ID NO: 483461 - RNA, 14 nt, Chlamydia trachomatis
cauaaggaagaugg

SEQ ID NO: 483462 - RNA, 18 nt, Chlamydia trachomatis
cauaaggaagcaaaaacu

SEQ ID NO: 483463 - RNA, 22 nt, Chlamydia trachomatis
cauaaggaagcaaaaacugucu

SEQ ID NO: 483464 - RNA, 16 nt, Chlamydia trachomatis
cauaagcucuaacucu

SEQ ID NO: 483465 - RNA, 23 nt, Chlamydia trachomatis
cauaagcucuaacucuucuuuau

SEQ ID NO: 483466 - RNA, 15 nt, Chlamydia trachomatis
cauaagcaaauccug

SEQ ID NO: 483467 - RNA, 16 nt, Chlamydia trachomatis
cauaagcagggcugua

SEQ ID NO: 483468 - RNA, 14 nt, Chlamydia trachomatis
cauaagaaauuaac

SEQ ID NO: 483469 - RNA, 18 nt, Chlamydia trachomatis
cauaagaaauuaacacca

SEQ ID NO: 483470 - RNA, 17 nt, Chlamydia trachomatis
cauaagaauguuuccua

SEQ ID NO: 483471 - RNA, 19 nt, Chlamydia trachomatis
cauaagagaggcuugagaa

SEQ ID NO: 483472 - RNA, 18 nt, Chlamydia trachomatis
cauaacagggaaaaacag

SEQ ID NO: 483473 - RNA, 21 nt, Chlamydia trachomatis
cauaacaccugcauagcugaa

SEQ ID NO: 483474 - RNA, 16 nt, Chlamydia trachomatis
cauaacaucuaacaga

SEQ ID NO: 483475 - RNA, 22 nt, Chlamydia trachomatis
cauaaauuugcugagaucgagc

SEQ ID NO: 483476 - RNA, 23 nt, Chlamydia trachomatis
cauaaauuugcugagaucgagcu

SEQ ID NO: 483477 - RNA, 18 nt, Chlamydia trachomatis
cauaacgaguguagggua

SEQ ID NO: 483478 - RNA, 17 nt, Chlamydia trachomatis
cauaacgauccucuuga

SEQ ID NO: 483479 - RNA, 15 nt, Chlamydia trachomatis
cauaaaggaaagggc

SEQ ID NO: 483480 - RNA, 19 nt, Chlamydia trachomatis
cauaaaauccaauguaaaa

SEQ ID NO: 483481 - RNA, 14 nt, Chlamydia trachomatis
cauaaaaaagaccc

SEQ ID NO: 483482 - RNA, 21 nt, Chlamydia trachomatis
cauaaaaagauagugcagaag

SEQ ID NO: 483483 - RNA, 22 nt, Chlamydia trachomatis
cauaaaacucuccaaacucuau

SEQ ID NO: 483484 - RNA, 14 nt, Chlamydia trachomatis
cauaaaagagaaga

SEQ ID NO: 483485 - RNA, 16 nt, Chlamydia trachomatis
cauaaaagagaagaac

SEQ ID NO: 483486 - RNA, 16 nt, Chlamydia trachomatis
cauaauuuucuucacu

SEQ ID NO: 483487 - RNA, 23 nt, Chlamydia trachomatis
cauaauuuucuucacuuccucuc

SEQ ID NO: 483488 - RNA, 23 nt, Chlamydia trachomatis
cauaauccuaugcaguaaagaaa

SEQ ID NO: 483489 - RNA, 20 nt, Chlamydia trachomatis
cauaauagcuugcacagcaa

SEQ ID NO: 483490 - RNA, 20 nt, Chlamydia trachomatis
cauaauaggaggaacccuuu

SEQ ID NO: 483491 - RNA, 18 nt, Chlamydia trachomatis
cauaauaguuaaaacaca

SEQ ID NO: 483492 - RNA, 21 nt, Chlamydia trachomatis
cauaauaguuaaaacacaaaa

SEQ ID NO: 483493 - RNA, 16 nt, Chlamydia trachomatis
cauacaugcuuuugau

SEQ ID NO: 483494 - RNA, 22 nt, Chlamydia trachomatis
cauacaugauagucagaauaau

SEQ ID NO: 483495 - RNA, 17 nt, Chlamydia trachomatis
cauaccaauauuuuuuc

SEQ ID NO: 483496 - RNA, 12 nt, Chlamydia trachomatis
cauacaucaucu

SEQ ID NO: 483497 - RNA, 14 nt, Chlamydia trachomatis
cauacaggagagac

SEQ ID NO: 483498 - RNA, 15 nt, Chlamydia trachomatis
cauacaggagagaca

SEQ ID NO: 483499 - RNA, 14 nt, Chlamydia trachomatis
cauacaccugcaag

SEQ ID NO: 483500 - RNA, 17 nt, Chlamydia trachomatis
cauacacaucaaaauga

SEQ ID NO: 483501 - RNA, 22 nt, Chlamydia trachomatis
cauacccuaacgaggcacaaaa

SEQ ID NO: 483502 - RNA, 20 nt, Chlamydia trachomatis
cauaccgaggauccuaacca

SEQ ID NO: 483503 - RNA, 15 nt, Chlamydia trachomatis
cauaucuccuaaaag

SEQ ID NO: 483504 - RNA, 19 nt, Chlamydia trachomatis
cauagucugauccauuuuc

SEQ ID NO: 483505 - RNA, 16 nt, Chlamydia trachomatis
cauacgcugcugacaa

SEQ ID NO: 483506 - RNA, 14 nt, Chlamydia trachomatis
cauacucagcgauu

SEQ ID NO: 483507 - RNA, 16 nt, Chlamydia trachomatis
cauaugcagaagacca

SEQ ID NO: 483508 - RNA, 16 nt, Chlamydia trachomatis
cauaugcgucuucccu

SEQ ID NO: 483509 - RNA, 16 nt, Chlamydia trachomatis
cauauuagacacuaaa

SEQ ID NO: 483510 - RNA, 19 nt, Chlamydia trachomatis
cauauuuaauugcauuaau

SEQ ID NO: 483511 - RNA, 13 nt, Chlamydia trachomatis
caucaaaauauag

SEQ ID NO: 483512 - RNA, 16 nt, Chlamydia trachomatis
caucaaacucuuuuuc

SEQ ID NO: 483513 - RNA, 17 nt, Chlamydia trachomatis
caucagccccaaaaaca

SEQ ID NO: 483514 - RNA, 13 nt, Chlamydia trachomatis
caucaaucacucu

SEQ ID NO: 483515 - RNA, 23 nt, Chlamydia trachomatis
caucaauccuggaaucacaugcu

SEQ ID NO: 483516 - RNA, 16 nt, Chlamydia trachomatis
caucaaugauguaguu

SEQ ID NO: 483517 - RNA, 18 nt, Chlamydia trachomatis
caucaucucucagcagau

SEQ ID NO: 483518 - RNA, 22 nt, Chlamydia trachomatis
caucaucgagaacggcaauaaa

SEQ ID NO: 483519 - RNA, 14 nt, Chlamydia trachomatis
caucaguaaaaaua

SEQ ID NO: 483520 - RNA, 16 nt, Chlamydia trachomatis
caucaguaaaaauaau

SEQ ID NO: 483521 - RNA, 14 nt, Chlamydia trachomatis
cauccgcuaaagga

SEQ ID NO: 483522 - RNA, 18 nt, Chlamydia trachomatis
cauccgcuaaaggaucug

SEQ ID NO: 483523 - RNA, 14 nt, Chlamydia trachomatis
caucccuugaacua

SEQ ID NO: 483524 - RNA, 19 nt, Chlamydia trachomatis
cauccguuucuagaagaac

SEQ ID NO: 483525 - RNA, 18 nt, Chlamydia trachomatis
cauccuaggggauuuuau

SEQ ID NO: 483526 - RNA, 16 nt, Chlamydia trachomatis
caucgaaugccccaga

SEQ ID NO: 483527 - RNA, 22 nt, Chlamydia trachomatis
cauccugcguguacauuagcaa

SEQ ID NO: 483528 - RNA, 15 nt, Chlamydia trachomatis
caucgauauuuuugg

SEQ ID NO: 483529 - RNA, 15 nt, Chlamydia trachomatis
caucguuuaugaagc

SEQ ID NO: 483530 - RNA, 13 nt, Chlamydia trachomatis
caucuaacagaac

SEQ ID NO: 483531 - RNA, 19 nt, Chlamydia trachomatis
caucuccauccgaauuagc

SEQ ID NO: 483532 - RNA, 23 nt, Chlamydia trachomatis
caucucaaugagcgcuuuuucuu

SEQ ID NO: 483533 - RNA, 18 nt, Chlamydia trachomatis
caucuccaaucacagcaa

SEQ ID NO: 483534 - RNA, 14 nt, Chlamydia trachomatis
caucuacaaaacca

SEQ ID NO: 483535 - RNA, 23 nt, Chlamydia trachomatis
caucuauugagaagacuuacucu

SEQ ID NO: 483536 - RNA, 17 nt, Chlamydia trachomatis
caucucgguauucucaa

SEQ ID NO: 483537 - RNA, 18 nt, Chlamydia trachomatis
caucucgguauucucaau

SEQ ID NO: 483538 - RNA, 16 nt, Chlamydia trachomatis
caucucuauacggaga

SEQ ID NO: 483539 - RNA, 22 nt, Chlamydia trachomatis
caucucggaucgagaagagcca

SEQ ID NO: 483540 - RNA, 17 nt, Chlamydia trachomatis
caucugcgauacggaag

SEQ ID NO: 483541 - RNA, 17 nt, Chlamydia trachomatis
caucuguugucgauuuu

SEQ ID NO: 483542 - RNA, 13 nt, Chlamydia trachomatis
caucuguuuaggu

SEQ ID NO: 483543 - RNA, 22 nt, Chlamydia trachomatis
caucuguauggcagacaaaaca

SEQ ID NO: 483544 - RNA, 23 nt, Chlamydia trachomatis
caucugugucauaagcucuaacu

SEQ ID NO: 483545 - RNA, 20 nt, Chlamydia trachomatis
caucuuaggaucuaacgcau

SEQ ID NO: 483546 - RNA, 16 nt, Chlamydia trachomatis
caucugguugguugug

SEQ ID NO: 483547 - RNA, 14 nt, Chlamydia trachomatis
caucuggaguggca

SEQ ID NO: 483548 - RNA, 17 nt, Chlamydia trachomatis
cauggaacgauuaucuu

SEQ ID NO: 483549 - RNA, 15 nt, Chlamydia trachomatis
cauggaagacaacau

SEQ ID NO: 483550 - RNA, 16 nt, Chlamydia trachomatis
cauggagcuucaucau

SEQ ID NO: 483551 - RNA, 20 nt, Chlamydia trachomatis
caucuucggacauugaacau

SEQ ID NO: 483552 - RNA, 14 nt, Chlamydia trachomatis
caugcuccuuucac

SEQ ID NO: 483553 - RNA, 19 nt, Chlamydia trachomatis
caugcuccuuucacuucau

SEQ ID NO: 483554 - RNA, 16 nt, Chlamydia trachomatis
caucuucaccaacucc

SEQ ID NO: 483555 - RNA, 15 nt, Chlamydia trachomatis
caucuuccaaaggau

SEQ ID NO: 483556 - RNA, 20 nt, Chlamydia trachomatis
caucuuccaaaggauauaca

SEQ ID NO: 483557 - RNA, 20 nt, Chlamydia trachomatis
caucuucccaauauauuccu

SEQ ID NO: 483558 - RNA, 21 nt, Chlamydia trachomatis
cauggcguuagaauaccaacu

SEQ ID NO: 483559 - RNA, 20 nt, Chlamydia trachomatis
caugguauucuaaagucuua

SEQ ID NO: 483560 - RNA, 17 nt, Chlamydia trachomatis
cauguccuaccaauauu

SEQ ID NO: 483561 - RNA, 12 nt, Chlamydia trachomatis
caugugaacaga

SEQ ID NO: 483562 - RNA, 15 nt, Chlamydia trachomatis
caugugaacagagcu

SEQ ID NO: 483563 - RNA, 20 nt, Chlamydia trachomatis
cauguggguaugucugugau

SEQ ID NO: 483564 - RNA, 17 nt, Chlamydia trachomatis
cauguguuucuggaaag

SEQ ID NO: 483565 - RNA, 20 nt, Chlamydia trachomatis
cauuaauagcggguucuuuu

SEQ ID NO: 483566 - RNA, 15 nt, Chlamydia trachomatis
cauuacauauagcau

SEQ ID NO: 483567 - RNA, 21 nt, Chlamydia trachomatis
cauuacgaggaagcuguuuau

SEQ ID NO: 483568 - RNA, 21 nt, Chlamydia trachomatis
cauuacgccccuucuucaaga

SEQ ID NO: 483569 - RNA, 15 nt, Chlamydia trachomatis
cauuacuguacuccu

SEQ ID NO: 483570 - RNA, 16 nt, Chlamydia trachomatis
cauuacuguacuccuc

SEQ ID NO: 483571 - RNA, 14 nt, Chlamydia trachomatis
cauuagcaaucaca

SEQ ID NO: 483572 - RNA, 12 nt, Chlamydia trachomatis
cauucaauaagc

SEQ ID NO: 483573 - RNA, 13 nt, Chlamydia trachomatis
cauucgaaucauu

SEQ ID NO: 483574 - RNA, 15 nt, Chlamydia trachomatis
cauuccuuggcaaag

SEQ ID NO: 483575 - RNA, 15 nt, Chlamydia trachomatis
cauucgccucuucuc

SEQ ID NO: 483576 - RNA, 18 nt, Chlamydia trachomatis
cauuccggcucucuucac

SEQ ID NO: 483577 - RNA, 22 nt, Chlamydia trachomatis
cauuggaauuuucaucaaaaua

SEQ ID NO: 483578 - RNA, 19 nt, Chlamydia trachomatis
cauugcgcagaucuccuuc

SEQ ID NO: 483579 - RNA, 15 nt, Chlamydia trachomatis
cauucguguguagga

SEQ ID NO: 483580 - RNA, 18 nt, Chlamydia trachomatis
cauugauuccauuugcua

SEQ ID NO: 483581 - RNA, 23 nt, Chlamydia trachomatis
cauugugaacaauaauucaggcu

SEQ ID NO: 483582 - RNA, 12 nt, Chlamydia trachomatis
cauuuacaaacg

SEQ ID NO: 483583 - RNA, 20 nt, Chlamydia trachomatis
cauuguaaauagacuucuuc

SEQ ID NO: 483584 - RNA, 21 nt, Chlamydia trachomatis
cauuguaucugggauggaaau

SEQ ID NO: 483585 - RNA, 17 nt, Chlamydia trachomatis
cauuugccaaugaaaua

SEQ ID NO: 483586 - RNA, 19 nt, Chlamydia trachomatis
cauuugccaaugaaauauc

SEQ ID NO: 483587 - RNA, 16 nt, Chlamydia trachomatis
cauuugccauauccuu

SEQ ID NO: 483588 - RNA, 14 nt, Chlamydia trachomatis
cauuugccaaaaag

SEQ ID NO: 483589 - RNA, 16 nt, Chlamydia trachomatis
cauuugcgugauaaaa

SEQ ID NO: 483590 - RNA, 21 nt, Chlamydia trachomatis
cauuugcgugauaaaaacucu

SEQ ID NO: 483591 - RNA, 14 nt, Chlamydia trachomatis
cauuugcucuucca

SEQ ID NO: 483592 - RNA, 13 nt, Chlamydia trachomatis
cauuugugugagu

SEQ ID NO: 483593 - RNA, 21 nt, Chlamydia trachomatis
cauuuuaaggacuucaacaaa

SEQ ID NO: 483594 - RNA, 22 nt, Chlamydia trachomatis
cauuuuauccgcaguaaaaucu

SEQ ID NO: 483595 - RNA, 18 nt, Chlamydia trachomatis
cauuucgaguuuuuuugu

SEQ ID NO: 483596 - RNA, 23 nt, Chlamydia trachomatis
cauuuccuaaggcuugggugacu

SEQ ID NO: 483597 - RNA, 23 nt, Chlamydia trachomatis
cauuuccgguauuaauaaugaaa

SEQ ID NO: 483598 - RNA, 21 nt, Chlamydia trachomatis
cauuuccagccucuccagaaa

SEQ ID NO: 483599 - RNA, 16 nt, Chlamydia trachomatis
cauuuccauagaaaga

SEQ ID NO: 483600 - RNA, 20 nt, Chlamydia trachomatis
cauuuacuccuaucgauucu

SEQ ID NO: 483601 - RNA, 23 nt, Chlamydia trachomatis
cauuuauccacaggucauaucca

SEQ ID NO: 483602 - RNA, 18 nt, Chlamydia trachomatis
cauuucaagagagaucua

SEQ ID NO: 483603 - RNA, 20 nt, Chlamydia trachomatis
cauuucacuauccaaagcug

SEQ ID NO: 483604 - RNA, 21 nt, Chlamydia trachomatis
ccaaaguaaucucuuaauccu

SEQ ID NO: 483605 - RNA, 17 nt, Chlamydia trachomatis
ccaaagcugcuuuagcu

SEQ ID NO: 483606 - RNA, 13 nt, Chlamydia trachomatis
ccaaagcuucuaa

SEQ ID NO: 483607 - RNA, 18 nt, Chlamydia trachomatis
ccaaaucaaaccaaaaau

SEQ ID NO: 483608 - RNA, 20 nt, Chlamydia trachomatis
cauuuuauuggcguaggcuu

SEQ ID NO: 483609 - RNA, 15 nt, Chlamydia trachomatis
cauuuuccaagaaaa

SEQ ID NO: 483610 - RNA, 17 nt, Chlamydia trachomatis
cauuuuccaagaaaaau

SEQ ID NO: 483611 - RNA, 15 nt, Chlamydia trachomatis
ccaaauccuccauaa

SEQ ID NO: 483612 - RNA, 14 nt, Chlamydia trachomatis
ccaaauccuccugc

SEQ ID NO: 483613 - RNA, 22 nt, Chlamydia trachomatis
ccaaaucugcaagaacaaagaa

SEQ ID NO: 483614 - RNA, 23 nt, Chlamydia trachomatis
ccaaaucugcaagaacaaagaau

SEQ ID NO: 483615 - RNA, 14 nt, Chlamydia trachomatis
ccaacaagggaaug

SEQ ID NO: 483616 - RNA, 17 nt, Chlamydia trachomatis
ccaacuggcaagucuag

SEQ ID NO: 483617 - RNA, 15 nt, Chlamydia trachomatis
ccaagcacuccucag

SEQ ID NO: 483618 - RNA, 16 nt, Chlamydia trachomatis
ccaaggaaaagaugaa

SEQ ID NO: 483619 - RNA, 19 nt, Chlamydia trachomatis
ccaaggaaaagaugaagaa

SEQ ID NO: 483620 - RNA, 13 nt, Chlamydia trachomatis
ccaaggaaaccaa

SEQ ID NO: 483621 - RNA, 13 nt, Chlamydia trachomatis
ccaagcuucuugg

SEQ ID NO: 483622 - RNA, 15 nt, Chlamydia trachomatis
ccaacgucccugugu

SEQ ID NO: 483623 - RNA, 20 nt, Chlamydia trachomatis
ccaacgcuugcacagcacga

SEQ ID NO: 483624 - RNA, 17 nt, Chlamydia trachomatis
ccaacgcaucuccaaag

SEQ ID NO: 483625 - RNA, 18 nt, Chlamydia trachomatis
ccaacgcauguaauucau

SEQ ID NO: 483626 - RNA, 21 nt, Chlamydia trachomatis
ccaacgagugccgaauaauga

SEQ ID NO: 483627 - RNA, 18 nt, Chlamydia trachomatis
ccaaggauuuuuuuccca

SEQ ID NO: 483628 - RNA, 18 nt, Chlamydia trachomatis
ccaauccuuggcaagaag

SEQ ID NO: 483629 - RNA, 17 nt, Chlamydia trachomatis
ccaaucaguguacccuc

SEQ ID NO: 483630 - RNA, 14 nt, Chlamydia trachomatis
ccaauauuuuuucu

SEQ ID NO: 483631 - RNA, 12 nt, Chlamydia trachomatis
ccaaucacagca

SEQ ID NO: 483632 - RNA, 13 nt, Chlamydia trachomatis
ccaaucacagcaa

SEQ ID NO: 483633 - RNA, 15 nt, Chlamydia trachomatis
ccaaucacagcaaua

SEQ ID NO: 483634 - RNA, 14 nt, Chlamydia trachomatis
ccaaucaccgcugc

SEQ ID NO: 483635 - RNA, 19 nt, Chlamydia trachomatis
ccaauggaccagaucauag

SEQ ID NO: 483636 - RNA, 14 nt, Chlamydia trachomatis
ccaccauagguaga

SEQ ID NO: 483637 - RNA, 16 nt, Chlamydia trachomatis
ccacgaagagcaaaau

SEQ ID NO: 483638 - RNA, 14 nt, Chlamydia trachomatis
ccacgaccacaaac

SEQ ID NO: 483639 - RNA, 15 nt, Chlamydia trachomatis
ccacgaugagauaca

SEQ ID NO: 483640 - RNA, 15 nt, Chlamydia trachomatis
ccacgccauaucaaa

SEQ ID NO: 483641 - RNA, 21 nt, Chlamydia trachomatis
ccacgguaaucuucacggaga

SEQ ID NO: 483642 - RNA, 22 nt, Chlamydia trachomatis
ccacgugcaacacaacuucugc

SEQ ID NO: 483643 - RNA, 21 nt, Chlamydia trachomatis
ccacugauggcuucgcaagca

SEQ ID NO: 483644 - RNA, 16 nt, Chlamydia trachomatis
ccagccuacaaauaaa

SEQ ID NO: 483645 - RNA, 16 nt, Chlamydia trachomatis
ccagccucuccagaaa

SEQ ID NO: 483646 - RNA, 23 nt, Chlamydia trachomatis
ccagcgucuccaaauaaucccac

SEQ ID NO: 483647 - RNA, 15 nt, Chlamydia trachomatis
ccagcucauuagaga

SEQ ID NO: 483648 - RNA, 15 nt, Chlamydia trachomatis
ccagcugcugcccaa

SEQ ID NO: 483649 - RNA, 22 nt, Chlamydia trachomatis
ccagcucuaauuaauaacgccc

SEQ ID NO: 483650 - RNA, 23 nt, Chlamydia trachomatis
ccaggagagucugcuacaaacug

SEQ ID NO: 483651 - RNA, 18 nt, Chlamydia trachomatis
ccaggagauguaggauuc

SEQ ID NO: 483652 - RNA, 19 nt, Chlamydia trachomatis
ccaguucuucacuuuucua

SEQ ID NO: 483653 - RNA, 21 nt, Chlamydia trachomatis
ccaguuucuucuacaaguucu

SEQ ID NO: 483654 - RNA, 15 nt, Chlamydia trachomatis
ccauagaaagauaga

SEQ ID NO: 483655 - RNA, 14 nt, Chlamydia trachomatis
ccauaauaguuaaa

SEQ ID NO: 483656 - RNA, 16 nt, Chlamydia trachomatis
ccauaacgaagauuaa

SEQ ID NO: 483657 - RNA, 22 nt, Chlamydia trachomatis
ccauaacgguagcgucuggaua

SEQ ID NO: 483658 - RNA, 23 nt, Chlamydia trachomatis
ccauaacguccgcuccuucuuuc

SEQ ID NO: 483659 - RNA, 17 nt, Chlamydia trachomatis
ccauauccaugaagacc

SEQ ID NO: 483660 - RNA, 14 nt, Chlamydia trachomatis
ccauaucaaagcua

SEQ ID NO: 483661 - RNA, 15 nt, Chlamydia trachomatis
ccaucaauaagagca

SEQ ID NO: 483662 - RNA, 19 nt, Chlamydia trachomatis
ccaucacuccaagaagagu

SEQ ID NO: 483663 - RNA, 20 nt, Chlamydia trachomatis
ccaucaggaauagcuacagc

SEQ ID NO: 483664 - RNA, 12 nt, Chlamydia trachomatis
aaacaagaauaa

SEQ ID NO: 483665 - RNA, 16 nt, Chlamydia trachomatis
aaacaagguucuucaa

SEQ ID NO: 483666 - RNA, 21 nt, Chlamydia trachomatis
aaacaaggauuuucuucuuuu

SEQ ID NO: 483667 - RNA, 13 nt, Chlamydia trachomatis
aaacaauaaguua

SEQ ID NO: 483668 - RNA, 21 nt, Chlamydia trachomatis
aaacaauauucuuuuccauau

SEQ ID NO: 483669 - RNA, 15 nt, Chlamydia trachomatis
ccauccuuuaucuug

SEQ ID NO: 483670 - RNA, 15 nt, Chlamydia trachomatis
ccaucccuugcaaaa

SEQ ID NO: 483671 - RNA, 17 nt, Chlamydia trachomatis
ccaucguugauauugac

SEQ ID NO: 483672 - RNA, 19 nt, Chlamydia trachomatis
ccaucuccaaucacagcaa

SEQ ID NO: 483673 - RNA, 15 nt, Chlamydia trachomatis
ccaucuguaaagcuu

SEQ ID NO: 483674 - RNA, 15 nt, Chlamydia trachomatis
ccaucugacuuuuua

SEQ ID NO: 483675 - RNA, 21 nt, Chlamydia trachomatis
ccaucuucaauggcaaaacuu

SEQ ID NO: 483676 - RNA, 21 nt, Chlamydia trachomatis
ccauucagcccaaucacccca

SEQ ID NO: 483677 - RNA, 13 nt, Chlamydia trachomatis
ccauucccagauu

SEQ ID NO: 483678 - RNA, 20 nt, Chlamydia trachomatis
ccauugauuccauuugcuac

SEQ ID NO: 483679 - RNA, 14 nt, Chlamydia trachomatis
ccauuguagaugcu

SEQ ID NO: 483680 - RNA, 19 nt, Chlamydia trachomatis
cccaaaccaguuucuucua

SEQ ID NO: 483681 - RNA, 20 nt, Chlamydia trachomatis
cccaaaauuuuucugcucca

SEQ ID NO: 483682 - RNA, 21 nt, Chlamydia trachomatis
cccaaagucaucgcuaaucuc

SEQ ID NO: 483683 - RNA, 22 nt, Chlamydia trachomatis
ccauuucaugacagcuucuuga

SEQ ID NO: 483684 - RNA, 16 nt, Chlamydia trachomatis
cccaaaaacaaucaaa

SEQ ID NO: 483685 - RNA, 20 nt, Chlamydia trachomatis
cccaaaaacaaucaaagcac

SEQ ID NO: 483686 - RNA, 13 nt, Chlamydia trachomatis
cccaaaagaauga

SEQ ID NO: 483687 - RNA, 16 nt, Chlamydia trachomatis
cccaaaauagcaggaa

SEQ ID NO: 483688 - RNA, 12 nt, Chlamydia trachomatis
ccauuuccacag

SEQ ID NO: 483689 - RNA, 20 nt, Chlamydia trachomatis
ccauuuccagccucuccaga

SEQ ID NO: 483690 - RNA, 12 nt, Chlamydia trachomatis
cccaaucuucua

SEQ ID NO: 483691 - RNA, 15 nt, Chlamydia trachomatis
cccaaucuucuaaau

SEQ ID NO: 483692 - RNA, 20 nt, Chlamydia trachomatis
cccacaagugccaacaucaa

SEQ ID NO: 483693 - RNA, 23 nt, Chlamydia trachomatis
cccaauauacaaguauuucuugu

SEQ ID NO: 483694 - RNA, 14 nt, Chlamydia trachomatis
cccaauauauuccu

SEQ ID NO: 483695 - RNA, 12 nt, Chlamydia trachomatis
cccaaucacccc

SEQ ID NO: 483696 - RNA, 18 nt, Chlamydia trachomatis
cccacgaaaagacucucc

SEQ ID NO: 483697 - RNA, 16 nt, Chlamydia trachomatis
cccacgccauaucaaa

SEQ ID NO: 483698 - RNA, 15 nt, Chlamydia trachomatis
ccccagaaacacuau

SEQ ID NO: 483699 - RNA, 12 nt, Chlamydia trachomatis
ccccauucuucu

SEQ ID NO: 483700 - RNA, 15 nt, Chlamydia trachomatis
ccccauucuucucga

SEQ ID NO: 483701 - RNA, 22 nt, Chlamydia trachomatis
ccccccuuuuuuuauucuuucu

SEQ ID NO: 483702 - RNA, 23 nt, Chlamydia trachomatis
ccccuuagggaaaccccaauguu

SEQ ID NO: 483703 - RNA, 19 nt, Chlamydia trachomatis
ccccuuauuuaccuugagu

SEQ ID NO: 483704 - RNA, 18 nt, Chlamydia trachomatis
cccgcauaccaaagcauu

SEQ ID NO: 483705 - RNA, 16 nt, Chlamydia trachomatis
cccgauuacuugagaa

SEQ ID NO: 483706 - RNA, 13 nt, Chlamydia trachomatis
cccgauucaaaaa

SEQ ID NO: 483707 - RNA, 22 nt, Chlamydia trachomatis
cccguaauagagccugggcgag

SEQ ID NO: 483708 - RNA, 13 nt, Chlamydia trachomatis
aaacacugcaaca

SEQ ID NO: 483709 - RNA, 14 nt, Chlamydia trachomatis
cccugcaccucuuu

SEQ ID NO: 483710 - RNA, 21 nt, Chlamydia trachomatis
cccugucauaccaagauuaga

SEQ ID NO: 483711 - RNA, 23 nt, Chlamydia trachomatis
cccuguaguuagguaaucuucua

SEQ ID NO: 483712 - RNA, 16 nt, Chlamydia trachomatis
cccuuuaguuaccaaa

SEQ ID NO: 483713 - RNA, 14 nt, Chlamydia trachomatis
cccuuugguuuuga

SEQ ID NO: 483714 - RNA, 11 nt, Chlamydia trachomatis
cccuuuguagu

SEQ ID NO: 483715 - RNA, 20 nt, Chlamydia trachomatis
cccuuuuuauaaucuccuaa

SEQ ID NO: 483716 - RNA, 15 nt, Chlamydia trachomatis
aaacagaaagaaaug

SEQ ID NO: 483717 - RNA, 16 nt, Chlamydia trachomatis
aaacagaaagaaaugc

SEQ ID NO: 483718 - RNA, 19 nt, Chlamydia trachomatis
aaacagaaccuuuuuaaaa

SEQ ID NO: 483719 - RNA, 22 nt, Chlamydia trachomatis
aaacagaaccuuuuuaaaauaa

SEQ ID NO: 483720 - RNA, 14 nt, Chlamydia trachomatis
aaacaucuuuuaaa

SEQ ID NO: 483721 - RNA, 16 nt, Chlamydia trachomatis
aaaccaaacugguugg

SEQ ID NO: 483722 - RNA, 17 nt, Chlamydia trachomatis
aaaccaaaggcaacaaa

SEQ ID NO: 483723 - RNA, 22 nt, Chlamydia trachomatis
aaaccaacgagugccgaauaau

SEQ ID NO: 483724 - RNA, 17 nt, Chlamydia trachomatis
aaaccacagacucaggu

SEQ ID NO: 483725 - RNA, 14 nt, Chlamydia trachomatis
aaacauuucugcaa

SEQ ID NO: 483726 - RNA, 20 nt, Chlamydia trachomatis
ccgaauuaaaucugcuccua

SEQ ID NO: 483727 - RNA, 18 nt, Chlamydia trachomatis
ccgaagcugcaauagaaa

SEQ ID NO: 483728 - RNA, 18 nt, Chlamydia trachomatis
ccgacuaaaaaauuuuga

SEQ ID NO: 483729 - RNA, 15 nt, Chlamydia trachomatis
aaaccacccuuccca

SEQ ID NO: 483730 - RNA, 13 nt, Chlamydia trachomatis
ccgagccuccgcu

SEQ ID NO: 483731 - RNA, 21 nt, Chlamydia trachomatis
ccgagagaagcuccucuucuu

SEQ ID NO: 483732 - RNA, 16 nt, Chlamydia trachomatis
ccgauagcaugcaaaa

SEQ ID NO: 483733 - RNA, 16 nt, Chlamydia trachomatis
ccgccuucugcaauga

SEQ ID NO: 483734 - RNA, 17 nt, Chlamydia trachomatis
ccgccuuugcuaggguu

SEQ ID NO: 483735 - RNA, 23 nt, Chlamydia trachomatis
aaacccucugcauagcuauaaaa

SEQ ID NO: 483736 - RNA, 13 nt, Chlamydia trachomatis
aaaccgaagaggg

SEQ ID NO: 483737 - RNA, 17 nt, Chlamydia trachomatis
aaaccgaagagggaaga

SEQ ID NO: 483738 - RNA, 23 nt, Chlamydia trachomatis
aaaccgaucccugaauaguugua

SEQ ID NO: 483739 - RNA, 13 nt, Chlamydia trachomatis
ccgcuauuuuccu

SEQ ID NO: 483740 - RNA, 21 nt, Chlamydia trachomatis
ccgcuauuuuccucuucacag

SEQ ID NO: 483741 - RNA, 13 nt, Chlamydia trachomatis
ccgcuagauccgu

SEQ ID NO: 483742 - RNA, 14 nt, Chlamydia trachomatis
ccgcuaauuuuuga

SEQ ID NO: 483743 - RNA, 11 nt, Chlamydia trachomatis
ccgcucuucca

SEQ ID NO: 483744 - RNA, 15 nt, Chlamydia trachomatis
ccgcugcucuaacca

SEQ ID NO: 483745 - RNA, 13 nt, Chlamydia trachomatis
ccggaaaugcaca

SEQ ID NO: 483746 - RNA, 13 nt, Chlamydia trachomatis
ccgcuuggaauac

SEQ ID NO: 483747 - RNA, 16 nt, Chlamydia trachomatis
ccggaaaccuguuucu

SEQ ID NO: 483748 - RNA, 23 nt, Chlamydia trachomatis
ccgcuucuucauguucugugaaa

SEQ ID NO: 483749 - RNA, 15 nt, Chlamydia trachomatis
ccggaguaccaaaaa

SEQ ID NO: 483750 - RNA, 18 nt, Chlamydia trachomatis
ccggaguaccaaaaaauc

SEQ ID NO: 483751 - RNA, 17 nt, Chlamydia trachomatis
aaaccuccuaaauacca

SEQ ID NO: 483752 - RNA, 15 nt, Chlamydia trachomatis
ccguacucugauuag

SEQ ID NO: 483753 - RNA, 15 nt, Chlamydia trachomatis
ccguaaggaagccag

SEQ ID NO: 483754 - RNA, 20 nt, Chlamydia trachomatis
ccguaaggaagccagccccu

SEQ ID NO: 483755 - RNA, 22 nt, Chlamydia trachomatis
ccguaaggaagccagccccucc

SEQ ID NO: 483756 - RNA, 17 nt, Chlamydia trachomatis
ccguaaaagucucuaaa

SEQ ID NO: 483757 - RNA, 13 nt, Chlamydia trachomatis
ccguauccuuucg

SEQ ID NO: 483758 - RNA, 15 nt, Chlamydia trachomatis
aaacgaagccaaaag

SEQ ID NO: 483759 - RNA, 19 nt, Chlamydia trachomatis
aaacgaaggagcuuugauu

SEQ ID NO: 483760 - RNA, 20 nt, Chlamydia trachomatis
aaaccuucuugaaagcuuag

SEQ ID NO: 483761 - RNA, 12 nt, Chlamydia trachomatis
aaaccuugauaa

SEQ ID NO: 483762 - RNA, 15 nt, Chlamydia trachomatis
aaaccuuuugaaaca

SEQ ID NO: 483763 - RNA, 15 nt, Chlamydia trachomatis
ccgucaguugcuccu

SEQ ID NO: 483764 - RNA, 15 nt, Chlamydia trachomatis
ccgucacucuugaua

SEQ ID NO: 483765 - RNA, 17 nt, Chlamydia trachomatis
aaacgauuauguucugu

SEQ ID NO: 483766 - RNA, 12 nt, Chlamydia trachomatis
ccgugauuuccg

SEQ ID NO: 483767 - RNA, 20 nt, Chlamydia trachomatis
ccuaucgcacacaauaaauc

SEQ ID NO: 483768 - RNA, 21 nt, Chlamydia trachomatis
ccucaaacaaucuaaaaaauu

SEQ ID NO: 483769 - RNA, 14 nt, Chlamydia trachomatis
ccucaguauaaaaa

SEQ ID NO: 483770 - RNA, 19 nt, Chlamydia trachomatis
ccucgcagagaaagagcca

SEQ ID NO: 483771 - RNA, 13 nt, Chlamydia trachomatis
ccuccuacuccaa

SEQ ID NO: 483772 - RNA, 19 nt, Chlamydia trachomatis
ccuccuagaaagaaccaca

SEQ ID NO: 483773 - RNA, 15 nt, Chlamydia trachomatis
ccucguuuuuuuaga

SEQ ID NO: 483774 - RNA, 22 nt, Chlamydia trachomatis
ccucuaaacaagguucuucaac

SEQ ID NO: 483775 - RNA, 11 nt, Chlamydia trachomatis
ccucuaaucuu

SEQ ID NO: 483776 - RNA, 14 nt, Chlamydia trachomatis
ccucuaaucuugau

SEQ ID NO: 483777 - RNA, 22 nt, Chlamydia trachomatis
ccucuaauaaacagaucuuuuu

SEQ ID NO: 483778 - RNA, 12 nt, Chlamydia trachomatis
ccucuccagaaa

SEQ ID NO: 483779 - RNA, 16 nt, Chlamydia trachomatis
ccucuccauccugcgu

SEQ ID NO: 483780 - RNA, 14 nt, Chlamydia trachomatis
ccucuaucucuucu

SEQ ID NO: 483781 - RNA, 12 nt, Chlamydia trachomatis
ccucuuucucuc

SEQ ID NO: 483782 - RNA, 17 nt, Chlamydia trachomatis
ccucuggggggaaguau

SEQ ID NO: 483783 - RNA, 16 nt, Chlamydia trachomatis
ccucugguacucaucu

SEQ ID NO: 483784 - RNA, 17 nt, Chlamydia trachomatis
ccucuguuuugaaauuc

SEQ ID NO: 483785 - RNA, 21 nt, Chlamydia trachomatis
ccugaaaguuuuuuccccuga

SEQ ID NO: 483786 - RNA, 17 nt, Chlamydia trachomatis
ccugaacauccaccagc

SEQ ID NO: 483787 - RNA, 20 nt, Chlamydia trachomatis
ccugaaacgaucagcuccug

SEQ ID NO: 483788 - RNA, 15 nt, Chlamydia trachomatis
ccugaagauuuuuua

SEQ ID NO: 483789 - RNA, 15 nt, Chlamydia trachomatis
ccugaaggagcgacu

SEQ ID NO: 483790 - RNA, 21 nt, Chlamydia trachomatis
ccugaauagggauuuuaaaga

SEQ ID NO: 483791 - RNA, 15 nt, Chlamydia trachomatis
ccugaauaguuguag

SEQ ID NO: 483792 - RNA, 15 nt, Chlamydia trachomatis
ccugaccaauaccua

SEQ ID NO: 483793 - RNA, 17 nt, Chlamydia trachomatis
ccugagggccuucuuuu

SEQ ID NO: 483794 - RNA, 16 nt, Chlamydia trachomatis
ccugagcccaaggaga

SEQ ID NO: 483795 - RNA, 16 nt, Chlamydia trachomatis
ccugagaaauugcuca

SEQ ID NO: 483796 - RNA, 24 nt, Chlamydia trachomatis
ccugcaaaaaggcuuacagagagc

SEQ ID NO: 483797 - RNA, 18 nt, Chlamydia trachomatis
ccugcaagcacacuugau

SEQ ID NO: 483798 - RNA, 12 nt, Chlamydia trachomatis
ccugcagacaua

SEQ ID NO: 483799 - RNA, 17 nt, Chlamydia trachomatis
ccugcagcaaauaaggu

SEQ ID NO: 483800 - RNA, 19 nt, Chlamydia trachomatis
ccuguaugugaaaauaucu

SEQ ID NO: 483801 - RNA, 18 nt, Chlamydia trachomatis
ccuguagugaaauaagaa

SEQ ID NO: 483802 - RNA, 20 nt, Chlamydia trachomatis
ccugugaagaaacuucugga

SEQ ID NO: 483803 - RNA, 22 nt, Chlamydia trachomatis
ccugugaagaaacuucuggaga

SEQ ID NO: 483804 - RNA, 17 nt, Chlamydia trachomatis
ccuguucuucaaauucu

SEQ ID NO: 483805 - RNA, 17 nt, Chlamydia trachomatis
ccuguuguguaucaaaa

SEQ ID NO: 483806 - RNA, 13 nt, Chlamydia trachomatis
ccuguuuagaaag

SEQ ID NO: 483807 - RNA, 19 nt, Chlamydia trachomatis
ccuguuuucuuguagaaaa

SEQ ID NO: 483808 - RNA, 16 nt, Chlamydia trachomatis
ccuuccgcagcuucuu

SEQ ID NO: 483809 - RNA, 17 nt, Chlamydia trachomatis
ccuucccgacagaggau

SEQ ID NO: 483810 - RNA, 15 nt, Chlamydia trachomatis
ccuuccccaaaccau

SEQ ID NO: 483811 - RNA, 23 nt, Chlamydia trachomatis
ccuucaugucggccgacuaccug

SEQ ID NO: 483812 - RNA, 18 nt, Chlamydia trachomatis
ccuuaaaugcaguggaag

SEQ ID NO: 483813 - RNA, 22 nt, Chlamydia trachomatis
ccuuaguuuuaauuccaucuuu

SEQ ID NO: 483814 - RNA, 11 nt, Chlamydia trachomatis
ccuucugcuau

SEQ ID NO: 483815 - RNA, 16 nt, Chlamydia trachomatis
ccuugagccuucaauu

SEQ ID NO: 483816 - RNA, 21 nt, Chlamydia trachomatis
ccuugaugaauuuuaucuaaa

SEQ ID NO: 483817 - RNA, 23 nt, Chlamydia trachomatis
ccuugccaucauuaucuucuucu

SEQ ID NO: 483818 - RNA, 16 nt, Chlamydia trachomatis
ccuugccuacagaauc

SEQ ID NO: 483819 - RNA, 18 nt, Chlamydia trachomatis
ccuugggaaucuucuucg

SEQ ID NO: 483820 - RNA, 22 nt, Chlamydia trachomatis
ccuuuuaagauauccauagccu

SEQ ID NO: 483821 - RNA, 22 nt, Chlamydia trachomatis
ccuuuuaaagggggacaaaaau

SEQ ID NO: 483822 - RNA, 15 nt, Chlamydia trachomatis
ccuuucucuaaaaga

SEQ ID NO: 483823 - RNA, 20 nt, Chlamydia trachomatis
ccuuucuuacuccuucucug

SEQ ID NO: 483824 - RNA, 22 nt, Chlamydia trachomatis
ccuuuucuagagaagagagcau

SEQ ID NO: 483825 - RNA, 23 nt, Chlamydia trachomatis
ccuuuucuagagaagagagcauc

SEQ ID NO: 483826 - RNA, 12 nt, Chlamydia trachomatis
cgaaaaaaagau

SEQ ID NO: 483827 - RNA, 13 nt, Chlamydia trachomatis
cgaaaagacucuc

SEQ ID NO: 483828 - RNA, 20 nt, Chlamydia trachomatis
cgaaacauuugcgugauaaa

SEQ ID NO: 483829 - RNA, 20 nt, Chlamydia trachomatis
cgaaacuacccgauucaaaa

SEQ ID NO: 483830 - RNA, 23 nt, Chlamydia trachomatis
cgaaacuacccgauucaaaaauc

SEQ ID NO: 483831 - RNA, 14 nt, Chlamydia trachomatis
cgaaacucaucuuc

SEQ ID NO: 483832 - RNA, 12 nt, Chlamydia trachomatis
cgaaauauugua

SEQ ID NO: 483833 - RNA, 20 nt, Chlamydia trachomatis
cgaaaguuuccuuaaaguuu

SEQ ID NO: 483834 - RNA, 22 nt, Chlamydia trachomatis
cgaaagcauguuucggaauuca

SEQ ID NO: 483835 - RNA, 16 nt, Chlamydia trachomatis
cgaaagcuaagauucc

SEQ ID NO: 483836 - RNA, 17 nt, Chlamydia trachomatis
cgaaaucgaaagguuuc

SEQ ID NO: 483837 - RNA, 13 nt, Chlamydia trachomatis
cgaacaaucggaa

SEQ ID NO: 483838 - RNA, 17 nt, Chlamydia trachomatis
cgaacaaucggaaaugu

SEQ ID NO: 483839 - RNA, 14 nt, Chlamydia trachomatis
cgaacaagaugacu

SEQ ID NO: 483840 - RNA, 12 nt, Chlamydia trachomatis
cgaacaaaacuu

SEQ ID NO: 483841 - RNA, 20 nt, Chlamydia trachomatis
cgaacagugacagcauagau

SEQ ID NO: 483842 - RNA, 22 nt, Chlamydia trachomatis
cgaauaagcauuacacaacucu

SEQ ID NO: 483843 - RNA, 16 nt, Chlamydia trachomatis
cgaagguucuucuucg

SEQ ID NO: 483844 - RNA, 15 nt, Chlamydia trachomatis
cgaauaaucagucgc

SEQ ID NO: 483845 - RNA, 21 nt, Chlamydia trachomatis
cgacuuagcacucaaacacuc

SEQ ID NO: 483846 - RNA, 23 nt, Chlamydia trachomatis
cgagaauuucucggccuuuucua

SEQ ID NO: 483847 - RNA, 23 nt, Chlamydia trachomatis
cgagaaccaaucgagagguccag

SEQ ID NO: 483848 - RNA, 12 nt, Chlamydia trachomatis
cgagagaggggg

SEQ ID NO: 483849 - RNA, 16 nt, Chlamydia trachomatis
cgagagaagcuccucu

SEQ ID NO: 483850 - RNA, 19 nt, Chlamydia trachomatis
cgagauguauuauuuugau

SEQ ID NO: 483851 - RNA, 22 nt, Chlamydia trachomatis
cgagauuaucauucaaaaucca

SEQ ID NO: 483852 - RNA, 15 nt, Chlamydia trachomatis
cgagcauaagaauaa

SEQ ID NO: 483853 - RNA, 18 nt, Chlamydia trachomatis
cgagccaagcugaggcuc

SEQ ID NO: 483854 - RNA, 23 nt, Chlamydia trachomatis
aaacggaagugguuaaugucucu

SEQ ID NO: 483855 - RNA, 14 nt, Chlamydia trachomatis
cgagcuuucuuacg

SEQ ID NO: 483856 - RNA, 12 nt, Chlamydia trachomatis
cgagcuaagaaa

SEQ ID NO: 483857 - RNA, 17 nt, Chlamydia trachomatis
cgaggaauucuucuucu

SEQ ID NO: 483858 - RNA, 17 nt, Chlamydia trachomatis
cgaggcacaaaaucccu

SEQ ID NO: 483859 - RNA, 21 nt, Chlamydia trachomatis
cgaggcuucuucuucuuuagc

SEQ ID NO: 483860 - RNA, 16 nt, Chlamydia trachomatis
cgagugccgaauaaug

SEQ ID NO: 483861 - RNA, 14 nt, Chlamydia trachomatis
cgagucucuugugg

SEQ ID NO: 483862 - RNA, 20 nt, Chlamydia trachomatis
cgagugaucuacagcuguau

SEQ ID NO: 483863 - RNA, 23 nt, Chlamydia trachomatis
cgagucccuucaaucauaggaau

SEQ ID NO: 483864 - RNA, 21 nt, Chlamydia trachomatis
cgaguaaucaaaaaaggaauc

SEQ ID NO: 483865 - RNA, 16 nt, Chlamydia trachomatis
cgauaaaguaaaggau

SEQ ID NO: 483866 - RNA, 18 nt, Chlamydia trachomatis
cgaguucgggaauaauuc

SEQ ID NO: 483867 - RNA, 20 nt, Chlamydia trachomatis
cgaguucgccccucuuuuuc

SEQ ID NO: 483868 - RNA, 21 nt, Chlamydia trachomatis
cgauaaugcuuagaaacuguc

SEQ ID NO: 483869 - RNA, 18 nt, Chlamydia trachomatis
cgauaccaauaaugacac

SEQ ID NO: 483870 - RNA, 22 nt, Chlamydia trachomatis
cgauaugcuuuuuaauauccuc

SEQ ID NO: 483871 - RNA, 20 nt, Chlamydia trachomatis
cgaugcuauuuucagcaaaa

SEQ ID NO: 483872 - RNA, 16 nt, Chlamydia trachomatis
cgcaaacugcucuucu

SEQ ID NO: 483873 - RNA, 13 nt, Chlamydia trachomatis
cgcaaaacaucua

SEQ ID NO: 483874 - RNA, 16 nt, Chlamydia trachomatis
cgauuuucugaaguuc

SEQ ID NO: 483875 - RNA, 12 nt, Chlamydia trachomatis
cgauuuuuaaaa

SEQ ID NO: 483876 - RNA, 20 nt, Chlamydia trachomatis
cgauuugauaucccccuucu

SEQ ID NO: 483877 - RNA, 14 nt, Chlamydia trachomatis
cgauucuugauaaa

SEQ ID NO: 483878 - RNA, 16 nt, Chlamydia trachomatis
cgauucuugauaaaua

SEQ ID NO: 483879 - RNA, 16 nt, Chlamydia trachomatis
cgauguuccccauuca

SEQ ID NO: 483880 - RNA, 12 nt, Chlamydia trachomatis
cgauguucacac

SEQ ID NO: 483881 - RNA, 16 nt, Chlamydia trachomatis
cgcacauccgcuucuu

SEQ ID NO: 483882 - RNA, 20 nt, Chlamydia trachomatis
cgcacaaagauuucuucuuu

SEQ ID NO: 483883 - RNA, 21 nt, Chlamydia trachomatis
cgcacuauuagggagcccagc

SEQ ID NO: 483884 - RNA, 16 nt, Chlamydia trachomatis
cgcagcuuucuuuucc

SEQ ID NO: 483885 - RNA, 14 nt, Chlamydia trachomatis
cgcagcucaccagc

SEQ ID NO: 483886 - RNA, 15 nt, Chlamydia trachomatis
cgcagaucuccuucu

SEQ ID NO: 483887 - RNA, 15 nt, Chlamydia trachomatis
cgcauacucgguaac

SEQ ID NO: 483888 - RNA, 14 nt, Chlamydia trachomatis
cgcauaguguugau

SEQ ID NO: 483889 - RNA, 20 nt, Chlamydia trachomatis
cgcauaugcagaagaccagu

SEQ ID NO: 483890 - RNA, 23 nt, Chlamydia trachomatis
cgcauaugcagaagaccagucaa

SEQ ID NO: 483891 - RNA, 22 nt, Chlamydia trachomatis
aaacgucgugccaccgaaggga

SEQ ID NO: 483892 - RNA, 16 nt, Chlamydia trachomatis
aaacgucgaaaagcuu

SEQ ID NO: 483893 - RNA, 23 nt, Chlamydia trachomatis
aaacguguaauuuccuauuucuu

SEQ ID NO: 483894 - RNA, 15 nt, Chlamydia trachomatis
cgccuugcgcaucaa

SEQ ID NO: 483895 - RNA, 17 nt, Chlamydia trachomatis
cgcgaauaaauccucuu

SEQ ID NO: 483896 - RNA, 12 nt, Chlamydia trachomatis
cgcgucucccua

SEQ ID NO: 483897 - RNA, 16 nt, Chlamydia trachomatis
cgcguaauuuucuagc

SEQ ID NO: 483898 - RNA, 17 nt, Chlamydia trachomatis
cgcuaauuuuugagaga

SEQ ID NO: 483899 - RNA, 17 nt, Chlamydia trachomatis
cgcuaagacuuucucua

SEQ ID NO: 483900 - RNA, 23 nt, Chlamydia trachomatis
cgcuaaaggaucugagcagugac

SEQ ID NO: 483901 - RNA, 20 nt, Chlamydia trachomatis
cgcuuuuuuuuuagaacaga

SEQ ID NO: 483902 - RNA, 13 nt, Chlamydia trachomatis
cggaaagcacuuc

SEQ ID NO: 483903 - RNA, 17 nt, Chlamydia trachomatis
cggaaagcacuucguua

SEQ ID NO: 483904 - RNA, 23 nt, Chlamydia trachomatis
cggaaagguuuguuuccucucuc

SEQ ID NO: 483905 - RNA, 19 nt, Chlamydia trachomatis
cggaacucuacaaaauaaa

SEQ ID NO: 483906 - RNA, 17 nt, Chlamydia trachomatis
cggaagauacagccugc

SEQ ID NO: 483907 - RNA, 20 nt, Chlamydia trachomatis
cggaagugguuaaugucucu

SEQ ID NO: 483908 - RNA, 22 nt, Chlamydia trachomatis
cggaauaagcgaaaaaaaaaga

SEQ ID NO: 483909 - RNA, 15 nt, Chlamydia trachomatis
cggaaggaaaaagaa

SEQ ID NO: 483910 - RNA, 21 nt, Chlamydia trachomatis
cggaauagccuccaaacauuu

SEQ ID NO: 483911 - RNA, 17 nt, Chlamydia trachomatis
cggaaucuugcuggucc

SEQ ID NO: 483912 - RNA, 15 nt, Chlamydia trachomatis
cggaauucauagaag

SEQ ID NO: 483913 - RNA, 13 nt, Chlamydia trachomatis
cggacuugaacca

SEQ ID NO: 483914 - RNA, 15 nt, Chlamydia trachomatis
cggagaagaagaggg

SEQ ID NO: 483915 - RNA, 14 nt, Chlamydia trachomatis
cggagagaaagagg

SEQ ID NO: 483916 - RNA, 20 nt, Chlamydia trachomatis
cggagauacggcuaacucca

SEQ ID NO: 483917 - RNA, 21 nt, Chlamydia trachomatis
cggagauacggcuaacuccag

SEQ ID NO: 483918 - RNA, 19 nt, Chlamydia trachomatis
cggauaaucaaaucgaaac

SEQ ID NO: 483919 - RNA, 15 nt, Chlamydia trachomatis
cggaucaauccccaa

SEQ ID NO: 483920 - RNA, 20 nt, Chlamydia trachomatis
cggaucgagaagagccauca

SEQ ID NO: 483921 - RNA, 20 nt, Chlamydia trachomatis
cggaugaggaauccucuucc

SEQ ID NO: 483922 - RNA, 15 nt, Chlamydia trachomatis
cggauucaagaccaa

SEQ ID NO: 483923 - RNA, 13 nt, Chlamydia trachomatis
cggauucaucaaa

SEQ ID NO: 483924 - RNA, 18 nt, Chlamydia trachomatis
cggcaaaagaucucauag

SEQ ID NO: 483925 - RNA, 22 nt, Human
uggcacuaguauuucuaugaaa

SEQ ID NO: 483926 - RNA, 23 nt, Human
uggcagaucuacaugucuagaga

SEQ ID NO: 483927 - RNA, 20 nt, Human
ugcauacucauuaggauggc

SEQ ID NO: 483928 - RNA, 16 nt, Human
ugcacuccagccugag

SEQ ID NO: 483929 - RNA, 14 nt, Human
ugcauuucuaaagc

SEQ ID NO: 483930 - RNA, 18 nt, Human
ugccgauaucuucagaaa

SEQ ID NO: 483931 - RNA, 22 nt, Human
uccagcuggccgggagccugau

SEQ ID NO: 483932 - RNA, 23 nt, Human
uccaggucuaccaaaaaucucaa

SEQ ID NO: 483933 - RNA, 17 nt, Human
ugagaugggagaaucac

SEQ ID NO: 483934 - RNA, 19 nt, Human
ugagcgcccacuagaccca

SEQ ID NO: 483935 - RNA, 22 nt, Human
uaaauauaaagcaagauaauaa

SEQ ID NO: 483936 - RNA, 16 nt, Human
uaggauguugaaaaag

SEQ ID NO: 483937 - RNA, 23 nt, Human
uauacccccugcaaagcccagcu

SEQ ID NO: 483938 - RNA, 18 nt, Human
gcucauggaauuggagcu

SEQ ID NO: 483939 - RNA, 14 nt, Human
gcucucuggccuuc

SEQ ID NO: 483940 - RNA, 12 nt, Human
gcaaagaaagga

SEQ ID NO: 483941 - RNA, 17 nt, Human
gcagaagcaacccaaau

SEQ ID NO: 483942 - RNA, 18 nt, Human
gaggccacguucuuacua

SEQ ID NO: 483943 - RNA, 11 nt, Human
cuggaaacuuc

SEQ ID NO: 483944 - RNA, 21 nt, Human
cuggccuucggccuccauccu

SEQ ID NO: 483945 - RNA, 16 nt, Human
cuguuuuuaagcuguu

SEQ ID NO: 483946 - RNA, 20 nt, Human
cuuucacaggggacaggaug

SEQ ID NO: 483947 - RNA, 14 nt, Human
gaaccuugaaaacu

SEQ ID NO: 483948 - RNA, 16 nt, Human
gaacucccuuucaaca

SEQ ID NO: 483949 - RNA, 20 nt, Human
gaauaccacaggaaccacaa

SEQ ID NO: 483950 - RNA, 18 nt, Human
cuccaaguucaaaacuua

SEQ ID NO: 483951 - RNA, 14 nt, Human
cuauuuaagagaac

SEQ ID NO: 483952 - RNA, 16 nt, Human
cucgagcguugcuggg

SEQ ID NO: 483953 - RNA, 13 nt, Human
cucuacuaaaaau

SEQ ID NO: 483954 - RNA, 15 nt, Human
cucuuauagaauauu

SEQ ID NO: 483955 - RNA, 20 nt, Human
cuaaauugacacuuaaaaau

SEQ ID NO: 483956 - RNA, 19 nt, Human
ccuucggccuccauccuga

SEQ ID NO: 483957 - RNA, 15 nt, Human
uugauuaagaaagga

SEQ ID NO: 483958 - RNA, 15 nt, Human
uuagaugggcauggu

SEQ ID NO: 483959 - RNA, 19 nt, Human
aaaucaugauauagcuuug

SEQ ID NO: 483960 - RNA, 12 nt, Human
aaauuagaaaug

SEQ ID NO: 483961 - RNA, 20 nt, Human
aacagauuucaaaaaaaaac

SEQ ID NO: 483962 - RNA, 23 nt, Human
aaccccgucucuacuaaaaauac

SEQ ID NO: 483963 - RNA, 15 nt, Human
aacugcuacaaauac

SEQ ID NO: 483964 - RNA, 15 nt, Human
aaagguacuucaaau

SEQ ID NO: 483965 - RNA, 19 nt, Human
uccccaugauguuuagaaa

SEQ ID NO: 483966 - RNA, 15 nt, Human
ugaaauaagccagac

SEQ ID NO: 483967 - RNA, 17 nt, Human
uggaguuucucuagaag

SEQ ID NO: 483968 - RNA, 16 nt, Human
uggccauuacccccag

SEQ ID NO: 483969 - RNA, 12 nt, Human
uggguagacaca

SEQ ID NO: 483970 - RNA, 13 nt, Human
uguccccuauccu

SEQ ID NO: 483971 - RNA, 19 nt, Human
uguguuauuucccucccaa

SEQ ID NO: 483972 - RNA, 13 nt, Human
uguucuauaacaa

SEQ ID NO: 483973 - RNA, 17 nt, Human
uguuuaauucugaaagc

SEQ ID NO: 483974 - RNA, 17 nt, Human
guauccuucagccugaa

SEQ ID NO: 483975 - RNA, 17 nt, Human
uaaaauaugcucuaaac

SEQ ID NO: 483976 - RNA, 22 nt, Human
uaaacaaagagugaaggauuua

SEQ ID NO: 483977 - RNA, 22 nt, Human
uaagacucgggauuaguacaca

SEQ ID NO: 483978 - RNA, 21 nt, Human
uaagagagaaugagagacaca

SEQ ID NO: 483979 - RNA, 13 nt, Human
uagggacccccaa

SEQ ID NO: 483980 - RNA, 21 nt, Human
uaucaaaagaaagaaaaucag

SEQ ID NO: 483981 - RNA, 19 nt, Human
uccacagcugcucaauaaa

SEQ ID NO: 483982 - RNA, 12 nt, Human
gccuauauuuuu

SEQ ID NO: 483983 - RNA, 21 nt, Human
gcuuauugucuagugaaacuc

SEQ ID NO: 483984 - RNA, 19 nt, Human
gauaaggcuguucuuuaaa

SEQ ID NO: 483985 - RNA, 16 nt, Human
cuugccauaaaacuua

SEQ ID NO: 483986 - RNA, 18 nt, Human
gaauucuggauuguguau

SEQ ID NO: 483987 - RNA, 12 nt, Human
cuugaaaacuuu

SEQ ID NO: 483988 - RNA, 13 nt, Human
cuugaaagcugug

SEQ ID NO: 483989 - RNA, 12 nt, Human
cuucaaauccuu

SEQ ID NO: 483990 - RNA, 16 nt, Human
cuaggaaauauuuauu

SEQ ID NO: 483991 - RNA, 21 nt, Human
cgauuauuauuuuagagcauc

SEQ ID NO: 483992 - RNA, 17 nt, Human
caagcauuuagauguau

SEQ ID NO: 483993 - RNA, 22 nt, Human
caucucuucuggguuccuuccu

SEQ ID NO: 483994 - RNA, 15 nt, Human
agugaaagaaaauaa

SEQ ID NO: 483995 - RNA, 19 nt, Human
agugauaagagauguugac

SEQ ID NO: 483996 - RNA, 14 nt, Human
auauuauguuaaaa

SEQ ID NO: 483997 - RNA, 20 nt, Human
agcaggauuagauaaggcug

SEQ ID NO: 483998 - RNA, 18 nt, Human
aggcugaugggcaaaaaa

SEQ ID NO: 483999 - RNA, 16 nt, Human
agauccuggaaaucag

SEQ ID NO: 484000 - RNA, 15 nt, Human
agcaaguauuagaau

SEQ ID NO: 484001 - RNA, 14 nt, Human
acuugccauaaaac

SEQ ID NO: 484002 - RNA, 17 nt, Human
agaaaauaacgauaaaa

SEQ ID NO: 484003 - RNA, 16 nt, Human
agaaaaucaggcuggc

SEQ ID NO: 484004 - RNA, 17 nt, Human
acuguaaaauaauaacu

SEQ ID NO: 484005 - RNA, 19 nt, Human
acucugcaagaagaaauca

SEQ ID NO: 484006 - RNA, 22 nt, Human
acuauauuguuugcuaagcauu

SEQ ID NO: 484007 - RNA, 22 nt, Human
acuaucucauuuccaagcaagu

SEQ ID NO: 484008 - RNA, 21 nt, Human
acucaguuuuaacuagaauuu

SEQ ID NO: 484009 - RNA, 13 nt, Human
acaauaaaagaca

SEQ ID NO: 484010 - RNA, 12 nt, Human
aagcaaauauaa

SEQ ID NO: 484011 - RNA, 16 nt, Human
aagcaacccaaauguu

SEQ ID NO: 484012 - RNA, 21 nt, Human
aagaucugcaacuacuaucca

SEQ ID NO: 484013 - RNA, 22 nt, Human
aagacucugucucaaaaaauaa

SEQ ID NO: 484014 - RNA, 11 nt, Human
aacacacagau

SEQ ID NO: 484015 - RNA, 15 nt, Human
aagaacugaaaucau

SEQ ID NO: 484016 - RNA, 14 nt, Human
aagaaacaaaaauc

SEQ ID NO: 484017 - RNA, 17 nt, Human
ugucucaaaaaauaaaa

SEQ ID NO: 484018 - RNA, 15 nt, Human
uucagauaaucacaa

SEQ ID NO: 484019 - RNA, 12 nt, Human
uucuaauagaac

SEQ ID NO: 484020 - RNA, 16 nt, Human
uugucaauaaaaucca

SEQ ID NO: 484021 - RNA, 18 nt, Human
uuuaaggccaggcauggu

SEQ ID NO: 484022 - RNA, 14 nt, Human
ucuagugaaacucg

SEQ ID NO: 484023 - RNA, 16 nt, Human
uccugaggcuccacuu

SEQ ID NO: 484024 - RNA, 19 nt, Human
ucucuacuaaaaauacaaa

SEQ ID NO: 484025 - RNA, 15 nt, Human
ucccaacuccagaaa

SEQ ID NO: 484026 - RNA, 12 nt, Human
uaccacaggaac

SEQ ID NO: 484027 - RNA, 20 nt, Human
uacugagagugaacaaauuu

SEQ ID NO: 484028 - RNA, 16 nt, Human
uaugcuucuuuguguu

SEQ ID NO: 484029 - RNA, 23 nt, Human
gucuggagggaagccuuggggcu

SEQ ID NO: 484030 - RNA, 20 nt, Human
uacacgagauacagaauuuu

SEQ ID NO: 484031 - RNA, 20 nt, Human
uacagauccccaagccuggc

SEQ ID NO: 484032 - RNA, 20 nt, Human
ggaauguguaagucuuuaau

SEQ ID NO: 484033 - RNA, 21 nt, Human
gcuuauucacaagacccaaaa

SEQ ID NO: 484034 - RNA, 19 nt, Human
gcuucuguuuuauaauuuu

SEQ ID NO: 484035 - RNA, 16 nt, Human
aaagggcuguuauaau

SEQ ID NO: 484036 - RNA, 23 nt, Human
caaaaacuuagaugggcauggug

SEQ ID NO: 484037 - RNA, 22 nt, Human
caaaaauuagccgggcauggug

SEQ ID NO: 484038 - RNA, 16 nt, Human
auuguaaaauggugug

SEQ ID NO: 484039 - RNA, 17 nt, Human
auuguagauaauacagu

SEQ ID NO: 484040 - RNA, 20 nt, Human
augaauuacauuuguauaaa

SEQ ID NO: 484041 - RNA, 16 nt, Human
aucuggaaaguuuucu

SEQ ID NO: 484042 - RNA, 18 nt, Human
aucuguuuuuauauuucu

SEQ ID NO: 484043 - RNA, 12 nt, Human
auccugaggcuc

SEQ ID NO: 484044 - RNA, 16 nt, Human
aggaaugaaguacuca

SEQ ID NO: 484045 - RNA, 22 nt, Human
aggcagaagcaacccaaauguu

SEQ ID NO: 484046 - RNA, 19 nt, Human
agcuugcccuggugccuca

SEQ ID NO: 484047 - RNA, 16 nt, Human
aggcuccacuuggucu

SEQ ID NO: 484048 - RNA, 22 nt, Human
aguucuacuccauuaaauauaa

SEQ ID NO: 484049 - RNA, 22 nt, Human
aguuguaccgcaaugugacuua

SEQ ID NO: 484050 - RNA, 20 nt, Human
aguuucccuugcaugguuua

SEQ ID NO: 484051 - RNA, 20 nt, Human
accagucugacuguuuccau

SEQ ID NO: 484052 - RNA, 20 nt, Human
acuuggucugugagaugcua

SEQ ID NO: 484053 - RNA, 20 nt, Human
aauacauauagcagcucuug

SEQ ID NO: 484054 - RNA, 22 nt, Human
aauaggcugaugggcaaaaaac

SEQ ID NO: 484055 - RNA, 20 nt, Human
aaucccagcuacuugggagg

SEQ ID NO: 484056 - RNA, 17 nt, Human
aauguaaaauagugaau

SEQ ID NO: 484057 - RNA, 14 nt, Human
accuguaaucccag

SEQ ID NO: 484058 - RNA, 13 nt, Human
acgauaaaagaca

SEQ ID NO: 484059 - RNA, 14 nt, Human
acgauaaaagacag

SEQ ID NO: 484060 - RNA, 14 nt, Human
acuaguauuucuau

SEQ ID NO: 484061 - RNA, 13 nt, Human
acugguucuucuu

SEQ ID NO: 484062 - RNA, 18 nt, Human
acuuauuggaauguugag

SEQ ID NO: 484063 - RNA, 21 nt, Human
acaaggaugaauuaaguuuuu

SEQ ID NO: 484064 - RNA, 18 nt, Human
acagggaggacgcucucu

SEQ ID NO: 484065 - RNA, 13 nt, Human
aaaauaaaaauaa

SEQ ID NO: 484066 - RNA, 20 nt, Human
aaaaucucaauauuucagau

SEQ ID NO: 484067 - RNA, 22 nt, Human
aaacccugucucuacuaaaaau

SEQ ID NO: 484068 - RNA, 18 nt, Human
aaagaugugaauaggcug

SEQ ID NO: 484069 - RNA, 14 nt, Human
aaggcuguucuuua

SEQ ID NO: 484070 - RNA, 20 nt, Human
aaguuuuguuuuguuuuuca

SEQ ID NO: 484071 - RNA, 15 nt, Human
aauaaaguacaagag

SEQ ID NO: 484072 - RNA, 14 nt, Human
aauauaugaggcua

SEQ ID NO: 484073 - RNA, 18 nt, Human
aauauuucagauaaucac

SEQ ID NO: 484074 - RNA, 20 nt, Human
aaucccagcacuuugggagg

SEQ ID NO: 484075 - RNA, 20 nt, Human
caugauguuuagaaacacaa

SEQ ID NO: 484076 - RNA, 17 nt, Human
cagugagccaaauguaa

SEQ ID NO: 484077 - RNA, 19 nt, Human
cauaaaauacaaaaacuua

SEQ ID NO: 484078 - RNA, 22 nt, Human
auuccaacuaucucauuuccaa

SEQ ID NO: 484079 - RNA, 13 nt, Human
caacauggugaaa

SEQ ID NO: 484080 - RNA, 21 nt, Human
caaggaaggaaagaugugaau

SEQ ID NO: 484081 - RNA, 23 nt, Human
cacaugaacuuguaaaggaauuu

SEQ ID NO: 484082 - RNA, 24 nt, Human
cacuuggucugugagaugcuagaa

SEQ ID NO: 484083 - RNA, 21 nt, Human
aucaguuccagccuucucuca

SEQ ID NO: 484084 - RNA, 17 nt, Human
auaacaauaaaagacaa

SEQ ID NO: 484085 - RNA, 12 nt, Human
auaacgauaaaa

SEQ ID NO: 484086 - RNA, 14 nt, Human
auaguucuacucca

SEQ ID NO: 484087 - RNA, 19 nt, Human
augacugacaaagacaucg

SEQ ID NO: 484088 - RNA, 19 nt, Human
auggaauuggagcucgugg

SEQ ID NO: 484089 - RNA, 16 nt, Human
auuacccccagcuuug

SEQ ID NO: 484090 - RNA, 13 nt, Human
auuagaaauguaa

SEQ ID NO: 484091 - RNA, 14 nt, Human
agugcaaauacucu

SEQ ID NO: 484092 - RNA, 18 nt, Human
aggcuacagaacuaaaaa

SEQ ID NO: 484093 - RNA, 20 nt, Human
aggcuguucuuuaaaugucu

SEQ ID NO: 484094 - RNA, 20 nt, Human
aggcuccacuuggucuguga

SEQ ID NO: 484095 - RNA, 16 nt, Human
uuuccugaaaacccuu

SEQ ID NO: 484096 - RNA, 16 nt, Human
uuuuccugaaaacccu

SEQ ID NO: 484097 - RNA, 20 nt, Human
uuggucugugagaugcuaga

SEQ ID NO: 484098 - RNA, 17 nt, Human
uugucaauaaaauccau

SEQ ID NO: 484099 - RNA, 15 nt, Human
ucuaagugccuccaa

SEQ ID NO: 484100 - RNA, 20 nt, Human
ucuaucuuugagcgcccacu

SEQ ID NO: 484101 - RNA, 16 nt, Human
ugauaacuggaaacuu

SEQ ID NO: 484102 - RNA, 17 nt, Human
ugaucaccugcccugcu

SEQ ID NO: 484103 - RNA, 11 nt, Human
uacaggauuug

SEQ ID NO: 484104 - RNA, 14 nt, Human
uacuaguuucccuu

SEQ ID NO: 484105 - RNA, 15 nt, Human
uagcuaaguuuuguu

SEQ ID NO: 484106 - RNA, 16 nt, Human
ucaaaagaaagaaaau

SEQ ID NO: 484107 - RNA, 18 nt, Human
ucacgccuguaaucccag

SEQ ID NO: 484108 - RNA, 16 nt, Human
ggucucuacauaaaau

SEQ ID NO: 484109 - RNA, 15 nt, Human
guuauguauauuuua

SEQ ID NO: 484110 - RNA, 18 nt, Human
ggcuaagcaaaaugugau

SEQ ID NO: 484111 - RNA, 13 nt, Human
cuuuccacagaag

SEQ ID NO: 484112 - RNA, 16 nt, Human
cuuuccucaaaacuuc

SEQ ID NO: 484113 - RNA, 23 nt, Human
cuuuggggagccaacagaagcuu

SEQ ID NO: 484114 - RNA, 11 nt, Human
caggcauggug

SEQ ID NO: 484115 - RNA, 14 nt, Human
caggcuagauguau

SEQ ID NO: 484116 - RNA, 13 nt, Human
cagggaggacgcu

SEQ ID NO: 484117 - RNA, 18 nt, Human
cuaguugaucagcuuauu

SEQ ID NO: 484118 - RNA, 17 nt, Human
cuaugucauuugcugga

SEQ ID NO: 484119 - RNA, 17 nt, Human
cucauggaauuggagcu

SEQ ID NO: 484120 - RNA, 17 nt, Human
cucuaggaaauauuuau

SEQ ID NO: 484121 - RNA, 16 nt, Human
cucugggcuuggggcu

SEQ ID NO: 484122 - RNA, 19 nt, Human
aacacaucaggaaagagag

SEQ ID NO: 484123 - RNA, 17 nt, Human
ccaaaagguauuuuaau

SEQ ID NO: 484124 - RNA, 20 nt, Human
gagccucagucucccucccu

SEQ ID NO: 484125 - RNA, 17 nt, Human
uccagcuggccgggagc

SEQ ID NO: 484126 - RNA, 12 nt, Human
uaauuccacagc

SEQ ID NO: 484127 - RNA, 21 nt, Human
cgacagugagacucugucuca

SEQ ID NO: 484128 - RNA, 21 nt, Human
caccagucugacuguuuccau

SEQ ID NO: 484129 - RNA, 22 nt, Human
aggcuccacuuggucugugaga

SEQ ID NO: 484130 - RNA, 16 nt, Human
aucaauuuaaaaaaaa

SEQ ID NO: 484131 - RNA, 14 nt, Human
agcaaguauuagaa

SEQ ID NO: 484132 - RNA, 13 nt, Human
uauuucuaugaaa

SEQ ID NO: 484133 - RNA, 22 nt, Human
cuacuugggaggcugaggcaag

SEQ ID NO: 484134 - RNA, 15 nt, Human
cugcuacuaucuguu

SEQ ID NO: 484135 - RNA, 16 nt, Human
gugaaaccuggucucu

SEQ ID NO: 484136 - RNA, 22 nt, Human
uaaaacaagcacuaaacaaaga

SEQ ID NO: 484137 - RNA, 16 nt, Human
acaaauccaaugaaau

SEQ ID NO: 484138 - RNA, 20 nt, Human
ucaaaacuucagacauagaa

SEQ ID NO: 484139 - RNA, 22 nt, Human
aaaguugauuuaaggccaggca

SEQ ID NO: 484140 - RNA, 18 nt, Human
auucuugccaaauauaaa

SEQ ID NO: 484141 - RNA, 20 nt, Human
agaaaaccuaagcaaacuua

SEQ ID NO: 484142 - RNA, 14 nt, Human
ucaauaaauaaaua

SEQ ID NO: 484143 - RNA, 17 nt, Human
uccauccugaggcucca

SEQ ID NO: 484144 - RNA, 18 nt, Human
cagugaaagaaaauaaca

SEQ ID NO: 484145 - RNA, 19 nt, Human
augaaguacucauacaugu

SEQ ID NO: 484146 - RNA, 21 nt, Human
gauaaaagacagugaaagaaa

SEQ ID NO: 484147 - RNA, 14 nt, Human
auuucuaugaaaua

SEQ ID NO: 484148 - RNA, 18 nt, Human
ccuguuuuuaagcuguuu

SEQ ID NO: 484149 - RNA, 22 nt, Human
gcagaugaugcuuugagaacau

SEQ ID NO: 484150 - RNA, 14 nt, Human
ggaaguagaggagg

SEQ ID NO: 484151 - RNA, 13 nt, Human
cccugcacuccag

SEQ ID NO: 484152 - RNA, 18 nt, Human
gcccuggugggcagagag

SEQ ID NO: 484153 - RNA, 18 nt, Human
cuuuccacagaagcucca

SEQ ID NO: 484154 - RNA, 12 nt, Human
aagaaaauaacg

SEQ ID NO: 484155 - RNA, 23 nt, Human
gucuccaaaaucggaucuggggc

SEQ ID NO: 484156 - RNA, 16 nt, Human
aaaugggaaacaaaag

SEQ ID NO: 484157 - RNA, 23 nt, Human
uuuguauaaaauaauuuuuauau

SEQ ID NO: 484158 - RNA, 18 nt, Human
aaacagcaacuuguguuc

SEQ ID NO: 484159 - RNA, 18 nt, Human
uuauuacuguaagaaaau

SEQ ID NO: 484160 - RNA, 17 nt, Human
acucaccucccccaucu

SEQ ID NO: 484161 - RNA, 21 nt, Human
ccaaggaugccccgucccccu

SEQ ID NO: 484162 - RNA, 15 nt, Human
auaauuuugugaagc

SEQ ID NO: 484163 - RNA, 16 nt, Human
aagaaaggagauacag

SEQ ID NO: 484164 - RNA, 21 nt, Human
aagacucgggauuaguacaca

SEQ ID NO: 484165 - RNA, 14 nt, Human
cugacccagccccu

SEQ ID NO: 484166 - RNA, 17 nt, Human
gacagucaccucaugga

SEQ ID NO: 484167 - RNA, 13 nt, Human
gaccagccugguc

SEQ ID NO: 484168 - RNA, 16 nt, Human
gccuucucucaaggag

SEQ ID NO: 484169 - RNA, 15 nt, Human
acauccuacaagaca

SEQ ID NO: 484170 - RNA, 21 nt, Human
cucuugaaguauauauaucau

SEQ ID NO: 484171 - RNA, 13 nt, Human
aacaagccuccuu

SEQ ID NO: 484172 - RNA, 17 nt, Human
guuuaauucugaaagca

SEQ ID NO: 484173 - RNA, 23 nt, Human
aucucuucuggguuccuuccucu

SEQ ID NO: 484174 - RNA, 16 nt, Human
cgccuguaaucccagc

SEQ ID NO: 484175 - RNA, 12 nt, Human
uuucuauuuauu

SEQ ID NO: 484176 - RNA, 15 nt, Human
aauauaaauaaaaau

SEQ ID NO: 484177 - RNA, 15 nt, Human
uauaaauaaaaauaa

SEQ ID NO: 484178 - RNA, 17 nt, Human
caauaacgauaaaagac

SEQ ID NO: 484179 - RNA, 14 nt, Human
cuguaaucacagcu

SEQ ID NO: 484180 - RNA, 18 nt, Human
aagucuuucacauuuaaa

SEQ ID NO: 484181 - RNA, 21 nt, Human
auuauauuuauuacuguaaga

SEQ ID NO: 484182 - RNA, 18 nt, Human
aucuuauaauuuaaaaua

SEQ ID NO: 484183 - RNA, 18 nt, Human
uaaauauaaagcaagaua

SEQ ID NO: 484184 - RNA, 21 nt, Human
guauacugugugcuaaaacaa

SEQ ID NO: 484185 - RNA, 17 nt, Human
cucagucucccucccuu

SEQ ID NO: 484186 - RNA, 17 nt, Human
aauauuuauuaccucug

SEQ ID NO: 484187 - RNA, 18 nt, Human
uaaaauccauacauuugu

SEQ ID NO: 484188 - RNA, 19 nt, Human
accccugagcuugcagaga

SEQ ID NO: 484189 - RNA, 14 nt, Human
uugugauugauuau

SEQ ID NO: 484190 - RNA, 18 nt, Human
ucugcaagaagaaaucau

SEQ ID NO: 484191 - RNA, 12 nt, Human
aaauauaaagca

SEQ ID NO: 484192 - RNA, 15 nt, Human
uuacagagacagaaa

SEQ ID NO: 484193 - RNA, 13 nt, Human
uagcuaaguuuug

SEQ ID NO: 484194 - RNA, 20 nt, Human
agccuaguugaucagcuuau

SEQ ID NO: 484195 - RNA, 14 nt, Human
agauguagaggaga

SEQ ID NO: 484196 - RNA, 18 nt, Human
ugagaugguuucuagaga

SEQ ID NO: 484197 - RNA, 17 nt, Human
agucugacuguuuccau

SEQ ID NO: 484198 - RNA, 16 nt, Human
uugccauaauuacuau

SEQ ID NO: 484199 - RNA, 21 nt, Human
agucucccucccuuggggccu

SEQ ID NO: 484200 - RNA, 15 nt, Human
ugucaauaaaaucca

SEQ ID NO: 484201 - RNA, 16 nt, Human
aacaauaaaagacaag

SEQ ID NO: 484202 - RNA, 22 nt, Human
caaugcuguauuuuaaaagaau

SEQ ID NO: 484203 - RNA, 14 nt, Human
gaaaacaauaacga

SEQ ID NO: 484204 - RNA, 19 nt, Human
aaucaaacuuuacagaaag

SEQ ID NO: 484205 - RNA, 20 nt, Human
aaaguugauuaagaaaggaa

SEQ ID NO: 484206 - RNA, 20 nt, Human
caggcugagccucagucucc

SEQ ID NO: 484207 - RNA, 14 nt, Human
cugcaaagcccagc

SEQ ID NO: 484208 - RNA, 16 nt, Human
auaauccuaaacauau

SEQ ID NO: 484209 - RNA, 16 nt, Human
caaaguugauuaagaa

SEQ ID NO: 484210 - RNA, 23 nt, Human
caccucauggaauuggagcucgu

SEQ ID NO: 484211 - RNA, 23 nt, Human
uauaguucuacuccauuaaauau

SEQ ID NO: 484212 - RNA, 23 nt, Human
cacuggacucaccucccccaucu

SEQ ID NO: 484213 - RNA, 22 nt, Human
cuccugccuaagugcagccccg

SEQ ID NO: 484214 - RNA, 13 nt, Human
auaaauaaaaaua

SEQ ID NO: 484215 - RNA, 12 nt, Human
caugggaaguga

SEQ ID NO: 484216 - RNA, 14 nt, Human
aaauguaaaauagu

SEQ ID NO: 484217 - RNA, 19 nt, Human
ccccucuggcuccagcugg

SEQ ID NO: 484218 - RNA, 16 nt, Human
uucccaacuccagaaa

SEQ ID NO: 484219 - RNA, 22 nt, Human
ugucucuacuaaaaauacaaaa

SEQ ID NO: 484220 - RNA, 16 nt, Human
agcuccagugauaaga

SEQ ID NO: 484221 - RNA, 18 nt, Human
acaaggaaggaaagaugu

SEQ ID NO: 484222 - RNA, 21 nt, Human
aaggcaggaggaucacuugag

SEQ ID NO: 484223 - RNA, 19 nt, Human
ugggacaggggagaaccua

SEQ ID NO: 484224 - RNA, 14 nt, Human
aacgauaaaagaca

SEQ ID NO: 484225 - RNA, 18 nt, Human
uguucaagaccagccugg

SEQ ID NO: 484226 - RNA, 22 nt, Human
caugucuagagaacacugugcu

SEQ ID NO: 484227 - RNA, 23 nt, Human
cucagcccuggugggcagagagg

SEQ ID NO: 484228 - RNA, 23 nt, Human
ucaauaucuuuuuuuuaauaaac

SEQ ID NO: 484229 - RNA, 15 nt, Human
gacagggaggacgcu

SEQ ID NO: 484230 - RNA, 16 nt, Human
aucacuugagccccgg

SEQ ID NO: 484231 - RNA, 18 nt, Human
ccaaccuggaguugaaaa

SEQ ID NO: 484232 - RNA, 22 nt, Human
auuacuguaagaaaauaucacu

SEQ ID NO: 484233 - RNA, 19 nt, Human
acaaauuuacagagacaga

SEQ ID NO: 484234 - RNA, 13 nt, Human
auugucuagugaa

SEQ ID NO: 484235 - RNA, 14 nt, Human
uauaauuuaaaaua

SEQ ID NO: 484236 - RNA, 14 nt, Human
auuauuuuuuaaaa

SEQ ID NO: 484237 - RNA, 18 nt, Human
auagugagacacugucuc

SEQ ID NO: 484238 - RNA, 12 nt, Human
ggcugaugcagu

SEQ ID NO: 484239 - RNA, 15 nt, Human
auauuuuuuguuaaa

SEQ ID NO: 484240 - RNA, 15 nt, Human
augauaacuggaaac

SEQ ID NO: 484241 - RNA, 19 nt, Human
ccucaacccccauuucuau

SEQ ID NO: 484242 - RNA, 18 nt, Human
uaauaauguuucaaacau

SEQ ID NO: 484243 - RNA, 23 nt, Human
cccagcccuccuuaucaaaggac

SEQ ID NO: 484244 - RNA, 16 nt, Human
ucucuaggaaauauuu

SEQ ID NO: 484245 - RNA, 16 nt, Human
caccuguaaucccagc

SEQ ID NO: 484246 - RNA, 17 nt, Human
cuuccucugagccuugg

SEQ ID NO: 484247 - RNA, 14 nt, Human
caaggcuagaacca

SEQ ID NO: 484248 - RNA, 19 nt, Human
uauacugugugcuaaaaca

SEQ ID NO: 484249 - RNA, 14 nt, Human
auuugaaauuguau

SEQ ID NO: 484250 - RNA, 13 nt, Human
auuuuuuaaaaaa

SEQ ID NO: 484251 - RNA, 16 nt, Human
uuuucucuaggaaaua

SEQ ID NO: 484252 - RNA, 15 nt, Human
ccuggugggcagaga

SEQ ID NO: 484253 - RNA, 22 nt, Human
uacauaagggaggaaaaaaaau

SEQ ID NO: 484254 - RNA, 16 nt, Human
caaacugaaacaaaau

SEQ ID NO: 484255 - RNA, 17 nt, Human
uacagaacuaaaaauua

SEQ ID NO: 484256 - RNA, 18 nt, Human
auagucaaauugugugaa

SEQ ID NO: 484257 - RNA, 15 nt, Human
cuuugaugauuaauu

SEQ ID NO: 484258 - RNA, 18 nt, Human
uguggucacaggaaguag

SEQ ID NO: 484259 - RNA, 14 nt, Human
ucuauuuauuuacu

SEQ ID NO: 484260 - RNA, 16 nt, Human
cagggcucacagaauu

SEQ ID NO: 484261 - RNA, 19 nt, Human
gccuggucaacauagugag

SEQ ID NO: 484262 - RNA, 23 nt, Human
auacaguggagacaucuggaaag

SEQ ID NO: 484263 - RNA, 14 nt, Human
aaaaaggaaggaag

SEQ ID NO: 484264 - RNA, 23 nt, Human
cauuguggucacaggaaguagag

SEQ ID NO: 484265 - RNA, 13 nt, Human
cuagcagugagcc

SEQ ID NO: 484266 - RNA, 17 nt, Human
aaaaauccuacuuucau

SEQ ID NO: 484267 - RNA, 15 nt, Human
gaaagaaaauaacga

SEQ ID NO: 484268 - RNA, 17 nt, Human
caagaaaugaaagcagg

SEQ ID NO: 484269 - RNA, 21 nt, Human
cacaugaacuuguaaaggaau

SEQ ID NO: 484270 - RNA, 18 nt, Human
cuccauuuuuagugaaau

SEQ ID NO: 484271 - RNA, 15 nt, Human
aauugacccacaaga

SEQ ID NO: 484272 - RNA, 16 nt, Human
aaaagcuccauuuuua

SEQ ID NO: 484273 - RNA, 13 nt, Human
guaacuaauuuua

SEQ ID NO: 484274 - RNA, 12 nt, Human
aaaauaacaaua

SEQ ID NO: 484275 - RNA, 24 nt, Human
uggcagaucuacaugucuagagaa

SEQ ID NO: 484276 - RNA, 22 nt, Human
acauccuacaagacacagugac

SEQ ID NO: 484277 - RNA, 23 nt, Human
auuucugagcauuuaauauggau

SEQ ID NO: 484278 - RNA, 15 nt, Human
agauuucaaaaaaaa

SEQ ID NO: 484279 - RNA, 17 nt, Human
acauagugagacacugu

SEQ ID NO: 484280 - RNA, 15 nt, Human
ggccuucggccucca

SEQ ID NO: 484281 - RNA, 10 nt, Human
ccugagcccc

SEQ ID NO: 484282 - RNA, 20 nt, Human
aaucuuucacaggggacagg

SEQ ID NO: 484283 - RNA, 14 nt, Human
ucuauaauuuaaau

SEQ ID NO: 484284 - RNA, 20 nt, Human
ugauuauaugucacuuugcu

SEQ ID NO: 484285 - RNA, 13 nt, Human
ccaggcugagccu

SEQ ID NO: 484286 - RNA, 18 nt, Human
ggauagcugacccagccc

SEQ ID NO: 484287 - RNA, 15 nt, Human
uaaauaaauaaauaa

SEQ ID NO: 484288 - RNA, 15 nt, Human
auaaauaaauaaaua

SEQ ID NO: 484289 - RNA, 12 nt, Human
agaaucuagagc

SEQ ID NO: 484290 - RNA, 19 nt, Human
gcucauggaauuggagcuc

SEQ ID NO: 484291 - RNA, 17 nt, Human
ccuauccuacuuccccu

SEQ ID NO: 484292 - RNA, 21 nt, Human
aauaauguuucaaacauauau

SEQ ID NO: 484293 - RNA, 23 nt, Human
caucucuucuggguuccuuccuc

SEQ ID NO: 484294 - RNA, 23 nt, Human
auaucuuuuuuuuaauaaaccau

SEQ ID NO: 484295 - RNA, 19 nt, Human
auuaaauauaaagcaagau

SEQ ID NO: 484296 - RNA, 16 nt, Human
cccccagcccuccuua

SEQ ID NO: 484297 - RNA, 19 nt, Human
cuacuugggaggcugaggc

SEQ ID NO: 484298 - RNA, 15 nt, Human
cugacucuuaagaag

SEQ ID NO: 484299 - RNA, 23 nt, Human
uguagguagaucuggucuuuaga

SEQ ID NO: 484300 - RNA, 19 nt, Human
guuauuauauuuacaaaug

SEQ ID NO: 484301 - RNA, 16 nt, Human
agguacuucaaauccu

SEQ ID NO: 484302 - RNA, 22 nt, Human
cccaugauguuuagaaacacaa

SEQ ID NO: 484303 - RNA, 21 nt, Human
gacagugaaagaaaauaacaa

SEQ ID NO: 484304 - RNA, 23 nt, Human
cuacacgagauacagaauuuuau

SEQ ID NO: 484305 - RNA, 16 nt, Human
ucuugagguaaaagca

SEQ ID NO: 484306 - RNA, 22 nt, Human
auaucuuuuuuuuaauaaacca

SEQ ID NO: 484307 - RNA, 18 nt, Human
aguucuccacuagcuaug

SEQ ID NO: 484308 - RNA, 13 nt, Human
aaaguguuugaaa

SEQ ID NO: 484309 - RNA, 22 nt, Human
gaaaacaauaacgauaaaagac

SEQ ID NO: 484310 - RNA, 22 nt, Human
gauaagagauguugacucuaaa

SEQ ID NO: 484311 - RNA, 22 nt, Human
auggaaauguuuacagaucccc

SEQ ID NO: 484312 - RNA, 14 nt, Human
uaugaauuacauuu

SEQ ID NO: 484313 - RNA, 16 nt, Human
gagaaacuggaacucu

SEQ ID NO: 484314 - RNA, 21 nt, Human
cucuucuggguuccuuccucu

SEQ ID NO: 484315 - RNA, 17 nt, Human
uuucacauuuaaauaaa

SEQ ID NO: 484316 - RNA, 18 nt, Human
cuuucacauuuaaauaaa

SEQ ID NO: 484317 - RNA, 19 nt, Human
ucucaaggagaggcaaaga

SEQ ID NO: 484318 - RNA, 14 nt, Human
cccacuugccauaa

SEQ ID NO: 484319 - RNA, 11 nt, Human
augggacaggg

SEQ ID NO: 484320 - RNA, 22 nt, Human
ccacagcuguaugauucccagc

SEQ ID NO: 484321 - RNA, 15 nt, Human
caccuguaaucccag

SEQ ID NO: 484322 - RNA, 17 nt, Human
agaaacaaaaaucaaac

SEQ ID NO: 484323 - RNA, 16 nt, Human
guuccuuccucugagc

SEQ ID NO: 484324 - RNA, 19 nt, Human
uuauggcacuaguauuucu

SEQ ID NO: 484325 - RNA, 20 nt, Human
uuaagagaacaagcaaauau

SEQ ID NO: 484326 - RNA, 16 nt, Human
cuguaaucccagcacu

SEQ ID NO: 484327 - RNA, 13 nt, Human
gaaccuaggguga

SEQ ID NO: 484328 - RNA, 23 nt, Human
uggaaauguuuacagauccccaa

SEQ ID NO: 484329 - RNA, 20 nt, Human
ucaagucuuucacauuuaaa

SEQ ID NO: 484330 - RNA, 13 nt, Human
uuuaaaaauccua

SEQ ID NO: 484331 - RNA, 16 nt, Human
cuacacuccagugaga

SEQ ID NO: 484332 - RNA, 13 nt, Human
ccaacuuauauuu

SEQ ID NO: 484333 - RNA, 19 nt, Human
ugaaauuguauuacaaauc

SEQ ID NO: 484334 - RNA, 19 nt, Human
auuucuucaacucccugcc

SEQ ID NO: 484335 - RNA, 19 nt, Human
ggaucuggggcucugggau

SEQ ID NO: 484336 - RNA, 17 nt, Human
cucugcaagaagaaauc

SEQ ID NO: 484337 - RNA, 22 nt, Human
ccauuucuugagguaaaagcau

SEQ ID NO: 484338 - RNA, 21 nt, Human
gcccugcugagucccaggcug

SEQ ID NO: 484339 - RNA, 20 nt, Human
agggcagaugaugcuuugag

SEQ ID NO: 484340 - RNA, 14 nt, Human
agcaaauauaaaca

SEQ ID NO: 484341 - RNA, 13 nt, Human
aaagaaaggagau

SEQ ID NO: 484342 - RNA, 21 nt, Human
ucagggcagaugaugcuuuga

SEQ ID NO: 484343 - RNA, 22 nt, Human
agaucacuugagcucaggaggu

SEQ ID NO: 484344 - RNA, 18 nt, Human
aaauauaaauaaaaauaa

SEQ ID NO: 484345 - RNA, 22 nt, Human
ucuggguuccuuccucugagcc

SEQ ID NO: 484346 - RNA, 15 nt, Human
aaacugaaacaaaau

SEQ ID NO: 484347 - RNA, 17 nt, Human
aauaaaguguuugaaag

SEQ ID NO: 484348 - RNA, 16 nt, Human
aucaaaagaaagaaaa

SEQ ID NO: 484349 - RNA, 17 nt, Human
caaauauaaauaaaaau

SEQ ID NO: 484350 - RNA, 13 nt, Human
ccaaaagguauuu

SEQ ID NO: 484351 - RNA, 18 nt, Human
ugccauaauuacuauguc

SEQ ID NO: 484352 - RNA, 16 nt, Human
augaauacuuuauaaa

SEQ ID NO: 484353 - RNA, 22 nt, Human
uuccccuuccuaauuccacagc

SEQ ID NO: 484354 - RNA, 20 nt, Human
cacagcacgggggccaagga

SEQ ID NO: 484355 - RNA, 18 nt, Human
gaagcaccaaucaugaau

SEQ ID NO: 484356 - RNA, 13 nt, Human
uccuacuuccccu

SEQ ID NO: 484357 - RNA, 20 nt, Human
ugagcgcccacuagacccac

SEQ ID NO: 484358 - RNA, 22 nt, Human
gaacaagcaaauauaaacagca

SEQ ID NO: 484359 - RNA, 14 nt, Human
cagauccuggaaau

SEQ ID NO: 484360 - RNA, 22 nt, Human
uuuauggcacuaguauuucuau

SEQ ID NO: 484361 - RNA, 14 nt, Human
caaggaaggaaaga

SEQ ID NO: 484362 - RNA, 22 nt, Human
caagagaauugcuugaacccag

SEQ ID NO: 484363 - RNA, 14 nt, Human
uaguuucccuugca

SEQ ID NO: 484364 - RNA, 22 nt, Human
ucucuacuaaaaauacaaaaau

SEQ ID NO: 484365 - RNA, 23 nt, Human
acgaggauugggaaaaaguaauu

SEQ ID NO: 484366 - RNA, 20 nt, Human
aagaugguaccaccagucug

SEQ ID NO: 484367 - RNA, 15 nt, Human
accagggagccccuu

SEQ ID NO: 484368 - RNA, 22 nt, Human
gaaaaucuuauaauuuaaaaua

SEQ ID NO: 484369 - RNA, 19 nt, Human
uauuuacugagcuucucug

SEQ ID NO: 484370 - RNA, 15 nt, Human
cccugccccccagcc

SEQ ID NO: 484371 - RNA, 13 nt, Human
uuuaaaaaagaaa

SEQ ID NO: 484372 - RNA, 18 nt, Human
gcaaagcccagcuugaaa

SEQ ID NO: 484373 - RNA, 15 nt, Human
uauaaagcaagauaa

SEQ ID NO: 484374 - RNA, 16 nt, Human
uuuuagugaaauauua

SEQ ID NO: 484375 - RNA, 15 nt, Human
auagaaguaaaaaca

SEQ ID NO: 484376 - RNA, 21 nt, Human
acagcccuucuuuccacagaa

SEQ ID NO: 484377 - RNA, 22 nt, Human
aggcacaguggcucacaccugu

SEQ ID NO: 484378 - RNA, 15 nt, Human
uuugaguguuuuaag

SEQ ID NO: 484379 - RNA, 21 nt, Human
caaagcccagcuugaaaccuu

SEQ ID NO: 484380 - RNA, 12 nt, Human
agggcaagagag

SEQ ID NO: 484381 - RNA, 21 nt, Human
caaggaaaaaauaacaaugaa

SEQ ID NO: 484382 - RNA, 19 nt, Human
gcacacagcacgggggcca

SEQ ID NO: 484383 - RNA, 17 nt, Human
cugagcgacagugagac

SEQ ID NO: 484384 - RNA, 16 nt, Human
caugucuagagaacac

SEQ ID NO: 484385 - RNA, 21 nt, Human
ccuuuuuuugaaaaaaagcuu

SEQ ID NO: 484386 - RNA, 19 nt, Human
agacagugaaagaaaauaa

SEQ ID NO: 484387 - RNA, 16 nt, Human
ccucagucucccuccc

SEQ ID NO: 484388 - RNA, 14 nt, Human
cuugagguaaaagc

SEQ ID NO: 484389 - RNA, 18 nt, Human
uucucuaggaaauauuua

SEQ ID NO: 484390 - RNA, 14 nt, Human
uuucuaugaaauau

SEQ ID NO: 484391 - RNA, 21 nt, Human
auuuguauaaaauaauuuuua

SEQ ID NO: 484392 - RNA, 15 nt, Human
ucuuauagaauauuu

SEQ ID NO: 484393 - RNA, 18 nt, Human
uaugaggcuacagaacua

SEQ ID NO: 484394 - RNA, 20 nt, Human
guuccuuccucugagccuug

SEQ ID NO: 484395 - RNA, 14 nt, Human
cuacaagacacagu

SEQ ID NO: 484396 - RNA, 19 nt, Human
cugccagaaucuagagcaa

SEQ ID NO: 484397 - RNA, 14 nt, Human
ucuucagaaaaccu

SEQ ID NO: 484398 - RNA, 13 nt, Human
ugauuauauguca

SEQ ID NO: 484399 - RNA, 14 nt, Human
agguugcagugagc

SEQ ID NO: 484400 - RNA, 17 nt, Human
ucuuauaauuuaaaaua

SEQ ID NO: 484401 - RNA, 19 nt, Human
auaaaagacagugaaagaa

SEQ ID NO: 484402 - RNA, 20 nt, Human
uggggcuaaggcaggaggau

SEQ ID NO: 484403 - RNA, 17 nt, Human
cuucuagcagugagcca

SEQ ID NO: 484404 - RNA, 17 nt, Human
cucgugggacagucacc

SEQ ID NO: 484405 - RNA, 18 nt, Human
cucccuuggggccuaugc

SEQ ID NO: 484406 - RNA, 16 nt, Human
aauauaaauaaaaaua

SEQ ID NO: 484407 - RNA, 12 nt, Human
acacuuaaaaau

SEQ ID NO: 484408 - RNA, 12 nt, Human
ugagagacacac

SEQ ID NO: 484409 - RNA, 17 nt, Human
cuacacuccagugagac

SEQ ID NO: 484410 - RNA, 14 nt, Human
cacuuauaggaauu

SEQ ID NO: 484411 - RNA, 15 nt, Human
ugcagauaaacagua

SEQ ID NO: 484412 - RNA, 22 nt, Human
ggacagcccuucuuuccacaga

SEQ ID NO: 484413 - RNA, 17 nt, Human
guuccuuuuaaagaaac

SEQ ID NO: 484414 - RNA, 16 nt, Human
cuucaacucccugccc

SEQ ID NO: 484415 - RNA, 16 nt, Human
auuguuugucugucuu

SEQ ID NO: 484416 - RNA, 21 nt, Human
ccagccuggucaacauaguga

SEQ ID NO: 484417 - RNA, 22 nt, Human
cccccugcaaagcccagcuuga

SEQ ID NO: 484418 - RNA, 19 nt, Human
ccccugcaaagcccagcuu

SEQ ID NO: 484419 - RNA, 16 nt, Human
cauggugaaaccccgu

SEQ ID NO: 484420 - RNA, 22 nt, Human
cuuccuaauuccacagcugcuc

SEQ ID NO: 484421 - RNA, 18 nt, Human
cccaggcugagccucagu

SEQ ID NO: 484422 - RNA, 17 nt, Human
gacucaccucccccauc

SEQ ID NO: 484423 - RNA, 16 nt, Human
aaauauuuauuuuaau

SEQ ID NO: 484424 - RNA, 22 nt, Human
cuuuccacagaagcuccaggua

SEQ ID NO: 484425 - RNA, 14 nt, Human
ucagucucccuccc

SEQ ID NO: 484426 - RNA, 14 nt, Human
ugacacuuaaaaau

SEQ ID NO: 484427 - RNA, 14 nt, Human
aauauuauuuuaua

SEQ ID NO: 484428 - RNA, 19 nt, Human
ugagucccaggcugagccu

SEQ ID NO: 484429 - RNA, 16 nt, Human
gaaucacuugaacccg

SEQ ID NO: 484430 - RNA, 17 nt, Human
ggaaauauuuauuuuaa

SEQ ID NO: 484431 - RNA, 18 nt, Human
uaucaaaagaaagaaaau

SEQ ID NO: 484432 - RNA, 14 nt, Human
uaaaggaauuuaaa

SEQ ID NO: 484433 - RNA, 20 nt, Human
uauaugcuaagucuuauaua

SEQ ID NO: 484434 - RNA, 14 nt, Human
uggacucaccuccc

SEQ ID NO: 484435 - RNA, 19 nt, Human
cagaaagcagaacagugau

SEQ ID NO: 484436 - RNA, 19 nt, Human
uuggcaagcucuaucacca

SEQ ID NO: 484437 - RNA, 18 nt, Human
cauggugaaaccuggucu

SEQ ID NO: 484438 - RNA, 20 nt, Human
cagcuuguuauuuauaacaa

SEQ ID NO: 484439 - RNA, 16 nt, Human
ccuacaugagguacug

SEQ ID NO: 484440 - RNA, 13 nt, Human
uguauauuuuaua

SEQ ID NO: 484441 - RNA, 22 nt, Human
aucaucaagucuuucacauuua

SEQ ID NO: 484442 - RNA, 17 nt, Human
uucuccacuggaaaacu

SEQ ID NO: 484443 - RNA, 23 nt, Human
auuaccauuauggauaaagauga

SEQ ID NO: 484444 - RNA, 15 nt, Human
aagcaagauaauaaa

SEQ ID NO: 484445 - RNA, 20 nt, Human
agaggagaaacuggaacucu

SEQ ID NO: 484446 - RNA, 22 nt, Human
auauaaauaaaaauaauccuca

SEQ ID NO: 484447 - RNA, 15 nt, Human
gagaugcuagaacuc

SEQ ID NO: 484448 - RNA, 13 nt, Human
agacacagugacc

SEQ ID NO: 484449 - RNA, 22 nt, Human
uucuaugcuuguaacugucuuc

SEQ ID NO: 484450 - RNA, 15 nt, Human
agaacaagcaaauau

SEQ ID NO: 484451 - RNA, 19 nt, Human
ucagugucaaugcagcccc

SEQ ID NO: 484452 - RNA, 16 nt, Human
uaggauguugaaaaag

SEQ ID NO: 484453 - RNA, 17 nt, Human
gccaugggacagggagg

SEQ ID NO: 484454 - RNA, 18 nt, Human
aagggaauuucuucaacu

SEQ ID NO: 484455 - RNA, 19 nt, Human
ugaucaccugcccugcuga

SEQ ID NO: 484456 - RNA, 22 nt, Human
augcagagguccacaacacaca

SEQ ID NO: 484457 - RNA, 22 nt, Human
uccagccuucucucaaggagag

SEQ ID NO: 484458 - RNA, 19 nt, Human
uaucucauuuccaagcaag

SEQ ID NO: 484459 - RNA, 16 nt, Human
aaauaaauaaauaaau

SEQ ID NO: 484460 - RNA, 16 nt, Human
uaaauaaauaaauaaa

SEQ ID NO: 484461 - RNA, 16 nt, Human
auaaauaaauaaauaa

SEQ ID NO: 484462 - RNA, 16 nt, Human
aauaaauaaauaaaua

SEQ ID NO: 484463 - RNA, 19 nt, Human
agcugauaucaugccccug

SEQ ID NO: 484464 - RNA, 23 nt, Human
ugaauuauguuugcauguucacu

SEQ ID NO: 484465 - RNA, 21 nt, Human
gaaaacaauaacgauaaaaga

SEQ ID NO: 484466 - RNA, 18 nt, Human
agcugcucaauaaaguac

SEQ ID NO: 484467 - RNA, 20 nt, Human
agaugcaguucugaagaaga

SEQ ID NO: 484468 - RNA, 23 nt, Human
uguaaucccagcacuuugggagg

SEQ ID NO: 484469 - RNA, 20 nt, Human
uaacgauaaaagacagugaa

SEQ ID NO: 484470 - RNA, 17 nt, Human
cucuuuugggauuuuug

SEQ ID NO: 484471 - RNA, 16 nt, Human
cucuaggacauaaauu

SEQ ID NO: 484472 - RNA, 15 nt, Human
uugcucauggaauug

SEQ ID NO: 484473 - RNA, 15 nt, Human
guaaggggaauugag

SEQ ID NO: 484474 - RNA, 18 nt, Human
auuagaaauguaauuaug

SEQ ID NO: 484475 - RNA, 12 nt, Human
uauaggccaggc

SEQ ID NO: 484476 - RNA, 20 nt, Human
aguugauuuaaggccaggca

SEQ ID NO: 484477 - RNA, 19 nt, Human
auuggagcucgugggacag

SEQ ID NO: 484478 - RNA, 14 nt, Human
aaagagaacuucca

SEQ ID NO: 484479 - RNA, 13 nt, Human
uuaaaaaagaaac

SEQ ID NO: 484480 - RNA, 20 nt, Human
ccagcuugaaaccuucacuu

SEQ ID NO: 484481 - RNA, 18 nt, Human
gaugcaguucugaagaag

SEQ ID NO: 484482 - RNA, 20 nt, Human
cucuaccaaaaaaaggaagg

SEQ ID NO: 484483 - RNA, 17 nt, Human
aaagaaacauuugguaa

SEQ ID NO: 484484 - RNA, 12 nt, Human
uuuuuuuuaaaa

SEQ ID NO: 484485 - RNA, 12 nt, Human
agggauggggcu

SEQ ID NO: 484486 - RNA, 18 nt, Human
uuggggccuaugcagagg

SEQ ID NO: 484487 - RNA, 18 nt, Human
ugccauguggcagaucua

SEQ ID NO: 484488 - RNA, 21 nt, Human
uccuacaagacacagugacca

SEQ ID NO: 484489 - RNA, 22 nt, Human
ggcacaacacaucaggaaagag

SEQ ID NO: 484490 - RNA, 20 nt, Human
aauuuuuucucuaggaaaua

SEQ ID NO: 484491 - RNA, 12 nt, Human
gaaaauaacaau

SEQ ID NO: 484492 - RNA, 12 nt, Human
caccuguuuuua

SEQ ID NO: 484493 - RNA, 23 nt, Human
caauaacgauaaaagacagugaa

SEQ ID NO: 484494 - RNA, 16 nt, Human
guccgaggugggcaga

SEQ ID NO: 484495 - RNA, 22 nt, Human
gcuugcagagaugaggccgcca

SEQ ID NO: 484496 - RNA, 13 nt, Human
uuuuaaaaaagaa

SEQ ID NO: 484497 - RNA, 23 nt, Human
aggcugaggcaggaggaucacuu

SEQ ID NO: 484498 - RNA, 16 nt, Human
ccuccuuuuaaaguaa

SEQ ID NO: 484499 - RNA, 17 nt, Human
cauaaaauacaaaaacu

SEQ ID NO: 484500 - RNA, 21 nt, Human
auaguuguaccgcaaugugac

SEQ ID NO: 484501 - RNA, 22 nt, Human
caguauggcagcuuuccucaaa

SEQ ID NO: 484502 - RNA, 21 nt, Human
uuauagcuacuaauuuuaaaa

SEQ ID NO: 484503 - RNA, 14 nt, Human
ccagcuggccggga

SEQ ID NO: 484504 - RNA, 21 nt, Human
gucaagaucagccugggcaac

SEQ ID NO: 484505 - RNA, 14 nt, Human
guaacuaauuuuaa

SEQ ID NO: 484506 - RNA, 18 nt, Human
aaggaugccccguccccc

SEQ ID NO: 484507 - RNA, 17 nt, Human
cccaggcugagccucag

SEQ ID NO: 484508 - RNA, 22 nt, Human
gaaaggaaguauaggccaggca

SEQ ID NO: 484509 - RNA, 11 nt, Human
gcuguuuccau

SEQ ID NO: 484510 - RNA, 23 nt, Human
acguaaucguguccccuauccua

SEQ ID NO: 484511 - RNA, 22 nt, Human
uugaaaaucuuauaauuuaaaa

SEQ ID NO: 484512 - RNA, 14 nt, Human
gcagaucacuugag

SEQ ID NO: 484513 - RNA, 13 nt, Human
aaaggaaggaagg

SEQ ID NO: 484514 - RNA, 15 nt, Human
ucaauuccucuggga

SEQ ID NO: 484515 - RNA, 15 nt, Human
aaauauaaagcaaga

SEQ ID NO: 484516 - RNA, 20 nt, Human
uuaaugccacuaaauugaca

SEQ ID NO: 484517 - RNA, 20 nt, Human
aauaagccagacaucaacag

SEQ ID NO: 484518 - RNA, 23 nt, Human
cuugauaaauggcuuccuggcaa

SEQ ID NO: 484519 - RNA, 22 nt, Human
uaauaggcguaacuaauuuuaa

SEQ ID NO: 484520 - RNA, 14 nt, Human
aacucaguuuuaac

SEQ ID NO: 484521 - RNA, 19 nt, Human
ucaauauuuauuauuuuca

SEQ ID NO: 484522 - RNA, 21 nt, Human
auaauuuuuauauuugaaaua

SEQ ID NO: 484523 - RNA, 20 nt, Human
uaugcuucuguuuuauaauu

SEQ ID NO: 484524 - RNA, 12 nt, Human
uucagccugaaa

SEQ ID NO: 484525 - RNA, 17 nt, Human
aaaccuuauuguaccuc

SEQ ID NO: 484526 - RNA, 16 nt, Human
ggcugaggcaggagga

SEQ ID NO: 484527 - RNA, 18 nt, Human
aaaaguucugcagauaaa

SEQ ID NO: 484528 - RNA, 16 nt, Human
uuguaaaggaauuuaa

SEQ ID NO: 484529 - RNA, 17 nt, Human
gucaaaguucauagagu

SEQ ID NO: 484530 - RNA, 14 nt, Human
ucuaggaaauauuu

SEQ ID NO: 484531 - RNA, 21 nt, Human
ucacaugaacuuguaaaggaa

SEQ ID NO: 484532 - RNA, 16 nt, Human
uaacaauaaaagacaa

SEQ ID NO: 484533 - RNA, 15 nt, Human
ccuugccaugugcua

SEQ ID NO: 484534 - RNA, 11 nt, Human
aaaaaaaggaa

SEQ ID NO: 484535 - RNA, 21 nt, Human
uuccuaauuccacagcugcuc

SEQ ID NO: 484536 - RNA, 16 nt, Human
aacuugguuuuaauua

SEQ ID NO: 484537 - RNA, 14 nt, Human
ugagaaaccuuauu

SEQ ID NO: 484538 - RNA, 17 nt, Human
aaaaugguauuaaagau

SEQ ID NO: 484539 - RNA, 16 nt, Human
ggccuccauccugagg

SEQ ID NO: 484540 - RNA, 21 nt, Human
uagggugauauuaaccagggg

SEQ ID NO: 484541 - RNA, 22 nt, Human
aaugggcacaggguuuauguuu

SEQ ID NO: 484542 - RNA, 22 nt, Human
ucucucaaggagaggcaaagaa

SEQ ID NO: 484543 - RNA, 14 nt, Human
aucuucagaaaacc

SEQ ID NO: 484544 - RNA, 15 nt, Human
gcacagccucuuaga

SEQ ID NO: 484545 - RNA, 18 nt, Human
acauaaaauacaaaaacu

SEQ ID NO: 484546 - RNA, 22 nt, Human
cucugggauagcugacccagcc

SEQ ID NO: 484547 - RNA, 13 nt, Human
aagcauuccaacu

SEQ ID NO: 484548 - RNA, 21 nt, Human
acacugucucuaccaaaaaaa

SEQ ID NO: 484549 - RNA, 14 nt, Human
uagaauauuuauua

SEQ ID NO: 484550 - RNA, 16 nt, Human
ccuggugggcagagag

SEQ ID NO: 484551 - RNA, 19 nt, Human
aaguugcauagguuuaaua

SEQ ID NO: 484552 - RNA, 13 nt, Human
gcagaacagugau

SEQ ID NO: 484553 - RNA, 18 nt, Human
cauagguuuaauaauuuu

SEQ ID NO: 484554 - RNA, 16 nt, Human
uaucaaaagaaagaaa

SEQ ID NO: 484555 - RNA, 18 nt, Human
gccccgucccccucuggc

SEQ ID NO: 484556 - RNA, 13 nt, Human
cugagagugaaca

SEQ ID NO: 484557 - RNA, 21 nt, Human
gccuauagucccacuacuugu

SEQ ID NO: 484558 - RNA, 18 nt, Human
cuucacuguaaaauaaua

SEQ ID NO: 484559 - RNA, 18 nt, Human
ugaaaaaguucugcagau

SEQ ID NO: 484560 - RNA, 18 nt, Human
cauggaauuggagcucgu

SEQ ID NO: 484561 - RNA, 19 nt, Human
uccccuauccuacuucccc

SEQ ID NO: 484562 - RNA, 20 nt, Human
cucuguucugcacacagcac

SEQ ID NO: 484563 - RNA, 19 nt, Human
gccccccagcccuccuuau

SEQ ID NO: 484564 - RNA, 15 nt, Human
aacugaaacaaaauu

SEQ ID NO: 484565 - RNA, 19 nt, Human
cucauggaauuggagcucg

SEQ ID NO: 484566 - RNA, 20 nt, Human
uuuaaauaaaguguuugaaa

SEQ ID NO: 484567 - RNA, 21 nt, Human
ugggaggcugagaugggagaa

SEQ ID NO: 484568 - RNA, 22 nt, Human
ucuagcaugucgucaaagcuga

SEQ ID NO: 484569 - RNA, 18 nt, Human
uauguuccuuuuaaagaa

SEQ ID NO: 484570 - RNA, 16 nt, Human
ugcuguauuuuaaaag

SEQ ID NO: 484571 - RNA, 16 nt, Human
gaugcuuugagaacau

SEQ ID NO: 484572 - RNA, 15 nt, Human
auauaaauaaaaaua

SEQ ID NO: 484573 - RNA, 13 nt, Human
cccaaaaggcaga

SEQ ID NO: 484574 - RNA, 11 nt, Human
auuaaaaccuc

SEQ ID NO: 484575 - RNA, 18 nt, Human
ggaggacgcucucuggcc

SEQ ID NO: 484576 - RNA, 17 nt, Human
uuauauuugaaauauug

SEQ ID NO: 484577 - RNA, 14 nt, Human
ggaguuccuaacca

SEQ ID NO: 484578 - RNA, 15 nt, Human
agacagcucugcaua

SEQ ID NO: 484579 - RNA, 18 nt, Human
uugaaaaugguauuaaag

SEQ ID NO: 484580 - RNA, 18 nt, Human
uacuuuauuuucuauaau

SEQ ID NO: 484581 - RNA, 20 nt, Human
ccaaauguucaucaaugaau

SEQ ID NO: 484582 - RNA, 16 nt, Human
uuauagaauauuuauu

SEQ ID NO: 484583 - RNA, 18 nt, Human
gccugagcgacagugaga

SEQ ID NO: 484584 - RNA, 19 nt, Human
uuccucccuucucuucaca

SEQ ID NO: 484585 - RNA, 13 nt, Human
uuauguuuaauuc

SEQ ID NO: 484586 - RNA, 15 nt, Human
ccacaagaaaugaaa

SEQ ID NO: 484587 - RNA, 21 nt, Human
ccugaucaccugcccugcuga

SEQ ID NO: 484588 - RNA, 14 nt, Human
cucccucccuuggg

SEQ ID NO: 484589 - RNA, 16 nt, Human
caauaacgauaaaaga

SEQ ID NO: 484590 - RNA, 21 nt, Human
uauaaaauaauuuuuauauuu

SEQ ID NO: 484591 - RNA, 14 nt, Human
cuguaaucccagcu

SEQ ID NO: 484592 - RNA, 14 nt, Human
aggcaagagaauug

SEQ ID NO: 484593 - RNA, 19 nt, Human
caccuguaaucccagcuac

SEQ ID NO: 484594 - RNA, 21 nt, Human
uguaaaauggugugaccacug

SEQ ID NO: 484595 - RNA, 20 nt, Human
aagcuucacuguaaaauaau

SEQ ID NO: 484596 - RNA, 21 nt, Human
uacaugagguacugagaguga

SEQ ID NO: 484597 - RNA, 19 nt, Human
auuagaaauguaauuaugu

SEQ ID NO: 484598 - RNA, 18 nt, Human
aaggagaggcaaagaaag

SEQ ID NO: 484599 - RNA, 23 nt, Human
gacacauaucaaacugaaacaaa

SEQ ID NO: 484600 - RNA, 13 nt, Human
uuauagaauauuu

SEQ ID NO: 484601 - RNA, 17 nt, Human
ggaaggcugaggcagga

SEQ ID NO: 484602 - RNA, 14 nt, Human
auaaauaaauaaau

SEQ ID NO: 484603 - RNA, 14 nt, Human
uaaauaaauaaaua

SEQ ID NO: 484604 - RNA, 22 nt, Human
uacaugagguacugagagugaa

SEQ ID NO: 484605 - RNA, 18 nt, Human
uuuuagugaaauauuauu

SEQ ID NO: 484606 - RNA, 18 nt, Human
guuaguauuguccagguc

SEQ ID NO: 484607 - RNA, 16 nt, Human
uggcaagcucuaucac

SEQ ID NO: 484608 - RNA, 22 nt, Human
ccucuaauuuaucuugucucug

SEQ ID NO: 484609 - RNA, 19 nt, Human
uguaguguuggagaagaac

SEQ ID NO: 484610 - RNA, 12 nt, Human
agauuucaaaaa

SEQ ID NO: 484611 - RNA, 18 nt, Human
auguuaaaacugggacag

SEQ ID NO: 484612 - RNA, 19 nt, Human
gcugaugggcaaaaaacca

SEQ ID NO: 484613 - RNA, 18 nt, Human
ggaaguauaggccaggca

SEQ ID NO: 484614 - RNA, 20 nt, Human
gcccacucugcaagaagaaa

SEQ ID NO: 484615 - RNA, 13 nt, Human
gagacagcucugc

SEQ ID NO: 484616 - RNA, 14 nt, Human
ccucagucucccuc

SEQ ID NO: 484617 - RNA, 17 nt, Human
gcucaggaggucaagau

SEQ ID NO: 484618 - RNA, 12 nt, Human
ucuuaagaagac

SEQ ID NO: 484619 - RNA, 16 nt, Human
aauuucuucaacuccc

SEQ ID NO: 484620 - RNA, 16 nt, Human
aagacugcacaucaaa

SEQ ID NO: 484621 - RNA, 17 nt, Human
cugcacuccagccugag

SEQ ID NO: 484622 - RNA, 14 nt, Human
uaaauaaaaauaau

SEQ ID NO: 484623 - RNA, 14 nt, Human
aauaaaaauaaauu

SEQ ID NO: 484624 - RNA, 22 nt, Human
uuuauagcuacuaauuuuaaaa

SEQ ID NO: 484625 - RNA, 12 nt, Human
aguguuugaaag

SEQ ID NO: 484626 - RNA, 17 nt, Human
acuuccagauccuggaa

SEQ ID NO: 484627 - RNA, 18 nt, Human
gaggcuccacuuggucug

SEQ ID NO: 484628 - RNA, 17 nt, Human
gccccccagcccuccuu

SEQ ID NO: 484629 - RNA, 20 nt, Human
uaaaagacagugaaagaaaa

SEQ ID NO: 484630 - RNA, 15 nt, Human
uaaauaaauguaucu

SEQ ID NO: 484631 - RNA, 18 nt, Human
uuacagguccugcugaaa

SEQ ID NO: 484632 - RNA, 15 nt, Human
aagaaaauaacaaua

SEQ ID NO: 484633 - RNA, 12 nt, Human
agcccaauauua

SEQ ID NO: 484634 - RNA, 10 nt, Human
caacucccug

SEQ ID NO: 484635 - RNA, 15 nt, Human
uucacuguaaaauaa

SEQ ID NO: 484636 - RNA, 13 nt, Human
ucuauaacaacaa

SEQ ID NO: 484637 - RNA, 21 nt, Human
cuaccaaaaaucucaauauuu

SEQ ID NO: 484638 - RNA, 17 nt, Human
gcaaauugucacaggac

SEQ ID NO: 484639 - RNA, 14 nt, Human
aaaaauaaaaauaa

SEQ ID NO: 484640 - RNA, 16 nt, Human
uauguucuaagaagug

SEQ ID NO: 484641 - RNA, 13 nt, Human
ccaccugccuaua

SEQ ID NO: 484642 - RNA, 23 nt, Human
aguucuacuccauuaaauauaaa

SEQ ID NO: 484643 - RNA, 17 nt, Human
ccacugcagaagacagu

SEQ ID NO: 484644 - RNA, 19 nt, Human
acauuuauguuccuuuuaa

SEQ ID NO: 484645 - RNA, 18 nt, Human
augaugcuuugagaacau

SEQ ID NO: 484646 - RNA, 20 nt, Human
uguaaaggaauuuaaaaauc

SEQ ID NO: 484647 - RNA, 14 nt, Human
uuauaaguuacaua

SEQ ID NO: 484648 - RNA, 16 nt, Human
ugacacuuaaaaaugg

SEQ ID NO: 484649 - RNA, 14 nt, Human
ugagcucagcccug

SEQ ID NO: 484650 - RNA, 18 nt, Human
acauuugcucauggaauu

SEQ ID NO: 484651 - RNA, 14 nt, Human
aaacugaaacaaaa

SEQ ID NO: 484652 - RNA, 16 nt, Human
cugcugagucccaggc

SEQ ID NO: 484653 - RNA, 16 nt, Human
aagggaggaaaaaaaa

SEQ ID NO: 484654 - RNA, 17 nt, Human
cugccucagaaaacaag

SEQ ID NO: 484655 - RNA, 13 nt, Human
aaguucaaaacuu

SEQ ID NO: 484656 - RNA, 22 nt, Human
gacucugucucaaaaaauaaaa

SEQ ID NO: 484657 - RNA, 17 nt, Human
cguaaucguguccccua

SEQ ID NO: 484658 - RNA, 17 nt, Human
aaagcagggacuugaac

SEQ ID NO: 484659 - RNA, 18 nt, Human
cccaagccuggcaaggga

SEQ ID NO: 484660 - RNA, 13 nt, Human
cacuguaaaauaa

SEQ ID NO: 484661 - RNA, 15 nt, Human
gcuguauuuuaaaag

SEQ ID NO: 484662 - RNA, 18 nt, Human
cacuccagugagacagcu

SEQ ID NO: 484663 - RNA, 19 nt, Human
gguuccuuccucugagccu

SEQ ID NO: 484664 - RNA, 16 nt, Human
cugagcuugcagagau

SEQ ID NO: 484665 - RNA, 16 nt, Human
cacuggacucaccucc

SEQ ID NO: 484666 - RNA, 14 nt, Human
uauaauuuaaauau

SEQ ID NO: 484667 - RNA, 13 nt, Human
ugcauuucuaaag

SEQ ID NO: 484668 - RNA, 20 nt, Human
auaagccagacaucaacaga

SEQ ID NO: 484669 - RNA, 19 nt, Human
ccccuauccuacuuccccu

SEQ ID NO: 484670 - RNA, 20 nt, Human
aauaauuuuuauauuugaaa

SEQ ID NO: 484671 - RNA, 11 nt, Human
gccaugggaca

SEQ ID NO: 484672 - RNA, 22 nt, Human
aucccagcacuuugggaggcug

SEQ ID NO: 484673 - RNA, 17 nt, Human
augauuaaguaaugaua

SEQ ID NO: 484674 - RNA, 19 nt, Human
uaucacuugucaauaaaau

SEQ ID NO: 484675 - RNA, 20 nt, Human
ugauuucugagcauuuaaua

SEQ ID NO: 484676 - RNA, 18 nt, Human
ccugcaaagcccagcuug

SEQ ID NO: 484677 - RNA, 14 nt, Human
aauggcuaagcaaa

SEQ ID NO: 484678 - RNA, 18 nt, Human
acaugaacuuguaaagga

SEQ ID NO: 484679 - RNA, 14 nt, Human
uauguauauuuuau

SEQ ID NO: 484680 - RNA, 14 nt, Human
aucaccaaggcuga

SEQ ID NO: 484681 - RNA, 20 nt, Human
gaaacugcccacucugcaag

SEQ ID NO: 484682 - RNA, 18 nt, Human
auagcuacuaauuuuaaa

SEQ ID NO: 484683 - RNA, 19 nt, Human
gucaaucagccuaguugau

SEQ ID NO: 484684 - RNA, 14 nt, Human
auauuuauuaccuc

SEQ ID NO: 484685 - RNA, 18 nt, Human
uccuaauuccacagcugc

SEQ ID NO: 484686 - RNA, 21 nt, Human
uaaauaaauguaucuuauuca

SEQ ID NO: 484687 - RNA, 13 nt, Human
ugaaauuguauua

SEQ ID NO: 484688 - RNA, 17 nt, Human
aggccaggcacaguggc

SEQ ID NO: 484689 - RNA, 13 nt, Human
uaaagaaacaaaa

SEQ ID NO: 484690 - RNA, 21 nt, Human
uguauaaaauaauuuuuauau

SEQ ID NO: 484691 - RNA, 23 nt, Human
ccaggagauggaaguugcaguga

SEQ ID NO: 484692 - RNA, 21 nt, Human
aaguuuaugguuguauuauuu

SEQ ID NO: 484693 - RNA, 19 nt, Human
uuacagaaagauuugaugu

SEQ ID NO: 484694 - RNA, 14 nt, Human
aaaacuucagacau

SEQ ID NO: 484695 - RNA, 17 nt, Human
acucugcaagaagaaau

SEQ ID NO: 484696 - RNA, 21 nt, Human
cugcccugcugagucccaggc

SEQ ID NO: 484697 - RNA, 12 nt, Human
ucaauauuuauu

SEQ ID NO: 484698 - RNA, 20 nt, Human
caggaguuccuaaccagccu

SEQ ID NO: 484699 - RNA, 22 nt, Human
acacugucucuaccaaaaaaag

SEQ ID NO: 484700 - RNA, 15 nt, Human
uguuaaaugauuuca

SEQ ID NO: 484701 - RNA, 19 nt, Human
aaaaucuuauaauuuaaaa

SEQ ID NO: 484702 - RNA, 19 nt, Human
cuucuggguuccuuccucu

SEQ ID NO: 484703 - RNA, 14 nt, Human
aucaaaagaaagaa

SEQ ID NO: 484704 - RNA, 15 nt, Human
aagugaaaaucuaca

SEQ ID NO: 484705 - RNA, 16 nt, Human
agugagacagcucugc

SEQ ID NO: 484706 - RNA, 14 nt, Human
auauuuauuuuaau

SEQ ID NO: 484707 - RNA, 16 nt, Human
auacauguuacaacac

SEQ ID NO: 484708 - RNA, 22 nt, Human
ggguuccuuccucugagccuug

SEQ ID NO: 484709 - RNA, 19 nt, Human
agaucuacaugucuagaga

SEQ ID NO: 484710 - RNA, 14 nt, Human
uugaaauuguauua

SEQ ID NO: 484711 - RNA, 18 nt, Human
aaauaacgauaaaagaca

SEQ ID NO: 484712 - RNA, 12 nt, Human
auuucaaaaaaa

SEQ ID NO: 484713 - RNA, 12 nt, Human
uucucuaggaaa

SEQ ID NO: 484714 - RNA, 15 nt, Human
aaucagagauaaagc

SEQ ID NO: 484715 - RNA, 18 nt, Human
cucuacuaaaaauacaaa

SEQ ID NO: 484716 - RNA, 18 nt, Human
acauguuacaacacggac

SEQ ID NO: 484717 - RNA, 23 nt, Human
ggggagccaacagaagcuuccau

SEQ ID NO: 484718 - RNA, 12 nt, Human
ccccuugccaua

SEQ ID NO: 484719 - RNA, 21 nt, Human
gcaaaauuuuuucucuaggaa

SEQ ID NO: 484720 - RNA, 19 nt, Human
ugaaauggacuuuuguaca

SEQ ID NO: 484721 - RNA, 18 nt, Human
uggucaauuuuguuaugu

SEQ ID NO: 484722 - RNA, 14 nt, Human
agcguuaauguaaa

SEQ ID NO: 484723 - RNA, 14 nt, Human
ggagauacagugga

SEQ ID NO: 484724 - RNA, 23 nt, Human
aagagccuuuuuuugaaaaaaag

SEQ ID NO: 484725 - RNA, 15 nt, Human
uccagauccuggaaa

SEQ ID NO: 484726 - RNA, 11 nt, Human
accauuuuuac

SEQ ID NO: 484727 - RNA, 18 nt, Human
cagcugcucaauaaagua

SEQ ID NO: 484728 - RNA, 15 nt, Human
aucaauuuaaaaaaa

SEQ ID NO: 484729 - RNA, 19 nt, Human
uacuauccaacuuauauuu

SEQ ID NO: 484730 - RNA, 17 nt, Human
ccaucaguuccagccuu

SEQ ID NO: 484731 - RNA, 20 nt, Human
aaagacaaggaaaaaauaac

SEQ ID NO: 484732 - RNA, 17 nt, Human
agucccaggcugagccu

SEQ ID NO: 484733 - RNA, 23 nt, Human
aaaauaucacuugucaauaaaau

SEQ ID NO: 484734 - RNA, 20 nt, Human
ggaaggcugaggcaggagga

SEQ ID NO: 484735 - RNA, 20 nt, Human
acuaaauugacacuuaaaaa

SEQ ID NO: 484736 - RNA, 14 nt, Human
ugcuaagucuuaua

SEQ ID NO: 484737 - RNA, 16 nt, Human
auaucauagcaaauaa

SEQ ID NO: 484738 - RNA, 13 nt, Human
ggacaaaaggaau

SEQ ID NO: 484739 - RNA, 17 nt, Human
aacaguuaccucugccu

SEQ ID NO: 484740 - RNA, 17 nt, Human
cccacuagacccacugg

SEQ ID NO: 484741 - RNA, 21 nt, Human
aagcuccauuuuuagugaaau

SEQ ID NO: 484742 - RNA, 14 nt, Human
auuuauguuuaauu

SEQ ID NO: 484743 - RNA, 20 nt, Human
gaaaauaacaauaaaagaca

SEQ ID NO: 484744 - RNA, 13 nt, Human
cacaacacacaga

SEQ ID NO: 484745 - RNA, 14 nt, Human
agagguccacaaca

SEQ ID NO: 484746 - RNA, 14 nt, Human
ggcaauagucaaau

SEQ ID NO: 484747 - RNA, 22 nt, Human
uauccuacuuccccuuccuaau

SEQ ID NO: 484748 - RNA, 19 nt, Human
ccccugagcuugcagagau

SEQ ID NO: 484749 - RNA, 22 nt, Human
ugggcacuguggguagacacac

SEQ ID NO: 484750 - RNA, 19 nt, Human
auuuucuauaauuuaaaua

SEQ ID NO: 484751 - RNA, 15 nt, Human
auaugcuucuuugug

SEQ ID NO: 484752 - RNA, 16 nt, Human
uguucuauaacaacaa

SEQ ID NO: 484753 - RNA, 16 nt, Human
ggcugagccucagucu

SEQ ID NO: 484754 - RNA, 14 nt, Human
acaagagcuuaaca

SEQ ID NO: 484755 - RNA, 17 nt, Human
uucugagcauuuaauau

SEQ ID NO: 484756 - RNA, 16 nt, Human
ggcagagagguaggga

SEQ ID NO: 484757 - RNA, 13 nt, Human
uuaaauuguaaua

SEQ ID NO: 484758 - RNA, 16 nt, Human
uugucaauaaaaucca

SEQ ID NO: 484759 - RNA, 17 nt, Human
aggaaaaugggcuuugg

SEQ ID NO: 484760 - RNA, 14 nt, Human
auuaagaaaggaag

SEQ ID NO: 484761 - RNA, 17 nt, Human
acaagaaaugaaagcag

SEQ ID NO: 484762 - RNA, 18 nt, Human
acuggacucaccuccccc

SEQ ID NO: 484763 - RNA, 22 nt, Human
agacucugucucaaaaaauaaa

SEQ ID NO: 484764 - RNA, 16 nt, Human
aacagauuucaaaaaa

SEQ ID NO: 484765 - RNA, 18 nt, Human
ccugaaagaggaaugaag

SEQ ID NO: 484766 - RNA, 14 nt, Human
uccacuuggucugu

SEQ ID NO: 484767 - RNA, 14 nt, Human
uagcugacccagcc

SEQ ID NO: 484768 - RNA, 20 nt, Human
ugagagacacacugaagaag

SEQ ID NO: 484769 - RNA, 16 nt, Human
ucagucucccucccuu

SEQ ID NO: 484770 - RNA, 15 nt, Human
aaugucugaaaugga

SEQ ID NO: 484771 - RNA, 12 nt, Human
agggacccccaa

SEQ ID NO: 484772 - RNA, 23 nt, Human
auuauauggcuugaguuuaaauu

SEQ ID NO: 484773 - RNA, 19 nt, Human
cccacuugccauaaaacuu

SEQ ID NO: 484774 - RNA, 14 nt, Human
ucucuacuaaaaau

SEQ ID NO: 484775 - RNA, 15 nt, Human
uucugcacacagcac

SEQ ID NO: 484776 - RNA, 15 nt, Human
ucugcagauaaacag

SEQ ID NO: 484777 - RNA, 15 nt, Human
auaaauaaaaauaau

SEQ ID NO: 484778 - RNA, 21 nt, Human
agccucuuagaugcaguucug

SEQ ID NO: 484779 - RNA, 15 nt, Human
cauguccacugguuc

SEQ ID NO: 484780 - RNA, 17 nt, Human
uaauuccacagcugcuc

SEQ ID NO: 484781 - RNA, 14 nt, Human
cagugaaagaaaau

SEQ ID NO: 484782 - RNA, 19 nt, Human
uauaauuuuuuucaauauu

SEQ ID NO: 484783 - RNA, 21 nt, Human
uuauuuucuauaauuuaaaua

SEQ ID NO: 484784 - RNA, 19 nt, Human
caccuguuuuuaagcuguu

SEQ ID NO: 484785 - RNA, 20 nt, Human
augcaguuguugcccacagc

SEQ ID NO: 484786 - RNA, 17 nt, Human
agcuacuaauuuuaaaa

SEQ ID NO: 484787 - RNA, 14 nt, Human
ucaccuguuuuuaa

SEQ ID NO: 484788 - RNA, 15 nt, Human
cugcagauaaacagu

SEQ ID NO: 484789 - RNA, 12 nt, Human
accccugagcuu

SEQ ID NO: 484790 - RNA, 14 nt, Human
cucuggcuccagcu

SEQ ID NO: 484791 - RNA, 15 nt, Human
ucgaggcuacaguga

SEQ ID NO: 484792 - RNA, 21 nt, Human
gacagaaagcagaacagugau

SEQ ID NO: 484793 - RNA, 23 nt, Human
uuauagcuacuaauuuuaaaaug

SEQ ID NO: 484794 - RNA, 17 nt, Human
ccccauuucuauuuauu

SEQ ID NO: 484795 - RNA, 23 nt, Human
acugucuuguuggacgagaaaac

SEQ ID NO: 484796 - RNA, 11 nt, Human
aaaaaggaagg

SEQ ID NO: 484797 - RNA, 17 nt, Human
uucucuaggaaauauuu

SEQ ID NO: 484798 - RNA, 14 nt, Human
aggggcagcagugc

SEQ ID NO: 484799 - RNA, 11 nt, Human
ccugagcccca

SEQ ID NO: 484800 - RNA, 23 nt, Human
caaagcugaaauggacuuuugua

SEQ ID NO: 484801 - RNA, 16 nt, Human
acagagacagaaagca

SEQ ID NO: 484802 - RNA, 23 nt, Human
cgaaauacguuaggaggacaaaa

SEQ ID NO: 484803 - RNA, 16 nt, Human
gcuugaacccaggaga

SEQ ID NO: 484804 - RNA, 16 nt, Human
agugucaaugcagccc

SEQ ID NO: 484805 - RNA, 14 nt, Human
auuuauuuuaauaa

SEQ ID NO: 484806 - RNA, 21 nt, Human
cagugagacagcucugcauac

SEQ ID NO: 484807 - RNA, 16 nt, Human
caaaaaaaggaaggaa

SEQ ID NO: 484808 - RNA, 19 nt, Human
cucacauuuauauuuuugu

SEQ ID NO: 484809 - RNA, 20 nt, Human
acuucuuaggguuaugauua

SEQ ID NO: 484810 - RNA, 19 nt, Human
caacaaaagcgauuauuau

SEQ ID NO: 484811 - RNA, 23 nt, Human
uaaguuuuuuuuuaaaaaagaaa

SEQ ID NO: 484812 - RNA, 22 nt, Human
cauuuaaauaaaguguuugaaa

SEQ ID NO: 484813 - RNA, 18 nt, Human
aggaaguauaggccaggc

SEQ ID NO: 484814 - RNA, 14 nt, Human
aaaggaauuuaaaa

SEQ ID NO: 484815 - RNA, 13 nt, Human
aacauuuauguuc

SEQ ID NO: 484816 - RNA, 18 nt, Human
uaacuagaauuuauucaa

SEQ ID NO: 484817 - RNA, 22 nt, Human
ccauacuaauuauacccccugc

SEQ ID NO: 484818 - RNA, 13 nt, Human
ggggcucugggau

SEQ ID NO: 484819 - RNA, 22 nt, Human
cacuuccaagagccuuuuuuug

SEQ ID NO: 484820 - RNA, 22 nt, Human
uuagauaaggcuguucuuuaaa

SEQ ID NO: 484821 - RNA, 18 nt, Human
cugcucaauaaaguacaa

SEQ ID NO: 484822 - RNA, 19 nt, Human
ucccucccaaguaaauguu

SEQ ID NO: 484823 - RNA, 12 nt, Human
uaguacacacuu

SEQ ID NO: 484824 - RNA, 13 nt, Human
agacagcucugca

SEQ ID NO: 484825 - RNA, 14 nt, Human
cagauuugagcuca

SEQ ID NO: 484826 - RNA, 14 nt, Human
aagagugaaggauu

SEQ ID NO: 484827 - RNA, 12 nt, Human
aaggaugccccg

SEQ ID NO: 484828 - RNA, 22 nt, Human
aggcugaugggcaaaaaaccaa

SEQ ID NO: 484829 - RNA, 16 nt, Human
auugucuagugaaacu

SEQ ID NO: 484830 - RNA, 20 nt, Human
cugaggcaggaggaucacuu

SEQ ID NO: 484831 - RNA, 21 nt, Human
cuggccuucggccuccauccu

SEQ ID NO: 484832 - RNA, 19 nt, Human
aaucuacacuccagugaga

SEQ ID NO: 484833 - RNA, 19 nt, Human
cauaucaaacugaaacaaa

SEQ ID NO: 484834 - RNA, 22 nt, Human
gaaauaagccagacaucaacag

SEQ ID NO: 484835 - RNA, 11 nt, Human
aaaggaaggaa

SEQ ID NO: 484836 - RNA, 16 nt, Human
caggaaguagaggagg

SEQ ID NO: 484837 - RNA, 21 nt, Human
cugggauagcugacccagccc

SEQ ID NO: 484838 - RNA, 15 nt, Human
gaccacugcagaaga

SEQ ID NO: 484839 - RNA, 17 nt, Human
uuaauaauuuuuaauua

SEQ ID NO: 484840 - RNA, 13 nt, Human
aaauaaaaauaaa

SEQ ID NO: 484841 - RNA, 19 nt, Human
auuuaagagaacaagcaaa

SEQ ID NO: 484842 - RNA, 15 nt, Human
ugagacacugucucu

SEQ ID NO: 484843 - RNA, 15 nt, Human
cuacaagacacagug

SEQ ID NO: 484844 - RNA, 16 nt, Human
aauuccacagcugcuc

SEQ ID NO: 484845 - RNA, 17 nt, Human
gcaugguuuagaaagcu

SEQ ID NO: 484846 - RNA, 17 nt, Human
ggagcucguggaacagu

SEQ ID NO: 484847 - RNA, 23 nt, Human
ggaugaauuaaguuuuuuuuuaa

SEQ ID NO: 484848 - RNA, 24 nt, Human
uggccgggagccugaucaccugcc

SEQ ID NO: 484849 - RNA, 17 nt, Human
uuauaaucuuucacagg

SEQ ID NO: 484850 - RNA, 14 nt, Human
ccaaauauaaauaa

SEQ ID NO: 484851 - RNA, 22 nt, Human
agcagcauaaauguugacaugg

SEQ ID NO: 484852 - RNA, 22 nt, Human
aaagacagugaaagaaaauaac

SEQ ID NO: 484853 - RNA, 19 nt, Human
caagaagauaaucuccaaa

SEQ ID NO: 484854 - RNA, 18 nt, Human
cugagccuugggaccccu

SEQ ID NO: 484855 - RNA, 16 nt, Human
uuucacauuuaaauaa

SEQ ID NO: 484856 - RNA, 15 nt, Human
auagcagauuuuaau

SEQ ID NO: 484857 - RNA, 19 nt, Human
gaggcugaggcaagagaau

SEQ ID NO: 484858 - RNA, 21 nt, Human
auucauagcagcuuauucaca

SEQ ID NO: 484859 - RNA, 18 nt, Human
caaggcugauuaaaccaa

SEQ ID NO: 484860 - RNA, 15 nt, Human
cucguggaacaguua

SEQ ID NO: 484861 - RNA, 13 nt, Human
auagugagacacu

SEQ ID NO: 484862 - RNA, 23 nt, Human
uaaaagacagugaaagaaaauaa

SEQ ID NO: 484863 - RNA, 17 nt, Human
gugccuguaaucacagc

SEQ ID NO: 484864 - RNA, 21 nt, Human
cucuacauaaaauacaaaaac

SEQ ID NO: 484865 - RNA, 14 nt, Human
ccaggcaugguggu

SEQ ID NO: 484866 - RNA, 18 nt, Human
acuagaauuuauucaauu

SEQ ID NO: 484867 - RNA, 22 nt, Human
acagauuugagcucagcccugg

SEQ ID NO: 484868 - RNA, 22 nt, Human
gagccucagucucccucccuug

SEQ ID NO: 484869 - RNA, 13 nt, Human
ccucauggaauug

SEQ ID NO: 484870 - RNA, 16 nt, Human
cuuuauaguucuacuc

SEQ ID NO: 484871 - RNA, 20 nt, Human
cucuacuaaaaauacaaaaa

SEQ ID NO: 484872 - RNA, 18 nt, Human
uauuucuguuaaaauaua

SEQ ID NO: 484873 - RNA, 17 nt, Human
auaaguacaugauaagc

SEQ ID NO: 484874 - RNA, 20 nt, Human
agcaacuuguguuccuaaca

SEQ ID NO: 484875 - RNA, 17 nt, Human
cuuugggaggcugaggc

SEQ ID NO: 484876 - RNA, 23 nt, Human
uaaaauauaugaggcuacagaac

SEQ ID NO: 484877 - RNA, 19 nt, Human
aaauuagaggucuccaaaa

SEQ ID NO: 484878 - RNA, 23 nt, Human
uuuagaaagaagcccaauauuau

SEQ ID NO: 484879 - RNA, 16 nt, Human
uuucuauaauuuaaau

SEQ ID NO: 484880 - RNA, 21 nt, Human
agggugauauuaaccaggggc

SEQ ID NO: 484881 - RNA, 18 nt, Human
agaagcaacccaaauguu

SEQ ID NO: 484882 - RNA, 18 nt, Human
uaaaagacagugaaagaa

SEQ ID NO: 484883 - RNA, 18 nt, Human
acaaaugggaaacaaaag

SEQ ID NO: 484884 - RNA, 13 nt, Human
uauuuauuuuaau

SEQ ID NO: 484885 - RNA, 15 nt, Human
ucugucucaguccau

SEQ ID NO: 484886 - RNA, 21 nt, Human
uaagucaucugaugagaacaa

SEQ ID NO: 484887 - RNA, 14 nt, Human
ugcuucuguuuuau

SEQ ID NO: 484888 - RNA, 23 nt, Human
cuaguaauuggaaaggcagcucu

SEQ ID NO: 484889 - RNA, 17 nt, Human
agaacucccuuucaaca

SEQ ID NO: 484890 - RNA, 22 nt, Human
agacucugucucaguccaugaa

SEQ ID NO: 484891 - RNA, 16 nt, Human
caaccacuucauucuu

SEQ ID NO: 484892 - RNA, 12 nt, Human
auucugaaagca

SEQ ID NO: 484893 - RNA, 19 nt, Human
guacugagagugaacaaau

SEQ ID NO: 484894 - RNA, 18 nt, Human
gaagcaaaauuuuuucuc

SEQ ID NO: 484895 - RNA, 17 nt, Human
acacuaagagagaauga

SEQ ID NO: 484896 - RNA, 16 nt, Human
aaauuagccgggcaug

SEQ ID NO: 484897 - RNA, 17 nt, Human
guuuaauaauuuuuaau

SEQ ID NO: 484898 - RNA, 14 nt, Human
gaaagcuguggcca

SEQ ID NO: 484899 - RNA, 17 nt, Human
aguauuucuaugaaaua

SEQ ID NO: 484900 - RNA, 23 nt, Human
ucaggaguuccuaaccagccugg

SEQ ID NO: 484901 - RNA, 14 nt, Human
gccucagucucccu

SEQ ID NO: 484902 - RNA, 21 nt, Human
cuuguuggacgagaaaacaau

SEQ ID NO: 484903 - RNA, 19 nt, Human
ccagccagggcaagagagc

SEQ ID NO: 484904 - RNA, 19 nt, Human
gagccugaucaccugcccu

SEQ ID NO: 484905 - RNA, 13 nt, Human
uaaacauguuuau

SEQ ID NO: 484906 - RNA, 19 nt, Human
cuggccuucggccuccauc

SEQ ID NO: 484907 - RNA, 17 nt, Human
uugugaagcaaaauuuu

SEQ ID NO: 484908 - RNA, 19 nt, Human
uagcagcucauaaaugaaa

SEQ ID NO: 484909 - RNA, 14 nt, Human
ugaggcuacagaac

SEQ ID NO: 484910 - RNA, 13 nt, Human
cuuaucaaaggac

SEQ ID NO: 484911 - RNA, 16 nt, Human
auaaugaauacuuuau

SEQ ID NO: 484912 - RNA, 22 nt, Human
agaaaacaauaacgauaaaaga

SEQ ID NO: 484913 - RNA, 15 nt, Human
aauucugaaagcaac

SEQ ID NO: 484914 - RNA, 14 nt, Human
uuuuaauuuugaau

SEQ ID NO: 484915 - RNA, 22 nt, Human
gaauuaaguuuuuuuuuaaaaa

SEQ ID NO: 484916 - RNA, 13 nt, Human
ugccaaaauauaa

SEQ ID NO: 484917 - RNA, 13 nt, Human
aaggaaggaaaga

SEQ ID NO: 484918 - RNA, 17 nt, Human
aaagacaaggaaaaaau

SEQ ID NO: 484919 - RNA, 20 nt, Human
cuucuuuguguuauuucccu

SEQ ID NO: 484920 - RNA, 13 nt, Human
uuuugaaucauca

SEQ ID NO: 484921 - RNA, 14 nt, Human
uacuaauuuuaaaa

SEQ ID NO: 484922 - RNA, 15 nt, Human
cuuaagaagacugca

SEQ ID NO: 484923 - RNA, 17 nt, Human
uguucuaagaagugaaa

SEQ ID NO: 484924 - RNA, 14 nt, Human
auuuauuauuuuca

SEQ ID NO: 484925 - RNA, 17 nt, Human
caccucccccaucucuu

SEQ ID NO: 484926 - RNA, 23 nt, Human
ugaauuacauuuguauaaaauaa

SEQ ID NO: 484927 - RNA, 22 nt, Human
aaacauccuacaagacacagug

SEQ ID NO: 484928 - RNA, 14 nt, Human
aauauaaauaaaaa

SEQ ID NO: 484929 - RNA, 22 nt, Human
uucuaauagaacucaguuuuaa

SEQ ID NO: 484930 - RNA, 23 nt, Human
caugcugucuacacuaagagaga

SEQ ID NO: 484931 - RNA, 16 nt, Human
aguugcagugagcuga

SEQ ID NO: 484932 - RNA, 14 nt, Human
cacaacacacagau

SEQ ID NO: 484933 - RNA, 23 nt, Human
caggcacaguggcucacaccugu

SEQ ID NO: 484934 - RNA, 19 nt, Human
agcagcuuauucacaagac

SEQ ID NO: 484935 - RNA, 23 nt, Human
auucaauaucuuuuuuuuaauaa

SEQ ID NO: 484936 - RNA, 15 nt, Human
gaaaacaaggaugaa

SEQ ID NO: 484937 - RNA, 13 nt, Human
cucugagccuugg

SEQ ID NO: 484938 - RNA, 15 nt, Human
cccugcaaagcccag

SEQ ID NO: 484939 - RNA, 19 nt, Human
agugccuccaaguucaaaa

SEQ ID NO: 484940 - RNA, 20 nt, Human
caaauauaaauaaaaauaau

SEQ ID NO: 484941 - RNA, 18 nt, Human
aaagaaaaucaggcuggc

SEQ ID NO: 484942 - RNA, 17 nt, Human
guugcugggggggauug

SEQ ID NO: 484943 - RNA, 20 nt, Human
caagagccuuuuuuugaaaa

SEQ ID NO: 484944 - RNA, 14 nt, Human
aagcucuaucacca

SEQ ID NO: 484945 - RNA, 16 nt, Human
auacuauuuaagagaa

SEQ ID NO: 484946 - RNA, 19 nt, Human
accaaaaaaaggaaggaag

SEQ ID NO: 484947 - RNA, 15 nt, Human
uucuguuaaaauaua

SEQ ID NO: 484948 - RNA, 15 nt, Human
uacuaauuuuaaaau

SEQ ID NO: 484949 - RNA, 13 nt, Human
aguguuugaaagc

SEQ ID NO: 484950 - RNA, 14 nt, Human
uaaauaguuuauga

SEQ ID NO: 484951 - RNA, 20 nt, Human
aauuaaguuuuuuuuuaaaa

SEQ ID NO: 484952 - RNA, 12 nt, Human
ccuucagccuga

SEQ ID NO: 484953 - RNA, 17 nt, Human
uuacagagacagaaagc

SEQ ID NO: 484954 - RNA, 18 nt, Human
aaaguaacccuacaaaac

SEQ ID NO: 484955 - RNA, 14 nt, Human
ccugccccugagcc

SEQ ID NO: 484956 - RNA, 12 nt, Human
ucaccccuugcc

SEQ ID NO: 484957 - RNA, 22 nt, Human
aggaugccccgucccccucugg

SEQ ID NO: 484958 - RNA, 16 nt, Human
agaugcuagaacuccc

SEQ ID NO: 484959 - RNA, 16 nt, Human
caucugaugagaacaa

SEQ ID NO: 484960 - RNA, 15 nt, Human
cuggguuccuuccuc

SEQ ID NO: 484961 - RNA, 19 nt, Human
aagucuuucacauuuaaau

SEQ ID NO: 484962 - RNA, 16 nt, Human
aaaaauacaaaaauua

SEQ ID NO: 484963 - RNA, 22 nt, Human
aagacucugucucaaaaaauaa

SEQ ID NO: 484964 - RNA, 21 nt, Human
aguuguugcccacagcuguau

SEQ ID NO: 484965 - RNA, 17 nt, Human
gauaaaagacagugaaa

SEQ ID NO: 484966 - RNA, 17 nt, Human
ccucuggcuccagcugg

SEQ ID NO: 484967 - RNA, 19 nt, Human
auacuaauuauacccccug

SEQ ID NO: 484968 - RNA, 20 nt, Human
auacugugugcuaaaacaag

SEQ ID NO: 484969 - RNA, 13 nt, Human
auaucuucagaaa

SEQ ID NO: 484970 - RNA, 23 nt, Human
cugaaaucauacuucuuaggguu

SEQ ID NO: 484971 - RNA, 13 nt, Human
ccagcacagccuc

SEQ ID NO: 484972 - RNA, 18 nt, Human
uacaugucuagagaacac

SEQ ID NO: 484973 - RNA, 23 nt, Human
ccagcacuuugggaggcugaggc

SEQ ID NO: 484974 - RNA, 22 nt, Human
aauuccuaccucuucaccugac

SEQ ID NO: 484975 - RNA, 18 nt, Human
auuuuuagugaaauauua

SEQ ID NO: 484976 - RNA, 18 nt, Human
auaaauguaucuuauuca

SEQ ID NO: 484977 - RNA, 15 nt, Human
uauaauuuuuuucaa

SEQ ID NO: 484978 - RNA, 19 nt, Human
aaaggaaggaagggacaca

SEQ ID NO: 484979 - RNA, 13 nt, Human
cccuccuuaucaa

SEQ ID NO: 484980 - RNA, 15 nt, Human
uuuaaaugucugaaa

SEQ ID NO: 484981 - RNA, 15 nt, Human
aauagugaauaaagu

SEQ ID NO: 484982 - RNA, 22 nt, Human
aaacaaggaugaauuaaguuuu

SEQ ID NO: 484983 - RNA, 18 nt, Human
ccuuccuaauuccacagc

SEQ ID NO: 484984 - RNA, 12 nt, Human
gacgagaaaaca

SEQ ID NO: 484985 - RNA, 17 nt, Human
gggcuaaggcaggagga

SEQ ID NO: 484986 - RNA, 22 nt, Human
cagcccuggugggcagagaggu

SEQ ID NO: 484987 - RNA, 20 nt, Human
uaagaaucuuuauaguucua

SEQ ID NO: 484988 - RNA, 18 nt, Human
uuaggaggacaaaaggaa

SEQ ID NO: 484989 - RNA, 12 nt, Human
aauaaaguacaa

SEQ ID NO: 484990 - RNA, 19 nt, Human
acucugucucaguccauga

SEQ ID NO: 484991 - RNA, 22 nt, Human
gcacagccucuuagaugcaguu

SEQ ID NO: 484992 - RNA, 17 nt, Human
aaauaacaauaaaagac

SEQ ID NO: 484993 - RNA, 16 nt, Human
cucaauaaaguacaag

SEQ ID NO: 484994 - RNA, 14 nt, Human
aaaagaaacauuug

SEQ ID NO: 484995 - RNA, 14 nt, Human
cuuaggaagagaaa

SEQ ID NO: 484996 - RNA, 18 nt, Human
aaccuuauuguaccucuc

SEQ ID NO: 484997 - RNA, 21 nt, Human
aaucaccaaggcugauuaaac

SEQ ID NO: 484998 - RNA, 16 nt, Human
acaugaaguccaagca

SEQ ID NO: 484999 - RNA, 19 nt, Human
augaguaacugauuuguaa

SEQ ID NO: 485000 - RNA, 18 nt, Human
ugcaagaagaaaucauga

SEQ ID NO: 485001 - RNA, 19 nt, Human
aaggaaguauaggccaggc

SEQ ID NO: 485002 - RNA, 16 nt, Human
uucuauaauuuaaaua

SEQ ID NO: 485003 - RNA, 21 nt, Human
aaugugacuuaaugccacuaa

SEQ ID NO: 485004 - RNA, 21 nt, Human
gcgagacccugucucaauaaa

SEQ ID NO: 485005 - RNA, 18 nt, Human
cuuuucccaacuccagaa

SEQ ID NO: 485006 - RNA, 17 nt, Human
cuggagggaagccuugg

SEQ ID NO: 485007 - RNA, 16 nt, Human
cacuuaaaaaugguuu

SEQ ID NO: 485008 - RNA, 14 nt, Human
gccaggcacagugg

SEQ ID NO: 485009 - RNA, 15 nt, Human
gaggucaggaguucc

SEQ ID NO: 485010 - RNA, 12 nt, Human
gucccaggcuga

SEQ ID NO: 485011 - RNA, 18 nt, Human
aggaaaaaauaacaauga

SEQ ID NO: 485012 - RNA, 21 nt, Human
acagugauuaccagggacuga

SEQ ID NO: 485013 - RNA, 19 nt, Human
cugccccccagcccuccuu

SEQ ID NO: 485014 - RNA, 16 nt, Human
uacauuuguauaaaau

SEQ ID NO: 485015 - RNA, 21 nt, Human
uguuuuaagauaaauuauaag

SEQ ID NO: 485016 - RNA, 13 nt, Human
gaagaacugaaau

SEQ ID NO: 485017 - RNA, 14 nt, Human
aggaaagaugugaa

SEQ ID NO: 485018 - RNA, 14 nt, Human
uaaaauccauacau

SEQ ID NO: 485019 - RNA, 22 nt, Human
agcuuguauuccuuuuucucuc

SEQ ID NO: 485020 - RNA, 21 nt, Human
aauaauccucaguuuuuguga

SEQ ID NO: 485021 - RNA, 17 nt, Human
agcuucacuguaaaaua

SEQ ID NO: 485022 - RNA, 16 nt, Human
ugcaaauugucacagg

SEQ ID NO: 485023 - RNA, 12 nt, Human
guauaggccagg

SEQ ID NO: 485024 - RNA, 14 nt, Human
uucuggaauaaucc

SEQ ID NO: 485025 - RNA, 14 nt, Human
aaccugagccccaa

SEQ ID NO: 485026 - RNA, 11 nt, Human
aauuuaaauau

SEQ ID NO: 485027 - RNA, 13 nt, Human
aagaccagccugg

SEQ ID NO: 485028 - RNA, 17 nt, Human
auaagggaggaaaaaaa

SEQ ID NO: 485029 - RNA, 13 nt, Human
cuaugaaauauua

SEQ ID NO: 485030 - RNA, 15 nt, Human
acaaaugggaaacaa

SEQ ID NO: 485031 - RNA, 20 nt, Human
cacuguggguagacacacau

SEQ ID NO: 485032 - RNA, 22 nt, Human
caacacaucaggaaagagagca

SEQ ID NO: 485033 - RNA, 21 nt, Human
gaaagcagggacuugaaccca

SEQ ID NO: 485034 - RNA, 21 nt, Human
uuucauuguucuauaacaaca

SEQ ID NO: 485035 - RNA, 18 nt, Human
ugcauagguuuaauaauu

SEQ ID NO: 485036 - RNA, 14 nt, Human
auaaagcaagauaa

SEQ ID NO: 485037 - RNA, 21 nt, Human
caacacacagauuugagcuca

SEQ ID NO: 485038 - RNA, 18 nt, Human
acagaaagcagaacagug

SEQ ID NO: 485039 - RNA, 14 nt, Human
uaaaauagugaaua

SEQ ID NO: 485040 - RNA, 21 nt, Human
uacauaagggaggaaaaaaaa

SEQ ID NO: 485041 - RNA, 13 nt, Human
agcuguggccagc

SEQ ID NO: 485042 - RNA, 22 nt, Human
ucuacuaaaaauacaaaaaaaa

SEQ ID NO: 485043 - RNA, 14 nt, Human
cugaggcuccacuu

SEQ ID NO: 485044 - RNA, 17 nt, Human
uggcuaagcaaaaugug

SEQ ID NO: 485045 - RNA, 15 nt, Human
cuacuaauuuuaaaa

SEQ ID NO: 485046 - RNA, 15 nt, Human
cucccuuggggccua

SEQ ID NO: 485047 - RNA, 23 nt, Human
ucuuagaugcaguucugaagaag

SEQ ID NO: 485048 - RNA, 21 nt, Human
acaguuaccucugccucagaa

SEQ ID NO: 485049 - RNA, 15 nt, Human
auauaucauagcaaa

SEQ ID NO: 485050 - RNA, 14 nt, Human
cugccccccagccc

SEQ ID NO: 485051 - RNA, 15 nt, Human
acagaagcuuccauu

SEQ ID NO: 485052 - RNA, 11 nt, Human
caucuagugag

SEQ ID NO: 485053 - RNA, 20 nt, Human
acuuuauuuucuauaauuua

SEQ ID NO: 485054 - RNA, 16 nt, Human
aaugaaagcagggacu

SEQ ID NO: 485055 - RNA, 22 nt, Human
cuucagaaaaccuaagcaaacu

SEQ ID NO: 485056 - RNA, 17 nt, Human
guggggcuaaggcagga

SEQ ID NO: 485057 - RNA, 17 nt, Human
uccucugagccuuggga

SEQ ID NO: 485058 - RNA, 19 nt, Human
aaagacagugaaagaaaau

SEQ ID NO: 485059 - RNA, 22 nt, Human
caggauuagauaaggcuguucu

SEQ ID NO: 485060 - RNA, 16 nt, Human
auaacuggaaacuuca

SEQ ID NO: 485061 - RNA, 18 nt, Human
uuacaaaugggaaacaaa

SEQ ID NO: 485062 - RNA, 14 nt, Human
caagcaaauauaaa

SEQ ID NO: 485063 - RNA, 16 nt, Human
uguucuaagaagugaa

SEQ ID NO: 485064 - RNA, 15 nt, Human
uaacaauaaaagaca

SEQ ID NO: 485065 - RNA, 22 nt, Human
cugaaacaaaauuagaaaugua

SEQ ID NO: 485066 - RNA, 15 nt, Human
gcaagcucuaucacc

SEQ ID NO: 485067 - RNA, 17 nt, Human
aacagauuucaaaaaaa

SEQ ID NO: 485068 - RNA, 18 nt, Human
uuuguuaaaugauuucau

SEQ ID NO: 485069 - RNA, 20 nt, Human
auuuucaguuauuauauuua

SEQ ID NO: 485070 - RNA, 15 nt, Human
acaggguuuauguuu

SEQ ID NO: 485071 - RNA, 13 nt, Human
aguuaccucugcc

SEQ ID NO: 485072 - RNA, 14 nt, Human
auuguccaggucua

SEQ ID NO: 485073 - RNA, 23 nt, Human
ugcagagguccacaacacacaga

SEQ ID NO: 485074 - RNA, 22 nt, Human
uccuuuuaaagaaacaaaaauc

SEQ ID NO: 485075 - RNA, 21 nt, Human
auacaguggagacaucuggaa

SEQ ID NO: 485076 - RNA, 21 nt, Human
auggcagcuuuccucaaaacu

SEQ ID NO: 485077 - RNA, 21 nt, Human
uauuauuuuauagcuacuaau

SEQ ID NO: 485078 - RNA, 20 nt, Human
uaacaagccuccuuuuaaag

SEQ ID NO: 485079 - RNA, 15 nt, Human
aaauacaaaaauuag

SEQ ID NO: 485080 - RNA, 23 nt, Human
ggaggcagagguugcagugagcc

SEQ ID NO: 485081 - RNA, 20 nt, Human
aauaucuuuuuuuuaauaaa

SEQ ID NO: 485082 - RNA, 19 nt, Human
cugcaaagcccagcuugaa

SEQ ID NO: 485083 - RNA, 21 nt, Human
cuaggaugggaacaaggaagg

SEQ ID NO: 485084 - RNA, 15 nt, Human
cucaacaaacauaau

SEQ ID NO: 485085 - RNA, 15 nt, Human
cucccugccccccag

SEQ ID NO: 485086 - RNA, 21 nt, Human
gcccauccugccccugagccc

SEQ ID NO: 485087 - RNA, 20 nt, Human
acaucuggaaaguuuucucc

SEQ ID NO: 485088 - RNA, 23 nt, Human
uuuauaugcuucuguuuuauaau

SEQ ID NO: 485089 - RNA, 12 nt, Human
auuuuaaaagaa

SEQ ID NO: 485090 - RNA, 15 nt, Human
uggagacaucuggaa

SEQ ID NO: 485091 - RNA, 16 nt, Human
ugacaagcucacagac

SEQ ID NO: 485092 - RNA, 17 nt, Human
agugagacagcucugca

SEQ ID NO: 485093 - RNA, 14 nt, Human
ccccugagcuugca

SEQ ID NO: 485094 - RNA, 17 nt, Human
gaagaccucauuuugaa

SEQ ID NO: 485095 - RNA, 13 nt, Human
cgggaggcagagg

SEQ ID NO: 485096 - RNA, 15 nt, Human
ucuggggcucuggga

SEQ ID NO: 485097 - RNA, 13 nt, Human
uggcuccagcugg

SEQ ID NO: 485098 - RNA, 20 nt, Human
uccagccugagcgacaguga

SEQ ID NO: 485099 - RNA, 15 nt, Human
agcucuaucaccaag

SEQ ID NO: 485100 - RNA, 23 nt, Human
uauguuaaaacugggacagggga

SEQ ID NO: 485101 - RNA, 22 nt, Human
cuggggcucugggauagcugac

SEQ ID NO: 485102 - RNA, 20 nt, Human
aggacaaaaggaauguguaa

SEQ ID NO: 485103 - RNA, 15 nt, Human
aaucucaauauuuca

SEQ ID NO: 485104 - RNA, 13 nt, Human
aaaugggaaacaa

SEQ ID NO: 485105 - RNA, 18 nt, Human
ugauuauuuuauguuuua

SEQ ID NO: 485106 - RNA, 14 nt, Human
acguuaggaggaca

SEQ ID NO: 485107 - RNA, 12 nt, Human
aaagaaacaaaa

SEQ ID NO: 485108 - RNA, 13 nt, Human
aaaaaugguuuaa

SEQ ID NO: 485109 - RNA, 22 nt, Human
cuggguuccuuccucugagccu

SEQ ID NO: 485110 - RNA, 12 nt, Human
cucauggaauug

SEQ ID NO: 485111 - RNA, 20 nt, Human
cugagccucagucucccucc

SEQ ID NO: 485112 - RNA, 20 nt, Human
uuucuucaacucccugcccc

SEQ ID NO: 485113 - RNA, 23 nt, Human
cuagacccacuggacucaccucc

SEQ ID NO: 485114 - RNA, 18 nt, Human
auuaaguuuuuuuuuaaa

SEQ ID NO: 485115 - RNA, 21 nt, Human
cugagccucagucucccuccc

SEQ ID NO: 485116 - RNA, 18 nt, Human
aggaugggaacaaggaag

SEQ ID NO: 485117 - RNA, 17 nt, Human
uuugaguguuuuaagau

SEQ ID NO: 485118 - RNA, 14 nt, Human
cucccucuaauuua

SEQ ID NO: 485119 - RNA, 13 nt, Human
uacuuuauuuucu

SEQ ID NO: 485120 - RNA, 19 nt, Human
gucuuucacauuuaaauaa

SEQ ID NO: 485121 - RNA, 20 nt, Human
aggagaggcaaagaaaggag

SEQ ID NO: 485122 - RNA, 17 nt, Human
cuaacaggaauuuucau

SEQ ID NO: 485123 - RNA, 13 nt, Human
aacaacaacaaca

SEQ ID NO: 485124 - RNA, 13 nt, Human
ucucaaaaaauaa

SEQ ID NO: 485125 - RNA, 12 nt, Human
ucugcacacagc

SEQ ID NO: 485126 - RNA, 14 nt, Human
agaaaauaacaaua

SEQ ID NO: 485127 - RNA, 14 nt, Human
uaacaacaacaaca

SEQ ID NO: 485128 - RNA, 20 nt, Human
uaauaaguugcauagguuua

SEQ ID NO: 485129 - RNA, 22 nt, Human
gucaagaucagccugggcaaca

SEQ ID NO: 485130 - RNA, 12 nt, Human
uaucuuauucac

SEQ ID NO: 485131 - RNA, 17 nt, Human
ccuguaaucccagcacu

SEQ ID NO: 485132 - RNA, 23 nt, Human
ggccuccauccugaggcuccacu

SEQ ID NO: 485133 - RNA, 18 nt, Human
uucugauauuggacagua

SEQ ID NO: 485134 - RNA, 21 nt, Human
gucucagugucaaugcagccc

SEQ ID NO: 485135 - RNA, 22 nt, Human
auaacaaugcuguauuuuaaaa

SEQ ID NO: 485136 - RNA, 19 nt, Human
augcagagguccacaacac

SEQ ID NO: 485137 - RNA, 17 nt, Human
aauaugcucuaaacaug

SEQ ID NO: 485138 - RNA, 18 nt, Human
aaaaugguauuaaagauc

SEQ ID NO: 485139 - RNA, 16 nt, Human
cugagcgacagugaga

SEQ ID NO: 485140 - RNA, 16 nt, Human
gagaacacugugcucu

SEQ ID NO: 485141 - RNA, 15 nt, Human
caaaacuuauuggaa

SEQ ID NO: 485142 - RNA, 15 nt, Human
ugaaauuguauuaca

SEQ ID NO: 485143 - RNA, 13 nt, Human
ucucagggcagau

SEQ ID NO: 485144 - RNA, 20 nt, Human
uaaaagacaaggaaaaaaua

SEQ ID NO: 485145 - RNA, 20 nt, Human
cugcacuccagccugagcga

SEQ ID NO: 485146 - RNA, 20 nt, Human
auugcuugaacccaggagau

SEQ ID NO: 485147 - RNA, 16 nt, Human
acauuugcucauggaa

SEQ ID NO: 485148 - RNA, 17 nt, Human
uugccaaauauaaauaa

SEQ ID NO: 485149 - RNA, 15 nt, Human
ccaaggagccaaaca

SEQ ID NO: 485150 - RNA, 14 nt, Human
uuagagcaucucau

SEQ ID NO: 485151 - RNA, 17 nt, Human
ucuauaauuuaaauaua

SEQ ID NO: 485152 - RNA, 16 nt, Human
uuuauauuugaaauau

SEQ ID NO: 485153 - RNA, 18 nt, Human
ugguucuaauagaacuca

SEQ ID NO: 485154 - RNA, 17 nt, Human
gaaugagagacacacug

SEQ ID NO: 485155 - RNA, 15 nt, Human
ggcaauagucaaauu

SEQ ID NO: 485156 - RNA, 16 nt, Human
gacauagaauuaacac

SEQ ID NO: 485157 - RNA, 17 nt, Human
aauguaucuuauucaca

SEQ ID NO: 485158 - RNA, 14 nt, Human
ccuugaugaagaag

SEQ ID NO: 485159 - RNA, 20 nt, Human
agccuucucucaaggagagg

SEQ ID NO: 485160 - RNA, 21 nt, Human
caacccccauuucuauuuauu

SEQ ID NO: 485161 - RNA, 14 nt, Human
acccaaaaggcaga

SEQ ID NO: 485162 - RNA, 14 nt, Human
augauguuuagaaa

SEQ ID NO: 485163 - RNA, 12 nt, Human
cccccagcccuc

SEQ ID NO: 485164 - RNA, 16 nt, Human
aggaggaucacuugag

SEQ ID NO: 485165 - RNA, 15 nt, Human
cuguaaaauaauaac

SEQ ID NO: 485166 - RNA, 23 nt, Human
aauauuuauuuuaauaauguuuc

SEQ ID NO: 485167 - RNA, 15 nt, Human
ugccccccagcccuc

SEQ ID NO: 485168 - RNA, 19 nt, Human
cauuguuugucugucuuca

SEQ ID NO: 485169 - RNA, 17 nt, Human
ccuacuuccccuuccua

SEQ ID NO: 485170 - RNA, 12 nt, Human
auaaaauacaaa

SEQ ID NO: 485171 - RNA, 13 nt, Human
cucaaaaaauaaa

SEQ ID NO: 485172 - RNA, 12 nt, Human
ucaacaugguga

SEQ ID NO: 485173 - RNA, 16 nt, Human
aauaaaguguuugaaa

SEQ ID NO: 485174 - RNA, 19 nt, Human
cauggaauuggagcucgug

SEQ ID NO: 485175 - RNA, 22 nt, Human
guacacugccuucucaacucca

SEQ ID NO: 485176 - RNA, 15 nt, Human
ccgucccccucuggc

SEQ ID NO: 485177 - RNA, 16 nt, Human
ccuguacuccagccug

SEQ ID NO: 485178 - RNA, 17 nt, Human
caauaaauaaauaaaua

SEQ ID NO: 485179 - RNA, 18 nt, Human
cuuagaugggcauggugg

SEQ ID NO: 485180 - RNA, 21 nt, Human
gaggcugaggcggguggauca

SEQ ID NO: 485181 - RNA, 13 nt, Human
acacuuaaaaaug

SEQ ID NO: 485182 - RNA, 14 nt, Human
aaagaaacaaaaau

SEQ ID NO: 485183 - RNA, 16 nt, Human
cccuauccuacuuccc

SEQ ID NO: 485184 - RNA, 17 nt, Human
ucuuauagaauauuuau

SEQ ID NO: 485185 - RNA, 23 nt, Human
gaggcauuuaggccaugggacag

SEQ ID NO: 485186 - RNA, 21 nt, Human
caacaacaaaagcgauuauua

SEQ ID NO: 485187 - RNA, 14 nt, Human
aacaacaacaacaa

SEQ ID NO: 485188 - RNA, 22 nt, Human
aauaaauguaucuuauucacau

SEQ ID NO: 485189 - RNA, 16 nt, Human
gucucaauaaauaaau

SEQ ID NO: 485190 - RNA, 13 nt, Human
agcuguugagcug

SEQ ID NO: 485191 - RNA, 17 nt, Human
gcaccuguaaucccagc

SEQ ID NO: 485192 - RNA, 14 nt, Human
cuggccgggagccu

SEQ ID NO: 485193 - RNA, 19 nt, Human
cagagaugaggccgccaug

SEQ ID NO: 485194 - RNA, 16 nt, Human
cuucggccuccauccu

SEQ ID NO: 485195 - RNA, 15 nt, Human
augucugaaauggaa

SEQ ID NO: 485196 - RNA, 18 nt, Human
uauagcuacuaauuuuaa

SEQ ID NO: 485197 - RNA, 19 nt, Human
agcucugcccauccugccc

SEQ ID NO: 485198 - RNA, 22 nt, Human
aacaaaguugauuaagaaagga

SEQ ID NO: 485199 - RNA, 22 nt, Human
cggaggucgaggcuacagugag

SEQ ID NO: 485200 - RNA, 20 nt, Human
ugagagugaacaaauuuaca

SEQ ID NO: 485201 - RNA, 14 nt, Human
agaaacaaaaauca

SEQ ID NO: 485202 - RNA, 19 nt, Human
cagugagccaaauguaaaa

SEQ ID NO: 485203 - RNA, 23 nt, Human
auuuauguuccuuuuaaagaaac

SEQ ID NO: 485204 - RNA, 14 nt, Human
ggcuccagcuggcc

SEQ ID NO: 485205 - RNA, 16 nt, Human
gaaaaugguauuaaag

SEQ ID NO: 485206 - RNA, 23 nt, Human
cucauacuauuuaagagaacaag

SEQ ID NO: 485207 - RNA, 22 nt, Human
aaccagggagccccuuugauga

SEQ ID NO: 485208 - RNA, 19 nt, Human
cccccucuggcuccagcug

SEQ ID NO: 485209 - RNA, 18 nt, Human
gcuccauuuuuagugaaa

SEQ ID NO: 485210 - RNA, 15 nt, Human
gccuaagugcagccc

SEQ ID NO: 485211 - RNA, 21 nt, Human
auuauauggcuugaguuuaaa

SEQ ID NO: 485212 - RNA, 16 nt, Human
uguccccuauccuacu

SEQ ID NO: 485213 - RNA, 18 nt, Human
gaaaauaacaauaaaaga

SEQ ID NO: 485214 - RNA, 15 nt, Human
ccugcaaagcccagc

SEQ ID NO: 485215 - RNA, 18 nt, Human
auaaaguguuugaaagcu

SEQ ID NO: 485216 - RNA, 18 nt, Human
uaaugaauacuuuauaaa

SEQ ID NO: 485217 - RNA, 16 nt, Human
gaagagaaaccaggga

SEQ ID NO: 485218 - RNA, 14 nt, Human
agcucuaucaccaa

SEQ ID NO: 485219 - RNA, 15 nt, Human
cccccagcccuccuu

SEQ ID NO: 485220 - RNA, 22 nt, Human
uauuucuaugaaauauuauguu

SEQ ID NO: 485221 - RNA, 19 nt, Human
acagucaccucauggaauu

SEQ ID NO: 485222 - RNA, 19 nt, Human
agcaucucauuuauaaugu

SEQ ID NO: 485223 - RNA, 15 nt, Human
gccuugggaccccug

SEQ ID NO: 485224 - RNA, 14 nt, Human
caguucugaagaag

SEQ ID NO: 485225 - RNA, 14 nt, Human
ugaagauguagagg

SEQ ID NO: 485226 - RNA, 17 nt, Human
guauuauuuuuuaaaaa

SEQ ID NO: 485227 - RNA, 21 nt, Human
aacuuguaaaggaauuuaaaa

SEQ ID NO: 485228 - RNA, 22 nt, Human
uauuuaagagaacaagcaaaua

SEQ ID NO: 485229 - RNA, 13 nt, Human
aaauauaaacagc

SEQ ID NO: 485230 - RNA, 17 nt, Human
cagacaucaacagauaa

SEQ ID NO: 485231 - RNA, 22 nt, Human
ugguuguauuauuuuuuaaaaa

SEQ ID NO: 485232 - RNA, 23 nt, Human
gucucccucccuuggggccuaug

SEQ ID NO: 485233 - RNA, 20 nt, Human
accucugccucagaaaacaa

SEQ ID NO: 485234 - RNA, 19 nt, Human
guacaagagcuuaacagug

SEQ ID NO: 485235 - RNA, 20 nt, Human
ggagauggaaguugcaguga

SEQ ID NO: 485236 - RNA, 15 nt, Human
uacaggauuugaaau

SEQ ID NO: 485237 - RNA, 14 nt, Human
ucucaaaaaauaaa

SEQ ID NO: 485238 - RNA, 17 nt, Human
auuuauaacaaccuaaa

SEQ ID NO: 485239 - RNA, 11 nt, Human
aaaaaaaaacc

SEQ ID NO: 485240 - RNA, 20 nt, Human
ucauucacucaacaaacaua

SEQ ID NO: 485241 - RNA, 19 nt, Human
gauggaguuucucuagaag

SEQ ID NO: 485242 - RNA, 16 nt, Human
ccuccuuaucaaagga

SEQ ID NO: 485243 - RNA, 11 nt, Human
gcaugguuuag

SEQ ID NO: 485244 - RNA, 13 nt, Human
uaaauaaauaaau

SEQ ID NO: 485245 - RNA, 21 nt, Human
gaaauguuuacagauccccaa

SEQ ID NO: 485246 - RNA, 23 nt, Human
agcucugcccauccugccccuga

SEQ ID NO: 485247 - RNA, 18 nt, Human
cagagacagaaagcagaa

SEQ ID NO: 485248 - RNA, 20 nt, Human
auuuaagagaacaagcaaau

SEQ ID NO: 485249 - RNA, 22 nt, Human
ggacaguaaaauccacagacca

SEQ ID NO: 485250 - RNA, 21 nt, Human
acuccagccagggcaagagag

SEQ ID NO: 485251 - RNA, 17 nt, Human
uucaaaacuuauuggaa

SEQ ID NO: 485252 - RNA, 22 nt, Human
agcccuccuuaucaaaggacac

SEQ ID NO: 485253 - RNA, 14 nt, Human
aauauaaacagcaa

SEQ ID NO: 485254 - RNA, 16 nt, Human
cuccauccugaggcuc

SEQ ID NO: 485255 - RNA, 18 nt, Human
acugccuucucaacucca

SEQ ID NO: 485256 - RNA, 17 nt, Human
aggcaggaggaucacuu

SEQ ID NO: 485257 - RNA, 23 nt, Human
uccaaacugacucuuaagaagac

SEQ ID NO: 485258 - RNA, 20 nt, Human
ggucaacauagugagacacu

SEQ ID NO: 485259 - RNA, 14 nt, Human
cuggaaaucagggu

SEQ ID NO: 485260 - RNA, 17 nt, Human
auaucaauuuaaaaaaa

SEQ ID NO: 485261 - RNA, 23 nt, Human
guauuugaguguuuuaagauaaa

SEQ ID NO: 485262 - RNA, 15 nt, Human
caaggagaggcaaag

SEQ ID NO: 485263 - RNA, 15 nt, Human
caggaaguagaggag

SEQ ID NO: 485264 - RNA, 13 nt, Human
aaauauaaagcaa

SEQ ID NO: 485265 - RNA, 18 nt, Human
acuugccauaaaacuuag

SEQ ID NO: 485266 - RNA, 12 nt, Human
aagaaaauaaca

SEQ ID NO: 485267 - RNA, 21 nt, Human
aggcucuuuugggauuuuuga

SEQ ID NO: 485268 - RNA, 19 nt, Human
cuggacucaccucccccau

SEQ ID NO: 485269 - RNA, 18 nt, Human
cgccuguaaucccagcac

SEQ ID NO: 485270 - RNA, 19 nt, Human
agcuacuaauuuuaaaaug

SEQ ID NO: 485271 - RNA, 23 nt, Human
caaauaagucaucugaugagaac

SEQ ID NO: 485272 - RNA, 15 nt, Human
uagauaggccauggg

SEQ ID NO: 485273 - RNA, 15 nt, Human
cuugaaaacuuuaug

SEQ ID NO: 485274 - RNA, 18 nt, Human
cuacuccauuaaauauaa

SEQ ID NO: 485275 - RNA, 17 nt, Human
uauaauuuuuuucaaua

SEQ ID NO: 485276 - RNA, 20 nt, Human
uuuaauuuugaauaaauaaa

SEQ ID NO: 485277 - RNA, 17 nt, Human
ucauacuucuuaggguu

SEQ ID NO: 485278 - RNA, 14 nt, Human
ugugaaaagcucca

SEQ ID NO: 485279 - RNA, 13 nt, Human
ucuagagcaaagc

SEQ ID NO: 485280 - RNA, 16 nt, Human
aaaauaacaauaaaag

SEQ ID NO: 485281 - RNA, 19 nt, Human
agccuucucucaaggagag

SEQ ID NO: 485282 - RNA, 21 nt, Human
agcaaauauaaacagcaacuu

SEQ ID NO: 485283 - RNA, 20 nt, Human
aaacuuuaugcuaagugaaa

SEQ ID NO: 485284 - RNA, 17 nt, Human
aaauauaaauaaaaaua

SEQ ID NO: 485285 - RNA, 21 nt, Human
ugaacaaauuuacagagacag

SEQ ID NO: 485286 - RNA, 19 nt, Human
uagugagcagucaggaaag

SEQ ID NO: 485287 - RNA, 22 nt, Human
guguccccuauccuacuucccc

SEQ ID NO: 485288 - RNA, 17 nt, Human
uuauuacuguaagaaaa

SEQ ID NO: 485289 - RNA, 23 nt, Human
auguuaaaacugggacaggggag

SEQ ID NO: 485290 - RNA, 13 nt, Human
aauaaaaauaaaa

SEQ ID NO: 485291 - RNA, 12 nt, Human
aagagcuuaaca

SEQ ID NO: 485292 - RNA, 17 nt, Human
gaagcaccaaucaugaa

SEQ ID NO: 485293 - RNA, 13 nt, Human
ucuuauucacauc

SEQ ID NO: 485294 - RNA, 17 nt, Human
ucuuucacauuuaaaua

SEQ ID NO: 485295 - RNA, 20 nt, Human
aaaaaccugagccccaaaag

SEQ ID NO: 485296 - RNA, 18 nt, Human
uuuucucuccucucccca

SEQ ID NO: 485297 - RNA, 22 nt, Human
aauaagucaucugaugagaaca

SEQ ID NO: 485298 - RNA, 18 nt, Human
auauuauaauuuuuuuca

SEQ ID NO: 485299 - RNA, 22 nt, Human
aaacauguuuaucguauuugau

SEQ ID NO: 485300 - RNA, 14 nt, Human
aaucucaauauuuc

SEQ ID NO: 485301 - RNA, 23 nt, Human
acaaauacucuuaggaagagaaa

SEQ ID NO: 485302 - RNA, 17 nt, Human
agaugggagaaucacuu

SEQ ID NO: 485303 - RNA, 13 nt, Human
aagcuguggccag

SEQ ID NO: 485304 - RNA, 13 nt, Human
cuucucaacucca

SEQ ID NO: 485305 - RNA, 23 nt, Human
aguacucauacauguuacaacac

SEQ ID NO: 485306 - RNA, 22 nt, Human
ggcagcuuuccucaaaacuuca

SEQ ID NO: 485307 - RNA, 12 nt, Human
ucccccucuggc

SEQ ID NO: 485308 - RNA, 17 nt, Human
uacaaaugcauuucuaa

SEQ ID NO: 485309 - RNA, 18 nt, Human
gggaacaaggaaggaaag

SEQ ID NO: 485310 - RNA, 21 nt, Human
aggguuaugauuaaguaauga

SEQ ID NO: 485311 - RNA, 13 nt, Human
cacaacuauauug

SEQ ID NO: 485312 - RNA, 15 nt, Human
auuugguaaggggaa

SEQ ID NO: 485313 - RNA, 23 nt, Human
augaauuaaguuuuuuuuuaaaa

SEQ ID NO: 485314 - RNA, 17 nt, Human
caaacauauauaacaau

SEQ ID NO: 485315 - RNA, 18 nt, Human
auuugcuggagcucugcc

SEQ ID NO: 485316 - RNA, 13 nt, Human
ccaaggaugcccc

SEQ ID NO: 485317 - RNA, 19 nt, Human
cuaagcuucacuguaaaau

SEQ ID NO: 485318 - RNA, 16 nt, Human
cauuuguauaaaauaa

SEQ ID NO: 485319 - RNA, 20 nt, Human
ggaaaguuuucuccacugga

SEQ ID NO: 485320 - RNA, 19 nt, Human
uauauuuuuuguuaaauga

SEQ ID NO: 485321 - RNA, 19 nt, Human
ucaguccaugaagauguag

SEQ ID NO: 485322 - RNA, 17 nt, Human
ucuauaauguguucauu

SEQ ID NO: 485323 - RNA, 23 nt, Human
ggcgacucuauagacucuaggac

SEQ ID NO: 485324 - RNA, 18 nt, Human
acaagccuccuuuuaaag

SEQ ID NO: 485325 - RNA, 22 nt, Human
cuuguaaaggaauuuaaaaauc

SEQ ID NO: 485326 - RNA, 22 nt, Human
augguuguauuauuuuuuaaaa

SEQ ID NO: 485327 - RNA, 13 nt, Human
aagacaaggaaaa

SEQ ID NO: 485328 - RNA, 13 nt, Human
cuacagugagcca

SEQ ID NO: 485329 - RNA, 22 nt, Human
caugaguaacugauuuguaaca

SEQ ID NO: 485330 - RNA, 13 nt, Human
ugggaggcugaga

SEQ ID NO: 485331 - RNA, 15 nt, Human
gucccaggcugagcc

SEQ ID NO: 485332 - RNA, 18 nt, Human
ccuugggaccccugagcu

SEQ ID NO: 485333 - RNA, 12 nt, Human
auaacuggaaac

SEQ ID NO: 485334 - RNA, 14 nt, Human
agcucguggaacag

SEQ ID NO: 485335 - RNA, 15 nt, Human
aaauauaaucagaga

SEQ ID NO: 485336 - RNA, 23 nt, Human
aacuuguaaaggaauuuaaaaau

SEQ ID NO: 485337 - RNA, 17 nt, Human
auaauuuaaauauaugc

SEQ ID NO: 485338 - RNA, 18 nt, Human
acuguacuccagccaggg

SEQ ID NO: 485339 - RNA, 18 nt, Human
gaugccccgucccccucu

SEQ ID NO: 485340 - RNA, 16 nt, Human
ucucuaccaaaaaaag

SEQ ID NO: 485341 - RNA, 18 nt, Human
aacaaaguugauuaagaa

SEQ ID NO: 485342 - RNA, 22 nt, Human
uaagagaacaagcaaauauaaa

SEQ ID NO: 485343 - RNA, 20 nt, Human
caaauguucaucaaugaaug

SEQ ID NO: 485344 - RNA, 16 nt, Human
cuuauagaauauuuau

SEQ ID NO: 485345 - RNA, 19 nt, Human
uaggaggacaaaaggaaug

SEQ ID NO: 485346 - RNA, 20 nt, Human
aggagauggaaguugcagug

SEQ ID NO: 485347 - RNA, 15 nt, Human
uggcgcgcaccugua

SEQ ID NO: 485348 - RNA, 20 nt, Human
gcuugcagagaugaggccgc

SEQ ID NO: 485349 - RNA, 19 nt, Human
uucauuguucuauaacaac

SEQ ID NO: 485350 - RNA, 14 nt, Human
cccugucucaauaa

SEQ ID NO: 485351 - RNA, 15 nt, Human
uuaauucugaaagca

SEQ ID NO: 485352 - RNA, 16 nt, Human
uucucuaggaaauauu

SEQ ID NO: 485353 - RNA, 16 nt, Human
auccaaugaaaugagu

SEQ ID NO: 485354 - RNA, 15 nt, Human
ccagcacagccucuu

SEQ ID NO: 485355 - RNA, 18 nt, Human
acaaauccaaugaaauga

SEQ ID NO: 485356 - RNA, 13 nt, Human
uacagagacagaa

SEQ ID NO: 485357 - RNA, 20 nt, Human
auaacaaugcuguauuuuaa

SEQ ID NO: 485358 - RNA, 19 nt, Human
uaccauuauggauaaagau

SEQ ID NO: 485359 - RNA, 21 nt, Human
aggaugggaacaaggaaggaa

SEQ ID NO: 485360 - RNA, 13 nt, Human
ccauuccaagccu

SEQ ID NO: 485361 - RNA, 19 nt, Human
cucuguucugcacacagca

SEQ ID NO: 485362 - RNA, 11 nt, Human
auaauuuaaau

SEQ ID NO: 485363 - RNA, 17 nt, Human
cauuaaauauaaagcaa

SEQ ID NO: 485364 - RNA, 15 nt, Human
aauaaauaaauaaaa

SEQ ID NO: 485365 - RNA, 21 nt, Human
aauuaaguuuuuuuuuaaaaa

SEQ ID NO: 485366 - RNA, 21 nt, Human
ucuucaacucccugcccccca

SEQ ID NO: 485367 - RNA, 22 nt, Human
auuuucuucucacauuuauauu

SEQ ID NO: 485368 - RNA, 17 nt, Human
uuuucaccuguuuuuaa

SEQ ID NO: 485369 - RNA, 12 nt, Human
gcugaggcagga

SEQ ID NO: 485370 - RNA, 22 nt, Human
cccagcccuccuuaucaaagga

SEQ ID NO: 485371 - RNA, 17 nt, Human
cacgccuguaaucccag

SEQ ID NO: 485372 - RNA, 21 nt, Human
aaagauuugauguauguaaua

SEQ ID NO: 485373 - RNA, 21 nt, Human
accaccugccuauauuuuuug

SEQ ID NO: 485374 - RNA, 16 nt, Human
augggaacaaggaagg

SEQ ID NO: 485375 - RNA, 19 nt, Human
aaauuaaaaccucuuugug

SEQ ID NO: 485376 - RNA, 23 nt, Human
ggaacaguuaccucugccucaga

SEQ ID NO: 485377 - RNA, 21 nt, Human
auuuuuucucuaggaaauauu

SEQ ID NO: 485378 - RNA, 14 nt, Human
cacaagaaaugaaa

SEQ ID NO: 485379 - RNA, 22 nt, Human
gcagagagguagggauggggcu

SEQ ID NO: 485380 - RNA, 20 nt, Human
uaaaacaagcacuaaacaaa

SEQ ID NO: 485381 - RNA, 17 nt, Human
gccuccuuuuaaaguaa

SEQ ID NO: 485382 - RNA, 16 nt, Human
uacaaaugggaaacaa

SEQ ID NO: 485383 - RNA, 19 nt, Human
ucaacauggugaaaccccg

SEQ ID NO: 485384 - RNA, 16 nt, Human
gucuaucuuugagcgc

SEQ ID NO: 485385 - RNA, 16 nt, Human
ugacuuaaugccacua

SEQ ID NO: 485386 - RNA, 15 nt, Human
uggggcuuccuaacu

SEQ ID NO: 485387 - RNA, 23 nt, Human
cuuaagaagacugcauuauauuu

SEQ ID NO: 485388 - RNA, 19 nt, Human
ucaccaaggcugauuaaac

SEQ ID NO: 485389 - RNA, 16 nt, Human
auaucaauuuaaaaaa

SEQ ID NO: 485390 - RNA, 11 nt, Human
auaacaacaac

SEQ ID NO: 485391 - RNA, 15 nt, Human
uauuuauuuuaauaa

SEQ ID NO: 485392 - RNA, 13 nt, Human
aggaaaaaauaac

SEQ ID NO: 485393 - RNA, 21 nt, Human
aauuuucauuguucuauaaca

SEQ ID NO: 485394 - RNA, 23 nt, Human
auaauguguucauucuggaauaa

SEQ ID NO: 485395 - RNA, 13 nt, Human
aacaaaauuagaa

SEQ ID NO: 485396 - RNA, 15 nt, Human
ucuuauaauuuaaaa

SEQ ID NO: 485397 - RNA, 17 nt, Human
augcagagguccacaac

SEQ ID NO: 485398 - RNA, 23 nt, Human
uuuauauuucuguuaaaauauau

SEQ ID NO: 485399 - RNA, 18 nt, Human
gagcgacagugagacucu

SEQ ID NO: 485400 - RNA, 21 nt, Human
aagagaacaagcaaauauaaa

SEQ ID NO: 485401 - RNA, 15 nt, Human
aaauauuuauuuuaa

SEQ ID NO: 485402 - RNA, 18 nt, Human
uuuauguuuaauucugaa

SEQ ID NO: 485403 - RNA, 23 nt, Human
uagacacacaugaaguccaagca

SEQ ID NO: 485404 - RNA, 16 nt, Human
ccccaucucuucuggg

SEQ ID NO: 485405 - RNA, 15 nt, Human
gcaacccaaauguuc

SEQ ID NO: 485406 - RNA, 18 nt, Human
gagccaacagaagcuucc

SEQ ID NO: 485407 - RNA, 18 nt, Human
cuaccaaaaaaaggaagg

SEQ ID NO: 485408 - RNA, 20 nt, Human
ggccaugggacagggaggac

SEQ ID NO: 485409 - RNA, 16 nt, Human
auuuuuagugaaauau

SEQ ID NO: 485410 - RNA, 17 nt, Human
agaaaugaaagcaggga

SEQ ID NO: 485411 - RNA, 22 nt, Human
cccuauccuacuuccccuuccu

SEQ ID NO: 485412 - RNA, 13 nt, Human
cuuacuucuucuc

SEQ ID NO: 485413 - RNA, 17 nt, Human
ggaacauuuauguuccu

SEQ ID NO: 485414 - RNA, 14 nt, Human
aauauaaagcaaga

SEQ ID NO: 485415 - RNA, 21 nt, Human
uuacauuuguauaaaauaauu

SEQ ID NO: 485416 - RNA, 22 nt, Human
accccugagcuugcagagauga

SEQ ID NO: 485417 - RNA, 14 nt, Human
guacuccagccugg

SEQ ID NO: 485418 - RNA, 18 nt, Human
gccuuggggcugaugcag

SEQ ID NO: 485419 - RNA, 15 nt, Human
auauuuauuaccucu

SEQ ID NO: 485420 - RNA, 13 nt, Human
aacaauaaaagac

SEQ ID NO: 485421 - RNA, 24 nt, Human
uaauuuaaaauaugcucuaaacau

SEQ ID NO: 485422 - RNA, 20 nt, Human
ccuccugccuaagugcagcc

SEQ ID NO: 485423 - RNA, 13 nt, Human
uaauuuuuuucaa

SEQ ID NO: 485424 - RNA, 22 nt, Human
agccaaacauccuacaagacac

SEQ ID NO: 485425 - RNA, 13 nt, Human
ccugagcuugcag

SEQ ID NO: 485426 - RNA, 17 nt, Human
acaaaugcauuucuaaa

SEQ ID NO: 485427 - RNA, 20 nt, Human
uauaaagcaagauaauaaaa

SEQ ID NO: 485428 - RNA, 12 nt, Human
gcaacaugguga

SEQ ID NO: 485429 - RNA, 14 nt, Human
cucagucucccucc

SEQ ID NO: 485430 - RNA, 20 nt, Human
gcccauccugccccugagcc

SEQ ID NO: 485431 - RNA, 18 nt, Human
uaguaucaaaagaaagaa

SEQ ID NO: 485432 - RNA, 15 nt, Human
aaggaauuuaaaaau

SEQ ID NO: 485433 - RNA, 17 nt, Human
ugguucccuugaugaag

SEQ ID NO: 485434 - RNA, 21 nt, Human
uuuucaggcuagauguaugua

SEQ ID NO: 485435 - RNA, 12 nt, Human
uaagaagacugc

SEQ ID NO: 485436 - RNA, 22 nt, Human
aauaugccccauucaacaucua

SEQ ID NO: 485437 - RNA, 17 nt, Human
ucugucucaaaaaauaa

SEQ ID NO: 485438 - RNA, 20 nt, Human
aaagacagugaaagaaaaua

SEQ ID NO: 485439 - RNA, 16 nt, Human
uaaaggaauuuaaaaa

SEQ ID NO: 485440 - RNA, 18 nt, Human
gccuggucaacaugguga

SEQ ID NO: 485441 - RNA, 14 nt, Human
uggcuugaguuuaa

SEQ ID NO: 485442 - RNA, 16 nt, Human
cucagcccuggugggc

SEQ ID NO: 485443 - RNA, 22 nt, Human
uguauacugugugcuaaaacaa

SEQ ID NO: 485444 - RNA, 23 nt, Human
ugagcugauaucaugccccugua

SEQ ID NO: 485445 - RNA, 16 nt, Human
augcuguauuuuaaaa

SEQ ID NO: 485446 - RNA, 22 nt, Human
aaaaaaccugagccccaaaagg

SEQ ID NO: 485447 - RNA, 20 nt, Human
auaauccuaaacauaugaau

SEQ ID NO: 485448 - RNA, 20 nt, Human
uccuaacaggaauuuucauu

SEQ ID NO: 485449 - RNA, 20 nt, Human
ggguuccuuccucugagccu

SEQ ID NO: 485450 - RNA, 21 nt, Human
auuugaguguuuuaagauaaa

SEQ ID NO: 485451 - RNA, 22 nt, Human
agaagcaccaaucaugaauuag

SEQ ID NO: 485452 - RNA, 13 nt, Human
gaugggcaaaaaa

SEQ ID NO: 485453 - RNA, 15 nt, Human
cuggacucaccuccc

SEQ ID NO: 485454 - RNA, 14 nt, Human
ucuuuuuuuuaaua

SEQ ID NO: 485455 - RNA, 21 nt, Human
aauucauucacucaacaaaca

SEQ ID NO: 485456 - RNA, 20 nt, Human
agcuucacuguaaaauaaua

SEQ ID NO: 485457 - RNA, 23 nt, Human
gauagauaggucagugcaaauac

SEQ ID NO: 485458 - RNA, 19 nt, Human
cccugccccccagcccucc

SEQ ID NO: 485459 - RNA, 16 nt, Human
ccugccccccagcccu

SEQ ID NO: 485460 - RNA, 18 nt, Human
gacccacuggacucaccu

SEQ ID NO: 485461 - RNA, 16 nt, Human
ggaacaaggaaggaaa

SEQ ID NO: 485462 - RNA, 14 nt, Human
agaauucauucacu

SEQ ID NO: 485463 - RNA, 19 nt, Human
ugagcgcccacuagaccca

SEQ ID NO: 485464 - RNA, 16 nt, Human
aagaaaauaacaauaa

SEQ ID NO: 485465 - RNA, 23 nt, Human
aauguagcagcucauaaaugaaa

SEQ ID NO: 485466 - RNA, 23 nt, Human
cccacuggacucaccucccccau

SEQ ID NO: 485467 - RNA, 12 nt, Human
auagaauauuua

SEQ ID NO: 485468 - RNA, 14 nt, Human
ugaggcaggaggau

SEQ ID NO: 485469 - RNA, 16 nt, Human
aaguugcagugagcug

SEQ ID NO: 485470 - RNA, 16 nt, Human
agcaagacucugucuc

SEQ ID NO: 485471 - RNA, 22 nt, Human
aaccuacacgagauacagaauu

SEQ ID NO: 485472 - RNA, 20 nt, Human
cuugccauaauuacuauguc

SEQ ID NO: 485473 - RNA, 22 nt, Human
uaaaauaauuuuuauauuugaa

SEQ ID NO: 485474 - RNA, 22 nt, Human
cucagcccuggugggcagagag

SEQ ID NO: 485475 - RNA, 13 nt, Human
acaucaggaaaga

SEQ ID NO: 485476 - RNA, 23 nt, Human
ucuccauguacuggcaagaccug

SEQ ID NO: 485477 - RNA, 21 nt, Human
gcacuguggguagacacacau

SEQ ID NO: 485478 - RNA, 21 nt, Human
cagccugggugacagagcaag

SEQ ID NO: 485479 - RNA, 23 nt, Human
gcaacuuguguuccuaacaggaa

SEQ ID NO: 485480 - RNA, 18 nt, Human
cugagucccaggcugagc

SEQ ID NO: 485481 - RNA, 21 nt, Human
auuuuccugaaaacccuugcc

SEQ ID NO: 485482 - RNA, 15 nt, Human
uucaaaguuaagaau

SEQ ID NO: 485483 - RNA, 20 nt, Human
uggaacagauuucaaaaaaa

SEQ ID NO: 485484 - RNA, 13 nt, Human
uuuaagauaaauu

SEQ ID NO: 485485 - RNA, 14 nt, Human
uuucaauauuuauu

SEQ ID NO: 485486 - RNA, 15 nt, Human
agaugggcauggugg

SEQ ID NO: 485487 - RNA, 13 nt, Human
auguaucuuauuc

SEQ ID NO: 485488 - RNA, 16 nt, Human
uaagauaaauuauaag

SEQ ID NO: 485489 - RNA, 16 nt, Human
uuuaaggauucugaga

SEQ ID NO: 485490 - RNA, 18 nt, Human
uuuuaaaaaagaaacauu

SEQ ID NO: 485491 - RNA, 23 nt, Human
ugaaaugaguuuuucuuuucauu

SEQ ID NO: 485492 - RNA, 19 nt, Human
auguuuacagauccccaag

SEQ ID NO: 485493 - RNA, 13 nt, Human
aaaaauacaaaaa

SEQ ID NO: 485494 - RNA, 18 nt, Human
uaaaagacaaggaaaaaa

SEQ ID NO: 485495 - RNA, 13 nt, Human
uaaaauacaaaaa

SEQ ID NO: 485496 - RNA, 15 nt, Human
aaacauaugaauuau

SEQ ID NO: 485497 - RNA, 15 nt, Human
aaagaaagaaaauca

SEQ ID NO: 485498 - RNA, 18 nt, Human
cucucuuauagaauauuu

SEQ ID NO: 485499 - RNA, 16 nt, Human
cauagaaguaaaaaca

SEQ ID NO: 485500 - RNA, 22 nt, Human
ccgggagccugaucaccugccc

SEQ ID NO: 485501 - RNA, 21 nt, Human
caaggagaggcaaagaaagga

SEQ ID NO: 485502 - RNA, 11 nt, Human
auuuaaaaauc

SEQ ID NO: 485503 - RNA, 21 nt, Human
cagagguccacaacacacaga

SEQ ID NO: 485504 - RNA, 17 nt, Human
ucaacccccauuucuau

SEQ ID NO: 485505 - RNA, 16 nt, Human
uauaugucacuuugcu

SEQ ID NO: 485506 - RNA, 16 nt, Human
uugauuaagaaaggaa

SEQ ID NO: 485507 - RNA, 16 nt, Human
agcuugaaaccuucac

SEQ ID NO: 485508 - RNA, 17 nt, Human
ccugagcuugcagagau

SEQ ID NO: 485509 - RNA, 20 nt, Human
ccagcuggccgggagccuga

SEQ ID NO: 485510 - RNA, 23 nt, Human
gauauuaaccaggggccaugaau

SEQ ID NO: 485511 - RNA, 22 nt, Human
ucuacuccauuaaauauaaagc

SEQ ID NO: 485512 - RNA, 18 nt, Human
cuccagccugagcgacag

SEQ ID NO: 485513 - RNA, 21 nt, Human
cccccauuguggucacaggaa

SEQ ID NO: 485514 - RNA, 13 nt, Human
aggcuagauguau

SEQ ID NO: 485515 - RNA, 22 nt, Human
uguaccucucuuauagaauauu

SEQ ID NO: 485516 - RNA, 14 nt, Human
cacuaaacaaagag

SEQ ID NO: 485517 - RNA, 19 nt, Human
uaaauguaucuuauucaca

SEQ ID NO: 485518 - RNA, 14 nt, Human
cagagguugcagug

SEQ ID NO: 485519 - RNA, 20 nt, Human
uagaugcaguucugaagaag

SEQ ID NO: 485520 - RNA, 19 nt, Human
uacaaaaaaaaaaaaaaau

SEQ ID NO: 485521 - RNA, 16 nt, Human
ugcaugguuuagaaag

SEQ ID NO: 485522 - RNA, 18 nt, Human
cucuauguucuaagaagu

SEQ ID NO: 485523 - RNA, 17 nt, Human
gacagugaaagaaaaua

SEQ ID NO: 485524 - RNA, 14 nt, Human
ccacuggacucacc

SEQ ID NO: 485525 - RNA, 15 nt, Human
cuaguaauuggaaag

SEQ ID NO: 485526 - RNA, 12 nt, Human
uguuugaaagcu

SEQ ID NO: 485527 - RNA, 23 nt, Human
uaacgauaaaagacagugaaaga

SEQ ID NO: 485528 - RNA, 23 nt, Human
uuacgaaauacguuaggaggaca

SEQ ID NO: 485529 - RNA, 16 nt, Human
ccugagcgacagugag

SEQ ID NO: 485530 - RNA, 21 nt, Human
uauuuauaacaaccuaaauuu

SEQ ID NO: 485531 - RNA, 19 nt, Human
ucaauucuugccaaauaua

SEQ ID NO: 485532 - RNA, 13 nt, Human
cauuuguauaaaa

SEQ ID NO: 485533 - RNA, 23 nt, Human
cucagucucccucccuuggggcc

SEQ ID NO: 485534 - RNA, 22 nt, Human
aagacccaaaaggcagaagcaa

SEQ ID NO: 485535 - RNA, 17 nt, Human
agaaugacugacaaaga

SEQ ID NO: 485536 - RNA, 15 nt, Human
agagacagaaagcag

SEQ ID NO: 485537 - RNA, 21 nt, Human
aucuuuuuuuuaauaaaccau

SEQ ID NO: 485538 - RNA, 17 nt, Human
uaaaugaaauugaaaau

SEQ ID NO: 485539 - RNA, 17 nt, Human
caaauccaaugaaauga

SEQ ID NO: 485540 - RNA, 17 nt, Human
ggcacaacacaucagga

SEQ ID NO: 485541 - RNA, 20 nt, Human
gaccauacuaauuauacccc

SEQ ID NO: 485542 - RNA, 18 nt, Human
ugugaccacugcagaaga

SEQ ID NO: 485543 - RNA, 19 nt, Human
aauauuauguuaaaacugg

SEQ ID NO: 485544 - RNA, 15 nt, Human
ucagucucccucccu

SEQ ID NO: 485545 - RNA, 12 nt, Human
cucccugccccc

SEQ ID NO: 485546 - RNA, 22 nt, Human
cugaggcuccacuuggucugug

SEQ ID NO: 485547 - RNA, 21 nt, Human
caagacccaaaaggcagaagc

SEQ ID NO: 485548 - RNA, 15 nt, Human
uaugcuuguaacugu

SEQ ID NO: 485549 - RNA, 14 nt, Human
agaugcuagaacuc

SEQ ID NO: 485550 - RNA, 20 nt, Human
aaggagccaaacauccuaca

SEQ ID NO: 485551 - RNA, 13 nt, Human
uuguaacugucuu

SEQ ID NO: 485552 - RNA, 20 nt, Human
gaaggcugaggcaggaggau

SEQ ID NO: 485553 - RNA, 17 nt, Human
cuuugaugauuaauuca

SEQ ID NO: 485554 - RNA, 12 nt, Human
caucaggaaaga

SEQ ID NO: 485555 - RNA, 20 nt, Human
ugguuguauuauuuuuuaaa

SEQ ID NO: 485556 - RNA, 23 nt, Human
ccccucuggcuccagcuggccgg

SEQ ID NO: 485557 - RNA, 23 nt, Human
caacggggugaaacccugucucu

SEQ ID NO: 485558 - RNA, 19 nt, Human
cuuccuaauuccacagcug

SEQ ID NO: 485559 - RNA, 18 nt, Human
cagggaggacgcucucug

SEQ ID NO: 485560 - RNA, 11 nt, Human
uccucugggaa

SEQ ID NO: 485561 - RNA, 18 nt, Human
augucugaaauggaacag

SEQ ID NO: 485562 - RNA, 18 nt, Human
gaaaauaucacuugucaa

SEQ ID NO: 485563 - RNA, 13 nt, Human
uucuauaauuuaa

SEQ ID NO: 485564 - RNA, 21 nt, Human
gcugagucccaggcugagccu

SEQ ID NO: 485565 - RNA, 17 nt, Human
ugaaauauuauuuuaua

SEQ ID NO: 485566 - RNA, 20 nt, Human
uuaaguuuuuuuuuaaaaaa

SEQ ID NO: 485567 - RNA, 17 nt, Human
aaacauccuacaagaca

SEQ ID NO: 485568 - RNA, 19 nt, Human
gagguacugagagugaaca

SEQ ID NO: 485569 - RNA, 12 nt, Human
aagaaaggaagu

SEQ ID NO: 485570 - RNA, 14 nt, Human
cguguccccuaucc

SEQ ID NO: 485571 - RNA, 11 nt, Human
aauaaauaaau

SEQ ID NO: 485572 - RNA, 17 nt, Human
aauuugguucuaggccg

SEQ ID NO: 485573 - RNA, 20 nt, Human
gggaggcagagguugcagug

SEQ ID NO: 485574 - RNA, 17 nt, Human
auauuugaaauauugac

SEQ ID NO: 485575 - RNA, 23 nt, Human
gccccugcacuccagccugagcg

SEQ ID NO: 485576 - RNA, 15 nt, Human
uaucaauuuaaaaaa

SEQ ID NO: 485577 - RNA, 16 nt, Human
aagcauuuagauguau

SEQ ID NO: 485578 - RNA, 16 nt, Human
uagcuacuaauuuuaa

SEQ ID NO: 485579 - RNA, 11 nt, Human
ugcagugagcc

SEQ ID NO: 485580 - RNA, 20 nt, Human
uuauuaccucugauaccuca

SEQ ID NO: 485581 - RNA, 20 nt, Human
uguaauaggcguaacuaauu

SEQ ID NO: 485582 - RNA, 17 nt, Human
ugaucaccugcccugcu

SEQ ID NO: 485583 - RNA, 23 nt, Human
caucaacagauaaauaguuuaug

SEQ ID NO: 485584 - RNA, 17 nt, Human
gacaaggaaaaaauaac

SEQ ID NO: 485585 - RNA, 15 nt, Human
uauuguaccucucuu

SEQ ID NO: 485586 - RNA, 17 nt, Human
uaugcuaagugaaauaa

SEQ ID NO: 485587 - RNA, 16 nt, Human
ggaugccccguccccc

SEQ ID NO: 485588 - RNA, 18 nt, Human
cagccucuuagaugcagu

SEQ ID NO: 485589 - RNA, 11 nt, Human
ucaccuccccc

SEQ ID NO: 485590 - RNA, 19 nt, Human
guuguauuauuuuuuaaaa

SEQ ID NO: 485591 - RNA, 16 nt, Human
cuuauaauuuaaaaua

SEQ ID NO: 485592 - RNA, 19 nt, Human
acccccagcuuugaggaaa

SEQ ID NO: 485593 - RNA, 18 nt, Human
ccacuuggucugugagau

SEQ ID NO: 485594 - RNA, 14 nt, Human
gcaaagcccagcuu

SEQ ID NO: 485595 - RNA, 14 nt, Human
aauuccucugggaa

SEQ ID NO: 485596 - RNA, 11 nt, Human
cgauaaaagac

SEQ ID NO: 485597 - RNA, 22 nt, Human
uucaauaucuuuuuuuuaauaa

SEQ ID NO: 485598 - RNA, 13 nt, Human
cugaugggcaaaa

SEQ ID NO: 485599 - RNA, 17 nt, Human
aaauaacgauaaaagac

SEQ ID NO: 485600 - RNA, 18 nt, Human
auuuguauaaaauaauuu

SEQ ID NO: 485601 - RNA, 12 nt, Human
ggaggcugagau

SEQ ID NO: 485602 - RNA, 20 nt, Human
uuacaaauccaaugaaauga

SEQ ID NO: 485603 - RNA, 20 nt, Human
uuccacagaagcuccaggua

SEQ ID NO: 485604 - RNA, 22 nt, Human
auauaugcuaagucuuauauau

SEQ ID NO: 485605 - RNA, 14 nt, Human
ugcucauggaauug

SEQ ID NO: 485606 - RNA, 14 nt, Human
ccugccccccagcc

SEQ ID NO: 485607 - RNA, 17 nt, Human
uaaaagacagugaaaga

SEQ ID NO: 485608 - RNA, 14 nt, Human
auuuucuauaauuu

SEQ ID NO: 485609 - RNA, 14 nt, Human
uuaaagaucugcaa

SEQ ID NO: 485610 - RNA, 18 nt, Human
uagugaaauauuauuuua

SEQ ID NO: 485611 - RNA, 22 nt, Human
accauuucuugagguaaaagca

SEQ ID NO: 485612 - RNA, 17 nt, Human
cuacaugucuagagaac

SEQ ID NO: 485613 - RNA, 22 nt, Human
uggacgagaaaacaauaacgau

SEQ ID NO: 485614 - RNA, 16 nt, Human
auuucaaaaaaaaacc

SEQ ID NO: 485615 - RNA, 21 nt, Human
cagcaacuuguguuccuaaca

SEQ ID NO: 485616 - RNA, 18 nt, Human
acucuuaagaagacugca

SEQ ID NO: 485617 - RNA, 21 nt, Human
aaugaauggcuaagcaaaaug

SEQ ID NO: 485618 - RNA, 20 nt, Human
aaauaauuuuuauauuugaa

SEQ ID NO: 485619 - RNA, 16 nt, Human
agaacuaaaaauuaaa

SEQ ID NO: 485620 - RNA, 15 nt, Human
gccuguaaucccagc

SEQ ID NO: 485621 - RNA, 20 nt, Human
uugaacccgggaggcagagg

SEQ ID NO: 485622 - RNA, 14 nt, Human
aggaaggaaagaug

SEQ ID NO: 485623 - RNA, 19 nt, Human
gguuuaauaauuuuuaauu

SEQ ID NO: 485624 - RNA, 22 nt, Human
aacugcccacucugcaagaaga

SEQ ID NO: 485625 - RNA, 22 nt, Human
uucauagaguucccaugaacua

SEQ ID NO: 485626 - RNA, 20 nt, Human
acaagacccaaaaggcagaa

SEQ ID NO: 485627 - RNA, 15 nt, Human
aagucauuauuagga

SEQ ID NO: 485628 - RNA, 12 nt, Human
gauaaaagacag

SEQ ID NO: 485629 - RNA, 16 nt, Human
gauuaagaaaggaagu

SEQ ID NO: 485630 - RNA, 19 nt, Human
cagauccccaagccuggca

SEQ ID NO: 485631 - RNA, 15 nt, Human
uuuuaagauaaauua

SEQ ID NO: 485632 - RNA, 21 nt, Human
ccucccuuggggccuaugcag

SEQ ID NO: 485633 - RNA, 22 nt, Human
agaauuuuaugcggcauuuucu

SEQ ID NO: 485634 - RNA, 22 nt, Human
aauguagcagcucauaaaugaa

SEQ ID NO: 485635 - RNA, 12 nt, Human
acugaaacaaaa

SEQ ID NO: 485636 - RNA, 14 nt, Human
caaggaaaaaauaa

SEQ ID NO: 485637 - RNA, 20 nt, Human
uggccacacaggaucuuuug

SEQ ID NO: 485638 - RNA, 23 nt, Human
gaaaacaauaacgauaaaagaca

SEQ ID NO: 485639 - RNA, 15 nt, Human
caagacucugucuca

SEQ ID NO: 485640 - RNA, 13 nt, Human
ucuauaauuuaaa

SEQ ID NO: 485641 - RNA, 14 nt, Human
cuacaaauacucuu

SEQ ID NO: 485642 - RNA, 22 nt, Human
agacacugucucuaccaaaaaa

SEQ ID NO: 485643 - RNA, 23 nt, Human
uuagaugcaguucugaagaagau

SEQ ID NO: 485644 - RNA, 22 nt, Human
caauaaaagacaaggaaaaaau

SEQ ID NO: 485645 - RNA, 14 nt, Human
cuaagcauuccaac

SEQ ID NO: 485646 - RNA, 15 nt, Human
ucauaauaaguugca

SEQ ID NO: 485647 - RNA, 21 nt, Human
gccaaauauaaauaaaaauaa

SEQ ID NO: 485648 - RNA, 14 nt, Human
acuacuauccaacu

SEQ ID NO: 485649 - RNA, 18 nt, Human
uauaacaaugcuguauuu

SEQ ID NO: 485650 - RNA, 22 nt, Human
agaaugagagacacacugaaga

SEQ ID NO: 485651 - RNA, 15 nt, Human
uaaaugaaauugaaa

SEQ ID NO: 485652 - RNA, 18 nt, Human
ggaugggaacaaggaagg

SEQ ID NO: 485653 - RNA, 18 nt, Human
uaauuuuaacucuauaau

SEQ ID NO: 485654 - RNA, 16 nt, Human
acaugucuagagaaca

SEQ ID NO: 485655 - RNA, 19 nt, Human
acauuuguauaaaauaauu

SEQ ID NO: 485656 - RNA, 12 nt, Human
auagcaaauaag

SEQ ID NO: 485657 - RNA, 15 nt, Human
ccugccccccagccc

SEQ ID NO: 485658 - RNA, 22 nt, Human
caaaugggaaacaaaaggauaa

SEQ ID NO: 485659 - RNA, 15 nt, Human
aauguuuguccuugg

SEQ ID NO: 485660 - RNA, 21 nt, Human
cccccucuggcuccagcuggc

SEQ ID NO: 485661 - RNA, 13 nt, Human
aaaauaacaauga

SEQ ID NO: 485662 - RNA, 10 nt, Human
agcuuugagg

SEQ ID NO: 485663 - RNA, 15 nt, Human
cacuuggucugugag

SEQ ID NO: 485664 - RNA, 17 nt, Human
aacaaaaaucaaacuuu

SEQ ID NO: 485665 - RNA, 18 nt, Human
aaaaucuuauaauuuaaa

SEQ ID NO: 485666 - RNA, 15 nt, Human
ucuggcuccagcugg

SEQ ID NO: 485667 - RNA, 16 nt, Human
cugagccucagucucc

SEQ ID NO: 485668 - RNA, 18 nt, Human
auauuucuguuaaaauau

SEQ ID NO: 485669 - RNA, 16 nt, Human
agggaggacgcucucu

SEQ ID NO: 485670 - RNA, 16 nt, Human
augcuaagugaaauaa

SEQ ID NO: 485671 - RNA, 19 nt, Human
aaaauaacaauaaaagaca

SEQ ID NO: 485672 - RNA, 12 nt, Human
aaugcagccccc

SEQ ID NO: 485673 - RNA, 21 nt, Human
aacauggugaaaccuggucuc

SEQ ID NO: 485674 - RNA, 21 nt, Human
gccugaucaccugcccugcug

SEQ ID NO: 485675 - RNA, 19 nt, Human
cgcccacuagacccacugg

SEQ ID NO: 485676 - RNA, 18 nt, Human
aaaaauaaaaauaaaaau

SEQ ID NO: 485677 - RNA, 17 nt, Human
gcaagcucuaucaccaa

SEQ ID NO: 485678 - RNA, 14 nt, Human
aggacaaaaggaau

SEQ ID NO: 485679 - RNA, 14 nt, Human
ugcuguauuuuaaa

SEQ ID NO: 485680 - RNA, 18 nt, Human
cauaagggaggaaaaaaa

SEQ ID NO: 485681 - RNA, 16 nt, Human
uauccuacuuccccuu

SEQ ID NO: 485682 - RNA, 16 nt, Human
cuggccuucggccucc

SEQ ID NO: 485683 - RNA, 20 nt, Human
guuauuuauaacaaccuaaa

SEQ ID NO: 485684 - RNA, 21 nt, Human
gugcucuauuaccauuaugga

SEQ ID NO: 485685 - RNA, 17 nt, Human
auuuuaauaauguuuca

SEQ ID NO: 485686 - RNA, 17 nt, Human
auguugacaugggacau

SEQ ID NO: 485687 - RNA, 17 nt, Human
uuaaauggucaauuuug

SEQ ID NO: 485688 - RNA, 13 nt, Human
ccccagcccuccu

SEQ ID NO: 485689 - RNA, 17 nt, Human
aaccuagggugauauua

SEQ ID NO: 485690 - RNA, 15 nt, Human
aaaauaacaaugaaa

SEQ ID NO: 485691 - RNA, 16 nt, Human
cccacuggacucaccu

SEQ ID NO: 485692 - RNA, 14 nt, Human
gugagcuacaaaug

SEQ ID NO: 485693 - RNA, 12 nt, Human
cuaccaaaaaaa

SEQ ID NO: 485694 - RNA, 13 nt, Human
ggaaguagaggag

SEQ ID NO: 485695 - RNA, 17 nt, Human
uauauuguagauaauac

SEQ ID NO: 485696 - RNA, 15 nt, Human
acucaacaaacauaa

SEQ ID NO: 485697 - RNA, 20 nt, Human
auaaauaaaaacaaaguuga

SEQ ID NO: 485698 - RNA, 22 nt, Human
aucucuucuggguuccuuccuc

SEQ ID NO: 485699 - RNA, 21 nt, Human
aaacaauaacgauaaaagaca

SEQ ID NO: 485700 - RNA, 12 nt, Human
cuccauuuuuag

SEQ ID NO: 485701 - RNA, 16 nt, Human
ugagccccggaggucg

SEQ ID NO: 485702 - RNA, 21 nt, Human
aauuuuuauauuugaaauauu

SEQ ID NO: 485703 - RNA, 21 nt, Human
ccucuguucugcacacagcac

SEQ ID NO: 485704 - RNA, 21 nt, Human
ccaaauauaaauaaaaauaau

SEQ ID NO: 485705 - RNA, 18 nt, Human
ccaagccuggcaagggaa

SEQ ID NO: 485706 - RNA, 22 nt, Human
uagacacacaugaaguccaagc

SEQ ID NO: 485707 - RNA, 20 nt, Human
accuacacgagauacagaau

SEQ ID NO: 485708 - RNA, 21 nt, Human
acuccauuaaauauaaagcaa

SEQ ID NO: 485709 - RNA, 13 nt, Human
aucaggcuggcca

SEQ ID NO: 485710 - RNA, 18 nt, Human
uguacuuuauuuucuaua

SEQ ID NO: 485711 - RNA, 21 nt, Human
gagauuuugcuugagcaggau

SEQ ID NO: 485712 - RNA, 16 nt, Human
uguaguccuguaaugg

SEQ ID NO: 485713 - RNA, 20 nt, Human
aguuguuucuacuacaugga

SEQ ID NO: 485714 - RNA, 21 nt, Human
aaacgaggauugggaaaaagu

SEQ ID NO: 485715 - RNA, 18 nt, Human
cugagggcauagaaguaa

SEQ ID NO: 485716 - RNA, 17 nt, Human
cccccugcaaagcccag

SEQ ID NO: 485717 - RNA, 17 nt, Human
ugugaacgauuuagaaa

SEQ ID NO: 485718 - RNA, 16 nt, Human
cuguacuccagccugg

SEQ ID NO: 485719 - RNA, 13 nt, Human
ucuaagaagugaa

SEQ ID NO: 485720 - RNA, 23 nt, Human
uuuaaugccgauaucuucagaaa

SEQ ID NO: 485721 - RNA, 16 nt, Human
ccccugcacuccagcc

SEQ ID NO: 485722 - RNA, 15 nt, Human
aaugaauggcuaagc

SEQ ID NO: 485723 - RNA, 21 nt, Human
uuggaaggcugaggcaggagg

SEQ ID NO: 485724 - RNA, 15 nt, Human
auccaacuuauauuu

SEQ ID NO: 485725 - RNA, 14 nt, Human
cucuaggacauaaa

SEQ ID NO: 485726 - RNA, 22 nt, Human
cuuuaaugccgauaucuucaga

SEQ ID NO: 485727 - RNA, 17 nt, Human
agagacagaaagcagaa

SEQ ID NO: 485728 - RNA, 15 nt, Human
cuccacuggaaaacu

SEQ ID NO: 485729 - RNA, 18 nt, Human
gaaaauaacgauaaaaga

SEQ ID NO: 485730 - RNA, 18 nt, Human
uuuuauaucaauuuaaaa

SEQ ID NO: 485731 - RNA, 18 nt, Human
augguauuugaguguuuu

SEQ ID NO: 485732 - RNA, 15 nt, Human
cagaacuaaaaauua

SEQ ID NO: 485733 - RNA, 21 nt, Human
auaauuuuuuucaauauuuau

SEQ ID NO: 485734 - RNA, 15 nt, Human
gccucagucucccuc

SEQ ID NO: 485735 - RNA, 20 nt, Human
aagucuuucacauuuaaaua

SEQ ID NO: 485736 - RNA, 15 nt, Human
auaucaauuuaaaaa

SEQ ID NO: 485737 - RNA, 18 nt, Human
cagaaagcagaacaguga

SEQ ID NO: 485738 - RNA, 21 nt, Human
uuuguauaaaauaauuuuuau

SEQ ID NO: 485739 - RNA, 22 nt, Human
gauaaaagacagugaaagaaaa

SEQ ID NO: 485740 - RNA, 15 nt, Human
augaauuaaguuuuu

SEQ ID NO: 485741 - RNA, 15 nt, Human
caaggaaaaaauaac

SEQ ID NO: 485742 - RNA, 16 nt, Human
cacgggggccaaggau

SEQ ID NO: 485743 - RNA, 20 nt, Human
cauaucaaacugaaacaaaa

SEQ ID NO: 485744 - RNA, 13 nt, Human
caaaaggaaugug

SEQ ID NO: 485745 - RNA, 13 nt, Human
agagauaaagcuu

SEQ ID NO: 485746 - RNA, 19 nt, Human
augaauuacauuuguauaa

SEQ ID NO: 485747 - RNA, 23 nt, Human
aguaauuggaaaggcagcucuaa

SEQ ID NO: 485748 - RNA, 22 nt, Human
acuccauuaaauauaaagcaag

SEQ ID NO: 485749 - RNA, 14 nt, Human
ccacaaucuaggau

SEQ ID NO: 485750 - RNA, 18 nt, Human
gaaauacguuaggaggac

SEQ ID NO: 485751 - RNA, 20 nt, Human
agcuacuaauuuuaaaaugu

SEQ ID NO: 485752 - RNA, 15 nt, Human
agaaaacaauaacga

SEQ ID NO: 485753 - RNA, 19 nt, Human
ccgggcgugguggugagug

SEQ ID NO: 485754 - RNA, 23 nt, Human
uccagguagaggguguguaagua

SEQ ID NO: 485755 - RNA, 19 nt, Human
caaauauaaacagcaacuu

SEQ ID NO: 485756 - RNA, 15 nt, Human
ggccauuacccccag

SEQ ID NO: 485757 - RNA, 22 nt, Human
cauaaauguugacaugggacau

SEQ ID NO: 485758 - RNA, 13 nt, Human
ugagcgacaguga

SEQ ID NO: 485759 - RNA, 21 nt, Human
acucugucucaaaaaauaaaa

SEQ ID NO: 485760 - RNA, 22 nt, Human
gucucuacuaaaaauacaaaaa

SEQ ID NO: 485761 - RNA, 21 nt, Human
aacauagugagacacugucuc

SEQ ID NO: 485762 - RNA, 19 nt, Human
gcuccagugauaagagaug

SEQ ID NO: 485763 - RNA, 14 nt, Human
cucaauaaauaaau

SEQ ID NO: 485764 - RNA, 22 nt, Human
acaugagguacugagagugaac

SEQ ID NO: 485765 - RNA, 19 nt, Human
auagcuacuaauuuuaaaa

SEQ ID NO: 485766 - RNA, 19 nt, Human
ugcacacagcacgggggcc

SEQ ID NO: 485767 - RNA, 21 nt, Human
auguuuacagauccccaagcc

SEQ ID NO: 485768 - RNA, 18 nt, Human
uucuagcuguugagcugu

SEQ ID NO: 485769 - RNA, 19 nt, Human
acucugcaagaagaaauca

SEQ ID NO: 485770 - RNA, 21 nt, Human
ugaugcuacaggauuugaaau

SEQ ID NO: 485771 - RNA, 17 nt, Human
cuuucccaacagcucca

SEQ ID NO: 485772 - RNA, 15 nt, Human
ggccuccauccugag

SEQ ID NO: 485773 - RNA, 14 nt, Human
cuuggucugugaga

SEQ ID NO: 485774 - RNA, 12 nt, Human
aauuuaaauaua

SEQ ID NO: 485775 - RNA, 15 nt, Human
ucuaugaaauauuau

SEQ ID NO: 485776 - RNA, 14 nt, Human
guauuuuaaaagaa

SEQ ID NO: 485777 - RNA, 15 nt, Human
gccucuuagaugcag

SEQ ID NO: 485778 - RNA, 21 nt, Human
ucaagucuuucacauuuaaau

SEQ ID NO: 485779 - RNA, 18 nt, Human
guauuauuuuuuaaaaaa

SEQ ID NO: 485780 - RNA, 20 nt, Human
gaagggacacauaucaaacu

SEQ ID NO: 485781 - RNA, 22 nt, Human
uucuagcuguugagcuguuuuc

SEQ ID NO: 485782 - RNA, 18 nt, Human
acaaaaggauaaugaaua

SEQ ID NO: 485783 - RNA, 15 nt, Human
cacuaugguauuuga

SEQ ID NO: 485784 - RNA, 13 nt, Human
gcuggagcucugc

SEQ ID NO: 485785 - RNA, 13 nt, Human
auauaaagcaaga

SEQ ID NO: 485786 - RNA, 15 nt, Human
uccuacaagacacag

SEQ ID NO: 485787 - RNA, 18 nt, Human
caagccucauguccacug

SEQ ID NO: 485788 - RNA, 16 nt, Human
aaaguguuugaaagcu

SEQ ID NO: 485789 - RNA, 19 nt, Human
uauauuuuugugauuuugu

SEQ ID NO: 485790 - RNA, 19 nt, Human
agaugcuagaacucccuuu

SEQ ID NO: 485791 - RNA, 22 nt, Human
gaagugaaaaucuacacuccag

SEQ ID NO: 485792 - RNA, 12 nt, Human
aauaaaaacaaa

SEQ ID NO: 485793 - RNA, 19 nt, Human
ggucgaggcuacagugagc

SEQ ID NO: 485794 - RNA, 22 nt, Human
caaauuuacagagacagaaagc

SEQ ID NO: 485795 - RNA, 16 nt, Human
uauuuuugugauuuug

SEQ ID NO: 485796 - RNA, 19 nt, Human
gugacuuaaugccacuaaa

SEQ ID NO: 485797 - RNA, 14 nt, Human
ccuuaucaaaggac

SEQ ID NO: 485798 - RNA, 20 nt, Human
aaagagugaaggauuuaugu

SEQ ID NO: 485799 - RNA, 17 nt, Human
cuucacuguaaaauaau

SEQ ID NO: 485800 - RNA, 15 nt, Human
auccugccccugagc

SEQ ID NO: 485801 - RNA, 13 nt, Human
acacacaugaagu

SEQ ID NO: 485802 - RNA, 18 nt, Human
aucuacacuccagugaga

SEQ ID NO: 485803 - RNA, 14 nt, Human
gauaaaagacagug

SEQ ID NO: 485804 - RNA, 23 nt, Human
cucuacuaaaaauacaaaaaaaa

SEQ ID NO: 485805 - RNA, 18 nt, Human
cccacuagacccacugga

SEQ ID NO: 485806 - RNA, 14 nt, Human
aauuagaaauguaa

SEQ ID NO: 485807 - RNA, 19 nt, Human
cagcacgggggccaaggau

SEQ ID NO: 485808 - RNA, 16 nt, Human
ucugcagauaaacagu

SEQ ID NO: 485809 - RNA, 18 nt, Human
guuuaugguuguauuauu

SEQ ID NO: 485810 - RNA, 21 nt, Human
ccccugcaaagcccagcuuga

SEQ ID NO: 485811 - RNA, 22 nt, Human
gaugguucccuugaugaagaag

SEQ ID NO: 485812 - RNA, 21 nt, Human
cauuucuugagguaaaagcau

SEQ ID NO: 485813 - RNA, 14 nt, Human
cuuucauaauaagu

SEQ ID NO: 485814 - RNA, 14 nt, Human
aguauaggccaggc

SEQ ID NO: 485815 - RNA, 16 nt, Human
auuuguauaaaauaau

SEQ ID NO: 485816 - RNA, 14 nt, Human
caugaacuuguaaa

SEQ ID NO: 485817 - RNA, 13 nt, Human
ucuuauaauuuaa

SEQ ID NO: 485818 - RNA, 23 nt, Human
aaaaugggcuuuggaugauuauu

SEQ ID NO: 485819 - RNA, 17 nt, Human
accugagccccaaaagg

SEQ ID NO: 485820 - RNA, 16 nt, Human
ugccucaccccuugcc

SEQ ID NO: 485821 - RNA, 20 nt, Human
ccccuauccuacuuccccuu

SEQ ID NO: 485822 - RNA, 17 nt, Human
auuuugaauaaauaaau

SEQ ID NO: 485823 - RNA, 19 nt, Human
auagugaggagcuuugaaa

SEQ ID NO: 485824 - RNA, 18 nt, Human
cagcuacuugggaggcug

SEQ ID NO: 485825 - RNA, 23 nt, Human
aauuaaaaccucuuugugucccu

SEQ ID NO: 485826 - RNA, 15 nt, Human
acuagaauuuauuca

SEQ ID NO: 485827 - RNA, 13 nt, Human
uacauaaaauaca

SEQ ID NO: 485828 - RNA, 17 nt, Human
guugauuuaaggccagg

SEQ ID NO: 485829 - RNA, 12 nt, Human
uucccugaccuc

SEQ ID NO: 485830 - RNA, 22 nt, Human
cuuccauuccaagccugaccac

SEQ ID NO: 485831 - RNA, 17 nt, Human
ccugccccccagcccuc

SEQ ID NO: 485832 - RNA, 19 nt, Human
cuccagcuggccgggagcc

SEQ ID NO: 485833 - RNA, 16 nt, Human
auuauaauuuuuuuca

SEQ ID NO: 485834 - RNA, 15 nt, Human
uucggccuccauccu

SEQ ID NO: 485835 - RNA, 19 nt, Human
cugagccucagucucccuc

SEQ ID NO: 485836 - RNA, 13 nt, Human
caccaaggagcca

SEQ ID NO: 485837 - RNA, 17 nt, Human
uuuuuaauuauauggcu

SEQ ID NO: 485838 - RNA, 22 nt, Human
agucuuucacauuuaaauaaag

SEQ ID NO: 485839 - RNA, 23 nt, Human
gauaaggcuguucuuuaaauguc

SEQ ID NO: 485840 - RNA, 15 nt, Human
agugacaagcucaca

SEQ ID NO: 485841 - RNA, 18 nt, Human
uucaauaucuuuuuuuua

SEQ ID NO: 485842 - RNA, 14 nt, Human
uucagccugaaaga

SEQ ID NO: 485843 - RNA, 14 nt, Human
uuuguauaaaauaa

SEQ ID NO: 485844 - RNA, 16 nt, Human
gauguugacucuaaag

SEQ ID NO: 485845 - RNA, 13 nt, Human
agcccagcuugaa

SEQ ID NO: 485846 - RNA, 17 nt, Human
aagacagugaaagaaaa

SEQ ID NO: 485847 - RNA, 20 nt, Human
uugaaaaugguauuaaagau

SEQ ID NO: 485848 - RNA, 18 nt, Human
uccagcuggccgggagcc

SEQ ID NO: 485849 - RNA, 20 nt, Human
gagccugaucaccugcccug

SEQ ID NO: 485850 - RNA, 22 nt, Human
ugaaaccccgucucuacuaaaa

SEQ ID NO: 485851 - RNA, 15 nt, Human
uggacgagaaaacaa

SEQ ID NO: 485852 - RNA, 15 nt, Human
gcuguugagcuguuu

SEQ ID NO: 485853 - RNA, 22 nt, Human
cagaagcuuccauuccaagccu

SEQ ID NO: 485854 - RNA, 14 nt, Human
cauagaaguaaaaa

SEQ ID NO: 485855 - RNA, 15 nt, Human
aauacuuuauaaagg

SEQ ID NO: 485856 - RNA, 15 nt, Human
aagccagauuuuccu

SEQ ID NO: 485857 - RNA, 17 nt, Human
ccucagucucccucccu

SEQ ID NO: 485858 - RNA, 16 nt, Human
gugagacagcucugca

SEQ ID NO: 485859 - RNA, 16 nt, Human
cuaaaaauuaaaaccu

SEQ ID NO: 485860 - RNA, 19 nt, Human
auuugguucuaggccgggc

SEQ ID NO: 485861 - RNA, 16 nt, Human
agagaacaagcaaaua

SEQ ID NO: 485862 - RNA, 21 nt, Human
aaaaaguucugcagauaaaca

SEQ ID NO: 485863 - RNA, 15 nt, Human
acaaaguugauuaag

SEQ ID NO: 485864 - RNA, 14 nt, Human
uaguaucaaaagaa

SEQ ID NO: 485865 - RNA, 12 nt, Human
agugcagccccg

SEQ ID NO: 485866 - RNA, 16 nt, Human
cagaagcaacccaaau

SEQ ID NO: 485867 - RNA, 14 nt, Human
uacguuaggaggac

SEQ ID NO: 485868 - RNA, 13 nt, Human
ugggcaaaaaacc

SEQ ID NO: 485869 - RNA, 23 nt, Human
ccagccugggugacagagcaaga

SEQ ID NO: 485870 - RNA, 16 nt, Human
caugguuuagaaagcu

SEQ ID NO: 485871 - RNA, 20 nt, Human
gaugggcuuucccaacagcu

SEQ ID NO: 485872 - RNA, 21 nt, Human
gaaaaaaagcuuuuuuugaau

SEQ ID NO: 485873 - RNA, 14 nt, Human
uauaaauaaaaaua

SEQ ID NO: 485874 - RNA, 18 nt, Human
gacauuugcucauggaau

SEQ ID NO: 485875 - RNA, 14 nt, Human
acaagcaaauauaa

SEQ ID NO: 485876 - RNA, 17 nt, Human
cuauccuacuuccccuu

SEQ ID NO: 485877 - RNA, 20 nt, Human
ccgauaucuucagaaaaccu

SEQ ID NO: 485878 - RNA, 16 nt, Human
agugaaauauuauuuu

SEQ ID NO: 485879 - RNA, 19 nt, Human
acgaaauacguuaggagga

SEQ ID NO: 485880 - RNA, 22 nt, Human
ccaaacauccuacaagacacag

SEQ ID NO: 485881 - RNA, 14 nt, Human
ggacucaccucccc

SEQ ID NO: 485882 - RNA, 12 nt, Human
aauacuuuauaa

SEQ ID NO: 485883 - RNA, 18 nt, Human
ccugucucaauaaauaaa

SEQ ID NO: 485884 - RNA, 15 nt, Human
aguauaggccaggca

SEQ ID NO: 485885 - RNA, 17 nt, Human
cccacuggacucaccuc

SEQ ID NO: 485886 - RNA, 16 nt, Human
gaaaaaauaacaauga

SEQ ID NO: 485887 - RNA, 19 nt, Human
uggugagugccuguaauca

SEQ ID NO: 485888 - RNA, 19 nt, Human
aauuuuguuauguauauuu

SEQ ID NO: 485889 - RNA, 14 nt, Human
uacaugucuagaga

SEQ ID NO: 485890 - RNA, 21 nt, Human
caauuuuguuauguauauuuu

SEQ ID NO: 485891 - RNA, 21 nt, Human
caagacucugucucaaaaaau

SEQ ID NO: 485892 - RNA, 22 nt, Human
uaaaguugauuuaaggccaggc

SEQ ID NO: 485893 - RNA, 20 nt, Human
ugccccccagcccuccuuau

SEQ ID NO: 485894 - RNA, 15 nt, Human
uccaagccucauguc

SEQ ID NO: 485895 - RNA, 17 nt, Human
uccacaacacacagauu

SEQ ID NO: 485896 - RNA, 14 nt, Human
gagaggcaaagaaa

SEQ ID NO: 485897 - RNA, 17 nt, Human
augauuauuuuauguuu

SEQ ID NO: 485898 - RNA, 23 nt, Human
acucuauguucuaagaagugaaa

SEQ ID NO: 485899 - RNA, 15 nt, Human
uuauauuucuguuaa

SEQ ID NO: 485900 - RNA, 14 nt, Human
auauuuauuauuuu

SEQ ID NO: 485901 - RNA, 15 nt, Human
aaaguuaagaaucuu

SEQ ID NO: 485902 - RNA, 11 nt, Human
aacauuuaugu

SEQ ID NO: 485903 - RNA, 19 nt, Human
caacuuauauuucugcuuu

SEQ ID NO: 485904 - RNA, 23 nt, Human
uaauuuguaguguuggagaagaa

SEQ ID NO: 485905 - RNA, 18 nt, Human
cuacauaaaauacaaaaa

SEQ ID NO: 485906 - RNA, 16 nt, Human
cuucuggguuccuucc

SEQ ID NO: 485907 - RNA, 19 nt, Human
uaguuuaugauuccaccua

SEQ ID NO: 485908 - RNA, 16 nt, Human
acuaguuucccuugca

SEQ ID NO: 485909 - RNA, 14 nt, Human
ucaaugcagccccc

SEQ ID NO: 485910 - RNA, 21 nt, Human
guacuccagccagggcaagag

SEQ ID NO: 485911 - RNA, 20 nt, Human
cugcacacagcacgggggcc

SEQ ID NO: 485912 - RNA, 22 nt, Human
agcuacuugggaggcugaggca

SEQ ID NO: 485913 - RNA, 16 nt, Human
cuucacuguaaaauaa

SEQ ID NO: 485914 - RNA, 12 nt, Human
acucccugcccc

SEQ ID NO: 485915 - RNA, 17 nt, Human
auggcuaguaucaaaag

SEQ ID NO: 485916 - RNA, 12 nt, Human
cuguuaaaauau

SEQ ID NO: 485917 - RNA, 14 nt, Human
gagcccauggcacu

SEQ ID NO: 485918 - RNA, 19 nt, Human
uauuauaauuuuuuucaau

SEQ ID NO: 485919 - RNA, 13 nt, Human
caacauagugaga

SEQ ID NO: 485920 - RNA, 12 nt, Human
caggcauggugg

SEQ ID NO: 485921 - RNA, 22 nt, Human
caccagucugacuguuuccauc

SEQ ID NO: 485922 - RNA, 18 nt, Human
cuuccucugagccuuggg

SEQ ID NO: 485923 - RNA, 21 nt, Human
aagucuuucacauuuaaauaa

SEQ ID NO: 485924 - RNA, 20 nt, Human
aagucaucugaugagaacaa

SEQ ID NO: 485925 - RNA, 21 nt, Human
uuuauauaagcuuguauuccu

SEQ ID NO: 485926 - RNA, 21 nt, Human
cuccagcuggccgggagccug

SEQ ID NO: 485927 - RNA, 16 nt, Human
agccucagucucccuc

SEQ ID NO: 485928 - RNA, 23 nt, Human
augguauuugaguguuuuaagau

SEQ ID NO: 485929 - RNA, 13 nt, Human
aaacauccuacaa

SEQ ID NO: 485930 - RNA, 20 nt, Human
agccuuuuuuugaaaaaaag

SEQ ID NO: 485931 - RNA, 21 nt, Human
acaaagacaucgauugauaug

SEQ ID NO: 485932 - RNA, 17 nt, Human
aagaaucuuuauaguuc

SEQ ID NO: 485933 - RNA, 15 nt, Human
uguauuuuaaaagaa

SEQ ID NO: 485934 - RNA, 23 nt, Human
gaaaaaguucugcagauaaacag

SEQ ID NO: 485935 - RNA, 16 nt, Human
aaaauaauccucaguu

SEQ ID NO: 485936 - RNA, 19 nt, Human
gaaaauaacgauaaaagac

SEQ ID NO: 485937 - RNA, 19 nt, Human
cacaggaaccacaagacug

SEQ ID NO: 485938 - RNA, 21 nt, Human
aaagcugaaauggacuuuugu

SEQ ID NO: 485939 - RNA, 15 nt, Human
cuucucuucacaguc

SEQ ID NO: 485940 - RNA, 17 nt, Human
cuaagcuucacuguaaa

SEQ ID NO: 485941 - RNA, 17 nt, Human
agcucugcccauccugc

SEQ ID NO: 485942 - RNA, 21 nt, Human
augaugcuuugagaacauacu

SEQ ID NO: 485943 - RNA, 15 nt, Human
cagugaaagaaaaua

SEQ ID NO: 485944 - RNA, 21 nt, Human
acugaaacaaaauuagaaaug

SEQ ID NO: 485945 - RNA, 13 nt, Human
agagcaagacucu

SEQ ID NO: 485946 - RNA, 20 nt, Human
aaaaucuuauaauuuaaaau

SEQ ID NO: 485947 - RNA, 13 nt, Human
augauuccaccua

SEQ ID NO: 485948 - RNA, 20 nt, Human
cucccugccccccagcccuc

SEQ ID NO: 485949 - RNA, 17 nt, Human
aaagcuccauuuuuagu

SEQ ID NO: 485950 - RNA, 18 nt, Human
caguuguugcccacagcu

SEQ ID NO: 485951 - RNA, 18 nt, Human
gccuucggccuccauccu

SEQ ID NO: 485952 - RNA, 13 nt, Human
auccugaggcucc

SEQ ID NO: 485953 - RNA, 20 nt, Human
uuccuaaccagccuggucaa

SEQ ID NO: 485954 - RNA, 19 nt, Human
aagcuuguauuccuuuuuc

SEQ ID NO: 485955 - RNA, 17 nt, Human
cauuuguauaaaauaau

SEQ ID NO: 485956 - RNA, 24 nt, Human
ccccugagcuugcagagaugaggc

SEQ ID NO: 485957 - RNA, 18 nt, Human
ccauccugccccugagcc

SEQ ID NO: 485958 - RNA, 12 nt, Human
aaaugaaagcag

SEQ ID NO: 485959 - RNA, 13 nt, Human
augcuagaacucc

SEQ ID NO: 485960 - RNA, 22 nt, Human
cuccagccugagcgacagugag

SEQ ID NO: 485961 - RNA, 21 nt, Human
guggccagcuuguuauuuaua

SEQ ID NO: 485962 - RNA, 14 nt, Human
acuaauuuuaaaau

SEQ ID NO: 485963 - RNA, 20 nt, Human
ccauuguggucacaggaagu

SEQ ID NO: 485964 - RNA, 16 nt, Human
uaaauaaaaauaaucc

SEQ ID NO: 485965 - RNA, 13 nt, Human
aaaaaauaaaaau

SEQ ID NO: 485966 - RNA, 23 nt, Human
ugcauagguuuaauaauuuuuaa

SEQ ID NO: 485967 - RNA, 18 nt, Human
gaacgauuuagaaagaag

SEQ ID NO: 485968 - RNA, 18 nt, Human
aaaucuuauaauuuaaaa

SEQ ID NO: 485969 - RNA, 19 nt, Human
auguuccuuuuaaagaaac

SEQ ID NO: 485970 - RNA, 19 nt, Human
caaaacuuauuggaauguu

SEQ ID NO: 485971 - RNA, 18 nt, Human
auagaauuaacacaugau

SEQ ID NO: 485972 - RNA, 15 nt, Human
uauaauuuaaauaua

SEQ ID NO: 485973 - RNA, 17 nt, Human
agacagugaaagaaaau

SEQ ID NO: 485974 - RNA, 17 nt, Human
agaaucacuugaacccg

SEQ ID NO: 485975 - RNA, 20 nt, Human
ccagcuacuugggaggcuga

SEQ ID NO: 485976 - RNA, 21 nt, Human
caucuagcaugucgucaaagc

SEQ ID NO: 485977 - RNA, 11 nt, Human
aaccugagccc

SEQ ID NO: 485978 - RNA, 20 nt, Human
aacaagccuccuuuuaaagu

SEQ ID NO: 485979 - RNA, 14 nt, Human
auuuaaggccaggc

SEQ ID NO: 485980 - RNA, 18 nt, Human
auaucaaacugaaacaaa

SEQ ID NO: 485981 - RNA, 16 nt, Human
acaaggaugaauuaag

SEQ ID NO: 485982 - RNA, 21 nt, Human
cucagugucaaugcagccccc

SEQ ID NO: 485983 - RNA, 16 nt, Human
ccugaucaccugcccu

SEQ ID NO: 485984 - RNA, 22 nt, Human
uugacccacaagaaaugaaagc

SEQ ID NO: 485985 - RNA, 12 nt, Human
gccccugagccc

SEQ ID NO: 485986 - RNA, 14 nt, Human
auaaaauaauuuuu

SEQ ID NO: 485987 - RNA, 22 nt, Human
uuugaaacgaggauugggaaaa

SEQ ID NO: 485988 - RNA, 13 nt, Human
agcagauuuuaau

SEQ ID NO: 485989 - RNA, 15 nt, Human
acucaccucccccau

SEQ ID NO: 485990 - RNA, 21 nt, Human
agggcagaugaugcuuugaga

SEQ ID NO: 485991 - RNA, 21 nt, Human
cugauauuggacaguaaaauc

SEQ ID NO: 485992 - RNA, 21 nt, Human
ugaaauggacuuuuguacaua

SEQ ID NO: 485993 - RNA, 18 nt, Human
cuuuuaaagaaacaaaaa

SEQ ID NO: 485994 - RNA, 14 nt, Human
gcaaauauaaacag

SEQ ID NO: 485995 - RNA, 17 nt, Human
aucaaggguacacugcc

SEQ ID NO: 485996 - RNA, 18 nt, Human
auccccaagccuggcaag

SEQ ID NO: 485997 - RNA, 13 nt, Human
aauuuuuauauuu

SEQ ID NO: 485998 - RNA, 16 nt, Human
aggccaugggacaggg

SEQ ID NO: 485999 - RNA, 15 nt, Human
ugagcucagcccugg

SEQ ID NO: 486000 - RNA, 14 nt, Human
cuaaauuugguucu

SEQ ID NO: 486001 - RNA, 14 nt, Human
cugucucaguccau

SEQ ID NO: 486002 - RNA, 17 nt, Human
agcugacccagccccuu

SEQ ID NO: 486003 - RNA, 17 nt, Human
aucaugccccuguacuc

SEQ ID NO: 486004 - RNA, 23 nt, Human
cucauguccacugguucuucuug

SEQ ID NO: 486005 - RNA, 13 nt, Human
cauuucuauuuau

SEQ ID NO: 486006 - RNA, 21 nt, Human
gaaaaguauguuagugcaaau

SEQ ID NO: 486007 - RNA, 17 nt, Human
cauuguuugucugucuu

SEQ ID NO: 486008 - RNA, 15 nt, Human
gaacuaaaaauuaaa

SEQ ID NO: 486009 - RNA, 17 nt, Human
acaaaaggaauguguaa

SEQ ID NO: 486010 - RNA, 13 nt, Human
aagacagugaaag

SEQ ID NO: 486011 - RNA, 14 nt, Human
uugcuggagcucug

SEQ ID NO: 486012 - RNA, 16 nt, Human
auuucuauuuauuuac

SEQ ID NO: 486013 - RNA, 14 nt, Human
agcucauaaaugaa

SEQ ID NO: 486014 - RNA, 23 nt, Human
ggucuaucuuugagcgcccacua

SEQ ID NO: 486015 - RNA, 19 nt, Human
aguauuucuaugaaauauu

SEQ ID NO: 486016 - RNA, 17 nt, Human
cuuguuauuuauaacaa

SEQ ID NO: 486017 - RNA, 17 nt, Human
aauucuugccaaauaua

SEQ ID NO: 486018 - RNA, 11 nt, Human
ggucacaggaa

SEQ ID NO: 486019 - RNA, 17 nt, Human
gaaguauaggccaggca

SEQ ID NO: 486020 - RNA, 14 nt, Human
gcuggagcucugcc

SEQ ID NO: 486021 - RNA, 18 nt, Human
aagacucugucucaaaaa

SEQ ID NO: 486022 - RNA, 19 nt, Human
caugaguaacugauuugua

SEQ ID NO: 486023 - RNA, 16 nt, Human
agugaaagaaaauaac

SEQ ID NO: 486024 - RNA, 21 nt, Human
cuaaauugacacuuaaaaaug

SEQ ID NO: 486025 - RNA, 20 nt, Human
aauucuugccaaauauaaau

SEQ ID NO: 486026 - RNA, 14 nt, Human
uugccaugugcuag

SEQ ID NO: 486027 - RNA, 15 nt, Human
auuuuaaaagaauga

SEQ ID NO: 486028 - RNA, 23 nt, Human
gaccccugagcuugcagagauga

SEQ ID NO: 486029 - RNA, 16 nt, Human
ccacuuauaggaauug

SEQ ID NO: 486030 - RNA, 21 nt, Human
caagacugcacaucaaaauau

SEQ ID NO: 486031 - RNA, 12 nt, Human
gacacugucucu

SEQ ID NO: 486032 - RNA, 16 nt, Human
ccauuuuuagugaaau

SEQ ID NO: 486033 - RNA, 21 nt, Human
aaaagguauuuuaaucaccaa

SEQ ID NO: 486034 - RNA, 22 nt, Human
acaccuuguacuuuauuuucua

SEQ ID NO: 486035 - RNA, 22 nt, Human
uacugagagugaacaaauuuac

SEQ ID NO: 486036 - RNA, 15 nt, Human
uuaagagaacaagca

SEQ ID NO: 486037 - RNA, 19 nt, Human
gacagucaccucauggaau

SEQ ID NO: 486038 - RNA, 14 nt, Human
uaagcuguuuccau

SEQ ID NO: 486039 - RNA, 22 nt, Human
uuaccucugccucagaaaacaa

SEQ ID NO: 486040 - RNA, 15 nt, Human
agccucagucucccu

SEQ ID NO: 486041 - RNA, 15 nt, Human
caagcucacagaccu

SEQ ID NO: 486042 - RNA, 21 nt, Human
uugaggaaaaugggcuuugga

SEQ ID NO: 486043 - RNA, 12 nt, Human
cuuccucugagc

SEQ ID NO: 486044 - RNA, 16 nt, Human
uuaagagaacaagcaa

SEQ ID NO: 486045 - RNA, 17 nt, Human
gaacagauuucaaaaaa

SEQ ID NO: 486046 - RNA, 18 nt, Human
auuauuuuuuaaaaaaau

SEQ ID NO: 486047 - RNA, 23 nt, Human
aggaugguucccuugaugaagaa

SEQ ID NO: 486048 - RNA, 11 nt, Human
uuauauuuauu

SEQ ID NO: 486049 - RNA, 13 nt, Human
aaggcaggaggau

SEQ ID NO: 486050 - RNA, 12 nt, Human
acaagaaaugaa

SEQ ID NO: 486051 - RNA, 16 nt, Human
ccaggcugagccucag

SEQ ID NO: 486052 - RNA, 14 nt, Human
uucacauuuaaaua

SEQ ID NO: 486053 - RNA, 18 nt, Human
auaauccuaaacauauga

SEQ ID NO: 486054 - RNA, 16 nt, Human
cauuauggauaaagau

SEQ ID NO: 486055 - RNA, 19 nt, Human
uacuucuuaggguuaugau

SEQ ID NO: 486056 - RNA, 20 nt, Human
accugauuucugagcauuua

SEQ ID NO: 486057 - RNA, 19 nt, Human
ucacgccuguaaucccagc

SEQ ID NO: 486058 - RNA, 15 nt, Human
ccauuaaauauaaag

SEQ ID NO: 486059 - RNA, 18 nt, Human
ccucuggcuccagcuggc

SEQ ID NO: 486060 - RNA, 13 nt, Human
auugauuauaugu

SEQ ID NO: 486061 - RNA, 13 nt, Human
uggacgagaaaac

SEQ ID NO: 486062 - RNA, 15 nt, Human
uaacugcuacaaaua

SEQ ID NO: 486063 - RNA, 14 nt, Human
uuucuguuaaaaua

SEQ ID NO: 486064 - RNA, 13 nt, Human
agccucagucucc

SEQ ID NO: 486065 - RNA, 16 nt, Human
ugaaauuguauuacaa

SEQ ID NO: 486066 - RNA, 16 nt, Human
aaauguaauuauguuc

SEQ ID NO: 486067 - RNA, 22 nt, Human
gucucuaccaaaaaaaggaagg

SEQ ID NO: 486068 - RNA, 13 nt, Human
aacucccugcccc

SEQ ID NO: 486069 - RNA, 19 nt, Human
aaaauaacgauaaaagaca

SEQ ID NO: 486070 - RNA, 15 nt, Human
agucaccucauggaa

SEQ ID NO: 486071 - RNA, 19 nt, Human
uggcaagcucuaucaccaa

SEQ ID NO: 486072 - RNA, 21 nt, Human
uuguuuuucagcguuaaugua

SEQ ID NO: 486073 - RNA, 21 nt, Human
acaaggaaggaaagaugugaa

SEQ ID NO: 486074 - RNA, 22 nt, Human
aaagagugaaggauuuauguuu

SEQ ID NO: 486075 - RNA, 21 nt, Human
cucaaaacuucagacauagaa

SEQ ID NO: 486076 - RNA, 16 nt, Human
ugcacaucaaaauaug

SEQ ID NO: 486077 - RNA, 20 nt, Human
augcuucuguuuuauaauuu

SEQ ID NO: 486078 - RNA, 13 nt, Human
ccuaaccagccug

SEQ ID NO: 486079 - RNA, 12 nt, Human
ggggcucuggga

SEQ ID NO: 486080 - RNA, 20 nt, Human
auucccagccagcacagccu

SEQ ID NO: 486081 - RNA, 15 nt, Human
ccucagucucccucc

SEQ ID NO: 486082 - RNA, 22 nt, Human
uagaauauuuauuaccucugau

SEQ ID NO: 486083 - RNA, 19 nt, Human
auuuugugaagcaaaauuu

SEQ ID NO: 486084 - RNA, 15 nt, Human
aucuuauaauuuaaa

SEQ ID NO: 486085 - RNA, 19 nt, Human
uucccuugaugaagaaguu

SEQ ID NO: 486086 - RNA, 15 nt, Human
uuuagugaaauauua

SEQ ID NO: 486087 - RNA, 22 nt, Human
cuucaacucccugccccccagc

SEQ ID NO: 486088 - RNA, 14 nt, Human
acaugucuagagaa

SEQ ID NO: 486089 - RNA, 13 nt, Human
ucucccucccuug

SEQ ID NO: 486090 - RNA, 17 nt, Human
agauacaguggagacau

SEQ ID NO: 486091 - RNA, 15 nt, Human
gucaaugcagccccc

SEQ ID NO: 486092 - RNA, 20 nt, Human
auuacuguaagaaaauauca

SEQ ID NO: 486093 - RNA, 18 nt, Human
ucaaggguacacugccuu

SEQ ID NO: 486094 - RNA, 15 nt, Human
ugaugggcaaaaaac

SEQ ID NO: 486095 - RNA, 18 nt, Human
aagaccucauuuugaagg

SEQ ID NO: 486096 - RNA, 13 nt, Human
cucagaaaacaag

SEQ ID NO: 486097 - RNA, 16 nt, Human
accuguuuuuaagcug

SEQ ID NO: 486098 - RNA, 13 nt, Human
uaacgauaaaaga

SEQ ID NO: 486099 - RNA, 20 nt, Human
agcccuggugggcagagagg

SEQ ID NO: 486100 - RNA, 17 nt, Human
aagcccaauauuauaau

SEQ ID NO: 486101 - RNA, 21 nt, Human
aaaauuuuuucucuaggaaau

SEQ ID NO: 486102 - RNA, 19 nt, Human
agagccuuuuuuugaaaaa

SEQ ID NO: 486103 - RNA, 18 nt, Human
caaacuuuacagaaagau

SEQ ID NO: 486104 - RNA, 21 nt, Human
acaugagguacugagagugaa

SEQ ID NO: 486105 - RNA, 14 nt, Human
aaauaaauaaauaa

SEQ ID NO: 486106 - RNA, 17 nt, Human
agacacacugaagaagc

SEQ ID NO: 486107 - RNA, 20 nt, Human
acaagcaaauauaaacagca

SEQ ID NO: 486108 - RNA, 19 nt, Human
gcacuaguauuucuaugaa

SEQ ID NO: 486109 - RNA, 13 nt, Human
aaaugaaagcagg

SEQ ID NO: 486110 - RNA, 16 nt, Human
ccugcaaagcccagcu

SEQ ID NO: 486111 - RNA, 15 nt, Human
cugaggcaggaggau

SEQ ID NO: 486112 - RNA, 14 nt, Human
uugacccacaagaa

SEQ ID NO: 486113 - RNA, 12 nt, Human
acaagacacagu

SEQ ID NO: 486114 - RNA, 20 nt, Human
ggccuaugcagagguccaca

SEQ ID NO: 486115 - RNA, 19 nt, Human
uguuggacgagaaaacaau

SEQ ID NO: 486116 - RNA, 14 nt, Human
auuaauucaccuuc

SEQ ID NO: 486117 - RNA, 14 nt, Human
ucccuugaugaaga

SEQ ID NO: 486118 - RNA, 12 nt, Human
acauaaaauaca

SEQ ID NO: 486119 - RNA, 17 nt, Human
aauaacaauaaaagaca

SEQ ID NO: 486120 - RNA, 14 nt, Human
guaacugauuugua

SEQ ID NO: 486121 - RNA, 18 nt, Human
cuggaaacuucagcgguu

SEQ ID NO: 486122 - RNA, 19 nt, Human
ccugccuaagugcagcccc

SEQ ID NO: 486123 - RNA, 12 nt, Human
caaguaaauguu

SEQ ID NO: 486124 - RNA, 23 nt, Human
agagcaagacucugucucaaaaa

SEQ ID NO: 486125 - RNA, 23 nt, Human
guaauuccguagguuauuuucag

SEQ ID NO: 486126 - RNA, 14 nt, Human
aguuuuuuuuuaaa

SEQ ID NO: 486127 - RNA, 16 nt, Human
auccuacaagacacag

SEQ ID NO: 486128 - RNA, 17 nt, Human
cuaaggcaggaggauca

SEQ ID NO: 486129 - RNA, 14 nt, Human
uccauuaaauauaa

SEQ ID NO: 486130 - RNA, 18 nt, Human
ccaauauuauaauuuuuu

SEQ ID NO: 486131 - RNA, 18 nt, Human
ucuaugaaauauuauguu

SEQ ID NO: 486132 - RNA, 15 nt, Human
acuuuauaaaggauu

SEQ ID NO: 486133 - RNA, 24 nt, Human
cauaugaaaaggcuaagcuucacu

SEQ ID NO: 486134 - RNA, 16 nt, Human
acauccuacaagacac

SEQ ID NO: 486135 - RNA, 15 nt, Human
ugauuucauucaaua

SEQ ID NO: 486136 - RNA, 14 nt, Human
aauaguuuaugauu

SEQ ID NO: 486137 - RNA, 22 nt, Human
uucuacuggcugccagaaucua

SEQ ID NO: 486138 - RNA, 22 nt, Human
accuaacgaaguauccuucagc

SEQ ID NO: 486139 - RNA, 18 nt, Human
uaggaugggaacaaggaa

SEQ ID NO: 486140 - RNA, 17 nt, Human
gaaagaagcccaauauu

SEQ ID NO: 486141 - RNA, 12 nt, Human
uauaauuuaaaa

SEQ ID NO: 486142 - RNA, 23 nt, Human
ucucuaccaaaaaaaggaaggaa

SEQ ID NO: 486143 - RNA, 17 nt, Human
acuugaacccauauuug

SEQ ID NO: 486144 - RNA, 20 nt, Human
uuaaauggucaauuuuguua

SEQ ID NO: 486145 - RNA, 20 nt, Human
guaucaaaagaaagaaaauc

SEQ ID NO: 486146 - RNA, 22 nt, Human
cuacuauccaacuuauauuucu

SEQ ID NO: 486147 - RNA, 19 nt, Human
cccauggcacucuauguuc

SEQ ID NO: 486148 - RNA, 18 nt, Human
uaaauugacacuuaaaaa

SEQ ID NO: 486149 - RNA, 14 nt, Human
gucccaggcugagc

SEQ ID NO: 486150 - RNA, 15 nt, Human
auaaaguguuugaaa

SEQ ID NO: 486151 - RNA, 14 nt, Human
cucugccucagaaa

SEQ ID NO: 486152 - RNA, 22 nt, Human
ucaacuccaaacugacucuuaa

SEQ ID NO: 486153 - RNA, 22 nt, Human
aaauguugacaugggacauuug

SEQ ID NO: 486154 - RNA, 16 nt, Human
gaagauguagaggaga

SEQ ID NO: 486155 - RNA, 21 nt, Human
uaauaggcguaacuaauuuua

SEQ ID NO: 486156 - RNA, 14 nt, Human
caauuccucuggga

SEQ ID NO: 486157 - RNA, 20 nt, Human
agagaucucuguagaaggag

SEQ ID NO: 486158 - RNA, 15 nt, Human
aagccuccuuuuaaa

SEQ ID NO: 486159 - RNA, 18 nt, Human
uauuuucuauaauuuaaa

SEQ ID NO: 486160 - RNA, 19 nt, Human
cucugccucagaaaacaag

SEQ ID NO: 486161 - RNA, 19 nt, Human
agccugaucaccugcccug

SEQ ID NO: 486162 - RNA, 18 nt, Human
cuuugagcgcccacuaga

SEQ ID NO: 486163 - RNA, 14 nt, Human
cuguuuuuaagcug

SEQ ID NO: 486164 - RNA, 17 nt, Human
cuacagaacuaaaaauu

SEQ ID NO: 486165 - RNA, 14 nt, Human
gccaggcauggugg

SEQ ID NO: 486166 - RNA, 17 nt, Human
uuauuucccucccaagu

SEQ ID NO: 486167 - RNA, 17 nt, Human
uuagaugggcauggugg

SEQ ID NO: 486168 - RNA, 23 nt, Human
aauuuucauuguucuauaacaac

SEQ ID NO: 486169 - RNA, 13 nt, Human
cuugucucugggc

SEQ ID NO: 486170 - RNA, 12 nt, Human
acugaaaucaua

SEQ ID NO: 486171 - RNA, 13 nt, Human
cguuaauguaaag

SEQ ID NO: 486172 - RNA, 21 nt, Human
cuacauaaaauacaaaaacuu

SEQ ID NO: 486173 - RNA, 19 nt, Human
auugaggacacugauaugg

SEQ ID NO: 486174 - RNA, 21 nt, Human
aaaauaugccccauucaacau

SEQ ID NO: 486175 - RNA, 22 nt, Human
uggaaaguuuaugguuguauua

SEQ ID NO: 486176 - RNA, 20 nt, Human
uaugaaaaggcuaagcuuca

SEQ ID NO: 486177 - RNA, 20 nt, Human
uaggaauugacccacaagaa

SEQ ID NO: 486178 - RNA, 17 nt, Human
gccuaagugcagccccg

SEQ ID NO: 486179 - RNA, 16 nt, Human
accucugccucagaaa

SEQ ID NO: 486180 - RNA, 12 nt, Human
acaugagguacu

SEQ ID NO: 486181 - RNA, 20 nt, Human
cagugaaagaaaauaacgau

SEQ ID NO: 486182 - RNA, 22 nt, Human
uguaacugucuucuagcaguga

SEQ ID NO: 486183 - RNA, 14 nt, Human
cucccuuggggccu

SEQ ID NO: 486184 - RNA, 16 nt, Human
gauuuaaggccaggca

SEQ ID NO: 486185 - RNA, 15 nt, Human
auacguuaggaggac

SEQ ID NO: 486186 - RNA, 23 nt, Human
agccuugggaccccugagcuugc

SEQ ID NO: 486187 - RNA, 17 nt, Human
aaucuuucacaggggac

SEQ ID NO: 486188 - RNA, 14 nt, Human
augggaacaaggaa

SEQ ID NO: 486189 - RNA, 21 nt, Human
gaagugaaaaucuacacucca

SEQ ID NO: 486190 - RNA, 22 nt, Human
aacucccugccccccagcccuc

SEQ ID NO: 486191 - RNA, 18 nt, Human
agcaaauauaaacagcaa

SEQ ID NO: 486192 - RNA, 17 nt, Human
aggagaggcaaagaaag

SEQ ID NO: 486193 - RNA, 15 nt, Human
gauccugcaauucca

SEQ ID NO: 486194 - RNA, 15 nt, Human
ugcuucuguuuuaua

SEQ ID NO: 486195 - RNA, 22 nt, Human
ggccauuacccccagcuuugag

SEQ ID NO: 486196 - RNA, 13 nt, Human
cuagaauuuauuc

SEQ ID NO: 486197 - RNA, 14 nt, Human
acuaaaaauacaaa

SEQ ID NO: 486198 - RNA, 15 nt, Human
agaggcaaagaaagg

SEQ ID NO: 486199 - RNA, 15 nt, Human
aauacaaaaacuuag

SEQ ID NO: 486200 - RNA, 14 nt, Human
cugcugagucccag

SEQ ID NO: 486201 - RNA, 23 nt, Human
aagccauccccgcuccugguugg

SEQ ID NO: 486202 - RNA, 17 nt, Human
guuucuagagaugguuu

SEQ ID NO: 486203 - RNA, 13 nt, Human
ucccaaguaaaug

SEQ ID NO: 486204 - RNA, 15 nt, Human
auuauuuuuuaaaaa

SEQ ID NO: 486205 - RNA, 18 nt, Human
gaauaauccuaaacauau

SEQ ID NO: 486206 - RNA, 16 nt, Human
caaaaggauaaugaau

SEQ ID NO: 486207 - RNA, 15 nt, Human
guggagacaucugga

SEQ ID NO: 486208 - RNA, 15 nt, Human
guugcagugagcuga

SEQ ID NO: 486209 - RNA, 18 nt, Human
aaagagugaaggauuuau

SEQ ID NO: 486210 - RNA, 15 nt, Human
aaaaaauaacaauga

SEQ ID NO: 486211 - RNA, 15 nt, Human
cucuacuaaaaauac

SEQ ID NO: 486212 - RNA, 19 nt, Human
acuucagcgguuuauauaa

SEQ ID NO: 486213 - RNA, 22 nt, Human
aucaccaaggcugauuaaacca

SEQ ID NO: 486214 - RNA, 15 nt, Human
gacucaccuccccca

SEQ ID NO: 486215 - RNA, 14 nt, Human
aucaggaaagagag

SEQ ID NO: 486216 - RNA, 15 nt, Human
augucuagagaacac

SEQ ID NO: 486217 - RNA, 11 nt, Human
caaaaaucaaa

SEQ ID NO: 486218 - RNA, 12 nt, Human
cagugaaagaaa

SEQ ID NO: 486219 - RNA, 16 nt, Human
uaaaagacaaggaaaa

SEQ ID NO: 486220 - RNA, 16 nt, Human
gccucagucucccucc

SEQ ID NO: 486221 - RNA, 17 nt, Human
ccaacuuauauuucugc

SEQ ID NO: 486222 - RNA, 12 nt, Human
agacagugaaag

SEQ ID NO: 486223 - RNA, 14 nt, Human
gaaugauuaugaau

SEQ ID NO: 486224 - RNA, 16 nt, Human
ucaucaaugaaugaau

SEQ ID NO: 486225 - RNA, 17 nt, Human
agguccacaacacacag

SEQ ID NO: 486226 - RNA, 20 nt, Human
ccagcacuuugggaggcuga

SEQ ID NO: 486227 - RNA, 21 nt, Human
uuauguuuaauucugaaagca

SEQ ID NO: 486228 - RNA, 22 nt, Human
uuguaacaagccuccuuuuaaa

SEQ ID NO: 486229 - RNA, 13 nt, Human
aagcaaauauaaa

SEQ ID NO: 486230 - RNA, 14 nt, Human
accauuuuuacuug

SEQ ID NO: 486231 - RNA, 17 nt, Human
gaucuacaugucuagag

SEQ ID NO: 486232 - RNA, 13 nt, Human
uuauucacaagac

SEQ ID NO: 486233 - RNA, 20 nt, Human
aaaacaagcacuaaacaaag

SEQ ID NO: 486234 - RNA, 14 nt, Human
ccaaugaaaugagu

SEQ ID NO: 486235 - RNA, 16 nt, Human
ugcauagguuuaauaa

SEQ ID NO: 486236 - RNA, 23 nt, Human
agaguuuagcuggaaaaguaugu

SEQ ID NO: 486237 - RNA, 14 nt, Human
ggccuucggccucc

SEQ ID NO: 486238 - RNA, 22 nt, Human
ccgggaggcagagguugcagug

SEQ ID NO: 486239 - RNA, 18 nt, Human
uuauguuccuuuuaaaga

SEQ ID NO: 486240 - RNA, 13 nt, Human
agaaguaaaaaca

SEQ ID NO: 486241 - RNA, 14 nt, Human
caaaguuaagaauc

SEQ ID NO: 486242 - RNA, 22 nt, Human
auacuuuggccauuacccccag

SEQ ID NO: 486243 - RNA, 16 nt, Human
aaguugauuaagaaag

SEQ ID NO: 486244 - RNA, 22 nt, Human
auguuccuuuuaaagaaacaaa

SEQ ID NO: 486245 - RNA, 17 nt, Human
gucaaagcugaaaugga

SEQ ID NO: 486246 - RNA, 19 nt, Human
caaggaugccccguccccc

SEQ ID NO: 486247 - RNA, 22 nt, Human
uuuccaagcaaguauuagaaua

SEQ ID NO: 486248 - RNA, 14 nt, Human
acacugaagaagca

SEQ ID NO: 486249 - RNA, 20 nt, Human
cccuuccuaauuccacagcu

SEQ ID NO: 486250 - RNA, 16 nt, Human
gaauggcuaagcaaaa

SEQ ID NO: 486251 - RNA, 14 nt, Human
ucucuacauaaaau

SEQ ID NO: 486252 - RNA, 19 nt, Human
uuugccaaguucuccacua

SEQ ID NO: 486253 - RNA, 14 nt, Human
acuggacucaccuc

SEQ ID NO: 486254 - RNA, 20 nt, Human
ucaauaaaauccauacauuu

SEQ ID NO: 486255 - RNA, 16 nt, Human
ccuaagugcagccccg

SEQ ID NO: 486256 - RNA, 23 nt, Human
gggagccugaucaccugcccugc

SEQ ID NO: 486257 - RNA, 14 nt, Human
cuccagugagacag

SEQ ID NO: 486258 - RNA, 17 nt, Human
agcgacagugagacucu

SEQ ID NO: 486259 - RNA, 16 nt, Human
cagggacuugaaccca

SEQ ID NO: 486260 - RNA, 16 nt, Human
guucugcacacagcac

SEQ ID NO: 486261 - RNA, 18 nt, Human
cuucucacauuuauauuu

SEQ ID NO: 486262 - RNA, 18 nt, Human
gucuucuagcagugagcc

SEQ ID NO: 486263 - RNA, 14 nt, Human
gaaaaaauaacaau

SEQ ID NO: 486264 - RNA, 18 nt, Human
cauagugagacacugucu

SEQ ID NO: 486265 - RNA, 16 nt, Human
ucuuggucucaguguc

SEQ ID NO: 486266 - RNA, 21 nt, Human
caacacaucaggaaagagagc

SEQ ID NO: 486267 - RNA, 14 nt, Human
caagacucugucuc

SEQ ID NO: 486268 - RNA, 19 nt, Human
cuuuuaaagaaacaaaaau

SEQ ID NO: 486269 - RNA, 12 nt, Human
gcaaagcccagc

SEQ ID NO: 486270 - RNA, 15 nt, Human
auuucuaugaaauau

SEQ ID NO: 486271 - RNA, 17 nt, Human
ucugggauagcugaccc

SEQ ID NO: 486272 - RNA, 17 nt, Human
aaucuuauaauuuaaaa

SEQ ID NO: 486273 - RNA, 14 nt, Human
uaaaagacaaggaa

SEQ ID NO: 486274 - RNA, 16 nt, Human
aucacuuuaggccugg

SEQ ID NO: 486275 - RNA, 14 nt, Human
aacagaagcuucca

SEQ ID NO: 486276 - RNA, 22 nt, Human
auucuugaaagcuguggccagc

SEQ ID NO: 486277 - RNA, 14 nt, Human
ugcuagaacucccu

SEQ ID NO: 486278 - RNA, 14 nt, Human
uuuuaaaaaagaaa

SEQ ID NO: 486279 - RNA, 18 nt, Human
aaguugauaugccuuuuc

SEQ ID NO: 486280 - RNA, 22 nt, Human
ugaaaaaguucugcagauaaac

SEQ ID NO: 486281 - RNA, 13 nt, Human
ucuacuaaaaaua

SEQ ID NO: 486282 - RNA, 14 nt, Human
aauguaucuuauuc

SEQ ID NO: 486283 - RNA, 14 nt, Human
acauauauaacaau

SEQ ID NO: 486284 - RNA, 11 nt, Human
aaagaaacaaa

SEQ ID NO: 486285 - RNA, 11 nt, Human
aauuccacagc

SEQ ID NO: 486286 - RNA, 22 nt, Human
cugcucaauaaaguacaagagc

SEQ ID NO: 486287 - RNA, 16 nt, Human
acaucaggaaagagag

SEQ ID NO: 486288 - RNA, 19 nt, Human
uguauacugugugcuaaaa

SEQ ID NO: 486289 - RNA, 16 nt, Human
caggcugagccucagu

SEQ ID NO: 486290 - RNA, 22 nt, Human
auauuuacaaaugggaaacaaa

SEQ ID NO: 486291 - RNA, 23 nt, Human
gaaauugaaaaugguauuaaaga

SEQ ID NO: 486292 - RNA, 21 nt, Human
cgaaguauccuucagccugaa

SEQ ID NO: 486293 - RNA, 13 nt, Human
ccagcccuccuua

SEQ ID NO: 486294 - RNA, 13 nt, Human
uucaaaaaaaaac

SEQ ID NO: 486295 - RNA, 21 nt, Human
cauuuucuucucacauuuaua

SEQ ID NO: 486296 - RNA, 19 nt, Human
agaaaauaacgauaaaaga

SEQ ID NO: 486297 - RNA, 23 nt, Human
acaacaaaagcgauuauuauuuu

SEQ ID NO: 486298 - RNA, 16 nt, Human
gaugggcaaaaaacca

SEQ ID NO: 486299 - RNA, 18 nt, Human
acugugugcuaaaacaag

SEQ ID NO: 486300 - RNA, 23 nt, Human
agcuuccauuccaagccugacca

SEQ ID NO: 486301 - RNA, 14 nt, Human
agaaaugaaagcag

SEQ ID NO: 486302 - RNA, 18 nt, Human
agcagugccaaaauauaa

SEQ ID NO: 486303 - RNA, 12 nt, Human
ucuacacuccag

SEQ ID NO: 486304 - RNA, 22 nt, Human
gaugggaacaaggaaggaaaga

SEQ ID NO: 486305 - RNA, 18 nt, Human
aaauauuuauuuuaauaa

SEQ ID NO: 486306 - RNA, 17 nt, Human
aaaguacaagagcuuaa

SEQ ID NO: 486307 - RNA, 19 nt, Human
auucccagccagcacagcc

SEQ ID NO: 486308 - RNA, 21 nt, Human
ucauucacucaacaaacauaa

SEQ ID NO: 486309 - RNA, 14 nt, Human
aaaaaaggaaggaa

SEQ ID NO: 486310 - RNA, 22 nt, Human
cuaagcuucacuguaaaauaau

SEQ ID NO: 486311 - RNA, 16 nt, Human
augccccgucccccuc

SEQ ID NO: 486312 - RNA, 14 nt, Human
aagaagugaaaauc

SEQ ID NO: 486313 - RNA, 21 nt, Human
uccuucagccugaaagaggaa

SEQ ID NO: 486314 - RNA, 22 nt, Human
augucuagagaacacugugcuc

SEQ ID NO: 486315 - RNA, 17 nt, Human
gauaucuucagaaaacc

SEQ ID NO: 486316 - RNA, 17 nt, Human
cuggacucaccuccccc

SEQ ID NO: 486317 - RNA, 13 nt, Human
uaauuuuuauauu

SEQ ID NO: 486318 - RNA, 21 nt, Human
uauacugugugcuaaaacaag

SEQ ID NO: 486319 - RNA, 19 nt, Human
agugaggagcuuugaaacg

SEQ ID NO: 486320 - RNA, 17 nt, Human
uuauaucaauuuaaaaa

SEQ ID NO: 486321 - RNA, 14 nt, Human
aauauuuauuuuaa

SEQ ID NO: 486322 - RNA, 22 nt, Human
gugaacaaauuuacagagacag

SEQ ID NO: 486323 - RNA, 17 nt, Human
ugaaauaagccagacau

SEQ ID NO: 486324 - RNA, 13 nt, Human
acaauaaaagaca

SEQ ID NO: 486325 - RNA, 17 nt, Human
caagccuccuuuuaaag

SEQ ID NO: 486326 - RNA, 14 nt, Human
cacaucaggaaaga

SEQ ID NO: 486327 - RNA, 19 nt, Human
cuuggggccuaugcagagg

SEQ ID NO: 486328 - RNA, 14 nt, Human
uucaauauuuauua

SEQ ID NO: 486329 - RNA, 16 nt, Human
gccaaggaugccccgu

SEQ ID NO: 486330 - RNA, 18 nt, Human
aaaaccuaagcaaacuua

SEQ ID NO: 486331 - RNA, 22 nt, Human
caagcucuaucaccaaggagcc

SEQ ID NO: 486332 - RNA, 21 nt, Human
cucugucucaaaaaauaaaaa

SEQ ID NO: 486333 - RNA, 17 nt, Human
agggcauagaaguaaaa

SEQ ID NO: 486334 - RNA, 13 nt, Human
agcucugcccauc

SEQ ID NO: 486335 - RNA, 16 nt, Human
guuuuuuuuuaaaaaa

SEQ ID NO: 486336 - RNA, 19 nt, Human
ucugagcauuuaauaugga

SEQ ID NO: 486337 - RNA, 18 nt, Human
auuuaggccaugggacag

SEQ ID NO: 486338 - RNA, 14 nt, Human
acuuggucugugag

SEQ ID NO: 486339 - RNA, 17 nt, Human
ccccaguuguuucuacu

SEQ ID NO: 486340 - RNA, 21 nt, Human
uauuacuguaagaaaauauca

SEQ ID NO: 486341 - RNA, 21 nt, Human
acacaucaggaaagagagcac

SEQ ID NO: 486342 - RNA, 19 nt, Human
aguugauuuaaggccaggc

SEQ ID NO: 486343 - RNA, 20 nt, Human
acagaacuaaaaauuaaaac

SEQ ID NO: 486344 - RNA, 20 nt, Human
cuuauucacaagacccaaaa

SEQ ID NO: 486345 - RNA, 16 nt, Human
aaauaacaaugaaagu

SEQ ID NO: 486346 - RNA, 17 nt, Human
ucuaccaaaaaaaggaa

SEQ ID NO: 486347 - RNA, 15 nt, Human
uuagugaaauauuau

SEQ ID NO: 486348 - RNA, 21 nt, Human
auguuuaauucugaaagcaac

SEQ ID NO: 486349 - RNA, 12 nt, Human
cuauaacaacaa

SEQ ID NO: 486350 - RNA, 23 nt, Human
aaagcccagcuugaaaccuucac

SEQ ID NO: 486351 - RNA, 14 nt, Human
aaaagaaagaaaau

SEQ ID NO: 486352 - RNA, 15 nt, Human
cagccagcacagccu

SEQ ID NO: 486353 - RNA, 22 nt, Human
aauuacauuuguauaaaauaau

SEQ ID NO: 486354 - RNA, 13 nt, Human
ucacuguaaaaua

SEQ ID NO: 486355 - RNA, 17 nt, Human
uuccaagccucaugucc

SEQ ID NO: 486356 - RNA, 17 nt, Human
uaccaaaaaaaggaagg

SEQ ID NO: 486357 - RNA, 13 nt, Human
cacauuuaaauaa

SEQ ID NO: 486358 - RNA, 16 nt, Human
cugcucucaguucacu

SEQ ID NO: 486359 - RNA, 18 nt, Human
ucuucucauacuauuuaa

SEQ ID NO: 486360 - RNA, 14 nt, Human
acaaauccaaugaa

SEQ ID NO: 486361 - RNA, 20 nt, Human
acuagaguuuagcuggaaaa

SEQ ID NO: 486362 - RNA, 17 nt, Human
cagugaaagaaaauaac

SEQ ID NO: 486363 - RNA, 13 nt, Human
agaauuuauucaa

SEQ ID NO: 486364 - RNA, 20 nt, Human
cauagugagacacugucucu

SEQ ID NO: 486365 - RNA, 20 nt, Human
aguugauuaagaaaggaagu

SEQ ID NO: 486366 - RNA, 16 nt, Human
ugcaacuacuauccaa

SEQ ID NO: 486367 - RNA, 20 nt, Human
caagcucuaucaccaaggag

SEQ ID NO: 486368 - RNA, 16 nt, Human
auuuuaauaauguuuc

SEQ ID NO: 486369 - RNA, 15 nt, Human
aaaagacaaggaaaa

SEQ ID NO: 486370 - RNA, 19 nt, Human
agaguuuagcuggaaaagu

SEQ ID NO: 486371 - RNA, 15 nt, Human
ccuuccagugucucg

SEQ ID NO: 486372 - RNA, 19 nt, Human
cucugcaagaagaaaucau

SEQ ID NO: 486373 - RNA, 13 nt, Human
ccacaacacacag

SEQ ID NO: 486374 - RNA, 19 nt, Human
caagagagcgagacccugu

SEQ ID NO: 486375 - RNA, 13 nt, Human
auuggacaguaaa

SEQ ID NO: 486376 - RNA, 15 nt, Human
ccccugagcuugcag

SEQ ID NO: 486377 - RNA, 17 nt, Human
aggcuagaaccaccugc

SEQ ID NO: 486378 - RNA, 12 nt, Human
gacagugaaaga

SEQ ID NO: 486379 - RNA, 15 nt, Human
uaggaaauauuuauu

SEQ ID NO: 486380 - RNA, 13 nt, Human
caguuauuauauu

SEQ ID NO: 486381 - RNA, 14 nt, Human
cucccugcccccca

SEQ ID NO: 486382 - RNA, 13 nt, Human
uaagaaaggaagu

SEQ ID NO: 486383 - RNA, 14 nt, Human
agagacagaaagca

SEQ ID NO: 486384 - RNA, 14 nt, Human
uccacaacacacag

SEQ ID NO: 486385 - RNA, 23 nt, Human
uuguaacaagccuccuuuuaaag

SEQ ID NO: 486386 - RNA, 16 nt, Human
acaugaacuuguaaag

SEQ ID NO: 486387 - RNA, 16 nt, Human
ucuuauaauuuaaaau

SEQ ID NO: 486388 - RNA, 21 nt, Human
ucacagaaugacugacaaaga

SEQ ID NO: 486389 - RNA, 22 nt, Human
aggauggcuaguaucaaaagaa

SEQ ID NO: 486390 - RNA, 12 nt, Human
acagagacagaa

SEQ ID NO: 486391 - RNA, 15 nt, Human
caaauccaaugaaau

SEQ ID NO: 486392 - RNA, 17 nt, Human
ugaugcuuugagaacau

SEQ ID NO: 486393 - RNA, 20 nt, Human
guauuauuuuuuaaaaaaau

SEQ ID NO: 486394 - RNA, 19 nt, Human
aaacaaaaggauaaugaau

SEQ ID NO: 486395 - RNA, 16 nt, Human
aaaauccauacauuug

SEQ ID NO: 486396 - RNA, 17 nt, Human
ucucaaaaaauaaaaau

SEQ ID NO: 486397 - RNA, 14 nt, Human
acagaauuuuaugc

SEQ ID NO: 486398 - RNA, 15 nt, Human
aaggaaaaaauaaca

SEQ ID NO: 486399 - RNA, 18 nt, Human
uauuuucaguuauuauau

SEQ ID NO: 486400 - RNA, 22 nt, Human
caucgcaauguaagacucggga

SEQ ID NO: 486401 - RNA, 23 nt, Human
ugucaauucuugccaaauauaaa

SEQ ID NO: 486402 - RNA, 19 nt, Human
acuaucucauuuccaagca

SEQ ID NO: 486403 - RNA, 17 nt, Human
ugaacuugguuuuaauu

SEQ ID NO: 486404 - RNA, 20 nt, Human
agccuuggggcugaugcagu

SEQ ID NO: 486405 - RNA, 23 nt, Human
ccuaaccucauuccccaaccacu

SEQ ID NO: 486406 - RNA, 14 nt, Human
cagauccccaagcc

SEQ ID NO: 486407 - RNA, 22 nt, Human
aacaaggaaggaaagaugugaa

SEQ ID NO: 486408 - RNA, 12 nt, Human
caauaaauaaau

SEQ ID NO: 486409 - RNA, 19 nt, Human
agauuugagcucagcccug

SEQ ID NO: 486410 - RNA, 13 nt, Human
uucaccuguuuuu

SEQ ID NO: 486411 - RNA, 14 nt, Human
ugggcagaucacuu

SEQ ID NO: 486412 - RNA, 18 nt, Human
ccuucggccuccauccug

SEQ ID NO: 486413 - RNA, 18 nt, Human
uguaaaggaauuuaaaaa

SEQ ID NO: 486414 - RNA, 18 nt, Human
aaaguugauuaagaaagg

SEQ ID NO: 486415 - RNA, 15 nt, Human
uaaaagacaaggaaa

SEQ ID NO: 486416 - RNA, 23 nt, Human
cccgcuccugguuggucacagaa

SEQ ID NO: 486417 - RNA, 15 nt, Human
augguuguauuauuu

SEQ ID NO: 486418 - RNA, 13 nt, Human
cacacugaagaag

SEQ ID NO: 486419 - RNA, 17 nt, Human
aacaaaauuagaaaugu

SEQ ID NO: 486420 - RNA, 13 nt, Human
cuccacuggaaaa

SEQ ID NO: 486421 - RNA, 15 nt, Human
guggcgcgcaccugu

SEQ ID NO: 486422 - RNA, 12 nt, Human
guagacacacau

SEQ ID NO: 486423 - RNA, 16 nt, Human
cagucucccucccuug

SEQ ID NO: 486424 - RNA, 21 nt, Human
cucaguccaugaagauguaga

SEQ ID NO: 486425 - RNA, 21 nt, Human
ccuggugccucaccccuugcc

SEQ ID NO: 486426 - RNA, 23 nt, Human
cagagguugcagugagccgagau

SEQ ID NO: 486427 - RNA, 17 nt, Human
cuuccuaauuccacagc

SEQ ID NO: 486428 - RNA, 19 nt, Human
caauucuugccaaauauaa

SEQ ID NO: 486429 - RNA, 16 nt, Human
aagagaacaagcaaau

SEQ ID NO: 486430 - RNA, 19 nt, Human
ccauccugccccugagccc

SEQ ID NO: 486431 - RNA, 23 nt, Human
aucacagcuacuugggaggcuga

SEQ ID NO: 486432 - RNA, 18 nt, Human
agccugaucaccugcccu

SEQ ID NO: 486433 - RNA, 20 nt, Human
uuguaccucucuuauagaau

SEQ ID NO: 486434 - RNA, 16 nt, Human
aaauauuauguuaaaa

SEQ ID NO: 486435 - RNA, 16 nt, Human
ugaauuaguuuuauau

SEQ ID NO: 486436 - RNA, 20 nt, Human
gauugugccccugcacucca

SEQ ID NO: 486437 - RNA, 19 nt, Human
auuauuuuuuaaaaaaauu

SEQ ID NO: 486438 - RNA, 13 nt, Human
uuaugcuaaguga

SEQ ID NO: 486439 - RNA, 22 nt, Human
caccucccccaucucuucuggg

SEQ ID NO: 486440 - RNA, 20 nt, Human
uugauaaguacaugauaagc

SEQ ID NO: 486441 - RNA, 21 nt, Human
aauaggcugaugggcaaaaaa

SEQ ID NO: 486442 - RNA, 13 nt, Human
ccucuggcuccag

SEQ ID NO: 486443 - RNA, 15 nt, Human
cuaucuuugagcgcc

SEQ ID NO: 486444 - RNA, 19 nt, Human
auaauuuuuauauuugaaa

SEQ ID NO: 486445 - RNA, 21 nt, Human
aggacagcccuucuuuccaca

SEQ ID NO: 486446 - RNA, 17 nt, Human
cugagaugggagaauca

SEQ ID NO: 486447 - RNA, 12 nt, Human
acacugaagaag

SEQ ID NO: 486448 - RNA, 18 nt, Human
gauuucaaaaaaaaaccc

SEQ ID NO: 486449 - RNA, 20 nt, Human
ucauuccccaaccacuucau

SEQ ID NO: 486450 - RNA, 20 nt, Human
auaaauggcuuccuggcaau

SEQ ID NO: 486451 - RNA, 19 nt, Human
ugaacaaauuuacagagac

SEQ ID NO: 486452 - RNA, 14 nt, Human
uugaauaaauaaau

SEQ ID NO: 486453 - RNA, 13 nt, Human
agagguccacaac

SEQ ID NO: 486454 - RNA, 16 nt, Human
aagcaagauaauaaaa

SEQ ID NO: 486455 - RNA, 20 nt, Human
cagccugagcgacagugaga

SEQ ID NO: 486456 - RNA, 23 nt, Human
ccagcuacuugggaggcugaggc

SEQ ID NO: 486457 - RNA, 16 nt, Human
aauuuuuaauuauaug

SEQ ID NO: 486458 - RNA, 23 nt, Human
uagauaggucagugcaaauacuc

SEQ ID NO: 486459 - RNA, 18 nt, Human
accaccugccuauauuuu

SEQ ID NO: 486460 - RNA, 19 nt, Human
cuagaguuuagcuggaaaa

SEQ ID NO: 486461 - RNA, 20 nt, Human
ggagccugaucaccugcccu

SEQ ID NO: 486462 - RNA, 19 nt, Human
guccaggucuaccaaaaau

SEQ ID NO: 486463 - RNA, 15 nt, Human
uuauagcuacuaauu

SEQ ID NO: 486464 - RNA, 13 nt, Human
caacaucuaguga

SEQ ID NO: 486465 - RNA, 23 nt, Human
aucaccaaggcugauuaaaccaa

SEQ ID NO: 486466 - RNA, 15 nt, Human
cagucucccucccuu

SEQ ID NO: 486467 - RNA, 16 nt, Human
aaagaucugcaacuac

SEQ ID NO: 486468 - RNA, 19 nt, Human
aauguuuacagauccccaa

SEQ ID NO: 486469 - RNA, 20 nt, Human
ugaggcuccacuuggucugu

SEQ ID NO: 486470 - RNA, 23 nt, Human
uacauuguuugucugucuucaua

SEQ ID NO: 486471 - RNA, 18 nt, Human
auuuuaauuuugaauaaa

SEQ ID NO: 486472 - RNA, 18 nt, Human
aacagauuucaaaaaaaa

SEQ ID NO: 486473 - RNA, 15 nt, Human
uuuaaggauucugag

SEQ ID NO: 486474 - RNA, 13 nt, Human
aaauccuugaaga

SEQ ID NO: 486475 - RNA, 18 nt, Human
aguagcugcccuuucuca

SEQ ID NO: 486476 - RNA, 11 nt, Human
caauaaaagac

SEQ ID NO: 486477 - RNA, 15 nt, Human
accaaggcugauuaa

SEQ ID NO: 486478 - RNA, 20 nt, Human
aggugggcagaucacuugag

SEQ ID NO: 486479 - RNA, 19 nt, Human
aggucuaccaaaaaucuca

SEQ ID NO: 486480 - RNA, 20 nt, Human
augguuuagaaagcuugccc

SEQ ID NO: 486481 - RNA, 13 nt, Human
cugcacuccagcc

SEQ ID NO: 486482 - RNA, 11 nt, Human
uaaaaauaaau

SEQ ID NO: 486483 - RNA, 20 nt, Human
ccgaggugggcagaucacuu

SEQ ID NO: 486484 - RNA, 15 nt, Human
gugaacuugguuuua

SEQ ID NO: 486485 - RNA, 18 nt, Human
auuuuaacucuauaaugu

SEQ ID NO: 486486 - RNA, 14 nt, Human
cauuuauguuccuu

SEQ ID NO: 486487 - RNA, 18 nt, Human
ugagcucagcccuggugg

SEQ ID NO: 486488 - RNA, 22 nt, Human
uggguuccuuccucugagccuu

SEQ ID NO: 486489 - RNA, 15 nt, Human
cuucaacucccugcc

SEQ ID NO: 486490 - RNA, 12 nt, Human
ccaggcugagcc

SEQ ID NO: 486491 - RNA, 15 nt, Human
auuucauucaauauc

SEQ ID NO: 486492 - RNA, 21 nt, Human
augaauacuuuauaaaggauu

SEQ ID NO: 486493 - RNA, 18 nt, Human
cugaugggcaaaaaacca

SEQ ID NO: 486494 - RNA, 22 nt, Human
aauaauccuaaacauaugaauu

SEQ ID NO: 486495 - RNA, 16 nt, Human
accuuacuucuucuca

SEQ ID NO: 486496 - RNA, 14 nt, Human
ccuaaccagccugg

SEQ ID NO: 486497 - RNA, 23 nt, Human
agaaugauuaugaauuacauuug

SEQ ID NO: 486498 - RNA, 17 nt, Human
auguuuacagaucccca

SEQ ID NO: 486499 - RNA, 14 nt, Human
ccaugggacaggga

SEQ ID NO: 486500 - RNA, 22 nt, Human
cuaggaugggaacaaggaagga

SEQ ID NO: 486501 - RNA, 21 nt, Human
gcccccacuugccauaaaacu

SEQ ID NO: 486502 - RNA, 14 nt, Human
auuuaaauauaugc

SEQ ID NO: 486503 - RNA, 16 nt, Human
aaauaguuuaugauuc

SEQ ID NO: 486504 - RNA, 22 nt, Human
acaagcaaauauaaacagcaac

SEQ ID NO: 486505 - RNA, 17 nt, Human
ugaaaaucuuauaauuu

SEQ ID NO: 486506 - RNA, 23 nt, Human
uuuaagagaacaagcaaauauaa

SEQ ID NO: 486507 - RNA, 23 nt, Human
caggcauggugguuuacgccuau

SEQ ID NO: 486508 - RNA, 14 nt, Human
agcuguugagcugu

SEQ ID NO: 486509 - RNA, 13 nt, Human
aggauuugaaauu

SEQ ID NO: 486510 - RNA, 22 nt, Human
ugagacucugucucaguccaug

SEQ ID NO: 486511 - RNA, 15 nt, Human
cuaagugcagccccg

SEQ ID NO: 486512 - RNA, 15 nt, Human
auuuacugagcuucu

SEQ ID NO: 486513 - RNA, 13 nt, Human
aacacaacuauau

SEQ ID NO: 486514 - RNA, 21 nt, Human
aaaugucuugcuugauuguau

SEQ ID NO: 486515 - RNA, 14 nt, Human
ggcuacagugagcc

SEQ ID NO: 486516 - RNA, 18 nt, Human
ugggcacaggguuuaugu

SEQ ID NO: 486517 - RNA, 16 nt, Human
agugaaggauuuaugu

SEQ ID NO: 486518 - RNA, 20 nt, Human
ucuucuggguuccuuccucu

SEQ ID NO: 486519 - RNA, 23 nt, Human
gggccuaugcagagguccacaac

SEQ ID NO: 486520 - RNA, 22 nt, Human
gacucaccucccccaucucuuc

SEQ ID NO: 486521 - RNA, 19 nt, Human
ggaauuucuucaacucccu

SEQ ID NO: 486522 - RNA, 21 nt, Human
cuucucacauuuauauuuuug

SEQ ID NO: 486523 - RNA, 20 nt, Human
guccccuauccuacuucccc

SEQ ID NO: 486524 - RNA, 19 nt, Human
cuaguaucaaaagaaagaa

SEQ ID NO: 486525 - RNA, 16 nt, Human
cugcacuccagccuga

SEQ ID NO: 486526 - RNA, 20 nt, Human
ucacaugaacuuguaaagga

SEQ ID NO: 486527 - RNA, 20 nt, Human
gaacguaaucguguccccua

SEQ ID NO: 486528 - RNA, 16 nt, Human
cugucucuaccaaaaa

SEQ ID NO: 486529 - RNA, 21 nt, Human
cacuugaacccgggaggcaga

SEQ ID NO: 486530 - RNA, 20 nt, Human
cugauauuggacaguaaaau

SEQ ID NO: 486531 - RNA, 19 nt, Human
agucaaauugugugaaagg

SEQ ID NO: 486532 - RNA, 14 nt, Human
cucaccccuugcca

SEQ ID NO: 486533 - RNA, 16 nt, Human
acccagccccuugaga

SEQ ID NO: 486534 - RNA, 21 nt, Human
ugaaacgaggauugggaaaaa

SEQ ID NO: 486535 - RNA, 15 nt, Human
uuuaugguuguauua

SEQ ID NO: 486536 - RNA, 16 nt, Human
uccugcaauuccacuu

SEQ ID NO: 486537 - RNA, 22 nt, Human
cgcaccuguaaucccagcuacu

SEQ ID NO: 486538 - RNA, 22 nt, Human
cucugagccuugggaccccuga

SEQ ID NO: 486539 - RNA, 16 nt, Human
uaaaauccauacauuu

SEQ ID NO: 486540 - RNA, 20 nt, Human
cuuauauuucugcuuucaaa

SEQ ID NO: 486541 - RNA, 14 nt, Human
cugaaacaaaauua

SEQ ID NO: 486542 - RNA, 23 nt, Human
cugauaucaugccccuguacucc

SEQ ID NO: 486543 - RNA, 21 nt, Human
auauaugcuaagucuuauaua

SEQ ID NO: 486544 - RNA, 17 nt, Human
aucccagcacuuuggga

SEQ ID NO: 486545 - RNA, 21 nt, Human
ucuuaggguuaugauuaagua

SEQ ID NO: 486546 - RNA, 20 nt, Human
uaagugaaauaagccagaca

SEQ ID NO: 486547 - RNA, 13 nt, Human
uuuucaauauuua

SEQ ID NO: 486548 - RNA, 17 nt, Human
uuccaagugauugaaac

SEQ ID NO: 486549 - RNA, 15 nt, Human
acgagauacagaauu

SEQ ID NO: 486550 - RNA, 18 nt, Human
caacuuguguuccuaaca

SEQ ID NO: 486551 - RNA, 15 nt, Human
cugaggcaagagaau

SEQ ID NO: 486552 - RNA, 13 nt, Human
caagcaaauauaa

SEQ ID NO: 486553 - RNA, 20 nt, Human
auuuugugauugauuauaug

SEQ ID NO: 486554 - RNA, 15 nt, Human
cuaaggcaggaggau

SEQ ID NO: 486555 - RNA, 19 nt, Human
agacucgggauuaguacac

SEQ ID NO: 486556 - RNA, 14 nt, Human
auuuguauaaaaua

SEQ ID NO: 486557 - RNA, 21 nt, Human
uaauuuugaauaaauaaaugu

SEQ ID NO: 486558 - RNA, 17 nt, Human
cuccuuaucaaaggaca

SEQ ID NO: 486559 - RNA, 12 nt, Human
gccagggcaaga

SEQ ID NO: 486560 - RNA, 21 nt, Human
uagaaagaagcccaauauuau

SEQ ID NO: 486561 - RNA, 20 nt, Human
agcagugagccaaauguaaa

SEQ ID NO: 486562 - RNA, 23 nt, Human
caccaaggagccaaacauccuac

SEQ ID NO: 486563 - RNA, 22 nt, Human
cagugagccaaauguaaaauag

SEQ ID NO: 486564 - RNA, 15 nt, Human
uggcucacgccugua

SEQ ID NO: 486565 - RNA, 13 nt, Human
ccucccccaucuc

SEQ ID NO: 486566 - RNA, 21 nt, Human
uaguauuucuaugaaauauua

SEQ ID NO: 486567 - RNA, 19 nt, Human
aaaagacagugaaagaaaa

SEQ ID NO: 486568 - RNA, 14 nt, Human
uauaauguagcagc

SEQ ID NO: 486569 - RNA, 18 nt, Human
gaaaugaaagcagggacu

SEQ ID NO: 486570 - RNA, 18 nt, Human
acaaaugcauuucuaaag

SEQ ID NO: 486571 - RNA, 22 nt, Human
aucccagcuacuugggaggcug

SEQ ID NO: 486572 - RNA, 16 nt, Human
auuaauucaccuucca

SEQ ID NO: 486573 - RNA, 23 nt, Human
ggcuaagcuucacuguaaaauaa

SEQ ID NO: 486574 - RNA, 14 nt, Human
aauugaaaauggua

SEQ ID NO: 486575 - RNA, 18 nt, Human
ggaaggcugaggcaggag

SEQ ID NO: 486576 - RNA, 20 nt, Human
guucugcagauaaacaguag

SEQ ID NO: 486577 - RNA, 15 nt, Human
cccacucugcaagaa

SEQ ID NO: 486578 - RNA, 21 nt, Human
gggagccugaucaccugcccu

SEQ ID NO: 486579 - RNA, 22 nt, Human
aauugacccacaagaaaugaaa

SEQ ID NO: 486580 - RNA, 17 nt, Human
cuaucucauuuccaagc

SEQ ID NO: 486581 - RNA, 15 nt, Human
aaugauuaugaauua

SEQ ID NO: 486582 - RNA, 19 nt, Human
gaggcagagguugcaguga

SEQ ID NO: 486583 - RNA, 15 nt, Human
uucaagaccagccug

SEQ ID NO: 486584 - RNA, 14 nt, Human
uauuuauuuuaaua

SEQ ID NO: 486585 - RNA, 19 nt, Human
cacacuaugguauuugagu

SEQ ID NO: 486586 - RNA, 20 nt, Human
aaguucaaaacuuauuggaa

SEQ ID NO: 486587 - RNA, 16 nt, Human
aaauauaaauaaaaau

SEQ ID NO: 486588 - RNA, 13 nt, Human
acaugucuagaga

SEQ ID NO: 486589 - RNA, 15 nt, Human
uccauccugaggcuc

SEQ ID NO: 486590 - RNA, 16 nt, Human
ccugagcuugcagaga

SEQ ID NO: 486591 - RNA, 14 nt, Human
augaugcuuugaga

SEQ ID NO: 486592 - RNA, 16 nt, Human
ugagccaaauguaaaa

SEQ ID NO: 486593 - RNA, 18 nt, Human
ucuuauagaauauuuauu

SEQ ID NO: 486594 - RNA, 16 nt, Human
uccuguaauggaagca

SEQ ID NO: 486595 - RNA, 17 nt, Human
ugcacaucaaaauaugc

SEQ ID NO: 486596 - RNA, 16 nt, Human
auaaauaaauaaaaac

SEQ ID NO: 486597 - RNA, 12 nt, Human
ugccaaaauaua

SEQ ID NO: 486598 - RNA, 17 nt, Human
uaucuucagaaaaccua

SEQ ID NO: 486599 - RNA, 14 nt, Human
auugucuagugaaa

SEQ ID NO: 486600 - RNA, 21 nt, Human
ugaccauacuaauuauacccc

SEQ ID NO: 486601 - RNA, 21 nt, Human
augucauuugcuggagcucug

SEQ ID NO: 486602 - RNA, 19 nt, Human
agaaacaaaaaucaaacuu

SEQ ID NO: 486603 - RNA, 22 nt, Human
auagaauauuuauuaccucuga

SEQ ID NO: 486604 - RNA, 20 nt, Human
cuaaaugucaaucagccuag

SEQ ID NO: 486605 - RNA, 20 nt, Human
uuuuaaagaaacaaaaauca

SEQ ID NO: 486606 - RNA, 19 nt, Human
gccugaucaccugcccugc

SEQ ID NO: 486607 - RNA, 21 nt, Human
acagugaaagaaaauaacaau

SEQ ID NO: 486608 - RNA, 21 nt, Human
ugagcucagcccuggugggca

SEQ ID NO: 486609 - RNA, 17 nt, Human
uaacugauuuguaacaa

SEQ ID NO: 486610 - RNA, 15 nt, Human
guuuuucuuuucauu

SEQ ID NO: 486611 - RNA, 19 nt, Human
aauaaauguaucuuauuca

SEQ ID NO: 486612 - RNA, 13 nt, Human
uaagugcagcccc

SEQ ID NO: 486613 - RNA, 18 nt, Human
cagucucccucccuuggg

SEQ ID NO: 486614 - RNA, 20 nt, Human
aaugaauacuuuauaaagga

SEQ ID NO: 486615 - RNA, 14 nt, Human
acgagaaaacaaua

SEQ ID NO: 486616 - RNA, 16 nt, Human
gacaagcucacagacc

SEQ ID NO: 486617 - RNA, 19 nt, Human
aaacaauaacgauaaaaga

SEQ ID NO: 486618 - RNA, 21 nt, Human
agcccuucuuuccacagaagc

SEQ ID NO: 486619 - RNA, 15 nt, Human
ucaagaucagccugg

SEQ ID NO: 486620 - RNA, 22 nt, Human
cacagauuugagcucagcccug

SEQ ID NO: 486621 - RNA, 20 nt, Human
aaaagacagugaaagaaaau

SEQ ID NO: 486622 - RNA, 15 nt, Human
uuucaaaaaaaaacc

SEQ ID NO: 486623 - RNA, 20 nt, Human
acuccagugagacagcucug

SEQ ID NO: 486624 - RNA, 18 nt, Human
ccuguaaucccagcuacu

SEQ ID NO: 486625 - RNA, 13 nt, Human
aggccuggugugu

SEQ ID NO: 486626 - RNA, 10 nt, Human
auguuuucag

SEQ ID NO: 486627 - RNA, 18 nt, Human
cuaauuuaucuugucucu

SEQ ID NO: 486628 - RNA, 15 nt, Human
augggacagggagga

SEQ ID NO: 486629 - RNA, 19 nt, Human
cuacuaaaaauacaaaaau

SEQ ID NO: 486630 - RNA, 13 nt, Human
ugaaagaaaauaa

SEQ ID NO: 486631 - RNA, 16 nt, Human
ccucaaaacuucagac

SEQ ID NO: 486632 - RNA, 19 nt, Human
agaacaagcaaauauaaac

SEQ ID NO: 486633 - RNA, 19 nt, Human
caucaaggguacacugccu

SEQ ID NO: 486634 - RNA, 20 nt, Human
cagcuggccgggagccugau

SEQ ID NO: 486635 - RNA, 16 nt, Human
cuuugaugauuaauuc

SEQ ID NO: 486636 - RNA, 12 nt, Human
aaaagaaagaaa

SEQ ID NO: 486637 - RNA, 14 nt, Human
gccagggcaagaga

SEQ ID NO: 486638 - RNA, 17 nt, Human
gauggaguuucucuaga

SEQ ID NO: 486639 - RNA, 15 nt, Human
acugaagaagcacca

SEQ ID NO: 486640 - RNA, 19 nt, Human
cccacuggacucaccuccc

SEQ ID NO: 486641 - RNA, 13 nt, Human
cacgaugggcuuu

SEQ ID NO: 486642 - RNA, 17 nt, Human
augccccgucccccucu

SEQ ID NO: 486643 - RNA, 12 nt, Human
cuggcuccagcu

SEQ ID NO: 486644 - RNA, 12 nt, Human
gcuguugagcug

SEQ ID NO: 486645 - RNA, 21 nt, Human
gacagucaccucauggaauug

SEQ ID NO: 486646 - RNA, 15 nt, Human
auaauccuaaacaua

SEQ ID NO: 486647 - RNA, 13 nt, Human
agaauauuuauua

SEQ ID NO: 486648 - RNA, 12 nt, Human
uuaauaaaccau

SEQ ID NO: 486649 - RNA, 14 nt, Human
cagucucccucccu

SEQ ID NO: 486650 - RNA, 14 nt, Human
auaaauaaauaaaa

SEQ ID NO: 486651 - RNA, 18 nt, Human
uaagcuucacuguaaaau

SEQ ID NO: 486652 - RNA, 11 nt, Human
ugccauaaaac

SEQ ID NO: 486653 - RNA, 15 nt, Human
acaucaacagauaaa

SEQ ID NO: 486654 - RNA, 15 nt, Human
gcuguucuuuaaaug

SEQ ID NO: 486655 - RNA, 20 nt, Human
aagacagugaaagaaaauaa

SEQ ID NO: 486656 - RNA, 16 nt, Human
cauuucuaaagccauu

SEQ ID NO: 486657 - RNA, 18 nt, Human
agcaaaauuuuuucucua

SEQ ID NO: 486658 - RNA, 22 nt, Human
agacccacuggacucaccuccc

SEQ ID NO: 486659 - RNA, 14 nt, Human
aauuguauuacaaa

SEQ ID NO: 486660 - RNA, 16 nt, Human
gacaaggaaaaaauaa

SEQ ID NO: 486661 - RNA, 15 nt, Human
aucaaaggacaccau

SEQ ID NO: 486662 - RNA, 21 nt, Human
acuauuuaagagaacaagcaa

SEQ ID NO: 486663 - RNA, 17 nt, Human
aaauguucaucaaugaa

SEQ ID NO: 486664 - RNA, 15 nt, Human
gauuaagaaaggaag

SEQ ID NO: 486665 - RNA, 15 nt, Human
agcagugccaaaaua

SEQ ID NO: 486666 - RNA, 20 nt, Human
caaacauccuacaagacaca

SEQ ID NO: 486667 - RNA, 16 nt, Human
ggaguuucucuagaag

SEQ ID NO: 486668 - RNA, 17 nt, Human
uuagccgggcauggugg

SEQ ID NO: 486669 - RNA, 23 nt, Human
gcuuuggucuaucuuugagcgcc

SEQ ID NO: 486670 - RNA, 21 nt, Human
auccccaagccuggcaaggga

SEQ ID NO: 486671 - RNA, 14 nt, Human
aauauuauguuaaa

SEQ ID NO: 486672 - RNA, 18 nt, Human
cacuugccauaaaacuua

SEQ ID NO: 486673 - RNA, 22 nt, Human
uucauucacucaacaaacauaa

SEQ ID NO: 486674 - RNA, 17 nt, Human
acaaaugggaaacaaaa

SEQ ID NO: 486675 - RNA, 20 nt, Human
gccgggcgugguggugagug

SEQ ID NO: 486676 - RNA, 11 nt, Human
acugggacagg

SEQ ID NO: 486677 - RNA, 22 nt, Human
uguugagcuguuuucccugacc

SEQ ID NO: 486678 - RNA, 18 nt, Human
ccugccuaagugcagccc

SEQ ID NO: 486679 - RNA, 18 nt, Human
uuuugugaagcaaaauuu

SEQ ID NO: 486680 - RNA, 13 nt, Human
cucaccuccccca

SEQ ID NO: 486681 - RNA, 21 nt, Human
caaaguugauuaagaaaggaa

SEQ ID NO: 486682 - RNA, 17 nt, Human
uccuacaagacacagug

SEQ ID NO: 486683 - RNA, 12 nt, Human
ccagcuuugagg

SEQ ID NO: 486684 - RNA, 18 nt, Human
auccuucagccugaaaga

SEQ ID NO: 486685 - RNA, 16 nt, Human
ucuucaacucccugcc

SEQ ID NO: 486686 - RNA, 13 nt, Human
acaaggaaaaaau

SEQ ID NO: 486687 - RNA, 14 nt, Human
acucuauagacucu

SEQ ID NO: 486688 - RNA, 12 nt, Human
gcucagcccugg

SEQ ID NO: 486689 - RNA, 19 nt, Human
uauuuuaauaauguuucaa

SEQ ID NO: 486690 - RNA, 22 nt, Human
cucuggccuucggccuccaucc

SEQ ID NO: 486691 - RNA, 23 nt, Human
cacagauuugagcucagcccugg

SEQ ID NO: 486692 - RNA, 14 nt, Human
aagaaucuuuauag

SEQ ID NO: 486693 - RNA, 16 nt, Human
aggguguguaaguaga

SEQ ID NO: 486694 - RNA, 17 nt, Human
aaaggaaggaagggaca

SEQ ID NO: 486695 - RNA, 19 nt, Human
accauuuuggcaagcucua

SEQ ID NO: 486696 - RNA, 13 nt, Human
acaagaaaugaaa

SEQ ID NO: 486697 - RNA, 19 nt, Human
aacuagaauuuauucaauu

SEQ ID NO: 486698 - RNA, 22 nt, Human
aguauguuagugcaaauuguca

SEQ ID NO: 486699 - RNA, 14 nt, Human
gccauuacccccag

SEQ ID NO: 486700 - RNA, 12 nt, Human
gguuuauauaag

SEQ ID NO: 486701 - RNA, 14 nt, Human
cuucucuucacagu

SEQ ID NO: 486702 - RNA, 17 nt, Human
caaaagcgauuauuauu

SEQ ID NO: 486703 - RNA, 20 nt, Human
uuugcaagccagauuuuccu

SEQ ID NO: 486704 - RNA, 23 nt, Human
aauaauccucaguuuuugugaaa

SEQ ID NO: 486705 - RNA, 11 nt, Human
cuguuuuauaa

SEQ ID NO: 486706 - RNA, 14 nt, Human
cugagucccaggcu

SEQ ID NO: 486707 - RNA, 21 nt, Human
cuauguucuaagaagugaaaa

SEQ ID NO: 486708 - RNA, 17 nt, Human
caacauggugaaacccc

SEQ ID NO: 486709 - RNA, 12 nt, Human
gcuaaggcagga

SEQ ID NO: 486710 - RNA, 17 nt, Human
ccaaggaugccccgucc

SEQ ID NO: 486711 - RNA, 18 nt, Human
uaauuuugaauaaauaaa

SEQ ID NO: 486712 - RNA, 14 nt, Human
cuggagcucugccc

SEQ ID NO: 486713 - RNA, 23 nt, Human
caagagaauugcuugaacccagg

SEQ ID NO: 486714 - RNA, 20 nt, Human
aauaagucaucugaugagaa

SEQ ID NO: 486715 - RNA, 23 nt, Human
caagagagcgagacccugucuca

SEQ ID NO: 486716 - RNA, 16 nt, Human
ccuaugcagaggucca

SEQ ID NO: 486717 - RNA, 15 nt, Human
ccaaaauauaaucag

SEQ ID NO: 486718 - RNA, 15 nt, Human
aacaaggaaggaaag

SEQ ID NO: 486719 - RNA, 17 nt, Human
gaaaaucaggcuggcca

SEQ ID NO: 486720 - RNA, 21 nt, Human
uccauccugaggcuccacuug

SEQ ID NO: 486721 - RNA, 16 nt, Human
ugaaguacucauacau

SEQ ID NO: 486722 - RNA, 15 nt, Human
aggagauggaaguug

SEQ ID NO: 486723 - RNA, 13 nt, Human
gguccacaacaca

SEQ ID NO: 486724 - RNA, 15 nt, Human
acucugcaagaagaa

SEQ ID NO: 486725 - RNA, 15 nt, Human
ccuguacuccagccu

SEQ ID NO: 486726 - RNA, 20 nt, Human
cacuagacccacuggacuca

SEQ ID NO: 486727 - RNA, 20 nt, Human
aguuuuuuuuuaaaaaagaa

SEQ ID NO: 486728 - RNA, 14 nt, Human
uuuucaauauuuau

SEQ ID NO: 486729 - RNA, 16 nt, Human
auuauacccccugcaa

SEQ ID NO: 486730 - RNA, 20 nt, Human
caaaguugauuaagaaagga

SEQ ID NO: 486731 - RNA, 18 nt, Human
cugaccucccucuaauuu

SEQ ID NO: 486732 - RNA, 15 nt, Human
gaaaugaaagcaggg

SEQ ID NO: 486733 - RNA, 15 nt, Human
uuaaauauaaagcaa

SEQ ID NO: 486734 - RNA, 17 nt, Human
cuccaaguucaaaacuu

SEQ ID NO: 486735 - RNA, 12 nt, Human
agaaaacaauaa

SEQ ID NO: 486736 - RNA, 13 nt, Human
cuacauaaaauac

SEQ ID NO: 486737 - RNA, 14 nt, Human
auauuugaaauauu

SEQ ID NO: 486738 - RNA, 13 nt, Human
uuccucugagccu

SEQ ID NO: 486739 - RNA, 14 nt, Human
gcugauuaaaccaa

SEQ ID NO: 486740 - RNA, 14 nt, Human
accacaagacugca

SEQ ID NO: 486741 - RNA, 21 nt, Human
auuccuuuuucucuccucucc

SEQ ID NO: 486742 - RNA, 20 nt, Human
aaucuuuauaguucuacucc

SEQ ID NO: 486743 - RNA, 20 nt, Human
cuggccuucggccuccaucc

SEQ ID NO: 486744 - RNA, 11 nt, Human
gcuacagugag

SEQ ID NO: 486745 - RNA, 15 nt, Human
cucgugggacaguca

SEQ ID NO: 486746 - RNA, 16 nt, Human
agguugcagugagccg

SEQ ID NO: 486747 - RNA, 17 nt, Human
caagacccaaaaggcag

SEQ ID NO: 486748 - RNA, 22 nt, Human
aaaucaggguuaguauugucca

SEQ ID NO: 486749 - RNA, 17 nt, Human
aguugauaaguacauga

SEQ ID NO: 486750 - RNA, 16 nt, Human
cugagcauuuaauaug

SEQ ID NO: 486751 - RNA, 20 nt, Human
accucauggaauuggagcuc

SEQ ID NO: 486752 - RNA, 17 nt, Human
ugaccacugcagaagac

SEQ ID NO: 486753 - RNA, 21 nt, Human
aaagaaaauaacgauaaaaga

SEQ ID NO: 486754 - RNA, 22 nt, Human
aaaggaauguguaagucuuuaa

SEQ ID NO: 486755 - RNA, 14 nt, Human
gaaaguuuucucca

SEQ ID NO: 486756 - RNA, 22 nt, Human
uguucugauauuggacaguaaa

SEQ ID NO: 486757 - RNA, 15 nt, Human
uugacacuuaaaaau

SEQ ID NO: 486758 - RNA, 12 nt, Human
gggcgcgguggc

SEQ ID NO: 486759 - RNA, 14 nt, Human
agauuucaaaaaaa

SEQ ID NO: 486760 - RNA, 18 nt, Human
aaacaaaauuagaaaugu

SEQ ID NO: 486761 - RNA, 18 nt, Human
acuuuaugcuaagugaaa

SEQ ID NO: 486762 - RNA, 21 nt, Human
auaugcucuaaacauguuuau

SEQ ID NO: 486763 - RNA, 15 nt, Human
acauaagggaggaaa

SEQ ID NO: 486764 - RNA, 21 nt, Human
ccauccugccccugagcccau

SEQ ID NO: 486765 - RNA, 15 nt, Human
ugaaacccugucucu

SEQ ID NO: 486766 - RNA, 15 nt, Human
uacaaaugcauuucu

SEQ ID NO: 486767 - RNA, 23 nt, Human
cuggccgggagccugaucaccug

SEQ ID NO: 486768 - RNA, 17 nt, Human
uguaaaggaauuuaaaa

SEQ ID NO: 486769 - RNA, 21 nt, Human
augcuacaggauuugaaauug

SEQ ID NO: 486770 - RNA, 23 nt, Human
gcccuggugccucaccccuugcc

SEQ ID NO: 486771 - RNA, 19 nt, Human
uuuauaucaauuuaaaaaa

SEQ ID NO: 486772 - RNA, 19 nt, Human
gucaaauugugugaaaggu

SEQ ID NO: 486773 - RNA, 23 nt, Human
cacaagaaaugaaagcagggacu

SEQ ID NO: 486774 - RNA, 19 nt, Human
uccagaaagugacaagcuc

SEQ ID NO: 486775 - RNA, 17 nt, Human
aaauccuacuuucauaa

SEQ ID NO: 486776 - RNA, 14 nt, Human
aagcaacccaaaug

SEQ ID NO: 486777 - RNA, 22 nt, Human
caagcacuaaacaaagagugaa

SEQ ID NO: 486778 - RNA, 11 nt, Human
caacucccugc

SEQ ID NO: 486779 - RNA, 14 nt, Human
cuaagucuuauaua

SEQ ID NO: 486780 - RNA, 20 nt, Human
gaaaauaacgauaaaagaca

SEQ ID NO: 486781 - RNA, 18 nt, Human
cccucuggcuccagcugg

SEQ ID NO: 486782 - RNA, 14 nt, Human
ugagacucugucuc

SEQ ID NO: 486783 - RNA, 17 nt, Human
ccacuggacucaccucc

SEQ ID NO: 486784 - RNA, 19 nt, Human
uuauauuucuguuaaaaua

SEQ ID NO: 486785 - RNA, 15 nt, Human
ccagauccuggaaau

SEQ ID NO: 486786 - RNA, 15 nt, Human
augggaacaaggaag

SEQ ID NO: 486787 - RNA, 19 nt, Human
ugauggaguuucucuagaa

SEQ ID NO: 486788 - RNA, 15 nt, Human
ggacucaccuccccc

SEQ ID NO: 486789 - RNA, 19 nt, Human
cucugucucaaaaaauaaa

SEQ ID NO: 486790 - RNA, 15 nt, Human
ggauuccccuaaccu

SEQ ID NO: 486791 - RNA, 14 nt, Human
cccugccccccagc

SEQ ID NO: 486792 - RNA, 21 nt, Human
uuaacuagaauuuauucaauu

SEQ ID NO: 486793 - RNA, 15 nt, Human
aaaaauaacaaugaa

SEQ ID NO: 486794 - RNA, 12 nt, Human
gguauuuuaauc

SEQ ID NO: 486795 - RNA, 13 nt, Human
uaaauuugguucu

SEQ ID NO: 486796 - RNA, 14 nt, Human
cgucccccucuggc

SEQ ID NO: 486797 - RNA, 16 nt, Human
aaaaugugauauguac

SEQ ID NO: 486798 - RNA, 18 nt, Human
auaacaacaacaacaaaa

SEQ ID NO: 486799 - RNA, 17 nt, Human
ccugggcaacaugguga

SEQ ID NO: 486800 - RNA, 16 nt, Human
auaaauaaaaacaaag

SEQ ID NO: 486801 - RNA, 15 nt, Human
cuaagcaaaauguga

SEQ ID NO: 486802 - RNA, 15 nt, Human
gcacuacuguacucc

SEQ ID NO: 486803 - RNA, 19 nt, Human
ggaaaaaauaacaaugaaa

SEQ ID NO: 486804 - RNA, 18 nt, Human
cucuggccuucggccucc

SEQ ID NO: 486805 - RNA, 17 nt, Human
ucgggauuaguacacac

SEQ ID NO: 486806 - RNA, 22 nt, Human
uuuuauagcuacuaauuuuaaa

SEQ ID NO: 486807 - RNA, 20 nt, Human
gaaacgaggauugggaaaaa

SEQ ID NO: 486808 - RNA, 21 nt, Human
uuagaaauguaauuauguucu

SEQ ID NO: 486809 - RNA, 17 nt, Human
ugcauuuuggaaggcug

SEQ ID NO: 486810 - RNA, 14 nt, Human
auccuugaagauuu

SEQ ID NO: 486811 - RNA, 16 nt, Human
auuuaaggauucugag

SEQ ID NO: 486812 - RNA, 23 nt, Human
gaacagauuucaaaaaaaaaccc

SEQ ID NO: 486813 - RNA, 16 nt, Human
aaggagauacagugga

SEQ ID NO: 486814 - RNA, 20 nt, Human
gggcaagagagcgagacccu

SEQ ID NO: 486815 - RNA, 22 nt, Human
cagcacgggggccaaggaugcc

SEQ ID NO: 486816 - RNA, 15 nt, Human
ugcaauuccacuuau

SEQ ID NO: 486817 - RNA, 15 nt, Human
guucugcagauaaac

SEQ ID NO: 486818 - RNA, 15 nt, Human
uacagaacuaaaaau

SEQ ID NO: 486819 - RNA, 11 nt, Human
cugacaaagac

SEQ ID NO: 486820 - RNA, 16 nt, Human
uuaaauuguaauaggc

SEQ ID NO: 486821 - RNA, 16 nt, Human
gccuaagugcagcccc

SEQ ID NO: 486822 - RNA, 19 nt, Human
ggacucaccucccccaucu

SEQ ID NO: 486823 - RNA, 18 nt, Human
cagcuuauugucuaguga

SEQ ID NO: 486824 - RNA, 19 nt, Human
auaaaagacaaggaaaaaa

SEQ ID NO: 486825 - RNA, 20 nt, Human
aauuuugugaagcaaaauuu

SEQ ID NO: 486826 - RNA, 20 nt, Human
aaauccuugaagauuuacca

SEQ ID NO: 486827 - RNA, 15 nt, Human
uuuaauaauuuuuaa

SEQ ID NO: 486828 - RNA, 16 nt, Human
aaagacaaggaaaaaa

SEQ ID NO: 486829 - RNA, 11 nt, Human
uucacagggga

SEQ ID NO: 486830 - RNA, 16 nt, Human
gacauuugcucaugga

SEQ ID NO: 486831 - RNA, 20 nt, Human
agaagaacugaaaucauacu

SEQ ID NO: 486832 - RNA, 21 nt, Human
aggaagggacacauaucaaac

SEQ ID NO: 486833 - RNA, 18 nt, Human
aauuuuuuucaauauuua

SEQ ID NO: 486834 - RNA, 18 nt, Human
auuuauuacuguaagaaa

SEQ ID NO: 486835 - RNA, 22 nt, Human
cugaaauggaacagauuucaaa

SEQ ID NO: 486836 - RNA, 18 nt, Human
uacauuuguauaaaauaa

SEQ ID NO: 486837 - RNA, 20 nt, Human
gaauucauucacucaacaaa

SEQ ID NO: 486838 - RNA, 19 nt, Human
ccaccugccuauauuuuuu

SEQ ID NO: 486839 - RNA, 17 nt, Human
aagaaacaaaaaucaaa

SEQ ID NO: 486840 - RNA, 16 nt, Human
cagauccccaagccug

SEQ ID NO: 486841 - RNA, 16 nt, Human
aauuacauuuguauaa

SEQ ID NO: 486842 - RNA, 18 nt, Human
uucauagcagauuuuaau

SEQ ID NO: 486843 - RNA, 17 nt, Human
guguccccuauccuacu

SEQ ID NO: 486844 - RNA, 16 nt, Human
ugaaguccaagcauuu

SEQ ID NO: 486845 - RNA, 17 nt, Human
guccgaggugggcagau

SEQ ID NO: 486846 - RNA, 18 nt, Human
acauuguuugucugucuu

SEQ ID NO: 486847 - RNA, 21 nt, Human
ucaguuccagccuucucucaa

SEQ ID NO: 486848 - RNA, 23 nt, Human
ucacagaaugacugacaaagaca

SEQ ID NO: 486849 - RNA, 12 nt, Human
aacuuuacagaa

SEQ ID NO: 486850 - RNA, 22 nt, Human
gcgacucuauagacucuaggac

SEQ ID NO: 486851 - RNA, 23 nt, Human
aggaggaucacuuuaggccuggu

SEQ ID NO: 486852 - RNA, 13 nt, Human
agcgacagugaga

SEQ ID NO: 486853 - RNA, 22 nt, Human
agugagcagucaggaaagagaa

SEQ ID NO: 486854 - RNA, 19 nt, Human
guaguccuguaauggaagc

SEQ ID NO: 486855 - RNA, 13 nt, Human
auuuuaaaagaau

SEQ ID NO: 486856 - RNA, 17 nt, Human
aggccaugggacaggga

SEQ ID NO: 486857 - RNA, 21 nt, Human
cuaguaucaaaagaaagaaaa

SEQ ID NO: 486858 - RNA, 15 nt, Human
cgggagccugaucac

SEQ ID NO: 486859 - RNA, 21 nt, Human
cccacuggacucaccuccccc

SEQ ID NO: 486860 - RNA, 19 nt, Human
uaaaaauaaaaauaaauuu

SEQ ID NO: 486861 - RNA, 17 nt, Human
gacgagaaaacaauaac

SEQ ID NO: 486862 - RNA, 18 nt, Human
agguccacaacacacaga

SEQ ID NO: 486863 - RNA, 12 nt, Human
cagaacagugau

SEQ ID NO: 486864 - RNA, 20 nt, Human
gcagagaugaggccgccaug

SEQ ID NO: 486865 - RNA, 13 nt, Human
uuuaaaaaaaaac

SEQ ID NO: 486866 - RNA, 18 nt, Human
caugaagauguagaggag

SEQ ID NO: 486867 - RNA, 15 nt, Human
ucaguuuuugugaaa

SEQ ID NO: 486868 - RNA, 14 nt, Human
ggccgggagccuga

SEQ ID NO: 486869 - RNA, 22 nt, Human
ugaagcaaaauuuuuucucuag

SEQ ID NO: 486870 - RNA, 22 nt, Human
cacuaguauuucuaugaaauau

SEQ ID NO: 486871 - RNA, 22 nt, Human
auauauaacaaugcuguauuuu

SEQ ID NO: 486872 - RNA, 19 nt, Human
uggaacaguuaccucugcc

SEQ ID NO: 486873 - RNA, 15 nt, Human
aagccuggcaaggga

SEQ ID NO: 486874 - RNA, 20 nt, Human
uguuggugaacuugguuuua

SEQ ID NO: 486875 - RNA, 12 nt, Human
uauaacaacaac

SEQ ID NO: 486876 - RNA, 13 nt, Human
gagcucaggaggu

SEQ ID NO: 486877 - RNA, 13 nt, Human
ccugccccccagc

SEQ ID NO: 486878 - RNA, 15 nt, Human
gcccacuagacccac

SEQ ID NO: 486879 - RNA, 15 nt, Human
aaauauaaauaaaaa

SEQ ID NO: 486880 - RNA, 14 nt, Human
aaaagacagugaaa

SEQ ID NO: 486881 - RNA, 16 nt, Human
gagcucgugggacagu

SEQ ID NO: 486882 - RNA, 18 nt, Human
gccccugcacuccagccu

SEQ ID NO: 486883 - RNA, 16 nt, Human
ucccugccccccagcc

SEQ ID NO: 486884 - RNA, 19 nt, Human
cgauuuagaaagaagccca

SEQ ID NO: 486885 - RNA, 20 nt, Human
aggcugagaugggagaauca

SEQ ID NO: 486886 - RNA, 18 nt, Human
caaggcuagaaccaccug

SEQ ID NO: 486887 - RNA, 22 nt, Human
aauuuaaaaaaaaaccugagcc

SEQ ID NO: 486888 - RNA, 17 nt, Human
cugaucaccugcccugc

SEQ ID NO: 486889 - RNA, 20 nt, Human
guaaaauagugaauaaaguc

SEQ ID NO: 486890 - RNA, 14 nt, Human
caggcacaguggcu

SEQ ID NO: 486891 - RNA, 17 nt, Human
ucagcguuaauguaaag

SEQ ID NO: 486892 - RNA, 15 nt, Human
caaaaaaaggaagga

SEQ ID NO: 486893 - RNA, 21 nt, Human
gcagaucuacaugucuagaga

SEQ ID NO: 486894 - RNA, 19 nt, Human
gugaacuugguuuuaauua

SEQ ID NO: 486895 - RNA, 13 nt, Human
acuguaaaauaau

SEQ ID NO: 486896 - RNA, 14 nt, Human
aaugauuaugaauu

SEQ ID NO: 486897 - RNA, 22 nt, Human
auaucaaacugaaacaaaauua

SEQ ID NO: 486898 - RNA, 12 nt, Human
aauuuuaaaaug

SEQ ID NO: 486899 - RNA, 11 nt, Human
acuaaaaauac

SEQ ID NO: 486900 - RNA, 22 nt, Human
cauacuauuuaagagaacaagc

SEQ ID NO: 486901 - RNA, 12 nt, Human
cuucaacucccu

SEQ ID NO: 486902 - RNA, 12 nt, Human
agacaucuggaa

SEQ ID NO: 486903 - RNA, 22 nt, Human
ccucccuuggggccuaugcaga

SEQ ID NO: 486904 - RNA, 15 nt, Human
ugagcgcccacuaga

SEQ ID NO: 486905 - RNA, 17 nt, Human
ccaaaaaucucaauauu

SEQ ID NO: 486906 - RNA, 22 nt, Human
uuuaauaauguuucaaacauau

SEQ ID NO: 486907 - RNA, 17 nt, Human
auaaaguacaagagcuu

SEQ ID NO: 486908 - RNA, 15 nt, Human
cagaauucauucacu

SEQ ID NO: 486909 - RNA, 16 nt, Human
ucaguuuuugugaaaa

SEQ ID NO: 486910 - RNA, 18 nt, Human
gcacuccagccugagcga

SEQ ID NO: 486911 - RNA, 20 nt, Human
ggugggcagaucacuugagc

SEQ ID NO: 486912 - RNA, 13 nt, Human
uuuucuuuucauu

SEQ ID NO: 486913 - RNA, 15 nt, Human
aauauaaacagcaac

SEQ ID NO: 486914 - RNA, 21 nt, Human
acgcucucuggccuucggccu

SEQ ID NO: 486915 - RNA, 16 nt, Human
gucauuauuaggaagu

SEQ ID NO: 486916 - RNA, 14 nt, Human
uaaagaaacaaaaa

SEQ ID NO: 486917 - RNA, 18 nt, Human
acagagacagaaagcaga

SEQ ID NO: 486918 - RNA, 18 nt, Human
auuuauuuacugagcuuc

SEQ ID NO: 486919 - RNA, 12 nt, Human
cauuauauuuau

SEQ ID NO: 486920 - RNA, 14 nt, Human
aaauauaaauaaaa

SEQ ID NO: 486921 - RNA, 14 nt, Human
auaaauaaaaauaa

SEQ ID NO: 486922 - RNA, 11 nt, Human
aggcaggagga

SEQ ID NO: 486923 - RNA, 22 nt, Human
gugccucaccccuugccauaau

SEQ ID NO: 486924 - RNA, 21 nt, Human
accaaggagccaaacauccua

SEQ ID NO: 486925 - RNA, 16 nt, Human
uuauaauuuaaaauau

SEQ ID NO: 486926 - RNA, 21 nt, Human
ugcucaauaaaguacaagagc

SEQ ID NO: 486927 - RNA, 19 nt, Human
agccuggucaacaugguga

SEQ ID NO: 486928 - RNA, 19 nt, Human
cucugcauacucauuagga

SEQ ID NO: 486929 - RNA, 11 nt, Human
ucaccugcccu

SEQ ID NO: 486930 - RNA, 15 nt, Human
ggaacaaggaaggaa

SEQ ID NO: 486931 - RNA, 14 nt, Human
uccaagccugacca

SEQ ID NO: 486932 - RNA, 14 nt, Human
aauacucuuaggaa

SEQ ID NO: 486933 - RNA, 18 nt, Human
guuucaaacauauauaac

SEQ ID NO: 486934 - RNA, 17 nt, Human
ggccaugggacagggag

SEQ ID NO: 486935 - RNA, 21 nt, Human
ggggagccaacagaagcuucc

SEQ ID NO: 486936 - RNA, 14 nt, Human
ugaucaccugcccu

SEQ ID NO: 486937 - RNA, 15 nt, Human
gccccugcacuccag

SEQ ID NO: 486938 - RNA, 13 nt, Human
aucaaugaaugaa

SEQ ID NO: 486939 - RNA, 13 nt, Human
aagacucugucuc

SEQ ID NO: 486940 - RNA, 22 nt, Human
uuugaugcuacaggauuugaaa

SEQ ID NO: 486941 - RNA, 16 nt, Human
acaaaaggaaugugua

SEQ ID NO: 486942 - RNA, 12 nt, Human
uuuuauauuuga

SEQ ID NO: 486943 - RNA, 22 nt, Human
uauuucagauaaucacaauaca

SEQ ID NO: 486944 - RNA, 18 nt, Human
gaggcugaggcgggugga

SEQ ID NO: 486945 - RNA, 12 nt, Human
gacccugucuca

SEQ ID NO: 486946 - RNA, 20 nt, Human
aagggcuguuauaaucuuuc

SEQ ID NO: 486947 - RNA, 18 nt, Human
ucuucaacucccugcccc

SEQ ID NO: 486948 - RNA, 15 nt, Human
aaaucaaacuuuaca

SEQ ID NO: 486949 - RNA, 22 nt, Human
accaaucaugaauuaguuuuau

SEQ ID NO: 486950 - RNA, 12 nt, Human
aauaauuuuuaa

SEQ ID NO: 486951 - RNA, 16 nt, Human
cagcuuuccucaaaac

SEQ ID NO: 486952 - RNA, 18 nt, Human
uguauuauuuuuuaaaaa

SEQ ID NO: 486953 - RNA, 24 nt, Human
cauucuggaauaauccuaaacaua

SEQ ID NO: 486954 - RNA, 13 nt, Human
agaaaugaaagca

SEQ ID NO: 486955 - RNA, 15 nt, Human
uuugaauaaauaaau

SEQ ID NO: 486956 - RNA, 16 nt, Human
ggagaggcaaagaaag

SEQ ID NO: 486957 - RNA, 19 nt, Human
uggugaacuugguuuuaau

SEQ ID NO: 486958 - RNA, 23 nt, Human
auuuuauagcuacuaauuuuaaa

SEQ ID NO: 486959 - RNA, 14 nt, Human
gcaagauaauaaaa

SEQ ID NO: 486960 - RNA, 22 nt, Human
agcacagccucuuagaugcagu

SEQ ID NO: 486961 - RNA, 15 nt, Human
auuccccuaaccuca

SEQ ID NO: 486962 - RNA, 16 nt, Human
cuagaacucccuuuca

SEQ ID NO: 486963 - RNA, 23 nt, Human
ccacuucauucuugaaagcugug

SEQ ID NO: 486964 - RNA, 19 nt, Human
gaucacuuuaggccuggug

SEQ ID NO: 486965 - RNA, 22 nt, Human
ggcuaagcuucacuguaaaaua

SEQ ID NO: 486966 - RNA, 15 nt, Human
cugaaagaggaauga

SEQ ID NO: 486967 - RNA, 12 nt, Human
agacucugucuc

SEQ ID NO: 486968 - RNA, 13 nt, Human
acuuauuggaaug

SEQ ID NO: 486969 - RNA, 17 nt, Human
gaugggaacaaggaagg

SEQ ID NO: 486970 - RNA, 20 nt, Human
agagacacacugaagaagca

SEQ ID NO: 486971 - RNA, 16 nt, Human
aggaggacaaaaggaa

SEQ ID NO: 486972 - RNA, 14 nt, Human
aaauaaaaacaaag

SEQ ID NO: 486973 - RNA, 17 nt, Human
gccugagcgacagugag

SEQ ID NO: 486974 - RNA, 13 nt, Human
gaggcaagagaau

SEQ ID NO: 486975 - RNA, 15 nt, Human
aauaacgauaaaaga

SEQ ID NO: 486976 - RNA, 13 nt, Human
agacacugucucu

SEQ ID NO: 486977 - RNA, 12 nt, Human
cuacaagacaca

SEQ ID NO: 486978 - RNA, 15 nt, Human
aacgauaaaagacag

SEQ ID NO: 486979 - RNA, 19 nt, Human
cuaccaaaaaaaggaagga

SEQ ID NO: 486980 - RNA, 17 nt, Human
uaauuuuuauauuugaa

SEQ ID NO: 486981 - RNA, 13 nt, Human
caugguggugugu

SEQ ID NO: 486982 - RNA, 15 nt, Human
gcagagguugcagug

SEQ ID NO: 486983 - RNA, 19 nt, Human
aauauaugaggcuacagaa

SEQ ID NO: 486984 - RNA, 14 nt, Human
ugaggucaggaguu

SEQ ID NO: 486985 - RNA, 12 nt, Human
cuaagaagugaa

SEQ ID NO: 486986 - RNA, 21 nt, Human
aauuuacagagacagaaagca

SEQ ID NO: 486987 - RNA, 12 nt, Human
uacuaaaaauac

SEQ ID NO: 486988 - RNA, 19 nt, Human
cuuccagauccuggaaauc

SEQ ID NO: 486989 - RNA, 14 nt, Human
cucaacaaacauaa

SEQ ID NO: 486990 - RNA, 11 nt, Human
gagguaaaagc

SEQ ID NO: 486991 - RNA, 23 nt, Human
cgauuauuauuuuagagcaucuc

SEQ ID NO: 486992 - RNA, 16 nt, Human
uauaucaauuuaaaaa

SEQ ID NO: 486993 - RNA, 17 nt, Human
aaaauuagaaauguaau

SEQ ID NO: 486994 - RNA, 19 nt, Human
uuuccugaaaacccuugcc

SEQ ID NO: 486995 - RNA, 11 nt, Human
aacaaggaagg

SEQ ID NO: 486996 - RNA, 18 nt, Human
cccugaccucccucuaau

SEQ ID NO: 486997 - RNA, 12 nt, Human
auauaaauaaaa

SEQ ID NO: 486998 - RNA, 12 nt, Human
auaaaaauaaau

SEQ ID NO: 486999 - RNA, 13 nt, Human
auaacgauaaaag

SEQ ID NO: 487000 - RNA, 12 nt, Human
gccauaaaacuu

SEQ ID NO: 487001 - RNA, 16 nt, Human
aaagaaaggagauaca

SEQ ID NO: 487002 - RNA, 20 nt, Human
acagcccuucuuuccacaga

SEQ ID NO: 487003 - RNA, 20 nt, Human
uggaauaauccuaaacauau

SEQ ID NO: 487004 - RNA, 15 nt, Human
cuuuucccaacucca

SEQ ID NO: 487005 - RNA, 18 nt, Human
uaaguuuuuuuuuaaaaa

SEQ ID NO: 487006 - RNA, 16 nt, Human
ugauuuaaggccaggc

SEQ ID NO: 487007 - RNA, 18 nt, Human
ucaggaaagagagcacca

SEQ ID NO: 487008 - RNA, 16 nt, Human
cuagaaccaccugccu

SEQ ID NO: 487009 - RNA, 16 nt, Human
aaggagaggcaaagaa

SEQ ID NO: 487010 - RNA, 17 nt, Human
uaggaugggaacaagga

SEQ ID NO: 487011 - RNA, 20 nt, Human
uccaagccucauguccacug

SEQ ID NO: 487012 - RNA, 14 nt, Human
aaagaggaaugaag

SEQ ID NO: 487013 - RNA, 21 nt, Human
gucucuaccaaaaaaaggaag

SEQ ID NO: 487014 - RNA, 13 nt, Human
gcucucuggccuu

SEQ ID NO: 487015 - RNA, 19 nt, Human
acgaugggcuuucccaaca

SEQ ID NO: 487016 - RNA, 20 nt, Human
auauuuuauaucaauuuaaa

SEQ ID NO: 487017 - RNA, 23 nt, Human
auauaacaaugcuguauuuuaaa

SEQ ID NO: 487018 - RNA, 17 nt, Human
uaaaagacaaggaaaaa

SEQ ID NO: 487019 - RNA, 15 nt, Human
aaggguacacugccu

SEQ ID NO: 487020 - RNA, 11 nt, Human
auggauaaaga

SEQ ID NO: 487021 - RNA, 13 nt, Human
aaaaauccuacuu

SEQ ID NO: 487022 - RNA, 17 nt, Human
ugaaggauuuauguuua

SEQ ID NO: 487023 - RNA, 22 nt, Human
gaauuucuucaacucccugccc

SEQ ID NO: 487024 - RNA, 18 nt, Human
agugucaaugcagccccc

SEQ ID NO: 487025 - RNA, 14 nt, Human
ucuugucucugggc

SEQ ID NO: 487026 - RNA, 14 nt, Human
ugguauguuuucag

SEQ ID NO: 487027 - RNA, 19 nt, Human
uugugccccugcacuccag

SEQ ID NO: 487028 - RNA, 22 nt, Human
aaacuuuacagaaagauuugau

SEQ ID NO: 487029 - RNA, 17 nt, Human
agaggcaaagaaaggag

SEQ ID NO: 487030 - RNA, 14 nt, Human
uauuugaaauauug

SEQ ID NO: 487031 - RNA, 23 nt, Human
cuucaacucccugccccccagcc

SEQ ID NO: 487032 - RNA, 13 nt, Human
uuuagugaaauau

SEQ ID NO: 487033 - RNA, 19 nt, Human
gcuuguauuccuuuuucuc

SEQ ID NO: 487034 - RNA, 12 nt, Human
gcugaugcaguu

SEQ ID NO: 487035 - RNA, 17 nt, Human
ucagacauagaauuaac

SEQ ID NO: 487036 - RNA, 14 nt, Human
aaaacuuauuggaa

SEQ ID NO: 487037 - RNA, 22 nt, Human
gaugcaguuguugcccacagcu

SEQ ID NO: 487038 - RNA, 23 nt, Human
uacaaaugggaaacaaaaggaua

SEQ ID NO: 487039 - RNA, 13 nt, Human
uaugaaauauuau

SEQ ID NO: 487040 - RNA, 14 nt, Human
cuacagaacuaaaa

SEQ ID NO: 487041 - RNA, 19 nt, Human
cugucucaaaaaauaaaaa

SEQ ID NO: 487042 - RNA, 22 nt, Human
gccugguguguucaagaccagc

SEQ ID NO: 487043 - RNA, 18 nt, Human
uaauuauguucuaagugc

SEQ ID NO: 487044 - RNA, 14 nt, Human
aagcaucacaugaa

SEQ ID NO: 487045 - RNA, 17 nt, Human
gaaguugcagugagcug

SEQ ID NO: 487046 - RNA, 20 nt, Human
ucuucauagcagauuuuaau

SEQ ID NO: 487047 - RNA, 23 nt, Human
caaaagcgauuauuauuuuagag

SEQ ID NO: 487048 - RNA, 17 nt, Human
caaaacuuauuggaaug

SEQ ID NO: 487049 - RNA, 14 nt, Human
agucucccucccuu

SEQ ID NO: 487050 - RNA, 18 nt, Human
ucuucuggguuccuuccu

SEQ ID NO: 487051 - RNA, 18 nt, Human
cagauuugagcucagccc

SEQ ID NO: 487052 - RNA, 18 nt, Human
agagaaugagagacacac

SEQ ID NO: 487053 - RNA, 19 nt, Human
auccuacaagacacaguga

SEQ ID NO: 487054 - RNA, 11 nt, Human
cauaugaaaag

SEQ ID NO: 487055 - RNA, 21 nt, Human
uccagccuucucucaaggaga

SEQ ID NO: 487056 - RNA, 11 nt, Human
aauauuauaau

SEQ ID NO: 487057 - RNA, 18 nt, Human
gccugggcaacaugguga

SEQ ID NO: 487058 - RNA, 15 nt, Human
ccucauguccacugg

SEQ ID NO: 487059 - RNA, 19 nt, Human
uccauccugaggcuccacu

SEQ ID NO: 487060 - RNA, 15 nt, Human
aguucugaagaagau

SEQ ID NO: 487061 - RNA, 15 nt, Human
cacaggacagcccuu

SEQ ID NO: 487062 - RNA, 16 nt, Human
auccuugaagauuuac

SEQ ID NO: 487063 - RNA, 17 nt, Human
uucacuguaaaauaaua

SEQ ID NO: 487064 - RNA, 16 nt, Human
gccaaauguaaaauag

SEQ ID NO: 487065 - RNA, 17 nt, Human
ucucuggccuucggccu

SEQ ID NO: 487066 - RNA, 13 nt, Human
aucucaauauuuc

SEQ ID NO: 487067 - RNA, 19 nt, Human
augaaagcagggacuugaa

SEQ ID NO: 487068 - RNA, 18 nt, Human
gagccucagucucccucc

SEQ ID NO: 487069 - RNA, 16 nt, Human
cuccaccuuacuucuu

SEQ ID NO: 487070 - RNA, 13 nt, Human
auaacuggaaacu

SEQ ID NO: 487071 - RNA, 15 nt, Human
ucacaggacagcccu

SEQ ID NO: 487072 - RNA, 13 nt, Human
uuugguucuaaua

SEQ ID NO: 487073 - RNA, 18 nt, Human
cauuauggauaaagauga

SEQ ID NO: 487074 - RNA, 21 nt, Human
uuuuauggcacuaguauuucu

SEQ ID NO: 487075 - RNA, 18 nt, Human
auguuccuuuuaaagaaa

SEQ ID NO: 487076 - RNA, 17 nt, Human
cagcagugccaaaauau

SEQ ID NO: 487077 - RNA, 15 nt, Human
ugcuguauuuuaaaa

SEQ ID NO: 487078 - RNA, 18 nt, Human
caugccccuguacuccag

SEQ ID NO: 487079 - RNA, 13 nt, Human
caacucccugccc

SEQ ID NO: 487080 - RNA, 22 nt, Human
agacccugucucaauaaauaaa

SEQ ID NO: 487081 - RNA, 14 nt, Human
gucucaauaaauaa

SEQ ID NO: 487082 - RNA, 14 nt, Human
uuaugauuaaguaa

SEQ ID NO: 487083 - RNA, 15 nt, Human
uggacucaccucccc

SEQ ID NO: 487084 - RNA, 19 nt, Human
acuggacucaccuccccca

SEQ ID NO: 487085 - RNA, 16 nt, Human
uucaguuauuauauuu

SEQ ID NO: 487086 - RNA, 17 nt, Human
aagcuuuuuuugaauca

SEQ ID NO: 487087 - RNA, 16 nt, Human
cacuaguauuucuaug

SEQ ID NO: 487088 - RNA, 22 nt, Human
uguugcccacagcuguaugauu

SEQ ID NO: 487089 - RNA, 19 nt, Human
cucaccucccccaucucuu

SEQ ID NO: 487090 - RNA, 17 nt, Human
cucguggaacaguuacc

SEQ ID NO: 487091 - RNA, 15 nt, Human
ccacaggaaccacaa

SEQ ID NO: 487092 - RNA, 11 nt, Human
aaauaaauaaa

SEQ ID NO: 487093 - RNA, 23 nt, Human
agcccuccuuaucaaaggacacc

SEQ ID NO: 487094 - RNA, 13 nt, Human
ugaaaaucuuaua

SEQ ID NO: 487095 - RNA, 19 nt, Human
aaucagagauaaagcuuag

SEQ ID NO: 487096 - RNA, 15 nt, Human
gacaguauggcagcu

SEQ ID NO: 487097 - RNA, 20 nt, Human
auuauaauuuuuuucaauau

SEQ ID NO: 487098 - RNA, 12 nt, Human
cuacagugagcc

SEQ ID NO: 487099 - RNA, 15 nt, Human
gaagauguagaggag

SEQ ID NO: 487100 - RNA, 20 nt, Human
ucugcaacuacuauccaacu

SEQ ID NO: 487101 - RNA, 23 nt, Human
uuuuauagcuacuaauuuuaaaa

SEQ ID NO: 487102 - RNA, 20 nt, Human
ccugccuaagugcagccccg

SEQ ID NO: 487103 - RNA, 13 nt, Human
uuccccuaaccuc

SEQ ID NO: 487104 - RNA, 18 nt, Human
ucacgccuguaaucccag

SEQ ID NO: 487105 - RNA, 22 nt, Human
agaaagugacaagcucacagac

SEQ ID NO: 487106 - RNA, 22 nt, Human
aggacaccauuuuggcaagcuc

SEQ ID NO: 487107 - RNA, 11 nt, Human
auuuuugaagc

SEQ ID NO: 487108 - RNA, 16 nt, Human
agagguccacaacaca

SEQ ID NO: 487109 - RNA, 15 nt, Human
aagcacuaaacaaag

SEQ ID NO: 487110 - RNA, 14 nt, Human
ugagaugcuagaac

SEQ ID NO: 487111 - RNA, 19 nt, Human
aagcauuccaacuaucuca

SEQ ID NO: 487112 - RNA, 18 nt, Human
acugagcuucucugugaa

SEQ ID NO: 487113 - RNA, 23 nt, Human
ggucucagugucaaugcagcccc

SEQ ID NO: 487114 - RNA, 12 nt, Human
auaaaaacaaag

SEQ ID NO: 487115 - RNA, 16 nt, Human
acauuuauauuuuugu

SEQ ID NO: 487116 - RNA, 14 nt, Human
aggcugaggcaaga

SEQ ID NO: 487117 - RNA, 20 nt, Human
auguuccuuuuaaagaaaca

SEQ ID NO: 487118 - RNA, 13 nt, Human
aaauaaaaauaau

SEQ ID NO: 487119 - RNA, 13 nt, Human
gguauuugagugu

SEQ ID NO: 487120 - RNA, 22 nt, Human
acacauaucaaacugaaacaaa

SEQ ID NO: 487121 - RNA, 14 nt, Human
gaaagcagaacagu

SEQ ID NO: 487122 - RNA, 14 nt, Human
augggccauaugaa

SEQ ID NO: 487123 - RNA, 17 nt, Human
acccacuggacucaccu

SEQ ID NO: 487124 - RNA, 22 nt, Human
aauuuuuucucuaggaaauauu

SEQ ID NO: 487125 - RNA, 12 nt, Human
auauuauaauuu

SEQ ID NO: 487126 - RNA, 13 nt, Human
gcuguugagcugu

SEQ ID NO: 487127 - RNA, 12 nt, Human
uaaaaauuaaaa

SEQ ID NO: 487128 - RNA, 23 nt, Human
ucggccuccauccugaggcucca

SEQ ID NO: 487129 - RNA, 13 nt, Human
aauaaaaauaaau

SEQ ID NO: 487130 - RNA, 22 nt, Human
caucucuucuggguuccuuccu

SEQ ID NO: 487131 - RNA, 14 nt, Human
gagcucagcccugg

SEQ ID NO: 487132 - RNA, 20 nt, Human
uuaacacaugauccugcaau

SEQ ID NO: 487133 - RNA, 13 nt, Human
uuggacgagaaaa

SEQ ID NO: 487134 - RNA, 22 nt, Human
gugugaccacugcagaagacag

SEQ ID NO: 487135 - RNA, 20 nt, Human
acaugagguacugagaguga

SEQ ID NO: 487136 - RNA, 15 nt, Human
ugguuuagaaagcuu

SEQ ID NO: 487137 - RNA, 15 nt, Human
agccgggcauggugg

SEQ ID NO: 487138 - RNA, 19 nt, Human
aacugaaacaaaauuagaa

SEQ ID NO: 487139 - RNA, 19 nt, Human
aaugaauggcuaagcaaaa

SEQ ID NO: 487140 - RNA, 16 nt, Human
aaaagcaucacaugaa

SEQ ID NO: 487141 - RNA, 20 nt, Human
agcaucucauuuauaaugua

SEQ ID NO: 487142 - RNA, 18 nt, Human
agauccccaagccuggca

SEQ ID NO: 487143 - RNA, 23 nt, Human
uguaaucccagcuacuugggagg

SEQ ID NO: 487144 - RNA, 16 nt, Human
gcuucacuguaaaaua

SEQ ID NO: 487145 - RNA, 15 nt, Human
gucucuacauaaaau

SEQ ID NO: 487146 - RNA, 18 nt, Human
aacaaugcuguauuuuaa

SEQ ID NO: 487147 - RNA, 18 nt, Human
uggagggaagccuugggg

SEQ ID NO: 487148 - RNA, 22 nt, Human
agaaaccuuauuguaccucucu

SEQ ID NO: 487149 - RNA, 14 nt, Human
agacaucaacagau

SEQ ID NO: 487150 - RNA, 22 nt, Human
ugauaguuguaccgcaauguga

SEQ ID NO: 487151 - RNA, 10 nt, Human
accugagccc

SEQ ID NO: 487152 - RNA, 15 nt, Human
cauuccaagccucau

SEQ ID NO: 487153 - RNA, 22 nt, Human
gaggggagcaugggaagugacg

SEQ ID NO: 487154 - RNA, 16 nt, Human
cacaucaggaaagaga

SEQ ID NO: 487155 - RNA, 17 nt, Human
auuuucuauaauuuaaa

SEQ ID NO: 487156 - RNA, 20 nt, Human
uauacugugugcuaaaacaa

SEQ ID NO: 487157 - RNA, 16 nt, Human
cugaucaccugcccug

SEQ ID NO: 487158 - RNA, 18 nt, Human
uuuauggcacuaguauuu

SEQ ID NO: 487159 - RNA, 18 nt, Human
caugaauuaguuuuauau

SEQ ID NO: 487160 - RNA, 13 nt, Human
caaaaaaaaaccc

SEQ ID NO: 487161 - RNA, 16 nt, Human
ucaaaaaauaaaaaua

SEQ ID NO: 487162 - RNA, 12 nt, Human
uauucacaagac

SEQ ID NO: 487163 - RNA, 19 nt, Human
gaaagaaaauaacaauaaa

SEQ ID NO: 487164 - RNA, 18 nt, Human
ugaacuugguuuuaauua

SEQ ID NO: 487165 - RNA, 18 nt, Human
acucuaggacauaaauua

SEQ ID NO: 487166 - RNA, 14 nt, Human
caaaugcauuucua

SEQ ID NO: 487167 - RNA, 14 nt, Human
aaauauuauuuuau

SEQ ID NO: 487168 - RNA, 17 nt, Human
ucugugagaugcuagaa

SEQ ID NO: 487169 - RNA, 15 nt, Human
cuuuggggagccaac

SEQ ID NO: 487170 - RNA, 16 nt, Human
ugagaugcuagaacuc

SEQ ID NO: 487171 - RNA, 20 nt, Human
aaagaaaggagauacagugg

SEQ ID NO: 487172 - RNA, 15 nt, Human
acaaggaaaaaauaa

SEQ ID NO: 487173 - RNA, 23 nt, Human
aaguauccuucagccugaaagag

SEQ ID NO: 487174 - RNA, 17 nt, Human
agugauuaccagggacu

SEQ ID NO: 487175 - RNA, 13 nt, Human
acggggugaaacc

SEQ ID NO: 487176 - RNA, 20 nt, Human
ugagucccaggcugagccuc

SEQ ID NO: 487177 - RNA, 20 nt, Human
auuacccccagcuuugagga

SEQ ID NO: 487178 - RNA, 12 nt, Human
cuugguuuuaau

SEQ ID NO: 487179 - RNA, 23 nt, Human
aauaggcugaugggcaaaaaacc

SEQ ID NO: 487180 - RNA, 15 nt, Human
agccugaaagaggaa

SEQ ID NO: 487181 - RNA, 16 nt, Human
aauugacccacaagaa

SEQ ID NO: 487182 - RNA, 16 nt, Human
uaaaugaaauugaaaa

SEQ ID NO: 487183 - RNA, 19 nt, Human
aauuuuuauauuugaaaua

SEQ ID NO: 487184 - RNA, 21 nt, Human
ugucucuaccaaaaaaaggaa

SEQ ID NO: 487185 - RNA, 15 nt, Human
cugcacuccagccug

SEQ ID NO: 487186 - RNA, 13 nt, Human
aaaauaacgauaa

SEQ ID NO: 487187 - RNA, 16 nt, Human
acgccuguaaucccag

SEQ ID NO: 487188 - RNA, 18 nt, Human
auggcuugaguuuaaauu

SEQ ID NO: 487189 - RNA, 21 nt, Human
ucaugccccuguacuccagcc

SEQ ID NO: 487190 - RNA, 16 nt, Human
agauaaggcuguucuu

SEQ ID NO: 487191 - RNA, 20 nt, Human
cccugccccccagcccuccu

SEQ ID NO: 487192 - RNA, 14 nt, Human
gauuaguacacacu

SEQ ID NO: 487193 - RNA, 20 nt, Human
cuacuuccccuuccuaauuc

SEQ ID NO: 487194 - RNA, 16 nt, Human
ugugagaugcuagaac

SEQ ID NO: 487195 - RNA, 23 nt, Human
ucuaccaaaaaucucaauauuuc

SEQ ID NO: 487196 - RNA, 19 nt, Human
caacucccugccccccagc

SEQ ID NO: 487197 - RNA, 15 nt, Human
accucccccaucucu

SEQ ID NO: 487198 - RNA, 22 nt, Human
cgaggugggcagaucacuugag

SEQ ID NO: 487199 - RNA, 12 nt, Human
gaagaccucauu

SEQ ID NO: 487200 - RNA, 13 nt, Human
acaagagcuuaac

SEQ ID NO: 487201 - RNA, 19 nt, Human
acuccauuaaauauaaagc

SEQ ID NO: 487202 - RNA, 22 nt, Human
cuucagccugaaagaggaauga

SEQ ID NO: 487203 - RNA, 22 nt, Human
ccccuuccuaauuccacagcug

SEQ ID NO: 487204 - RNA, 17 nt, Human
uccugccccugagccca

SEQ ID NO: 487205 - RNA, 16 nt, Human
caaccuaaauuugguu

SEQ ID NO: 487206 - RNA, 20 nt, Human
ccagugagacagcucugcau

SEQ ID NO: 487207 - RNA, 15 nt, Human
agaauaccacaggaa

SEQ ID NO: 487208 - RNA, 15 nt, Human
aaauaauuuuuauau

SEQ ID NO: 487209 - RNA, 23 nt, Human
augucaauucuugccaaauauaa

SEQ ID NO: 487210 - RNA, 16 nt, Human
aaguauaggccaggca

SEQ ID NO: 487211 - RNA, 16 nt, Human
gucucuacauaaaaua

SEQ ID NO: 487212 - RNA, 14 nt, Human
gagacacugucucu

SEQ ID NO: 487213 - RNA, 17 nt, Human
aggguguguaaguagau

SEQ ID NO: 487214 - RNA, 13 nt, Human
ucuaccaaaaaaa

SEQ ID NO: 487215 - RNA, 21 nt, Human
gccuuuucccaacuccagaaa

SEQ ID NO: 487216 - RNA, 14 nt, Human
aaaauacaaaaaaa

SEQ ID NO: 487217 - RNA, 19 nt, Human
ccuccauccugaggcucca

SEQ ID NO: 487218 - RNA, 14 nt, Human
uugcagugagcuga

SEQ ID NO: 487219 - RNA, 15 nt, Human
uucacauuuaaauaa

SEQ ID NO: 487220 - RNA, 12 nt, Human
cuacauaaaaua

SEQ ID NO: 487221 - RNA, 14 nt, Human
uuauuauauuuaca

SEQ ID NO: 487222 - RNA, 22 nt, Human
gcuaaaacaagcacuaaacaaa

SEQ ID NO: 487223 - RNA, 21 nt, Human
ugccuguaaucacagcuacuu

SEQ ID NO: 487224 - RNA, 22 nt, Human
caagacucugucucaaaaaaua

SEQ ID NO: 487225 - RNA, 15 nt, Human
acaagacccaaaagg

SEQ ID NO: 487226 - RNA, 18 nt, Human
aacuagaauuuauucaau

SEQ ID NO: 487227 - RNA, 15 nt, Human
gccccauucaacauc

SEQ ID NO: 487228 - RNA, 20 nt, Human
ggcaggaggaucacuugagc

SEQ ID NO: 487229 - RNA, 13 nt, Human
aagugcagccccg

SEQ ID NO: 487230 - RNA, 14 nt, Human
cuuuacagaaagau

SEQ ID NO: 487231 - RNA, 20 nt, Human
acaagacacagugaccauac

SEQ ID NO: 487232 - RNA, 16 nt, Human
uggggauagugaggca

SEQ ID NO: 487233 - RNA, 18 nt, Human
gaaacaaaaggauaauga

SEQ ID NO: 487234 - RNA, 16 nt, Human
uaaugaauacuuuaua

SEQ ID NO: 487235 - RNA, 15 nt, Human
acagugaaagaaaau

SEQ ID NO: 487236 - RNA, 19 nt, Human
gauaaagcuuaggucaaag

SEQ ID NO: 487237 - RNA, 19 nt, Human
cagcuacuugggaggcuga

SEQ ID NO: 487238 - RNA, 13 nt, Human
ccuccuuuuaaag

SEQ ID NO: 487239 - RNA, 23 nt, Human
uguugcccacagcuguaugauuc

SEQ ID NO: 487240 - RNA, 16 nt, Human
ugagcucaggagguca

SEQ ID NO: 487241 - RNA, 12 nt, Human
uauuauuuuuua

SEQ ID NO: 487242 - RNA, 21 nt, Human
aaauaauuuuuauauuugaaa

SEQ ID NO: 487243 - RNA, 14 nt, Human
ugagcuugcagaga

SEQ ID NO: 487244 - RNA, 11 nt, Human
gaguuucucua

SEQ ID NO: 487245 - RNA, 22 nt, Human
gaugcaguucugaagaagaugg

SEQ ID NO: 487246 - RNA, 14 nt, Human
gggcaagagagcga

SEQ ID NO: 487247 - RNA, 14 nt, Human
acauagugaggagc

SEQ ID NO: 487248 - RNA, 17 nt, Human
gaaacaaaaaucaaacu

SEQ ID NO: 487249 - RNA, 23 nt, Human
uccaacuaucucauuuccaagca

SEQ ID NO: 487250 - RNA, 16 nt, Human
ccacuuggucugugag

SEQ ID NO: 487251 - RNA, 22 nt, Human
uauuccuuuuucucuccucucc

SEQ ID NO: 487252 - RNA, 20 nt, Human
aucuacaugucuagagaaca

SEQ ID NO: 487253 - RNA, 18 nt, Human
ucucuaggaaauauuuau

SEQ ID NO: 487254 - RNA, 16 nt, Human
accuuauuguaccucu

SEQ ID NO: 487255 - RNA, 16 nt, Human
aacagaagcuuccauu

SEQ ID NO: 487256 - RNA, 23 nt, Human
gaaugagagacacacugaagaag

SEQ ID NO: 487257 - RNA, 20 nt, Human
aacaaugcuguauuuuaaaa

SEQ ID NO: 487258 - RNA, 19 nt, Human
aaauaugccccauucaaca

SEQ ID NO: 487259 - RNA, 19 nt, Human
cggccuccauccugaggcu

SEQ ID NO: 487260 - RNA, 16 nt, Human
ugaugggcaaaaaacc

SEQ ID NO: 487261 - RNA, 22 nt, Human
ugaguuuuucuuuucauuuacc

SEQ ID NO: 487262 - RNA, 20 nt, Human
caagccuccuuuuaaaguaa

SEQ ID NO: 487263 - RNA, 14 nt, Human
uccagauccuggaa

SEQ ID NO: 487264 - RNA, 15 nt, Human
uagggugauauuaac

SEQ ID NO: 487265 - RNA, 14 nt, Human
acccgggaggcaga

SEQ ID NO: 487266 - RNA, 23 nt, Human
gaaaaucuuauaauuuaaaauau

SEQ ID NO: 487267 - RNA, 23 nt, Human
uggcuugaguuuaaauuguaaua

SEQ ID NO: 487268 - RNA, 21 nt, Human
cccuauccuacuuccccuucc

SEQ ID NO: 487269 - RNA, 23 nt, Human
agcaugucgucaaagcugaaaug

SEQ ID NO: 487270 - RNA, 20 nt, Human
uauuuauuacuguaagaaaa

SEQ ID NO: 487271 - RNA, 17 nt, Human
caaauaagucaucugau

SEQ ID NO: 487272 - RNA, 16 nt, Human
caugggacagggagga

SEQ ID NO: 487273 - RNA, 22 nt, Human
cugccagaaucuagagcaaagc

SEQ ID NO: 487274 - RNA, 15 nt, Human
ccaccuuacuucuuc

SEQ ID NO: 487275 - RNA, 23 nt, Human
gaucuacaugucuagagaacacu

SEQ ID NO: 487276 - RNA, 18 nt, Human
gcuacagugagccaagag

SEQ ID NO: 487277 - RNA, 18 nt, Human
acugacucuuaagaagac

SEQ ID NO: 487278 - RNA, 15 nt, Human
cgagacccugucuca

SEQ ID NO: 487279 - RNA, 20 nt, Human
ugaaaaucuuauaauuuaaa

SEQ ID NO: 487280 - RNA, 22 nt, Human
ugaauggcuaagcaaaauguga

SEQ ID NO: 487281 - RNA, 22 nt, Human
uuauuuauaacaaccuaaauuu

SEQ ID NO: 487282 - RNA, 22 nt, Human
ugaccauacuaauuauaccccc

SEQ ID NO: 487283 - RNA, 20 nt, Human
gacauuugcucauggaauug

SEQ ID NO: 487284 - RNA, 22 nt, Human
cugggacaggggagaaccuagg

SEQ ID NO: 487285 - RNA, 23 nt, Human
uuuccaucaaggguacacugccu

SEQ ID NO: 487286 - RNA, 19 nt, Human
auuuucaguuauuauauuu

SEQ ID NO: 487287 - RNA, 21 nt, Human
cuaagcuucacuguaaaauaa

SEQ ID NO: 487288 - RNA, 12 nt, Human
aucguguccccu

SEQ ID NO: 487289 - RNA, 17 nt, Human
agaauugcuugaaccca

SEQ ID NO: 487290 - RNA, 19 nt, Human
uggaaauguuuacagaucc

SEQ ID NO: 487291 - RNA, 23 nt, Human
gggaaacaaaaggauaaugaaua

SEQ ID NO: 487292 - RNA, 12 nt, Human
gaauuggagcuc

SEQ ID NO: 487293 - RNA, 15 nt, Human
ucaaaggacaccauu

SEQ ID NO: 487294 - RNA, 14 nt, Human
uugggaaaaaguaa

SEQ ID NO: 487295 - RNA, 16 nt, Human
ucaaacuuuacagaaa

SEQ ID NO: 487296 - RNA, 22 nt, Human
aagagccuuuuuuugaaaaaaa

SEQ ID NO: 487297 - RNA, 15 nt, Human
uccaccuuacuucuu

SEQ ID NO: 487298 - RNA, 17 nt, Human
cgauaaaagacagugaa

SEQ ID NO: 487299 - RNA, 16 nt, Human
uggucugugagaugcu

SEQ ID NO: 487300 - RNA, 20 nt, Human
cuucaacucccugcccccca

SEQ ID NO: 487301 - RNA, 14 nt, Human
ugcuggagcucugc

SEQ ID NO: 487302 - RNA, 11 nt, Human
cccaacagcuc

SEQ ID NO: 487303 - RNA, 18 nt, Human
uuacuguaagaaaauauc

SEQ ID NO: 487304 - RNA, 20 nt, Human
aaggaugccccgucccccuc

SEQ ID NO: 487305 - RNA, 13 nt, Human
gauuguaaaaugg

SEQ ID NO: 487306 - RNA, 12 nt, Human
cauagaaguaaa

SEQ ID NO: 487307 - RNA, 23 nt, Human
ugaaaaucuuauaauuuaaaaua

SEQ ID NO: 487308 - RNA, 15 nt, Human
auuugaguguuuuaa

SEQ ID NO: 487309 - RNA, 16 nt, Human
uuaauaauuuuuaauu

SEQ ID NO: 487310 - RNA, 19 nt, Human
gagccucagucucccuccc

SEQ ID NO: 487311 - RNA, 14 nt, Human
gagagugaacaaau

SEQ ID NO: 487312 - RNA, 15 nt, Human
uaacgauaaaagaca

SEQ ID NO: 487313 - RNA, 15 nt, Human
cccuguacuccagcc

SEQ ID NO: 487314 - RNA, 22 nt, Human
caaggaugccccgucccccucu

SEQ ID NO: 487315 - RNA, 20 nt, Human
agcuuauugucuagugaaac

SEQ ID NO: 487316 - RNA, 14 nt, Human
cuaaacauaugaau

SEQ ID NO: 487317 - RNA, 14 nt, Human
uaauccuaaacaua

SEQ ID NO: 487318 - RNA, 20 nt, Human
uacaucccuuaccugggaaa

SEQ ID NO: 487319 - RNA, 19 nt, Human
acauauagcagcucuugaa

SEQ ID NO: 487320 - RNA, 12 nt, Human
caacccaaaugu

SEQ ID NO: 487321 - RNA, 18 nt, Human
uuaacuagaauuuauuca

SEQ ID NO: 487322 - RNA, 12 nt, Human
cacaacacacag

SEQ ID NO: 487323 - RNA, 19 nt, Human
ggagccugaucaccugccc

SEQ ID NO: 487324 - RNA, 23 nt, Human
uaggauggcuaguaucaaaagaa

SEQ ID NO: 487325 - RNA, 16 nt, Human
caaauauaaacagcaa

SEQ ID NO: 487326 - RNA, 14 nt, Human
agucugacuguuuc

SEQ ID NO: 487327 - RNA, 20 nt, Human
uuuaaggccaggcauggugg

SEQ ID NO: 487328 - RNA, 17 nt, Human
auuauuuuuuaaaaaaa

SEQ ID NO: 487329 - RNA, 13 nt, Human
aagaaaauaacga

SEQ ID NO: 487330 - RNA, 15 nt, Human
uuaauuuguaguguu

SEQ ID NO: 487331 - RNA, 20 nt, Human
augucgucaaagcugaaaug

SEQ ID NO: 487332 - RNA, 18 nt, Human
ccuaacugcuacaaauac

SEQ ID NO: 487333 - RNA, 18 nt, Human
aaaagacaaggaaaaaau

SEQ ID NO: 487334 - RNA, 13 nt, Human
gacaaggaaaaaa

SEQ ID NO: 487335 - RNA, 22 nt, Human
gagucccaggcugagccucagu

SEQ ID NO: 487336 - RNA, 15 nt, Human
gugaccacugcagaa

SEQ ID NO: 487337 - RNA, 19 nt, Human
auuaaguuuuuuuuuaaaa

SEQ ID NO: 487338 - RNA, 15 nt, Human
ugccccgucccccuc

SEQ ID NO: 487339 - RNA, 23 nt, Human
aaauuuacagagacagaaagcag

SEQ ID NO: 487340 - RNA, 20 nt, Human
auuacauuuguauaaaauaa

SEQ ID NO: 487341 - RNA, 13 nt, Human
aagaucagccugg

SEQ ID NO: 487342 - RNA, 19 nt, Human
agaucacuugagcucagga

SEQ ID NO: 487343 - RNA, 16 nt, Human
gccaugugcuaguaau

SEQ ID NO: 487344 - RNA, 20 nt, Human
ccaaguaaauguuuguccuu

SEQ ID NO: 487345 - RNA, 15 nt, Human
ggcaagcucuaucac

SEQ ID NO: 487346 - RNA, 23 nt, Human
uagauguauagguugaugguggu

SEQ ID NO: 487347 - RNA, 16 nt, Human
ugagcucagcccuggu

SEQ ID NO: 487348 - RNA, 12 nt, Human
cagauuuuccug

SEQ ID NO: 487349 - RNA, 21 nt, Human
guccccuauccuacuuccccu

SEQ ID NO: 487350 - RNA, 13 nt, Human
acuaauuuuaaaa

SEQ ID NO: 487351 - RNA, 22 nt, Human
cuacauaaaauacaaaaacuua

SEQ ID NO: 487352 - RNA, 23 nt, Human
ggaugguucccuugaugaagaag

SEQ ID NO: 487353 - RNA, 12 nt, Human
caggacagcccu

SEQ ID NO: 487354 - RNA, 14 nt, Human
uaacuaauuuuaac

SEQ ID NO: 487355 - RNA, 20 nt, Human
acggacgaaccuugaaaacu

SEQ ID NO: 487356 - RNA, 16 nt, Human
auuccaccuacaugag

SEQ ID NO: 487357 - RNA, 16 nt, Human
uucacauuuaaauaaa

SEQ ID NO: 487358 - RNA, 16 nt, Human
ucaaaagaaagaaaau

SEQ ID NO: 487359 - RNA, 22 nt, Human
ggcauuuaggccaugggacagg

SEQ ID NO: 487360 - RNA, 17 nt, Human
uaacgauaaaagacagu

SEQ ID NO: 487361 - RNA, 15 nt, Human
uaaauaaauaaaaac

SEQ ID NO: 487362 - RNA, 15 nt, Human
aaaauacaaaaaaaa

SEQ ID NO: 487363 - RNA, 19 nt, Human
agaaaauaacaauaaaaga

SEQ ID NO: 487364 - RNA, 16 nt, Human
aagcuucacuguaaaa

SEQ ID NO: 487365 - RNA, 22 nt, Human
aaggagaggcaaagaaaggaga

SEQ ID NO: 487366 - RNA, 22 nt, Human
aagaugagaugguuucuagaga

SEQ ID NO: 487367 - RNA, 22 nt, Human
agacucgggauuaguacacacu

SEQ ID NO: 487368 - RNA, 13 nt, Human
acagcccuucuuu

SEQ ID NO: 487369 - RNA, 20 nt, Human
uacuucuucucauacuauuu

SEQ ID NO: 487370 - RNA, 17 nt, Human
uaucaauuuaaaaaaaa

SEQ ID NO: 487371 - RNA, 17 nt, Human
uaucuuuuuuuuaauaa

SEQ ID NO: 487372 - RNA, 14 nt, Human
auacaaaaaaaaaa

SEQ ID NO: 487373 - RNA, 14 nt, Human
uauagaauauuuau

SEQ ID NO: 487374 - RNA, 16 nt, Human
ugcuaagucuuauaua

SEQ ID NO: 487375 - RNA, 21 nt, Human
auuuacaaaugggaaacaaaa

SEQ ID NO: 487376 - RNA, 15 nt, Human
accuguaaucccagc

SEQ ID NO: 487377 - RNA, 21 nt, Human
ugcccauccugccccugagcc

SEQ ID NO: 487378 - RNA, 13 nt, Human
uaacaauaaaaga

SEQ ID NO: 487379 - RNA, 19 nt, Human
acaauaacgauaaaagaca

SEQ ID NO: 487380 - RNA, 14 nt, Human
aaaaauacaaaaau

SEQ ID NO: 487381 - RNA, 16 nt, Human
aaaaauuccaagugau

SEQ ID NO: 487382 - RNA, 21 nt, Human
ccaagaagauaaucuccaaag

SEQ ID NO: 487383 - RNA, 18 nt, Human
uuguaaaggaauuuaaaa

SEQ ID NO: 487384 - RNA, 17 nt, Human
aagacaaggaaaaaaua

SEQ ID NO: 487385 - RNA, 14 nt, Human
uaaggauucugaga

SEQ ID NO: 487386 - RNA, 20 nt, Human
acagaaagauuugauguaug

SEQ ID NO: 487387 - RNA, 14 nt, Human
agacacugucucua

SEQ ID NO: 487388 - RNA, 19 nt, Human
cccugcaaagcccagcuug

SEQ ID NO: 487389 - RNA, 20 nt, Human
ccauacuaauuauacccccu

SEQ ID NO: 487390 - RNA, 18 nt, Human
gagucccaggcugagccu

SEQ ID NO: 487391 - RNA, 12 nt, Human
uugggaggcuga

SEQ ID NO: 487392 - RNA, 21 nt, Human
aauauaaagcaagauaauaaa

SEQ ID NO: 487393 - RNA, 15 nt, Human
agacaaggaaaaaau

SEQ ID NO: 487394 - RNA, 20 nt, Human
cccugcacuccagccugagc

SEQ ID NO: 487395 - RNA, 13 nt, Human
uucuaggccgggc

SEQ ID NO: 487396 - RNA, 16 nt, Human
cuuuaugcuaagugaa

SEQ ID NO: 487397 - RNA, 18 nt, Human
cuccauccugaggcucca

SEQ ID NO: 487398 - RNA, 22 nt, Human
auuuuaauuuugaauaaauaaa

SEQ ID NO: 487399 - RNA, 23 nt, Human
ucuagcaugucgucaaagcugaa

SEQ ID NO: 487400 - RNA, 15 nt, Human
cuuacuucuucucau

SEQ ID NO: 487401 - RNA, 18 nt, Human
gaccccugagcuugcaga

SEQ ID NO: 487402 - RNA, 14 nt, Human
auccaaugaaauga

SEQ ID NO: 487403 - RNA, 21 nt, Human
uaaaagacagugaaagaaaau

SEQ ID NO: 487404 - RNA, 15 nt, Human
agggcucacagaauu

SEQ ID NO: 487405 - RNA, 14 nt, Human
uucuaugaaauauu

SEQ ID NO: 487406 - RNA, 17 nt, Human
aauaacgauaaaagaca

SEQ ID NO: 487407 - RNA, 15 nt, Human
auauugacuuuuuau

SEQ ID NO: 487408 - RNA, 18 nt, Human
gcaggaggaucacuugag

SEQ ID NO: 487409 - RNA, 23 nt, Human
cuaggaugggaacaaggaaggaa

SEQ ID NO: 487410 - RNA, 21 nt, Human
uuagauaaggcuguucuuuaa

SEQ ID NO: 487411 - RNA, 19 nt, Human
auuuacagagacagaaagc

SEQ ID NO: 487412 - RNA, 15 nt, Human
ucccccaucucuucu

SEQ ID NO: 487413 - RNA, 13 nt, Human
cugccuucucaac

SEQ ID NO: 487414 - RNA, 21 nt, Human
gaaaugaguuuuucuuuucau

SEQ ID NO: 487415 - RNA, 22 nt, Human
aaauaacaaugaaaguugauaa

SEQ ID NO: 487416 - RNA, 13 nt, Human
aacucuauaaugu

SEQ ID NO: 487417 - RNA, 19 nt, Human
auuguaguccuguaaugga

SEQ ID NO: 487418 - RNA, 16 nt, Human
auuugaugcuacagga

SEQ ID NO: 487419 - RNA, 15 nt, Human
uugacccacaagaaa

SEQ ID NO: 487420 - RNA, 19 nt, Human
ucaguuauuauauuuacaa

SEQ ID NO: 487421 - RNA, 20 nt, Human
auaucauagcaaauaaguca

SEQ ID NO: 487422 - RNA, 16 nt, Human
acuaaacaaagaguga

SEQ ID NO: 487423 - RNA, 12 nt, Human
aucuucagaaaa

SEQ ID NO: 487424 - RNA, 22 nt, Human
gucacaggaaguagaggaggcc

SEQ ID NO: 487425 - RNA, 21 nt, Human
aagaagcccaauauuauaauu

SEQ ID NO: 487426 - RNA, 20 nt, Human
gaaacauuugguaaggggaa

SEQ ID NO: 487427 - RNA, 15 nt, Human
aagaagugaaaaucu

SEQ ID NO: 487428 - RNA, 14 nt, Human
gccgggcauggugg

SEQ ID NO: 487429 - RNA, 18 nt, Human
cccacuggacucaccucc

SEQ ID NO: 487430 - RNA, 15 nt, Human
ucucaauaaauaaau

SEQ ID NO: 487431 - RNA, 15 nt, Human
aaaaaagaaacauuu

SEQ ID NO: 487432 - RNA, 17 nt, Human
agcagcucauaaaugaa

SEQ ID NO: 487433 - RNA, 13 nt, Human
aucuacacuccag

SEQ ID NO: 487434 - RNA, 18 nt, Human
ucucaaaaaauaaaaaua

SEQ ID NO: 487435 - RNA, 18 nt, Human
acauuuauauuuuuguga

SEQ ID NO: 487436 - RNA, 19 nt, Human
acagugauuaccagggacu

SEQ ID NO: 487437 - RNA, 15 nt, Human
ugggacagggaggac

SEQ ID NO: 487438 - RNA, 20 nt, Human
uguaagaaaauaucacuugu

SEQ ID NO: 487439 - RNA, 23 nt, Chlamydophila pneumoniae AR39
cgaauucucagaaagccuuugcu

SEQ ID NO: 487440 - RNA, 17 nt, Chlamydophila pneumoniae AR39
agagucucuugcuuuug

SEQ ID NO: 487441 - RNA, 14 nt, Chlamydophila pneumoniae AR39
uucgaauucucaga

SEQ ID NO: 487442 - RNA, 16 nt, Chlamydophila pneumoniae AR39
guagcaucucucucca

SEQ ID NO: 487443 - RNA, 24 nt, Chlamydophila pneumoniae AR39
aagcugagguagcaucucucucca

SEQ ID NO: 487444 - RNA, 20 nt, Chlamydophila pneumoniae AR39
gagucucuugcuuuuguaga

SEQ ID NO: 487445 - RNA, 20 nt, Chlamydophila pneumoniae AR39
cuagaaaacgcucuccuaga

SEQ ID NO: 487446 - RNA, 22 nt, Chlamydophila pneumoniae AR39
gcaacaguaauuauuuucuaca

SEQ ID NO: 487447 - RNA, 20 nt, Chlamydophila pneumoniae AR39
gagguagcaucucucuccaa

SEQ ID NO: 487448 - RNA, 18 nt, Chlamydophila pneumoniae AR39
gacucuuccaauuguaaa

SEQ ID NO: 487449 - RNA, 20 nt, Chlamydophila pneumoniae AR39
cucuagaaaacgcucuccua

SEQ ID NO: 487450 - RNA, 21 nt, Chlamydophila pneumoniae AR39
aucuucagcauagagagaagg

SEQ ID NO: 487451 - RNA, 17 nt, Chlamydophila pneumoniae AR39
ugcucacuguuuuucgu

SEQ ID NO: 487452 - RNA, 20 nt, Chlamydophila pneumoniae AR39
uccuucaaaauguuuaucga

SEQ ID NO: 487453 - RNA, 16 nt, Chlamydophila pneumoniae AR39
gcuuuuguagauuagg

SEQ ID NO: 487454 - RNA, 20 nt, Chlamydophila pneumoniae AR39
gaauucucagaaagccuuug

SEQ ID NO: 487455 - RNA, 15 nt, Chlamydophila pneumoniae AR39
cucacaagcauccua

SEQ ID NO: 487456 - RNA, 21 nt, Chlamydophila pneumoniae AR39
aaauguuuaucgacucuucca

SEQ ID NO: 487457 - RNA, 16 nt, Chlamydophila pneumoniae AR39
uuccaauuguaaauca

SEQ ID NO: 487458 - RNA, 20 nt, Chlamydophila pneumoniae AR39
uucagaugauuuuaucugcg

SEQ ID NO: 487459 - RNA, 15 nt, Chlamydophila pneumoniae AR39
uuauuuucuacacug

SEQ ID NO: 487460 - RNA, 16 nt, Chlamydophila pneumoniae AR39
ugaaguacauuaucac

SEQ ID NO: 487461 - RNA, 21 nt, Chlamydophila pneumoniae AR39
ugaaguacauuaucacagcaa

SEQ ID NO: 487462 - RNA, 19 nt, Chlamydophila pneumoniae AR39
ugaaguugagucgauuucc

SEQ ID NO: 487463 - RNA, 22 nt, Chlamydophila pneumoniae AR39
ugaaaauucgaauucucagaaa

SEQ ID NO: 487464 - RNA, 15 nt, Chlamydophila pneumoniae AR39
ucagcauagagagaa

SEQ ID NO: 487465 - RNA, 18 nt, Chlamydophila pneumoniae AR39
ucagcauagagagaagga

SEQ ID NO: 487466 - RNA, 16 nt, Chlamydophila pneumoniae AR39
uaucugcgacaaaaau

SEQ ID NO: 487467 - RNA, 22 nt, Chlamydophila pneumoniae AR39
uagguccguuuuuucagaugau

SEQ ID NO: 487468 - RNA, 19 nt, Chlamydophila pneumoniae AR39
uacacuguuguaauaaaau

SEQ ID NO: 487469 - RNA, 21 nt, Chlamydophila pneumoniae AR39
gcucuccuagacgaucuucag

SEQ ID NO: 487470 - RNA, 23 nt, Chlamydophila pneumoniae AR39
gcaaucugcagguaagggaugcu

SEQ ID NO: 487471 - RNA, 14 nt, Chlamydophila pneumoniae AR39
gaacuugggaugcu

SEQ ID NO: 487472 - RNA, 22 nt, Chlamydophila pneumoniae AR39
cuucagcauagagagaaggaau

SEQ ID NO: 487473 - RNA, 17 nt, Chlamydophila pneumoniae AR39
cuguuuuucguaagcug

SEQ ID NO: 487474 - RNA, 19 nt, Chlamydophila pneumoniae AR39
cucuagaaaacgcucuccu

SEQ ID NO: 487475 - RNA, 22 nt, Chlamydophila pneumoniae AR39
cucacuguuuuucguaagcuga

SEQ ID NO: 487476 - RNA, 19 nt, Chlamydophila pneumoniae AR39
cgugagaggaucgugaagu

SEQ ID NO: 487477 - RNA, 21 nt, Chlamydophila pneumoniae AR39
cguacgagaucagauguaaag

SEQ ID NO: 487478 - RNA, 14 nt, Chlamydophila pneumoniae AR39
cgacaaaaaugccu

SEQ ID NO: 487479 - RNA, 13 nt, Chlamydophila pneumoniae AR39
cgaauucucagaa

SEQ ID NO: 487480 - RNA, 17 nt, Chlamydophila pneumoniae AR39
caucucacaagcauccu

SEQ ID NO: 487481 - RNA, 23 nt, Chlamydophila pneumoniae AR39
cauagagagaaggaauuaaaaua

SEQ ID NO: 487482 - RNA, 16 nt, Chlamydophila pneumoniae AR39
caaguccgugagagga

SEQ ID NO: 487483 - RNA, 22 nt, Chlamydophila pneumoniae AR39
caaagagucucuugcuuuugua

SEQ ID NO: 487484 - RNA, 19 nt, Chlamydophila pneumoniae AR39
auucgaauucucagaaagc

SEQ ID NO: 487485 - RNA, 13 nt, Chlamydophila pneumoniae AR39
augcucuagaaaa

SEQ ID NO: 487486 - RNA, 22 nt, Chlamydophila pneumoniae AR39
aucgacucuuccaauuguaaau

SEQ ID NO: 487487 - RNA, 15 nt, Chlamydophila pneumoniae AR39
auaaaaucauguccu

SEQ ID NO: 487488 - RNA, 23 nt, Chlamydophila pneumoniae AR39
agcugagguagcaucucucucca

SEQ ID NO: 487489 - RNA, 14 nt, Chlamydophila pneumoniae AR39
agcaucucucucca

SEQ ID NO: 487490 - RNA, 13 nt, Chlamydophila pneumoniae AR39
agcauagagagaa

SEQ ID NO: 487491 - RNA, 19 nt, Chlamydophila pneumoniae AR39
agcaacaguaauuauuuuc

SEQ ID NO: 487492 - RNA, 20 nt, Chlamydophila pneumoniae AR39
acuguuguaauaaaaucaug

SEQ ID NO: 487493 - RNA, 23 nt, Chlamydophila pneumoniae AR39
acucuuccaauuguaaaucauug

SEQ ID NO: 487494 - RNA, 20 nt, Chlamydophila pneumoniae AR39
aauguuuaucgacucuucca

SEQ ID NO: 487495 - RNA, 18 nt, Chlamydophila pneumoniae AR39
aagauaguauuuuugaaa

SEQ ID NO: 487496 - RNA, 19 nt, Chlamydophila pneumoniae AR39
aagauaguauuuuugaaac

SEQ ID NO: 487497 - RNA, 13 nt, Chlamydophila pneumoniae AR39
aagauaguauuuu

SEQ ID NO: 487498 - RNA, 20 nt, Chlamydophila pneumoniae AR39
uuuccacguacgagaucaga

SEQ ID NO: 487499 - RNA, 23 nt, Chlamydophila pneumoniae AR39
uucguaagcugagguagcaucuc

SEQ ID NO: 487500 - RNA, 15 nt, Chlamydophila pneumoniae AR39
ugcgacaaaaaugcc

SEQ ID NO: 487501 - RNA, 17 nt, Chlamydophila pneumoniae AR39
ugccugaaaauucgaau

SEQ ID NO: 487502 - RNA, 21 nt, Chlamydophila pneumoniae AR39
ugagaggaucgugaaguacau

SEQ ID NO: 487503 - RNA, 19 nt, Chlamydophila pneumoniae AR39
ugaaaauucgaauucucag

SEQ ID NO: 487504 - RNA, 15 nt, Chlamydophila pneumoniae AR39
uccguuuuuucagau

SEQ ID NO: 487505 - RNA, 16 nt, Chlamydophila pneumoniae AR39
ucagaaagccuuugcu

SEQ ID NO: 487506 - RNA, 15 nt, Chlamydophila pneumoniae AR39
ucacagcaaucugca

SEQ ID NO: 487507 - RNA, 16 nt, Chlamydophila pneumoniae AR39
ucacagcaaucugcag

SEQ ID NO: 487508 - RNA, 18 nt, Chlamydophila pneumoniae AR39
uacgagaucagauguaaa

SEQ ID NO: 487509 - RNA, 21 nt, Chlamydophila pneumoniae AR39
aaaucauuggaaccauaggau

SEQ ID NO: 487510 - RNA, 13 nt, Chlamydophila pneumoniae AR39
gcaucucucucca

SEQ ID NO: 487511 - RNA, 22 nt, Chlamydophila pneumoniae AR39
gcauagagagaaggaauuaaaa

SEQ ID NO: 487512 - RNA, 20 nt, Chlamydophila pneumoniae AR39
gauuuuacucccugaaguug

SEQ ID NO: 487513 - RNA, 23 nt, Chlamydophila pneumoniae AR39
gaugcucuagaaaacgcucuccu

SEQ ID NO: 487514 - RNA, 14 nt, Chlamydophila pneumoniae AR39
gagcaacaguaauu

SEQ ID NO: 487515 - RNA, 11 nt, Chlamydophila pneumoniae AR39
gacaaaaaugc

SEQ ID NO: 487516 - RNA, 16 nt, Chlamydophila pneumoniae AR39
cuagaaaacgcucucc

SEQ ID NO: 487517 - RNA, 19 nt, Chlamydophila pneumoniae AR39
cuagaacuugggaugcuac

SEQ ID NO: 487518 - RNA, 16 nt, Chlamydophila pneumoniae AR39
cuagaacuugggaugc

SEQ ID NO: 487519 - RNA, 21 nt, Chlamydophila pneumoniae AR39
cuacacuguuguaauaaaauc

SEQ ID NO: 487520 - RNA, 16 nt, Chlamydophila pneumoniae AR39
aaagccuuugcucacu

SEQ ID NO: 487521 - RNA, 23 nt, Chlamydophila pneumoniae AR39
aaagagucucuugcuuuuguaga

SEQ ID NO: 487522 - RNA, 15 nt, Chlamydophila pneumoniae AR39
auucucagaaagccu

SEQ ID NO: 487523 - RNA, 19 nt, Chlamydophila pneumoniae AR39
auguccuucaaaauguuua

SEQ ID NO: 487524 - RNA, 22 nt, Chlamydophila pneumoniae AR39
aucugcgacaaaaaugccugaa

SEQ ID NO: 487525 - RNA, 13 nt, Chlamydophila pneumoniae AR39
aucgacucuucca

SEQ ID NO: 487526 - RNA, 18 nt, Chlamydophila pneumoniae AR39
aucagauguaaagagcaa

SEQ ID NO: 487527 - RNA, 19 nt, Chlamydophila pneumoniae AR39
aucagauguaaagagcaac

SEQ ID NO: 487528 - RNA, 20 nt, Chlamydophila pneumoniae AR39
aucagauguaaagagcaaca

SEQ ID NO: 487529 - RNA, 18 nt, Chlamydophila pneumoniae AR39
agucgauuucccagaagg

SEQ ID NO: 487530 - RNA, 22 nt, Chlamydophila pneumoniae AR39
agguaagggaugcucuagaaaa

SEQ ID NO: 487531 - RNA, 15 nt, Chlamydophila pneumoniae AR39
aggaagauaguauuu

SEQ ID NO: 487532 - RNA, 14 nt, Chlamydophila pneumoniae AR39
agcauagagagaag

SEQ ID NO: 487533 - RNA, 22 nt, Chlamydophila pneumoniae AR39
acucuuccaauuguaaaucauu

SEQ ID NO: 487534 - RNA, 22 nt, Chlamydophila pneumoniae AR39
aaaaaugccugaaaauucgaau

SEQ ID NO: 487535 - RNA, 19 nt, Chlamydophila pneumoniae AR39
aagccuuugcucacuguuu

SEQ ID NO: 487536 - RNA, 21 nt, Chlamydophila pneumoniae AR39
aagagcaacaguaauuauuuu

SEQ ID NO: 487537 - RNA, 14 nt, Chlamydophila pneumoniae AR39
aagagucucuugcu

SEQ ID NO: 487538 - RNA, 13 nt, Chlamydophila pneumoniae AR39
cgauuucccagaa

SEQ ID NO: 487539 - RNA, 15 nt, Chlamydophila pneumoniae AR39
cagaugauuuuaucu

SEQ ID NO: 487540 - RNA, 13 nt, Chlamydophila pneumoniae AR39
uuuguagauuagg

SEQ ID NO: 487541 - RNA, 12 nt, Chlamydophila pneumoniae AR39
uuuuacucccug

SEQ ID NO: 487542 - RNA, 16 nt, Chlamydophila pneumoniae AR39
uuuaucgacucuucca

SEQ ID NO: 487543 - RNA, 22 nt, Chlamydophila pneumoniae AR39
uucuacacuguuguaauaaaau

SEQ ID NO: 487544 - RNA, 17 nt, Chlamydophila pneumoniae AR39
uguuuaucgacucuucc

SEQ ID NO: 487545 - RNA, 23 nt, Chlamydophila pneumoniae AR39
uguaaagagcaacaguaauuauu

SEQ ID NO: 487546 - RNA, 15 nt, Chlamydophila pneumoniae AR39
ucugcagguaaggga

SEQ ID NO: 487547 - RNA, 20 nt, Chlamydophila pneumoniae AR39
ucugcagguaagggaugcuc

SEQ ID NO: 487548 - RNA, 21 nt, Chlamydophila pneumoniae AR39
ucuccaaagagucucuugcuu

SEQ ID NO: 487549 - RNA, 13 nt, Chlamydophila pneumoniae AR39
ucucagaaagccu

SEQ ID NO: 487550 - RNA, 18 nt, Chlamydophila pneumoniae AR39
ucucagaaagccuuugcu

SEQ ID NO: 487551 - RNA, 21 nt, Chlamydophila pneumoniae AR39
ucucagaaagccuuugcucac

SEQ ID NO: 487552 - RNA, 12 nt, Chlamydophila pneumoniae AR39
ucgacucuucca

SEQ ID NO: 487553 - RNA, 16 nt, Chlamydophila pneumoniae AR39
uccuagacgaucuuca

SEQ ID NO: 487554 - RNA, 20 nt, Chlamydophila pneumoniae AR39
ucccagaaggggaauaauau

SEQ ID NO: 487555 - RNA, 17 nt, Chlamydophila pneumoniae AR39
uccaauuguaaaucauu

SEQ ID NO: 487556 - RNA, 17 nt, Chlamydophila pneumoniae AR39
ucauguccuucaaaaug

SEQ ID NO: 487557 - RNA, 15 nt, Chlamydophila pneumoniae AR39
uagaacuugggaugc

SEQ ID NO: 487558 - RNA, 19 nt, Chlamydophila pneumoniae AR39
uagaacuugggaugcuacu

SEQ ID NO: 487559 - RNA, 15 nt, Chlamydophila pneumoniae AR39
gaugcuacuuuccac

SEQ ID NO: 487560 - RNA, 22 nt, Chlamydophila pneumoniae AR39
gauaguauuuuugaaaccaagg

SEQ ID NO: 487561 - RNA, 13 nt, Chlamydophila pneumoniae AR39
gagucgauuuccc

SEQ ID NO: 487562 - RNA, 15 nt, Chlamydophila pneumoniae AR39
gagucgauuucccag

SEQ ID NO: 487563 - RNA, 18 nt, Chlamydophila pneumoniae AR39
gagagaaggaauuaaaau

SEQ ID NO: 487564 - RNA, 13 nt, Chlamydophila pneumoniae AR39
gacaaaaaugccu

SEQ ID NO: 487565 - RNA, 16 nt, Chlamydophila pneumoniae AR39
cuuccaauuguaaauc

SEQ ID NO: 487566 - RNA, 20 nt, Chlamydophila pneumoniae AR39
cggauuuuacucccugaagu

SEQ ID NO: 487567 - RNA, 15 nt, Chlamydophila pneumoniae AR39
cauuaucacagcaau

SEQ ID NO: 487568 - RNA, 12 nt, Chlamydophila pneumoniae AR39
cagaugauuuua

SEQ ID NO: 487569 - RNA, 14 nt, Chlamydophila pneumoniae AR39
caagcauccuagaa

SEQ ID NO: 487570 - RNA, 22 nt, Chlamydophila pneumoniae AR39
auuuuaucugcgacaaaaaugc

SEQ ID NO: 487571 - RNA, 21 nt, Chlamydophila pneumoniae AR39
auuguaaaucauuggaaccau

SEQ ID NO: 487572 - RNA, 16 nt, Chlamydophila pneumoniae AR39
auguccuucaaaaugu

SEQ ID NO: 487573 - RNA, 19 nt, Chlamydophila pneumoniae AR39
aucugcgacaaaaaugccu

SEQ ID NO: 487574 - RNA, 19 nt, Chlamydophila pneumoniae AR39
aucugcagguaagggaugc

SEQ ID NO: 487575 - RNA, 12 nt, Chlamydophila pneumoniae AR39
aucggauuuuac

SEQ ID NO: 487576 - RNA, 20 nt, Chlamydophila pneumoniae AR39
aucggauuuuacucccugaa

SEQ ID NO: 487577 - RNA, 23 nt, Chlamydophila pneumoniae AR39
aguaauuauuuucuacacuguug

SEQ ID NO: 487578 - RNA, 15 nt, Chlamydophila pneumoniae AR39
agggaugcucuagaa

SEQ ID NO: 487579 - RNA, 22 nt, Chlamydophila pneumoniae AR39
aggauagguccguuuuuucaga

SEQ ID NO: 487580 - RNA, 14 nt, Chlamydophila pneumoniae AR39
aggaauuaaaauau

SEQ ID NO: 487581 - RNA, 17 nt, Chlamydophila pneumoniae AR39
agauguaaagagcaaca

SEQ ID NO: 487582 - RNA, 23 nt, Chlamydophila pneumoniae AR39
agaaagccuuugcucacuguuuu

SEQ ID NO: 487583 - RNA, 13 nt, Chlamydophila pneumoniae AR39
acaguaauuauuu

SEQ ID NO: 487584 - RNA, 14 nt, Chlamydophila pneumoniae AR39
aauucucagaaagc

SEQ ID NO: 487585 - RNA, 16 nt, Chlamydophila pneumoniae AR39
aauucucagaaagccu

SEQ ID NO: 487586 - RNA, 16 nt, Chlamydophila pneumoniae AR39
aauucgaauucucaga

SEQ ID NO: 487587 - RNA, 22 nt, Chlamydophila pneumoniae AR39
aaguacauuaucacagcaaucu

SEQ ID NO: 487588 - RNA, 18 nt, Chlamydophila pneumoniae AR39
aagcugagguagcaucuc

SEQ ID NO: 487589 - RNA, 19 nt, Chlamydophila pneumoniae AR39
uuuaucugcgacaaaaaug

SEQ ID NO: 487590 - RNA, 14 nt, Chlamydophila pneumoniae AR39
uuguaauaaaauca

SEQ ID NO: 487591 - RNA, 19 nt, Chlamydophila pneumoniae AR39
uucagaugauuuuaucugc

SEQ ID NO: 487592 - RNA, 15 nt, Chlamydophila pneumoniae AR39
uucagaugauuuuau

SEQ ID NO: 487593 - RNA, 16 nt, Chlamydophila pneumoniae AR39
uguuguaauaaaauca

SEQ ID NO: 487594 - RNA, 22 nt, Chlamydophila pneumoniae AR39
ugaaguugagucgauuucccag

SEQ ID NO: 487595 - RNA, 23 nt, Chlamydophila pneumoniae AR39
ucugcagguaagggaugcucuag

SEQ ID NO: 487596 - RNA, 16 nt, Chlamydophila pneumoniae AR39
ucucacaagcauccua

SEQ ID NO: 487597 - RNA, 20 nt, Chlamydophila pneumoniae AR39
ucuacacuguuguaauaaaa

SEQ ID NO: 487598 - RNA, 16 nt, Chlamydophila pneumoniae AR39
uccaauuguaaaucau

SEQ ID NO: 487599 - RNA, 13 nt, Chlamydophila pneumoniae AR39
ucauguccuucaa

SEQ ID NO: 487600 - RNA, 21 nt, Chlamydophila pneumoniae AR39
ucaucucacaagcauccuaga

SEQ ID NO: 487601 - RNA, 18 nt, Chlamydophila pneumoniae AR39
ucacuguuuuucguaagc

SEQ ID NO: 487602 - RNA, 20 nt, Chlamydophila pneumoniae AR39
uauccaaguccgugagagga

SEQ ID NO: 487603 - RNA, 14 nt, Chlamydophila pneumoniae AR39
uagcaucucucucc

SEQ ID NO: 487604 - RNA, 19 nt, Chlamydophila pneumoniae AR39
uagagagaaggaauuaaaa

SEQ ID NO: 487605 - RNA, 14 nt, Chlamydophila pneumoniae AR39
uagauuaggaagau

SEQ ID NO: 487606 - RNA, 23 nt, Chlamydophila pneumoniae AR39
uacacuguuguaauaaaaucaug

SEQ ID NO: 487607 - RNA, 18 nt, Chlamydophila pneumoniae AR39
uaaaauaucggauuuuac

SEQ ID NO: 487608 - RNA, 22 nt, Chlamydophila pneumoniae AR39
guaauuauuuucuacacuguug

SEQ ID NO: 487609 - RNA, 12 nt, Chlamydophila pneumoniae AR39
guaagggaugcu

SEQ ID NO: 487610 - RNA, 21 nt, Chlamydophila pneumoniae AR39
guaaaucauuggaaccauagg

SEQ ID NO: 487611 - RNA, 21 nt, Chlamydophila pneumoniae AR39
gaaagccuuugcucacuguuu

SEQ ID NO: 487612 - RNA, 14 nt, Chlamydophila pneumoniae AR39
cuuuuguagauuag

SEQ ID NO: 487613 - RNA, 20 nt, Chlamydophila pneumoniae AR39
cuuuccacguacgagaucag

SEQ ID NO: 487614 - RNA, 18 nt, Chlamydophila pneumoniae AR39
cuucaaaauguuuaucga

SEQ ID NO: 487615 - RNA, 17 nt, Chlamydophila pneumoniae AR39
cugcagguaagggaugc

SEQ ID NO: 487616 - RNA, 21 nt, Chlamydophila pneumoniae AR39
aaaucauguccuucaaaaugu

SEQ ID NO: 487617 - RNA, 13 nt, Chlamydophila pneumoniae AR39
aaaugccugaaaa

SEQ ID NO: 487618 - RNA, 18 nt, Chlamydophila pneumoniae AR39
aaauucgaauucucagaa

SEQ ID NO: 487619 - RNA, 22 nt, Chlamydophila pneumoniae AR39
caagcauccuagaacuugggau

SEQ ID NO: 487620 - RNA, 13 nt, Chlamydophila pneumoniae AR39
caacaguaauuau

SEQ ID NO: 487621 - RNA, 15 nt, Chlamydophila pneumoniae AR39
caacaguaauuauuu

SEQ ID NO: 487622 - RNA, 14 nt, Chlamydophila pneumoniae AR39
caaaauguuuaucg

SEQ ID NO: 487623 - RNA, 22 nt, Chlamydophila pneumoniae AR39
caaaauguuuaucgacucuucc

SEQ ID NO: 487624 - RNA, 16 nt, Chlamydophila pneumoniae AR39
aucacagcaaucugca

SEQ ID NO: 487625 - RNA, 20 nt, Chlamydophila pneumoniae AR39
auaguauuuuugaaaccaag

SEQ ID NO: 487626 - RNA, 18 nt, Chlamydophila pneumoniae AR39
aguacauuaucacagcaa

SEQ ID NO: 487627 - RNA, 21 nt, Chlamydophila pneumoniae AR39
aguacauuaucacagcaaucu

SEQ ID NO: 487628 - RNA, 21 nt, Chlamydophila pneumoniae AR39
agauguaaagagcaacaguaa

SEQ ID NO: 487629 - RNA, 15 nt, Chlamydophila pneumoniae AR39
agauguaaagagcaa

SEQ ID NO: 487630 - RNA, 21 nt, Chlamydophila pneumoniae AR39
agauaguauuuuugaaaccaa

SEQ ID NO: 487631 - RNA, 13 nt, Chlamydophila pneumoniae AR39
acuugggaugcua

SEQ ID NO: 487632 - RNA, 20 nt, Chlamydophila pneumoniae AR39
acagcaaucugcagguaagg

SEQ ID NO: 487633 - RNA, 12 nt, Chlamydophila pneumoniae AR39
acaaaaaugccu

SEQ ID NO: 487634 - RNA, 18 nt, Chlamydophila pneumoniae AR39
aauucgaauucucagaaa

SEQ ID NO: 487635 - RNA, 23 nt, Chlamydophila pneumoniae AR39
aaucauuggaaccauaggauagg

SEQ ID NO: 487636 - RNA, 17 nt, Chlamydophila pneumoniae AR39
aagggaugcucuagaaa

SEQ ID NO: 487637 - RNA, 20 nt, Chlamydophila pneumoniae AR39
aagggaugcucuagaaaacg

SEQ ID NO: 487638 - RNA, 22 nt, Chlamydophila pneumoniae AR39
aagcugagguagcaucucucuc

SEQ ID NO: 487639 - RNA, 13 nt, Chlamydophila pneumoniae AR39
aaacgcucuccua

SEQ ID NO: 487640 - RNA, 16 nt, Chlamydophila pneumoniae AR39
aaacgcucuccuagac

SEQ ID NO: 487641 - RNA, 14 nt, Chlamydophila pneumoniae AR39
caucucucuccaaa

SEQ ID NO: 487642 - RNA, 11 nt, Chlamydophila pneumoniae AR39
caucucucucc

SEQ ID NO: 487643 - RNA, 17 nt, Chlamydophila pneumoniae AR39
cagguaagggaugcucu

SEQ ID NO: 487644 - RNA, 21 nt, Chlamydophila pneumoniae AR39
cagguaagggaugcucuagaa

SEQ ID NO: 487645 - RNA, 23 nt, Chlamydophila pneumoniae AR39
aaaauucgaauucucagaaagcc

SEQ ID NO: 487646 - RNA, 22 nt, Human
cccuauccuacuuccccuuccu

SEQ ID NO: 487647 - RNA, 18 nt, Human
ccucuggcuccagcuggc

SEQ ID NO: 487648 - RNA, 19 nt, Human
ccuaacgaaguauccuuca

SEQ ID NO: 487649 - RNA, 17 nt, Human
cuaauuccacagcugcu

SEQ ID NO: 487650 - RNA, 16 nt, Human
cuccacuuggucugug

SEQ ID NO: 487651 - RNA, 18 nt, Human
cuccauccugaggcucca

SEQ ID NO: 487652 - RNA, 21 nt, Human
gagccgagauugugccccugc

SEQ ID NO: 487653 - RNA, 19 nt, Human
gcaauguaagacucgggau

SEQ ID NO: 487654 - RNA, 19 nt, Human
gccccgucccccucuggcu

SEQ ID NO: 487655 - RNA, 14 nt, Human
uacuuccccuuccu

SEQ ID NO: 487656 - RNA, 16 nt, Human
aacacaugauccugca

SEQ ID NO: 487657 - RNA, 19 nt, Human
aagcagggacuugaaccca

SEQ ID NO: 487658 - RNA, 22 nt, Human
acgaugggcuuucccaacagcu

SEQ ID NO: 487659 - RNA, 21 nt, Human
acuugaacccgggaggcagag

SEQ ID NO: 487660 - RNA, 21 nt, Human
auccaacuuauauuucugcuu

SEQ ID NO: 487661 - RNA, 18 nt, Human
augagguacugagaguga

SEQ ID NO: 487662 - RNA, 19 nt, Human
auguuuacagauccccaag

SEQ ID NO: 487663 - RNA, 17 nt, Human
cacagauuugagcucag

SEQ ID NO: 487664 - RNA, 12 nt, Human
cccaaauguuca

SEQ ID NO: 487665 - RNA, 13 nt, Human
cuacuuccccuuc

SEQ ID NO: 487666 - RNA, 16 nt, Human
gccccgucccccucug

SEQ ID NO: 487667 - RNA, 14 nt, Human
gacacuuaaaaaug

SEQ ID NO: 487668 - RNA, 15 nt, Human
uccaccuuacuucuu

SEQ ID NO: 487669 - RNA, 23 nt, Human
uaaaauggugugaccacugcaga

SEQ ID NO: 487670 - RNA, 19 nt, Human
ggagcucugcccauccugc

SEQ ID NO: 487671 - RNA, 16 nt, Human
gucucuacuaaaaaua

SEQ ID NO: 487672 - RNA, 21 nt, Human
uggucugugagaugcuagaac

SEQ ID NO: 487673 - RNA, 20 nt, Human
uggugccucaccccuugcca

SEQ ID NO: 487674 - RNA, 21 nt, Human
uggccuucggccuccauccug

SEQ ID NO: 487675 - RNA, 17 nt, Human
ugagaugcuagaacucc

SEQ ID NO: 487676 - RNA, 22 nt, Human
aacagugauuaccagggacuga

SEQ ID NO: 487677 - RNA, 22 nt, Human
uauuuuaaucaccaaggcugau

SEQ ID NO: 487678 - RNA, 15 nt, Human
ucuggguuccuuccu

SEQ ID NO: 487679 - RNA, 16 nt, Human
ggcuagaaccaccugc

SEQ ID NO: 487680 - RNA, 17 nt, Human
gugagacucugucucag

SEQ ID NO: 487681 - RNA, 20 nt, Human
ggggugaaacccugucucua

SEQ ID NO: 487682 - RNA, 13 nt, Human
ucaaaacuucaga

SEQ ID NO: 487683 - RNA, 18 nt, Human
uacuaguuucccuugcau

SEQ ID NO: 487684 - RNA, 14 nt, Human
agccuggcaaggga

SEQ ID NO: 487685 - RNA, 14 nt, Human
aggauguugaaaaa

SEQ ID NO: 487686 - RNA, 14 nt, Human
agcuugcagagaug

SEQ ID NO: 487687 - RNA, 22 nt, Human
aguauccuucagccugaaagag

SEQ ID NO: 487688 - RNA, 23 nt, Human
auggcuaguaucaaaagaaagaa

SEQ ID NO: 487689 - RNA, 14 nt, Human
aucguguccccuau

SEQ ID NO: 487690 - RNA, 15 nt, Human
aucuuuauaguucua

SEQ ID NO: 487691 - RNA, 17 nt, Human
auccccaagccuggcaa

SEQ ID NO: 487692 - RNA, 16 nt, Human
cacuccagugagacag

SEQ ID NO: 487693 - RNA, 16 nt, Human
caggaaguagaggagg

SEQ ID NO: 487694 - RNA, 20 nt, Human
cccagcuugaaaccuucacu

SEQ ID NO: 487695 - RNA, 20 nt, Human
ccaugaagauguagaggaga

SEQ ID NO: 487696 - RNA, 18 nt, Human
acauccuacaagacacag

SEQ ID NO: 487697 - RNA, 16 nt, Human
acacagauuugagcuc

SEQ ID NO: 487698 - RNA, 17 nt, Human
acagcuccaccuuacuu

SEQ ID NO: 487699 - RNA, 12 nt, Human
acaacaaaagcg

SEQ ID NO: 487700 - RNA, 14 nt, Human
acaacacacagauu

SEQ ID NO: 487701 - RNA, 12 nt, Human
accuuacuucuu

SEQ ID NO: 487702 - RNA, 15 nt, Human
aaucacuugaacccg

SEQ ID NO: 487703 - RNA, 15 nt, Human
acccaaaaggcagaa

SEQ ID NO: 487704 - RNA, 20 nt, Human
acagcuacuugggaggcuga

SEQ ID NO: 487705 - RNA, 13 nt, Human
accccugagcuug

SEQ ID NO: 487706 - RNA, 19 nt, Human
agcccuccuuaucaaagga

SEQ ID NO: 487707 - RNA, 18 nt, Human
agcucugcccauccugcc

SEQ ID NO: 487708 - RNA, 17 nt, Human
auuccacagcugcucaa

SEQ ID NO: 487709 - RNA, 20 nt, Human
cacuccagccugagcgacag

SEQ ID NO: 487710 - RNA, 17 nt, Human
caaauuuacagagacag

SEQ ID NO: 487711 - RNA, 19 nt, Human
aaagaucugcaacuacuau

SEQ ID NO: 487712 - RNA, 14 nt, Human
uaguuucccuugca

SEQ ID NO: 487713 - RNA, 12 nt, Human
cagaacagugau

SEQ ID NO: 487714 - RNA, 14 nt, Human
aaaagaaagaaaau

SEQ ID NO: 487715 - RNA, 20 nt, Human
guaucaaaagaaagaaaauc

SEQ ID NO: 487716 - RNA, 12 nt, Human
uaguacacacuu

SEQ ID NO: 487717 - RNA, 12 nt, Human
ucugcacacagc

SEQ ID NO: 487718 - RNA, 21 nt, Human
aaugaauggcuaagcaaaaug

SEQ ID NO: 487719 - RNA, 15 nt, Human
cuuacuucuucucau

SEQ ID NO: 487720 - RNA, 17 nt, Human
uguucuaagaagugaaa

SEQ ID NO: 487721 - RNA, 19 nt, Human
cccauggcacucuauguuc

SEQ ID NO: 487722 - RNA, 17 nt, Human
caccucccccaucucuu

SEQ ID NO: 487723 - RNA, 19 nt, Human
auuaaauauaaagcaagau

SEQ ID NO: 487724 - RNA, 18 nt, Human
agaagcaacccaaauguu

SEQ ID NO: 487725 - RNA, 11 nt, Human
ugcagugagcc

SEQ ID NO: 487726 - RNA, 19 nt, Human
cugcaaagcccagcuugaa

SEQ ID NO: 487727 - RNA, 12 nt, Human
agggauggggcu

SEQ ID NO: 487728 - RNA, 17 nt, Human
acaagaaaugaaagcag

SEQ ID NO: 487729 - RNA, 19 nt, Human
ugaacaaauuuacagagac

SEQ ID NO: 487730 - RNA, 20 nt, Human
gggaggcagagguugcagug

SEQ ID NO: 487731 - RNA, 15 nt, Human
agcucuaucaccaag

SEQ ID NO: 487732 - RNA, 15 nt, Human
ccauuaaauauaaag

SEQ ID NO: 487733 - RNA, 14 nt, Human
cugaggcuccacuu

SEQ ID NO: 487734 - RNA, 17 nt, Human
agguccacaacacacag

SEQ ID NO: 487735 - RNA, 17 nt, Human
ccaacuuauauuucugc

SEQ ID NO: 487736 - RNA, 17 nt, Human
cugagcgacagugagac

SEQ ID NO: 487737 - RNA, 19 nt, Human
caaggaugccccguccccc

SEQ ID NO: 487738 - RNA, 15 nt, Human
cuggguuccuuccuc

SEQ ID NO: 487739 - RNA, 23 nt, Human
gaccccugagcuugcagagauga

SEQ ID NO: 487740 - RNA, 20 nt, Human
agaggagaaacuggaacucu

SEQ ID NO: 487741 - RNA, 23 nt, Human
ggccuccauccugaggcuccacu

SEQ ID NO: 487742 - RNA, 16 nt, Human
cagggacuugaaccca

SEQ ID NO: 487743 - RNA, 21 nt, Human
gucucagugucaaugcagccc

SEQ ID NO: 487744 - RNA, 14 nt, Human
caaaguuaagaauc

SEQ ID NO: 487745 - RNA, 12 nt, Human
aaugcagccccc

SEQ ID NO: 487746 - RNA, 21 nt, Human
aaucaccaaggcugauuaaac

SEQ ID NO: 487747 - RNA, 12 nt, Human
aauaaaguacaa

SEQ ID NO: 487748 - RNA, 18 nt, Human
aagggaauuucuucaacu

SEQ ID NO: 487749 - RNA, 17 nt, Human
aagaaucuuuauaguuc

SEQ ID NO: 487750 - RNA, 14 nt, Human
ccccugagcuugca

SEQ ID NO: 487751 - RNA, 23 nt, Human
acguaaucguguccccuauccua

SEQ ID NO: 487752 - RNA, 20 nt, Human
acaagacccaaaaggcagaa

SEQ ID NO: 487753 - RNA, 19 nt, Human
ccccuauccuacuuccccu

SEQ ID NO: 487754 - RNA, 13 nt, Human
cccaaaaggcaga

SEQ ID NO: 487755 - RNA, 15 nt, Human
aaaauacaaaaaaaa

SEQ ID NO: 487756 - RNA, 16 nt, Human
guucugcacacagcac

SEQ ID NO: 487757 - RNA, 14 nt, Human
uugcuggagcucug

SEQ ID NO: 487758 - RNA, 12 nt, Human
aaaugaaagcag

SEQ ID NO: 487759 - RNA, 21 nt, Human
cagugagacagcucugcauac

SEQ ID NO: 487760 - RNA, 19 nt, Human
ccccugagcuugcagagau

SEQ ID NO: 487761 - RNA, 22 nt, Human
uacugagagugaacaaauuuac

SEQ ID NO: 487762 - RNA, 14 nt, Human
ugagaugcuagaac

SEQ ID NO: 487763 - RNA, 17 nt, Human
uuacagagacagaaagc

SEQ ID NO: 487764 - RNA, 20 nt, Human
acuaaauugacacuuaaaaa

SEQ ID NO: 487765 - RNA, 14 nt, Human
ccugccccugagcc

SEQ ID NO: 487766 - RNA, 17 nt, Human
cccccugcaaagcccag

SEQ ID NO: 487767 - RNA, 21 nt, Human
ugggaggcugagaugggagaa

SEQ ID NO: 487768 - RNA, 20 nt, Human
agcccuggugggcagagagg

SEQ ID NO: 487769 - RNA, 16 nt, Human
gaauggcuaagcaaaa

SEQ ID NO: 487770 - RNA, 17 nt, Human
cugagaugggagaauca

SEQ ID NO: 487771 - RNA, 15 nt, Human
aucaauuuaaaaaaa

SEQ ID NO: 487772 - RNA, 15 nt, Human
acaagacccaaaagg

SEQ ID NO: 487773 - RNA, 10 nt, Human
accugagccc

SEQ ID NO: 487774 - RNA, 11 nt, Human
accauuuuuac

SEQ ID NO: 487775 - RNA, 18 nt, Human
cugcucaauaaaguacaa

SEQ ID NO: 487776 - RNA, 14 nt, Human
agagguccacaaca

SEQ ID NO: 487777 - RNA, 22 nt, Human
aaugggcacaggguuuauguuu

SEQ ID NO: 487778 - RNA, 17 nt, Human
uccacaacacacagauu

SEQ ID NO: 487779 - RNA, 14 nt, Human
cugcaaagcccagc

SEQ ID NO: 487780 - RNA, 17 nt, Human
uaauuccacagcugcuc

SEQ ID NO: 487781 - RNA, 18 nt, Human
acuggacucaccuccccc

SEQ ID NO: 487782 - RNA, 19 nt, Human
aaucuacacuccagugaga

SEQ ID NO: 487783 - RNA, 23 nt, Human
aucaccaaggcugauuaaaccaa

SEQ ID NO: 487784 - RNA, 22 nt, Human
ucuacuaaaaauacaaaaaaaa

SEQ ID NO: 487785 - RNA, 14 nt, Human
auaaagcaagauaa

SEQ ID NO: 487786 - RNA, 12 nt, Human
gcaaagcccagc

SEQ ID NO: 487787 - RNA, 14 nt, Human
gucccaggcugagc

SEQ ID NO: 487788 - RNA, 20 nt, Human
cugagccucagucucccucc

SEQ ID NO: 487789 - RNA, 23 nt, Human
auucaauaucuuuuuuuuaauaa

SEQ ID NO: 487790 - RNA, 22 nt, Human
gagccucagucucccucccuug

SEQ ID NO: 487791 - RNA, 23 nt, Human
cucauguccacugguucuucuug

SEQ ID NO: 487792 - RNA, 22 nt, Human
gaaauaagccagacaucaacag

SEQ ID NO: 487793 - RNA, 19 nt, Human
gagccugaucaccugcccu

SEQ ID NO: 487794 - RNA, 14 nt, Human
uaaauaguuuauga

SEQ ID NO: 487795 - RNA, 17 nt, Human
agugauuaccagggacu

SEQ ID NO: 487796 - RNA, 22 nt, Human
ucuggguuccuuccucugagcc

SEQ ID NO: 487797 - RNA, 17 nt, Human
ucugugagaugcuagaa

SEQ ID NO: 487798 - RNA, 15 nt, Human
gugaccacugcagaa

SEQ ID NO: 487799 - RNA, 21 nt, Human
cuggccuucggccuccauccu

SEQ ID NO: 487800 - RNA, 16 nt, Human
ggcagagagguaggga

SEQ ID NO: 487801 - RNA, 21 nt, Human
agucucccucccuuggggccu

SEQ ID NO: 487802 - RNA, 15 nt, Human
gaccacugcagaaga

SEQ ID NO: 487803 - RNA, 23 nt, Human
gggagccugaucaccugcccugc

SEQ ID NO: 487804 - RNA, 21 nt, Human
cugagccucagucucccuccc

SEQ ID NO: 487805 - RNA, 24 nt, Human
uggccgggagccugaucaccugcc

SEQ ID NO: 487806 - RNA, 14 nt, Human
caaggcuagaacca

SEQ ID NO: 487807 - RNA, 22 nt, Human
aaacauccuacaagacacagug

SEQ ID NO: 487808 - RNA, 15 nt, Human
gacaguauggcagcu

SEQ ID NO: 487809 - RNA, 19 nt, Human
uggugagugccuguaauca

SEQ ID NO: 487810 - RNA, 16 nt, Human
ugccucaccccuugcc

SEQ ID NO: 487811 - RNA, 15 nt, Human
cucccuuggggccua

SEQ ID NO: 487812 - RNA, 19 nt, Human
uaguuuaugauuccaccua

SEQ ID NO: 487813 - RNA, 20 nt, Human
ucugcaacuacuauccaacu

SEQ ID NO: 487814 - RNA, 15 nt, Human
ucugcagauaaacag

SEQ ID NO: 487815 - RNA, 19 nt, Human
agcagcuuauucacaagac

SEQ ID NO: 487816 - RNA, 22 nt, Human
aggaugccccgucccccucugg

SEQ ID NO: 487817 - RNA, 15 nt, Human
uauaaagcaagauaa

SEQ ID NO: 487818 - RNA, 15 nt, Human
agccugaaagaggaa

SEQ ID NO: 487819 - RNA, 22 nt, Human
cuggguuccuuccucugagccu

SEQ ID NO: 487820 - RNA, 16 nt, Human
aucaaaagaaagaaaa

SEQ ID NO: 487821 - RNA, 13 nt, Human
ccaggcugagccu

SEQ ID NO: 487822 - RNA, 14 nt, Human
aagcucuaucacca

SEQ ID NO: 487823 - RNA, 18 nt, Human
aaagaaaaucaggcuggc

SEQ ID NO: 487824 - RNA, 21 nt, Human
cucagugucaaugcagccccc

SEQ ID NO: 487825 - RNA, 23 nt, Human
auaucuuuuuuuuaauaaaccau

SEQ ID NO: 487826 - RNA, 18 nt, Human
cuccauccugaggcucca

SEQ ID NO: 487827 - RNA, 14 nt, Human
agcucauaaaugaa

SEQ ID NO: 487828 - RNA, 12 nt, Human
ccuucagccuga

SEQ ID NO: 487829 - RNA, 22 nt, Human
aucaccaaggcugauuaaacca

SEQ ID NO: 487830 - RNA, 20 nt, Human
gaugggcuuucccaacagcu

SEQ ID NO: 487831 - RNA, 23 nt, Human
ggucuaucuuugagcgcccacua

SEQ ID NO: 487832 - RNA, 18 nt, Human
cuuugagcgcccacuaga

SEQ ID NO: 487833 - RNA, 15 nt, Human
ccucagucucccucc

SEQ ID NO: 487834 - RNA, 21 nt, Human
acagugauuaccagggacuga

SEQ ID NO: 487835 - RNA, 16 nt, Human
auacuauuuaagagaa

SEQ ID NO: 487836 - RNA, 23 nt, Human
gaaaaaguucugcagauaaacag

SEQ ID NO: 487837 - RNA, 13 nt, Human
ccaccugccuaua

SEQ ID NO: 487838 - RNA, 12 nt, Human
uauucacaagac

SEQ ID NO: 487839 - RNA, 12 nt, Human
aaggaugccccg

SEQ ID NO: 487840 - RNA, 19 nt, Human
auacuaauuauacccccug

SEQ ID NO: 487841 - RNA, 22 nt, Human
cagcccuggugggcagagaggu

SEQ ID NO: 487842 - RNA, 17 nt, Human
guugcugggggggauug

SEQ ID NO: 487843 - RNA, 18 nt, Human
auagaauuaacacaugau

SEQ ID NO: 487844 - RNA, 20 nt, Human
aauaucuuuuuuuuaauaaa

SEQ ID NO: 487845 - RNA, 15 nt, Human
cuacaagacacagug

SEQ ID NO: 487846 - RNA, 20 nt, Human
cccuuccuaauuccacagcu

SEQ ID NO: 487847 - RNA, 15 nt, Human
ugagcucagcccugg

SEQ ID NO: 487848 - RNA, 16 nt, Human
ccuaagugcagccccg

SEQ ID NO: 487849 - RNA, 14 nt, Human
auacaaaaaaaaaa

SEQ ID NO: 487850 - RNA, 16 nt, Human
cugcugagucccaggc

SEQ ID NO: 487851 - RNA, 19 nt, Human
uagcagcucauaaaugaaa

SEQ ID NO: 487852 - RNA, 14 nt, Human
cugucucaguccau

SEQ ID NO: 487853 - RNA, 15 nt, Human
agccucagucucccu

SEQ ID NO: 487854 - RNA, 14 nt, Human
ccucagucucccuc

SEQ ID NO: 487855 - RNA, 14 nt, Human
uccauuaaauauaa

SEQ ID NO: 487856 - RNA, 16 nt, Human
ccugaucaccugcccu

SEQ ID NO: 487857 - RNA, 16 nt, Human
cuuuauaguucuacuc

SEQ ID NO: 487858 - RNA, 17 nt, Human
uaucaauuuaaaaaaaa

SEQ ID NO: 487859 - RNA, 22 nt, Human
ugaccauacuaauuauaccccc

SEQ ID NO: 487860 - RNA, 11 nt, Human
ggucacaggaa

SEQ ID NO: 487861 - RNA, 21 nt, Human
aaugugacuuaaugccacuaa

SEQ ID NO: 487862 - RNA, 20 nt, Human
uuaaauggucaauuuuguua

SEQ ID NO: 487863 - RNA, 16 nt, Human
cucaauaaaguacaag

SEQ ID NO: 487864 - RNA, 16 nt, Human
aucaauuuaaaaaaaa

SEQ ID NO: 487865 - RNA, 12 nt, Human
cccccagcccuc

SEQ ID NO: 487866 - RNA, 18 nt, Human
cccacuagacccacugga

SEQ ID NO: 487867 - RNA, 14 nt, Human
uaguaucaaaagaa

SEQ ID NO: 487868 - RNA, 20 nt, Human
ucaaaacuucagacauagaa

SEQ ID NO: 487869 - RNA, 22 nt, Human
gaagugaaaaucuacacuccag

SEQ ID NO: 487870 - RNA, 23 nt, Human
cucuacuaaaaauacaaaaaaaa

SEQ ID NO: 487871 - RNA, 13 nt, Human
caccaaggagcca

SEQ ID NO: 487872 - RNA, 19 nt, Human
gugacuuaaugccacuaaa

SEQ ID NO: 487873 - RNA, 22 nt, Human
aggcuccacuuggucugugaga

SEQ ID NO: 487874 - RNA, 22 nt, Human
caaauuuacagagacagaaagc

SEQ ID NO: 487875 - RNA, 21 nt, Human
ccccugcaaagcccagcuuga

SEQ ID NO: 487876 - RNA, 19 nt, Human
caacaaaagcgauuauuau

SEQ ID NO: 487877 - RNA, 16 nt, Human
caggcugagccucagu

SEQ ID NO: 487878 - RNA, 23 nt, Human
cauuguggucacaggaaguagag

SEQ ID NO: 487879 - RNA, 16 nt, Human
ccuggugggcagagag

SEQ ID NO: 487880 - RNA, 19 nt, Human
cugagccucagucucccuc

SEQ ID NO: 487881 - RNA, 17 nt, Human
ccaaaagguauuuuaau

SEQ ID NO: 487882 - RNA, 19 nt, Human
cagaaagcagaacagugau

SEQ ID NO: 487883 - RNA, 16 nt, Human
ucugcagauaaacagu

SEQ ID NO: 487884 - RNA, 15 nt, Human
accaaggcugauuaa

SEQ ID NO: 487885 - RNA, 18 nt, Human
aaacagcaacuuguguuc

SEQ ID NO: 487886 - RNA, 23 nt, Human
cccagcccuccuuaucaaaggac

SEQ ID NO: 487887 - RNA, 13 nt, Human
acacuuaaaaaug

SEQ ID NO: 487888 - RNA, 22 nt, Human
ggcagcuuuccucaaaacuuca

SEQ ID NO: 487889 - RNA, 15 nt, Human
gauccugcaauucca

SEQ ID NO: 487890 - RNA, 14 nt, Human
ucaaugcagccccc

SEQ ID NO: 487891 - RNA, 13 nt, Human
ccugccccccagc

SEQ ID NO: 487892 - RNA, 17 nt, Human
agaacucccuuucaaca

SEQ ID NO: 487893 - RNA, 21 nt, Human
gccugaucaccugcccugcug

SEQ ID NO: 487894 - RNA, 13 nt, Human
aacucccugcccc

SEQ ID NO: 487895 - RNA, 18 nt, Human
ccugaaagaggaaugaag

SEQ ID NO: 487896 - RNA, 16 nt, Human
caugguuuagaaagcu

SEQ ID NO: 487897 - RNA, 19 nt, Human
cagcacgggggccaaggau

SEQ ID NO: 487898 - RNA, 22 nt, Human
caagcucuaucaccaaggagcc

SEQ ID NO: 487899 - RNA, 18 nt, Human
gccuucggccuccauccu

SEQ ID NO: 487900 - RNA, 21 nt, Human
cgacagugagacucugucuca

SEQ ID NO: 487901 - RNA, 22 nt, Human
cuccagccugagcgacagugag

SEQ ID NO: 487902 - RNA, 17 nt, Human
uccagcuggccgggagc

SEQ ID NO: 487903 - RNA, 16 nt, Human
gugagacagcucugca

SEQ ID NO: 487904 - RNA, 14 nt, Human
ccuuaucaaaggac

SEQ ID NO: 487905 - RNA, 15 nt, Human
gucccaggcugagcc

SEQ ID NO: 487906 - RNA, 23 nt, Human
agcccuccuuaucaaaggacacc

SEQ ID NO: 487907 - RNA, 21 nt, Human
auguuuacagauccccaagcc

SEQ ID NO: 487908 - RNA, 21 nt, Human
ugaccauacuaauuauacccc

SEQ ID NO: 487909 - RNA, 12 nt, Human
uucagccugaaa

SEQ ID NO: 487910 - RNA, 21 nt, Human
auggcagcuuuccucaaaacu

SEQ ID NO: 487911 - RNA, 18 nt, Human
agauccccaagccuggca

SEQ ID NO: 487912 - RNA, 19 nt, Human
cucaccucccccaucucuu

SEQ ID NO: 487913 - RNA, 17 nt, Human
agagacagaaagcagaa

SEQ ID NO: 487914 - RNA, 20 nt, Human
acaagcaaauauaaacagca

SEQ ID NO: 487915 - RNA, 16 nt, Human
cuggccuucggccucc

SEQ ID NO: 487916 - RNA, 22 nt, Human
aauguagcagcucauaaaugaa

SEQ ID NO: 487917 - RNA, 20 nt, Human
auauuuuauaucaauuuaaa

SEQ ID NO: 487918 - RNA, 17 nt, Human
gccuaagugcagccccg

SEQ ID NO: 487919 - RNA, 21 nt, Human
uguaaaauggugugaccacug

SEQ ID NO: 487920 - RNA, 17 nt, Human
uaugcuaagugaaauaa

SEQ ID NO: 487921 - RNA, 20 nt, Human
uuaacacaugauccugcaau

SEQ ID NO: 487922 - RNA, 22 nt, Human
gucucuacuaaaaauacaaaaa

SEQ ID NO: 487923 - RNA, 18 nt, Human
uuuguuaaaugauuucau

SEQ ID NO: 487924 - RNA, 17 nt, Human
aaauguucaucaaugaa

SEQ ID NO: 487925 - RNA, 17 nt, Human
agugagacagcucugca

SEQ ID NO: 487926 - RNA, 20 nt, Human
aaaaaccugagccccaaaag

SEQ ID NO: 487927 - RNA, 14 nt, Human
gaaagcagaacagu

SEQ ID NO: 487928 - RNA, 14 nt, Human
agacaucaacagau

SEQ ID NO: 487929 - RNA, 14 nt, Human
gcaaagcccagcuu

SEQ ID NO: 487930 - RNA, 22 nt, Human
gaggggagcaugggaagugacg

SEQ ID NO: 487931 - RNA, 16 nt, Human
cuccaccuuacuucuu

SEQ ID NO: 487932 - RNA, 16 nt, Human
aaaaugugauauguac

SEQ ID NO: 487933 - RNA, 21 nt, Human
aaaagguauuuuaaucaccaa

SEQ ID NO: 487934 - RNA, 17 nt, Human
ugaaauaagccagacau

SEQ ID NO: 487935 - RNA, 17 nt, Human
acccacuggacucaccu

SEQ ID NO: 487936 - RNA, 15 nt, Human
uaucaauuuaaaaaa

SEQ ID NO: 487937 - RNA, 19 nt, Human
uccauccugaggcuccacu

SEQ ID NO: 487938 - RNA, 21 nt, Human
cccuauccuacuuccccuucc

SEQ ID NO: 487939 - RNA, 17 nt, Human
ugaucaccugcccugcu

SEQ ID NO: 487940 - RNA, 21 nt, Human
ugccuguaaucacagcuacuu

SEQ ID NO: 487941 - RNA, 21 nt, Human
ccucccuuggggccuaugcag

SEQ ID NO: 487942 - RNA, 19 nt, Human
cagcuacuugggaggcuga

SEQ ID NO: 487943 - RNA, 14 nt, Human
ccacuggacucacc

SEQ ID NO: 487944 - RNA, 20 nt, Human
ccugccuaagugcagccccg

SEQ ID NO: 487945 - RNA, 16 nt, Human
ugagaugcuagaacuc

SEQ ID NO: 487946 - RNA, 17 nt, Human
cuaacaggaauuuucau

SEQ ID NO: 487947 - RNA, 19 nt, Human
agccugaucaccugcccug

SEQ ID NO: 487948 - RNA, 14 nt, Human
acuacuauccaacu

SEQ ID NO: 487949 - RNA, 19 nt, Human
cuuccuaauuccacagcug

SEQ ID NO: 487950 - RNA, 14 nt, Human
aaagaggaaugaag

SEQ ID NO: 487951 - RNA, 21 nt, Human
uuucauuguucuauaacaaca

SEQ ID NO: 487952 - RNA, 15 nt, Human
uccaccuuacuucuu

SEQ ID NO: 487953 - RNA, 19 nt, Human
cucuguucugcacacagca

SEQ ID NO: 487954 - RNA, 22 nt, Human
cuacuauccaacuuauauuucu

SEQ ID NO: 487955 - RNA, 22 nt, Human
gugugaccacugcagaagacag

SEQ ID NO: 487956 - RNA, 23 nt, Human
cgauuauuauuuuagagcaucuc

SEQ ID NO: 487957 - RNA, 18 nt, Human
ucuucuggguuccuuccu

SEQ ID NO: 487958 - RNA, 19 nt, Human
ucaccaaggcugauuaaac

SEQ ID NO: 487959 - RNA, 14 nt, Human
uuaaagaucugcaa

SEQ ID NO: 487960 - RNA, 12 nt, Human
ccccuugccaua

SEQ ID NO: 487961 - RNA, 14 nt, Human
cuacaagacacagu

SEQ ID NO: 487962 - RNA, 20 nt, Human
cuucaacucccugcccccca

SEQ ID NO: 487963 - RNA, 19 nt, Human
gcacacagcacgggggcca

SEQ ID NO: 487964 - RNA, 13 nt, Human
cccugcacuccag

SEQ ID NO: 487965 - RNA, 21 nt, Human
cccacuggacucaccuccccc

SEQ ID NO: 487966 - RNA, 22 nt, Human
accuaacgaaguauccuucagc

SEQ ID NO: 487967 - RNA, 18 nt, Human
cagauuugagcucagccc

SEQ ID NO: 487968 - RNA, 16 nt, Human
uggcaagcucuaucac

SEQ ID NO: 487969 - RNA, 14 nt, Human
ggacucaccucccc

SEQ ID NO: 487970 - RNA, 19 nt, Human
cagauccccaagccuggca

SEQ ID NO: 487971 - RNA, 19 nt, Human
uugugccccugcacuccag

SEQ ID NO: 487972 - RNA, 13 nt, Human
ggaaguagaggag

SEQ ID NO: 487973 - RNA, 15 nt, Human
ccucauguccacugg

SEQ ID NO: 487974 - RNA, 14 nt, Human
agguugcagugagc

SEQ ID NO: 487975 - RNA, 20 nt, Human
guuccuuccucugagccuug

SEQ ID NO: 487976 - RNA, 22 nt, Human
uuccccuuccuaauuccacagc

SEQ ID NO: 487977 - RNA, 18 nt, Human
gcaaagcccagcuugaaa

SEQ ID NO: 487978 - RNA, 14 nt, Human
ugcuagaacucccu

SEQ ID NO: 487979 - RNA, 20 nt, Human
ugagcgcccacuagacccac

SEQ ID NO: 487980 - RNA, 20 nt, Human
ccccuauccuacuuccccuu

SEQ ID NO: 487981 - RNA, 22 nt, Human
ugaaaaaguucugcagauaaac

SEQ ID NO: 487982 - RNA, 12 nt, Human
acacuuaaaaau

SEQ ID NO: 487983 - RNA, 22 nt, Human
aggacaccauuuuggcaagcuc

SEQ ID NO: 487984 - RNA, 22 nt, Human
aacucccugccccccagcccuc

SEQ ID NO: 487985 - RNA, 12 nt, Human
acaagacacagu

SEQ ID NO: 487986 - RNA, 20 nt, Human
gaccauacuaauuauacccc

SEQ ID NO: 487987 - RNA, 14 nt, Human
ugagcuugcagaga

SEQ ID NO: 487988 - RNA, 14 nt, Human
uaacaacaacaaca

SEQ ID NO: 487989 - RNA, 16 nt, Human
ucagucucccucccuu

SEQ ID NO: 487990 - RNA, 14 nt, Human
ugacacuuaaaaau

SEQ ID NO: 487991 - RNA, 21 nt, Human
caacacacagauuugagcuca

SEQ ID NO: 487992 - RNA, 11 nt, Human
ccugagcccca

SEQ ID NO: 487993 - RNA, 19 nt, Human
cuuggggccuaugcagagg

SEQ ID NO: 487994 - RNA, 18 nt, Human
auuuaggccaugggacag

SEQ ID NO: 487995 - RNA, 14 nt, Human
acaagagcuuaaca

SEQ ID NO: 487996 - RNA, 19 nt, Human
guacaagagcuuaacagug

SEQ ID NO: 487997 - RNA, 20 nt, Human
cuuauauuucugcuuucaaa

SEQ ID NO: 487998 - RNA, 12 nt, Human
aucguguccccu

SEQ ID NO: 487999 - RNA, 18 nt, Human
cccacuggacucaccucc

SEQ ID NO: 488000 - RNA, 16 nt, Human
ugugagaugcuagaac

SEQ ID NO: 488001 - RNA, 15 nt, Human
ucccccaucucuucu

SEQ ID NO: 488002 - RNA, 15 nt, Human
aauauaaacagcaac

SEQ ID NO: 488003 - RNA, 14 nt, Human
acccgggaggcaga

SEQ ID NO: 488004 - RNA, 12 nt, Human
cacaacacacag

SEQ ID NO: 488005 - RNA, 20 nt, Human
aaggaugccccgucccccuc

SEQ ID NO: 488006 - RNA, 22 nt, Human
ccccuuccuaauuccacagcug

SEQ ID NO: 488007 - RNA, 13 nt, Human
gauuguaaaaugg

SEQ ID NO: 488008 - RNA, 16 nt, Human
cuagaacucccuuuca

SEQ ID NO: 488009 - RNA, 18 nt, Human
gcacuccagccugagcga

SEQ ID NO: 488010 - RNA, 16 nt, Human
ucaaaagaaagaaaau

SEQ ID NO: 488011 - RNA, 17 nt, Human
gcaagcucuaucaccaa

SEQ ID NO: 488012 - RNA, 17 nt, Human
aaaaugguauuaaagau

SEQ ID NO: 488013 - RNA, 18 nt, Human
gagucccaggcugagccu

SEQ ID NO: 488014 - RNA, 21 nt, Human
acaugagguacugagagugaa

SEQ ID NO: 488015 - RNA, 19 nt, Human
auuuacagagacagaaagc

SEQ ID NO: 488016 - RNA, 21 nt, Human
aauuuacagagacagaaagca

SEQ ID NO: 488017 - RNA, 12 nt, Human
ggaggcugagau

SEQ ID NO: 488018 - RNA, 15 nt, Human
ucaaaggacaccauu

SEQ ID NO: 488019 - RNA, 19 nt, Human
augcagagguccacaacac

SEQ ID NO: 488020 - RNA, 19 nt, Human
gagccucagucucccuccc

SEQ ID NO: 488021 - RNA, 13 nt, Human
aucaggcuggcca

SEQ ID NO: 488022 - RNA, 15 nt, Human
cacuuggucugugag

SEQ ID NO: 488023 - RNA, 16 nt, Human
caaauauaaacagcaa

SEQ ID NO: 488024 - RNA, 16 nt, Human
cuagaaccaccugccu

SEQ ID NO: 488025 - RNA, 16 nt, Human
aauuucuucaacuccc

SEQ ID NO: 488026 - RNA, 17 nt, Human
cugcacuccagccugag

SEQ ID NO: 488027 - RNA, 21 nt, Human
ccaagaagauaaucuccaaag

SEQ ID NO: 488028 - RNA, 21 nt, Human
cacuugaacccgggaggcaga

SEQ ID NO: 488029 - RNA, 19 nt, Human
acagugauuaccagggacu

SEQ ID NO: 488030 - RNA, 21 nt, Human
gaagugaaaaucuacacucca

SEQ ID NO: 488031 - RNA, 13 nt, Human
ucuaagaagugaa

SEQ ID NO: 488032 - RNA, 18 nt, Human
ucuucaacucccugcccc

SEQ ID NO: 488033 - RNA, 19 nt, Human
cccugcaaagcccagcuug

SEQ ID NO: 488034 - RNA, 13 nt, Human
agaaaugaaagca

SEQ ID NO: 488035 - RNA, 16 nt, Human
uauguucuaagaagug

SEQ ID NO: 488036 - RNA, 22 nt, Human
ggcauuuaggccaugggacagg

SEQ ID NO: 488037 - RNA, 16 nt, Human
cagcuuuccucaaaac

SEQ ID NO: 488038 - RNA, 21 nt, Human
ccucuguucugcacacagcac

SEQ ID NO: 488039 - RNA, 18 nt, Human
caaggcugauuaaaccaa

SEQ ID NO: 488040 - RNA, 23 nt, Human
cuucaacucccugccccccagcc

SEQ ID NO: 488041 - RNA, 16 nt, Human
agugagacagcucugc

SEQ ID NO: 488042 - RNA, 16 nt, Human
ccuaugcagaggucca

SEQ ID NO: 488043 - RNA, 15 nt, Human
cccugcaaagcccag

SEQ ID NO: 488044 - RNA, 15 nt, Human
auuucauucaauauc

SEQ ID NO: 488045 - RNA, 19 nt, Human
aaugaauggcuaagcaaaa

SEQ ID NO: 488046 - RNA, 15 nt, Human
ggcaagcucuaucac

SEQ ID NO: 488047 - RNA, 21 nt, Human
aauauaaagcaagauaauaaa

SEQ ID NO: 488048 - RNA, 14 nt, Human
aauugaaaauggua

SEQ ID NO: 488049 - RNA, 13 nt, Human
aagugcagccccg

SEQ ID NO: 488050 - RNA, 22 nt, Human
cugcucaauaaaguacaagagc

SEQ ID NO: 488051 - RNA, 16 nt, Human
cuucggccuccauccu

SEQ ID NO: 488052 - RNA, 18 nt, Human
caagccucauguccacug

SEQ ID NO: 488053 - RNA, 23 nt, Human
ccccucuggcuccagcuggccgg

SEQ ID NO: 488054 - RNA, 23 nt, Human
ggucucagugucaaugcagcccc

SEQ ID NO: 488055 - RNA, 13 nt, Human
gcuggagcucugc

SEQ ID NO: 488056 - RNA, 17 nt, Human
auaaaguacaagagcuu

SEQ ID NO: 488057 - RNA, 23 nt, Human
gccccugcacuccagccugagcg

SEQ ID NO: 488058 - RNA, 23 nt, Human
cucagucucccucccuuggggcc

SEQ ID NO: 488059 - RNA, 17 nt, Human
ccuacuuccccuuccua

SEQ ID NO: 488060 - RNA, 13 nt, Human
caacucccugccc

SEQ ID NO: 488061 - RNA, 15 nt, Human
aagugaaaaucuaca

SEQ ID NO: 488062 - RNA, 22 nt, Human
gucacaggaaguagaggaggcc

SEQ ID NO: 488063 - RNA, 22 nt, Human
caaggaugccccgucccccucu

SEQ ID NO: 488064 - RNA, 14 nt, Human
cguguccccuaucc

SEQ ID NO: 488065 - RNA, 14 nt, Human
cuuggucugugaga

SEQ ID NO: 488066 - RNA, 15 nt, Human
cucccugccccccag

SEQ ID NO: 488067 - RNA, 14 nt, Human
aucaccaaggcuga

SEQ ID NO: 488068 - RNA, 23 nt, Human
caacggggugaaacccugucucu

SEQ ID NO: 488069 - RNA, 15 nt, Human
aucaaaggacaccau

SEQ ID NO: 488070 - RNA, 22 nt, Human
ggguuccuuccucugagccuug

SEQ ID NO: 488071 - RNA, 19 nt, Human
uggaaauguuuacagaucc

SEQ ID NO: 488072 - RNA, 11 nt, Human
gccaugggaca

SEQ ID NO: 488073 - RNA, 12 nt, Human
aaaagaaagaaa

SEQ ID NO: 488074 - RNA, 15 nt, Human
acaucaacagauaaa

SEQ ID NO: 488075 - RNA, 15 nt, Human
uucggccuccauccu

SEQ ID NO: 488076 - RNA, 14 nt, Human
ugaagauguagagg

SEQ ID NO: 488077 - RNA, 21 nt, Human
cucaguccaugaagauguaga

SEQ ID NO: 488078 - RNA, 22 nt, Human
gcuugcagagaugaggccgcca

SEQ ID NO: 488079 - RNA, 16 nt, Human
cuucuggguuccuucc

SEQ ID NO: 488080 - RNA, 14 nt, Human
ccagcuggccggga

SEQ ID NO: 488081 - RNA, 17 nt, Human
agaugggagaaucacuu

SEQ ID NO: 488082 - RNA, 17 nt, Human
uuauaucaauuuaaaaa

SEQ ID NO: 488083 - RNA, 21 nt, Human
cucuucuggguuccuuccucu

SEQ ID NO: 488084 - RNA, 16 nt, Human
cccccagcccuccuua

SEQ ID NO: 488085 - RNA, 14 nt, Human
cuggagcucugccc

SEQ ID NO: 488086 - RNA, 19 nt, Human
acaaauuuacagagacaga

SEQ ID NO: 488087 - RNA, 21 nt, Human
cagcaacuuguguuccuaaca

SEQ ID NO: 488088 - RNA, 23 nt, Human
acaacaaaagcgauuauuauuuu

SEQ ID NO: 488089 - RNA, 20 nt, Human
uuaaugccacuaaauugaca

SEQ ID NO: 488090 - RNA, 18 nt, Human
uucaauaucuuuuuuuua

SEQ ID NO: 488091 - RNA, 14 nt, Human
cagauccccaagcc

SEQ ID NO: 488092 - RNA, 20 nt, Human
ccaaauguucaucaaugaau

SEQ ID NO: 488093 - RNA, 14 nt, Human
uggacucaccuccc

SEQ ID NO: 488094 - RNA, 18 nt, Human
uccagcuggccgggagcc

SEQ ID NO: 488095 - RNA, 17 nt, Human
caagaaaugaaagcagg

SEQ ID NO: 488096 - RNA, 18 nt, Human
auccccaagccuggcaag

SEQ ID NO: 488097 - RNA, 22 nt, Human
aauuuaaaaaaaaaccugagcc

SEQ ID NO: 488098 - RNA, 20 nt, Human
cuggccuucggccuccaucc

SEQ ID NO: 488099 - RNA, 15 nt, Human
cugaaagaggaauga

SEQ ID NO: 488100 - RNA, 19 nt, Human
agaugcuagaacucccuuu

SEQ ID NO: 488101 - RNA, 22 nt, Human
augcagagguccacaacacaca

SEQ ID NO: 488102 - RNA, 13 nt, Human
agcucugcccauc

SEQ ID NO: 488103 - RNA, 23 nt, Human
cucagcccuggugggcagagagg

SEQ ID NO: 488104 - RNA, 15 nt, Human
uggacucaccucccc

SEQ ID NO: 488105 - RNA, 18 nt, Human
acagaaagcagaacagug

SEQ ID NO: 488106 - RNA, 13 nt, Human
cugagagugaaca

SEQ ID NO: 488107 - RNA, 22 nt, Human
cucuggccuucggccuccaucc

SEQ ID NO: 488108 - RNA, 14 nt, Human
ugagacucugucuc

SEQ ID NO: 488109 - RNA, 12 nt, Human
agugcagccccg

SEQ ID NO: 488110 - RNA, 17 nt, Human
uccauccugaggcucca

SEQ ID NO: 488111 - RNA, 14 nt, Human
cucccugcccccca

SEQ ID NO: 488112 - RNA, 13 nt, Human
ucuacuaaaaaua

SEQ ID NO: 488113 - RNA, 22 nt, Human
gugaacaaauuuacagagacag

SEQ ID NO: 488114 - RNA, 23 nt, Human
aucacagcuacuugggaggcuga

SEQ ID NO: 488115 - RNA, 21 nt, Human
cuccagcuggccgggagccug

SEQ ID NO: 488116 - RNA, 13 nt, Human
aaacauccuacaa

SEQ ID NO: 488117 - RNA, 19 nt, Human
ggacucaccucccccaucu

SEQ ID NO: 488118 - RNA, 19 nt, Human
uuggcaagcucuaucacca

SEQ ID NO: 488119 - RNA, 17 nt, Human
cccacuggacucaccuc

SEQ ID NO: 488120 - RNA, 18 nt, Human
ugccauaauuacuauguc

SEQ ID NO: 488121 - RNA, 16 nt, Human
augcuaagugaaauaa

SEQ ID NO: 488122 - RNA, 18 nt, Human
ccauccugccccugagcc

SEQ ID NO: 488123 - RNA, 18 nt, Human
ugugaccacugcagaaga

SEQ ID NO: 488124 - RNA, 13 nt, Human
uuccucugagccu

SEQ ID NO: 488125 - RNA, 19 nt, Human
agauuugagcucagcccug

SEQ ID NO: 488126 - RNA, 17 nt, Human
acuugaacccauauuug

SEQ ID NO: 488127 - RNA, 22 nt, Human
aggauggcuaguaucaaaagaa

SEQ ID NO: 488128 - RNA, 14 nt, Human
accauuuuuacuug

SEQ ID NO: 488129 - RNA, 22 nt, Human
ccaaacauccuacaagacacag

SEQ ID NO: 488130 - RNA, 13 nt, Human
uggcuccagcugg

SEQ ID NO: 488131 - RNA, 17 nt, Human
augcagagguccacaac

SEQ ID NO: 488132 - RNA, 15 nt, Human
aaaguuaagaaucuu

SEQ ID NO: 488133 - RNA, 16 nt, Human
cugagcgacagugaga

SEQ ID NO: 488134 - RNA, 14 nt, Human
agauguagaggaga

SEQ ID NO: 488135 - RNA, 13 nt, Human
augauuccaccua

SEQ ID NO: 488136 - RNA, 22 nt, Human
caccucccccaucucuucuggg

SEQ ID NO: 488137 - RNA, 13 nt, Human
ccucuggcuccag

SEQ ID NO: 488138 - RNA, 18 nt, Human
aaaaguucugcagauaaa

SEQ ID NO: 488139 - RNA, 17 nt, Human
uaucuuuuuuuuaauaa

SEQ ID NO: 488140 - RNA, 17 nt, Human
ucagacauagaauuaac

SEQ ID NO: 488141 - RNA, 18 nt, Human
agccugaucaccugcccu

SEQ ID NO: 488142 - RNA, 16 nt, Human
aagcaagauaauaaaa

SEQ ID NO: 488143 - RNA, 20 nt, Human
caggcugagccucagucucc

SEQ ID NO: 488144 - RNA, 22 nt, Human
uacaugagguacugagagugaa

SEQ ID NO: 488145 - RNA, 21 nt, Human
cuaguaucaaaagaaagaaaa

SEQ ID NO: 488146 - RNA, 14 nt, Human
cagagguugcagug

SEQ ID NO: 488147 - RNA, 18 nt, Human
aucuacacuccagugaga

SEQ ID NO: 488148 - RNA, 15 nt, Human
aagccuggcaaggga

SEQ ID NO: 488149 - RNA, 16 nt, Human
ucccugccccccagcc

SEQ ID NO: 488150 - RNA, 13 nt, Human
aucuacacuccag

SEQ ID NO: 488151 - RNA, 19 nt, Human
uacaaaaaaaaaaaaaaau

SEQ ID NO: 488152 - RNA, 21 nt, Human
aucuuuuuuuuaauaaaccau

SEQ ID NO: 488153 - RNA, 20 nt, Human
cacuagacccacuggacuca

SEQ ID NO: 488154 - RNA, 18 nt, Human
cagggaggacgcucucug

SEQ ID NO: 488155 - RNA, 21 nt, Human
acgcucucuggccuucggccu

SEQ ID NO: 488156 - RNA, 15 nt, Human
cagucucccucccuu

SEQ ID NO: 488157 - RNA, 18 nt, Human
cccaagccuggcaaggga

SEQ ID NO: 488158 - RNA, 22 nt, Human
cccagcccuccuuaucaaagga

SEQ ID NO: 488159 - RNA, 14 nt, Human
ccaugggacaggga

SEQ ID NO: 488160 - RNA, 14 nt, Human
cagucucccucccu

SEQ ID NO: 488161 - RNA, 22 nt, Human
cacagauuugagcucagcccug

SEQ ID NO: 488162 - RNA, 20 nt, Human
uccuaacaggaauuuucauu

SEQ ID NO: 488163 - RNA, 14 nt, Human
ucuuuuuuuuaaua

SEQ ID NO: 488164 - RNA, 18 nt, Human
uccuaauuccacagcugc

SEQ ID NO: 488165 - RNA, 15 nt, Human
ccacaagaaaugaaa

SEQ ID NO: 488166 - RNA, 18 nt, Human
ugagcucagcccuggugg

SEQ ID NO: 488167 - RNA, 17 nt, Human
ggccaugggacagggag

SEQ ID NO: 488168 - RNA, 16 nt, Human
cugagcuugcagagau

SEQ ID NO: 488169 - RNA, 19 nt, Human
uucauuguucuauaacaac

SEQ ID NO: 488170 - RNA, 21 nt, Human
uacaugagguacugagaguga

SEQ ID NO: 488171 - RNA, 22 nt, Human
ucuacuccauuaaauauaaagc

SEQ ID NO: 488172 - RNA, 15 nt, Human
uguuaaaugauuuca

SEQ ID NO: 488173 - RNA, 16 nt, Human
ugacuuaaugccacua

SEQ ID NO: 488174 - RNA, 22 nt, Human
gcagagagguagggauggggcu

SEQ ID NO: 488175 - RNA, 18 nt, Human
acuuuaugcuaagugaaa

SEQ ID NO: 488176 - RNA, 14 nt, Human
cgucccccucuggc

SEQ ID NO: 488177 - RNA, 11 nt, Human
caacucccugc

SEQ ID NO: 488178 - RNA, 16 nt, Human
ucaucaaugaaugaau

SEQ ID NO: 488179 - RNA, 16 nt, Human
auuauacccccugcaa

SEQ ID NO: 488180 - RNA, 22 nt, Human
ccgggaggcagagguugcagug

SEQ ID NO: 488181 - RNA, 18 nt, Human
gaugccccgucccccucu

SEQ ID NO: 488182 - RNA, 23 nt, Human
cacaagaaaugaaagcagggacu

SEQ ID NO: 488183 - RNA, 23 nt, Human
cuggccgggagccugaucaccug

SEQ ID NO: 488184 - RNA, 14 nt, Human
gagcucagcccugg

SEQ ID NO: 488185 - RNA, 18 nt, Human
cucuauguucuaagaagu

SEQ ID NO: 488186 - RNA, 18 nt, Human
agguccacaacacacaga

SEQ ID NO: 488187 - RNA, 19 nt, Human
gagguacugagagugaaca

SEQ ID NO: 488188 - RNA, 18 nt, Human
auuugcuggagcucugcc

SEQ ID NO: 488189 - RNA, 20 nt, Human
gcuugcagagaugaggccgc

SEQ ID NO: 488190 - RNA, 20 nt, Human
guucugcagauaaacaguag

SEQ ID NO: 488191 - RNA, 18 nt, Human
cugagucccaggcugagc

SEQ ID NO: 488192 - RNA, 21 nt, Human
ucuucaacucccugcccccca

SEQ ID NO: 488193 - RNA, 21 nt, Human
ccauccugccccugagcccau

SEQ ID NO: 488194 - RNA, 22 nt, Human
uaagagaacaagcaaauauaaa

SEQ ID NO: 488195 - RNA, 14 nt, Human
uccacaacacacag

SEQ ID NO: 488196 - RNA, 14 nt, Human
cuccagugagacag

SEQ ID NO: 488197 - RNA, 18 nt, Human
gagccucagucucccucc

SEQ ID NO: 488198 - RNA, 10 nt, Human
caacucccug

SEQ ID NO: 488199 - RNA, 19 nt, Human
ucagugucaaugcagcccc

SEQ ID NO: 488200 - RNA, 15 nt, Human
ccccugagcuugcag

SEQ ID NO: 488201 - RNA, 21 nt, Human
cccccauuguggucacaggaa

SEQ ID NO: 488202 - RNA, 16 nt, Human
augccccgucccccuc

SEQ ID NO: 488203 - RNA, 20 nt, Human
gaacguaaucguguccccua

SEQ ID NO: 488204 - RNA, 11 nt, Human
gcaugguuuag

SEQ ID NO: 488205 - RNA, 21 nt, Human
gggagccugaucaccugcccu

SEQ ID NO: 488206 - RNA, 20 nt, Human
guccccuauccuacuucccc

SEQ ID NO: 488207 - RNA, 14 nt, Human
gcaagauaauaaaa

SEQ ID NO: 488208 - RNA, 14 nt, Human
agaaaugaaagcag

SEQ ID NO: 488209 - RNA, 11 nt, Human
cccaacagcuc

SEQ ID NO: 488210 - RNA, 13 nt, Human
uguauauuuuaua

SEQ ID NO: 488211 - RNA, 19 nt, Human
cucugcauacucauuagga

SEQ ID NO: 488212 - RNA, 13 nt, Human
aaauauaaagcaa

SEQ ID NO: 488213 - RNA, 13 nt, Human
uuaugcuaaguga

SEQ ID NO: 488214 - RNA, 14 nt, Human
aacaacaacaacaa

SEQ ID NO: 488215 - RNA, 20 nt, Human
cuuauucacaagacccaaaa

SEQ ID NO: 488216 - RNA, 18 nt, Human
agcugcucaauaaaguac

SEQ ID NO: 488217 - RNA, 16 nt, Human
ugacacuuaaaaaugg

SEQ ID NO: 488218 - RNA, 19 nt, Human
ugaucaccugcccugcuga

SEQ ID NO: 488219 - RNA, 23 nt, Human
gggccuaugcagagguccacaac

SEQ ID NO: 488220 - RNA, 15 nt, Human
gcccacuagacccac

SEQ ID NO: 488221 - RNA, 20 nt, Human
cagcuggccgggagccugau

SEQ ID NO: 488222 - RNA, 23 nt, Human
cccacuggacucaccucccccau

SEQ ID NO: 488223 - RNA, 16 nt, Human
cuacacuccagugaga

SEQ ID NO: 488224 - RNA, 13 nt, Human
agagguccacaac

SEQ ID NO: 488225 - RNA, 15 nt, Human
auccugccccugagc

SEQ ID NO: 488226 - RNA, 12 nt, Human
ucccccucuggc

SEQ ID NO: 488227 - RNA, 18 nt, Human
caaggcuagaaccaccug

SEQ ID NO: 488228 - RNA, 18 nt, Human
ucuucucauacuauuuaa

SEQ ID NO: 488229 - RNA, 23 nt, Human
agcucugcccauccugccccuga

SEQ ID NO: 488230 - RNA, 15 nt, Human
cuugaaaacuuuaug

SEQ ID NO: 488231 - RNA, 14 nt, Human
ggccgggagccuga

SEQ ID NO: 488232 - RNA, 15 nt, Human
agacagcucugcaua

SEQ ID NO: 488233 - RNA, 14 nt, Human
cacaagaaaugaaa

SEQ ID NO: 488234 - RNA, 19 nt, Human
aauguuuacagauccccaa

SEQ ID NO: 488235 - RNA, 22 nt, Human
auaucuuuuuuuuaauaaacca

SEQ ID NO: 488236 - RNA, 15 nt, Human
ucuggcuccagcugg

SEQ ID NO: 488237 - RNA, 13 nt, Human
cacgaugggcuuu

SEQ ID NO: 488238 - RNA, 21 nt, Human
aauuuucauuguucuauaaca

SEQ ID NO: 488239 - RNA, 14 nt, Human
cuggccgggagccu

SEQ ID NO: 488240 - RNA, 19 nt, Human
ccccucuggcuccagcugg

SEQ ID NO: 488241 - RNA, 13 nt, Human
cucaccuccccca

SEQ ID NO: 488242 - RNA, 15 nt, Human
gccuugggaccccug

SEQ ID NO: 488243 - RNA, 22 nt, Human
gagucccaggcugagccucagu

SEQ ID NO: 488244 - RNA, 16 nt, Human
aaagaucugcaacuac

SEQ ID NO: 488245 - RNA, 14 nt, Human
uuagagcaucucau

SEQ ID NO: 488246 - RNA, 16 nt, Human
cuccauccugaggcuc

SEQ ID NO: 488247 - RNA, 13 nt, Human
cugcacuccagcc

SEQ ID NO: 488248 - RNA, 20 nt, Human
ugagagugaacaaauuuaca

SEQ ID NO: 488249 - RNA, 21 nt, Human
acuauuuaagagaacaagcaa

SEQ ID NO: 488250 - RNA, 20 nt, Human
augguuuagaaagcuugccc

SEQ ID NO: 488251 - RNA, 15 nt, Human
cuaagugcagccccg

SEQ ID NO: 488252 - RNA, 21 nt, Human
agcaaauauaaacagcaacuu

SEQ ID NO: 488253 - RNA, 18 nt, Human
acauguuacaacacggac

SEQ ID NO: 488254 - RNA, 13 nt, Human
uacagagacagaa

SEQ ID NO: 488255 - RNA, 18 nt, Human
cccucuggcuccagcugg

SEQ ID NO: 488256 - RNA, 14 nt, Human
ggcuccagcuggcc

SEQ ID NO: 488257 - RNA, 19 nt, Human
uuuauaucaauuuaaaaaa

SEQ ID NO: 488258 - RNA, 18 nt, Human
gcccuggugggcagagag

SEQ ID NO: 488259 - RNA, 17 nt, Human
uccugccccugagccca

SEQ ID NO: 488260 - RNA, 14 nt, Human
cucagucucccucc

SEQ ID NO: 488261 - RNA, 16 nt, Human
ccccaucucuucuggg

SEQ ID NO: 488262 - RNA, 20 nt, Human
cugcacuccagccugagcga

SEQ ID NO: 488263 - RNA, 18 nt, Human
ugggcacaggguuuaugu

SEQ ID NO: 488264 - RNA, 20 nt, Human
gccgggcgugguggugagug

SEQ ID NO: 488265 - RNA, 22 nt, Human
cucugagccuugggaccccuga

SEQ ID NO: 488266 - RNA, 13 nt, Human
aaauauaaacagc

SEQ ID NO: 488267 - RNA, 23 nt, Human
gucucccucccuuggggccuaug

SEQ ID NO: 488268 - RNA, 19 nt, Human
agacucgggauuaguacac

SEQ ID NO: 488269 - RNA, 19 nt, Human
cagagaugaggccgccaug

SEQ ID NO: 488270 - RNA, 17 nt, Human
guguccccuauccuacu

SEQ ID NO: 488271 - RNA, 20 nt, Human
uaagugaaauaagccagaca

SEQ ID NO: 488272 - RNA, 16 nt, Human
uggggauagugaggca

SEQ ID NO: 488273 - RNA, 18 nt, Human
cagagacagaaagcagaa

SEQ ID NO: 488274 - RNA, 17 nt, Human
ugaccacugcagaagac

SEQ ID NO: 488275 - RNA, 23 nt, Human
gcccuggugccucaccccuugcc

SEQ ID NO: 488276 - RNA, 22 nt, Human
agcccuccuuaucaaaggacac

SEQ ID NO: 488277 - RNA, 22 nt, Human
ugauaguuguaccgcaauguga

SEQ ID NO: 488278 - RNA, 14 nt, Human
agaugcuagaacuc

SEQ ID NO: 488279 - RNA, 17 nt, Human
cugaucaccugcccugc

SEQ ID NO: 488280 - RNA, 16 nt, Human
cagaagcaacccaaau

SEQ ID NO: 488281 - RNA, 21 nt, Human
ugaacaaauuuacagagacag

SEQ ID NO: 488282 - RNA, 21 nt, Human
augucauuugcuggagcucug

SEQ ID NO: 488283 - RNA, 15 nt, Human
uccauccugaggcuc

SEQ ID NO: 488284 - RNA, 22 nt, Human
cccuauccuacuuccccuuccu

SEQ ID NO: 488285 - RNA, 19 nt, Human
agaacaagcaaauauaaac

SEQ ID NO: 488286 - RNA, 23 nt, Human
acucuauguucuaagaagugaaa

SEQ ID NO: 488287 - RNA, 19 nt, Human
auuucuucaacucccugcc

SEQ ID NO: 488288 - RNA, 17 nt, Human
auaucaauuuaaaaaaa

SEQ ID NO: 488289 - RNA, 13 nt, Human
agcgacagugaga

SEQ ID NO: 488290 - RNA, 15 nt, Human
ccugcaaagcccagc

SEQ ID NO: 488291 - RNA, 20 nt, Human
aaggagccaaacauccuaca

SEQ ID NO: 488292 - RNA, 12 nt, Human
cuggcuccagcu

SEQ ID NO: 488293 - RNA, 24 nt, Human
ccccugagcuugcagagaugaggc

SEQ ID NO: 488294 - RNA, 20 nt, Human
gcccauccugccccugagcc

SEQ ID NO: 488295 - RNA, 16 nt, Human
auacauguuacaacac

SEQ ID NO: 488296 - RNA, 15 nt, Human
uuacagagacagaaa

SEQ ID NO: 488297 - RNA, 23 nt, Human
aguucuacuccauuaaauauaaa

SEQ ID NO: 488298 - RNA, 18 nt, Human
caugaagauguagaggag

SEQ ID NO: 488299 - RNA, 20 nt, Human
cuugccauaauuacuauguc

SEQ ID NO: 488300 - RNA, 15 nt, Human
ugguuuagaaagcuu

SEQ ID NO: 488301 - RNA, 19 nt, Human
gguuccuuccucugagccu

SEQ ID NO: 488302 - RNA, 13 nt, Human
auauaaagcaaga

SEQ ID NO: 488303 - RNA, 18 nt, Human
ccugcaaagcccagcuug

SEQ ID NO: 488304 - RNA, 12 nt, Human
uauaacaacaac

SEQ ID NO: 488305 - RNA, 16 nt, Human
uguucuauaacaacaa

SEQ ID NO: 488306 - RNA, 14 nt, Human
cucuggcuccagcu

SEQ ID NO: 488307 - RNA, 15 nt, Human
ugccccgucccccuc

SEQ ID NO: 488308 - RNA, 13 nt, Human
gagacagcucugc

SEQ ID NO: 488309 - RNA, 14 nt, Human
aauggcuaagcaaa

SEQ ID NO: 488310 - RNA, 17 nt, Human
cuuucccaacagcucca

SEQ ID NO: 488311 - RNA, 18 nt, Human
gaggcuccacuuggucug

SEQ ID NO: 488312 - RNA, 17 nt, Human
cguaaucguguccccua

SEQ ID NO: 488313 - RNA, 15 nt, Human
ugggacagggaggac

SEQ ID NO: 488314 - RNA, 17 nt, Human
agcagcucauaaaugaa

SEQ ID NO: 488315 - RNA, 19 nt, Human
cuucuggguuccuuccucu

SEQ ID NO: 488316 - RNA, 21 nt, Human
cugcccugcugagucccaggc

SEQ ID NO: 488317 - RNA, 15 nt, Human
aaagaaagaaaauca

SEQ ID NO: 488318 - RNA, 14 nt, Human
aaaacuucagacau

SEQ ID NO: 488319 - RNA, 20 nt, Human
auaagccagacaucaacaga

SEQ ID NO: 488320 - RNA, 14 nt, Human
cugcugagucccag

SEQ ID NO: 488321 - RNA, 22 nt, Human
agacucugucucaguccaugaa

SEQ ID NO: 488322 - RNA, 16 nt, Human
cuuuaugcuaagugaa

SEQ ID NO: 488323 - RNA, 22 nt, Human
uggguuccuuccucugagccuu

SEQ ID NO: 488324 - RNA, 20 nt, Human
cccugccccccagcccuccu

SEQ ID NO: 488325 - RNA, 20 nt, Human
agcaucucauuuauaaugua

SEQ ID NO: 488326 - RNA, 15 nt, Human
accucccccaucucu

SEQ ID NO: 488327 - RNA, 18 nt, Human
uuuuauaucaauuuaaaa

SEQ ID NO: 488328 - RNA, 22 nt, Human
uauuuaagagaacaagcaaaua

SEQ ID NO: 488329 - RNA, 23 nt, Human
aaguauccuucagccugaaagag

SEQ ID NO: 488330 - RNA, 17 nt, Human
aaagcagggacuugaac

SEQ ID NO: 488331 - RNA, 14 nt, Human
ugaucaccugcccu

SEQ ID NO: 488332 - RNA, 15 nt, Human
ugauuucauucaaua

SEQ ID NO: 488333 - RNA, 22 nt, Human
uucaauaucuuuuuuuuaauaa

SEQ ID NO: 488334 - RNA, 21 nt, Human
caagacccaaaaggcagaagc

SEQ ID NO: 488335 - RNA, 12 nt, Human
gcucagcccugg

SEQ ID NO: 488336 - RNA, 16 nt, Human
aauugacccacaagaa

SEQ ID NO: 488337 - RNA, 20 nt, Human
uccagccugagcgacaguga

SEQ ID NO: 488338 - RNA, 22 nt, Human
ugaauggcuaagcaaaauguga

SEQ ID NO: 488339 - RNA, 16 nt, Human
ugaaguacucauacau

SEQ ID NO: 488340 - RNA, 20 nt, Human
cuacuuccccuuccuaauuc

SEQ ID NO: 488341 - RNA, 23 nt, Human
caccaaggagccaaacauccuac

SEQ ID NO: 488342 - RNA, 16 nt, Human
ccacuuggucugugag

SEQ ID NO: 488343 - RNA, 19 nt, Human
caagaagauaaucuccaaa

SEQ ID NO: 488344 - RNA, 21 nt, Human
auucauagcagcuuauucaca

SEQ ID NO: 488345 - RNA, 14 nt, Human
uauaauguagcagc

SEQ ID NO: 488346 - RNA, 13 nt, Human
ccccagcccuccu

SEQ ID NO: 488347 - RNA, 13 nt, Human
ucuauaacaacaa

SEQ ID NO: 488348 - RNA, 16 nt, Human
uggucugugagaugcu

SEQ ID NO: 488349 - RNA, 15 nt, Human
ugcagauaaacagua

SEQ ID NO: 488350 - RNA, 16 nt, Human
gucuaucuuugagcgc

SEQ ID NO: 488351 - RNA, 18 nt, Human
uggucaauuuuguuaugu

SEQ ID NO: 488352 - RNA, 16 nt, Human
cacuggacucaccucc

SEQ ID NO: 488353 - RNA, 20 nt, Human
cccugcacuccagccugagc

SEQ ID NO: 488354 - RNA, 19 nt, Human
cgcccacuagacccacugg

SEQ ID NO: 488355 - RNA, 21 nt, Human
caacaacaaaagcgauuauua

SEQ ID NO: 488356 - RNA, 20 nt, Human
auuuaagagaacaagcaaau

SEQ ID NO: 488357 - RNA, 16 nt, Human
ggaugccccguccccc

SEQ ID NO: 488358 - RNA, 23 nt, Human
aaauuuacagagacagaaagcag

SEQ ID NO: 488359 - RNA, 22 nt, Human
gugccucaccccuugccauaau

SEQ ID NO: 488360 - RNA, 19 nt, Human
caaauauaaacagcaacuu

SEQ ID NO: 488361 - RNA, 16 nt, Human
agggaggacgcucucu

SEQ ID NO: 488362 - RNA, 23 nt, Human
uaggauggcuaguaucaaaagaa

SEQ ID NO: 488363 - RNA, 21 nt, Human
acuccauuaaauauaaagcaa

SEQ ID NO: 488364 - RNA, 21 nt, Human
ugcccauccugccccugagcc

SEQ ID NO: 488365 - RNA, 15 nt, Human
uugacccacaagaaa

SEQ ID NO: 488366 - RNA, 15 nt, Human
aagaagugaaaaucu

SEQ ID NO: 488367 - RNA, 16 nt, Human
cugagccucagucucc

SEQ ID NO: 488368 - RNA, 16 nt, Human
caugggacagggagga

SEQ ID NO: 488369 - RNA, 21 nt, Human
ugagcucagcccuggugggca

SEQ ID NO: 488370 - RNA, 23 nt, Human
cacagauuugagcucagcccugg

SEQ ID NO: 488371 - RNA, 18 nt, Human
uaaauugacacuuaaaaa

SEQ ID NO: 488372 - RNA, 16 nt, Human
ggccuccauccugagg

SEQ ID NO: 488373 - RNA, 16 nt, Human
ccccugcacuccagcc

SEQ ID NO: 488374 - RNA, 21 nt, Human
gaaagcagggacuugaaccca

SEQ ID NO: 488375 - RNA, 19 nt, Human
acucugucucaguccauga

SEQ ID NO: 488376 - RNA, 15 nt, Human
uucaaaguuaagaau

SEQ ID NO: 488377 - RNA, 12 nt, Human
gccccugagccc

SEQ ID NO: 488378 - RNA, 13 nt, Human
cccuccuuaucaa

SEQ ID NO: 488379 - RNA, 17 nt, Human
ucucuggccuucggccu

SEQ ID NO: 488380 - RNA, 18 nt, Human
uaucaaaagaaagaaaau

SEQ ID NO: 488381 - RNA, 20 nt, Human
acuccagugagacagcucug

SEQ ID NO: 488382 - RNA, 15 nt, Human
uccuacaagacacag

SEQ ID NO: 488383 - RNA, 13 nt, Human
aaaugaaagcagg

SEQ ID NO: 488384 - RNA, 16 nt, Human
uguucuaagaagugaa

SEQ ID NO: 488385 - RNA, 20 nt, Human
caaacauccuacaagacaca

SEQ ID NO: 488386 - RNA, 18 nt, Human
acagagacagaaagcaga

SEQ ID NO: 488387 - RNA, 18 nt, Human
ccacuuggucugugagau

SEQ ID NO: 488388 - RNA, 18 nt, Human
ccucuggcuccagcuggc

SEQ ID NO: 488389 - RNA, 17 nt, Human
caagacccaaaaggcag

SEQ ID NO: 488390 - RNA, 14 nt, Human
ccugccccccagcc

SEQ ID NO: 488391 - RNA, 15 nt, Human
ccugccccccagccc

SEQ ID NO: 488392 - RNA, 16 nt, Human
gccuaagugcagcccc

SEQ ID NO: 488393 - RNA, 12 nt, Human
ucaccccuugcc

SEQ ID NO: 488394 - RNA, 21 nt, Human
gcccauccugccccugagccc

SEQ ID NO: 488395 - RNA, 15 nt, Human
uaaaugaaauugaaa

SEQ ID NO: 488396 - RNA, 21 nt, Human
gcugagucccaggcugagccu

SEQ ID NO: 488397 - RNA, 19 nt, Human
ugcacacagcacgggggcc

SEQ ID NO: 488398 - RNA, 15 nt, Human
gaagauguagaggag

SEQ ID NO: 488399 - RNA, 19 nt, Human
ccugccuaagugcagcccc

SEQ ID NO: 488400 - RNA, 15 nt, Human
auccaacuuauauuu

SEQ ID NO: 488401 - RNA, 20 nt, Human
acaugagguacugagaguga

SEQ ID NO: 488402 - RNA, 15 nt, Human
auaucaauuuaaaaa

SEQ ID NO: 488403 - RNA, 12 nt, Human
cuaagaagugaa

SEQ ID NO: 488404 - RNA, 15 nt, Human
ggacucaccuccccc

SEQ ID NO: 488405 - RNA, 18 nt, Human
gaccccugagcuugcaga

SEQ ID NO: 488406 - RNA, 20 nt, Human
ccagugagacagcucugcau

SEQ ID NO: 488407 - RNA, 20 nt, Human
aaucuuuauaguucuacucc

SEQ ID NO: 488408 - RNA, 15 nt, Human
ggccuccauccugag

SEQ ID NO: 488409 - RNA, 16 nt, Human
agagguccacaacaca

SEQ ID NO: 488410 - RNA, 16 nt, Human
uauaucaauuuaaaaa

SEQ ID NO: 488411 - RNA, 16 nt, Human
ccucagucucccuccc

SEQ ID NO: 488412 - RNA, 22 nt, Human
agacucgggauuaguacacacu

SEQ ID NO: 488413 - RNA, 22 nt, Human
aucucuucuggguuccuuccuc

SEQ ID NO: 488414 - RNA, 16 nt, Human
uaaaugaaauugaaaa

SEQ ID NO: 488415 - RNA, 14 nt, Human
ugcuggagcucugc

SEQ ID NO: 488416 - RNA, 13 nt, Human
acaagagcuuaac

SEQ ID NO: 488417 - RNA, 19 nt, Human
acgaugggcuuucccaaca

SEQ ID NO: 488418 - RNA, 14 nt, Human
gagagugaacaaau

SEQ ID NO: 488419 - RNA, 13 nt, Human
uuuaaaaaaaaac

SEQ ID NO: 488420 - RNA, 13 nt, Human
gcucucuggccuu

SEQ ID NO: 488421 - RNA, 22 nt, Human
gaauuucuucaacucccugccc

SEQ ID NO: 488422 - RNA, 16 nt, Human
cccacuggacucaccu

SEQ ID NO: 488423 - RNA, 16 nt, Human
ugagcucagcccuggu

SEQ ID NO: 488424 - RNA, 18 nt, Human
agugucaaugcagccccc

SEQ ID NO: 488425 - RNA, 23 nt, Human
uggaaauguuuacagauccccaa

SEQ ID NO: 488426 - RNA, 19 nt, Human
augaaagcagggacuugaa

SEQ ID NO: 488427 - RNA, 18 nt, Human
ccaagccuggcaagggaa

SEQ ID NO: 488428 - RNA, 16 nt, Human
gagaaacuggaacucu

SEQ ID NO: 488429 - RNA, 15 nt, Human
cuaagcaaaauguga

SEQ ID NO: 488430 - RNA, 15 nt, Human
cccugccccccagcc

SEQ ID NO: 488431 - RNA, 14 nt, Human
ugagcucagcccug

SEQ ID NO: 488432 - RNA, 21 nt, Human
cccccucuggcuccagcuggc

SEQ ID NO: 488433 - RNA, 16 nt, Human
ucuuggucucaguguc

SEQ ID NO: 488434 - RNA, 14 nt, Human
cugccccccagccc

SEQ ID NO: 488435 - RNA, 22 nt, Human
cugaggcuccacuuggucugug

SEQ ID NO: 488436 - RNA, 19 nt, Human
cugccccccagcccuccuu

SEQ ID NO: 488437 - RNA, 18 nt, Human
aaaaugguauuaaagauc

SEQ ID NO: 488438 - RNA, 17 nt, Human
accugagccccaaaagg

SEQ ID NO: 488439 - RNA, 15 nt, Human
ugagcgcccacuaga

SEQ ID NO: 488440 - RNA, 16 nt, Human
ggcugagccucagucu

SEQ ID NO: 488441 - RNA, 17 nt, Human
agcgacagugagacucu

SEQ ID NO: 488442 - RNA, 13 nt, Human
ccagcccuccuua

SEQ ID NO: 488443 - RNA, 16 nt, Human
uauccuacuuccccuu

SEQ ID NO: 488444 - RNA, 20 nt, Human
uaggaauugacccacaagaa

SEQ ID NO: 488445 - RNA, 16 nt, Human
gaagauguagaggaga

SEQ ID NO: 488446 - RNA, 22 nt, Human
caucucuucuggguuccuuccu

SEQ ID NO: 488447 - RNA, 20 nt, Human
caagcucuaucaccaaggag

SEQ ID NO: 488448 - RNA, 19 nt, Human
uacuauccaacuuauauuu

SEQ ID NO: 488449 - RNA, 16 nt, Human
ugcaugguuuagaaag

SEQ ID NO: 488450 - RNA, 16 nt, Human
agugucaaugcagccc

SEQ ID NO: 488451 - RNA, 16 nt, Human
agaugcuagaacuccc

SEQ ID NO: 488452 - RNA, 18 nt, Human
cacuccagugagacagcu

SEQ ID NO: 488453 - RNA, 11 nt, Human
ucaccugcccu

SEQ ID NO: 488454 - RNA, 21 nt, Human
cgaaguauccuucagccugaa

SEQ ID NO: 488455 - RNA, 23 nt, Human
caucaacagauaaauaguuuaug

SEQ ID NO: 488456 - RNA, 15 nt, Human
gucaaugcagccccc

SEQ ID NO: 488457 - RNA, 14 nt, Human
ggccuucggccucc

SEQ ID NO: 488458 - RNA, 23 nt, Human
ugcagagguccacaacacacaga

SEQ ID NO: 488459 - RNA, 14 nt, Human
gauuaguacacacu

SEQ ID NO: 488460 - RNA, 20 nt, Human
ggccuaugcagagguccaca

SEQ ID NO: 488461 - RNA, 13 nt, Human
ucucccucccuug

SEQ ID NO: 488462 - RNA, 14 nt, Human
uccacuuggucugu

SEQ ID NO: 488463 - RNA, 12 nt, Human
cuucaacucccu

SEQ ID NO: 488464 - RNA, 13 nt, Human
uuauucacaagac

SEQ ID NO: 488465 - RNA, 14 nt, Human
acuggacucaccuc

SEQ ID NO: 488466 - RNA, 18 nt, Human
gccugagcgacagugaga

SEQ ID NO: 488467 - RNA, 16 nt, Human
cugaucaccugcccug

SEQ ID NO: 488468 - RNA, 14 nt, Human
uugacccacaagaa

SEQ ID NO: 488469 - RNA, 17 nt, Human
aaaguacaagagcuuaa

SEQ ID NO: 488470 - RNA, 20 nt, Human
ccagcuggccgggagccuga

SEQ ID NO: 488471 - RNA, 16 nt, Human
ccugcaaagcccagcu

SEQ ID NO: 488472 - RNA, 15 nt, Human
gcagagguugcagug

SEQ ID NO: 488473 - RNA, 16 nt, Human
uaucaaaagaaagaaa

SEQ ID NO: 488474 - RNA, 14 nt, Human
caagcaaauauaaa

SEQ ID NO: 488475 - RNA, 22 nt, Human
ccucccuuggggccuaugcaga

SEQ ID NO: 488476 - RNA, 18 nt, Human
cucccuuggggccuaugc

SEQ ID NO: 488477 - RNA, 18 nt, Human
cugagccuugggaccccu

SEQ ID NO: 488478 - RNA, 23 nt, Human
cuagacccacuggacucaccucc

SEQ ID NO: 488479 - RNA, 17 nt, Human
gccugagcgacagugag

SEQ ID NO: 488480 - RNA, 16 nt, Human
aaugaaagcagggacu

SEQ ID NO: 488481 - RNA, 16 nt, Human
ccacuuauaggaauug

SEQ ID NO: 488482 - RNA, 13 nt, Human
aacaacaacaaca

SEQ ID NO: 488483 - RNA, 16 nt, Human
gccucagucucccucc

SEQ ID NO: 488484 - RNA, 14 nt, Human
aauaguuuaugauu

SEQ ID NO: 488485 - RNA, 15 nt, Human
acucaccucccccau

SEQ ID NO: 488486 - RNA, 23 nt, Human
aauuuucauuguucuauaacaac

SEQ ID NO: 488487 - RNA, 19 nt, Human
ugagucccaggcugagccu

SEQ ID NO: 488488 - RNA, 17 nt, Human
agucccaggcugagccu

SEQ ID NO: 488489 - RNA, 17 nt, Human
gccaugggacagggagg

SEQ ID NO: 488490 - RNA, 16 nt, Human
aggccaugggacaggg

SEQ ID NO: 488491 - RNA, 20 nt, Human
uuucuucaacucccugcccc

SEQ ID NO: 488492 - RNA, 14 nt, Human
gcaaauauaaacag

SEQ ID NO: 488493 - RNA, 15 nt, Human
gacucaccuccccca

SEQ ID NO: 488494 - RNA, 19 nt, Human
cggccuccauccugaggcu

SEQ ID NO: 488495 - RNA, 14 nt, Human
gccucagucucccu

SEQ ID NO: 488496 - RNA, 20 nt, Human
gagccucagucucccucccu

SEQ ID NO: 488497 - RNA, 17 nt, Human
cuuccuaauuccacagc

SEQ ID NO: 488498 - RNA, 15 nt, Human
uuaagagaacaagca

SEQ ID NO: 488499 - RNA, 15 nt, Human
acaggguuuauguuu

SEQ ID NO: 488500 - RNA, 22 nt, Human
ugucucuacuaaaaauacaaaa

SEQ ID NO: 488501 - RNA, 20 nt, Human
cacagcacgggggccaagga

SEQ ID NO: 488502 - RNA, 15 nt, Human
cuaucuuugagcgcc

SEQ ID NO: 488503 - RNA, 20 nt, Human
agcaacuuguguuccuaaca

SEQ ID NO: 488504 - RNA, 12 nt, Human
acaugagguacu

SEQ ID NO: 488505 - RNA, 15 nt, Human
gccucagucucccuc

SEQ ID NO: 488506 - RNA, 18 nt, Human
uuggggccuaugcagagg

SEQ ID NO: 488507 - RNA, 19 nt, Human
augaaguacucauacaugu

SEQ ID NO: 488508 - RNA, 19 nt, Human
cuccagcuggccgggagcc

SEQ ID NO: 488509 - RNA, 21 nt, Human
ccaaggaugccccgucccccu

SEQ ID NO: 488510 - RNA, 16 nt, Human
uuaagagaacaagcaa

SEQ ID NO: 488511 - RNA, 19 nt, Human
ccuccauccugaggcucca

SEQ ID NO: 488512 - RNA, 13 nt, Human
cucugagccuugg

SEQ ID NO: 488513 - RNA, 22 nt, Human
cuucaacucccugccccccagc

SEQ ID NO: 488514 - RNA, 19 nt, Human
uggcaagcucuaucaccaa

SEQ ID NO: 488515 - RNA, 12 nt, Human
cuuccucugagc

SEQ ID NO: 488516 - RNA, 16 nt, Human
agagaacaagcaaaua

SEQ ID NO: 488517 - RNA, 15 nt, Human
auauuuuuuguuaaa

SEQ ID NO: 488518 - RNA, 12 nt, Human
acaagaaaugaa

SEQ ID NO: 488519 - RNA, 12 nt, Human
accccugagcuu

SEQ ID NO: 488520 - RNA, 21 nt, Human
cucaaaacuucagacauagaa

SEQ ID NO: 488521 - RNA, 15 nt, Human
aaugaauggcuaagc

SEQ ID NO: 488522 - RNA, 22 nt, Human
uugacccacaagaaaugaaagc

SEQ ID NO: 488523 - RNA, 21 nt, Human
cuaaauugacacuuaaaaaug

SEQ ID NO: 488524 - RNA, 15 nt, Human
cugcacuccagccug

SEQ ID NO: 488525 - RNA, 19 nt, Human
auuuaagagaacaagcaaa

SEQ ID NO: 488526 - RNA, 20 nt, Human
uccaagccucauguccacug

SEQ ID NO: 488527 - RNA, 16 nt, Human
cacuuaaaaaugguuu

SEQ ID NO: 488528 - RNA, 17 nt, Human
uggcuaagcaaaaugug

SEQ ID NO: 488529 - RNA, 11 nt, Human
aaccugagccc

SEQ ID NO: 488530 - RNA, 13 nt, Human
cacaacacacaga

SEQ ID NO: 488531 - RNA, 12 nt, Human
gucccaggcuga

SEQ ID NO: 488532 - RNA, 13 nt, Human
agacagcucugca

SEQ ID NO: 488533 - RNA, 18 nt, Human
gccccgucccccucuggc

SEQ ID NO: 488534 - RNA, 22 nt, Human
ccauacuaauuauacccccugc

SEQ ID NO: 488535 - RNA, 16 nt, Human
ccaggcugagccucag

SEQ ID NO: 488536 - RNA, 16 nt, Human
aauuccacagcugcuc

SEQ ID NO: 488537 - RNA, 14 nt, Human
aucaaaagaaagaa

SEQ ID NO: 488538 - RNA, 17 nt, Human
cccacuagacccacugg

SEQ ID NO: 488539 - RNA, 15 nt, Human
ggccuucggccucca

SEQ ID NO: 488540 - RNA, 22 nt, Human
acagauuugagcucagcccugg

SEQ ID NO: 488541 - RNA, 14 nt, Human
aaccugagccccaa

SEQ ID NO: 488542 - RNA, 19 nt, Human
guacugagagugaacaaau

SEQ ID NO: 488543 - RNA, 14 nt, Human
acaagcaaauauaa

SEQ ID NO: 488544 - RNA, 22 nt, Human
uauccuacuuccccuuccuaau

SEQ ID NO: 488545 - RNA, 23 nt, Human
ggaggcagagguugcagugagcc

SEQ ID NO: 488546 - RNA, 14 nt, Human
cagauuugagcuca

SEQ ID NO: 488547 - RNA, 16 nt, Human
auccuacaagacacag

SEQ ID NO: 488548 - RNA, 15 nt, Human
ccaccuuacuucuuc

SEQ ID NO: 488549 - RNA, 20 nt, Human
uaagaaucuuuauaguucua

SEQ ID NO: 488550 - RNA, 15 nt, Human
augggacagggagga

SEQ ID NO: 488551 - RNA, 12 nt, Human
uaauuccacagc

SEQ ID NO: 488552 - RNA, 23 nt, Human
aucucuucuggguuccuuccucu

SEQ ID NO: 488553 - RNA, 16 nt, Human
uugccauaauuacuau

SEQ ID NO: 488554 - RNA, 15 nt, Human
uucugcacacagcac

SEQ ID NO: 488555 - RNA, 20 nt, Human
ccauuguggucacaggaagu

SEQ ID NO: 488556 - RNA, 13 nt, Human
aaaaaugguuuaa

SEQ ID NO: 488557 - RNA, 23 nt, Human
caucucuucuggguuccuuccuc

SEQ ID NO: 488558 - RNA, 17 nt, Human
uuaaauggucaauuuug

SEQ ID NO: 488559 - RNA, 21 nt, Human
accaaggagccaaacauccua

SEQ ID NO: 488560 - RNA, 17 nt, Human
gcaugguuuagaaagcu

SEQ ID NO: 488561 - RNA, 14 nt, Human
ucagucucccuccc

SEQ ID NO: 488562 - RNA, 11 nt, Human
aauuccacagc

SEQ ID NO: 488563 - RNA, 22 nt, Human
agccaaacauccuacaagacac

SEQ ID NO: 488564 - RNA, 14 nt, Human
cacuuauaggaauu

SEQ ID NO: 488565 - RNA, 22 nt, Human
cuccugccuaagugcagccccg

SEQ ID NO: 488566 - RNA, 20 nt, Human
gagccugaucaccugcccug

SEQ ID NO: 488567 - RNA, 13 nt, Human
agccucagucucc

SEQ ID NO: 488568 - RNA, 19 nt, Human
accccugagcuugcagaga

SEQ ID NO: 488569 - RNA, 19 nt, Human
caacuuauauuucugcuuu

SEQ ID NO: 488570 - RNA, 12 nt, Human
aaauauaaagca

SEQ ID NO: 488571 - RNA, 17 nt, Human
cucagucucccucccuu

SEQ ID NO: 488572 - RNA, 17 nt, Human
ccugagcuugcagagau

SEQ ID NO: 488573 - RNA, 12 nt, Human
acucccugcccc

SEQ ID NO: 488574 - RNA, 17 nt, Human
cauuaaauauaaagcaa

SEQ ID NO: 488575 - RNA, 15 nt, Human
uccaagccucauguc

SEQ ID NO: 488576 - RNA, 20 nt, Human
uugaaaaugguauuaaagau

SEQ ID NO: 488577 - RNA, 20 nt, Human
ccuccugccuaagugcagcc

SEQ ID NO: 488578 - RNA, 14 nt, Human
uucagccugaaaga

SEQ ID NO: 488579 - RNA, 11 nt, Human
augggacaggg

SEQ ID NO: 488580 - RNA, 19 nt, Human
cuggccuucggccuccauc

SEQ ID NO: 488581 - RNA, 14 nt, Human
ggaaguagaggagg

SEQ ID NO: 488582 - RNA, 23 nt, Human
cacuggacucaccucccccaucu

SEQ ID NO: 488583 - RNA, 23 nt, Human
uuuaagagaacaagcaaauauaa

SEQ ID NO: 488584 - RNA, 21 nt, Human
caauuuuguuauguauauuuu

SEQ ID NO: 488585 - RNA, 14 nt, Human
agcaaauauaaaca

SEQ ID NO: 488586 - RNA, 22 nt, Human
caguauggcagcuuuccucaaa

SEQ ID NO: 488587 - RNA, 13 nt, Human
cuuaucaaaggac

SEQ ID NO: 488588 - RNA, 17 nt, Human
uccucugagccuuggga

SEQ ID NO: 488589 - RNA, 22 nt, Human
auggaaauguuuacagaucccc

SEQ ID NO: 488590 - RNA, 16 nt, Human
uguccccuauccuacu

SEQ ID NO: 488591 - RNA, 16 nt, Human
caggaaguagaggagg

SEQ ID NO: 488592 - RNA, 17 nt, Human
cuacacuccagugagac

SEQ ID NO: 488593 - RNA, 18 nt, Human
cuuccucugagccuuggg

SEQ ID NO: 488594 - RNA, 17 nt, Human
cuauccuacuuccccuu

SEQ ID NO: 488595 - RNA, 15 nt, Human
gcaagcucuaucacc

SEQ ID NO: 488596 - RNA, 22 nt, Human
aauugacccacaagaaaugaaa

SEQ ID NO: 488597 - RNA, 23 nt, Human
gaaauugaaaaugguauuaaaga

SEQ ID NO: 488598 - RNA, 16 nt, Human
guuccuuccucugagc

SEQ ID NO: 488599 - RNA, 12 nt, Human
ucuacacuccag

SEQ ID NO: 488600 - RNA, 15 nt, Human
ccuggugggcagaga

SEQ ID NO: 488601 - RNA, 14 nt, Human
cccugccccccagc

SEQ ID NO: 488602 - RNA, 17 nt, Human
agaaucacuugaacccg

SEQ ID NO: 488603 - RNA, 17 nt, Human
aaacauccuacaagaca

SEQ ID NO: 488604 - RNA, 15 nt, Human
cauguccacugguuc

SEQ ID NO: 488605 - RNA, 16 nt, Human
aaauaguuuaugauuc

SEQ ID NO: 488606 - RNA, 17 nt, Human
gugccuguaaucacagc

SEQ ID NO: 488607 - RNA, 18 nt, Human
cagcugcucaauaaagua

SEQ ID NO: 488608 - RNA, 18 nt, Human
uguggucacaggaaguag

SEQ ID NO: 488609 - RNA, 19 nt, Human
aauuuuguuauguauauuu

SEQ ID NO: 488610 - RNA, 16 nt, Human
cuucaacucccugccc

SEQ ID NO: 488611 - RNA, 20 nt, Human
aauaagccagacaucaacag

SEQ ID NO: 488612 - RNA, 17 nt, Human
cuggacucaccuccccc

SEQ ID NO: 488613 - RNA, 23 nt, Human
agccuugggaccccugagcuugc

SEQ ID NO: 488614 - RNA, 15 nt, Human
ucugucucaguccau

SEQ ID NO: 488615 - RNA, 15 nt, Human
acauccuacaagaca

SEQ ID NO: 488616 - RNA, 21 nt, Human
gacagaaagcagaacagugau

SEQ ID NO: 488617 - RNA, 22 nt, Human
cccccugcaaagcccagcuuga

SEQ ID NO: 488618 - RNA, 15 nt, Human
uuaaauauaaagcaa

SEQ ID NO: 488619 - RNA, 16 nt, Human
ccuacaugagguacug

SEQ ID NO: 488620 - RNA, 20 nt, Human
cugcacacagcacgggggcc

SEQ ID NO: 488621 - RNA, 19 nt, Human
ccauccugccccugagccc

SEQ ID NO: 488622 - RNA, 17 nt, Human
ccucagucucccucccu

SEQ ID NO: 488623 - RNA, 14 nt, Human
gagcccauggcacu

SEQ ID NO: 488624 - RNA, 12 nt, Human
cuacaagacaca

SEQ ID NO: 488625 - RNA, 18 nt, Human
cccaggcugagccucagu

SEQ ID NO: 488626 - RNA, 15 nt, Human
cugcagauaaacagu

SEQ ID NO: 488627 - RNA, 22 nt, Human
agacccacuggacucaccuccc

SEQ ID NO: 488628 - RNA, 23 nt, Human
gaggcauuuaggccaugggacag

SEQ ID NO: 488629 - RNA, 12 nt, Human
aagagcuuaaca

SEQ ID NO: 488630 - RNA, 16 nt, Human
acagagacagaaagca

SEQ ID NO: 488631 - RNA, 14 nt, Human
gcuggagcucugcc

SEQ ID NO: 488632 - RNA, 13 nt, Human
agcccagcuugaa

SEQ ID NO: 488633 - RNA, 19 nt, Human
gccccccagcccuccuuau

SEQ ID NO: 488634 - RNA, 17 nt, Human
agcucugcccauccugc

SEQ ID NO: 488635 - RNA, 19 nt, Human
cuaguaucaaaagaaagaa

SEQ ID NO: 488636 - RNA, 23 nt, Human
aaagcccagcuugaaaccuucac

SEQ ID NO: 488637 - RNA, 13 nt, Human
auccugaggcucc

SEQ ID NO: 488638 - RNA, 22 nt, Human
ugagacucugucucaguccaug

SEQ ID NO: 488639 - RNA, 21 nt, Human
caaagcccagcuugaaaccuu

SEQ ID NO: 488640 - RNA, 15 nt, Human
caggaaguagaggag

SEQ ID NO: 488641 - RNA, 15 nt, Human
guucugcagauaaac

SEQ ID NO: 488642 - RNA, 17 nt, Human
ccucuggcuccagcugg

SEQ ID NO: 488643 - RNA, 21 nt, Human
gaaauguuuacagauccccaa

SEQ ID NO: 488644 - RNA, 13 nt, Human
ccaacuuauauuu

SEQ ID NO: 488645 - RNA, 13 nt, Human
aagcaaauauaaa

SEQ ID NO: 488646 - RNA, 19 nt, Human
uauauuuuuuguuaaauga

SEQ ID NO: 488647 - RNA, 21 nt, Human
ccugaucaccugcccugcuga

SEQ ID NO: 488648 - RNA, 22 nt, Human
guguccccuauccuacuucccc

SEQ ID NO: 488649 - RNA, 19 nt, Human
auguuuacagauccccaag

SEQ ID NO: 488650 - RNA, 19 nt, Human
uuccucccuucucuucaca

SEQ ID NO: 488651 - RNA, 19 nt, Human
uccccuauccuacuucccc

SEQ ID NO: 488652 - RNA, 17 nt, Human
uuccaagccucaugucc

SEQ ID NO: 488653 - RNA, 14 nt, Human
cacaacacacagau

SEQ ID NO: 488654 - RNA, 13 nt, Human
agacacagugacc

SEQ ID NO: 488655 - RNA, 14 nt, Human
aagaagugaaaauc

SEQ ID NO: 488656 - RNA, 17 nt, Human
caaaagcgauuauuauu

SEQ ID NO: 488657 - RNA, 16 nt, Human
aagagaacaagcaaau

SEQ ID NO: 488658 - RNA, 16 nt, Human
cagucucccucccuug

SEQ ID NO: 488659 - RNA, 17 nt, Human
uaaaugaaauugaaaau

SEQ ID NO: 488660 - RNA, 16 nt, Human
uaggauguugaaaaag

SEQ ID NO: 488661 - RNA, 18 nt, Human
uugaaaaugguauuaaag

SEQ ID NO: 488662 - RNA, 20 nt, Human
ggagccugaucaccugcccu

SEQ ID NO: 488663 - RNA, 23 nt, Human
cagagguugcagugagccgagau

SEQ ID NO: 488664 - RNA, 19 nt, Human
acuggacucaccuccccca

SEQ ID NO: 488665 - RNA, 18 nt, Human
uaguaucaaaagaaagaa

SEQ ID NO: 488666 - RNA, 15 nt, Human
agaacaagcaaauau

SEQ ID NO: 488667 - RNA, 21 nt, Human
aaaaaguucugcagauaaaca

SEQ ID NO: 488668 - RNA, 16 nt, Human
gccaaggaugccccgu

SEQ ID NO: 488669 - RNA, 18 nt, Human
auccuucagccugaaaga

SEQ ID NO: 488670 - RNA, 18 nt, Human
ugaaaaaguucugcagau

SEQ ID NO: 488671 - RNA, 17 nt, Human
gacucaccucccccauc

SEQ ID NO: 488672 - RNA, 14 nt, Human
acuuggucugugag

SEQ ID NO: 488673 - RNA, 21 nt, Human
uccuacaagacacagugacca

SEQ ID NO: 488674 - RNA, 15 nt, Human
gaaaugaaagcaggg

SEQ ID NO: 488675 - RNA, 20 nt, Human
ugccccccagcccuccuuau

SEQ ID NO: 488676 - RNA, 18 nt, Human
auaacaacaacaacaaaa

SEQ ID NO: 488677 - RNA, 22 nt, Human
cuuccuaauuccacagcugcuc

SEQ ID NO: 488678 - RNA, 19 nt, Human
accauuuuggcaagcucua

SEQ ID NO: 488679 - RNA, 16 nt, Human
gaaucacuugaacccg

SEQ ID NO: 488680 - RNA, 17 nt, Human
aggcuagaaccaccugc

SEQ ID NO: 488681 - RNA, 15 nt, Human
ucagucucccucccu

SEQ ID NO: 488682 - RNA, 18 nt, Human
ccuuccuaauuccacagc

SEQ ID NO: 488683 - RNA, 14 nt, Human
aauauaaagcaaga

SEQ ID NO: 488684 - RNA, 18 nt, Human
gccccugcacuccagccu

SEQ ID NO: 488685 - RNA, 16 nt, Human
acuaguuucccuugca

SEQ ID NO: 488686 - RNA, 13 nt, Human
ccacaacacacag

SEQ ID NO: 488687 - RNA, 20 nt, Human
ccagcuugaaaccuucacuu

SEQ ID NO: 488688 - RNA, 18 nt, Human
ggaggacgcucucuggcc

SEQ ID NO: 488689 - RNA, 10 nt, Human
ccugagcccc

SEQ ID NO: 488690 - RNA, 14 nt, Human
cucccuuggggccu

SEQ ID NO: 488691 - RNA, 23 nt, Human
ucaauaucuuuuuuuuaauaaac

SEQ ID NO: 488692 - RNA, 17 nt, Human
ccacugcagaagacagu

SEQ ID NO: 488693 - RNA, 18 nt, Human
aaggaugccccguccccc

SEQ ID NO: 488694 - RNA, 18 nt, Human
gagcgacagugagacucu

SEQ ID NO: 488695 - RNA, 17 nt, Human
gccccccagcccuccuu

SEQ ID NO: 488696 - RNA, 17 nt, Human
auggcuaguaucaaaag

SEQ ID NO: 488697 - RNA, 16 nt, Human
cucagcccuggugggc

SEQ ID NO: 488698 - RNA, 13 nt, Human
ugagcgacaguga

SEQ ID NO: 488699 - RNA, 17 nt, Human
agaaaugaaagcaggga

SEQ ID NO: 488700 - RNA, 15 nt, Human
cuucucuucacaguc

SEQ ID NO: 488701 - RNA, 14 nt, Human
agagacagaaagca

SEQ ID NO: 488702 - RNA, 17 nt, Human
cccaggcugagccucag

SEQ ID NO: 488703 - RNA, 15 nt, Human
aaauauaaagcaaga

SEQ ID NO: 488704 - RNA, 15 nt, Human
aauugacccacaaga

SEQ ID NO: 488705 - RNA, 17 nt, Human
ccuauccuacuuccccu

SEQ ID NO: 488706 - RNA, 21 nt, Human
gcccugcugagucccaggcug

SEQ ID NO: 488707 - RNA, 15 nt, Human
gccccugcacuccag

SEQ ID NO: 488708 - RNA, 13 nt, Human
gcagaacagugau

SEQ ID NO: 488709 - RNA, 13 nt, Human
augcuagaacucc

SEQ ID NO: 488710 - RNA, 20 nt, Human
gauugugccccugcacucca

SEQ ID NO: 488711 - RNA, 18 nt, Human
ccuucggccuccauccug

SEQ ID NO: 488712 - RNA, 23 nt, Human
gcaacuuguguuccuaacaggaa

SEQ ID NO: 488713 - RNA, 20 nt, Human
cucccugccccccagcccuc

SEQ ID NO: 488714 - RNA, 12 nt, Human
caacccaaaugu

SEQ ID NO: 488715 - RNA, 12 nt, Human
acagagacagaa

SEQ ID NO: 488716 - RNA, 20 nt, Human
cucuguucugcacacagcac

SEQ ID NO: 488717 - RNA, 21 nt, Human
aagacucgggauuaguacaca

SEQ ID NO: 488718 - RNA, 13 nt, Human
cgggaggcagagg

SEQ ID NO: 488719 - RNA, 19 nt, Human
ccgggcgugguggugagug

SEQ ID NO: 488720 - RNA, 13 nt, Human
uccuacuuccccu

SEQ ID NO: 488721 - RNA, 17 nt, Human
ccugccccccagcccuc

SEQ ID NO: 488722 - RNA, 16 nt, Human
acauccuacaagacac

SEQ ID NO: 488723 - RNA, 14 nt, Human
cuguaaucacagcu

SEQ ID NO: 488724 - RNA, 20 nt, Human
cagccugagcgacagugaga

SEQ ID NO: 488725 - RNA, 21 nt, Human
uuccuaauuccacagcugcuc

SEQ ID NO: 488726 - RNA, 15 nt, Human
ugcaauuccacuuau

SEQ ID NO: 488727 - RNA, 22 nt, Human
acaugagguacugagagugaac

SEQ ID NO: 488728 - RNA, 13 nt, Human
acggggugaaacc

SEQ ID NO: 488729 - RNA, 21 nt, Human
ugcucaauaaaguacaagagc

SEQ ID NO: 488730 - RNA, 15 nt, Human
agagacagaaagcag

SEQ ID NO: 488731 - RNA, 18 nt, Human
cuccagccugagcgacag

SEQ ID NO: 488732 - RNA, 12 nt, Human
cuauaacaacaa

SEQ ID NO: 488733 - RNA, 20 nt, Human
gcagagaugaggccgccaug

SEQ ID NO: 488734 - RNA, 20 nt, Human
ccauacuaauuauacccccu

SEQ ID NO: 488735 - RNA, 17 nt, Human
uccuacaagacacagug

SEQ ID NO: 488736 - RNA, 16 nt, Human
ugcaacuacuauccaa

SEQ ID NO: 488737 - RNA, 18 nt, Human
agcaaauauaaacagcaa

SEQ ID NO: 488738 - RNA, 17 nt, Human
aggccaugggacaggga

SEQ ID NO: 488739 - RNA, 22 nt, Human
gaacaagcaaauauaaacagca

SEQ ID NO: 488740 - RNA, 21 nt, Human
guccccuauccuacuuccccu

SEQ ID NO: 488741 - RNA, 22 nt, Human
aagacccaaaaggcagaagcaa

SEQ ID NO: 488742 - RNA, 20 nt, Human
uugaacccgggaggcagagg

SEQ ID NO: 488743 - RNA, 16 nt, Human
accuuacuucuucuca

SEQ ID NO: 488744 - RNA, 22 nt, Human
ccgggagccugaucaccugccc

SEQ ID NO: 488745 - RNA, 11 nt, Human
ucaccuccccc

SEQ ID NO: 488746 - RNA, 16 nt, Human
auaucaauuuaaaaaa

SEQ ID NO: 488747 - RNA, 21 nt, Human
uccuucagccugaaagaggaa

SEQ ID NO: 488748 - RNA, 19 nt, Human
ucaguccaugaagauguag

SEQ ID NO: 488749 - RNA, 18 nt, Human
cucuggccuucggccucc

SEQ ID NO: 488750 - RNA, 19 nt, Human
cccccucuggcuccagcug

SEQ ID NO: 488751 - RNA, 23 nt, Human
ucggccuccauccugaggcucca

SEQ ID NO: 488752 - RNA, 15 nt, Human
gagaugcuagaacuc

SEQ ID NO: 488753 - RNA, 19 nt, Human
ccccugcaaagcccagcuu

SEQ ID NO: 488754 - RNA, 17 nt, Human
cuccuuaucaaaggaca

SEQ ID NO: 488755 - RNA, 22 nt, Human
cuucagccugaaagaggaauga

SEQ ID NO: 488756 - RNA, 20 nt, Human
ugaggcuccacuuggucugu

SEQ ID NO: 488757 - RNA, 19 nt, Human
ugagcgcccacuagaccca

SEQ ID NO: 488758 - RNA, 15 nt, Human
gcaacccaaauguuc

SEQ ID NO: 488759 - RNA, 22 nt, Human
accccugagcuugcagagauga

SEQ ID NO: 488760 - RNA, 23 nt, Human
uauaguucuacuccauuaaauau

SEQ ID NO: 488761 - RNA, 19 nt, Human
gaggcagagguugcaguga

SEQ ID NO: 488762 - RNA, 16 nt, Human
ccugccccccagcccu

SEQ ID NO: 488763 - RNA, 20 nt, Human
aggcugagaugggagaauca

SEQ ID NO: 488764 - RNA, 22 nt, Human
acuccauuaaauauaaagcaag

SEQ ID NO: 488765 - RNA, 15 nt, Human
ugccccccagcccuc

SEQ ID NO: 488766 - RNA, 22 nt, Human
cauacuauuuaagagaacaagc

SEQ ID NO: 488767 - RNA, 15 nt, Human
cuggacucaccuccc

SEQ ID NO: 488768 - RNA, 19 nt, Human
cccugccccccagcccucc

SEQ ID NO: 488769 - RNA, 12 nt, Human
ccaggcugagcc

SEQ ID NO: 488770 - RNA, 14 nt, Human
acccaaaaggcaga

SEQ ID NO: 488771 - RNA, 21 nt, Human
auaguuguaccgcaaugugac

SEQ ID NO: 488772 - RNA, 12 nt, Human
cucccugccccc

SEQ ID NO: 488773 - RNA, 23 nt, Human
aauguagcagcucauaaaugaaa

SEQ ID NO: 488774 - RNA, 12 nt, Human
uuaauaaaccau

SEQ ID NO: 488775 - RNA, 16 nt, Human
ccugagcgacagugag

SEQ ID NO: 488776 - RNA, 16 nt, Human
cccuauccuacuuccc

SEQ ID NO: 488777 - RNA, 13 nt, Human
ccaaaagguauuu

SEQ ID NO: 488778 - RNA, 13 nt, Human
aucaaugaaugaa

SEQ ID NO: 488779 - RNA, 20 nt, Human
ggguuccuuccucugagccu

SEQ ID NO: 488780 - RNA, 15 nt, Human
aagcaagauaauaaa

SEQ ID NO: 488781 - RNA, 13 nt, Human
uaagugcagcccc

SEQ ID NO: 488782 - RNA, 22 nt, Human
caucgcaauguaagacucggga

SEQ ID NO: 488783 - RNA, 13 nt, Human
cuuacuucuucuc

SEQ ID NO: 488784 - RNA, 18 nt, Human
gacccacuggacucaccu

SEQ ID NO: 488785 - RNA, 19 nt, Human
ccaccugccuauauuuuuu

SEQ ID NO: 488786 - RNA, 14 nt, Human
cuucucuucacagu

SEQ ID NO: 488787 - RNA, 17 nt, Human
ccaaggaugccccgucc

SEQ ID NO: 488788 - RNA, 12 nt, Human
caugggaaguga

SEQ ID NO: 488789 - RNA, 15 nt, Human
ccaaggagccaaaca

SEQ ID NO: 488790 - RNA, 18 nt, Human
ccugccuaagugcagccc

SEQ ID NO: 488791 - RNA, 13 nt, Human
ugggaggcugaga

SEQ ID NO: 488792 - RNA, 16 nt, Human
cacgggggccaaggau

SEQ ID NO: 488793 - RNA, 15 nt, Human
gacagggaggacgcu

SEQ ID NO: 488794 - RNA, 12 nt, Human
gguauuuuaauc

SEQ ID NO: 488795 - RNA, 14 nt, Human
cucccucccuuggg

SEQ ID NO: 488796 - RNA, 17 nt, Human
ccacuggacucaccucc

SEQ ID NO: 488797 - RNA, 21 nt, Human
uccauccugaggcuccacuug

SEQ ID NO: 488798 - RNA, 20 nt, Human
caaauguucaucaaugaaug

SEQ ID NO: 488799 - RNA, 17 nt, Human
gaaaaucaggcuggcca

SEQ ID NO: 488800 - RNA, 18 nt, Human
cagaaagcagaacaguga

SEQ ID NO: 488801 - RNA, 13 nt, Human
caagcaaauauaa

SEQ ID NO: 488802 - RNA, 21 nt, Human
cuauguucuaagaagugaaaa

SEQ ID NO: 488803 - RNA, 15 nt, Human
cccccagcccuccuu

SEQ ID NO: 488804 - RNA, 20 nt, Human
ugagucccaggcugagccuc

SEQ ID NO: 488805 - RNA, 15 nt, Human
cauuccaagccucau

SEQ ID NO: 488806 - RNA, 15 nt, Human
uugacacuuaaaaau

SEQ ID NO: 488807 - RNA, 18 nt, Human
accaccugccuauauuuu

SEQ ID NO: 488808 - RNA, 15 nt, Human
cuucaacucccugcc

SEQ ID NO: 488809 - RNA, 14 nt, Human
gcugauuaaaccaa

SEQ ID NO: 488810 - RNA, 21 nt, Human
ccuggugccucaccccuugcc

SEQ ID NO: 488811 - RNA, 16 nt, Human
ccucaaaacuucagac

SEQ ID NO: 488812 - RNA, 22 nt, Human
acaagcaaauauaaacagcaac

SEQ ID NO: 488813 - RNA, 14 nt, Human
uauguauauuuuau

SEQ ID NO: 488814 - RNA, 18 nt, Human
caacuuguguuccuaaca

SEQ ID NO: 488815 - RNA, 18 nt, Human
gaaaugaaagcagggacu

SEQ ID NO: 488816 - RNA, 23 nt, Human
caaaagcgauuauuauuuuagag

SEQ ID NO: 488817 - RNA, 16 nt, Human
ucuucaacucccugcc

SEQ ID NO: 488818 - RNA, 16 nt, Human
gacauagaauuaacac

SEQ ID NO: 488819 - RNA, 16 nt, Human
agguugcagugagccg

SEQ ID NO: 488820 - RNA, 19 nt, Human
caacucccugccccccagc

SEQ ID NO: 488821 - RNA, 20 nt, Human
ucuucuggguuccuuccucu

SEQ ID NO: 488822 - RNA, 21 nt, Human
auccccaagccuggcaaggga

SEQ ID NO: 488823 - RNA, 15 nt, Human
ccgucccccucuggc

SEQ ID NO: 488824 - RNA, 19 nt, Human
auccuacaagacacaguga

SEQ ID NO: 488825 - RNA, 22 nt, Human
gacucaccucccccaucucuuc

SEQ ID NO: 488826 - RNA, 23 nt, Human
aguacucauacauguuacaacac

SEQ ID NO: 488827 - RNA, 14 nt, Human
agucucccucccuu

SEQ ID NO: 488828 - RNA, 23 nt, Human
gcuuuggucuaucuuugagcgcc

SEQ ID NO: 488829 - RNA, 16 nt, Human
ccuccuuaucaaagga

SEQ ID NO: 488830 - RNA, 14 nt, Human
cucaccccuugcca

SEQ ID NO: 488831 - RNA, 13 nt, Human
ccaaggaugcccc

SEQ ID NO: 488832 - RNA, 14 nt, Human
cugagucccaggcu

SEQ ID NO: 488833 - RNA, 20 nt, Human
uuaagagaacaagcaaauau

SEQ ID NO: 488834 - RNA, 14 nt, Human
aagaaucuuuauag

SEQ ID NO: 488835 - RNA, 19 nt, Human
agcaucucauuuauaaugu

SEQ ID NO: 488836 - RNA, 14 nt, Human
aaaauacaaaaaaa

SEQ ID NO: 488837 - RNA, 23 nt, Human
cucauacuauuuaagagaacaag

SEQ ID NO: 488838 - RNA, 19 nt, Human
agcucugcccauccugccc

SEQ ID NO: 488839 - RNA, 14 nt, Human
agcucuaucaccaa

SEQ ID NO: 488840 - RNA, 15 nt, Human
ugaaacccugucucu

SEQ ID NO: 488841 - RNA, 17 nt, Human
auguuuacagaucccca

SEQ ID NO: 488842 - RNA, 13 nt, Human
ccugagcuugcag

SEQ ID NO: 488843 - RNA, 11 nt, Human
auaacaacaac

SEQ ID NO: 488844 - RNA, 13 nt, Human
ccucccccaucuc

SEQ ID NO: 488845 - RNA, 16 nt, Human
gaaaaugguauuaaag

SEQ ID NO: 488846 - RNA, 17 nt, Human
ucgggauuaguacacac

SEQ ID NO: 488847 - RNA, 19 nt, Human
acuccauuaaauauaaagc

SEQ ID NO: 488848 - RNA, 18 nt, Human
cagucucccucccuuggg

SEQ ID NO: 488849 - RNA, 19 nt, Human
gccugaucaccugcccugc

SEQ ID NO: 488850 - RNA, 22 nt, Human
cagcacgggggccaaggaugcc

SEQ ID NO: 488851 - RNA, 16 nt, Human
ccugagcuugcagaga

SEQ ID NO: 488852 - RNA, 18 nt, Human
uaaauauaaagcaagaua

SEQ ID NO: 488853 - RNA, 15 nt, Human
gccuaagugcagccc

SEQ ID NO: 488854 - RNA, 16 nt, Human
cagauccccaagccug

SEQ ID NO: 488855 - RNA, 14 nt, Human
aauauaaacagcaa

SEQ ID NO: 488856 - RNA, 17 nt, Human
cuuccucugagccuugg

SEQ ID NO: 488857 - RNA, 16 nt, Human
cugcacuccagccuga

SEQ ID NO: 488858 - RNA, 21 nt, Human
aagagaacaagcaaauauaaa

SEQ ID NO: 488859 - RNA, 22 nt, Human
cucagcccuggugggcagagag

SEQ ID NO: 488860 - RNA, 17 nt, Human
cagacaucaacagauaa

SEQ ID NO: 488861 - RNA, 13 nt, Human
gguccacaacaca

SEQ ID NO: 488862 - RNA, 22 nt, Human
acauccuacaagacacagugac

SEQ ID NO: 488863 - RNA, 21 nt, Human
accaccugccuauauuuuuug

SEQ ID NO: 488864 - RNA, 17 nt, Human
acucaccucccccaucu

SEQ ID NO: 488865 - RNA, 20 nt, Human
aaacuuuaugcuaagugaaa

SEQ ID NO: 488866 - RNA, 18 nt, Human
cuacuccauuaaauauaa

SEQ ID NO: 488867 - RNA, 20 nt, Human
acggacgaaccuugaaaacu

SEQ ID NO: 488868 - RNA, 22 nt, Human
aaaaaaccugagccccaaaagg

SEQ ID NO: 488869 - RNA, 16 nt, Human
agccucagucucccuc

SEQ ID NO: 488870 - RNA, 20 nt, Human
acaagacacagugaccauac

SEQ ID NO: 488871 - RNA, 19 nt, Human
ggaauuucuucaacucccu

SEQ ID NO: 488872 - RNA, 19 nt, Human
ggagccugaucaccugccc

SEQ ID NO: 488873 - RNA, 16 nt, Human
auuccaccuacaugag

SEQ ID NO: 488874 - RNA, 17 nt, Human
augccccgucccccucu

SEQ ID NO: 488875 - RNA, 14 nt, Human
aagcaacccaaaug

SEQ ID NO: 488876 - RNA, 15 nt, Human
cgggagccugaucac

SEQ ID NO: 488877 - RNA, 16 nt, Human
agcuugaaaccuucac

SEQ ID NO: 488878 - RNA, 20 nt, Human
ggccaugggacagggaggac

SEQ ID NO: 488879 - RNA, 16 nt, Human
uccugcaauuccacuu

SEQ ID NO: 488880 - RNA, 21 nt, Human
cagagguccacaacacacaga

SEQ ID NO: 488881 - RNA, 13 nt, Human
acaagaaaugaaa

SEQ ID NO: 488882 - RNA, 19 nt, Human
cccacuggacucaccuccc

SEQ ID NO: 488883 - RNA, 20 nt, Human
uacuucuucucauacuauuu

SEQ ID NO: 488884 - RNA, 19 nt, Human
cuggacucaccucccccau

SEQ ID NO: 488885 - RNA, 18 nt, Human
ccuugggaccccugagcu

SEQ ID NO: 488886 - RNA, 20 nt, Human
uauaaagcaagauaauaaaa

SEQ ID NO: 488887 - RNA, 16 nt, Chlamydophila pneumoniae CWL029
uuuucuugauuagaga

SEQ ID NO: 488888 - RNA, 16 nt, Chlamydophila pneumoniae CWL029
uuuuuggaaauccgua

SEQ ID NO: 488889 - RNA, 14 nt, Chlamydophila pneumoniae CWL029
uuuucaagucugua

SEQ ID NO: 488890 - RNA, 22 nt, Chlamydophila pneumoniae CWL029
uuuucacgagcucacaacccuu

SEQ ID NO: 488891 - RNA, 20 nt, Chlamydophila pneumoniae CWL029
uuucgcagauacuucuucca

SEQ ID NO: 488892 - RNA, 18 nt, Chlamydophila pneumoniae CWL029
uuuaagaaaugcaaacca

SEQ ID NO: 488893 - RNA, 19 nt, Chlamydophila pneumoniae CWL029
uuuccuugguaucccaauc

SEQ ID NO: 488894 - RNA, 22 nt, Chlamydophila pneumoniae CWL029
uugugcugcuuccccuaauagg

SEQ ID NO: 488895 - RNA, 16 nt, Chlamydophila pneumoniae CWL029
uuguuugcuauacaga

SEQ ID NO: 488896 - RNA, 15 nt, Chlamydophila pneumoniae CWL029
uuuaaaaugauagcc

SEQ ID NO: 488897 - RNA, 15 nt, Chlamydophila pneumoniae CWL029
uuggucgaucaaggu

SEQ ID NO: 488898 - RNA, 13 nt, Chlamydophila pneumoniae CWL029
uuggaagugcguu

SEQ ID NO: 488899 - RNA, 18 nt, Chlamydophila pneumoniae CWL029
uugcuauugaaaaauccc

SEQ ID NO: 488900 - RNA, 16 nt, Chlamydophila pneumoniae CWL029
uugcuugcgcaucagc

SEQ ID NO: 488901 - RNA, 18 nt, Chlamydophila pneumoniae CWL029
uugcccauugaccugcuu

SEQ ID NO: 488902 - RNA, 17 nt, Chlamydophila pneumoniae CWL029
uugcaugcaacggagaa

SEQ ID NO: 488903 - RNA, 15 nt, Chlamydophila pneumoniae CWL029
uugauucauaaagag

SEQ ID NO: 488904 - RNA, 23 nt, Chlamydophila pneumoniae CWL029
uugauuaggaacaagucggcagg

SEQ ID NO: 488905 - RNA, 13 nt, Chlamydophila pneumoniae CWL029
uugauauccaggg

SEQ ID NO: 488906 - RNA, 17 nt, Chlamydophila pneumoniae CWL029
uugagaaagaccaccuu

SEQ ID NO: 488907 - RNA, 21 nt, Chlamydophila pneumoniae CWL029
uugaagaucuccgaagacuac

SEQ ID NO: 488908 - RNA, 20 nt, Chlamydophila pneumoniae CWL029
uugaacucucaguuaaagag

SEQ ID NO: 488909 - RNA, 14 nt, Chlamydophila pneumoniae CWL029
uugaacaacuccuu

SEQ ID NO: 488910 - RNA, 13 nt, Chlamydophila pneumoniae CWL029
uuccccugaaaau

SEQ ID NO: 488911 - RNA, 14 nt, Chlamydophila pneumoniae CWL029
uucccgauagcaua

SEQ ID NO: 488912 - RNA, 16 nt, Chlamydophila pneumoniae CWL029
uucauauuuacgaaaa

SEQ ID NO: 488913 - RNA, 19 nt, Chlamydophila pneumoniae CWL029
uuccaauagagucucuuga

SEQ ID NO: 488914 - RNA, 17 nt, Chlamydophila pneumoniae CWL029
uuaucuggagaugcgcu

SEQ ID NO: 488915 - RNA, 17 nt, Chlamydophila pneumoniae CWL029
uuauaggaauaacacca

SEQ ID NO: 488916 - RNA, 14 nt, Chlamydophila pneumoniae CWL029
uuauauaaagaucu

SEQ ID NO: 488917 - RNA, 18 nt, Chlamydophila pneumoniae CWL029
uuagagucgauaaaaacu

SEQ ID NO: 488918 - RNA, 15 nt, Chlamydophila pneumoniae CWL029
uguuuaugaaaaucu

SEQ ID NO: 488919 - RNA, 19 nt, Chlamydophila pneumoniae CWL029
uuaagaagauucuuuaauc

SEQ ID NO: 488920 - RNA, 13 nt, Chlamydophila pneumoniae CWL029
uuaagcuaauaag

SEQ ID NO: 488921 - RNA, 12 nt, Chlamydophila pneumoniae CWL029
uuaauuuuucua

SEQ ID NO: 488922 - RNA, 20 nt, Chlamydophila pneumoniae CWL029
uguuagugagaucaaaaaua

SEQ ID NO: 488923 - RNA, 18 nt, Chlamydophila pneumoniae CWL029
uguuaacaaguaccaaga

SEQ ID NO: 488924 - RNA, 20 nt, Chlamydophila pneumoniae CWL029
uguuaacaaguaccaagaaa

SEQ ID NO: 488925 - RNA, 15 nt, Chlamydophila pneumoniae CWL029
uguucauaaucagaa

SEQ ID NO: 488926 - RNA, 15 nt, Chlamydophila pneumoniae CWL029
uguucuuuacuacau

SEQ ID NO: 488927 - RNA, 22 nt, Chlamydophila pneumoniae CWL029
uguugcaauucuucaugcugcu

SEQ ID NO: 488928 - RNA, 22 nt, Chlamydophila pneumoniae CWL029
ugugcagaagguuccacagaga

SEQ ID NO: 488929 - RNA, 14 nt, Chlamydophila pneumoniae CWL029
ugugccagaauaua

SEQ ID NO: 488930 - RNA, 19 nt, Chlamydophila pneumoniae CWL029
uguagaggucacuauagau

SEQ ID NO: 488931 - RNA, 13 nt, Chlamydophila pneumoniae CWL029
ugucagaacaaga

SEQ ID NO: 488932 - RNA, 12 nt, Chlamydophila pneumoniae CWL029
uguacacagaga

SEQ ID NO: 488933 - RNA, 13 nt, Chlamydophila pneumoniae CWL029
uguaauaaaagaa

SEQ ID NO: 488934 - RNA, 15 nt, Chlamydophila pneumoniae CWL029
ugguaaggagagucu

SEQ ID NO: 488935 - RNA, 19 nt, Chlamydophila pneumoniae CWL029
ugguaacacgagugccuuc

SEQ ID NO: 488936 - RNA, 17 nt, Chlamydophila pneumoniae CWL029
uggcuggaaagccaagc

SEQ ID NO: 488937 - RNA, 19 nt, Chlamydophila pneumoniae CWL029
uggauaacacgaguuucga

SEQ ID NO: 488938 - RNA, 15 nt, Chlamydophila pneumoniae CWL029
uggauuucuucuguu

SEQ ID NO: 488939 - RNA, 20 nt, Chlamydophila pneumoniae CWL029
uggcaaauaaaacaagcuuu

SEQ ID NO: 488940 - RNA, 19 nt, Chlamydophila pneumoniae CWL029
uggaccagaugcuaaagag

SEQ ID NO: 488941 - RNA, 17 nt, Chlamydophila pneumoniae CWL029
uggaagcaaagaaaauu

SEQ ID NO: 488942 - RNA, 15 nt, Chlamydophila pneumoniae CWL029
uggcaaugauauccu

SEQ ID NO: 488943 - RNA, 21 nt, Chlamydophila pneumoniae CWL029
uggcauaaagaccgagaagcu

SEQ ID NO: 488944 - RNA, 15 nt, Chlamydophila pneumoniae CWL029
ugcauauugccuucu

SEQ ID NO: 488945 - RNA, 22 nt, Chlamydophila pneumoniae CWL029
ugauuuguuuagcauagagcuc

SEQ ID NO: 488946 - RNA, 14 nt, Chlamydophila pneumoniae CWL029
ugcaaucucaaaau

SEQ ID NO: 488947 - RNA, 13 nt, Chlamydophila pneumoniae CWL029
ugaucugaaguug

SEQ ID NO: 488948 - RNA, 19 nt, Chlamydophila pneumoniae CWL029
ugauaaaauaaacucuugu

SEQ ID NO: 488949 - RNA, 22 nt, Chlamydophila pneumoniae CWL029
ugacgcaagagacaagaaaaua

SEQ ID NO: 488950 - RNA, 12 nt, Chlamydophila pneumoniae CWL029
ugaauuaguuuc

SEQ ID NO: 488951 - RNA, 15 nt, Chlamydophila pneumoniae CWL029
ugaauaccaaaauua

SEQ ID NO: 488952 - RNA, 16 nt, Chlamydophila pneumoniae CWL029
ugaauaccguuucagg

SEQ ID NO: 488953 - RNA, 14 nt, Chlamydophila pneumoniae CWL029
ugaauaucaucacu

SEQ ID NO: 488954 - RNA, 13 nt, Chlamydophila pneumoniae CWL029
ugaaucauagaga

SEQ ID NO: 488955 - RNA, 15 nt, Chlamydophila pneumoniae CWL029
ugaaguuuuuucucu

SEQ ID NO: 488956 - RNA, 12 nt, Chlamydophila pneumoniae CWL029
ugaaauuuucua

SEQ ID NO: 488957 - RNA, 19 nt, Chlamydophila pneumoniae CWL029
ucuuucgaugcuauuuuuc

SEQ ID NO: 488958 - RNA, 20 nt, Chlamydophila pneumoniae CWL029
ucuuuccucucaugaaauuu

SEQ ID NO: 488959 - RNA, 21 nt, Chlamydophila pneumoniae CWL029
ucuuugaagcucgaccucuag

SEQ ID NO: 488960 - RNA, 15 nt, Chlamydophila pneumoniae CWL029
ucuccccauucacaa

SEQ ID NO: 488961 - RNA, 16 nt, Chlamydophila pneumoniae CWL029
ucuuuuaacuuaaaga

SEQ ID NO: 488962 - RNA, 16 nt, Chlamydophila pneumoniae CWL029
ugaaaguacagaaagg

SEQ ID NO: 488963 - RNA, 22 nt, Chlamydophila pneumoniae CWL029
ucuagccaauauagaagcugcu

SEQ ID NO: 488964 - RNA, 23 nt, Chlamydophila pneumoniae CWL029
ucuaagcugugcauuuucuucuu

SEQ ID NO: 488965 - RNA, 15 nt, Chlamydophila pneumoniae CWL029
ucuaagaauauggac

SEQ ID NO: 488966 - RNA, 16 nt, Chlamydophila pneumoniae CWL029
ucuaggaucucuagua

SEQ ID NO: 488967 - RNA, 15 nt, Chlamydophila pneumoniae CWL029
ucuaggccuaaagaa

SEQ ID NO: 488968 - RNA, 19 nt, Chlamydophila pneumoniae CWL029
ucuauauuuuuucccacaa

SEQ ID NO: 488969 - RNA, 16 nt, Chlamydophila pneumoniae CWL029
ucucaucagcaaaacu

SEQ ID NO: 488970 - RNA, 15 nt, Chlamydophila pneumoniae CWL029
ucucaucggcauaac

SEQ ID NO: 488971 - RNA, 18 nt, Chlamydophila pneumoniae CWL029
ucucauccagacaagaca

SEQ ID NO: 488972 - RNA, 21 nt, Chlamydophila pneumoniae CWL029
ucucauuucguagacgcucua

SEQ ID NO: 488973 - RNA, 21 nt, Chlamydophila pneumoniae CWL029
ucuaaauagaaaacauagaga

SEQ ID NO: 488974 - RNA, 19 nt, Chlamydophila pneumoniae CWL029
ucgugcaggagaacaauau

SEQ ID NO: 488975 - RNA, 22 nt, Chlamydophila pneumoniae CWL029
ucguagcucaggaaaacuuaau

SEQ ID NO: 488976 - RNA, 14 nt, Chlamydophila pneumoniae CWL029
ucgcuagaucacaa

SEQ ID NO: 488977 - RNA, 18 nt, Chlamydophila pneumoniae CWL029
ucggaccuacguuuucuc

SEQ ID NO: 488978 - RNA, 13 nt, Chlamydophila pneumoniae CWL029
ucgcaguaaugcc

SEQ ID NO: 488979 - RNA, 19 nt, Chlamydophila pneumoniae CWL029
ucgcagcaggauaaccauc

SEQ ID NO: 488980 - RNA, 16 nt, Chlamydophila pneumoniae CWL029
ucgccguuaaagacuu

SEQ ID NO: 488981 - RNA, 18 nt, Chlamydophila pneumoniae CWL029
uccccucccccaaucaca

SEQ ID NO: 488982 - RNA, 18 nt, Chlamydophila pneumoniae CWL029
uccccuuggaaaucagaa

SEQ ID NO: 488983 - RNA, 17 nt, Chlamydophila pneumoniae CWL029
ucccccagaccuaaaaa

SEQ ID NO: 488984 - RNA, 14 nt, Chlamydophila pneumoniae CWL029
uccccauucacaaa

SEQ ID NO: 488985 - RNA, 16 nt, Chlamydophila pneumoniae CWL029
uccccagggagaucua

SEQ ID NO: 488986 - RNA, 13 nt, Chlamydophila pneumoniae CWL029
uccaguucuucau

SEQ ID NO: 488987 - RNA, 17 nt, Chlamydophila pneumoniae CWL029
uccaaugagagagagac

SEQ ID NO: 488988 - RNA, 18 nt, Chlamydophila pneumoniae CWL029
uccaauaauuuucccaau

SEQ ID NO: 488989 - RNA, 19 nt, Chlamydophila pneumoniae CWL029
uccaauagccaaagacucu

SEQ ID NO: 488990 - RNA, 15 nt, Chlamydophila pneumoniae CWL029
ucauuuucuuuuaag

SEQ ID NO: 488991 - RNA, 19 nt, Chlamydophila pneumoniae CWL029
uccagaaaguauuccucuu

SEQ ID NO: 488992 - RNA, 19 nt, Chlamydophila pneumoniae CWL029
uccagaaauuacuguggua

SEQ ID NO: 488993 - RNA, 23 nt, Chlamydophila pneumoniae CWL029
uccacgaguucgcggaucuucuu

SEQ ID NO: 488994 - RNA, 15 nt, Chlamydophila pneumoniae CWL029
ucaguaggagcagcg

SEQ ID NO: 488995 - RNA, 18 nt, Chlamydophila pneumoniae CWL029
ucauccccucagaaagga

SEQ ID NO: 488996 - RNA, 18 nt, Chlamydophila pneumoniae CWL029
ucauggauuacugaagau

SEQ ID NO: 488997 - RNA, 21 nt, Chlamydophila pneumoniae CWL029
ucagaaugcccuuuagggaau

SEQ ID NO: 488998 - RNA, 17 nt, Chlamydophila pneumoniae CWL029
ucagagauuuuaaagcc

SEQ ID NO: 488999 - RNA, 18 nt, Chlamydophila pneumoniae CWL029
ucagaggaaucuaagaac

SEQ ID NO: 489000 - RNA, 17 nt, Chlamydophila pneumoniae CWL029
ucagaagcuccugagua

SEQ ID NO: 489001 - RNA, 14 nt, Chlamydophila pneumoniae CWL029
ucaccugagcuaua

SEQ ID NO: 489002 - RNA, 19 nt, Chlamydophila pneumoniae CWL029
ucacaauaccaucucuuuc

SEQ ID NO: 489003 - RNA, 20 nt, Chlamydophila pneumoniae CWL029
ucacaauuuuaaaaucuccu

SEQ ID NO: 489004 - RNA, 13 nt, Chlamydophila pneumoniae CWL029
ucacaucaagaua

SEQ ID NO: 489005 - RNA, 20 nt, Chlamydophila pneumoniae CWL029
ucacaucaguuaacugugua

SEQ ID NO: 489006 - RNA, 15 nt, Chlamydophila pneumoniae CWL029
ucacauccuguaguu

SEQ ID NO: 489007 - RNA, 13 nt, Chlamydophila pneumoniae CWL029
ucacaucuuucuc

SEQ ID NO: 489008 - RNA, 16 nt, Chlamydophila pneumoniae CWL029
ucacacucguagccuu

SEQ ID NO: 489009 - RNA, 20 nt, Chlamydophila pneumoniae CWL029
ucacacuuaaagguaaaacu

SEQ ID NO: 489010 - RNA, 14 nt, Chlamydophila pneumoniae CWL029
ucaccauuaagaua

SEQ ID NO: 489011 - RNA, 23 nt, Chlamydophila pneumoniae CWL029
ucaacauuuugccuuuagggaaa

SEQ ID NO: 489012 - RNA, 20 nt, Chlamydophila pneumoniae CWL029
ucaaauaggaucucucuuuc

SEQ ID NO: 489013 - RNA, 17 nt, Chlamydophila pneumoniae CWL029
ucaaauucaaaauagaa

SEQ ID NO: 489014 - RNA, 17 nt, Chlamydophila pneumoniae CWL029
ucaaacaucacucagga

SEQ ID NO: 489015 - RNA, 20 nt, Chlamydophila pneumoniae CWL029
ucaaaauuuaaauauagaaa

SEQ ID NO: 489016 - RNA, 22 nt, Chlamydophila pneumoniae CWL029
ucaacuuuuuuacuaucuccua

SEQ ID NO: 489017 - RNA, 23 nt, Chlamydophila pneumoniae CWL029
uaugcuguugcuccaagaguucu

SEQ ID NO: 489018 - RNA, 12 nt, Chlamydophila pneumoniae CWL029
ucaaaagacuua

SEQ ID NO: 489019 - RNA, 20 nt, Chlamydophila pneumoniae CWL029
ucaaaaucacauuuugguau

SEQ ID NO: 489020 - RNA, 18 nt, Chlamydophila pneumoniae CWL029
uauuuauuuuauuaguuu

SEQ ID NO: 489021 - RNA, 14 nt, Chlamydophila pneumoniae CWL029
uaucugccauagga

SEQ ID NO: 489022 - RNA, 23 nt, Chlamydophila pneumoniae CWL029
uaugccucaggucugcugaggag

SEQ ID NO: 489023 - RNA, 17 nt, Chlamydophila pneumoniae CWL029
uaucgccguuaaagacu

SEQ ID NO: 489024 - RNA, 19 nt, Chlamydophila pneumoniae CWL029
uaucgaagagcccucuuca

SEQ ID NO: 489025 - RNA, 18 nt, Chlamydophila pneumoniae CWL029
uagcagaguuuuucccuc

SEQ ID NO: 489026 - RNA, 17 nt, Chlamydophila pneumoniae CWL029
uagauaagaucucuccg

SEQ ID NO: 489027 - RNA, 14 nt, Chlamydophila pneumoniae CWL029
uagccaaagacucu

SEQ ID NO: 489028 - RNA, 20 nt, Chlamydophila pneumoniae CWL029
uagcaguauagagaagauuu

SEQ ID NO: 489029 - RNA, 19 nt, Chlamydophila pneumoniae CWL029
uagcauuucuuucucuucg

SEQ ID NO: 489030 - RNA, 14 nt, Chlamydophila pneumoniae CWL029
uagaaaaagaucua

SEQ ID NO: 489031 - RNA, 20 nt, Chlamydophila pneumoniae CWL029
uacuucuguaguuuguucac

SEQ ID NO: 489032 - RNA, 18 nt, Chlamydophila pneumoniae CWL029
uagagaauuggaagcuuu

SEQ ID NO: 489033 - RNA, 14 nt, Chlamydophila pneumoniae CWL029
uagagacaucguau

SEQ ID NO: 489034 - RNA, 16 nt, Chlamydophila pneumoniae CWL029
uagagagaaugacuuu

SEQ ID NO: 489035 - RNA, 22 nt, Chlamydophila pneumoniae CWL029
uaccaccccaaagcagauccug

SEQ ID NO: 489036 - RNA, 18 nt, Chlamydophila pneumoniae CWL029
uaccaagaugaagaaacu

SEQ ID NO: 489037 - RNA, 14 nt, Chlamydophila pneumoniae CWL029
uacaucaaaaugcu

SEQ ID NO: 489038 - RNA, 19 nt, Chlamydophila pneumoniae CWL029
uacccuuccggggugcgac

SEQ ID NO: 489039 - RNA, 13 nt, Chlamydophila pneumoniae CWL029
uaccguaaagaaa

SEQ ID NO: 489040 - RNA, 15 nt, Chlamydophila pneumoniae CWL029
uaacuggcaaucuaa

SEQ ID NO: 489041 - RNA, 14 nt, Chlamydophila pneumoniae CWL029
uaagccaaauacca

SEQ ID NO: 489042 - RNA, 22 nt, Chlamydophila pneumoniae CWL029
uaauccuccucgaauggagugc

SEQ ID NO: 489043 - RNA, 10 nt, Chlamydophila pneumoniae CWL029
uaauccugca

SEQ ID NO: 489044 - RNA, 14 nt, Chlamydophila pneumoniae CWL029
uaaucauaaaaaaa

SEQ ID NO: 489045 - RNA, 18 nt, Chlamydophila pneumoniae CWL029
uacagaugcaugauccua

SEQ ID NO: 489046 - RNA, 19 nt, Chlamydophila pneumoniae CWL029
uaauuaaauauauaaagaa

SEQ ID NO: 489047 - RNA, 16 nt, Chlamydophila pneumoniae CWL029
uaaaacacaaauagca

SEQ ID NO: 489048 - RNA, 15 nt, Chlamydophila pneumoniae CWL029
uaaaauaaagagcug

SEQ ID NO: 489049 - RNA, 16 nt, Chlamydophila pneumoniae CWL029
uaaaaacuauccuauu

SEQ ID NO: 489050 - RNA, 15 nt, Chlamydophila pneumoniae CWL029
uaaaaucauaggcua

SEQ ID NO: 489051 - RNA, 18 nt, Chlamydophila pneumoniae CWL029
uaaacuuacagccaccuu

SEQ ID NO: 489052 - RNA, 17 nt, Chlamydophila pneumoniae CWL029
uaaacuucaaugaagaa

SEQ ID NO: 489053 - RNA, 20 nt, Chlamydophila pneumoniae CWL029
uaaacuaaaaugguaaaccu

SEQ ID NO: 489054 - RNA, 15 nt, Chlamydophila pneumoniae CWL029
uaaagagaaucuccu

SEQ ID NO: 489055 - RNA, 21 nt, Chlamydophila pneumoniae CWL029
uaaagagucuuccuagaccua

SEQ ID NO: 489056 - RNA, 19 nt, Chlamydophila pneumoniae CWL029
uaaagaucuucauaaccaa

SEQ ID NO: 489057 - RNA, 13 nt, Chlamydophila pneumoniae CWL029
uaaaguaggaauu

SEQ ID NO: 489058 - RNA, 15 nt, Chlamydophila pneumoniae CWL029
uaacacccucccuca

SEQ ID NO: 489059 - RNA, 19 nt, Chlamydophila pneumoniae CWL029
uaaaguugaacugacacca

SEQ ID NO: 489060 - RNA, 12 nt, Chlamydophila pneumoniae CWL029
guugcuaagauc

SEQ ID NO: 489061 - RNA, 18 nt, Chlamydophila pneumoniae CWL029
guugggagcuuccuccaa

SEQ ID NO: 489062 - RNA, 16 nt, Chlamydophila pneumoniae CWL029
guugccuuucucuucc

SEQ ID NO: 489063 - RNA, 14 nt, Chlamydophila pneumoniae CWL029
guucggucucuucu

SEQ ID NO: 489064 - RNA, 13 nt, Chlamydophila pneumoniae CWL029
guguugaauaaga

SEQ ID NO: 489065 - RNA, 23 nt, Chlamydophila pneumoniae CWL029
guguuccagaucaaugccuugcg

SEQ ID NO: 489066 - RNA, 15 nt, Chlamydophila pneumoniae CWL029
guuccaaaucucaau

SEQ ID NO: 489067 - RNA, 23 nt, Chlamydophila pneumoniae CWL029
guuccagccugugagcucucgac

SEQ ID NO: 489068 - RNA, 15 nt, Chlamydophila pneumoniae CWL029
gucuugaguucuuuu

SEQ ID NO: 489069 - RNA, 21 nt, Chlamydophila pneumoniae CWL029
guccuggacgauauaaucacg

SEQ ID NO: 489070 - RNA, 14 nt, Chlamydophila pneumoniae CWL029
gucgaaucuaaaaa

SEQ ID NO: 489071 - RNA, 20 nt, Chlamydophila pneumoniae CWL029
guagaaggggguucuaagaa

SEQ ID NO: 489072 - RNA, 19 nt, Chlamydophila pneumoniae CWL029
guaucgagcucuuuaagaa

SEQ ID NO: 489073 - RNA, 21 nt, Chlamydophila pneumoniae CWL029
guaggaccugugugcuuuaau

SEQ ID NO: 489074 - RNA, 15 nt, Chlamydophila pneumoniae CWL029
guaccacauacucuu

SEQ ID NO: 489075 - RNA, 14 nt, Chlamydophila pneumoniae CWL029
guaacgcuuuucua

SEQ ID NO: 489076 - RNA, 23 nt, Chlamydophila pneumoniae CWL029
gguauccugcuccaaaaugggau

SEQ ID NO: 489077 - RNA, 14 nt, Chlamydophila pneumoniae CWL029
ggucuguauuuucu

SEQ ID NO: 489078 - RNA, 24 nt, Chlamydophila pneumoniae CWL029
ggagacuugaucuacaaaaacuag

SEQ ID NO: 489079 - RNA, 21 nt, Chlamydophila pneumoniae CWL029
ggagaccuuuauagauaugcc

SEQ ID NO: 489080 - RNA, 14 nt, Chlamydophila pneumoniae CWL029
ggauguugcguuag

SEQ ID NO: 489081 - RNA, 12 nt, Chlamydophila pneumoniae CWL029
ggaaugaucccu

SEQ ID NO: 489082 - RNA, 11 nt, Chlamydophila pneumoniae CWL029
ggaauuucucc

SEQ ID NO: 489083 - RNA, 15 nt, Chlamydophila pneumoniae CWL029
ggaaaugagagggau

SEQ ID NO: 489084 - RNA, 14 nt, Chlamydophila pneumoniae CWL029
ggaaagcguuucga

SEQ ID NO: 489085 - RNA, 16 nt, Chlamydophila pneumoniae CWL029
ggaaaggucggggaga

SEQ ID NO: 489086 - RNA, 23 nt, Chlamydophila pneumoniae CWL029
ggaaacuagauuucuacaaacag

SEQ ID NO: 489087 - RNA, 15 nt, Chlamydophila pneumoniae CWL029
gcuuucgucuaaaau

SEQ ID NO: 489088 - RNA, 22 nt, Chlamydophila pneumoniae CWL029
gcuguaaucgagagaagaaauu

SEQ ID NO: 489089 - RNA, 14 nt, Chlamydophila pneumoniae CWL029
gcucgcuaacuuau

SEQ ID NO: 489090 - RNA, 23 nt, Chlamydophila pneumoniae CWL029
gccugucacaauaccaucucuuu

SEQ ID NO: 489091 - RNA, 14 nt, Chlamydophila pneumoniae CWL029
uucgaauucucaga

SEQ ID NO: 489092 - RNA, 18 nt, Chlamydophila pneumoniae CWL029
uuccuuucucagucacaa

SEQ ID NO: 489093 - RNA, 13 nt, Chlamydophila pneumoniae CWL029
uucuaaagauuuu

SEQ ID NO: 489094 - RNA, 13 nt, Chlamydophila pneumoniae CWL029
uucuaagauaucu

SEQ ID NO: 489095 - RNA, 13 nt, Chlamydophila pneumoniae CWL029
uucuaagauuccu

SEQ ID NO: 489096 - RNA, 17 nt, Chlamydophila pneumoniae CWL029
uucuaagcaauauuucu

SEQ ID NO: 489097 - RNA, 16 nt, Chlamydophila pneumoniae CWL029
uucuaaaacagaaauu

SEQ ID NO: 489098 - RNA, 13 nt, Chlamydophila pneumoniae CWL029
uucguuacuagga

SEQ ID NO: 489099 - RNA, 16 nt, Chlamydophila pneumoniae CWL029
uucguggagugcucua

SEQ ID NO: 489100 - RNA, 15 nt, Chlamydophila pneumoniae CWL029
uucccuaccugagga

SEQ ID NO: 489101 - RNA, 23 nt, Chlamydophila pneumoniae CWL029
uuccgaauugcgaauccugagga

SEQ ID NO: 489102 - RNA, 20 nt, Chlamydophila pneumoniae CWL029
uuccaagacaacaccuccca

SEQ ID NO: 489103 - RNA, 15 nt, Chlamydophila pneumoniae CWL029
uuagcaagagcucuu

SEQ ID NO: 489104 - RNA, 21 nt, Chlamydophila pneumoniae CWL029
uuacuaggaaggaaaucacag

SEQ ID NO: 489105 - RNA, 22 nt, Chlamydophila pneumoniae CWL029
uuagacaagacaccgaaagaaa

SEQ ID NO: 489106 - RNA, 20 nt, Chlamydophila pneumoniae CWL029
uuagcuucuuuuuuuuucuu

SEQ ID NO: 489107 - RNA, 21 nt, Chlamydophila pneumoniae CWL029
uuagucccgccguaugcauca

SEQ ID NO: 489108 - RNA, 22 nt, Chlamydophila pneumoniae CWL029
uuauaaacuucuagacaacaaa

SEQ ID NO: 489109 - RNA, 18 nt, Chlamydophila pneumoniae CWL029
uuaaauuuuguuuuucca

SEQ ID NO: 489110 - RNA, 16 nt, Chlamydophila pneumoniae CWL029
uuacauguaaacaaaa

SEQ ID NO: 489111 - RNA, 15 nt, Chlamydophila pneumoniae CWL029
uuaaugaacucaggc

SEQ ID NO: 489112 - RNA, 14 nt, Chlamydophila pneumoniae CWL029
uuaaagcaaaaauu

SEQ ID NO: 489113 - RNA, 22 nt, Chlamydophila pneumoniae CWL029
ugucuugaagagauugauuucu

SEQ ID NO: 489114 - RNA, 23 nt, Chlamydophila pneumoniae CWL029
ugugauaccuccuccaaucugcu

SEQ ID NO: 489115 - RNA, 19 nt, Chlamydophila pneumoniae CWL029
ugucacacugcgagagaaa

SEQ ID NO: 489116 - RNA, 18 nt, Chlamydophila pneumoniae CWL029
ugucaccacgaacuucag

SEQ ID NO: 489117 - RNA, 13 nt, Chlamydophila pneumoniae CWL029
ugugcuuuucucu

SEQ ID NO: 489118 - RNA, 18 nt, Chlamydophila pneumoniae CWL029
aauguauccuucuacaau

SEQ ID NO: 489119 - RNA, 21 nt, Chlamydophila pneumoniae CWL029
aauggguuuuguuucaucuuc

SEQ ID NO: 489120 - RNA, 19 nt, Chlamydophila pneumoniae CWL029
uuuuuaggacgcuauccua

SEQ ID NO: 489121 - RNA, 14 nt, Chlamydophila pneumoniae CWL029
uuugcuaagagcuc

SEQ ID NO: 489122 - RNA, 12 nt, Chlamydophila pneumoniae CWL029
uuugcuauuuuc

SEQ ID NO: 489123 - RNA, 19 nt, Chlamydophila pneumoniae CWL029
uuugcgauaucuauaaaug

SEQ ID NO: 489124 - RNA, 13 nt, Chlamydophila pneumoniae CWL029
uuugccugaaauc

SEQ ID NO: 489125 - RNA, 16 nt, Chlamydophila pneumoniae CWL029
uuuacaauuagagauu

SEQ ID NO: 489126 - RNA, 21 nt, Chlamydophila pneumoniae CWL029
uuuccggggagaacuucaaca

SEQ ID NO: 489127 - RNA, 23 nt, Chlamydophila pneumoniae CWL029
uuuccguaaguaaccaauacagc

SEQ ID NO: 489128 - RNA, 14 nt, Chlamydophila pneumoniae CWL029
uuucgcuaacuuau

SEQ ID NO: 489129 - RNA, 14 nt, Chlamydophila pneumoniae CWL029
uuguuuuaauugua

SEQ ID NO: 489130 - RNA, 19 nt, Chlamydophila pneumoniae CWL029
uuguauuccuuggauuucu

SEQ ID NO: 489131 - RNA, 14 nt, Chlamydophila pneumoniae CWL029
aauccauaguccua

SEQ ID NO: 489132 - RNA, 18 nt, Chlamydophila pneumoniae CWL029
uugcaguggcuuauagag

SEQ ID NO: 489133 - RNA, 14 nt, Chlamydophila pneumoniae CWL029
uugcaugaggagac

SEQ ID NO: 489134 - RNA, 16 nt, Chlamydophila pneumoniae CWL029
uugcauggauccuuca

SEQ ID NO: 489135 - RNA, 21 nt, Chlamydophila pneumoniae CWL029
uugcaagagccggaacuucag

SEQ ID NO: 489136 - RNA, 18 nt, Chlamydophila pneumoniae CWL029
uucuucaucuucuaaauc

SEQ ID NO: 489137 - RNA, 22 nt, Chlamydophila pneumoniae CWL029
uucuguagugagauacggagga

SEQ ID NO: 489138 - RNA, 23 nt, Chlamydophila pneumoniae CWL029
uucuucaacgaggaaggcuccag

SEQ ID NO: 489139 - RNA, 14 nt, Chlamydophila pneumoniae CWL029
uugccauaauaaag

SEQ ID NO: 489140 - RNA, 17 nt, Chlamydophila pneumoniae CWL029
uguacuugauauuguuc

SEQ ID NO: 489141 - RNA, 15 nt, Chlamydophila pneumoniae CWL029
uguacgguaaaucca

SEQ ID NO: 489142 - RNA, 13 nt, Chlamydophila pneumoniae CWL029
uguacagaaaaua

SEQ ID NO: 489143 - RNA, 21 nt, Chlamydophila pneumoniae CWL029
uguaaucauaaaaaaagcuag

SEQ ID NO: 489144 - RNA, 14 nt, Chlamydophila pneumoniae CWL029
uggucuguauuuuc

SEQ ID NO: 489145 - RNA, 16 nt, Chlamydophila pneumoniae CWL029
uggaauucaaacuccu

SEQ ID NO: 489146 - RNA, 13 nt, Chlamydophila pneumoniae CWL029
uggaauuuuccug

SEQ ID NO: 489147 - RNA, 22 nt, Chlamydophila pneumoniae CWL029
ugcugcagcaaaacuaggaaaa

SEQ ID NO: 489148 - RNA, 16 nt, Chlamydophila pneumoniae CWL029
ugcuccugaagcugag

SEQ ID NO: 489149 - RNA, 23 nt, Chlamydophila pneumoniae CWL029
ugcuuaaggaaacagugguaugc

SEQ ID NO: 489150 - RNA, 16 nt, Chlamydophila pneumoniae CWL029
ugcuguuccauaauuu

SEQ ID NO: 489151 - RNA, 16 nt, Chlamydophila pneumoniae CWL029
aauaggaacaaagcuc

SEQ ID NO: 489152 - RNA, 19 nt, Chlamydophila pneumoniae CWL029
aauagcaagagcuauaccu

SEQ ID NO: 489153 - RNA, 15 nt, Chlamydophila pneumoniae CWL029
acucccucaaaauuu

SEQ ID NO: 489154 - RNA, 13 nt, Chlamydophila pneumoniae CWL029
acucuugcuugcu

SEQ ID NO: 489155 - RNA, 20 nt, Chlamydophila pneumoniae CWL029
acucuuuaggucuugucuau

SEQ ID NO: 489156 - RNA, 22 nt, Chlamydophila pneumoniae CWL029
acugaugugaagccauuuucua

SEQ ID NO: 489157 - RNA, 14 nt, Chlamydophila pneumoniae CWL029
acuagagaaaaagc

SEQ ID NO: 489158 - RNA, 12 nt, Chlamydophila pneumoniae CWL029
acuaaaacagcc

SEQ ID NO: 489159 - RNA, 15 nt, Chlamydophila pneumoniae CWL029
acguagucaaaaauu

SEQ ID NO: 489160 - RNA, 21 nt, Chlamydophila pneumoniae CWL029
acggauaggaucauugaguuc

SEQ ID NO: 489161 - RNA, 20 nt, Chlamydophila pneumoniae CWL029
acggccgacucuacaucuuc

SEQ ID NO: 489162 - RNA, 12 nt, Chlamydophila pneumoniae CWL029
acgaucuagaag

SEQ ID NO: 489163 - RNA, 16 nt, Chlamydophila pneumoniae CWL029
acgaugaacguauagg

SEQ ID NO: 489164 - RNA, 11 nt, Chlamydophila pneumoniae CWL029
acgcagagaug

SEQ ID NO: 489165 - RNA, 14 nt, Chlamydophila pneumoniae CWL029
accuuacauccaau

SEQ ID NO: 489166 - RNA, 20 nt, Chlamydophila pneumoniae CWL029
accucuucucuauaaaaaaa

SEQ ID NO: 489167 - RNA, 14 nt, Chlamydophila pneumoniae CWL029
accuauauuuuuua

SEQ ID NO: 489168 - RNA, 23 nt, Chlamydophila pneumoniae CWL029
accucaucagaaguggccuugcc

SEQ ID NO: 489169 - RNA, 19 nt, Chlamydophila pneumoniae CWL029
accuacaucagacugaaga

SEQ ID NO: 489170 - RNA, 14 nt, Chlamydophila pneumoniae CWL029
accucgaauuccuc

SEQ ID NO: 489171 - RNA, 21 nt, Chlamydophila pneumoniae CWL029
acccucggagacucagagaaa

SEQ ID NO: 489172 - RNA, 23 nt, Chlamydophila pneumoniae CWL029
accgccugacgauaguacuuauc

SEQ ID NO: 489173 - RNA, 22 nt, Chlamydophila pneumoniae CWL029
accaacuccucaaaagauaucg

SEQ ID NO: 489174 - RNA, 12 nt, Chlamydophila pneumoniae CWL029
acagucauaaaa

SEQ ID NO: 489175 - RNA, 17 nt, Chlamydophila pneumoniae CWL029
acagucugugagaaaua

SEQ ID NO: 489176 - RNA, 19 nt, Chlamydophila pneumoniae CWL029
acauagaggagauccuaag

SEQ ID NO: 489177 - RNA, 18 nt, Chlamydophila pneumoniae CWL029
acauaguuuaauaaaucu

SEQ ID NO: 489178 - RNA, 14 nt, Chlamydophila pneumoniae CWL029
acauccuuguagaa

SEQ ID NO: 489179 - RNA, 22 nt, Chlamydophila pneumoniae CWL029
acacgcuuuccuaaccauugcu

SEQ ID NO: 489180 - RNA, 19 nt, Chlamydophila pneumoniae CWL029
acaagaaccuguuuuucua

SEQ ID NO: 489181 - RNA, 21 nt, Chlamydophila pneumoniae CWL029
acaaaugcgguaucuccggaa

SEQ ID NO: 489182 - RNA, 19 nt, Chlamydophila pneumoniae CWL029
acaaaggcauaagaucaua

SEQ ID NO: 489183 - RNA, 21 nt, Chlamydophila pneumoniae CWL029
aauguugggaugaucucguag

SEQ ID NO: 489184 - RNA, 19 nt, Chlamydophila pneumoniae CWL029
ugauguaggugauauuuuc

SEQ ID NO: 489185 - RNA, 17 nt, Chlamydophila pneumoniae CWL029
ugcacucuuucagaaag

SEQ ID NO: 489186 - RNA, 20 nt, Chlamydophila pneumoniae CWL029
ugcauaguauggcauucuuu

SEQ ID NO: 489187 - RNA, 20 nt, Chlamydophila pneumoniae CWL029
ugauaaagggaauuuucuca

SEQ ID NO: 489188 - RNA, 19 nt, Chlamydophila pneumoniae CWL029
ugauaccaagaugaagaaa

SEQ ID NO: 489189 - RNA, 19 nt, Chlamydophila pneumoniae CWL029
ucuuucauaagauagagcg

SEQ ID NO: 489190 - RNA, 16 nt, Chlamydophila pneumoniae CWL029
ucuuucuaagaagacu

SEQ ID NO: 489191 - RNA, 16 nt, Chlamydophila pneumoniae CWL029
ucuuucugcucuucua

SEQ ID NO: 489192 - RNA, 14 nt, Chlamydophila pneumoniae CWL029
ucuuuauuuaaaua

SEQ ID NO: 489193 - RNA, 14 nt, Chlamydophila pneumoniae CWL029
ucuuucaauagcuu

SEQ ID NO: 489194 - RNA, 20 nt, Chlamydophila pneumoniae CWL029
ugaacaaaaucgaacagaga

SEQ ID NO: 489195 - RNA, 19 nt, Chlamydophila pneumoniae CWL029
ucuucugaaaucaaaaaaa

SEQ ID NO: 489196 - RNA, 20 nt, Chlamydophila pneumoniae CWL029
ucuucugaauagcucuuuuc

SEQ ID NO: 489197 - RNA, 18 nt, Chlamydophila pneumoniae CWL029
ucuucuaaaaccacagaa

SEQ ID NO: 489198 - RNA, 16 nt, Chlamydophila pneumoniae CWL029
ucuucuaaaacuucag

SEQ ID NO: 489199 - RNA, 17 nt, Chlamydophila pneumoniae CWL029
ucuucaugaaaaaagaa

SEQ ID NO: 489200 - RNA, 19 nt, Chlamydophila pneumoniae CWL029
ucuucgauuguaacuucgu

SEQ ID NO: 489201 - RNA, 19 nt, Chlamydophila pneumoniae CWL029
ucuuagaauccaaagacuu

SEQ ID NO: 489202 - RNA, 12 nt, Chlamydophila pneumoniae CWL029
ucuuaacaauau

SEQ ID NO: 489203 - RNA, 17 nt, Chlamydophila pneumoniae CWL029
ucuuaucugcuauguag

SEQ ID NO: 489204 - RNA, 16 nt, Chlamydophila pneumoniae CWL029
ucugauccgaaaagaa

SEQ ID NO: 489205 - RNA, 17 nt, Chlamydophila pneumoniae CWL029
ucugaugaccucaucuc

SEQ ID NO: 489206 - RNA, 22 nt, Chlamydophila pneumoniae CWL029
ucugaauagcucuuuucaugau

SEQ ID NO: 489207 - RNA, 17 nt, Chlamydophila pneumoniae CWL029
ucucuuccuucuccugu

SEQ ID NO: 489208 - RNA, 18 nt, Chlamydophila pneumoniae CWL029
ucucuucauugcaaaaau

SEQ ID NO: 489209 - RNA, 17 nt, Chlamydophila pneumoniae CWL029
ucucuaggaagauuuau

SEQ ID NO: 489210 - RNA, 19 nt, Chlamydophila pneumoniae CWL029
ucucugaagcuaaaaaauu

SEQ ID NO: 489211 - RNA, 21 nt, Chlamydophila pneumoniae CWL029
ucucuggaauacauuccuagc

SEQ ID NO: 489212 - RNA, 16 nt, Chlamydophila pneumoniae CWL029
ucucagcaaagacauc

SEQ ID NO: 489213 - RNA, 17 nt, Chlamydophila pneumoniae CWL029
ucucauaaguauagaga

SEQ ID NO: 489214 - RNA, 20 nt, Chlamydophila pneumoniae CWL029
ucucauagcuuccuguagug

SEQ ID NO: 489215 - RNA, 23 nt, Chlamydophila pneumoniae CWL029
ucucauuccagcaucuucucgaa

SEQ ID NO: 489216 - RNA, 20 nt, Chlamydophila pneumoniae CWL029
ucucccgugaacaaaaacug

SEQ ID NO: 489217 - RNA, 15 nt, Chlamydophila pneumoniae CWL029
ucuccaaaagcucua

SEQ ID NO: 489218 - RNA, 18 nt, Chlamydophila pneumoniae CWL029
ucucaaucgauaaucaaa

SEQ ID NO: 489219 - RNA, 21 nt, Chlamydophila pneumoniae CWL029
ucgugacucuuaucuggagau

SEQ ID NO: 489220 - RNA, 13 nt, Chlamydophila pneumoniae CWL029
ucgucaaauucau

SEQ ID NO: 489221 - RNA, 18 nt, Chlamydophila pneumoniae CWL029
ucgguucggucucuucuc

SEQ ID NO: 489222 - RNA, 17 nt, Chlamydophila pneumoniae CWL029
ucguagcaggcaucacu

SEQ ID NO: 489223 - RNA, 16 nt, Chlamydophila pneumoniae CWL029
ucggggagaacaccuc

SEQ ID NO: 489224 - RNA, 23 nt, Chlamydophila pneumoniae CWL029
ucgcuagguauacgguaaugcca

SEQ ID NO: 489225 - RNA, 20 nt, Chlamydophila pneumoniae CWL029
aauaccaguagagaauguuc

SEQ ID NO: 489226 - RNA, 18 nt, Chlamydophila pneumoniae CWL029
ucgcaguccaaagacuuu

SEQ ID NO: 489227 - RNA, 15 nt, Chlamydophila pneumoniae CWL029
ucgcgacaagacaau

SEQ ID NO: 489228 - RNA, 21 nt, Chlamydophila pneumoniae CWL029
uccuuuagccuggucucauga

SEQ ID NO: 489229 - RNA, 17 nt, Chlamydophila pneumoniae CWL029
uccucuuaggagagcuu

SEQ ID NO: 489230 - RNA, 16 nt, Chlamydophila pneumoniae CWL029
uccucguuaauaagaa

SEQ ID NO: 489231 - RNA, 18 nt, Chlamydophila pneumoniae CWL029
uccguaaggacuguagug

SEQ ID NO: 489232 - RNA, 16 nt, Chlamydophila pneumoniae CWL029
uccucuccuaaugccg

SEQ ID NO: 489233 - RNA, 20 nt, Chlamydophila pneumoniae CWL029
ucgacuucaccuugaaguuu

SEQ ID NO: 489234 - RNA, 19 nt, Chlamydophila pneumoniae CWL029
uccccaugaaaauacaacg

SEQ ID NO: 489235 - RNA, 22 nt, Chlamydophila pneumoniae CWL029
ucccugagccugugauaguaga

SEQ ID NO: 489236 - RNA, 15 nt, Chlamydophila pneumoniae CWL029
ucccucgcuaaagua

SEQ ID NO: 489237 - RNA, 18 nt, Chlamydophila pneumoniae CWL029
ucccucaaaauuuaaaua

SEQ ID NO: 489238 - RNA, 16 nt, Chlamydophila pneumoniae CWL029
ucccuguauuaaagaa

SEQ ID NO: 489239 - RNA, 17 nt, Chlamydophila pneumoniae CWL029
uccggggagaacuucaa

SEQ ID NO: 489240 - RNA, 17 nt, Chlamydophila pneumoniae CWL029
uccacgagauucugcuu

SEQ ID NO: 489241 - RNA, 21 nt, Chlamydophila pneumoniae CWL029
uccaaacccugggcucacucu

SEQ ID NO: 489242 - RNA, 18 nt, Chlamydophila pneumoniae CWL029
uccaggacguaaaaagaa

SEQ ID NO: 489243 - RNA, 21 nt, Chlamydophila pneumoniae CWL029
uccacgaguucgcggaucuuc

SEQ ID NO: 489244 - RNA, 20 nt, Chlamydophila pneumoniae CWL029
ucaccacaaaccucuaaaaa

SEQ ID NO: 489245 - RNA, 12 nt, Chlamydophila pneumoniae CWL029
ucaccaacuccu

SEQ ID NO: 489246 - RNA, 15 nt, Chlamydophila pneumoniae CWL029
ucagacuuaaaguac

SEQ ID NO: 489247 - RNA, 14 nt, Chlamydophila pneumoniae CWL029
aauacaaaaaauaa

SEQ ID NO: 489248 - RNA, 13 nt, Chlamydophila pneumoniae CWL029
aauacauuccuag

SEQ ID NO: 489249 - RNA, 14 nt, Chlamydophila pneumoniae CWL029
aauacaaacaagaa

SEQ ID NO: 489250 - RNA, 17 nt, Chlamydophila pneumoniae CWL029
aauacaggaaucuccuc

SEQ ID NO: 489251 - RNA, 12 nt, Chlamydophila pneumoniae CWL029
uauuuuuaaaua

SEQ ID NO: 489252 - RNA, 20 nt, Chlamydophila pneumoniae CWL029
uauuuuuacuucacucuuuc

SEQ ID NO: 489253 - RNA, 20 nt, Chlamydophila pneumoniae CWL029
uauuguucuugguguauagu

SEQ ID NO: 489254 - RNA, 17 nt, Chlamydophila pneumoniae CWL029
uaucgauaacgauuucu

SEQ ID NO: 489255 - RNA, 19 nt, Chlamydophila pneumoniae CWL029
uauaaauagaaaucuuagu

SEQ ID NO: 489256 - RNA, 21 nt, Chlamydophila pneumoniae CWL029
uauaaacuccacgaauucuuu

SEQ ID NO: 489257 - RNA, 14 nt, Chlamydophila pneumoniae CWL029
uauaaucacguccu

SEQ ID NO: 489258 - RNA, 19 nt, Chlamydophila pneumoniae CWL029
uauagacuuguauucuuga

SEQ ID NO: 489259 - RNA, 16 nt, Chlamydophila pneumoniae CWL029
uauagagaagauuucu

SEQ ID NO: 489260 - RNA, 22 nt, Chlamydophila pneumoniae CWL029
uauagcuggcaaugauauccuc

SEQ ID NO: 489261 - RNA, 16 nt, Chlamydophila pneumoniae CWL029
uaucaaccauaaagaa

SEQ ID NO: 489262 - RNA, 16 nt, Chlamydophila pneumoniae CWL029
uauccagaaagauucu

SEQ ID NO: 489263 - RNA, 23 nt, Chlamydophila pneumoniae CWL029
uaucauuauacuucguuaugaag

SEQ ID NO: 489264 - RNA, 16 nt, Chlamydophila pneumoniae CWL029
uagucgggaccauaaa

SEQ ID NO: 489265 - RNA, 16 nt, Chlamydophila pneumoniae CWL029
uaguguucgagcaucu

SEQ ID NO: 489266 - RNA, 17 nt, Chlamydophila pneumoniae CWL029
uaguggaaauugugaaa

SEQ ID NO: 489267 - RNA, 21 nt, Chlamydophila pneumoniae CWL029
uaguucaccacuaccgaauuu

SEQ ID NO: 489268 - RNA, 12 nt, Chlamydophila pneumoniae CWL029
uaguuguaauuu

SEQ ID NO: 489269 - RNA, 18 nt, Chlamydophila pneumoniae CWL029
uagguuaagccaaucccu

SEQ ID NO: 489270 - RNA, 15 nt, Chlamydophila pneumoniae CWL029
uagucaaaaauucuu

SEQ ID NO: 489271 - RNA, 16 nt, Chlamydophila pneumoniae CWL029
aaguugaccuuuuuca

SEQ ID NO: 489272 - RNA, 18 nt, Chlamydophila pneumoniae CWL029
uagcuuacagagaaauuu

SEQ ID NO: 489273 - RNA, 14 nt, Chlamydophila pneumoniae CWL029
uagcaucaucuccu

SEQ ID NO: 489274 - RNA, 18 nt, Chlamydophila pneumoniae CWL029
uagcaugaaggauaguuu

SEQ ID NO: 489275 - RNA, 17 nt, Chlamydophila pneumoniae CWL029
uacuguccauccaaaua

SEQ ID NO: 489276 - RNA, 16 nt, Chlamydophila pneumoniae CWL029
uacuguagaguuuucu

SEQ ID NO: 489277 - RNA, 22 nt, Chlamydophila pneumoniae CWL029
uacuguuaacaaguaccaagaa

SEQ ID NO: 489278 - RNA, 18 nt, Chlamydophila pneumoniae CWL029
uagaauccaaagacuuuu

SEQ ID NO: 489279 - RNA, 19 nt, Chlamydophila pneumoniae CWL029
uagaacuucucaagaaucu

SEQ ID NO: 489280 - RNA, 18 nt, Chlamydophila pneumoniae CWL029
uagagcuuucagaaaaga

SEQ ID NO: 489281 - RNA, 16 nt, Chlamydophila pneumoniae CWL029
uagagucgauaaaaac

SEQ ID NO: 489282 - RNA, 12 nt, Chlamydophila pneumoniae CWL029
uacccaucuaga

SEQ ID NO: 489283 - RNA, 20 nt, Chlamydophila pneumoniae CWL029
uacgcucguagguaugagcu

SEQ ID NO: 489284 - RNA, 14 nt, Chlamydophila pneumoniae CWL029
uaauucagaaagac

SEQ ID NO: 489285 - RNA, 21 nt, Chlamydophila pneumoniae CWL029
uaauggugucuuacaaaccca

SEQ ID NO: 489286 - RNA, 16 nt, Chlamydophila pneumoniae CWL029
uaaugacucuagagua

SEQ ID NO: 489287 - RNA, 17 nt, Chlamydophila pneumoniae CWL029
uaaugccaauaugguag

SEQ ID NO: 489288 - RNA, 18 nt, Chlamydophila pneumoniae CWL029
uaauacggacuucacaaa

SEQ ID NO: 489289 - RNA, 14 nt, Chlamydophila pneumoniae CWL029
uaauacguuuuuag

SEQ ID NO: 489290 - RNA, 21 nt, Chlamydophila pneumoniae CWL029
uaaucucgcaguccuugagcu

SEQ ID NO: 489291 - RNA, 20 nt, Chlamydophila pneumoniae CWL029
uaagcaagcaacugauguuu

SEQ ID NO: 489292 - RNA, 18 nt, Chlamydophila pneumoniae CWL029
uaagaguuccaagacaau

SEQ ID NO: 489293 - RNA, 23 nt, Chlamydophila pneumoniae CWL029
uaagaucuuuagaauaagagcua

SEQ ID NO: 489294 - RNA, 23 nt, Chlamydophila pneumoniae CWL029
uaagaacguauacgucccacaaa

SEQ ID NO: 489295 - RNA, 19 nt, Chlamydophila pneumoniae CWL029
uaagaagguuuauuagaag

SEQ ID NO: 489296 - RNA, 18 nt, Chlamydophila pneumoniae CWL029
uaagaaucuauagaacua

SEQ ID NO: 489297 - RNA, 24 nt, Chlamydophila pneumoniae CWL029
uaagaaaggcacuccaaaacucaa

SEQ ID NO: 489298 - RNA, 15 nt, Chlamydophila pneumoniae CWL029
uaagaaaucaguccu

SEQ ID NO: 489299 - RNA, 22 nt, Chlamydophila pneumoniae CWL029
uaagacauuauagaggucuuug

SEQ ID NO: 489300 - RNA, 22 nt, Chlamydophila pneumoniae CWL029
uaacgaagugaggagaauagca

SEQ ID NO: 489301 - RNA, 14 nt, Chlamydophila pneumoniae CWL029
uaaaagaggaagau

SEQ ID NO: 489302 - RNA, 21 nt, Chlamydophila pneumoniae CWL029
uaaacucccuaaggagaaucc

SEQ ID NO: 489303 - RNA, 13 nt, Chlamydophila pneumoniae CWL029
uaaauaaaaccac

SEQ ID NO: 489304 - RNA, 21 nt, Chlamydophila pneumoniae CWL029
uaacacuuccuacggcaagaa

SEQ ID NO: 489305 - RNA, 16 nt, Chlamydophila pneumoniae CWL029
uaacaccaaaagaaua

SEQ ID NO: 489306 - RNA, 18 nt, Chlamydophila pneumoniae CWL029
guuguugauaauuacaga

SEQ ID NO: 489307 - RNA, 15 nt, Chlamydophila pneumoniae CWL029
guugccuuucucuuc

SEQ ID NO: 489308 - RNA, 17 nt, Chlamydophila pneumoniae CWL029
guugcuucuaagaaacu

SEQ ID NO: 489309 - RNA, 18 nt, Chlamydophila pneumoniae CWL029
guucggucucuucucugu

SEQ ID NO: 489310 - RNA, 21 nt, Chlamydophila pneumoniae CWL029
guuacagcguugcuaagcaua

SEQ ID NO: 489311 - RNA, 21 nt, Chlamydophila pneumoniae CWL029
guuauuaaggaucccaucauc

SEQ ID NO: 489312 - RNA, 14 nt, Chlamydophila pneumoniae CWL029
aagugcguuccuau

SEQ ID NO: 489313 - RNA, 12 nt, Chlamydophila pneumoniae CWL029
gugcucucuucu

SEQ ID NO: 489314 - RNA, 16 nt, Chlamydophila pneumoniae CWL029
gugcuaggcucucgac

SEQ ID NO: 489315 - RNA, 17 nt, Chlamydophila pneumoniae CWL029
agagucucuugcuuuug

SEQ ID NO: 489316 - RNA, 20 nt, Chlamydophila pneumoniae CWL029
agagugaccauagcauagag

SEQ ID NO: 489317 - RNA, 13 nt, Chlamydophila pneumoniae CWL029
agauaaacauuaa

SEQ ID NO: 489318 - RNA, 23 nt, Chlamydophila pneumoniae CWL029
agauaaaggcauaacugugcucc

SEQ ID NO: 489319 - RNA, 12 nt, Chlamydophila pneumoniae CWL029
agauaauagaga

SEQ ID NO: 489320 - RNA, 17 nt, Chlamydophila pneumoniae CWL029
agauaggguaagauugc

SEQ ID NO: 489321 - RNA, 16 nt, Chlamydophila pneumoniae CWL029
agauacuuaucuuuaa

SEQ ID NO: 489322 - RNA, 14 nt, Chlamydophila pneumoniae CWL029
agauagagauaagu

SEQ ID NO: 489323 - RNA, 13 nt, Chlamydophila pneumoniae CWL029
agauaccaucaag

SEQ ID NO: 489324 - RNA, 18 nt, Chlamydophila pneumoniae CWL029
agaccugccaagauacua

SEQ ID NO: 489325 - RNA, 16 nt, Chlamydophila pneumoniae CWL029
agacagaugcuucaag

SEQ ID NO: 489326 - RNA, 21 nt, Chlamydophila pneumoniae CWL029
agaauguaugugaaagauuau

SEQ ID NO: 489327 - RNA, 21 nt, Chlamydophila pneumoniae CWL029
agaauuuucaugauauuuuua

SEQ ID NO: 489328 - RNA, 17 nt, Chlamydophila pneumoniae CWL029
agacaaguucaucaaau

SEQ ID NO: 489329 - RNA, 17 nt, Chlamydophila pneumoniae CWL029
agacacacuuucuuuaa

SEQ ID NO: 489330 - RNA, 12 nt, Chlamydophila pneumoniae CWL029
agaauaacgcaa

SEQ ID NO: 489331 - RNA, 19 nt, Chlamydophila pneumoniae CWL029
agaauguacauagaggaga

SEQ ID NO: 489332 - RNA, 18 nt, Chlamydophila pneumoniae CWL029
agaauccuuuuuaggaaa

SEQ ID NO: 489333 - RNA, 16 nt, Chlamydophila pneumoniae CWL029
agaaucuauagaacua

SEQ ID NO: 489334 - RNA, 21 nt, Chlamydophila pneumoniae CWL029
agaaugacacagagaacaaua

SEQ ID NO: 489335 - RNA, 14 nt, Chlamydophila pneumoniae CWL029
agaauaucuuuuga

SEQ ID NO: 489336 - RNA, 23 nt, Chlamydophila pneumoniae CWL029
agaaccuccaccaggagcuccuc

SEQ ID NO: 489337 - RNA, 19 nt, Chlamydophila pneumoniae CWL029
agaacgaauuucaacagcu

SEQ ID NO: 489338 - RNA, 20 nt, Chlamydophila pneumoniae CWL029
agaacguauacgucccacaa

SEQ ID NO: 489339 - RNA, 14 nt, Chlamydophila pneumoniae CWL029
agaacguggggaaa

SEQ ID NO: 489340 - RNA, 20 nt, Chlamydophila pneumoniae CWL029
agaacaccaucacauccugu

SEQ ID NO: 489341 - RNA, 19 nt, Chlamydophila pneumoniae CWL029
agaaaucucagugaacucu

SEQ ID NO: 489342 - RNA, 17 nt, Chlamydophila pneumoniae CWL029
agaaauucaugccuuug

SEQ ID NO: 489343 - RNA, 12 nt, Chlamydophila pneumoniae CWL029
agaaauuccuaa

SEQ ID NO: 489344 - RNA, 22 nt, Chlamydophila pneumoniae CWL029
agaaauuccuaaaauuuccgcu

SEQ ID NO: 489345 - RNA, 18 nt, Chlamydophila pneumoniae CWL029
agaacaagaaguaggaaa

SEQ ID NO: 489346 - RNA, 15 nt, Chlamydophila pneumoniae CWL029
agcauaccuuggaaa

SEQ ID NO: 489347 - RNA, 17 nt, Chlamydophila pneumoniae CWL029
agcagaugaaacuuuag

SEQ ID NO: 489348 - RNA, 20 nt, Chlamydophila pneumoniae CWL029
agcacuuguuuuuucuucug

SEQ ID NO: 489349 - RNA, 15 nt, Chlamydophila pneumoniae CWL029
agcacugaugaaaaa

SEQ ID NO: 489350 - RNA, 22 nt, Chlamydophila pneumoniae CWL029
agcacauaagaugaaguuuaau

SEQ ID NO: 489351 - RNA, 17 nt, Chlamydophila pneumoniae CWL029
agcaaggaaaaaaaauc

SEQ ID NO: 489352 - RNA, 18 nt, Chlamydophila pneumoniae CWL029
agcaagauucuucagaau

SEQ ID NO: 489353 - RNA, 14 nt, Chlamydophila pneumoniae CWL029
agauauagauucau

SEQ ID NO: 489354 - RNA, 21 nt, Chlamydophila pneumoniae CWL029
agauugcagguagauccuaua

SEQ ID NO: 489355 - RNA, 13 nt, Chlamydophila pneumoniae CWL029
agcgcuuccagcu

SEQ ID NO: 489356 - RNA, 19 nt, Chlamydophila pneumoniae CWL029
auauaggcgugugaaaucu

SEQ ID NO: 489357 - RNA, 22 nt, Chlamydophila pneumoniae CWL029
auaucgaguucuuuuugcagau

SEQ ID NO: 489358 - RNA, 16 nt, Chlamydophila pneumoniae CWL029
auaucuauaaauguag

SEQ ID NO: 489359 - RNA, 16 nt, Chlamydophila pneumoniae CWL029
auaguuuuuauuuuua

SEQ ID NO: 489360 - RNA, 23 nt, Chlamydophila pneumoniae CWL029
auaguguucgagcaucucaagag

SEQ ID NO: 489361 - RNA, 22 nt, Chlamydophila pneumoniae CWL029
auagucgcuagugcgaugggaa

SEQ ID NO: 489362 - RNA, 12 nt, Chlamydophila pneumoniae CWL029
auaggcauuaca

SEQ ID NO: 489363 - RNA, 22 nt, Chlamydophila pneumoniae CWL029
auaggguugugucucugaagac

SEQ ID NO: 489364 - RNA, 18 nt, Chlamydophila pneumoniae CWL029
auagguacgcuuuuucuu

SEQ ID NO: 489365 - RNA, 19 nt, Chlamydophila pneumoniae CWL029
auaggagagcacuuuuaau

SEQ ID NO: 489366 - RNA, 18 nt, Chlamydophila pneumoniae CWL029
auagaaaacauagagauu

SEQ ID NO: 489367 - RNA, 19 nt, Chlamydophila pneumoniae CWL029
auagaaauaagcaucuaga

SEQ ID NO: 489368 - RNA, 17 nt, Chlamydophila pneumoniae CWL029
auacaaaacaaaagcca

SEQ ID NO: 489369 - RNA, 22 nt, Chlamydophila pneumoniae CWL029
auacgccgggccacuucaucuu

SEQ ID NO: 489370 - RNA, 20 nt, Chlamydophila pneumoniae CWL029
auaaguuuugauuuugcagu

SEQ ID NO: 489371 - RNA, 13 nt, Chlamydophila pneumoniae CWL029
auaauaauggcau

SEQ ID NO: 489372 - RNA, 19 nt, Chlamydophila pneumoniae CWL029
auaagugacuuuucuucuu

SEQ ID NO: 489373 - RNA, 15 nt, Chlamydophila pneumoniae CWL029
auaaccaaaagaauu

SEQ ID NO: 489374 - RNA, 23 nt, Chlamydophila pneumoniae CWL029
auaacgggguugucucuacaggg

SEQ ID NO: 489375 - RNA, 19 nt, Chlamydophila pneumoniae CWL029
aguucacacguaagaaagg

SEQ ID NO: 489376 - RNA, 23 nt, Chlamydophila pneumoniae CWL029
aguuucccgacauuuaacaucuu

SEQ ID NO: 489377 - RNA, 17 nt, Chlamydophila pneumoniae CWL029
aguuaaaccuuuuuuua

SEQ ID NO: 489378 - RNA, 21 nt, Chlamydophila pneumoniae CWL029
agugauuacggcgugccuuuu

SEQ ID NO: 489379 - RNA, 14 nt, Chlamydophila pneumoniae CWL029
agucuauuugaaaa

SEQ ID NO: 489380 - RNA, 18 nt, Chlamydophila pneumoniae CWL029
agucuucaggugaaggaa

SEQ ID NO: 489381 - RNA, 15 nt, Chlamydophila pneumoniae CWL029
agucuucgacaagga

SEQ ID NO: 489382 - RNA, 20 nt, Chlamydophila pneumoniae CWL029
agucguuuagcuauuugaaa

SEQ ID NO: 489383 - RNA, 19 nt, Chlamydophila pneumoniae CWL029
aguccuaucaaagcaaaag

SEQ ID NO: 489384 - RNA, 11 nt, Chlamydophila pneumoniae CWL029
agucaaagggc

SEQ ID NO: 489385 - RNA, 16 nt, Chlamydophila pneumoniae CWL029
agucaaauacuucucc

SEQ ID NO: 489386 - RNA, 14 nt, Chlamydophila pneumoniae CWL029
aguauuaaucuuau

SEQ ID NO: 489387 - RNA, 21 nt, Chlamydophila pneumoniae CWL029
aggguuuugaaauaauuuuca

SEQ ID NO: 489388 - RNA, 16 nt, Chlamydophila pneumoniae CWL029
aggcucuuuagcaaac

SEQ ID NO: 489389 - RNA, 23 nt, Chlamydophila pneumoniae CWL029
aggaugacacucacuauccggaa

SEQ ID NO: 489390 - RNA, 21 nt, Chlamydophila pneumoniae CWL029
aggagauaaagauguagaaua

SEQ ID NO: 489391 - RNA, 22 nt, Chlamydophila pneumoniae CWL029
aggagagcuugguuuucuccuu

SEQ ID NO: 489392 - RNA, 17 nt, Chlamydophila pneumoniae CWL029
aggagaguaaggucauu

SEQ ID NO: 489393 - RNA, 16 nt, Chlamydophila pneumoniae CWL029
aggaccuacugggaaa

SEQ ID NO: 489394 - RNA, 19 nt, Chlamydophila pneumoniae CWL029
aggacagccggagcuucua

SEQ ID NO: 489395 - RNA, 16 nt, Chlamydophila pneumoniae CWL029
aggagcuacugaaaga

SEQ ID NO: 489396 - RNA, 13 nt, Chlamydophila pneumoniae CWL029
aggagcuccuccu

SEQ ID NO: 489397 - RNA, 20 nt, Chlamydophila pneumoniae CWL029
aggagcaucauuaauuccau

SEQ ID NO: 489398 - RNA, 16 nt, Chlamydophila pneumoniae CWL029
agcuguacagaacaau

SEQ ID NO: 489399 - RNA, 16 nt, Chlamydophila pneumoniae CWL029
agcuguuuacuuuucu

SEQ ID NO: 489400 - RNA, 18 nt, Chlamydophila pneumoniae CWL029
aggaagguucucaaagcu

SEQ ID NO: 489401 - RNA, 19 nt, Chlamydophila pneumoniae CWL029
aggaaauuacaaucucuag

SEQ ID NO: 489402 - RNA, 15 nt, Chlamydophila pneumoniae CWL029
agcuuucuuggagaa

SEQ ID NO: 489403 - RNA, 21 nt, Chlamydophila pneumoniae CWL029
cacauaguuuaauaaaucuau

SEQ ID NO: 489404 - RNA, 18 nt, Chlamydophila pneumoniae CWL029
caauuuuuauaauauuuu

SEQ ID NO: 489405 - RNA, 16 nt, Chlamydophila pneumoniae CWL029
caauuccgaagaagaa

SEQ ID NO: 489406 - RNA, 17 nt, Chlamydophila pneumoniae CWL029
caauuacaggaaacucu

SEQ ID NO: 489407 - RNA, 15 nt, Chlamydophila pneumoniae CWL029
caagauucucacucu

SEQ ID NO: 489408 - RNA, 23 nt, Chlamydophila pneumoniae CWL029
caagagcuccgcuagaggaucuu

SEQ ID NO: 489409 - RNA, 18 nt, Chlamydophila pneumoniae CWL029
caagaaugaaucgaagaa

SEQ ID NO: 489410 - RNA, 15 nt, Chlamydophila pneumoniae CWL029
caagacaaaaaaggg

SEQ ID NO: 489411 - RNA, 16 nt, Chlamydophila pneumoniae CWL029
caaagucaaauacuuc

SEQ ID NO: 489412 - RNA, 22 nt, Chlamydophila pneumoniae CWL029
caacaguucgacaaccaaaaca

SEQ ID NO: 489413 - RNA, 22 nt, Chlamydophila pneumoniae CWL029
caaccuuuccuaaaauaauuuu

SEQ ID NO: 489414 - RNA, 14 nt, Chlamydophila pneumoniae CWL029
caaaccaaaaaagu

SEQ ID NO: 489415 - RNA, 15 nt, Chlamydophila pneumoniae CWL029
caaagccugaaaaau

SEQ ID NO: 489416 - RNA, 20 nt, Chlamydophila pneumoniae CWL029
caaaacucaaggaguuuuaa

SEQ ID NO: 489417 - RNA, 16 nt, Chlamydophila pneumoniae CWL029
caaaaguugucuuuga

SEQ ID NO: 489418 - RNA, 13 nt, Chlamydophila pneumoniae CWL029
caaaaacuuucga

SEQ ID NO: 489419 - RNA, 19 nt, Chlamydophila pneumoniae CWL029
caaaaauaaacauauucuc

SEQ ID NO: 489420 - RNA, 15 nt, Chlamydophila pneumoniae CWL029
auuuuuccagaaaug

SEQ ID NO: 489421 - RNA, 16 nt, Chlamydophila pneumoniae CWL029
auuuuugggaaaagaa

SEQ ID NO: 489422 - RNA, 14 nt, Chlamydophila pneumoniae CWL029
auuuucagcacuga

SEQ ID NO: 489423 - RNA, 12 nt, Chlamydophila pneumoniae CWL029
auuuucaagcuu

SEQ ID NO: 489424 - RNA, 17 nt, Chlamydophila pneumoniae CWL029
auuuguuuagcauagag

SEQ ID NO: 489425 - RNA, 22 nt, Chlamydophila pneumoniae CWL029
auuuuaaacuuacagccaccuu

SEQ ID NO: 489426 - RNA, 13 nt, Chlamydophila pneumoniae CWL029
auuugauuuuuca

SEQ ID NO: 489427 - RNA, 22 nt, Chlamydophila pneumoniae CWL029
auuugcaacaaucuuucuucua

SEQ ID NO: 489428 - RNA, 19 nt, Chlamydophila pneumoniae CWL029
auuucuucuucuauacgaa

SEQ ID NO: 489429 - RNA, 15 nt, Chlamydophila pneumoniae CWL029
auuuagaaaucucac

SEQ ID NO: 489430 - RNA, 13 nt, Chlamydophila pneumoniae CWL029
auuuaguucacca

SEQ ID NO: 489431 - RNA, 18 nt, Chlamydophila pneumoniae CWL029
auucccggaggcaaagau

SEQ ID NO: 489432 - RNA, 21 nt, Chlamydophila pneumoniae CWL029
auuuauuaucuuguuucguaa

SEQ ID NO: 489433 - RNA, 18 nt, Chlamydophila pneumoniae CWL029
auucaaacuccuuuuaaa

SEQ ID NO: 489434 - RNA, 15 nt, Chlamydophila pneumoniae CWL029
auuaucuuagggaau

SEQ ID NO: 489435 - RNA, 20 nt, Chlamydophila pneumoniae CWL029
auuccaucgccgaccaucau

SEQ ID NO: 489436 - RNA, 14 nt, Chlamydophila pneumoniae CWL029
auuccagcaucuuc

SEQ ID NO: 489437 - RNA, 15 nt, Chlamydophila pneumoniae CWL029
auucacaaaucuucc

SEQ ID NO: 489438 - RNA, 23 nt, Chlamydophila pneumoniae CWL029
auuagagagugcguacucuucuu

SEQ ID NO: 489439 - RNA, 18 nt, Chlamydophila pneumoniae CWL029
auuaguaacuaaauucuu

SEQ ID NO: 489440 - RNA, 17 nt, Chlamydophila pneumoniae CWL029
auuauaaauagaaaucu

SEQ ID NO: 489441 - RNA, 15 nt, Chlamydophila pneumoniae CWL029
auuauacuuuuuuua

SEQ ID NO: 489442 - RNA, 17 nt, Chlamydophila pneumoniae CWL029
auuaucaagaaauucuu

SEQ ID NO: 489443 - RNA, 16 nt, Chlamydophila pneumoniae CWL029
auuacaggaaacucua

SEQ ID NO: 489444 - RNA, 16 nt, Chlamydophila pneumoniae CWL029
auuaagauaaacagca

SEQ ID NO: 489445 - RNA, 12 nt, Chlamydophila pneumoniae CWL029
auguuuaaagca

SEQ ID NO: 489446 - RNA, 12 nt, Chlamydophila pneumoniae CWL029
augguccuaggc

SEQ ID NO: 489447 - RNA, 20 nt, Chlamydophila pneumoniae CWL029
augcuaaauuugucaucaca

SEQ ID NO: 489448 - RNA, 21 nt, Chlamydophila pneumoniae CWL029
augcuaucuccagaaauuuuu

SEQ ID NO: 489449 - RNA, 21 nt, Chlamydophila pneumoniae CWL029
augaucucuucaugaaaaaag

SEQ ID NO: 489450 - RNA, 19 nt, Chlamydophila pneumoniae CWL029
augaugcaagcagauagag

SEQ ID NO: 489451 - RNA, 21 nt, Chlamydophila pneumoniae CWL029
augagaauuuucaugauauuu

SEQ ID NO: 489452 - RNA, 19 nt, Chlamydophila pneumoniae CWL029
aucucuuucacaaaggcga

SEQ ID NO: 489453 - RNA, 19 nt, Chlamydophila pneumoniae CWL029
augauuucuuuagcuuuau

SEQ ID NO: 489454 - RNA, 15 nt, Chlamydophila pneumoniae CWL029
aucucuuuaaauguu

SEQ ID NO: 489455 - RNA, 16 nt, Chlamydophila pneumoniae CWL029
aucucuucuguaggaa

SEQ ID NO: 489456 - RNA, 15 nt, Chlamydophila pneumoniae CWL029
aucucuuaaaauauu

SEQ ID NO: 489457 - RNA, 17 nt, Chlamydophila pneumoniae CWL029
aucguagccccauagag

SEQ ID NO: 489458 - RNA, 14 nt, Chlamydophila pneumoniae CWL029
auccccucagaaag

SEQ ID NO: 489459 - RNA, 15 nt, Chlamydophila pneumoniae CWL029
auccccuucauucuu

SEQ ID NO: 489460 - RNA, 18 nt, Chlamydophila pneumoniae CWL029
auccccgggauuguucuu

SEQ ID NO: 489461 - RNA, 21 nt, Chlamydophila pneumoniae CWL029
aucccgccuuucuacccuucc

SEQ ID NO: 489462 - RNA, 21 nt, Chlamydophila pneumoniae CWL029
aucauugcuauugaaaaaucc

SEQ ID NO: 489463 - RNA, 22 nt, Chlamydophila pneumoniae CWL029
auccacauccuuguagaacuuc

SEQ ID NO: 489464 - RNA, 16 nt, Chlamydophila pneumoniae CWL029
aucaugccgagauuuu

SEQ ID NO: 489465 - RNA, 16 nt, Chlamydophila pneumoniae CWL029
aucaucuccugaagcc

SEQ ID NO: 489466 - RNA, 20 nt, Chlamydophila pneumoniae CWL029
ccauuucuaggaauugcugu

SEQ ID NO: 489467 - RNA, 14 nt, Chlamydophila pneumoniae CWL029
ccaucuaauccugu

SEQ ID NO: 489468 - RNA, 15 nt, Chlamydophila pneumoniae CWL029
ccagaugcuaaagag

SEQ ID NO: 489469 - RNA, 22 nt, Chlamydophila pneumoniae CWL029
ccacuccagaaaguauuccucu

SEQ ID NO: 489470 - RNA, 13 nt, Chlamydophila pneumoniae CWL029
ccaacuccucaaa

SEQ ID NO: 489471 - RNA, 13 nt, Chlamydophila pneumoniae CWL029
ccaacuccucuaa

SEQ ID NO: 489472 - RNA, 16 nt, Chlamydophila pneumoniae CWL029
cauuugccccuuccaa

SEQ ID NO: 489473 - RNA, 23 nt, Chlamydophila pneumoniae CWL029
cauugcuauugaaaaaucccugu

SEQ ID NO: 489474 - RNA, 15 nt, Chlamydophila pneumoniae CWL029
cauuggcuccuaagg

SEQ ID NO: 489475 - RNA, 12 nt, Chlamydophila pneumoniae CWL029
cauuccaagauu

SEQ ID NO: 489476 - RNA, 12 nt, Chlamydophila pneumoniae CWL029
caucuuccucuu

SEQ ID NO: 489477 - RNA, 16 nt, Chlamydophila pneumoniae CWL029
caucuucuuugccaau

SEQ ID NO: 489478 - RNA, 14 nt, Chlamydophila pneumoniae CWL029
caugaaagauaaug

SEQ ID NO: 489479 - RNA, 23 nt, Chlamydophila pneumoniae CWL029
caugaauugucaucucauaguuu

SEQ ID NO: 489480 - RNA, 19 nt, Chlamydophila pneumoniae CWL029
caugaaucucuucuguagg

SEQ ID NO: 489481 - RNA, 22 nt, Chlamydophila pneumoniae CWL029
caugaaucuuaugggagaagcu

SEQ ID NO: 489482 - RNA, 23 nt, Chlamydophila pneumoniae CWL029
caucggcuucuccaacuuccaua

SEQ ID NO: 489483 - RNA, 14 nt, Chlamydophila pneumoniae CWL029
caucaaagaauuau

SEQ ID NO: 489484 - RNA, 15 nt, Chlamydophila pneumoniae CWL029
caucacuuauauuuu

SEQ ID NO: 489485 - RNA, 16 nt, Chlamydophila pneumoniae CWL029
caucagaggccaccaa

SEQ ID NO: 489486 - RNA, 23 nt, Chlamydophila pneumoniae CWL029
cauacucgucaaauucauuaaga

SEQ ID NO: 489487 - RNA, 20 nt, Chlamydophila pneumoniae CWL029
cauagaauaaagauuuuagg

SEQ ID NO: 489488 - RNA, 18 nt, Chlamydophila pneumoniae CWL029
cauaguuuuuauuuuuaa

SEQ ID NO: 489489 - RNA, 24 nt, Chlamydophila pneumoniae CWL029
cauaagaguagacaagagagagcu

SEQ ID NO: 489490 - RNA, 20 nt, Chlamydophila pneumoniae CWL029
cauaaccugggcaauauuuu

SEQ ID NO: 489491 - RNA, 20 nt, Chlamydophila pneumoniae CWL029
caguugcgcgcccucuucua

SEQ ID NO: 489492 - RNA, 15 nt, Chlamydophila pneumoniae CWL029
caguugcaauaccaa

SEQ ID NO: 489493 - RNA, 16 nt, Chlamydophila pneumoniae CWL029
caguaauuccaaaaua

SEQ ID NO: 489494 - RNA, 20 nt, Chlamydophila pneumoniae CWL029
caggcaucacuaaucucagg

SEQ ID NO: 489495 - RNA, 17 nt, Chlamydophila pneumoniae CWL029
cacugacuuuaugaucu

SEQ ID NO: 489496 - RNA, 18 nt, Chlamydophila pneumoniae CWL029
cagaaauuacugugguau

SEQ ID NO: 489497 - RNA, 20 nt, Chlamydophila pneumoniae CWL029
cagaaauuuuuacaaucucg

SEQ ID NO: 489498 - RNA, 11 nt, Chlamydophila pneumoniae CWL029
caccucuucuc

SEQ ID NO: 489499 - RNA, 19 nt, Chlamydophila pneumoniae CWL029
cagaaguuccuucaggauu

SEQ ID NO: 489500 - RNA, 20 nt, Chlamydophila pneumoniae CWL029
cagauuagaaaagauaaaac

SEQ ID NO: 489501 - RNA, 21 nt, Chlamydophila pneumoniae CWL029
cagcauuuucucugagcagcu

SEQ ID NO: 489502 - RNA, 16 nt, Chlamydophila pneumoniae CWL029
cagcauucacuaaaua

SEQ ID NO: 489503 - RNA, 23 nt, Chlamydophila pneumoniae CWL029
cgaauucucagaaagccuuugcu

SEQ ID NO: 489504 - RNA, 16 nt, Chlamydophila pneumoniae CWL029
cgaaaugucgcuacca

SEQ ID NO: 489505 - RNA, 19 nt, Chlamydophila pneumoniae CWL029
ccucucaucaaagcaaaga

SEQ ID NO: 489506 - RNA, 20 nt, Chlamydophila pneumoniae CWL029
ccucugcauauaaagacucu

SEQ ID NO: 489507 - RNA, 12 nt, Chlamydophila pneumoniae CWL029
ccuccaauaauc

SEQ ID NO: 489508 - RNA, 17 nt, Chlamydophila pneumoniae CWL029
ccuccaacaaacaauuc

SEQ ID NO: 489509 - RNA, 13 nt, Chlamydophila pneumoniae CWL029
ccuacuucugcag

SEQ ID NO: 489510 - RNA, 20 nt, Chlamydophila pneumoniae CWL029
ccuaccucugggaagacucu

SEQ ID NO: 489511 - RNA, 17 nt, Chlamydophila pneumoniae CWL029
ccgucaagaacaagagc

SEQ ID NO: 489512 - RNA, 13 nt, Chlamydophila pneumoniae CWL029
cggcaagaaucgc

SEQ ID NO: 489513 - RNA, 21 nt, Chlamydophila pneumoniae CWL029
gcaguaacugcaaagagaauu

SEQ ID NO: 489514 - RNA, 21 nt, Chlamydophila pneumoniae CWL029
gcagccugcgacuacaagaua

SEQ ID NO: 489515 - RNA, 15 nt, Chlamydophila pneumoniae CWL029
gcaauaucuauagaa

SEQ ID NO: 489516 - RNA, 15 nt, Chlamydophila pneumoniae CWL029
gcacaaacuaacaua

SEQ ID NO: 489517 - RNA, 16 nt, Chlamydophila pneumoniae CWL029
gcacauucaagauucc

SEQ ID NO: 489518 - RNA, 18 nt, Chlamydophila pneumoniae CWL029
gcacggauauucuuuagg

SEQ ID NO: 489519 - RNA, 21 nt, Chlamydophila pneumoniae CWL029
gauugauaaauuugcuuccaa

SEQ ID NO: 489520 - RNA, 15 nt, Chlamydophila pneumoniae CWL029
gauugcuaagauugc

SEQ ID NO: 489521 - RNA, 23 nt, Chlamydophila pneumoniae CWL029
gauugcuuugcuggagacaacua

SEQ ID NO: 489522 - RNA, 19 nt, Chlamydophila pneumoniae CWL029
gauguauaaaguuuguaaa

SEQ ID NO: 489523 - RNA, 15 nt, Chlamydophila pneumoniae CWL029
gauguugcccuacaa

SEQ ID NO: 489524 - RNA, 14 nt, Chlamydophila pneumoniae CWL029
gaugccaagaaaua

SEQ ID NO: 489525 - RNA, 16 nt, Chlamydophila pneumoniae CWL029
gaugcggucagaaaca

SEQ ID NO: 489526 - RNA, 13 nt, Chlamydophila pneumoniae CWL029
gaugcuucuuuca

SEQ ID NO: 489527 - RNA, 16 nt, Chlamydophila pneumoniae CWL029
gaucuucucauccaga

SEQ ID NO: 489528 - RNA, 16 nt, Chlamydophila pneumoniae CWL029
gauccugaaaguacag

SEQ ID NO: 489529 - RNA, 22 nt, Chlamydophila pneumoniae CWL029
gauaagaagcucguacuguucc

SEQ ID NO: 489530 - RNA, 22 nt, Chlamydophila pneumoniae CWL029
gagucgaaacacucaugaaagu

SEQ ID NO: 489531 - RNA, 14 nt, Chlamydophila pneumoniae CWL029
gaucacaagaaaga

SEQ ID NO: 489532 - RNA, 16 nt, Chlamydophila pneumoniae CWL029
gauaucguagacaaca

SEQ ID NO: 489533 - RNA, 23 nt, Chlamydophila pneumoniae CWL029
gauagcucagcucuaauucuucu

SEQ ID NO: 489534 - RNA, 17 nt, Chlamydophila pneumoniae CWL029
gauacguuuuucccuuu

SEQ ID NO: 489535 - RNA, 15 nt, Chlamydophila pneumoniae CWL029
gagucaggaagaugc

SEQ ID NO: 489536 - RNA, 23 nt, Chlamydophila pneumoniae CWL029
gaguagccccagcaacccgaauu

SEQ ID NO: 489537 - RNA, 16 nt, Chlamydophila pneumoniae CWL029
gaggauugacaaucgc

SEQ ID NO: 489538 - RNA, 18 nt, Chlamydophila pneumoniae CWL029
gagcgguucuuucuagaa

SEQ ID NO: 489539 - RNA, 13 nt, Chlamydophila pneumoniae CWL029
gagcucuugagaa

SEQ ID NO: 489540 - RNA, 20 nt, Chlamydophila pneumoniae CWL029
gagccgucuacuuuugugaa

SEQ ID NO: 489541 - RNA, 23 nt, Chlamydophila pneumoniae CWL029
gacgaucuugagccacuuuuaau

SEQ ID NO: 489542 - RNA, 16 nt, Chlamydophila pneumoniae CWL029
gacauugcaauacauc

SEQ ID NO: 489543 - RNA, 12 nt, Chlamydophila pneumoniae CWL029
gacaaacucuau

SEQ ID NO: 489544 - RNA, 17 nt, Chlamydophila pneumoniae CWL029
gacaaauaaguccuguu

SEQ ID NO: 489545 - RNA, 12 nt, Chlamydophila pneumoniae CWL029
gaauuaaaaguu

SEQ ID NO: 489546 - RNA, 22 nt, Chlamydophila pneumoniae CWL029
gaauauccguauggauuucucc

SEQ ID NO: 489547 - RNA, 15 nt, Chlamydophila pneumoniae CWL029
gaauagcucuuuuca

SEQ ID NO: 489548 - RNA, 17 nt, Chlamydophila pneumoniae CWL029
gaaguccuaucaaagca

SEQ ID NO: 489549 - RNA, 21 nt, Chlamydophila pneumoniae CWL029
gaaguacaagugaagacaagu

SEQ ID NO: 489550 - RNA, 18 nt, Chlamydophila pneumoniae CWL029
gaagguccaugucuaaag

SEQ ID NO: 489551 - RNA, 21 nt, Chlamydophila pneumoniae CWL029
gaagcucuaucuuugguaugc

SEQ ID NO: 489552 - RNA, 17 nt, Chlamydophila pneumoniae CWL029
gaagcaacuaaacucuc

SEQ ID NO: 489553 - RNA, 17 nt, Chlamydophila pneumoniae CWL029
gaacgugcaucucuuca

SEQ ID NO: 489554 - RNA, 13 nt, Chlamydophila pneumoniae CWL029
gaaacgauuucuu

SEQ ID NO: 489555 - RNA, 14 nt, Chlamydophila pneumoniae CWL029
gaaaaucaacucuc

SEQ ID NO: 489556 - RNA, 15 nt, Chlamydophila pneumoniae CWL029
gaaacagugguaugc

SEQ ID NO: 489557 - RNA, 18 nt, Chlamydophila pneumoniae CWL029
gaaaaauaucggaagaga

SEQ ID NO: 489558 - RNA, 21 nt, Chlamydophila pneumoniae CWL029
gaaaaagccuaugggaggaau

SEQ ID NO: 489559 - RNA, 14 nt, Chlamydophila pneumoniae CWL029
cuuugggauaaaaa

SEQ ID NO: 489560 - RNA, 14 nt, Chlamydophila pneumoniae CWL029
cuuuuuuuuuucuu

SEQ ID NO: 489561 - RNA, 15 nt, Chlamydophila pneumoniae CWL029
gaaaaaaaaucugcu

SEQ ID NO: 489562 - RNA, 20 nt, Chlamydophila pneumoniae CWL029
cuuugaagagcauuuaaaac

SEQ ID NO: 489563 - RNA, 20 nt, Chlamydophila pneumoniae CWL029
cuuucauaagauagagcgac

SEQ ID NO: 489564 - RNA, 14 nt, Chlamydophila pneumoniae CWL029
cuuucagcucaagu

SEQ ID NO: 489565 - RNA, 13 nt, Chlamydophila pneumoniae CWL029
cuuuccuaaaaua

SEQ ID NO: 489566 - RNA, 14 nt, Chlamydophila pneumoniae CWL029
cuuguagaacuucu

SEQ ID NO: 489567 - RNA, 18 nt, Chlamydophila pneumoniae CWL029
cuuggauuucuucuucua

SEQ ID NO: 489568 - RNA, 16 nt, Chlamydophila pneumoniae CWL029
cuugaaguuuuuucuc

SEQ ID NO: 489569 - RNA, 23 nt, Chlamydophila pneumoniae CWL029
cuugauguacaguaaaguaugca

SEQ ID NO: 489570 - RNA, 16 nt, Chlamydophila pneumoniae CWL029
cuugcaaagauaacca

SEQ ID NO: 489571 - RNA, 18 nt, Chlamydophila pneumoniae CWL029
cuugcaaucuuugaagcu

SEQ ID NO: 489572 - RNA, 22 nt, Chlamydophila pneumoniae CWL029
cuucuggauacguuuuucccuu

SEQ ID NO: 489573 - RNA, 15 nt, Chlamydophila pneumoniae CWL029
cuucucuaagaaauu

SEQ ID NO: 489574 - RNA, 15 nt, Chlamydophila pneumoniae CWL029
cuucugacaauaaca

SEQ ID NO: 489575 - RNA, 23 nt, Chlamydophila pneumoniae CWL029
cuucuuuuaaaaacucuuucaua

SEQ ID NO: 489576 - RNA, 23 nt, Chlamydophila pneumoniae CWL029
cuucuuuuauauuaagaauggau

SEQ ID NO: 489577 - RNA, 23 nt, Chlamydophila pneumoniae CWL029
cuucgcccauuaacuaagauaug

SEQ ID NO: 489578 - RNA, 17 nt, Chlamydophila pneumoniae CWL029
cuucacaaucuaaauaa

SEQ ID NO: 489579 - RNA, 18 nt, Chlamydophila pneumoniae CWL029
cuuaagaguuuuacauca

SEQ ID NO: 489580 - RNA, 21 nt, Chlamydophila pneumoniae CWL029
cuuaauuaaaaacugauagcg

SEQ ID NO: 489581 - RNA, 20 nt, Chlamydophila pneumoniae CWL029
cuucaaugauguguugauuu

SEQ ID NO: 489582 - RNA, 22 nt, Chlamydophila pneumoniae CWL029
cuuacggccccuggaauuucuc

SEQ ID NO: 489583 - RNA, 23 nt, Chlamydophila pneumoniae CWL029
cuuauccgucagccuuagcagca

SEQ ID NO: 489584 - RNA, 23 nt, Chlamydophila pneumoniae CWL029
cugucuauaagauagcucuugcg

SEQ ID NO: 489585 - RNA, 21 nt, Chlamydophila pneumoniae CWL029
cugucacuagagaaaaagccc

SEQ ID NO: 489586 - RNA, 15 nt, Chlamydophila pneumoniae CWL029
cugucagaacaagaa

SEQ ID NO: 489587 - RNA, 20 nt, Chlamydophila pneumoniae CWL029
cuggcaaucuaaaaucacac

SEQ ID NO: 489588 - RNA, 22 nt, Chlamydophila pneumoniae CWL029
cugcucuauagcauuauucccu

SEQ ID NO: 489589 - RNA, 16 nt, Chlamydophila pneumoniae CWL029
cugaugccuuuuucuu

SEQ ID NO: 489590 - RNA, 22 nt, Chlamydophila pneumoniae CWL029
cugacgugcauugaauccuucu

SEQ ID NO: 489591 - RNA, 12 nt, Chlamydophila pneumoniae CWL029
cugagagaagca

SEQ ID NO: 489592 - RNA, 13 nt, Chlamydophila pneumoniae CWL029
cucucucugcagc

SEQ ID NO: 489593 - RNA, 15 nt, Chlamydophila pneumoniae CWL029
cucucccgaccaaga

SEQ ID NO: 489594 - RNA, 18 nt, Chlamydophila pneumoniae CWL029
cucgacacuauguguuuc

SEQ ID NO: 489595 - RNA, 21 nt, Chlamydophila pneumoniae CWL029
cuccguauacugcugcuaagc

SEQ ID NO: 489596 - RNA, 15 nt, Chlamydophila pneumoniae CWL029
cucgggauaaugcuc

SEQ ID NO: 489597 - RNA, 19 nt, Chlamydophila pneumoniae CWL029
cuccagaaauuuuuacaau

SEQ ID NO: 489598 - RNA, 23 nt, Chlamydophila pneumoniae CWL029
cuauuuuugaggaacgcacgcca

SEQ ID NO: 489599 - RNA, 18 nt, Chlamydophila pneumoniae CWL029
cuaagguuuccaugagaa

SEQ ID NO: 489600 - RNA, 17 nt, Chlamydophila pneumoniae CWL029
cuaaguuuguagcagca

SEQ ID NO: 489601 - RNA, 16 nt, Chlamydophila pneumoniae CWL029
cuaaucauagccauca

SEQ ID NO: 489602 - RNA, 22 nt, Chlamydophila pneumoniae CWL029
cuaagagcccuugaaucauaga

SEQ ID NO: 489603 - RNA, 21 nt, Chlamydophila pneumoniae CWL029
cuaagaguuccaagacaauaa

SEQ ID NO: 489604 - RNA, 12 nt, Chlamydophila pneumoniae CWL029
cuaagccaaaua

SEQ ID NO: 489605 - RNA, 16 nt, Chlamydophila pneumoniae CWL029
cuaagauaucuccagg

SEQ ID NO: 489606 - RNA, 16 nt, Chlamydophila pneumoniae CWL029
cuaaucuucuuaaugg

SEQ ID NO: 489607 - RNA, 19 nt, Chlamydophila pneumoniae CWL029
cuacaaucgccuuacaauu

SEQ ID NO: 489608 - RNA, 21 nt, Chlamydophila pneumoniae CWL029
cuaccaauaaccgaaacuucu

SEQ ID NO: 489609 - RNA, 14 nt, Chlamydophila pneumoniae CWL029
cuaucuaucuauag

SEQ ID NO: 489610 - RNA, 11 nt, Chlamydophila pneumoniae CWL029
cuaucuccaga

SEQ ID NO: 489611 - RNA, 20 nt, Chlamydophila pneumoniae CWL029
cuaucuccagaaauuuuuac

SEQ ID NO: 489612 - RNA, 18 nt, Chlamydophila pneumoniae CWL029
cuagugcugcuauacaac

SEQ ID NO: 489613 - RNA, 14 nt, Chlamydophila pneumoniae CWL029
cuagcucaaaucuc

SEQ ID NO: 489614 - RNA, 16 nt, Chlamydophila pneumoniae CWL029
cuaggagaaaucacac

SEQ ID NO: 489615 - RNA, 13 nt, Chlamydophila pneumoniae CWL029
cuaaacucuccaa

SEQ ID NO: 489616 - RNA, 17 nt, Chlamydophila pneumoniae CWL029
cuaaauucuuaacaaua

SEQ ID NO: 489617 - RNA, 20 nt, Chlamydophila pneumoniae CWL029
cuaacaacuucugacaauaa

SEQ ID NO: 489618 - RNA, 21 nt, Chlamydophila pneumoniae CWL029
cuaaaauggugaagaauaaua

SEQ ID NO: 489619 - RNA, 23 nt, Chlamydophila pneumoniae CWL029
cguuuugauucccuccuuccuua

SEQ ID NO: 489620 - RNA, 12 nt, Chlamydophila pneumoniae CWL029
cguuuuucccua

SEQ ID NO: 489621 - RNA, 19 nt, Chlamydophila pneumoniae CWL029
cguugauuggaugauagcu

SEQ ID NO: 489622 - RNA, 14 nt, Chlamydophila pneumoniae CWL029
cgucuauuagauuu

SEQ ID NO: 489623 - RNA, 14 nt, Chlamydophila pneumoniae CWL029
cguauccuugauuu

SEQ ID NO: 489624 - RNA, 20 nt, Chlamydophila pneumoniae CWL029
cuagaaaacgcucuccuaga

SEQ ID NO: 489625 - RNA, 21 nt, Chlamydophila pneumoniae CWL029
cuagaagacauucauuuuuua

SEQ ID NO: 489626 - RNA, 18 nt, Chlamydophila pneumoniae CWL029
cuagaggagcgaugacuu

SEQ ID NO: 489627 - RNA, 17 nt, Chlamydophila pneumoniae CWL029
cuaggguuucuacagga

SEQ ID NO: 489628 - RNA, 19 nt, Chlamydophila pneumoniae CWL029
cuaccuacguagcauuaaa

SEQ ID NO: 489629 - RNA, 15 nt, Chlamydophila pneumoniae CWL029
cuaauuuuaaauuuu

SEQ ID NO: 489630 - RNA, 14 nt, Chlamydophila pneumoniae CWL029
cuacaggagaagcg

SEQ ID NO: 489631 - RNA, 14 nt, Chlamydophila pneumoniae CWL029
cuacaugcucaaga

SEQ ID NO: 489632 - RNA, 23 nt, Chlamydophila pneumoniae CWL029
cuaaguaacaguccucucccuua

SEQ ID NO: 489633 - RNA, 17 nt, Chlamydophila pneumoniae CWL029
cuaagucguuaacauca

SEQ ID NO: 489634 - RNA, 17 nt, Chlamydophila pneumoniae CWL029
cuaauucucgagcagcu

SEQ ID NO: 489635 - RNA, 16 nt, Chlamydophila pneumoniae CWL029
cuaauucuucuacaga

SEQ ID NO: 489636 - RNA, 15 nt, Chlamydophila pneumoniae CWL029
cuaaaguaacgauaa

SEQ ID NO: 489637 - RNA, 23 nt, Chlamydophila pneumoniae CWL029
cuaaaaaggucagcccugccuca

SEQ ID NO: 489638 - RNA, 14 nt, Chlamydophila pneumoniae CWL029
cguuucaaauagga

SEQ ID NO: 489639 - RNA, 22 nt, Chlamydophila pneumoniae CWL029
cguuccuuucucagucacaaua

SEQ ID NO: 489640 - RNA, 19 nt, Chlamydophila pneumoniae CWL029
cucuccagcuugaucagga

SEQ ID NO: 489641 - RNA, 19 nt, Chlamydophila pneumoniae CWL029
cucugaucccucaaaauca

SEQ ID NO: 489642 - RNA, 20 nt, Chlamydophila pneumoniae CWL029
cucuucuauguguucucgaa

SEQ ID NO: 489643 - RNA, 12 nt, Chlamydophila pneumoniae CWL029
cucuucugcagc

SEQ ID NO: 489644 - RNA, 13 nt, Chlamydophila pneumoniae CWL029
cucuuccuucucc

SEQ ID NO: 489645 - RNA, 20 nt, Chlamydophila pneumoniae CWL029
cuccugacucuuauugcaga

SEQ ID NO: 489646 - RNA, 19 nt, Chlamydophila pneumoniae CWL029
cuccucgucuaaagaagau

SEQ ID NO: 489647 - RNA, 23 nt, Chlamydophila pneumoniae CWL029
cuccuuuuuaggacgcuauccua

SEQ ID NO: 489648 - RNA, 13 nt, Chlamydophila pneumoniae CWL029
cuccagcauaagg

SEQ ID NO: 489649 - RNA, 12 nt, Chlamydophila pneumoniae CWL029
cuccgaagacua

SEQ ID NO: 489650 - RNA, 22 nt, Chlamydophila pneumoniae CWL029
cucccuagguuuuaucuuuaga

SEQ ID NO: 489651 - RNA, 22 nt, Chlamydophila pneumoniae CWL029
cgucccccccggguuguccaga

SEQ ID NO: 489652 - RNA, 17 nt, Chlamydophila pneumoniae CWL029
aacgguaaauaucuuaa

SEQ ID NO: 489653 - RNA, 22 nt, Chlamydophila pneumoniae CWL029
gaccagguguagguuccugcuu

SEQ ID NO: 489654 - RNA, 14 nt, Chlamydophila pneumoniae CWL029
aacgcgauuuucaa

SEQ ID NO: 489655 - RNA, 22 nt, Chlamydophila pneumoniae CWL029
aacgccaacacgcacaaacuaa

SEQ ID NO: 489656 - RNA, 14 nt, Chlamydophila pneumoniae CWL029
aacgcagcuuuccu

SEQ ID NO: 489657 - RNA, 12 nt, Chlamydophila pneumoniae CWL029
aacgaauuucaa

SEQ ID NO: 489658 - RNA, 15 nt, Chlamydophila pneumoniae CWL029
gaaugaagagaguuc

SEQ ID NO: 489659 - RNA, 21 nt, Chlamydophila pneumoniae CWL029
gaaugauauuacagauuucuu

SEQ ID NO: 489660 - RNA, 17 nt, Chlamydophila pneumoniae CWL029
gaauacuguucgauaag

SEQ ID NO: 489661 - RNA, 13 nt, Chlamydophila pneumoniae CWL029
gaauaccagaagc

SEQ ID NO: 489662 - RNA, 13 nt, Chlamydophila pneumoniae CWL029
gaagucguuuaga

SEQ ID NO: 489663 - RNA, 21 nt, Chlamydophila pneumoniae CWL029
gaagcuuccaucguuagauuu

SEQ ID NO: 489664 - RNA, 18 nt, Chlamydophila pneumoniae CWL029
gaagcuugcugauuucuu

SEQ ID NO: 489665 - RNA, 20 nt, Chlamydophila pneumoniae CWL029
gaagagaguauagucugguu

SEQ ID NO: 489666 - RNA, 17 nt, Chlamydophila pneumoniae CWL029
gaagagguguccauaau

SEQ ID NO: 489667 - RNA, 22 nt, Chlamydophila pneumoniae CWL029
gaagaugagcgagguauucucu

SEQ ID NO: 489668 - RNA, 22 nt, Chlamydophila pneumoniae CWL029
gaagcacaccaaguacaguauc

SEQ ID NO: 489669 - RNA, 17 nt, Chlamydophila pneumoniae CWL029
gaagcagaaacuuuaaa

SEQ ID NO: 489670 - RNA, 14 nt, Chlamydophila pneumoniae CWL029
gaagauucuuuaau

SEQ ID NO: 489671 - RNA, 20 nt, Chlamydophila pneumoniae CWL029
gaagcaacuaaacucuccaa

SEQ ID NO: 489672 - RNA, 18 nt, Chlamydophila pneumoniae CWL029
gaacaugccaaauaucuc

SEQ ID NO: 489673 - RNA, 13 nt, Chlamydophila pneumoniae CWL029
gaacaggaggugu

SEQ ID NO: 489674 - RNA, 17 nt, Chlamydophila pneumoniae CWL029
gaaaguaaaauuucugu

SEQ ID NO: 489675 - RNA, 14 nt, Chlamydophila pneumoniae CWL029
gaaaggaccuccuc

SEQ ID NO: 489676 - RNA, 17 nt, Chlamydophila pneumoniae CWL029
cuugugcuaaagcagga

SEQ ID NO: 489677 - RNA, 13 nt, Chlamydophila pneumoniae CWL029
cuuguuaugaaaa

SEQ ID NO: 489678 - RNA, 17 nt, Chlamydophila pneumoniae CWL029
cuugcaaaacagcauca

SEQ ID NO: 489679 - RNA, 20 nt, Chlamydophila pneumoniae CWL029
cuugaggaggauugacaauc

SEQ ID NO: 489680 - RNA, 19 nt, Chlamydophila pneumoniae CWL029
cuugcgauacaauaaacaa

SEQ ID NO: 489681 - RNA, 15 nt, Chlamydophila pneumoniae CWL029
cuucuuucaaagccu

SEQ ID NO: 489682 - RNA, 23 nt, Chlamydophila pneumoniae CWL029
cuucuuucuaggccgggauuuua

SEQ ID NO: 489683 - RNA, 15 nt, Chlamydophila pneumoniae CWL029
cuucuuuggaugcua

SEQ ID NO: 489684 - RNA, 22 nt, Chlamydophila pneumoniae CWL029
cuucugaacuguucauaaucca

SEQ ID NO: 489685 - RNA, 22 nt, Chlamydophila pneumoniae CWL029
cuucuaugaauugacugcuaga

SEQ ID NO: 489686 - RNA, 16 nt, Chlamydophila pneumoniae CWL029
cuucucaaagacaaug

SEQ ID NO: 489687 - RNA, 14 nt, Chlamydophila pneumoniae CWL029
cuuccauaacaguu

SEQ ID NO: 489688 - RNA, 21 nt, Chlamydophila pneumoniae CWL029
cuuccgucugaauguaacucc

SEQ ID NO: 489689 - RNA, 21 nt, Chlamydophila pneumoniae CWL029
cuuacaauuuaaaucugcaag

SEQ ID NO: 489690 - RNA, 21 nt, Chlamydophila pneumoniae CWL029
cuuaauuacucgcucugcacg

SEQ ID NO: 489691 - RNA, 17 nt, Chlamydophila pneumoniae CWL029
cuguugcauuagauacg

SEQ ID NO: 489692 - RNA, 15 nt, Chlamydophila pneumoniae CWL029
cuuacgaaucuuagc

SEQ ID NO: 489693 - RNA, 16 nt, Chlamydophila pneumoniae CWL029
cuucacaaucuaaaua

SEQ ID NO: 489694 - RNA, 16 nt, Chlamydophila pneumoniae CWL029
cuguuccaagagucuu

SEQ ID NO: 489695 - RNA, 12 nt, Chlamydophila pneumoniae CWL029
cugcgugacgug

SEQ ID NO: 489696 - RNA, 20 nt, Chlamydophila pneumoniae CWL029
cugccuuaugcucauuaaua

SEQ ID NO: 489697 - RNA, 20 nt, Chlamydophila pneumoniae CWL029
gagucucuugcuuuuguaga

SEQ ID NO: 489698 - RNA, 18 nt, Chlamydophila pneumoniae CWL029
gagucuuuuucagaaagc

SEQ ID NO: 489699 - RNA, 23 nt, Chlamydophila pneumoniae CWL029
gagucccuugucaacaaaagcua

SEQ ID NO: 489700 - RNA, 14 nt, Chlamydophila pneumoniae CWL029
gaguguauuguaaa

SEQ ID NO: 489701 - RNA, 21 nt, Chlamydophila pneumoniae CWL029
gagcuuuuugcuuuucccuuu

SEQ ID NO: 489702 - RNA, 21 nt, Chlamydophila pneumoniae CWL029
gauagaccccccauuccaaag

SEQ ID NO: 489703 - RNA, 12 nt, Chlamydophila pneumoniae CWL029
gauaucucuacc

SEQ ID NO: 489704 - RNA, 16 nt, Chlamydophila pneumoniae CWL029
gagauucuugaggacc

SEQ ID NO: 489705 - RNA, 14 nt, Chlamydophila pneumoniae CWL029
gagauugauuucuu

SEQ ID NO: 489706 - RNA, 22 nt, Chlamydophila pneumoniae CWL029
gagcacuuuuaauauuugagaa

SEQ ID NO: 489707 - RNA, 21 nt, Chlamydophila pneumoniae CWL029
gagagagcuggacuucugguu

SEQ ID NO: 489708 - RNA, 15 nt, Chlamydophila pneumoniae CWL029
gagagcgaacgcuga

SEQ ID NO: 489709 - RNA, 18 nt, Chlamydophila pneumoniae CWL029
gagagcuugguuuucucc

SEQ ID NO: 489710 - RNA, 16 nt, Chlamydophila pneumoniae CWL029
gagauccaaagccuga

SEQ ID NO: 489711 - RNA, 18 nt, Chlamydophila pneumoniae CWL029
gagaauccuuuuuaggaa

SEQ ID NO: 489712 - RNA, 13 nt, Chlamydophila pneumoniae CWL029
gagaauaucaucu

SEQ ID NO: 489713 - RNA, 13 nt, Chlamydophila pneumoniae CWL029
gagacgcuuuuau

SEQ ID NO: 489714 - RNA, 18 nt, Chlamydophila pneumoniae CWL029
gagaccuacuuauuguuc

SEQ ID NO: 489715 - RNA, 17 nt, Chlamydophila pneumoniae CWL029
gagcaugagagucgaaa

SEQ ID NO: 489716 - RNA, 14 nt, Chlamydophila pneumoniae CWL029
aacuagaccaauaa

SEQ ID NO: 489717 - RNA, 17 nt, Chlamydophila pneumoniae CWL029
gacucuaguuuuucuuu

SEQ ID NO: 489718 - RNA, 21 nt, Chlamydophila pneumoniae CWL029
gacucgccgaaaguaucuuca

SEQ ID NO: 489719 - RNA, 21 nt, Chlamydophila pneumoniae CWL029
gacuaucgcaaauuuccauag

SEQ ID NO: 489720 - RNA, 13 nt, Chlamydophila pneumoniae CWL029
gcagauccugcuu

SEQ ID NO: 489721 - RNA, 18 nt, Chlamydophila pneumoniae CWL029
gcaagagacaagaaaaua

SEQ ID NO: 489722 - RNA, 15 nt, Chlamydophila pneumoniae CWL029
gcaacaaccaaaaga

SEQ ID NO: 489723 - RNA, 15 nt, Chlamydophila pneumoniae CWL029
gauucucauaaaggc

SEQ ID NO: 489724 - RNA, 18 nt, Chlamydophila pneumoniae CWL029
gauuccugucauuccuaa

SEQ ID NO: 489725 - RNA, 15 nt, Chlamydophila pneumoniae CWL029
aagagucuuccuaga

SEQ ID NO: 489726 - RNA, 19 nt, Chlamydophila pneumoniae CWL029
aagagucuuccuagaccua

SEQ ID NO: 489727 - RNA, 17 nt, Chlamydophila pneumoniae CWL029
aagaggaagaugauauu

SEQ ID NO: 489728 - RNA, 13 nt, Chlamydophila pneumoniae CWL029
aagagagcaagau

SEQ ID NO: 489729 - RNA, 14 nt, Chlamydophila pneumoniae CWL029
aagacucaucuuug

SEQ ID NO: 489730 - RNA, 18 nt, Chlamydophila pneumoniae CWL029
aagagacguuaucuaaga

SEQ ID NO: 489731 - RNA, 24 nt, Chlamydophila pneumoniae CWL029
aagcugagguagcaucucucucca

SEQ ID NO: 489732 - RNA, 20 nt, Chlamydophila pneumoniae CWL029
aagcugcaaucucaaaauca

SEQ ID NO: 489733 - RNA, 20 nt, Chlamydophila pneumoniae CWL029
aagcguuucgauaauuuuca

SEQ ID NO: 489734 - RNA, 14 nt, Chlamydophila pneumoniae CWL029
aagcugcuuuuucu

SEQ ID NO: 489735 - RNA, 23 nt, Chlamydophila pneumoniae CWL029
aagccuaugggaggaauuccucu

SEQ ID NO: 489736 - RNA, 17 nt, Chlamydophila pneumoniae CWL029
aagccucgaaauuuuca

SEQ ID NO: 489737 - RNA, 19 nt, Chlamydophila pneumoniae CWL029
gcucuucuaugguaaucac

SEQ ID NO: 489738 - RNA, 19 nt, Chlamydophila pneumoniae CWL029
gcucgugcgacugcucuuu

SEQ ID NO: 489739 - RNA, 13 nt, Chlamydophila pneumoniae CWL029
gcuauuccauaaa

SEQ ID NO: 489740 - RNA, 17 nt, Chlamydophila pneumoniae CWL029
gcuauuccauaaaaaug

SEQ ID NO: 489741 - RNA, 23 nt, Chlamydophila pneumoniae CWL029
gcuacuguccauccaaauagagu

SEQ ID NO: 489742 - RNA, 15 nt, Chlamydophila pneumoniae CWL029
gcuaauaagauccaa

SEQ ID NO: 489743 - RNA, 14 nt, Chlamydophila pneumoniae CWL029
aagcuuuuuucucu

SEQ ID NO: 489744 - RNA, 14 nt, Chlamydophila pneumoniae CWL029
aagcuuauuucugu

SEQ ID NO: 489745 - RNA, 16 nt, Chlamydophila pneumoniae CWL029
aagcugugcauuuucu

SEQ ID NO: 489746 - RNA, 15 nt, Chlamydophila pneumoniae CWL029
aagccauuccauauc

SEQ ID NO: 489747 - RNA, 16 nt, Chlamydophila pneumoniae CWL029
guagcaucucucucca

SEQ ID NO: 489748 - RNA, 12 nt, Chlamydophila pneumoniae CWL029
guacgucuuuca

SEQ ID NO: 489749 - RNA, 21 nt, Chlamydophila pneumoniae CWL029
guacgucuuucaccaacuccu

SEQ ID NO: 489750 - RNA, 13 nt, Chlamydophila pneumoniae CWL029
aagucgagaaaca

SEQ ID NO: 489751 - RNA, 21 nt, Chlamydophila pneumoniae CWL029
aagucacucaaacccucucca

SEQ ID NO: 489752 - RNA, 20 nt, Chlamydophila pneumoniae CWL029
guagugauacuuuagaaucc

SEQ ID NO: 489753 - RNA, 14 nt, Chlamydophila pneumoniae CWL029
guaccuucucguca

SEQ ID NO: 489754 - RNA, 20 nt, Chlamydophila pneumoniae CWL029
guaccgaccgaaucucucca

SEQ ID NO: 489755 - RNA, 16 nt, Chlamydophila pneumoniae CWL029
guaacuaguaacuuaa

SEQ ID NO: 489756 - RNA, 14 nt, Chlamydophila pneumoniae CWL029
guaugguccauaau

SEQ ID NO: 489757 - RNA, 22 nt, Chlamydophila pneumoniae CWL029
guaugguccauaauuucuuuca

SEQ ID NO: 489758 - RNA, 14 nt, Chlamydophila pneumoniae CWL029
guaucuagggacuu

SEQ ID NO: 489759 - RNA, 16 nt, Chlamydophila pneumoniae CWL029
gucauauuuaaaaggc

SEQ ID NO: 489760 - RNA, 17 nt, Chlamydophila pneumoniae CWL029
gucgaagauucaaagaa

SEQ ID NO: 489761 - RNA, 16 nt, Chlamydophila pneumoniae CWL029
aaguaccaagaaaaua

SEQ ID NO: 489762 - RNA, 15 nt, Chlamydophila pneumoniae CWL029
aagggaucuccuuca

SEQ ID NO: 489763 - RNA, 16 nt, Chlamydophila pneumoniae CWL029
aagguauuucucucca

SEQ ID NO: 489764 - RNA, 15 nt, Chlamydophila pneumoniae CWL029
ggagguccuuggcau

SEQ ID NO: 489765 - RNA, 20 nt, Chlamydophila pneumoniae CWL029
ggauccaucggcauuucucc

SEQ ID NO: 489766 - RNA, 20 nt, Chlamydophila pneumoniae CWL029
aaggaucuuauauaaaacuu

SEQ ID NO: 489767 - RNA, 22 nt, Chlamydophila pneumoniae CWL029
aaggaucccaucaucgagcuga

SEQ ID NO: 489768 - RNA, 14 nt, Chlamydophila pneumoniae CWL029
aaggagauuccuaa

SEQ ID NO: 489769 - RNA, 18 nt, Chlamydophila pneumoniae CWL029
ggagacucagagaaaauc

SEQ ID NO: 489770 - RNA, 14 nt, Chlamydophila pneumoniae CWL029
ggacuuuauucucu

SEQ ID NO: 489771 - RNA, 23 nt, Chlamydophila pneumoniae CWL029
ggaagcuguacuugauauuguuc

SEQ ID NO: 489772 - RNA, 15 nt, Chlamydophila pneumoniae CWL029
ggaagcuuuuacgag

SEQ ID NO: 489773 - RNA, 20 nt, Chlamydophila pneumoniae CWL029
ggaauaaucaaccaaaaugc

SEQ ID NO: 489774 - RNA, 12 nt, Chlamydophila pneumoniae CWL029
ggaaucuaagaa

SEQ ID NO: 489775 - RNA, 18 nt, Chlamydophila pneumoniae CWL029
ggaaucauaaccaaaaga

SEQ ID NO: 489776 - RNA, 13 nt, Chlamydophila pneumoniae CWL029
aacaguaauuauu

SEQ ID NO: 489777 - RNA, 19 nt, Chlamydophila pneumoniae CWL029
cggagacucagagaaaauc

SEQ ID NO: 489778 - RNA, 17 nt, Chlamydophila pneumoniae CWL029
cggacgcuaauccuccu

SEQ ID NO: 489779 - RNA, 18 nt, Chlamydophila pneumoniae CWL029
aacagagcgucuauuaga

SEQ ID NO: 489780 - RNA, 19 nt, Chlamydophila pneumoniae CWL029
cgauagcauaacgacaugc

SEQ ID NO: 489781 - RNA, 23 nt, Chlamydophila pneumoniae CWL029
cgaggagcgauagcucagcucua

SEQ ID NO: 489782 - RNA, 18 nt, Chlamydophila pneumoniae CWL029
aacaaucuuucuucuaga

SEQ ID NO: 489783 - RNA, 20 nt, Chlamydophila pneumoniae CWL029
cgacaugcaggccaacucuc

SEQ ID NO: 489784 - RNA, 15 nt, Chlamydophila pneumoniae CWL029
cgaaauucauuaaaa

SEQ ID NO: 489785 - RNA, 19 nt, Chlamydophila pneumoniae CWL029
cgaaaaacgguaaauaucu

SEQ ID NO: 489786 - RNA, 13 nt, Chlamydophila pneumoniae CWL029
ccuucuuuccaua

SEQ ID NO: 489787 - RNA, 11 nt, Chlamydophila pneumoniae CWL029
ccuucuugcaa

SEQ ID NO: 489788 - RNA, 19 nt, Chlamydophila pneumoniae CWL029
ccugugauaguagaacugc

SEQ ID NO: 489789 - RNA, 16 nt, Chlamydophila pneumoniae CWL029
ccuccgaggagggaaa

SEQ ID NO: 489790 - RNA, 13 nt, Chlamydophila pneumoniae CWL029
ccuauagcaaaga

SEQ ID NO: 489791 - RNA, 13 nt, Chlamydophila pneumoniae CWL029
ccuaaaacaagaa

SEQ ID NO: 489792 - RNA, 13 nt, Chlamydophila pneumoniae CWL029
ccguaacugaggc

SEQ ID NO: 489793 - RNA, 17 nt, Chlamydophila pneumoniae CWL029
aaauuaagaacccgaua

SEQ ID NO: 489794 - RNA, 18 nt, Chlamydophila pneumoniae CWL029
ccgcaaauacagacagau

SEQ ID NO: 489795 - RNA, 14 nt, Chlamydophila pneumoniae CWL029
cccucauaagauuu

SEQ ID NO: 489796 - RNA, 17 nt, Chlamydophila pneumoniae CWL029
ccaugguuauagauacg

SEQ ID NO: 489797 - RNA, 12 nt, Chlamydophila pneumoniae CWL029
ccauaaauguau

SEQ ID NO: 489798 - RNA, 14 nt, Chlamydophila pneumoniae CWL029
aaauauaaauuuau

SEQ ID NO: 489799 - RNA, 16 nt, Chlamydophila pneumoniae CWL029
aaauauaaauuuauaa

SEQ ID NO: 489800 - RNA, 17 nt, Chlamydophila pneumoniae CWL029
aaauauccuaaauauau

SEQ ID NO: 489801 - RNA, 21 nt, Chlamydophila pneumoniae CWL029
aaauaccccaucuaauccugu

SEQ ID NO: 489802 - RNA, 21 nt, Chlamydophila pneumoniae CWL029
aaauacccucggagacucaga

SEQ ID NO: 489803 - RNA, 14 nt, Chlamydophila pneumoniae CWL029
aaauaaccccucca

SEQ ID NO: 489804 - RNA, 21 nt, Chlamydophila pneumoniae CWL029
aaauaaagagcugauccagcu

SEQ ID NO: 489805 - RNA, 14 nt, Chlamydophila pneumoniae CWL029
ccagagauucuuca

SEQ ID NO: 489806 - RNA, 13 nt, Chlamydophila pneumoniae CWL029
cauuugcuauuuu

SEQ ID NO: 489807 - RNA, 17 nt, Chlamydophila pneumoniae CWL029
cauguaguaaauuccuc

SEQ ID NO: 489808 - RNA, 14 nt, Chlamydophila pneumoniae CWL029
cauucuuucgauau

SEQ ID NO: 489809 - RNA, 18 nt, Chlamydophila pneumoniae CWL029
cauugacuugggauucuu

SEQ ID NO: 489810 - RNA, 19 nt, Chlamydophila pneumoniae CWL029
cauuaucaagaaauucuuc

SEQ ID NO: 489811 - RNA, 20 nt, Chlamydophila pneumoniae CWL029
cauuccaagauugaauucau

SEQ ID NO: 489812 - RNA, 15 nt, Chlamydophila pneumoniae CWL029
cauaggggaugauuu

SEQ ID NO: 489813 - RNA, 23 nt, Chlamydophila pneumoniae CWL029
cauaggguaguuaucucccaaga

SEQ ID NO: 489814 - RNA, 20 nt, Chlamydophila pneumoniae CWL029
cauaguuaaauuuccaaaga

SEQ ID NO: 489815 - RNA, 17 nt, Chlamydophila pneumoniae CWL029
cauaacaagucuaucga

SEQ ID NO: 489816 - RNA, 17 nt, Chlamydophila pneumoniae CWL029
cauaaaaauguaauuuu

SEQ ID NO: 489817 - RNA, 19 nt, Chlamydophila pneumoniae CWL029
caucauuuucauagcagcu

SEQ ID NO: 489818 - RNA, 17 nt, Chlamydophila pneumoniae CWL029
caucgacaaguaccuuc

SEQ ID NO: 489819 - RNA, 17 nt, Chlamydophila pneumoniae CWL029
cagugaaauuuugcaac

SEQ ID NO: 489820 - RNA, 15 nt, Chlamydophila pneumoniae CWL029
cagugaauccuucca

SEQ ID NO: 489821 - RNA, 23 nt, Chlamydophila pneumoniae CWL029
caguaauuccaaaauaaaaggag

SEQ ID NO: 489822 - RNA, 21 nt, Chlamydophila pneumoniae CWL029
cagcuauagauuuaagagucu

SEQ ID NO: 489823 - RNA, 23 nt, Chlamydophila pneumoniae CWL029
cagcgugaauaucaucacuaaga

SEQ ID NO: 489824 - RNA, 16 nt, Chlamydophila pneumoniae CWL029
caggagagagaaggcu

SEQ ID NO: 489825 - RNA, 15 nt, Chlamydophila pneumoniae CWL029
aaagcagauccugcu

SEQ ID NO: 489826 - RNA, 14 nt, Chlamydophila pneumoniae CWL029
cagacuuuccucuc

SEQ ID NO: 489827 - RNA, 12 nt, Chlamydophila pneumoniae CWL029
aaagaaauguaa

SEQ ID NO: 489828 - RNA, 20 nt, Chlamydophila pneumoniae CWL029
cagagcgaucgcaaucagca

SEQ ID NO: 489829 - RNA, 15 nt, Chlamydophila pneumoniae CWL029
cagaaagacgaucuu

SEQ ID NO: 489830 - RNA, 23 nt, Chlamydophila pneumoniae CWL029
cagaaguuccuacuucugcagga

SEQ ID NO: 489831 - RNA, 17 nt, Chlamydophila pneumoniae CWL029
cagaaguuccuucagga

SEQ ID NO: 489832 - RNA, 14 nt, Chlamydophila pneumoniae CWL029
cacgucgaacauga

SEQ ID NO: 489833 - RNA, 23 nt, Chlamydophila pneumoniae CWL029
cacguuacgaauguguugcucua

SEQ ID NO: 489834 - RNA, 15 nt, Chlamydophila pneumoniae CWL029
cacuagaauaccguu

SEQ ID NO: 489835 - RNA, 11 nt, Chlamydophila pneumoniae CWL029
cacggauucua

SEQ ID NO: 489836 - RNA, 19 nt, Chlamydophila pneumoniae CWL029
cacgcuuucgucuaaaaua

SEQ ID NO: 489837 - RNA, 16 nt, Chlamydophila pneumoniae CWL029
caauaucuugaauucu

SEQ ID NO: 489838 - RNA, 22 nt, Chlamydophila pneumoniae CWL029
caauaggccagaauguacauag

SEQ ID NO: 489839 - RNA, 19 nt, Chlamydophila pneumoniae CWL029
caaguaaucaugauaaaaa

SEQ ID NO: 489840 - RNA, 14 nt, Chlamydophila pneumoniae CWL029
caacucuccauccu

SEQ ID NO: 489841 - RNA, 16 nt, Chlamydophila pneumoniae CWL029
caagaguucucuuuga

SEQ ID NO: 489842 - RNA, 17 nt, Chlamydophila pneumoniae CWL029
caaaugcagucucagga

SEQ ID NO: 489843 - RNA, 21 nt, Chlamydophila pneumoniae CWL029
caaaugccuguacuaucuuuu

SEQ ID NO: 489844 - RNA, 17 nt, Chlamydophila pneumoniae CWL029
caacaaaagcuauauag

SEQ ID NO: 489845 - RNA, 16 nt, Chlamydophila pneumoniae CWL029
auuuacgaaaacaucu

SEQ ID NO: 489846 - RNA, 17 nt, Chlamydophila pneumoniae CWL029
auuuagaaucuuuucua

SEQ ID NO: 489847 - RNA, 13 nt, Chlamydophila pneumoniae CWL029
caacacgcacaaa

SEQ ID NO: 489848 - RNA, 21 nt, Chlamydophila pneumoniae CWL029
caacacgcacaaacuaacaua

SEQ ID NO: 489849 - RNA, 15 nt, Chlamydophila pneumoniae CWL029
caacccgaauuccuc

SEQ ID NO: 489850 - RNA, 18 nt, Chlamydophila pneumoniae CWL029
caauuuucucaauagugu

SEQ ID NO: 489851 - RNA, 23 nt, Chlamydophila pneumoniae CWL029
cacauacucuucauccugaucuu

SEQ ID NO: 489852 - RNA, 15 nt, Chlamydophila pneumoniae CWL029
auuguauagcuuacu

SEQ ID NO: 489853 - RNA, 20 nt, Chlamydophila pneumoniae CWL029
auugcaauacaucuuaagag

SEQ ID NO: 489854 - RNA, 23 nt, Chlamydophila pneumoniae CWL029
auugcugccaggcuuaaauauua

SEQ ID NO: 489855 - RNA, 18 nt, Chlamydophila pneumoniae CWL029
auucuucugauacaucau

SEQ ID NO: 489856 - RNA, 17 nt, Chlamydophila pneumoniae CWL029
auucuugcauagcggca

SEQ ID NO: 489857 - RNA, 17 nt, Chlamydophila pneumoniae CWL029
auucgcucagaaaaugu

SEQ ID NO: 489858 - RNA, 13 nt, Chlamydophila pneumoniae CWL029
auguucucuccag

SEQ ID NO: 489859 - RNA, 17 nt, Chlamydophila pneumoniae CWL029
auguucccaaauagaaa

SEQ ID NO: 489860 - RNA, 18 nt, Chlamydophila pneumoniae CWL029
auguuaagcguauagaau

SEQ ID NO: 489861 - RNA, 13 nt, Chlamydophila pneumoniae CWL029
augugcugaagac

SEQ ID NO: 489862 - RNA, 20 nt, Chlamydophila pneumoniae CWL029
auuauaaagauaaucuguaa

SEQ ID NO: 489863 - RNA, 14 nt, Chlamydophila pneumoniae CWL029
auuaagaagaagcu

SEQ ID NO: 489864 - RNA, 22 nt, Chlamydophila pneumoniae CWL029
auguccguucgagagguucccu

SEQ ID NO: 489865 - RNA, 22 nt, Chlamydophila pneumoniae CWL029
augucguaccccgcagcaaaaa

SEQ ID NO: 489866 - RNA, 14 nt, Chlamydophila pneumoniae CWL029
augucuaaagauug

SEQ ID NO: 489867 - RNA, 21 nt, Chlamydophila pneumoniae CWL029
auguacaguuuguaaaaagcc

SEQ ID NO: 489868 - RNA, 12 nt, Chlamydophila pneumoniae CWL029
augggaaucuug

SEQ ID NO: 489869 - RNA, 16 nt, Chlamydophila pneumoniae CWL029
aucuuucauucccuuu

SEQ ID NO: 489870 - RNA, 14 nt, Chlamydophila pneumoniae CWL029
aucuuucuucuaga

SEQ ID NO: 489871 - RNA, 15 nt, Chlamydophila pneumoniae CWL029
aucuuuuuauuaaaa

SEQ ID NO: 489872 - RNA, 16 nt, Chlamydophila pneumoniae CWL029
aucuguggcguaagca

SEQ ID NO: 489873 - RNA, 14 nt, Chlamydophila pneumoniae CWL029
aucugcguuucuuu

SEQ ID NO: 489874 - RNA, 17 nt, Chlamydophila pneumoniae CWL029
aucuacgauguuuucuu

SEQ ID NO: 489875 - RNA, 21 nt, Chlamydophila pneumoniae CWL029
aucuauauccacaaucucuuu

SEQ ID NO: 489876 - RNA, 21 nt, Chlamydophila pneumoniae CWL029
aucaaauuccuucucagaaag

SEQ ID NO: 489877 - RNA, 11 nt, Chlamydophila pneumoniae CWL029
aucaaagaauu

SEQ ID NO: 489878 - RNA, 16 nt, Chlamydophila pneumoniae CWL029
aucaagagcucguaau

SEQ ID NO: 489879 - RNA, 21 nt, Chlamydophila pneumoniae CWL029
aucacacuuaaagguaaaacu

SEQ ID NO: 489880 - RNA, 14 nt, Chlamydophila pneumoniae CWL029
aucaauuuuaccac

SEQ ID NO: 489881 - RNA, 22 nt, Chlamydophila pneumoniae CWL029
auaugcuccagaaacgcagcuu

SEQ ID NO: 489882 - RNA, 20 nt, Chlamydophila pneumoniae CWL029
auaucuaauaaaauuggcuu

SEQ ID NO: 489883 - RNA, 12 nt, Chlamydophila pneumoniae CWL029
auauagagaucu

SEQ ID NO: 489884 - RNA, 15 nt, Chlamydophila pneumoniae CWL029
auagguagaggcaau

SEQ ID NO: 489885 - RNA, 20 nt, Chlamydophila pneumoniae CWL029
auaggcauuacacaacucuu

SEQ ID NO: 489886 - RNA, 18 nt, Chlamydophila pneumoniae CWL029
auaguugcaugacuauuu

SEQ ID NO: 489887 - RNA, 21 nt, Chlamydophila pneumoniae CWL029
auaguugcaugacuauuuuca

SEQ ID NO: 489888 - RNA, 20 nt, Chlamydophila pneumoniae CWL029
auaguuucuaucuaaucaau

SEQ ID NO: 489889 - RNA, 22 nt, Chlamydophila pneumoniae CWL029
auaguuuuugcuguuucuucug

SEQ ID NO: 489890 - RNA, 14 nt, Chlamydophila pneumoniae CWL029
auagcuuugaagag

SEQ ID NO: 489891 - RNA, 18 nt, Chlamydophila pneumoniae CWL029
auagccaugguuauagau

SEQ ID NO: 489892 - RNA, 23 nt, Chlamydophila pneumoniae CWL029
auacuuuaggaggggggauucug

SEQ ID NO: 489893 - RNA, 18 nt, Chlamydophila pneumoniae CWL029
auagaaagacauccuucu

SEQ ID NO: 489894 - RNA, 20 nt, Chlamydophila pneumoniae CWL029
auagagaacuccauucagau

SEQ ID NO: 489895 - RNA, 18 nt, Chlamydophila pneumoniae CWL029
auagagugaccauagcau

SEQ ID NO: 489896 - RNA, 15 nt, Chlamydophila pneumoniae CWL029
auacgaacacagaua

SEQ ID NO: 489897 - RNA, 14 nt, Chlamydophila pneumoniae CWL029
auaccaaaauacca

SEQ ID NO: 489898 - RNA, 13 nt, Chlamydophila pneumoniae CWL029
auacaaaaaauaa

SEQ ID NO: 489899 - RNA, 13 nt, Chlamydophila pneumoniae CWL029
aguuugagcagua

SEQ ID NO: 489900 - RNA, 20 nt, Chlamydophila pneumoniae CWL029
aguuuguuuuaauuguagag

SEQ ID NO: 489901 - RNA, 11 nt, Chlamydophila pneumoniae CWL029
auaagaucaau

SEQ ID NO: 489902 - RNA, 19 nt, Chlamydophila pneumoniae CWL029
auaacuccaggggauaaaa

SEQ ID NO: 489903 - RNA, 20 nt, Chlamydophila pneumoniae CWL029
auaacgggguugucucuaca

SEQ ID NO: 489904 - RNA, 12 nt, Chlamydophila pneumoniae CWL029
auaaccugagag

SEQ ID NO: 489905 - RNA, 20 nt, Chlamydophila pneumoniae CWL029
auaaccaggggcuuuccuuc

SEQ ID NO: 489906 - RNA, 19 nt, Chlamydophila pneumoniae CWL029
aguucuuuagcuacagaaa

SEQ ID NO: 489907 - RNA, 20 nt, Chlamydophila pneumoniae CWL029
agugucauacgcagcacgca

SEQ ID NO: 489908 - RNA, 16 nt, Chlamydophila pneumoniae CWL029
aguuccaagacaauaa

SEQ ID NO: 489909 - RNA, 13 nt, Chlamydophila pneumoniae CWL029
agugaauccuucc

SEQ ID NO: 489910 - RNA, 14 nt, Chlamydophila pneumoniae CWL029
agugaaugagcuuc

SEQ ID NO: 489911 - RNA, 15 nt, Chlamydophila pneumoniae CWL029
agucucucuaaggga

SEQ ID NO: 489912 - RNA, 16 nt, Chlamydophila pneumoniae CWL029
agguuguccuauagag

SEQ ID NO: 489913 - RNA, 20 nt, Chlamydophila pneumoniae CWL029
aguaaucacuucagcacgaa

SEQ ID NO: 489914 - RNA, 13 nt, Chlamydophila pneumoniae CWL029
aguauaagaugcu

SEQ ID NO: 489915 - RNA, 22 nt, Chlamydophila pneumoniae CWL029
aguaucgagcucuuuaagaacu

SEQ ID NO: 489916 - RNA, 22 nt, Chlamydophila pneumoniae CWL029
aggucgauaucccacagaaaug

SEQ ID NO: 489917 - RNA, 14 nt, Chlamydophila pneumoniae CWL029
agggcuuccuuacu

SEQ ID NO: 489918 - RNA, 14 nt, Chlamydophila pneumoniae CWL029
agggcuucauuccu

SEQ ID NO: 489919 - RNA, 12 nt, Chlamydophila pneumoniae CWL029
agcuggauucug

SEQ ID NO: 489920 - RNA, 17 nt, Chlamydophila pneumoniae CWL029
agcugagcuaucuucaa

SEQ ID NO: 489921 - RNA, 16 nt, Chlamydophila pneumoniae CWL029
agcucuccauuaaagg

SEQ ID NO: 489922 - RNA, 18 nt, Chlamydophila pneumoniae CWL029
agcucuaaaaaagauaaa

SEQ ID NO: 489923 - RNA, 18 nt, Chlamydophila pneumoniae CWL029
agcuaucaaccauaaaga

SEQ ID NO: 489924 - RNA, 20 nt, Chlamydophila pneumoniae CWL029
agccuguuguagugauggaa

SEQ ID NO: 489925 - RNA, 19 nt, Chlamydophila pneumoniae CWL029
agcaucaggauucucucug

SEQ ID NO: 489926 - RNA, 18 nt, Chlamydophila pneumoniae CWL029
agcaucgcuuaacaaacu

SEQ ID NO: 489927 - RNA, 15 nt, Chlamydophila pneumoniae CWL029
agcaucguauuuucc

SEQ ID NO: 489928 - RNA, 18 nt, Chlamydophila pneumoniae CWL029
agcaauuaccugcccuug

SEQ ID NO: 489929 - RNA, 22 nt, Chlamydophila pneumoniae CWL029
agcaacuucccgaacagcggca

SEQ ID NO: 489930 - RNA, 21 nt, Chlamydophila pneumoniae CWL029
agcagauccugcuucuauaga

SEQ ID NO: 489931 - RNA, 22 nt, Chlamydophila pneumoniae CWL029
acuucuuguccuguuaagaugu

SEQ ID NO: 489932 - RNA, 23 nt, Chlamydophila pneumoniae CWL029
acuucugaugacguuaauaaaga

SEQ ID NO: 489933 - RNA, 18 nt, Chlamydophila pneumoniae CWL029
acuugccaaucuuccuua

SEQ ID NO: 489934 - RNA, 16 nt, Chlamydophila pneumoniae CWL029
acuucaccuugaaguu

SEQ ID NO: 489935 - RNA, 14 nt, Chlamydophila pneumoniae CWL029
acuuaucgaaugcu

SEQ ID NO: 489936 - RNA, 15 nt, Chlamydophila pneumoniae CWL029
acucuagaaaauauu

SEQ ID NO: 489937 - RNA, 15 nt, Chlamydophila pneumoniae CWL029
acucuaguuuuucuu

SEQ ID NO: 489938 - RNA, 22 nt, Chlamydophila pneumoniae CWL029
acucuguaauauucaacauguu

SEQ ID NO: 489939 - RNA, 21 nt, Chlamydophila pneumoniae CWL029
acuccuuaaacuuuacaaucu

SEQ ID NO: 489940 - RNA, 23 nt, Chlamydophila pneumoniae CWL029
acucccuagguuuuaucuuuaga

SEQ ID NO: 489941 - RNA, 18 nt, Chlamydophila pneumoniae CWL029
acuaugguaagcauuucu

SEQ ID NO: 489942 - RNA, 18 nt, Chlamydophila pneumoniae CWL029
acucacgcucucgcuaag

SEQ ID NO: 489943 - RNA, 20 nt, Chlamydophila pneumoniae CWL029
acgcucucgcuaagcaaagc

SEQ ID NO: 489944 - RNA, 20 nt, Chlamydophila pneumoniae CWL029
acgccgugccuauagaaauu

SEQ ID NO: 489945 - RNA, 14 nt, Chlamydophila pneumoniae CWL029
acgcauaggccaau

SEQ ID NO: 489946 - RNA, 15 nt, Chlamydophila pneumoniae CWL029
acgauauuugggaua

SEQ ID NO: 489947 - RNA, 15 nt, Chlamydophila pneumoniae CWL029
acgaucaaauuccuu

SEQ ID NO: 489948 - RNA, 22 nt, Chlamydophila pneumoniae CWL029
acgaucaaauuccuucucagaa

SEQ ID NO: 489949 - RNA, 23 nt, Chlamydophila pneumoniae CWL029
acgagcaugcuaagcaucagaau

SEQ ID NO: 489950 - RNA, 16 nt, Chlamydophila pneumoniae CWL029
accugggggacuucaa

SEQ ID NO: 489951 - RNA, 23 nt, Chlamydophila pneumoniae CWL029
accuggcauugccauaauaaagg

SEQ ID NO: 489952 - RNA, 19 nt, Chlamydophila pneumoniae CWL029
acccugggcucacucuaag

SEQ ID NO: 489953 - RNA, 22 nt, Chlamydophila pneumoniae CWL029
accgagaagcuucaaugaugug

SEQ ID NO: 489954 - RNA, 14 nt, Chlamydophila pneumoniae CWL029
acccucaaagaaua

SEQ ID NO: 489955 - RNA, 19 nt, Chlamydophila pneumoniae CWL029
accacuuuagaauuuucuu

SEQ ID NO: 489956 - RNA, 12 nt, Chlamydophila pneumoniae CWL029
accagaagacuc

SEQ ID NO: 489957 - RNA, 17 nt, Chlamydophila pneumoniae CWL029
accacuaccgaauuuuc

SEQ ID NO: 489958 - RNA, 15 nt, Chlamydophila pneumoniae CWL029
accagaugcuaaaga

SEQ ID NO: 489959 - RNA, 19 nt, Chlamydophila pneumoniae CWL029
accacauacucuucauccu

SEQ ID NO: 489960 - RNA, 13 nt, Chlamydophila pneumoniae CWL029
accaccuaaaaug

SEQ ID NO: 489961 - RNA, 20 nt, Chlamydophila pneumoniae CWL029
accaauaaauccaaaaaaug

SEQ ID NO: 489962 - RNA, 19 nt, Chlamydophila pneumoniae CWL029
accaacuccucaaaagaua

SEQ ID NO: 489963 - RNA, 12 nt, Chlamydophila pneumoniae CWL029
accaacugagcu

SEQ ID NO: 489964 - RNA, 12 nt, Chlamydophila pneumoniae CWL029
acauuuugguau

SEQ ID NO: 489965 - RNA, 21 nt, Chlamydophila pneumoniae CWL029
acauuuguugucagcuuugcu

SEQ ID NO: 489966 - RNA, 22 nt, Chlamydophila pneumoniae CWL029
acauuaagcucaaaauuuccuc

SEQ ID NO: 489967 - RNA, 20 nt, Chlamydophila pneumoniae CWL029
acaucuccaagccaugcaau

SEQ ID NO: 489968 - RNA, 22 nt, Chlamydophila pneumoniae CWL029
acauauacguggcuuccauaac

SEQ ID NO: 489969 - RNA, 12 nt, Chlamydophila pneumoniae CWL029
aauucuuuuccu

SEQ ID NO: 489970 - RNA, 12 nt, Chlamydophila pneumoniae CWL029
aauguaauuuuu

SEQ ID NO: 489971 - RNA, 15 nt, Chlamydophila pneumoniae CWL029
aaucuucgaauuuuu

SEQ ID NO: 489972 - RNA, 14 nt, Chlamydophila pneumoniae CWL029
aaugagaucugcaa

SEQ ID NO: 489973 - RNA, 21 nt, Chlamydophila pneumoniae CWL029
aaugagcaucugagucauaag

SEQ ID NO: 489974 - RNA, 24 nt, Chlamydophila pneumoniae CWL029
aaucugacgugcauugaauccuuc

SEQ ID NO: 489975 - RNA, 14 nt, Chlamydophila pneumoniae CWL029
aauccuaauuccuu

SEQ ID NO: 489976 - RNA, 19 nt, Chlamydophila pneumoniae CWL029
aaucuaauuuuagaacuuc

SEQ ID NO: 489977 - RNA, 17 nt, Chlamydophila pneumoniae CWL029
aaucucacuggcuccua

SEQ ID NO: 489978 - RNA, 20 nt, Chlamydophila pneumoniae CWL029
aaucauuagaguuugguuug

SEQ ID NO: 489979 - RNA, 16 nt, Chlamydophila pneumoniae CWL029
aaucauucaaauauau

SEQ ID NO: 489980 - RNA, 15 nt, Chlamydophila pneumoniae CWL029
aauccaacaaagaug

SEQ ID NO: 489981 - RNA, 17 nt, Chlamydophila pneumoniae CWL029
aaucacuuaauaauguu

SEQ ID NO: 489982 - RNA, 15 nt, Chlamydophila pneumoniae CWL029
aauaaacaucaugau

SEQ ID NO: 489983 - RNA, 23 nt, Chlamydophila pneumoniae CWL029
aagucacggcgaaagcuacagcu

SEQ ID NO: 489984 - RNA, 15 nt, Chlamydophila pneumoniae CWL029
aaguuuguauuuucu

SEQ ID NO: 489985 - RNA, 23 nt, Chlamydophila pneumoniae CWL029
aauaauagcaaguagcucucucc

SEQ ID NO: 489986 - RNA, 19 nt, Chlamydophila pneumoniae CWL029
aauacauagguaaaaccag

SEQ ID NO: 489987 - RNA, 19 nt, Chlamydophila pneumoniae CWL029
aauacaucaccacugcucc

SEQ ID NO: 489988 - RNA, 20 nt, Chlamydophila pneumoniae CWL029
aauacaucuuaagagcaaac

SEQ ID NO: 489989 - RNA, 17 nt, Chlamydophila pneumoniae CWL029
aaguauucgauuccuga

SEQ ID NO: 489990 - RNA, 19 nt, Chlamydophila pneumoniae CWL029
aaguacgaccaacuccuca

SEQ ID NO: 489991 - RNA, 15 nt, Chlamydophila pneumoniae CWL029
aaguagaauccuucu

SEQ ID NO: 489992 - RNA, 13 nt, Chlamydophila pneumoniae CWL029
aagguugcuaaga

SEQ ID NO: 489993 - RNA, 19 nt, Chlamydophila pneumoniae CWL029
aagguugcuuuucuaggau

SEQ ID NO: 489994 - RNA, 17 nt, Chlamydophila pneumoniae CWL029
aaggcuuuucuuuuucu

SEQ ID NO: 489995 - RNA, 14 nt, Chlamydophila pneumoniae CWL029
aagggccagaaacg

SEQ ID NO: 489996 - RNA, 19 nt, Chlamydophila pneumoniae CWL029
aagggaucuccuucaugca

SEQ ID NO: 489997 - RNA, 23 nt, Chlamydophila pneumoniae CWL029
aaggaagaucuugaacagagacu

SEQ ID NO: 489998 - RNA, 21 nt, Chlamydophila pneumoniae CWL029
aaggaccuccucacauguuuc

SEQ ID NO: 489999 - RNA, 18 nt, Chlamydophila pneumoniae CWL029
aagcuucuuuaauuccaa

SEQ ID NO: 490000 - RNA, 21 nt, Chlamydophila pneumoniae CWL029
aagcugucguccuaauuuucc

SEQ ID NO: 490001 - RNA, 18 nt, Chlamydophila pneumoniae CWL029
aagcucuuaauuucugcu

SEQ ID NO: 490002 - RNA, 13 nt, Chlamydophila pneumoniae CWL029
aagcucuaagucc

SEQ ID NO: 490003 - RNA, 13 nt, Chlamydophila pneumoniae CWL029
aagcuaaaaugcg

SEQ ID NO: 490004 - RNA, 22 nt, Chlamydophila pneumoniae CWL029
aagcucccaacaagggaaagaa

SEQ ID NO: 490005 - RNA, 17 nt, Chlamydophila pneumoniae CWL029
aagcucgcguauuuucg

SEQ ID NO: 490006 - RNA, 12 nt, Chlamydophila pneumoniae CWL029
aagcgcucuaca

SEQ ID NO: 490007 - RNA, 16 nt, Chlamydophila pneumoniae CWL029
aagcggagcaucuuuu

SEQ ID NO: 490008 - RNA, 17 nt, Chlamydophila pneumoniae CWL029
aagccuucauuccauga

SEQ ID NO: 490009 - RNA, 19 nt, Chlamydophila pneumoniae CWL029
aacuaccuaccuauuuaag

SEQ ID NO: 490010 - RNA, 11 nt, Chlamydophila pneumoniae CWL029
aacuacauaua

SEQ ID NO: 490011 - RNA, 13 nt, Chlamydophila pneumoniae CWL029
aagauaaauccca

SEQ ID NO: 490012 - RNA, 13 nt, Chlamydophila pneumoniae CWL029
aagaggucgaaga

SEQ ID NO: 490013 - RNA, 22 nt, Chlamydophila pneumoniae CWL029
aagagcucguaauccuucuuuc

SEQ ID NO: 490014 - RNA, 18 nt, Chlamydophila pneumoniae CWL029
aacuacuuaaauccuaag

SEQ ID NO: 490015 - RNA, 19 nt, Chlamydophila pneumoniae CWL029
aacuaguaacuuaaucaau

SEQ ID NO: 490016 - RNA, 23 nt, Chlamydophila pneumoniae CWL029
aacuaguucuucuuuacucaagu

SEQ ID NO: 490017 - RNA, 14 nt, Chlamydophila pneumoniae CWL029
aagaucuccgaaga

SEQ ID NO: 490018 - RNA, 15 nt, Chlamydophila pneumoniae CWL029
aagaugaauaccaga

SEQ ID NO: 490019 - RNA, 13 nt, Chlamydophila pneumoniae CWL029
aagauuccuaagc

SEQ ID NO: 490020 - RNA, 21 nt, Chlamydophila pneumoniae CWL029
aagauugcagguagauccuau

SEQ ID NO: 490021 - RNA, 13 nt, Chlamydophila pneumoniae CWL029
aagcaauuucucc

SEQ ID NO: 490022 - RNA, 20 nt, Chlamydophila pneumoniae CWL029
aacccauauuugaauaaagg

SEQ ID NO: 490023 - RNA, 23 nt, Chlamydophila pneumoniae CWL029
aaccacacaggauuguuauugag

SEQ ID NO: 490024 - RNA, 13 nt, Chlamydophila pneumoniae CWL029
aaccagccaauaa

SEQ ID NO: 490025 - RNA, 15 nt, Chlamydophila pneumoniae CWL029
aacaucagcaacaua

SEQ ID NO: 490026 - RNA, 15 nt, Chlamydophila pneumoniae CWL029
aacagagcgccucca

SEQ ID NO: 490027 - RNA, 15 nt, Chlamydophila pneumoniae CWL029
aacaagaagaucaaa

SEQ ID NO: 490028 - RNA, 23 nt, Chlamydophila pneumoniae CWL029
aacaaguugacgcgcuucuucaa

SEQ ID NO: 490029 - RNA, 17 nt, Chlamydophila pneumoniae CWL029
aacagcuuuaucuucga

SEQ ID NO: 490030 - RNA, 13 nt, Chlamydophila pneumoniae CWL029
aaaugcuccugca

SEQ ID NO: 490031 - RNA, 17 nt, Chlamydophila pneumoniae CWL029
aaaugccuuaaauguau

SEQ ID NO: 490032 - RNA, 19 nt, Chlamydophila pneumoniae CWL029
aaauugaaaucuuuagaau

SEQ ID NO: 490033 - RNA, 16 nt, Chlamydophila pneumoniae CWL029
aaauacagccagcaga

SEQ ID NO: 490034 - RNA, 14 nt, Chlamydophila pneumoniae CWL029
aaauaccaaggcug

SEQ ID NO: 490035 - RNA, 20 nt, Chlamydophila pneumoniae CWL029
aaaguuagguagauagaaau

SEQ ID NO: 490036 - RNA, 23 nt, Chlamydophila pneumoniae CWL029
aaauacguccagccugcaccaga

SEQ ID NO: 490037 - RNA, 15 nt, Chlamydophila pneumoniae CWL029
aaauaggagaagccc

SEQ ID NO: 490038 - RNA, 18 nt, Chlamydophila pneumoniae CWL029
aaauauuaacccaccaga

SEQ ID NO: 490039 - RNA, 22 nt, Chlamydophila pneumoniae CWL029
aaaaauucuagaccugccaaga

SEQ ID NO: 490040 - RNA, 20 nt, Chlamydophila pneumoniae CWL029
aaaaauaccaagaugucucc

SEQ ID NO: 490041 - RNA, 22 nt, Chlamydophila pneumoniae CWL029
aaaaauggcacuugagcacauu

SEQ ID NO: 490042 - RNA, 23 nt, Chlamydophila pneumoniae CWL029
aaaaaccccuagaacuuuacaau

SEQ ID NO: 490043 - RNA, 14 nt, Chlamydophila pneumoniae CWL029
aaacuauaaaagcc

SEQ ID NO: 490044 - RNA, 22 nt, Chlamydophila pneumoniae CWL029
aaacuugcuuuuuugaaagcug

SEQ ID NO: 490045 - RNA, 13 nt, Chlamydophila pneumoniae CWL029
uuuuaaagcaaaa

SEQ ID NO: 490046 - RNA, 22 nt, Chlamydophila pneumoniae CWL029
uuuuaagcuaauaagauccaaa

SEQ ID NO: 490047 - RNA, 14 nt, Chlamydophila pneumoniae CWL029
uuuucauagggcag

SEQ ID NO: 490048 - RNA, 13 nt, Chlamydophila pneumoniae CWL029
uuuugcugaagau

SEQ ID NO: 490049 - RNA, 20 nt, Chlamydophila pneumoniae CWL029
uuuugguugugucaacccuu

SEQ ID NO: 490050 - RNA, 15 nt, Chlamydophila pneumoniae CWL029
uuucuuuugcaaauc

SEQ ID NO: 490051 - RNA, 20 nt, Chlamydophila pneumoniae CWL029
uuugcgcccgagcuuccaua

SEQ ID NO: 490052 - RNA, 21 nt, Chlamydophila pneumoniae CWL029
uuugauuauucccaagaacuu

SEQ ID NO: 490053 - RNA, 14 nt, Chlamydophila pneumoniae CWL029
uuucccuuuaaaag

SEQ ID NO: 490054 - RNA, 13 nt, Chlamydophila pneumoniae CWL029
uuucuaagaaagg

SEQ ID NO: 490055 - RNA, 17 nt, Chlamydophila pneumoniae CWL029
uuucuaauccuccaaac

SEQ ID NO: 490056 - RNA, 21 nt, Chlamydophila pneumoniae CWL029
uuucucggauccuccaagauc

SEQ ID NO: 490057 - RNA, 13 nt, Chlamydophila pneumoniae CWL029
uuguagaacuucu

SEQ ID NO: 490058 - RNA, 19 nt, Chlamydophila pneumoniae CWL029
uuguaacucaagguauugu

SEQ ID NO: 490059 - RNA, 19 nt, Chlamydophila pneumoniae CWL029
uuguccugcaagcauuguu

SEQ ID NO: 490060 - RNA, 18 nt, Chlamydophila pneumoniae CWL029
uucuuguugcaauagcaa

SEQ ID NO: 490061 - RNA, 20 nt, Chlamydophila pneumoniae CWL029
uucuuuauaaauacaggaga

SEQ ID NO: 490062 - RNA, 16 nt, Chlamydophila pneumoniae CWL029
uucuuucaauaacaga

SEQ ID NO: 490063 - RNA, 20 nt, Chlamydophila pneumoniae CWL029
uucuuucugcuugucuacag

SEQ ID NO: 490064 - RNA, 18 nt, Chlamydophila pneumoniae CWL029
uucuuucggugucucuag

SEQ ID NO: 490065 - RNA, 15 nt, Chlamydophila pneumoniae CWL029
uucuuuucugaagau

SEQ ID NO: 490066 - RNA, 22 nt, Chlamydophila pneumoniae CWL029
uuuaauguuuggccaacagcua

SEQ ID NO: 490067 - RNA, 20 nt, Chlamydophila pneumoniae CWL029
uuuaucauugcuauugaaaa

SEQ ID NO: 490068 - RNA, 22 nt, Chlamydophila pneumoniae CWL029
uuuaucuccccauucacaaauc

SEQ ID NO: 490069 - RNA, 18 nt, Chlamydophila pneumoniae CWL029
uucuucuucggaucugua

SEQ ID NO: 490070 - RNA, 22 nt, Chlamydophila pneumoniae CWL029
uucuucuagcucauuaucaaga

SEQ ID NO: 490071 - RNA, 15 nt, Chlamydophila pneumoniae CWL029
uucuguaaagauucu

SEQ ID NO: 490072 - RNA, 22 nt, Chlamydophila pneumoniae CWL029
uucucugguauagaaacaccgu

SEQ ID NO: 490073 - RNA, 14 nt, Chlamydophila pneumoniae CWL029
uucucugagcagcu

SEQ ID NO: 490074 - RNA, 22 nt, Chlamydophila pneumoniae CWL029
uucugauuagagccccaacccu

SEQ ID NO: 490075 - RNA, 22 nt, Chlamydophila pneumoniae CWL029
uucucccgcaaaguuaaaccuu

SEQ ID NO: 490076 - RNA, 16 nt, Chlamydophila pneumoniae CWL029
uucuauagcaagacga

SEQ ID NO: 490077 - RNA, 17 nt, Chlamydophila pneumoniae CWL029
uucuauguguucucgaa

SEQ ID NO: 490078 - RNA, 19 nt, Chlamydophila pneumoniae CWL029
uucucauccagacaagaca

SEQ ID NO: 490079 - RNA, 20 nt, Chlamydophila pneumoniae CWL029
uucuagagcuucaaguuucu

SEQ ID NO: 490080 - RNA, 16 nt, Chlamydophila pneumoniae CWL029
uuccuuuuugcauagc

SEQ ID NO: 490081 - RNA, 20 nt, Chlamydophila pneumoniae CWL029
uuccuucaggauuacggaaa

SEQ ID NO: 490082 - RNA, 20 nt, Chlamydophila pneumoniae CWL029
uucccccgcguaauagcagu

SEQ ID NO: 490083 - RNA, 21 nt, Chlamydophila pneumoniae CWL029
uucccuaagguagaguccaca

SEQ ID NO: 490084 - RNA, 15 nt, Chlamydophila pneumoniae CWL029
uucgcacuacagcuu

SEQ ID NO: 490085 - RNA, 18 nt, Chlamydophila pneumoniae CWL029
uucgcugucuagaacacu

SEQ ID NO: 490086 - RNA, 18 nt, Chlamydophila pneumoniae CWL029
uuccauacccaaauuucu

SEQ ID NO: 490087 - RNA, 18 nt, Chlamydophila pneumoniae CWL029
uuccauaggaucugcaug

SEQ ID NO: 490088 - RNA, 13 nt, Chlamydophila pneumoniae CWL029
uucaaugaagaaa

SEQ ID NO: 490089 - RNA, 16 nt, Chlamydophila pneumoniae CWL029
uucaaaagaccgccuu

SEQ ID NO: 490090 - RNA, 20 nt, Chlamydophila pneumoniae CWL029
uucaaacugauuaguuuguu

SEQ ID NO: 490091 - RNA, 19 nt, Chlamydophila pneumoniae CWL029
uuauuaucaaagugaacga

SEQ ID NO: 490092 - RNA, 17 nt, Chlamydophila pneumoniae CWL029
uuaagguugcuuuucua

SEQ ID NO: 490093 - RNA, 15 nt, Chlamydophila pneumoniae CWL029
uuaauaaaucuauau

SEQ ID NO: 490094 - RNA, 18 nt, Chlamydophila pneumoniae CWL029
uuacucccugaaguugag

SEQ ID NO: 490095 - RNA, 17 nt, Chlamydophila pneumoniae CWL029
ugucuaagauauagaga

SEQ ID NO: 490096 - RNA, 22 nt, Chlamydophila pneumoniae CWL029
ugucuuccacgaaggaaucuga

SEQ ID NO: 490097 - RNA, 20 nt, Chlamydophila pneumoniae CWL029
uguaaaugaggcuccuccuu

SEQ ID NO: 490098 - RNA, 19 nt, Chlamydophila pneumoniae CWL029
uguaagaaggcagagaacu

SEQ ID NO: 490099 - RNA, 12 nt, Chlamydophila pneumoniae CWL029
uguauuuaaauu

SEQ ID NO: 490100 - RNA, 16 nt, Chlamydophila pneumoniae CWL029
uguaucuguauccuuc

SEQ ID NO: 490101 - RNA, 14 nt, Chlamydophila pneumoniae CWL029
uguagguuuuucca

SEQ ID NO: 490102 - RNA, 22 nt, Chlamydophila pneumoniae CWL029
uguauaugcuuggcaauagcuu

SEQ ID NO: 490103 - RNA, 21 nt, Chlamydophila pneumoniae CWL029
ugucccauggcuggaaagcca

SEQ ID NO: 490104 - RNA, 19 nt, Chlamydophila pneumoniae CWL029
uguccaugcacgagauucu

SEQ ID NO: 490105 - RNA, 20 nt, Chlamydophila pneumoniae CWL029
uguaaaaacuguguuuucua

SEQ ID NO: 490106 - RNA, 20 nt, Chlamydophila pneumoniae CWL029
uggcgaggggccacuugcau

SEQ ID NO: 490107 - RNA, 18 nt, Chlamydophila pneumoniae CWL029
uggcucaguguauuguuu

SEQ ID NO: 490108 - RNA, 17 nt, Chlamydophila pneumoniae CWL029
ugcuaaacuuuuuuuca

SEQ ID NO: 490109 - RNA, 19 nt, Chlamydophila pneumoniae CWL029
ugcuacgacuacaucuugu

SEQ ID NO: 490110 - RNA, 19 nt, Chlamydophila pneumoniae CWL029
ugcuacuguccauccaaau

SEQ ID NO: 490111 - RNA, 17 nt, Chlamydophila pneumoniae CWL029
ugcuauagggaucuccu

SEQ ID NO: 490112 - RNA, 14 nt, Chlamydophila pneumoniae CWL029
ugcuaucuccagaa

SEQ ID NO: 490113 - RNA, 23 nt, Chlamydophila pneumoniae CWL029
ugcucaauacagauaucaaagca

SEQ ID NO: 490114 - RNA, 20 nt, Chlamydophila pneumoniae CWL029
ugcgcacggauucuaaaaga

SEQ ID NO: 490115 - RNA, 15 nt, Chlamydophila pneumoniae CWL029
ugcgaacgaagacuu

SEQ ID NO: 490116 - RNA, 22 nt, Chlamydophila pneumoniae CWL029
ugcgaacgaagacuuguucuuc

SEQ ID NO: 490117 - RNA, 15 nt, Chlamydophila pneumoniae CWL029
ugccuuugaucagga

SEQ ID NO: 490118 - RNA, 15 nt, Chlamydophila pneumoniae CWL029
ugcaggccaggagac

SEQ ID NO: 490119 - RNA, 12 nt, Chlamydophila pneumoniae CWL029
ugccaaaaaauu

SEQ ID NO: 490120 - RNA, 21 nt, Chlamydophila pneumoniae CWL029
ugcagaguuggaucauucuuu

SEQ ID NO: 490121 - RNA, 23 nt, Chlamydophila pneumoniae CWL029
ugaugcaccauaauauaauagug

SEQ ID NO: 490122 - RNA, 20 nt, Chlamydophila pneumoniae CWL029
ugaugauuuuuuaugacaaa

SEQ ID NO: 490123 - RNA, 17 nt, Chlamydophila pneumoniae CWL029
ugauagcugaugcugag

SEQ ID NO: 490124 - RNA, 19 nt, Chlamydophila pneumoniae CWL029
ugauaucaccagguccuuc

SEQ ID NO: 490125 - RNA, 13 nt, Chlamydophila pneumoniae CWL029
ugauauccaccuu

SEQ ID NO: 490126 - RNA, 14 nt, Chlamydophila pneumoniae CWL029
ugauauuuucuugu

SEQ ID NO: 490127 - RNA, 17 nt, Chlamydophila pneumoniae CWL029
ugacuuuaugaucuccc

SEQ ID NO: 490128 - RNA, 21 nt, Chlamydophila pneumoniae CWL029
ugacuuuauguuagcuagagc

SEQ ID NO: 490129 - RNA, 15 nt, Chlamydophila pneumoniae CWL029
ugagagauuuuuuca

SEQ ID NO: 490130 - RNA, 19 nt, Chlamydophila pneumoniae CWL029
ugagauacuuuaaagacuu

SEQ ID NO: 490131 - RNA, 19 nt, Chlamydophila pneumoniae CWL029
ugagaucgaaucuuuauuu

SEQ ID NO: 490132 - RNA, 18 nt, Chlamydophila pneumoniae CWL029
ugaagcagggaaaaugcg

SEQ ID NO: 490133 - RNA, 23 nt, Chlamydophila pneumoniae CWL029
ucuuuuucuauuaaaaauagcuu

SEQ ID NO: 490134 - RNA, 19 nt, Chlamydophila pneumoniae CWL029
ucuuuuuuuugaagugcuu

SEQ ID NO: 490135 - RNA, 18 nt, Chlamydophila pneumoniae CWL029
ucuuuagaauaagagcua

SEQ ID NO: 490136 - RNA, 23 nt, Chlamydophila pneumoniae CWL029
ucuuuuagacgugcucucuucuu

SEQ ID NO: 490137 - RNA, 23 nt, Chlamydophila pneumoniae CWL029
ucuuuucuagaaacugcuccuga

SEQ ID NO: 490138 - RNA, 22 nt, Chlamydophila pneumoniae CWL029
ucuuguauugcuacuguccauc

SEQ ID NO: 490139 - RNA, 16 nt, Chlamydophila pneumoniae CWL029
ucuuguaaacgagcuu

SEQ ID NO: 490140 - RNA, 13 nt, Chlamydophila pneumoniae CWL029
ucuuuaauuaaaa

SEQ ID NO: 490141 - RNA, 13 nt, Chlamydophila pneumoniae CWL029
ucuucucuaccca

SEQ ID NO: 490142 - RNA, 21 nt, Chlamydophila pneumoniae CWL029
ucuucuguaggaacaaucgua

SEQ ID NO: 490143 - RNA, 15 nt, Chlamydophila pneumoniae CWL029
ucuucuugauuaaga

SEQ ID NO: 490144 - RNA, 13 nt, Chlamydophila pneumoniae CWL029
ucuugacuuguuu

SEQ ID NO: 490145 - RNA, 15 nt, Chlamydophila pneumoniae CWL029
ucuucuuguucuucu

SEQ ID NO: 490146 - RNA, 15 nt, Chlamydophila pneumoniae CWL029
ucuucuuuccauaga

SEQ ID NO: 490147 - RNA, 19 nt, Chlamydophila pneumoniae CWL029
ucuucauugcaaaaaugaa

SEQ ID NO: 490148 - RNA, 22 nt, Chlamydophila pneumoniae CWL029
ucuucauugcaaaaaugaaaga

SEQ ID NO: 490149 - RNA, 19 nt, Chlamydophila pneumoniae CWL029
ucuuccaucucuuuaaaug

SEQ ID NO: 490150 - RNA, 20 nt, Chlamydophila pneumoniae CWL029
ucuucaauaggaauuagaga

SEQ ID NO: 490151 - RNA, 19 nt, Chlamydophila pneumoniae CWL029
ucuucacuuauaagcugcu

SEQ ID NO: 490152 - RNA, 17 nt, Chlamydophila pneumoniae CWL029
ucuuaucaugaaaagga

SEQ ID NO: 490153 - RNA, 18 nt, Chlamydophila pneumoniae CWL029
ucuucaaaaguaaucacu

SEQ ID NO: 490154 - RNA, 12 nt, Chlamydophila pneumoniae CWL029
ucuguuuucucu

SEQ ID NO: 490155 - RNA, 22 nt, Chlamydophila pneumoniae CWL029
ucugugugacgacaaaucacga

SEQ ID NO: 490156 - RNA, 23 nt, Chlamydophila pneumoniae CWL029
ucuguagguuuuuccaacuucaa

SEQ ID NO: 490157 - RNA, 18 nt, Chlamydophila pneumoniae CWL029
ucuggauacguuuuuccc

SEQ ID NO: 490158 - RNA, 12 nt, Chlamydophila pneumoniae CWL029
ucugaagcugca

SEQ ID NO: 490159 - RNA, 23 nt, Chlamydophila pneumoniae CWL029
ucugaaggauuugcucuguagua

SEQ ID NO: 490160 - RNA, 21 nt, Chlamydophila pneumoniae CWL029
ucugcccgucuuagaauccaa

SEQ ID NO: 490161 - RNA, 15 nt, Chlamydophila pneumoniae CWL029
ucucuaugcgcucua

SEQ ID NO: 490162 - RNA, 14 nt, Chlamydophila pneumoniae CWL029
ucuccugcaaaaag

SEQ ID NO: 490163 - RNA, 17 nt, Chlamydophila pneumoniae CWL029
ucuccgucauauuuaaa

SEQ ID NO: 490164 - RNA, 23 nt, Chlamydophila pneumoniae CWL029
ucuacgauguuuucuuauccuug

SEQ ID NO: 490165 - RNA, 15 nt, Chlamydophila pneumoniae CWL029
ucuacaugcucaaga

SEQ ID NO: 490166 - RNA, 14 nt, Chlamydophila pneumoniae CWL029
ucuauuuucaggag

SEQ ID NO: 490167 - RNA, 14 nt, Chlamydophila pneumoniae CWL029
ucuaucuaaucaau

SEQ ID NO: 490168 - RNA, 13 nt, Chlamydophila pneumoniae CWL029
ucggcuaaagaaa

SEQ ID NO: 490169 - RNA, 21 nt, Chlamydophila pneumoniae CWL029
ucggauuuagauuaaagagac

SEQ ID NO: 490170 - RNA, 14 nt, Chlamydophila pneumoniae CWL029
ucgcuuuugcuaga

SEQ ID NO: 490171 - RNA, 18 nt, Chlamydophila pneumoniae CWL029
ucgaaaccacagcaaaga

SEQ ID NO: 490172 - RNA, 17 nt, Chlamydophila pneumoniae CWL029
uccuuggauuucuucuu

SEQ ID NO: 490173 - RNA, 14 nt, Chlamydophila pneumoniae CWL029
ucgaaauuuucaga

SEQ ID NO: 490174 - RNA, 14 nt, Chlamydophila pneumoniae CWL029
uccuucuauagcaa

SEQ ID NO: 490175 - RNA, 11 nt, Chlamydophila pneumoniae CWL029
uccuucuucuu

SEQ ID NO: 490176 - RNA, 15 nt, Chlamydophila pneumoniae CWL029
uccuugaauuaguuu

SEQ ID NO: 490177 - RNA, 13 nt, Chlamydophila pneumoniae CWL029
uccugaagaugag

SEQ ID NO: 490178 - RNA, 18 nt, Chlamydophila pneumoniae CWL029
uccugaacaucuccagca

SEQ ID NO: 490179 - RNA, 18 nt, Chlamydophila pneumoniae CWL029
uccuaucaaagcaaaagu

SEQ ID NO: 490180 - RNA, 17 nt, Chlamydophila pneumoniae CWL029
uccuagcagagaaauua

SEQ ID NO: 490181 - RNA, 16 nt, Chlamydophila pneumoniae CWL029
uccuagggagugagga

SEQ ID NO: 490182 - RNA, 19 nt, Chlamydophila pneumoniae CWL029
uccuagguucuuuucggau

SEQ ID NO: 490183 - RNA, 20 nt, Chlamydophila pneumoniae CWL029
uccuaaaucugcuuuuaucu

SEQ ID NO: 490184 - RNA, 13 nt, Chlamydophila pneumoniae CWL029
uccuccaaaauua

SEQ ID NO: 490185 - RNA, 20 nt, Chlamydophila pneumoniae CWL029
uccgucaagaacaagagcuu

SEQ ID NO: 490186 - RNA, 13 nt, Chlamydophila pneumoniae CWL029
uccgagaaacaac

SEQ ID NO: 490187 - RNA, 12 nt, Chlamydophila pneumoniae CWL029
ucccaaaaaaug

SEQ ID NO: 490188 - RNA, 21 nt, Chlamydophila pneumoniae CWL029
uccauuggaauccuuuggaag

SEQ ID NO: 490189 - RNA, 17 nt, Chlamydophila pneumoniae CWL029
uccaacuuccauaugag

SEQ ID NO: 490190 - RNA, 19 nt, Chlamydophila pneumoniae CWL029
uccaaauagagugaccaua

SEQ ID NO: 490191 - RNA, 18 nt, Chlamydophila pneumoniae CWL029
ucauuccagcaucuucuc

SEQ ID NO: 490192 - RNA, 23 nt, Chlamydophila pneumoniae CWL029
ucaucggcuucuccaacuuccau

SEQ ID NO: 490193 - RNA, 15 nt, Chlamydophila pneumoniae CWL029
ucaguuaaagagcau

SEQ ID NO: 490194 - RNA, 18 nt, Chlamydophila pneumoniae CWL029
ucaucauaacuaggguac

SEQ ID NO: 490195 - RNA, 15 nt, Chlamydophila pneumoniae CWL029
uauuucuaaaaaaua

SEQ ID NO: 490196 - RNA, 22 nt, Chlamydophila pneumoniae CWL029
ucacuguuuuucguaagcugag

SEQ ID NO: 490197 - RNA, 23 nt, Chlamydophila pneumoniae CWL029
ucaggaaagguaguuuucuucuu

SEQ ID NO: 490198 - RNA, 17 nt, Chlamydophila pneumoniae CWL029
ucaggacccuuuuccuc

SEQ ID NO: 490199 - RNA, 18 nt, Chlamydophila pneumoniae CWL029
uauaguuuucaaaaaucg

SEQ ID NO: 490200 - RNA, 17 nt, Chlamydophila pneumoniae CWL029
uauaggaagcucuucua

SEQ ID NO: 490201 - RNA, 22 nt, Chlamydophila pneumoniae CWL029
uauaucgccguuaaagacuucu

SEQ ID NO: 490202 - RNA, 13 nt, Chlamydophila pneumoniae CWL029
uauaggauuugca

SEQ ID NO: 490203 - RNA, 23 nt, Chlamydophila pneumoniae CWL029
uauagcuccuuggcuauggaaag

SEQ ID NO: 490204 - RNA, 22 nt, Chlamydophila pneumoniae CWL029
uauagauacguaguccuuauuu

SEQ ID NO: 490205 - RNA, 11 nt, Chlamydophila pneumoniae CWL029
uauaacucucu

SEQ ID NO: 490206 - RNA, 14 nt, Chlamydophila pneumoniae CWL029
uaguaacuaaauuc

SEQ ID NO: 490207 - RNA, 19 nt, Chlamydophila pneumoniae CWL029
uaggugccugaagauggca

SEQ ID NO: 490208 - RNA, 14 nt, Chlamydophila pneumoniae CWL029
uagguagagaaucc

SEQ ID NO: 490209 - RNA, 21 nt, Chlamydophila pneumoniae CWL029
uagucucgguuuccugaagau

SEQ ID NO: 490210 - RNA, 18 nt, Chlamydophila pneumoniae CWL029
uaugauagaacucuccuc

SEQ ID NO: 490211 - RNA, 13 nt, Chlamydophila pneumoniae CWL029
uauuaaagaaucu

SEQ ID NO: 490212 - RNA, 14 nt, Chlamydophila pneumoniae CWL029
uauuaagaauggau

SEQ ID NO: 490213 - RNA, 15 nt, Chlamydophila pneumoniae CWL029
uauucugaaauuucu

SEQ ID NO: 490214 - RNA, 18 nt, Chlamydophila pneumoniae CWL029
uaucuacagagagaaacu

SEQ ID NO: 490215 - RNA, 14 nt, Chlamydophila pneumoniae CWL029
uaucuuugguaugc

SEQ ID NO: 490216 - RNA, 17 nt, Chlamydophila pneumoniae CWL029
uauccguauggauuucu

SEQ ID NO: 490217 - RNA, 14 nt, Chlamydophila pneumoniae CWL029
uauccucgucuuca

SEQ ID NO: 490218 - RNA, 20 nt, Chlamydophila pneumoniae CWL029
uaucaugcaauacuuuucuc

SEQ ID NO: 490219 - RNA, 19 nt, Chlamydophila pneumoniae CWL029
uaucauggacaagcaaaag

SEQ ID NO: 490220 - RNA, 18 nt, Chlamydophila pneumoniae CWL029
uagggagaucuuauagac

SEQ ID NO: 490221 - RNA, 22 nt, Chlamydophila pneumoniae CWL029
uaggggagguaaaauaaagagc

SEQ ID NO: 490222 - RNA, 13 nt, Chlamydophila pneumoniae CWL029
uagcucuggagau

SEQ ID NO: 490223 - RNA, 13 nt, Chlamydophila pneumoniae CWL029
uaggauaucauau

SEQ ID NO: 490224 - RNA, 23 nt, Chlamydophila pneumoniae CWL029
uagaucuuuugauaacuuugcau

SEQ ID NO: 490225 - RNA, 24 nt, Chlamydophila pneumoniae CWL029
uagauuuuucuuuuagagaaaucu

SEQ ID NO: 490226 - RNA, 20 nt, Chlamydophila pneumoniae CWL029
uagcuaaaccuucagauccg

SEQ ID NO: 490227 - RNA, 12 nt, Chlamydophila pneumoniae CWL029
uacguuuucucu

SEQ ID NO: 490228 - RNA, 20 nt, Chlamydophila pneumoniae CWL029
uacuucacguugcaauggcu

SEQ ID NO: 490229 - RNA, 23 nt, Chlamydophila pneumoniae CWL029
uacuucggaugagauccaaagcc

SEQ ID NO: 490230 - RNA, 12 nt, Chlamydophila pneumoniae CWL029
uacuucuccuga

SEQ ID NO: 490231 - RNA, 21 nt, Chlamydophila pneumoniae CWL029
uagaaacaacugaaaaaccau

SEQ ID NO: 490232 - RNA, 14 nt, Chlamydophila pneumoniae CWL029
uacuuacaagaaca

SEQ ID NO: 490233 - RNA, 15 nt, Chlamydophila pneumoniae CWL029
uaccuuguuuuccug

SEQ ID NO: 490234 - RNA, 17 nt, Chlamydophila pneumoniae CWL029
uacggacaacaacagcu

SEQ ID NO: 490235 - RNA, 15 nt, Chlamydophila pneumoniae CWL029
uacaggaaacucuau

SEQ ID NO: 490236 - RNA, 12 nt, Chlamydophila pneumoniae CWL029
uaauuucuuaca

SEQ ID NO: 490237 - RNA, 18 nt, Chlamydophila pneumoniae CWL029
uaaucuuuuuuaaagcua

SEQ ID NO: 490238 - RNA, 18 nt, Chlamydophila pneumoniae CWL029
uaaugguacaauacugga

SEQ ID NO: 490239 - RNA, 20 nt, Chlamydophila pneumoniae CWL029
uaaucuggaagcaaucugua

SEQ ID NO: 490240 - RNA, 19 nt, Chlamydophila pneumoniae CWL029
uaauaagcauauuuaaaua

SEQ ID NO: 490241 - RNA, 18 nt, Chlamydophila pneumoniae CWL029
uaauaagcggaguccuuc

SEQ ID NO: 490242 - RNA, 14 nt, Chlamydophila pneumoniae CWL029
uaagcaauaucuau

SEQ ID NO: 490243 - RNA, 16 nt, Chlamydophila pneumoniae CWL029
uaagacuucuggaagc

SEQ ID NO: 490244 - RNA, 20 nt, Chlamydophila pneumoniae CWL029
uaagaaugguuauuucuugu

SEQ ID NO: 490245 - RNA, 12 nt, Chlamydophila pneumoniae CWL029
uaauaaaaugcg

SEQ ID NO: 490246 - RNA, 12 nt, Chlamydophila pneumoniae CWL029
uaagaaauccca

SEQ ID NO: 490247 - RNA, 22 nt, Chlamydophila pneumoniae CWL029
uaacauuggagucuaaaaaaua

SEQ ID NO: 490248 - RNA, 22 nt, Chlamydophila pneumoniae CWL029
uaacauuuagauaaagaaagcg

SEQ ID NO: 490249 - RNA, 17 nt, Chlamydophila pneumoniae CWL029
uaacaucaagaauuucu

SEQ ID NO: 490250 - RNA, 21 nt, Chlamydophila pneumoniae CWL029
uaaauauuuuaccauugagau

SEQ ID NO: 490251 - RNA, 16 nt, Chlamydophila pneumoniae CWL029
uaaauuaguaaaugcc

SEQ ID NO: 490252 - RNA, 22 nt, Chlamydophila pneumoniae CWL029
uaaaagaacgauaaaauugaaa

SEQ ID NO: 490253 - RNA, 17 nt, Chlamydophila pneumoniae CWL029
uaaaacuccacgccaaa

SEQ ID NO: 490254 - RNA, 14 nt, Chlamydophila pneumoniae CWL029
guuucuaaaacaga

SEQ ID NO: 490255 - RNA, 19 nt, Chlamydophila pneumoniae CWL029
guuucuagaaaaucucuaa

SEQ ID NO: 490256 - RNA, 18 nt, Chlamydophila pneumoniae CWL029
guuguauuuccuucuuuu

SEQ ID NO: 490257 - RNA, 20 nt, Chlamydophila pneumoniae CWL029
guuuagacgaggagaagucg

SEQ ID NO: 490258 - RNA, 22 nt, Chlamydophila pneumoniae CWL029
guuuacagaugcaugauccuau

SEQ ID NO: 490259 - RNA, 21 nt, Chlamydophila pneumoniae CWL029
guucuaugccauaaauacagg

SEQ ID NO: 490260 - RNA, 21 nt, Chlamydophila pneumoniae CWL029
guugauuucgugaacaaaauc

SEQ ID NO: 490261 - RNA, 17 nt, Chlamydophila pneumoniae CWL029
gugcaggagaacaauau

SEQ ID NO: 490262 - RNA, 20 nt, Chlamydophila pneumoniae CWL029
gucuuagaauccaaagacuu

SEQ ID NO: 490263 - RNA, 16 nt, Chlamydophila pneumoniae CWL029
gucuuccacgaaggaa

SEQ ID NO: 490264 - RNA, 23 nt, Chlamydophila pneumoniae CWL029
gucugcgauaggaucuucuauuu

SEQ ID NO: 490265 - RNA, 13 nt, Chlamydophila pneumoniae CWL029
gucucugaagacc

SEQ ID NO: 490266 - RNA, 20 nt, Chlamydophila pneumoniae CWL029
gucuccaaauguucucucca

SEQ ID NO: 490267 - RNA, 15 nt, Chlamydophila pneumoniae CWL029
gucccaaucaagaua

SEQ ID NO: 490268 - RNA, 13 nt, Chlamydophila pneumoniae CWL029
guaucuucucuua

SEQ ID NO: 490269 - RNA, 16 nt, Chlamydophila pneumoniae CWL029
guauucuugagagucc

SEQ ID NO: 490270 - RNA, 14 nt, Chlamydophila pneumoniae CWL029
guagacgauuuucu

SEQ ID NO: 490271 - RNA, 15 nt, Chlamydophila pneumoniae CWL029
guaauccuaauuccu

SEQ ID NO: 490272 - RNA, 23 nt, Chlamydophila pneumoniae CWL029
guagauccuauaguaauuucucc

SEQ ID NO: 490273 - RNA, 22 nt, Chlamydophila pneumoniae CWL029
guaaaaaauacaggaaucuccu

SEQ ID NO: 490274 - RNA, 20 nt, Chlamydophila pneumoniae CWL029
guaacauuggagucuaaaaa

SEQ ID NO: 490275 - RNA, 22 nt, Chlamydophila pneumoniae CWL029
guaaacaaaagcagacgaauaa

SEQ ID NO: 490276 - RNA, 15 nt, Chlamydophila pneumoniae CWL029
gguucuaagaaaucc

SEQ ID NO: 490277 - RNA, 14 nt, Chlamydophila pneumoniae CWL029
ggcuuaggaggagg

SEQ ID NO: 490278 - RNA, 13 nt, Chlamydophila pneumoniae CWL029
gggaacgcucucu

SEQ ID NO: 490279 - RNA, 18 nt, Chlamydophila pneumoniae CWL029
ggcauagauacaaacauc

SEQ ID NO: 490280 - RNA, 21 nt, Chlamydophila pneumoniae CWL029
ggcauucuguaauuuugagaa

SEQ ID NO: 490281 - RNA, 14 nt, Chlamydophila pneumoniae CWL029
gcuuuuuucucuug

SEQ ID NO: 490282 - RNA, 18 nt, Chlamydophila pneumoniae CWL029
ggacaacagcaacacucg

SEQ ID NO: 490283 - RNA, 22 nt, Chlamydophila pneumoniae CWL029
ggaaguccauguacagaaaaua

SEQ ID NO: 490284 - RNA, 18 nt, Chlamydophila pneumoniae CWL029
ggaccagaugcuaaagag

SEQ ID NO: 490285 - RNA, 12 nt, Chlamydophila pneumoniae CWL029
gcuuucccccuc

SEQ ID NO: 490286 - RNA, 18 nt, Chlamydophila pneumoniae CWL029
gcuguuuacuuuucucuu

SEQ ID NO: 490287 - RNA, 13 nt, Chlamydophila pneumoniae CWL029
gcuguuucucugu

SEQ ID NO: 490288 - RNA, 18 nt, Chlamydophila pneumoniae CWL029
gcucucuuuaaaaaauuc

SEQ ID NO: 490289 - RNA, 14 nt, Chlamydophila pneumoniae CWL029
gcuauaaauaauua

SEQ ID NO: 490290 - RNA, 23 nt, Chlamydophila pneumoniae CWL029
gcuauggaagauaaacauacaug

SEQ ID NO: 490291 - RNA, 15 nt, Chlamydophila pneumoniae CWL029
gcguguaaaagcuua

SEQ ID NO: 490292 - RNA, 19 nt, Chlamydophila pneumoniae CWL029
gccugaugucuccauacag

SEQ ID NO: 490293 - RNA, 20 nt, Chlamydophila pneumoniae CWL029
uccuucaaaauguuuaucga

SEQ ID NO: 490294 - RNA, 15 nt, Chlamydophila pneumoniae CWL029
uccuucucagaaaga

SEQ ID NO: 490295 - RNA, 23 nt, Chlamydophila pneumoniae CWL029
uccucgcucagcuaauuuaaaug

SEQ ID NO: 490296 - RNA, 18 nt, Chlamydophila pneumoniae CWL029
ucgaagaaaauaaagauc

SEQ ID NO: 490297 - RNA, 20 nt, Chlamydophila pneumoniae CWL029
ucgacaacaacauaaagaag

SEQ ID NO: 490298 - RNA, 21 nt, Chlamydophila pneumoniae CWL029
ucgcaaaaauccgauaagaua

SEQ ID NO: 490299 - RNA, 15 nt, Chlamydophila pneumoniae CWL029
ucgauaucucuaccg

SEQ ID NO: 490300 - RNA, 19 nt, Chlamydophila pneumoniae CWL029
uccuagaagcgcuuuaugu

SEQ ID NO: 490301 - RNA, 16 nt, Chlamydophila pneumoniae CWL029
uccuauaguaauuucu

SEQ ID NO: 490302 - RNA, 16 nt, Chlamydophila pneumoniae CWL029
uccucacauguuucac

SEQ ID NO: 490303 - RNA, 22 nt, Chlamydophila pneumoniae CWL029
ucggaaaucagggauauacaau

SEQ ID NO: 490304 - RNA, 18 nt, Chlamydophila pneumoniae CWL029
ucggauuuuacucccuga

SEQ ID NO: 490305 - RNA, 15 nt, Chlamydophila pneumoniae CWL029
ugcccacagaccaaa

SEQ ID NO: 490306 - RNA, 13 nt, Chlamydophila pneumoniae CWL029
ugcaaggcaagau

SEQ ID NO: 490307 - RNA, 16 nt, Chlamydophila pneumoniae CWL029
ugauuucucuaagcag

SEQ ID NO: 490308 - RNA, 19 nt, Chlamydophila pneumoniae CWL029
ugauuuuuugaauccuguu

SEQ ID NO: 490309 - RNA, 13 nt, Chlamydophila pneumoniae CWL029
ugcaaaaaaccag

SEQ ID NO: 490310 - RNA, 15 nt, Chlamydophila pneumoniae CWL029
ugaugccaagaaaua

SEQ ID NO: 490311 - RNA, 17 nt, Chlamydophila pneumoniae CWL029
ugauccuugcaaaacag

SEQ ID NO: 490312 - RNA, 16 nt, Chlamydophila pneumoniae CWL029
ugauguugcccuacaa

SEQ ID NO: 490313 - RNA, 16 nt, Chlamydophila pneumoniae CWL029
ugauuauuucuaaaaa

SEQ ID NO: 490314 - RNA, 21 nt, Chlamydophila pneumoniae CWL029
ugagaaaaguugccuaaagag

SEQ ID NO: 490315 - RNA, 20 nt, Chlamydophila pneumoniae CWL029
ugacuuuuguugcaauucca

SEQ ID NO: 490316 - RNA, 17 nt, Chlamydophila pneumoniae CWL029
ugacucuuauugcagaa

SEQ ID NO: 490317 - RNA, 13 nt, Chlamydophila pneumoniae CWL029
ugaaucucuucug

SEQ ID NO: 490318 - RNA, 21 nt, Chlamydophila pneumoniae CWL029
ugaauccaugggaucucauca

SEQ ID NO: 490319 - RNA, 18 nt, Chlamydophila pneumoniae CWL029
ugacacagcuaaucaauc

SEQ ID NO: 490320 - RNA, 17 nt, Chlamydophila pneumoniae CWL029
ugaagaacaaaaaauca

SEQ ID NO: 490321 - RNA, 16 nt, Chlamydophila pneumoniae CWL029
ugaagauauuaucgau

SEQ ID NO: 490322 - RNA, 17 nt, Chlamydophila pneumoniae CWL029
ugaagggacagucuccu

SEQ ID NO: 490323 - RNA, 13 nt, Chlamydophila pneumoniae CWL029
ucuugaagagauu

SEQ ID NO: 490324 - RNA, 21 nt, Chlamydophila pneumoniae CWL029
ucuuguaagacuaaaaaagag

SEQ ID NO: 490325 - RNA, 15 nt, Chlamydophila pneumoniae CWL029
ucuugauucucuucc

SEQ ID NO: 490326 - RNA, 21 nt, Chlamydophila pneumoniae CWL029
ucuguuuuuugaaaacuucaa

SEQ ID NO: 490327 - RNA, 13 nt, Chlamydophila pneumoniae CWL029
ucuuaaaaacuac

SEQ ID NO: 490328 - RNA, 19 nt, Chlamydophila pneumoniae CWL029
ucuuugcgaacgaagacuu

SEQ ID NO: 490329 - RNA, 13 nt, Chlamydophila pneumoniae CWL029
ucuuuaaaaauag

SEQ ID NO: 490330 - RNA, 18 nt, Chlamydophila pneumoniae CWL029
ugaaaaggauugcacuca

SEQ ID NO: 490331 - RNA, 19 nt, Chlamydophila pneumoniae CWL029
aauacguaccguauccucu

SEQ ID NO: 490332 - RNA, 13 nt, Chlamydophila pneumoniae CWL029
ucuguauccgacu

SEQ ID NO: 490333 - RNA, 13 nt, Chlamydophila pneumoniae CWL029
ucuccuggaacag

SEQ ID NO: 490334 - RNA, 17 nt, Chlamydophila pneumoniae CWL029
ucucgaaauccuaaaaa

SEQ ID NO: 490335 - RNA, 16 nt, Chlamydophila pneumoniae CWL029
ucuaaagauuucguau

SEQ ID NO: 490336 - RNA, 15 nt, Chlamydophila pneumoniae CWL029
ucuaagaaucguucu

SEQ ID NO: 490337 - RNA, 18 nt, Chlamydophila pneumoniae CWL029
ucuaaggacaaaucuccc

SEQ ID NO: 490338 - RNA, 16 nt, Chlamydophila pneumoniae CWL029
ucuagagauuuuucua

SEQ ID NO: 490339 - RNA, 14 nt, Chlamydophila pneumoniae CWL029
ucuaccuguagcua

SEQ ID NO: 490340 - RNA, 20 nt, Chlamydophila pneumoniae CWL029
ucuaccgaacagagcgucua

SEQ ID NO: 490341 - RNA, 18 nt, Chlamydophila pneumoniae CWL029
ucuaugagaguaaguuuu

SEQ ID NO: 490342 - RNA, 19 nt, Chlamydophila pneumoniae CWL029
ucuauggacuaaacaagaa

SEQ ID NO: 490343 - RNA, 14 nt, Chlamydophila pneumoniae CWL029
ucuauuagauuucc

SEQ ID NO: 490344 - RNA, 19 nt, Chlamydophila pneumoniae CWL029
ucuccguuaccaaaaacug

SEQ ID NO: 490345 - RNA, 19 nt, Chlamydophila pneumoniae CWL029
ucuccugaaccgcaaaaag

SEQ ID NO: 490346 - RNA, 16 nt, Chlamydophila pneumoniae CWL029
ucguuuccgaucauuu

SEQ ID NO: 490347 - RNA, 13 nt, Chlamydophila pneumoniae CWL029
ucgugcaggagaa

SEQ ID NO: 490348 - RNA, 19 nt, Chlamydophila pneumoniae CWL029
ucguaaugcccgauauccu

SEQ ID NO: 490349 - RNA, 17 nt, Chlamydophila pneumoniae CWL029
uccauucugagaaagaa

SEQ ID NO: 490350 - RNA, 16 nt, Chlamydophila pneumoniae CWL029
uccauuggcauagagc

SEQ ID NO: 490351 - RNA, 22 nt, Chlamydophila pneumoniae CWL029
uccagcuccauaagcuuuucuu

SEQ ID NO: 490352 - RNA, 19 nt, Chlamydophila pneumoniae CWL029
uccacagagaccuucucuu

SEQ ID NO: 490353 - RNA, 15 nt, Chlamydophila pneumoniae CWL029
uccagacaagacacu

SEQ ID NO: 490354 - RNA, 13 nt, Chlamydophila pneumoniae CWL029
uccagcagcaaau

SEQ ID NO: 490355 - RNA, 14 nt, Chlamydophila pneumoniae CWL029
ucauuaagauccuu

SEQ ID NO: 490356 - RNA, 15 nt, Chlamydophila pneumoniae CWL029
uccaagaguucucuu

SEQ ID NO: 490357 - RNA, 12 nt, Chlamydophila pneumoniae CWL029
uccaagaucucc

SEQ ID NO: 490358 - RNA, 19 nt, Chlamydophila pneumoniae CWL029
uccaauaggccagaaugua

SEQ ID NO: 490359 - RNA, 12 nt, Chlamydophila pneumoniae CWL029
uccaaaaaagag

SEQ ID NO: 490360 - RNA, 18 nt, Chlamydophila pneumoniae CWL029
uccaaaaacgauucgaaa

SEQ ID NO: 490361 - RNA, 12 nt, Chlamydophila pneumoniae CWL029
ucauccucauca

SEQ ID NO: 490362 - RNA, 15 nt, Chlamydophila pneumoniae CWL029
ucauaaccaaaagaa

SEQ ID NO: 490363 - RNA, 13 nt, Chlamydophila pneumoniae CWL029
ucauaagauuucc

SEQ ID NO: 490364 - RNA, 16 nt, Chlamydophila pneumoniae CWL029
ucagaaacaugaaguu

SEQ ID NO: 490365 - RNA, 23 nt, Chlamydophila pneumoniae CWL029
ucacaauuuuaaaaucuccucuc

SEQ ID NO: 490366 - RNA, 12 nt, Chlamydophila pneumoniae CWL029
aauaaucuucaa

SEQ ID NO: 490367 - RNA, 17 nt, Chlamydophila pneumoniae CWL029
ucaggacaaugaagaac

SEQ ID NO: 490368 - RNA, 17 nt, Chlamydophila pneumoniae CWL029
ucacaaacaacagaaau

SEQ ID NO: 490369 - RNA, 15 nt, Chlamydophila pneumoniae CWL029
ucaagacuauagaaa

SEQ ID NO: 490370 - RNA, 20 nt, Chlamydophila pneumoniae CWL029
ucaagagcucguaauccuuc

SEQ ID NO: 490371 - RNA, 20 nt, Chlamydophila pneumoniae CWL029
ucaagaggcuguccuugcag

SEQ ID NO: 490372 - RNA, 15 nt, Chlamydophila pneumoniae CWL029
ucaaccauaaagaau

SEQ ID NO: 490373 - RNA, 20 nt, Chlamydophila pneumoniae CWL029
ucaacugguauagacuccuu

SEQ ID NO: 490374 - RNA, 19 nt, Chlamydophila pneumoniae CWL029
uauuguguucccucuucuu

SEQ ID NO: 490375 - RNA, 17 nt, Chlamydophila pneumoniae CWL029
uaucuacagcuauagaa

SEQ ID NO: 490376 - RNA, 14 nt, Chlamydophila pneumoniae CWL029
uaucuaagacuucu

SEQ ID NO: 490377 - RNA, 23 nt, Chlamydophila pneumoniae CWL029
uaucugagcauaacuugaagaag

SEQ ID NO: 490378 - RNA, 22 nt, Chlamydophila pneumoniae CWL029
uaucuuuacuaacaaaauuucu

SEQ ID NO: 490379 - RNA, 13 nt, Chlamydophila pneumoniae CWL029
uaucuuagggaau

SEQ ID NO: 490380 - RNA, 14 nt, Chlamydophila pneumoniae CWL029
uauuacagauuucu

SEQ ID NO: 490381 - RNA, 13 nt, Chlamydophila pneumoniae CWL029
uauuaucuuguuu

SEQ ID NO: 490382 - RNA, 16 nt, Chlamydophila pneumoniae CWL029
uauaccuauauagaga

SEQ ID NO: 490383 - RNA, 15 nt, Chlamydophila pneumoniae CWL029
uauacgguaaugcca

SEQ ID NO: 490384 - RNA, 20 nt, Chlamydophila pneumoniae CWL029
uauaugcuacaaacucuucc

SEQ ID NO: 490385 - RNA, 21 nt, Chlamydophila pneumoniae CWL029
uagggacuucucaaagacaau

SEQ ID NO: 490386 - RNA, 14 nt, Chlamydophila pneumoniae CWL029
uauccuauuggaag

SEQ ID NO: 490387 - RNA, 22 nt, Chlamydophila pneumoniae CWL029
uaucagcuggguaaguccacaa

SEQ ID NO: 490388 - RNA, 20 nt, Chlamydophila pneumoniae CWL029
uaucagggagcggaauuucu

SEQ ID NO: 490389 - RNA, 14 nt, Chlamydophila pneumoniae CWL029
aauaaaagaacauu

SEQ ID NO: 490390 - RNA, 15 nt, Chlamydophila pneumoniae CWL029
aauaaaccacgaauu

SEQ ID NO: 490391 - RNA, 16 nt, Chlamydophila pneumoniae CWL029
aaguuuuuuauuuucu

SEQ ID NO: 490392 - RNA, 18 nt, Chlamydophila pneumoniae CWL029
aaguuuugcucucuagau

SEQ ID NO: 490393 - RNA, 14 nt, Chlamydophila pneumoniae CWL029
uaggauuuagacua

SEQ ID NO: 490394 - RNA, 15 nt, Chlamydophila pneumoniae CWL029
uaggaacaaagccaa

SEQ ID NO: 490395 - RNA, 18 nt, Chlamydophila pneumoniae CWL029
uaggaacuugaauaccaa

SEQ ID NO: 490396 - RNA, 22 nt, Chlamydophila pneumoniae CWL029
uagccuggaggcgguggcaugc

SEQ ID NO: 490397 - RNA, 18 nt, Chlamydophila pneumoniae CWL029
uagcaggaaggaauagag

SEQ ID NO: 490398 - RNA, 20 nt, Chlamydophila pneumoniae CWL029
uagcaaacggaacuaaagag

SEQ ID NO: 490399 - RNA, 17 nt, Chlamydophila pneumoniae CWL029
uagcucuggagauugcu

SEQ ID NO: 490400 - RNA, 17 nt, Chlamydophila pneumoniae CWL029
uacucuugcuugcuagg

SEQ ID NO: 490401 - RNA, 22 nt, Chlamydophila pneumoniae CWL029
uacugccagcgaucacauagaa

SEQ ID NO: 490402 - RNA, 13 nt, Chlamydophila pneumoniae CWL029
uagauuuccuccg

SEQ ID NO: 490403 - RNA, 17 nt, Chlamydophila pneumoniae CWL029
uagauuuguuagagcuu

SEQ ID NO: 490404 - RNA, 23 nt, Chlamydophila pneumoniae CWL029
uagacgauucuaggccuaaagaa

SEQ ID NO: 490405 - RNA, 13 nt, Chlamydophila pneumoniae CWL029
uagacaagacacc

SEQ ID NO: 490406 - RNA, 17 nt, Chlamydophila pneumoniae CWL029
uacgaauccaaaaaaga

SEQ ID NO: 490407 - RNA, 13 nt, Chlamydophila pneumoniae CWL029
uacgaauccaaaa

SEQ ID NO: 490408 - RNA, 14 nt, Chlamydophila pneumoniae CWL029
uacgauccaucuca

SEQ ID NO: 490409 - RNA, 17 nt, Chlamydophila pneumoniae CWL029
uacaaucccgaguccua

SEQ ID NO: 490410 - RNA, 17 nt, Chlamydophila pneumoniae CWL029
uacaaucgccuuacaau

SEQ ID NO: 490411 - RNA, 23 nt, Chlamydophila pneumoniae CWL029
uacacccaggaaacuagauuucu

SEQ ID NO: 490412 - RNA, 15 nt, Chlamydophila pneumoniae CWL029
uacaucuuaagagca

SEQ ID NO: 490413 - RNA, 13 nt, Chlamydophila pneumoniae CWL029
uacauccucacua

SEQ ID NO: 490414 - RNA, 17 nt, Chlamydophila pneumoniae CWL029
uacagauaggguaagau

SEQ ID NO: 490415 - RNA, 22 nt, Chlamydophila pneumoniae CWL029
uacagaaagagcuaaagaaacu

SEQ ID NO: 490416 - RNA, 16 nt, Chlamydophila pneumoniae CWL029
uaagugacuuuucuuc

SEQ ID NO: 490417 - RNA, 22 nt, Chlamydophila pneumoniae CWL029
uaacgauuucuugaagaucucc

SEQ ID NO: 490418 - RNA, 17 nt, Chlamydophila pneumoniae CWL029
uaaaccuucagauccga

SEQ ID NO: 490419 - RNA, 20 nt, Chlamydophila pneumoniae CWL029
uaaaaccagcauaaucagua

SEQ ID NO: 490420 - RNA, 13 nt, Chlamydophila pneumoniae CWL029
uaaaaaaguccua

SEQ ID NO: 490421 - RNA, 17 nt, Chlamydophila pneumoniae CWL029
guuuucguaagagaauu

SEQ ID NO: 490422 - RNA, 22 nt, Chlamydophila pneumoniae CWL029
guuuuccccuuggaaaucagaa

SEQ ID NO: 490423 - RNA, 15 nt, Chlamydophila pneumoniae CWL029
guuuugcucucuaga

SEQ ID NO: 490424 - RNA, 17 nt, Chlamydophila pneumoniae CWL029
guuuucucgaagaaaau

SEQ ID NO: 490425 - RNA, 14 nt, Chlamydophila pneumoniae CWL029
guuuuaacucuaga

SEQ ID NO: 490426 - RNA, 16 nt, Chlamydophila pneumoniae CWL029
guuucguaagagaauu

SEQ ID NO: 490427 - RNA, 21 nt, Chlamydophila pneumoniae CWL029
guuguagugaaugagcuucac

SEQ ID NO: 490428 - RNA, 15 nt, Chlamydophila pneumoniae CWL029
guugccaaucuuuca

SEQ ID NO: 490429 - RNA, 14 nt, Chlamydophila pneumoniae CWL029
guugcaauucuuca

SEQ ID NO: 490430 - RNA, 17 nt, Chlamydophila pneumoniae CWL029
guucuuucaauaacaga

SEQ ID NO: 490431 - RNA, 22 nt, Chlamydophila pneumoniae CWL029
aaguugaaaugagugagaaugc

SEQ ID NO: 490432 - RNA, 19 nt, Chlamydophila pneumoniae CWL029
guuaugaagcuucuuuaau

SEQ ID NO: 490433 - RNA, 23 nt, Chlamydophila pneumoniae CWL029
guuccacagagaccuucucuuca

SEQ ID NO: 490434 - RNA, 12 nt, Chlamydophila pneumoniae CWL029
guuccaaaucuc

SEQ ID NO: 490435 - RNA, 22 nt, Chlamydophila pneumoniae CWL029
guggaucagaaaaaaugcguuu

SEQ ID NO: 490436 - RNA, 15 nt, Chlamydophila pneumoniae CWL029
gugcggcucucuuca

SEQ ID NO: 490437 - RNA, 16 nt, Chlamydophila pneumoniae CWL029
gugcauuaucuaagaa

SEQ ID NO: 490438 - RNA, 17 nt, Chlamydophila pneumoniae CWL029
ugcucacuguuuuucgu

SEQ ID NO: 490439 - RNA, 22 nt, Chlamydophila pneumoniae CWL029
ugcucuagaaaacgcucuccua

SEQ ID NO: 490440 - RNA, 22 nt, Chlamydophila pneumoniae CWL029
ugcucuagucuuucaaccuccg

SEQ ID NO: 490441 - RNA, 18 nt, Chlamydophila pneumoniae CWL029
ugcuaucuccagaaauuu

SEQ ID NO: 490442 - RNA, 12 nt, Chlamydophila pneumoniae CWL029
uggaucagaaaa

SEQ ID NO: 490443 - RNA, 19 nt, Chlamydophila pneumoniae CWL029
ugcgcaaagaacucaacuu

SEQ ID NO: 490444 - RNA, 18 nt, Chlamydophila pneumoniae CWL029
uguccagagacaaagcca

SEQ ID NO: 490445 - RNA, 13 nt, Chlamydophila pneumoniae CWL029
uguauuaaagaau

SEQ ID NO: 490446 - RNA, 22 nt, Chlamydophila pneumoniae CWL029
uguaacucuuaagaauaaaaua

SEQ ID NO: 490447 - RNA, 14 nt, Chlamydophila pneumoniae CWL029
uggcauagcgaaag

SEQ ID NO: 490448 - RNA, 16 nt, Chlamydophila pneumoniae CWL029
uggcaguuuuaaugag

SEQ ID NO: 490449 - RNA, 13 nt, Chlamydophila pneumoniae CWL029
uggcguucaggau

SEQ ID NO: 490450 - RNA, 18 nt, Chlamydophila pneumoniae CWL029
ugggaaggucuuuucgca

SEQ ID NO: 490451 - RNA, 21 nt, Chlamydophila pneumoniae CWL029
ugggaauuguucuugaaguuc

SEQ ID NO: 490452 - RNA, 18 nt, Chlamydophila pneumoniae CWL029
aauuagagaaauuuuuaa

SEQ ID NO: 490453 - RNA, 16 nt, Chlamydophila pneumoniae CWL029
aauuaguaaaugccuc

SEQ ID NO: 490454 - RNA, 13 nt, Chlamydophila pneumoniae CWL029
aauuccaaaauaa

SEQ ID NO: 490455 - RNA, 17 nt, Chlamydophila pneumoniae CWL029
aauuccuaaaacaagaa

SEQ ID NO: 490456 - RNA, 12 nt, Chlamydophila pneumoniae CWL029
aauucaaaauca

SEQ ID NO: 490457 - RNA, 15 nt, Chlamydophila pneumoniae CWL029
aauucgguagagcua

SEQ ID NO: 490458 - RNA, 21 nt, Chlamydophila pneumoniae CWL029
aauugcaaaguacuacaauaa

SEQ ID NO: 490459 - RNA, 23 nt, Chlamydophila pneumoniae CWL029
aaugcaaaccaaaaaaguaacua

SEQ ID NO: 490460 - RNA, 22 nt, Chlamydophila pneumoniae CWL029
uuuugucgcaauaacaaacgcc

SEQ ID NO: 490461 - RNA, 13 nt, Chlamydophila pneumoniae CWL029
uuuuaaauacaga

SEQ ID NO: 490462 - RNA, 22 nt, Chlamydophila pneumoniae CWL029
uuucuagaaugaugcaagcaga

SEQ ID NO: 490463 - RNA, 22 nt, Chlamydophila pneumoniae CWL029
uuucuauaauaaccuccauaga

SEQ ID NO: 490464 - RNA, 14 nt, Chlamydophila pneumoniae CWL029
uuucguuuucuagc

SEQ ID NO: 490465 - RNA, 20 nt, Chlamydophila pneumoniae CWL029
uuucuaaauagaaaacauag

SEQ ID NO: 490466 - RNA, 22 nt, Chlamydophila pneumoniae CWL029
uuucgucaaagguuuuaaaaug

SEQ ID NO: 490467 - RNA, 14 nt, Chlamydophila pneumoniae CWL029
uuuucagaaagcga

SEQ ID NO: 490468 - RNA, 14 nt, Chlamydophila pneumoniae CWL029
uuuucucugagcag

SEQ ID NO: 490469 - RNA, 12 nt, Chlamydophila pneumoniae CWL029
uuuucugaagau

SEQ ID NO: 490470 - RNA, 20 nt, Chlamydophila pneumoniae CWL029
uuuucucaauaguguaacau

SEQ ID NO: 490471 - RNA, 21 nt, Chlamydophila pneumoniae CWL029
uuuucucgaagaaaauaaaga

SEQ ID NO: 490472 - RNA, 21 nt, Chlamydophila pneumoniae CWL029
uuuugauucccuccuuccuua

SEQ ID NO: 490473 - RNA, 15 nt, Chlamydophila pneumoniae CWL029
uuuccuaguccucua

SEQ ID NO: 490474 - RNA, 22 nt, Chlamydophila pneumoniae CWL029
uuuccuccaaauacgaacugua

SEQ ID NO: 490475 - RNA, 16 nt, Chlamydophila pneumoniae CWL029
uuuccaacuucaacuu

SEQ ID NO: 490476 - RNA, 21 nt, Chlamydophila pneumoniae CWL029
uuucgcacgcaacaucucaca

SEQ ID NO: 490477 - RNA, 14 nt, Chlamydophila pneumoniae CWL029
uuuaucaugagaau

SEQ ID NO: 490478 - RNA, 12 nt, Chlamydophila pneumoniae CWL029
uuguuagcaucg

SEQ ID NO: 490479 - RNA, 21 nt, Chlamydophila pneumoniae CWL029
uuuagcaaucucuuucacaaa

SEQ ID NO: 490480 - RNA, 13 nt, Chlamydophila pneumoniae CWL029
uuuagacaagaca

SEQ ID NO: 490481 - RNA, 13 nt, Chlamydophila pneumoniae CWL029
uuuaggaagcugu

SEQ ID NO: 490482 - RNA, 23 nt, Chlamydophila pneumoniae CWL029
uuguaggaacaugccaaauaucu

SEQ ID NO: 490483 - RNA, 11 nt, Chlamydophila pneumoniae CWL029
uugcugaagau

SEQ ID NO: 490484 - RNA, 23 nt, Chlamydophila pneumoniae CWL029
uugcgauaucuauaaauguaggg

SEQ ID NO: 490485 - RNA, 17 nt, Chlamydophila pneumoniae CWL029
uugaggauuucuugcaa

SEQ ID NO: 490486 - RNA, 10 nt, Chlamydophila pneumoniae CWL029
uugagcucuc

SEQ ID NO: 490487 - RNA, 17 nt, Chlamydophila pneumoniae CWL029
uugaauuaauaaaagag

SEQ ID NO: 490488 - RNA, 15 nt, Chlamydophila pneumoniae CWL029
uucuuuaagauuucc

SEQ ID NO: 490489 - RNA, 16 nt, Chlamydophila pneumoniae CWL029
uucugcagcgugaaua

SEQ ID NO: 490490 - RNA, 14 nt, Chlamydophila pneumoniae CWL029
uucuugaaaaaucc

SEQ ID NO: 490491 - RNA, 13 nt, Chlamydophila pneumoniae CWL029
uucuuucaaacca

SEQ ID NO: 490492 - RNA, 20 nt, Chlamydophila pneumoniae CWL029
uucuuugccguauagauuuu

SEQ ID NO: 490493 - RNA, 13 nt, Chlamydophila pneumoniae CWL029
uucuuuuccugca

SEQ ID NO: 490494 - RNA, 18 nt, Chlamydophila pneumoniae CWL029
uucucauagcuuccugua

SEQ ID NO: 490495 - RNA, 18 nt, Chlamydophila pneumoniae CWL029
uucucuaagcagccucuu

SEQ ID NO: 490496 - RNA, 17 nt, Chlamydophila pneumoniae CWL029
uuccugaggcuauagaa

SEQ ID NO: 490497 - RNA, 17 nt, Chlamydophila pneumoniae CWL029
uucauaaagaggaauga

SEQ ID NO: 490498 - RNA, 14 nt, Chlamydophila pneumoniae CWL029
uuccuggucuccag

SEQ ID NO: 490499 - RNA, 14 nt, Chlamydophila pneumoniae CWL029
uucaagaacuccuu

SEQ ID NO: 490500 - RNA, 17 nt, Chlamydophila pneumoniae CWL029
uucaccauauaauagau

SEQ ID NO: 490501 - RNA, 22 nt, Chlamydophila pneumoniae CWL029
uucaauaagaucucgugaauua

SEQ ID NO: 490502 - RNA, 19 nt, Chlamydophila pneumoniae CWL029
uucaauagcaaagauuucu

SEQ ID NO: 490503 - RNA, 19 nt, Chlamydophila pneumoniae CWL029
uucagcagguucuugaauc

SEQ ID NO: 490504 - RNA, 17 nt, Chlamydophila pneumoniae CWL029
uuacugaggaaaucgca

SEQ ID NO: 490505 - RNA, 20 nt, Chlamydophila pneumoniae CWL029
uuacugugguauacauccca

SEQ ID NO: 490506 - RNA, 17 nt, Chlamydophila pneumoniae CWL029
uuauggauuaucuuagg

SEQ ID NO: 490507 - RNA, 21 nt, Chlamydophila pneumoniae CWL029
uuauguagaucuacaagacua

SEQ ID NO: 490508 - RNA, 19 nt, Chlamydophila pneumoniae CWL029
uuauuauguagaucauaaa

SEQ ID NO: 490509 - RNA, 23 nt, Chlamydophila pneumoniae CWL029
uguuaacaaguaccaagaaaaua

SEQ ID NO: 490510 - RNA, 22 nt, Chlamydophila pneumoniae CWL029
uguuaagauguggucuuccgua

SEQ ID NO: 490511 - RNA, 18 nt, Chlamydophila pneumoniae CWL029
uuaaguugaccuuuuuca

SEQ ID NO: 490512 - RNA, 18 nt, Chlamydophila pneumoniae CWL029
uguuuuagauggaucuau

SEQ ID NO: 490513 - RNA, 19 nt, Chlamydophila pneumoniae CWL029
uguuuauuaucuacagaga

SEQ ID NO: 490514 - RNA, 22 nt, Chlamydophila pneumoniae CWL029
uguuucaaacaauaguaaagca

SEQ ID NO: 490515 - RNA, 23 nt, Chlamydophila pneumoniae CWL029
acuucuccacagcuucuucguaa

SEQ ID NO: 490516 - RNA, 15 nt, Chlamydophila pneumoniae CWL029
acuugcccaaaaguu

SEQ ID NO: 490517 - RNA, 17 nt, Chlamydophila pneumoniae CWL029
acuuaggaauuuuucua

SEQ ID NO: 490518 - RNA, 15 nt, Chlamydophila pneumoniae CWL029
acuucggaugagauc

SEQ ID NO: 490519 - RNA, 14 nt, Chlamydophila pneumoniae CWL029
acucuaagcgaaac

SEQ ID NO: 490520 - RNA, 19 nt, Chlamydophila pneumoniae CWL029
acucuuaaagguaaagcuu

SEQ ID NO: 490521 - RNA, 21 nt, Chlamydophila pneumoniae CWL029
acucuuccaauuguaaaucau

SEQ ID NO: 490522 - RNA, 20 nt, Chlamydophila pneumoniae CWL029
acggacuucacaaagaacca

SEQ ID NO: 490523 - RNA, 21 nt, Chlamydophila pneumoniae CWL029
acgcaaaguacuaauuacaga

SEQ ID NO: 490524 - RNA, 14 nt, Chlamydophila pneumoniae CWL029
acgaccaacuccuc

SEQ ID NO: 490525 - RNA, 18 nt, Chlamydophila pneumoniae CWL029
acccuucagaauucucaa

SEQ ID NO: 490526 - RNA, 20 nt, Chlamydophila pneumoniae CWL029
accgaugauaccaagaugaa

SEQ ID NO: 490527 - RNA, 21 nt, Chlamydophila pneumoniae CWL029
accguaacugaggcaaagauu

SEQ ID NO: 490528 - RNA, 20 nt, Chlamydophila pneumoniae CWL029
accaucaagguauuggaauc

SEQ ID NO: 490529 - RNA, 22 nt, Chlamydophila pneumoniae CWL029
accacgaacuucagcaagaaaa

SEQ ID NO: 490530 - RNA, 19 nt, Chlamydophila pneumoniae CWL029
accacgcaucuuaagagaa

SEQ ID NO: 490531 - RNA, 13 nt, Chlamydophila pneumoniae CWL029
acaucaucagaag

SEQ ID NO: 490532 - RNA, 14 nt, Chlamydophila pneumoniae CWL029
acaucacuaucaug

SEQ ID NO: 490533 - RNA, 18 nt, Chlamydophila pneumoniae CWL029
acagaugcuucaaggcau

SEQ ID NO: 490534 - RNA, 12 nt, Chlamydophila pneumoniae CWL029
acagauuuuuca

SEQ ID NO: 490535 - RNA, 20 nt, Chlamydophila pneumoniae CWL029
acagagucugggauguucaa

SEQ ID NO: 490536 - RNA, 14 nt, Chlamydophila pneumoniae CWL029
acagcauaaaaauu

SEQ ID NO: 490537 - RNA, 16 nt, Chlamydophila pneumoniae CWL029
acacuuucaagauugu

SEQ ID NO: 490538 - RNA, 19 nt, Chlamydophila pneumoniae CWL029
acacuuucuuuaaagaaua

SEQ ID NO: 490539 - RNA, 14 nt, Chlamydophila pneumoniae CWL029
aauuugcuccucca

SEQ ID NO: 490540 - RNA, 23 nt, Chlamydophila pneumoniae CWL029
aucuucaucacaaaauucaugca

SEQ ID NO: 490541 - RNA, 23 nt, Chlamydophila pneumoniae CWL029
aucuuaagagcaaacaucaaaga

SEQ ID NO: 490542 - RNA, 16 nt, Chlamydophila pneumoniae CWL029
aucuugagcauccaaa

SEQ ID NO: 490543 - RNA, 13 nt, Chlamydophila pneumoniae CWL029
aucuugaaaagau

SEQ ID NO: 490544 - RNA, 14 nt, Chlamydophila pneumoniae CWL029
aucuuguacauccu

SEQ ID NO: 490545 - RNA, 21 nt, Chlamydophila pneumoniae CWL029
aucuguaagaaaaugaggaca

SEQ ID NO: 490546 - RNA, 14 nt, Chlamydophila pneumoniae CWL029
aucuguauccuucc

SEQ ID NO: 490547 - RNA, 14 nt, Chlamydophila pneumoniae CWL029
aucugcugaaggga

SEQ ID NO: 490548 - RNA, 18 nt, Chlamydophila pneumoniae CWL029
aucuaaucaauucgcuca

SEQ ID NO: 490549 - RNA, 21 nt, Chlamydophila pneumoniae CWL029
aucuauagucuguuuuggaaa

SEQ ID NO: 490550 - RNA, 17 nt, Chlamydophila pneumoniae CWL029
aucuccggaacgcagag

SEQ ID NO: 490551 - RNA, 14 nt, Chlamydophila pneumoniae CWL029
aucuccuucaugca

SEQ ID NO: 490552 - RNA, 22 nt, Chlamydophila pneumoniae CWL029
aucuaagaacuagaaaaaaucc

SEQ ID NO: 490553 - RNA, 18 nt, Chlamydophila pneumoniae CWL029
aucuaagauccugagacc

SEQ ID NO: 490554 - RNA, 17 nt, Chlamydophila pneumoniae CWL029
aucuacaaacagauuuu

SEQ ID NO: 490555 - RNA, 16 nt, Chlamydophila pneumoniae CWL029
aucgucuccaaaaauu

SEQ ID NO: 490556 - RNA, 18 nt, Chlamydophila pneumoniae CWL029
aucgugaaguacauuauc

SEQ ID NO: 490557 - RNA, 14 nt, Chlamydophila pneumoniae CWL029
augcaguucuuguu

SEQ ID NO: 490558 - RNA, 14 nt, Chlamydophila pneumoniae CWL029
augcaucaagagau

SEQ ID NO: 490559 - RNA, 16 nt, Chlamydophila pneumoniae CWL029
augauccgaaaacucu

SEQ ID NO: 490560 - RNA, 12 nt, Chlamydophila pneumoniae CWL029
aucuuucuucua

SEQ ID NO: 490561 - RNA, 13 nt, Chlamydophila pneumoniae CWL029
aucuuuauuuaaa

SEQ ID NO: 490562 - RNA, 17 nt, Chlamydophila pneumoniae CWL029
aucuuuaaaaggccgau

SEQ ID NO: 490563 - RNA, 13 nt, Chlamydophila pneumoniae CWL029
augaaaaucugcu

SEQ ID NO: 490564 - RNA, 14 nt, Chlamydophila pneumoniae CWL029
augaagaaaaaucu

SEQ ID NO: 490565 - RNA, 18 nt, Chlamydophila pneumoniae CWL029
auccuuucacaaagaauu

SEQ ID NO: 490566 - RNA, 23 nt, Chlamydophila pneumoniae CWL029
auccuugauuuuaaaaugaccgc

SEQ ID NO: 490567 - RNA, 21 nt, Chlamydophila pneumoniae CWL029
aucgaaaaauaccucagaaau

SEQ ID NO: 490568 - RNA, 20 nt, Chlamydophila pneumoniae CWL029
auccugcauacccuucuucu

SEQ ID NO: 490569 - RNA, 16 nt, Chlamydophila pneumoniae CWL029
auccucggcaucuuug

SEQ ID NO: 490570 - RNA, 19 nt, Chlamydophila pneumoniae CWL029
aucgacaccuauaccaaau

SEQ ID NO: 490571 - RNA, 13 nt, Chlamydophila pneumoniae CWL029
aucccuucuucuu

SEQ ID NO: 490572 - RNA, 16 nt, Chlamydophila pneumoniae CWL029
auugcuugcgcagcuu

SEQ ID NO: 490573 - RNA, 20 nt, Chlamydophila pneumoniae CWL029
auugaguuccgaauaggcau

SEQ ID NO: 490574 - RNA, 20 nt, Chlamydophila pneumoniae CWL029
auugaccugcuuuuuuucua

SEQ ID NO: 490575 - RNA, 24 nt, Chlamydophila pneumoniae CWL029
auugcaacuuugggcucgagaaau

SEQ ID NO: 490576 - RNA, 17 nt, Chlamydophila pneumoniae CWL029
auugcagguagauccua

SEQ ID NO: 490577 - RNA, 21 nt, Chlamydophila pneumoniae CWL029
auuccuagccaucgcgaagcu

SEQ ID NO: 490578 - RNA, 20 nt, Chlamydophila pneumoniae CWL029
auuccuucucagaaagauau

SEQ ID NO: 490579 - RNA, 16 nt, Chlamydophila pneumoniae CWL029
auucgcugucuagaac

SEQ ID NO: 490580 - RNA, 21 nt, Chlamydophila pneumoniae CWL029
auucuggagucgagcagaaau

SEQ ID NO: 490581 - RNA, 15 nt, Chlamydophila pneumoniae CWL029
auucugagaaagaag

SEQ ID NO: 490582 - RNA, 23 nt, Chlamydophila pneumoniae CWL029
auucuauuuauuuuauuaguuuu

SEQ ID NO: 490583 - RNA, 14 nt, Chlamydophila pneumoniae CWL029
auucucgaaaaauu

SEQ ID NO: 490584 - RNA, 21 nt, Chlamydophila pneumoniae CWL029
auucccuaacaggaaagaaua

SEQ ID NO: 490585 - RNA, 18 nt, Chlamydophila pneumoniae CWL029
auuauguagaucauaaac

SEQ ID NO: 490586 - RNA, 23 nt, Chlamydophila pneumoniae CWL029
auuaucuuguaaacgagcuuuau

SEQ ID NO: 490587 - RNA, 16 nt, Chlamydophila pneumoniae CWL029
auguauuguguucccu

SEQ ID NO: 490588 - RNA, 21 nt, Chlamydophila pneumoniae CWL029
augucacucuagaaaauauuc

SEQ ID NO: 490589 - RNA, 13 nt, Chlamydophila pneumoniae CWL029
auguguuuccuuu

SEQ ID NO: 490590 - RNA, 23 nt, Chlamydophila pneumoniae CWL029
auguuaaaggaauaugcucuccu

SEQ ID NO: 490591 - RNA, 13 nt, Chlamydophila pneumoniae CWL029
auggaacauccuu

SEQ ID NO: 490592 - RNA, 12 nt, Chlamydophila pneumoniae CWL029
auggaugaucuc

SEQ ID NO: 490593 - RNA, 17 nt, Chlamydophila pneumoniae CWL029
caccagcucgagaucuu

SEQ ID NO: 490594 - RNA, 24 nt, Chlamydophila pneumoniae CWL029
cacaaggagagaaaauaucacauu

SEQ ID NO: 490595 - RNA, 20 nt, Chlamydophila pneumoniae CWL029
cacaauaccaucucuuucua

SEQ ID NO: 490596 - RNA, 15 nt, Chlamydophila pneumoniae CWL029
caauggcgauaaaug

SEQ ID NO: 490597 - RNA, 23 nt, Chlamydophila pneumoniae CWL029
caaucaccguacuucccucauga

SEQ ID NO: 490598 - RNA, 13 nt, Chlamydophila pneumoniae CWL029
caauaggcaccca

SEQ ID NO: 490599 - RNA, 21 nt, Chlamydophila pneumoniae CWL029
caauauagaagcugcugcuac

SEQ ID NO: 490600 - RNA, 13 nt, Chlamydophila pneumoniae CWL029
caauaagaaaauc

SEQ ID NO: 490601 - RNA, 14 nt, Chlamydophila pneumoniae CWL029
caauaaaaugucca

SEQ ID NO: 490602 - RNA, 12 nt, Chlamydophila pneumoniae CWL029
caaguaaagaaa

SEQ ID NO: 490603 - RNA, 20 nt, Chlamydophila pneumoniae CWL029
caagucgagaaacaaaaucu

SEQ ID NO: 490604 - RNA, 14 nt, Chlamydophila pneumoniae CWL029
caagugaagacaag

SEQ ID NO: 490605 - RNA, 21 nt, Chlamydophila pneumoniae CWL029
caaaggaccacaauuccuaaa

SEQ ID NO: 490606 - RNA, 16 nt, Chlamydophila pneumoniae CWL029
caaacuaaaucaacua

SEQ ID NO: 490607 - RNA, 17 nt, Chlamydophila pneumoniae CWL029
caaauaauuaaauauau

SEQ ID NO: 490608 - RNA, 22 nt, Chlamydophila pneumoniae CWL029
caaauagcaagagcuauaccua

SEQ ID NO: 490609 - RNA, 18 nt, Chlamydophila pneumoniae CWL029
caaauugaugauuuuuua

SEQ ID NO: 490610 - RNA, 19 nt, Chlamydophila pneumoniae CWL029
aucacauuaagcucaaaau

SEQ ID NO: 490611 - RNA, 16 nt, Chlamydophila pneumoniae CWL029
aucacuuauauuuucu

SEQ ID NO: 490612 - RNA, 13 nt, Chlamydophila pneumoniae CWL029
auauggaauggcu

SEQ ID NO: 490613 - RNA, 19 nt, Chlamydophila pneumoniae CWL029
aucaaaaaaaagaccaaau

SEQ ID NO: 490614 - RNA, 14 nt, Chlamydophila pneumoniae CWL029
aucaagaagagaaa

SEQ ID NO: 490615 - RNA, 18 nt, Chlamydophila pneumoniae CWL029
aucacaauuuuaaaaucu

SEQ ID NO: 490616 - RNA, 17 nt, Chlamydophila pneumoniae CWL029
auagauuccccaaacuu

SEQ ID NO: 490617 - RNA, 14 nt, Chlamydophila pneumoniae CWL029
auagagccuccucc

SEQ ID NO: 490618 - RNA, 18 nt, Chlamydophila pneumoniae CWL029
auagagcuucuuuaucua

SEQ ID NO: 490619 - RNA, 18 nt, Chlamydophila pneumoniae CWL029
auagagcgguucuuucua

SEQ ID NO: 490620 - RNA, 14 nt, Chlamydophila pneumoniae CWL029
auagauaaaucccc

SEQ ID NO: 490621 - RNA, 16 nt, Chlamydophila pneumoniae CWL029
auagccaaagacucuu

SEQ ID NO: 490622 - RNA, 17 nt, Chlamydophila pneumoniae CWL029
auacuguugauccuucu

SEQ ID NO: 490623 - RNA, 17 nt, Chlamydophila pneumoniae CWL029
auacaucguauccaaau

SEQ ID NO: 490624 - RNA, 22 nt, Chlamydophila pneumoniae CWL029
auacguuuuuuuccuuucuuuu

SEQ ID NO: 490625 - RNA, 14 nt, Chlamydophila pneumoniae CWL029
auaaucuauaggau

SEQ ID NO: 490626 - RNA, 13 nt, Chlamydophila pneumoniae CWL029
aguuguaauuucu

SEQ ID NO: 490627 - RNA, 15 nt, Chlamydophila pneumoniae CWL029
aguuuuuaauuuucu

SEQ ID NO: 490628 - RNA, 18 nt, Chlamydophila pneumoniae CWL029
auaaaguuuguaaaaacu

SEQ ID NO: 490629 - RNA, 15 nt, Chlamydophila pneumoniae CWL029
auaaaucuauaucca

SEQ ID NO: 490630 - RNA, 19 nt, Chlamydophila pneumoniae CWL029
auaaaucuauauccacaau

SEQ ID NO: 490631 - RNA, 12 nt, Chlamydophila pneumoniae CWL029
auaaaauagccc

SEQ ID NO: 490632 - RNA, 14 nt, Chlamydophila pneumoniae CWL029
aguugauuguagag

SEQ ID NO: 490633 - RNA, 20 nt, Chlamydophila pneumoniae CWL029
aguuccauagaguaucuaaa

SEQ ID NO: 490634 - RNA, 16 nt, Chlamydophila pneumoniae CWL029
aguucaucuagaugau

SEQ ID NO: 490635 - RNA, 23 nt, Chlamydophila pneumoniae CWL029
aguguaacauugaccuaaaggaa

SEQ ID NO: 490636 - RNA, 23 nt, Chlamydophila pneumoniae CWL029
aguccuuuuuguucaaagauugc

SEQ ID NO: 490637 - RNA, 22 nt, Chlamydophila pneumoniae CWL029
aguaccucaucucuggaauaca

SEQ ID NO: 490638 - RNA, 15 nt, Chlamydophila pneumoniae CWL029
aguauuaaagaugaa

SEQ ID NO: 490639 - RNA, 14 nt, Chlamydophila pneumoniae CWL029
aguccuugaauuag

SEQ ID NO: 490640 - RNA, 16 nt, Chlamydophila pneumoniae CWL029
aguccugggguucucu

SEQ ID NO: 490641 - RNA, 22 nt, Chlamydophila pneumoniae CWL029
agguuuuaaaaugugucuugcu

SEQ ID NO: 490642 - RNA, 18 nt, Chlamydophila pneumoniae CWL029
agguuugcugcucuccaa

SEQ ID NO: 490643 - RNA, 18 nt, Chlamydophila pneumoniae CWL029
aggucugcucuauauauc

SEQ ID NO: 490644 - RNA, 18 nt, Chlamydophila pneumoniae CWL029
agggcaaccauucaucua

SEQ ID NO: 490645 - RNA, 18 nt, Chlamydophila pneumoniae CWL029
aggggcguucuugaaaaa

SEQ ID NO: 490646 - RNA, 17 nt, Chlamydophila pneumoniae CWL029
agggacagucuccugga

SEQ ID NO: 490647 - RNA, 15 nt, Chlamydophila pneumoniae CWL029
aggcuuuaaauuuuu

SEQ ID NO: 490648 - RNA, 23 nt, Chlamydophila pneumoniae CWL029
aggcugcuacgugaucaaaauua

SEQ ID NO: 490649 - RNA, 20 nt, Chlamydophila pneumoniae CWL029
aggcccccuacagcagaaac

SEQ ID NO: 490650 - RNA, 16 nt, Chlamydophila pneumoniae CWL029
aggauuccuugacuau

SEQ ID NO: 490651 - RNA, 22 nt, Chlamydophila pneumoniae CWL029
agcucucuugauugcuaucaaa

SEQ ID NO: 490652 - RNA, 17 nt, Chlamydophila pneumoniae CWL029
agcucucuugcuauacc

SEQ ID NO: 490653 - RNA, 19 nt, Chlamydophila pneumoniae CWL029
agcucuuucauaagauugc

SEQ ID NO: 490654 - RNA, 22 nt, Chlamydophila pneumoniae CWL029
agcucuuucauaagauugccau

SEQ ID NO: 490655 - RNA, 14 nt, Chlamydophila pneumoniae CWL029
agcuccuuggcuau

SEQ ID NO: 490656 - RNA, 17 nt, Chlamydophila pneumoniae CWL029
agcucccucuagagcuu

SEQ ID NO: 490657 - RNA, 16 nt, Chlamydophila pneumoniae CWL029
agcucaucuagaaaga

SEQ ID NO: 490658 - RNA, 20 nt, Chlamydophila pneumoniae CWL029
agcuaaauuguuaucaggaa

SEQ ID NO: 490659 - RNA, 18 nt, Chlamydophila pneumoniae CWL029
agcguuuuuugaaaauuu

SEQ ID NO: 490660 - RNA, 23 nt, Chlamydophila pneumoniae CWL029
agauucccugcggacagaaacug

SEQ ID NO: 490661 - RNA, 13 nt, Chlamydophila pneumoniae CWL029
agaugucuagaaa

SEQ ID NO: 490662 - RNA, 17 nt, Chlamydophila pneumoniae CWL029
agcaagagcucuugaga

SEQ ID NO: 490663 - RNA, 19 nt, Chlamydophila pneumoniae CWL029
agaucuuuaucauugcuau

SEQ ID NO: 490664 - RNA, 13 nt, Chlamydophila pneumoniae CWL029
agaucucuuuagc

SEQ ID NO: 490665 - RNA, 22 nt, Chlamydophila pneumoniae CWL029
agaugcaaauccuguagaaaca

SEQ ID NO: 490666 - RNA, 22 nt, Chlamydophila pneumoniae CWL029
agauggucgagaaccuccacca

SEQ ID NO: 490667 - RNA, 13 nt, Chlamydophila pneumoniae CWL029
agaucguuaucaa

SEQ ID NO: 490668 - RNA, 13 nt, Chlamydophila pneumoniae CWL029
agaucacaucaag

SEQ ID NO: 490669 - RNA, 17 nt, Chlamydophila pneumoniae CWL029
agauccuuuaaagauuc

SEQ ID NO: 490670 - RNA, 21 nt, Chlamydophila pneumoniae CWL029
agaggucgaagauucaaagaa

SEQ ID NO: 490671 - RNA, 13 nt, Chlamydophila pneumoniae CWL029
agaggaucuucaa

SEQ ID NO: 490672 - RNA, 21 nt, Chlamydophila pneumoniae CWL029
agagcuugguuuucuccuucu

SEQ ID NO: 490673 - RNA, 12 nt, Chlamydophila pneumoniae CWL029
agagcuaaagaa

SEQ ID NO: 490674 - RNA, 14 nt, Chlamydophila pneumoniae CWL029
agagauauagguau

SEQ ID NO: 490675 - RNA, 18 nt, Chlamydophila pneumoniae CWL029
agaaaggauuggaugaga

SEQ ID NO: 490676 - RNA, 20 nt, Chlamydophila pneumoniae CWL029
agaaacuagggagaucuuau

SEQ ID NO: 490677 - RNA, 23 nt, Chlamydophila pneumoniae CWL029
agaaacuagggagaucuuauaga

SEQ ID NO: 490678 - RNA, 20 nt, Chlamydophila pneumoniae CWL029
agaaaauaucacauuccaau

SEQ ID NO: 490679 - RNA, 12 nt, Chlamydophila pneumoniae CWL029
agagagaaacuu

SEQ ID NO: 490680 - RNA, 19 nt, Chlamydophila pneumoniae CWL029
agagagagucggcuuuaga

SEQ ID NO: 490681 - RNA, 15 nt, Chlamydophila pneumoniae CWL029
agacuaaaagaauaa

SEQ ID NO: 490682 - RNA, 12 nt, Chlamydophila pneumoniae CWL029
cccuaagauucg

SEQ ID NO: 490683 - RNA, 15 nt, Chlamydophila pneumoniae CWL029
ccaucccauauggau

SEQ ID NO: 490684 - RNA, 16 nt, Chlamydophila pneumoniae CWL029
ccauacugauauacag

SEQ ID NO: 490685 - RNA, 15 nt, Chlamydophila pneumoniae CWL029
ccauacauagggaaa

SEQ ID NO: 490686 - RNA, 20 nt, Chlamydophila pneumoniae CWL029
ccaagcuuccgucugaaugu

SEQ ID NO: 490687 - RNA, 17 nt, Chlamydophila pneumoniae CWL029
ccaaggaaauuauggag

SEQ ID NO: 490688 - RNA, 12 nt, Chlamydophila pneumoniae CWL029
ccaaaauaaucu

SEQ ID NO: 490689 - RNA, 17 nt, Chlamydophila pneumoniae CWL029
cauuguuuguccuagga

SEQ ID NO: 490690 - RNA, 22 nt, Chlamydophila pneumoniae CWL029
cauuguuuguccuaggagagcu

SEQ ID NO: 490691 - RNA, 17 nt, Chlamydophila pneumoniae CWL029
caugcuaauaauuccug

SEQ ID NO: 490692 - RNA, 22 nt, Chlamydophila pneumoniae CWL029
cauguuaucaagacgacacuca

SEQ ID NO: 490693 - RNA, 20 nt, Chlamydophila pneumoniae CWL029
ccacggauuuucucuacaca

SEQ ID NO: 490694 - RNA, 15 nt, Chlamydophila pneumoniae CWL029
caucgcaguuccaua

SEQ ID NO: 490695 - RNA, 19 nt, Chlamydophila pneumoniae CWL029
cauagaggagauccuaaga

SEQ ID NO: 490696 - RNA, 12 nt, Chlamydophila pneumoniae CWL029
cauagaggagau

SEQ ID NO: 490697 - RNA, 16 nt, Chlamydophila pneumoniae CWL029
cauagccaucauagca

SEQ ID NO: 490698 - RNA, 17 nt, Chlamydophila pneumoniae CWL029
cauagcuuuagaagccc

SEQ ID NO: 490699 - RNA, 15 nt, Chlamydophila pneumoniae CWL029
caucacgaaaaggag

SEQ ID NO: 490700 - RNA, 13 nt, Chlamydophila pneumoniae CWL029
caucaggauucuc

SEQ ID NO: 490701 - RNA, 14 nt, Chlamydophila pneumoniae CWL029
caguaggagcagcg

SEQ ID NO: 490702 - RNA, 16 nt, Chlamydophila pneumoniae CWL029
caguaguaaauaauaa

SEQ ID NO: 490703 - RNA, 19 nt, Chlamydophila pneumoniae CWL029
cagucugugagaaauaggu

SEQ ID NO: 490704 - RNA, 22 nt, Chlamydophila pneumoniae CWL029
cauaaucuccaaacauuuuuaa

SEQ ID NO: 490705 - RNA, 20 nt, Chlamydophila pneumoniae CWL029
cauaaauaggcucuacagga

SEQ ID NO: 490706 - RNA, 23 nt, Chlamydophila pneumoniae CWL029
cauaaagccccacccacuccaga

SEQ ID NO: 490707 - RNA, 18 nt, Chlamydophila pneumoniae CWL029
cauaaagaucuuuauuuu

SEQ ID NO: 490708 - RNA, 21 nt, Chlamydophila pneumoniae CWL029
cauaaauacgugcuugaauau

SEQ ID NO: 490709 - RNA, 15 nt, Chlamydophila pneumoniae CWL029
cagcuucgcaaucuu

SEQ ID NO: 490710 - RNA, 16 nt, Chlamydophila pneumoniae CWL029
caggaguucuugauuc

SEQ ID NO: 490711 - RNA, 16 nt, Chlamydophila pneumoniae CWL029
cagcguugcuaagcau

SEQ ID NO: 490712 - RNA, 23 nt, Chlamydophila pneumoniae CWL029
cagcgaggaguuuuccaaaguca

SEQ ID NO: 490713 - RNA, 22 nt, Chlamydophila pneumoniae CWL029
cagauaaagcaaagauaaagaa

SEQ ID NO: 490714 - RNA, 17 nt, Chlamydophila pneumoniae CWL029
cagaguggucauugccu

SEQ ID NO: 490715 - RNA, 20 nt, Chlamydophila pneumoniae CWL029
cagagauugccaggagagcu

SEQ ID NO: 490716 - RNA, 19 nt, Chlamydophila pneumoniae CWL029
cagagaugcuucuaaacaa

SEQ ID NO: 490717 - RNA, 19 nt, Chlamydophila pneumoniae CWL029
cacuucuuuaggagcauag

SEQ ID NO: 490718 - RNA, 21 nt, Chlamydophila pneumoniae CWL029
cacuuuuuucccuccaccaga

SEQ ID NO: 490719 - RNA, 21 nt, Chlamydophila pneumoniae CWL029
cagaaacuagggagaucuuau

SEQ ID NO: 490720 - RNA, 20 nt, Chlamydophila pneumoniae CWL029
cacgggauagccgagaucuu

SEQ ID NO: 490721 - RNA, 16 nt, Chlamydophila pneumoniae CWL029
cacuaaaagggaagcu

SEQ ID NO: 490722 - RNA, 20 nt, Chlamydophila pneumoniae CWL029
cacuacagcuucauuaucuu

SEQ ID NO: 490723 - RNA, 19 nt, Chlamydophila pneumoniae CWL029
cacguucccacgagcacaa

SEQ ID NO: 490724 - RNA, 20 nt, Chlamydophila pneumoniae CWL029
cucuagaaaacgcucuccua

SEQ ID NO: 490725 - RNA, 15 nt, Chlamydophila pneumoniae CWL029
cucuagccaccaaca

SEQ ID NO: 490726 - RNA, 21 nt, Chlamydophila pneumoniae CWL029
cucuacaguaguaaauaauaa

SEQ ID NO: 490727 - RNA, 15 nt, Chlamydophila pneumoniae CWL029
cucguugccaaucuu

SEQ ID NO: 490728 - RNA, 22 nt, Chlamydophila pneumoniae CWL029
cucgguuuccugaagaugagaa

SEQ ID NO: 490729 - RNA, 23 nt, Chlamydophila pneumoniae CWL029
cugaacaucuccagcagcaaaua

SEQ ID NO: 490730 - RNA, 15 nt, Chlamydophila pneumoniae CWL029
cugaacauucuuaau

SEQ ID NO: 490731 - RNA, 18 nt, Chlamydophila pneumoniae CWL029
cucuuucgaugcuauuuu

SEQ ID NO: 490732 - RNA, 18 nt, Chlamydophila pneumoniae CWL029
cucugacaaguguguuuc

SEQ ID NO: 490733 - RNA, 22 nt, Chlamydophila pneumoniae CWL029
cucugcauguugcaaagcauga

SEQ ID NO: 490734 - RNA, 14 nt, Chlamydophila pneumoniae CWL029
cugacacaacucuu

SEQ ID NO: 490735 - RNA, 15 nt, Chlamydophila pneumoniae CWL029
cugacggaucuuagg

SEQ ID NO: 490736 - RNA, 23 nt, Chlamydophila pneumoniae CWL029
cugcgacacgaauuucuaacuua

SEQ ID NO: 490737 - RNA, 15 nt, Chlamydophila pneumoniae CWL029
cuccuucaaagauau

SEQ ID NO: 490738 - RNA, 12 nt, Chlamydophila pneumoniae CWL029
cuccucaucaga

SEQ ID NO: 490739 - RNA, 18 nt, Chlamydophila pneumoniae CWL029
cucgaagcuugcugauuu

SEQ ID NO: 490740 - RNA, 12 nt, Chlamydophila pneumoniae CWL029
cuccgcucuaag

SEQ ID NO: 490741 - RNA, 15 nt, Chlamydophila pneumoniae CWL029
cucaucgaaucuuga

SEQ ID NO: 490742 - RNA, 20 nt, Chlamydophila pneumoniae CWL029
cucaggucugcugaggagag

SEQ ID NO: 490743 - RNA, 19 nt, Chlamydophila pneumoniae CWL029
cucaggcuuuaaguguuuc

SEQ ID NO: 490744 - RNA, 15 nt, Chlamydophila pneumoniae CWL029
cucccaauauccaga

SEQ ID NO: 490745 - RNA, 17 nt, Chlamydophila pneumoniae CWL029
cuacauaaaaugagcuc

SEQ ID NO: 490746 - RNA, 20 nt, Chlamydophila pneumoniae CWL029
cuacagaggaaucuauccuu

SEQ ID NO: 490747 - RNA, 17 nt, Chlamydophila pneumoniae CWL029
cuacgugaucaaaauua

SEQ ID NO: 490748 - RNA, 15 nt, Chlamydophila pneumoniae CWL029
cuagagauuuuucua

SEQ ID NO: 490749 - RNA, 14 nt, Chlamydophila pneumoniae CWL029
cuagaaguuuaaac

SEQ ID NO: 490750 - RNA, 14 nt, Chlamydophila pneumoniae CWL029
cuagaaaaugaaga

SEQ ID NO: 490751 - RNA, 14 nt, Chlamydophila pneumoniae CWL029
cuauagcauagccu

SEQ ID NO: 490752 - RNA, 21 nt, Chlamydophila pneumoniae CWL029
cuagauuuugagaaugaacaa

SEQ ID NO: 490753 - RNA, 17 nt, Chlamydophila pneumoniae CWL029
cucaaucgauaaucaaa

SEQ ID NO: 490754 - RNA, 18 nt, Chlamydophila pneumoniae CWL029
cucaaugcgauaaccacu

SEQ ID NO: 490755 - RNA, 13 nt, Chlamydophila pneumoniae CWL029
cucaagaucuuca

SEQ ID NO: 490756 - RNA, 18 nt, Chlamydophila pneumoniae CWL029
cguucaucugucauuaaa

SEQ ID NO: 490757 - RNA, 13 nt, Chlamydophila pneumoniae CWL029
cgucaugcauaga

SEQ ID NO: 490758 - RNA, 17 nt, Chlamydophila pneumoniae CWL029
cgguuuaaacagaucuu

SEQ ID NO: 490759 - RNA, 22 nt, Chlamydophila pneumoniae CWL029
cguauggauuucuccagcagcu

SEQ ID NO: 490760 - RNA, 18 nt, Chlamydophila pneumoniae CWL029
gacucuuccaauuguaaa

SEQ ID NO: 490761 - RNA, 12 nt, Chlamydophila pneumoniae CWL029
gacucuuuuaag

SEQ ID NO: 490762 - RNA, 20 nt, Chlamydophila pneumoniae CWL029
gagaaauacgcuuuucuucu

SEQ ID NO: 490763 - RNA, 15 nt, Chlamydophila pneumoniae CWL029
gacuuuccucucuuu

SEQ ID NO: 490764 - RNA, 12 nt, Chlamydophila pneumoniae CWL029
gacugcauagac

SEQ ID NO: 490765 - RNA, 20 nt, Chlamydophila pneumoniae CWL029
gagaguguuguuggagcaga

SEQ ID NO: 490766 - RNA, 19 nt, Chlamydophila pneumoniae CWL029
gagacuuugccauuucuau

SEQ ID NO: 490767 - RNA, 15 nt, Chlamydophila pneumoniae CWL029
gagaccuucucuuca

SEQ ID NO: 490768 - RNA, 13 nt, Chlamydophila pneumoniae CWL029
gagaauaaaacuu

SEQ ID NO: 490769 - RNA, 16 nt, Chlamydophila pneumoniae CWL029
gagaaugacuuuagaa

SEQ ID NO: 490770 - RNA, 20 nt, Chlamydophila pneumoniae CWL029
gagaugcaaauccuguagaa

SEQ ID NO: 490771 - RNA, 12 nt, Chlamydophila pneumoniae CWL029
gagcagaaacuc

SEQ ID NO: 490772 - RNA, 23 nt, Chlamydophila pneumoniae CWL029
gacgcuuuuaucuguuaaaaaca

SEQ ID NO: 490773 - RNA, 16 nt, Chlamydophila pneumoniae CWL029
gacguuguaucccugu

SEQ ID NO: 490774 - RNA, 20 nt, Chlamydophila pneumoniae CWL029
gacgugguaagguuaucuuu

SEQ ID NO: 490775 - RNA, 16 nt, Chlamydophila pneumoniae CWL029
gacaaugacuguagga

SEQ ID NO: 490776 - RNA, 16 nt, Chlamydophila pneumoniae CWL029
gacacaacucuuuaau

SEQ ID NO: 490777 - RNA, 16 nt, Chlamydophila pneumoniae CWL029
gaaucacguccacaag

SEQ ID NO: 490778 - RNA, 22 nt, Chlamydophila pneumoniae CWL029
gaccuuuaggaacuugaauacc

SEQ ID NO: 490779 - RNA, 20 nt, Chlamydophila pneumoniae CWL029
gaaccacuuuagaauuuucu

SEQ ID NO: 490780 - RNA, 15 nt, Chlamydophila pneumoniae CWL029
gaacaggggauguga

SEQ ID NO: 490781 - RNA, 23 nt, Chlamydophila pneumoniae CWL029
gaacaggauugauaaauacccuc

SEQ ID NO: 490782 - RNA, 22 nt, Chlamydophila pneumoniae CWL029
gaacaagucggcaggagaggua

SEQ ID NO: 490783 - RNA, 18 nt, Chlamydophila pneumoniae CWL029
gaaaucgcauuacaaaug

SEQ ID NO: 490784 - RNA, 23 nt, Chlamydophila pneumoniae CWL029
gaaauuagagggauuuguaggaa

SEQ ID NO: 490785 - RNA, 23 nt, Chlamydophila pneumoniae CWL029
gaaacuucugacccuguagcgaa

SEQ ID NO: 490786 - RNA, 19 nt, Chlamydophila pneumoniae CWL029
gaaagaagccuuccuuguu

SEQ ID NO: 490787 - RNA, 23 nt, Chlamydophila pneumoniae CWL029
gaaagaauuguaguucuuugaau

SEQ ID NO: 490788 - RNA, 16 nt, Chlamydophila pneumoniae CWL029
gaaauaagcaucuaga

SEQ ID NO: 490789 - RNA, 13 nt, Chlamydophila pneumoniae CWL029
gaaauauacucuu

SEQ ID NO: 490790 - RNA, 20 nt, Chlamydophila pneumoniae CWL029
cuuuuuccauacccaaauuu

SEQ ID NO: 490791 - RNA, 18 nt, Chlamydophila pneumoniae CWL029
cuuuuucuucaauaucuu

SEQ ID NO: 490792 - RNA, 14 nt, Chlamydophila pneumoniae CWL029
gaaaauuguuggaa

SEQ ID NO: 490793 - RNA, 23 nt, Chlamydophila pneumoniae CWL029
cuuuuccugcagcagccuuggcu

SEQ ID NO: 490794 - RNA, 20 nt, Chlamydophila pneumoniae CWL029
cuuuagcuuuauugauagcu

SEQ ID NO: 490795 - RNA, 17 nt, Chlamydophila pneumoniae CWL029
cuuuaacgaagaaggga

SEQ ID NO: 490796 - RNA, 19 nt, Chlamydophila pneumoniae CWL029
cuugguuuucuccuucucc

SEQ ID NO: 490797 - RNA, 24 nt, Chlamydophila pneumoniae CWL029
cuucuaccaauucucucucugcag

SEQ ID NO: 490798 - RNA, 20 nt, Chlamydophila pneumoniae CWL029
cuuccucacguucugcaaca

SEQ ID NO: 490799 - RNA, 13 nt, Chlamydophila pneumoniae CWL029
cuuccugcugcuu

SEQ ID NO: 490800 - RNA, 16 nt, Chlamydophila pneumoniae CWL029
cuucagauuuacagac

SEQ ID NO: 490801 - RNA, 19 nt, Chlamydophila pneumoniae CWL029
cuucacuuauaagcugcuu

SEQ ID NO: 490802 - RNA, 20 nt, Chlamydophila pneumoniae CWL029
cuuauagggaauuuuuucug

SEQ ID NO: 490803 - RNA, 14 nt, Chlamydophila pneumoniae CWL029
cuuccauaucuaga

SEQ ID NO: 490804 - RNA, 19 nt, Chlamydophila pneumoniae CWL029
cuucaugaaaaaagaauaa

SEQ ID NO: 490805 - RNA, 15 nt, Chlamydophila pneumoniae CWL029
cuucaucacaaaauu

SEQ ID NO: 490806 - RNA, 16 nt, Chlamydophila pneumoniae CWL029
cuguucuagcaaaucu

SEQ ID NO: 490807 - RNA, 14 nt, Chlamydophila pneumoniae CWL029
cuuaaaauuccuga

SEQ ID NO: 490808 - RNA, 17 nt, Chlamydophila pneumoniae CWL029
cuguucgauaagaacuu

SEQ ID NO: 490809 - RNA, 15 nt, Chlamydophila pneumoniae CWL029
cugguuuuucgauuu

SEQ ID NO: 490810 - RNA, 18 nt, Chlamydophila pneumoniae CWL029
cuguagccacuaaguuua

SEQ ID NO: 490811 - RNA, 13 nt, Chlamydophila pneumoniae CWL029
cugggaagaccac

SEQ ID NO: 490812 - RNA, 12 nt, Chlamydophila pneumoniae CWL029
cugggaagacuc

SEQ ID NO: 490813 - RNA, 20 nt, Chlamydophila pneumoniae CWL029
gagguagcaucucucuccaa

SEQ ID NO: 490814 - RNA, 22 nt, Chlamydophila pneumoniae CWL029
gagucugaacauucuuaauauc

SEQ ID NO: 490815 - RNA, 14 nt, Chlamydophila pneumoniae CWL029
gauauauagagcag

SEQ ID NO: 490816 - RNA, 14 nt, Chlamydophila pneumoniae CWL029
gauacacuucuaau

SEQ ID NO: 490817 - RNA, 16 nt, Chlamydophila pneumoniae CWL029
gauacgaauaaguuuu

SEQ ID NO: 490818 - RNA, 17 nt, Chlamydophila pneumoniae CWL029
gaucuguaauagcagga

SEQ ID NO: 490819 - RNA, 19 nt, Chlamydophila pneumoniae CWL029
gaucgucaagcucugagaa

SEQ ID NO: 490820 - RNA, 22 nt, Chlamydophila pneumoniae CWL029
gcaacaguaauuauuuucuaca

SEQ ID NO: 490821 - RNA, 15 nt, Chlamydophila pneumoniae CWL029
gcaaguaaagaaauu

SEQ ID NO: 490822 - RNA, 17 nt, Chlamydophila pneumoniae CWL029
gauuuagaaaucucacu

SEQ ID NO: 490823 - RNA, 18 nt, Chlamydophila pneumoniae CWL029
gauuucuuuauucccuuu

SEQ ID NO: 490824 - RNA, 15 nt, Chlamydophila pneumoniae CWL029
gcaaacuccccaguu

SEQ ID NO: 490825 - RNA, 15 nt, Chlamydophila pneumoniae CWL029
gauucaaagaagucg

SEQ ID NO: 490826 - RNA, 15 nt, Chlamydophila pneumoniae CWL029
gauuauuucuaaaaa

SEQ ID NO: 490827 - RNA, 21 nt, Chlamydophila pneumoniae CWL029
gauucuguauaaacaauaaga

SEQ ID NO: 490828 - RNA, 13 nt, Chlamydophila pneumoniae CWL029
gcauuggacaacg

SEQ ID NO: 490829 - RNA, 12 nt, Chlamydophila pneumoniae CWL029
gcaugcauagcu

SEQ ID NO: 490830 - RNA, 14 nt, Chlamydophila pneumoniae CWL029
gcaugcauagcuga

SEQ ID NO: 490831 - RNA, 23 nt, Chlamydophila pneumoniae CWL029
gcccaaggaaaaacaaaccuccu

SEQ ID NO: 490832 - RNA, 15 nt, Chlamydophila pneumoniae CWL029
cgcgaccugugauuu

SEQ ID NO: 490833 - RNA, 22 nt, Chlamydophila pneumoniae CWL029
cgcuaaaguagaauccuucucc

SEQ ID NO: 490834 - RNA, 13 nt, Chlamydophila pneumoniae CWL029
cggaacuaaagag

SEQ ID NO: 490835 - RNA, 15 nt, Chlamydophila pneumoniae CWL029
cggaacucauuaaga

SEQ ID NO: 490836 - RNA, 23 nt, Chlamydophila pneumoniae CWL029
cgaugcuauuuuuccauggcuau

SEQ ID NO: 490837 - RNA, 20 nt, Chlamydophila pneumoniae CWL029
cgauagaucacaucaagaua

SEQ ID NO: 490838 - RNA, 17 nt, Chlamydophila pneumoniae CWL029
cgaggagcuuuuaccuu

SEQ ID NO: 490839 - RNA, 20 nt, Chlamydophila pneumoniae CWL029
cgacaccgauucgcuacaua

SEQ ID NO: 490840 - RNA, 21 nt, Chlamydophila pneumoniae CWL029
cgaaugguuccugaagcagcu

SEQ ID NO: 490841 - RNA, 13 nt, Chlamydophila pneumoniae CWL029
ccuucuuuaccua

SEQ ID NO: 490842 - RNA, 13 nt, Chlamydophila pneumoniae CWL029
ccuucuucuucag

SEQ ID NO: 490843 - RNA, 22 nt, Chlamydophila pneumoniae CWL029
ccuuaucgccaacggcauagga

SEQ ID NO: 490844 - RNA, 16 nt, Chlamydophila pneumoniae CWL029
ccuuccuuaucuucag

SEQ ID NO: 490845 - RNA, 17 nt, Chlamydophila pneumoniae CWL029
ccugcuccaaaauggga

SEQ ID NO: 490846 - RNA, 16 nt, Chlamydophila pneumoniae CWL029
ccugcguuaaacccuu

SEQ ID NO: 490847 - RNA, 17 nt, Chlamydophila pneumoniae CWL029
ccugacucuuauugcag

SEQ ID NO: 490848 - RNA, 16 nt, Chlamydophila pneumoniae CWL029
ccuaaauuaaauaucu

SEQ ID NO: 490849 - RNA, 17 nt, Chlamydophila pneumoniae CWL029
ccuaagucguuaacauc

SEQ ID NO: 490850 - RNA, 13 nt, Chlamydophila pneumoniae CWL029
ccguuucaggaaa

SEQ ID NO: 490851 - RNA, 15 nt, Chlamydophila pneumoniae CWL029
ccguagccccuuaaa

SEQ ID NO: 490852 - RNA, 12 nt, Chlamydophila pneumoniae CWL029
ccgcaaaccauc

SEQ ID NO: 490853 - RNA, 21 nt, Chlamydophila pneumoniae CWL029
aaauguuuaucgacucuucca

SEQ ID NO: 490854 - RNA, 16 nt, Chlamydophila pneumoniae CWL029
aaaugcacuuugaaua

SEQ ID NO: 490855 - RNA, 14 nt, Chlamydophila pneumoniae CWL029
aaagguugcuaaga

SEQ ID NO: 490856 - RNA, 15 nt, Chlamydophila pneumoniae CWL029
aaaguauauauuuua

SEQ ID NO: 490857 - RNA, 22 nt, Chlamydophila pneumoniae CWL029
aaagccgauacccaucuagaaa

SEQ ID NO: 490858 - RNA, 18 nt, Chlamydophila pneumoniae CWL029
aaagcaggagcaucauua

SEQ ID NO: 490859 - RNA, 21 nt, Chlamydophila pneumoniae CWL029
aaacuuucgaagcgcucuaca

SEQ ID NO: 490860 - RNA, 16 nt, Chlamydophila pneumoniae CWL029
aaacauagagauucua

SEQ ID NO: 490861 - RNA, 19 nt, Chlamydophila pneumoniae CWL029
aaaccucuuagcuaucaac

SEQ ID NO: 490862 - RNA, 14 nt, Chlamydophila pneumoniae CWL029
aaaacaaucuaaag

SEQ ID NO: 490863 - RNA, 17 nt, Chlamydophila pneumoniae CWL029
aaaaauuuucguaacca

SEQ ID NO: 490864 - RNA, 18 nt, Chlamydophila pneumoniae CWL029
aaaaaucugcuauaacca

SEQ ID NO: 490865 - RNA, 13 nt, Chlamydophila pneumoniae CWL029
aaaagaccaaaua

SEQ ID NO: 490866 - RNA, 13 nt, Chlamydophila pneumoniae CWL029
aaaagagcucaaa

SEQ ID NO: 490867 - RNA, 13 nt, Chlamydophila pneumoniae CWL029
aaaacuauaaaag

SEQ ID NO: 490868 - RNA, 16 nt, Chlamydophila pneumoniae CWL029
aaaagcugaauccagg

SEQ ID NO: 490869 - RNA, 17 nt, Chlamydophila pneumoniae CWL029
aaaaucuucuggaggga

SEQ ID NO: 490870 - RNA, 23 nt, Chlamydophila pneumoniae CWL029
aaaaucucuaugcgcucuaagag

SEQ ID NO: 490871 - RNA, 16 nt, Chlamydophila pneumoniae CWL029
aaaaucuccucucuca

SEQ ID NO: 490872 - RNA, 13 nt, Chlamydophila pneumoniae CWL029
aaaaaccuucucc

SEQ ID NO: 490873 - RNA, 18 nt, Chlamydophila pneumoniae CWL029
aaaaagcccauuccugca

SEQ ID NO: 490874 - RNA, 14 nt, Chlamydophila pneumoniae CWL029
acagcaucaggauu

SEQ ID NO: 490875 - RNA, 13 nt, Chlamydophila pneumoniae CWL029
acacucagagaug

SEQ ID NO: 490876 - RNA, 16 nt, Chlamydophila pneumoniae CWL029
acaccaacaacaauaa

SEQ ID NO: 490877 - RNA, 19 nt, Chlamydophila pneumoniae CWL029
acaaucucgcuauuccaua

SEQ ID NO: 490878 - RNA, 17 nt, Chlamydophila pneumoniae CWL029
acaaugcuaucuccaga

SEQ ID NO: 490879 - RNA, 15 nt, Chlamydophila pneumoniae CWL029
acaagaacugaagag

SEQ ID NO: 490880 - RNA, 21 nt, Chlamydophila pneumoniae CWL029
acaaagcucuccuucagaguu

SEQ ID NO: 490881 - RNA, 14 nt, Chlamydophila pneumoniae CWL029
acaacagaaauguu

SEQ ID NO: 490882 - RNA, 15 nt, Chlamydophila pneumoniae CWL029
aauugugcucucuaa

SEQ ID NO: 490883 - RNA, 16 nt, Chlamydophila pneumoniae CWL029
aauuguucuugaaguu

SEQ ID NO: 490884 - RNA, 17 nt, Chlamydophila pneumoniae CWL029
aauuucaggagcuccug

SEQ ID NO: 490885 - RNA, 21 nt, Chlamydophila pneumoniae CWL029
aauuccagaaaaagaacauaa

SEQ ID NO: 490886 - RNA, 16 nt, Chlamydophila pneumoniae CWL029
aauggaaacuuuucca

SEQ ID NO: 490887 - RNA, 22 nt, Chlamydophila pneumoniae CWL029
aaugacagcugagaaauuccua

SEQ ID NO: 490888 - RNA, 23 nt, Chlamydophila pneumoniae CWL029
aauauuuuaccauugagauccau

SEQ ID NO: 490889 - RNA, 22 nt, Chlamydophila pneumoniae CWL029
aaucaauaaaauguccaacuca

SEQ ID NO: 490890 - RNA, 22 nt, Chlamydophila pneumoniae CWL029
aauauaucgcguguaaaagcuu

SEQ ID NO: 490891 - RNA, 15 nt, Chlamydophila pneumoniae CWL029
aagugacuuccucca

SEQ ID NO: 490892 - RNA, 19 nt, Chlamydophila pneumoniae CWL029
aaguguuucuucauagcau

SEQ ID NO: 490893 - RNA, 14 nt, Chlamydophila pneumoniae CWL029
aaggcugcuugaga

SEQ ID NO: 490894 - RNA, 13 nt, Chlamydophila pneumoniae CWL029
aagguauuucucu

SEQ ID NO: 490895 - RNA, 17 nt, Chlamydophila pneumoniae CWL029
aaggucacagcauuuuc

SEQ ID NO: 490896 - RNA, 14 nt, Chlamydophila pneumoniae CWL029
aaggcuaaaaccua

SEQ ID NO: 490897 - RNA, 15 nt, Chlamydophila pneumoniae CWL029
aagcgccgcauuaca

SEQ ID NO: 490898 - RNA, 13 nt, Chlamydophila pneumoniae CWL029
aaggauccauaac

SEQ ID NO: 490899 - RNA, 17 nt, Chlamydophila pneumoniae CWL029
aagacucuugaauauuu

SEQ ID NO: 490900 - RNA, 16 nt, Chlamydophila pneumoniae CWL029
aagaccuaagcucaua

SEQ ID NO: 490901 - RNA, 22 nt, Chlamydophila pneumoniae CWL029
aagacuuuuuaguauacuaaga

SEQ ID NO: 490902 - RNA, 19 nt, Chlamydophila pneumoniae CWL029
aagcauucugcuagagcuu

SEQ ID NO: 490903 - RNA, 20 nt, Chlamydophila pneumoniae CWL029
aagccuccucaagauaaauc

SEQ ID NO: 490904 - RNA, 15 nt, Chlamydophila pneumoniae CWL029
aacuuuuccaaauuc

SEQ ID NO: 490905 - RNA, 16 nt, Chlamydophila pneumoniae CWL029
aacuuuuuuucuucuc

SEQ ID NO: 490906 - RNA, 21 nt, Chlamydophila pneumoniae CWL029
aagaauguagcuguuccaaga

SEQ ID NO: 490907 - RNA, 15 nt, Chlamydophila pneumoniae CWL029
aagaauacucuaaga

SEQ ID NO: 490908 - RNA, 21 nt, Chlamydophila pneumoniae CWL029
aagaauuuguaacucuuaaga

SEQ ID NO: 490909 - RNA, 19 nt, Chlamydophila pneumoniae CWL029
aagacauccuucuuuaccu

SEQ ID NO: 490910 - RNA, 21 nt, Chlamydophila pneumoniae CWL029
aagacaugagggcaugccuau

SEQ ID NO: 490911 - RNA, 15 nt, Chlamydophila pneumoniae CWL029
aagacaucuccugca

SEQ ID NO: 490912 - RNA, 20 nt, Chlamydophila pneumoniae CWL029
aagacccuucuuuccauaaa

SEQ ID NO: 490913 - RNA, 23 nt, Chlamydophila pneumoniae CWL029
aacuucccaucuuguucuaaaau

SEQ ID NO: 490914 - RNA, 16 nt, Chlamydophila pneumoniae CWL029
aacucuagaucuucaa

SEQ ID NO: 490915 - RNA, 18 nt, Chlamydophila pneumoniae CWL029
aacucuuaagaauaaaau

SEQ ID NO: 490916 - RNA, 21 nt, Chlamydophila pneumoniae CWL029
aacugacguuuuucccuaccu

SEQ ID NO: 490917 - RNA, 15 nt, Chlamydophila pneumoniae CWL029
aacuauccaaagccg

SEQ ID NO: 490918 - RNA, 22 nt, Chlamydophila pneumoniae CWL029
aacuccgcacuugcucuuuaau

SEQ ID NO: 490919 - RNA, 16 nt, Chlamydophila pneumoniae CWL029
aacucaaucucuuuga

SEQ ID NO: 490920 - RNA, 12 nt, Chlamydophila pneumoniae CWL029
aacucagagauu

SEQ ID NO: 490921 - RNA, 13 nt, Chlamydophila pneumoniae CWL029
aacgacguuuaau

SEQ ID NO: 490922 - RNA, 18 nt, Chlamydophila pneumoniae CWL029
aaccuccauagaauccuc

SEQ ID NO: 490923 - RNA, 21 nt, Chlamydophila pneumoniae CWL029
agaucucuuuagcaaucucuu

SEQ ID NO: 490924 - RNA, 18 nt, Chlamydophila pneumoniae CWL029
agaucuugaaaagauuuu

SEQ ID NO: 490925 - RNA, 16 nt, Chlamydophila pneumoniae CWL029
agaucuuuauuuuuaa

SEQ ID NO: 490926 - RNA, 20 nt, Chlamydophila pneumoniae CWL029
agaugcuauuuacugaaaca

SEQ ID NO: 490927 - RNA, 16 nt, Chlamydophila pneumoniae CWL029
agagcuaaagaaacuu

SEQ ID NO: 490928 - RNA, 18 nt, Chlamydophila pneumoniae CWL029
agagcuucuaaaaacucu

SEQ ID NO: 490929 - RNA, 17 nt, Chlamydophila pneumoniae CWL029
agaggaaucuaagaacu

SEQ ID NO: 490930 - RNA, 15 nt, Chlamydophila pneumoniae CWL029
agaggacucccucaa

SEQ ID NO: 490931 - RNA, 14 nt, Chlamydophila pneumoniae CWL029
agagguucccucaa

SEQ ID NO: 490932 - RNA, 22 nt, Chlamydophila pneumoniae CWL029
agaguugccaggaaacguucuu

SEQ ID NO: 490933 - RNA, 19 nt, Chlamydophila pneumoniae CWL029
agaguagcucaucuagaaa

SEQ ID NO: 490934 - RNA, 23 nt, Chlamydophila pneumoniae CWL029
agagucucacucuuuucuagaaa

SEQ ID NO: 490935 - RNA, 21 nt, Chlamydophila pneumoniae CWL029
agagucucuuucagcucaagu

SEQ ID NO: 490936 - RNA, 18 nt, Chlamydophila pneumoniae CWL029
agaguggucauugccuug

SEQ ID NO: 490937 - RNA, 13 nt, Chlamydophila pneumoniae CWL029
agaucaaaaauag

SEQ ID NO: 490938 - RNA, 19 nt, Chlamydophila pneumoniae CWL029
agacucucaucagcaaaac

SEQ ID NO: 490939 - RNA, 16 nt, Chlamydophila pneumoniae CWL029
agagauucauaaaacu

SEQ ID NO: 490940 - RNA, 18 nt, Chlamydophila pneumoniae CWL029
agagcaauuaagaaacua

SEQ ID NO: 490941 - RNA, 21 nt, Chlamydophila pneumoniae CWL029
agagauuuuaaagccuccuca

SEQ ID NO: 490942 - RNA, 15 nt, Chlamydophila pneumoniae CWL029
agagacaagaaaaua

SEQ ID NO: 490943 - RNA, 15 nt, Chlamydophila pneumoniae CWL029
agaauuuguccuuug

SEQ ID NO: 490944 - RNA, 21 nt, Chlamydophila pneumoniae CWL029
agacaaugcgccuuguuuaga

SEQ ID NO: 490945 - RNA, 20 nt, Chlamydophila pneumoniae CWL029
agaagucgcuagaucacaag

SEQ ID NO: 490946 - RNA, 21 nt, Chlamydophila pneumoniae CWL029
agaauaacgcaagggcggaga

SEQ ID NO: 490947 - RNA, 14 nt, Chlamydophila pneumoniae CWL029
agaauaugaacugc

SEQ ID NO: 490948 - RNA, 19 nt, Chlamydophila pneumoniae CWL029
agaaucuuuucuagaaaac

SEQ ID NO: 490949 - RNA, 22 nt, Chlamydophila pneumoniae CWL029
agaauccugaguaaaaucauag

SEQ ID NO: 490950 - RNA, 18 nt, Chlamydophila pneumoniae CWL029
agaaugcccuuuagggaa

SEQ ID NO: 490951 - RNA, 15 nt, Chlamydophila pneumoniae CWL029
agaacuuuagggaag

SEQ ID NO: 490952 - RNA, 20 nt, Chlamydophila pneumoniae CWL029
agaagcaugaagcagaaacu

SEQ ID NO: 490953 - RNA, 12 nt, Chlamydophila pneumoniae CWL029
agaaacugcucc

SEQ ID NO: 490954 - RNA, 20 nt, Chlamydophila pneumoniae CWL029
agaaacuuuaaaagcauagu

SEQ ID NO: 490955 - RNA, 22 nt, Chlamydophila pneumoniae CWL029
agaaagaauuguaguucuuuga

SEQ ID NO: 490956 - RNA, 19 nt, Chlamydophila pneumoniae CWL029
agaaagauaucccaaagcu

SEQ ID NO: 490957 - RNA, 23 nt, Chlamydophila pneumoniae CWL029
agaaaaucucuaagaaucuauag

SEQ ID NO: 490958 - RNA, 21 nt, Chlamydophila pneumoniae CWL029
agaaacccgcaacucuuuagg

SEQ ID NO: 490959 - RNA, 22 nt, Chlamydophila pneumoniae CWL029
agaacaaggcuccguugaauua

SEQ ID NO: 490960 - RNA, 21 nt, Chlamydophila pneumoniae CWL029
agaaauuagaguaugaggaga

SEQ ID NO: 490961 - RNA, 18 nt, Chlamydophila pneumoniae CWL029
acuuuugaauuaaaaguu

SEQ ID NO: 490962 - RNA, 13 nt, Chlamydophila pneumoniae CWL029
acuuuguuuuuca

SEQ ID NO: 490963 - RNA, 14 nt, Chlamydophila pneumoniae CWL029
acuuauauuuucua

SEQ ID NO: 490964 - RNA, 15 nt, Chlamydophila pneumoniae CWL029
acuaucuucuaaaac

SEQ ID NO: 490965 - RNA, 18 nt, Chlamydophila pneumoniae CWL029
acucuuuuaagacaauau

SEQ ID NO: 490966 - RNA, 16 nt, Chlamydophila pneumoniae CWL029
acugaaaaaccauaag

SEQ ID NO: 490967 - RNA, 22 nt, Chlamydophila pneumoniae CWL029
acugcaggaaauuauagaugau

SEQ ID NO: 490968 - RNA, 13 nt, Chlamydophila pneumoniae CWL029
acugugauuuucu

SEQ ID NO: 490969 - RNA, 19 nt, Chlamydophila pneumoniae CWL029
acuguuguaauaaaaucau

SEQ ID NO: 490970 - RNA, 20 nt, Chlamydophila pneumoniae CWL029
acuuaaguugaccuuuuuca

SEQ ID NO: 490971 - RNA, 16 nt, Chlamydophila pneumoniae CWL029
acuuagaucuuuucua

SEQ ID NO: 490972 - RNA, 14 nt, Chlamydophila pneumoniae CWL029
acguuuaauuccuu

SEQ ID NO: 490973 - RNA, 13 nt, Chlamydophila pneumoniae CWL029
acguuuuuuuccu

SEQ ID NO: 490974 - RNA, 15 nt, Chlamydophila pneumoniae CWL029
acuaaaaguuuuuua

SEQ ID NO: 490975 - RNA, 17 nt, Chlamydophila pneumoniae CWL029
acuaaauucuuaacaau

SEQ ID NO: 490976 - RNA, 13 nt, Chlamydophila pneumoniae CWL029
acuagaucgucaa

SEQ ID NO: 490977 - RNA, 17 nt, Chlamydophila pneumoniae CWL029
acuagaucccucaagcg

SEQ ID NO: 490978 - RNA, 14 nt, Chlamydophila pneumoniae CWL029
acguggcuuccaua

SEQ ID NO: 490979 - RNA, 14 nt, Chlamydophila pneumoniae CWL029
acgggagcucuuuc

SEQ ID NO: 490980 - RNA, 21 nt, Chlamydophila pneumoniae CWL029
acggcggagaauaucaucuuc

SEQ ID NO: 490981 - RNA, 13 nt, Chlamydophila pneumoniae CWL029
aaacaggaauagg

SEQ ID NO: 490982 - RNA, 18 nt, Chlamydophila pneumoniae CWL029
aaacauagagauucuaca

SEQ ID NO: 490983 - RNA, 14 nt, Chlamydophila pneumoniae CWL029
aaacaaaccuccua

SEQ ID NO: 490984 - RNA, 11 nt, Chlamydophila pneumoniae CWL029
aaacaaaagca

SEQ ID NO: 490985 - RNA, 19 nt, Chlamydophila pneumoniae CWL029
accuuuccuaaaauaauuu

SEQ ID NO: 490986 - RNA, 21 nt, Chlamydophila pneumoniae CWL029
acgaacuuugaccagaugauu

SEQ ID NO: 490987 - RNA, 13 nt, Chlamydophila pneumoniae CWL029
acgacauugaaga

SEQ ID NO: 490988 - RNA, 18 nt, Chlamydophila pneumoniae CWL029
accguuaauuuuugcuaa

SEQ ID NO: 490989 - RNA, 13 nt, Chlamydophila pneumoniae CWL029
accauuaagauau

SEQ ID NO: 490990 - RNA, 13 nt, Chlamydophila pneumoniae CWL029
accccacaaucac

SEQ ID NO: 490991 - RNA, 21 nt, Chlamydophila pneumoniae CWL029
aaaaugcacuuugaauaaugc

SEQ ID NO: 490992 - RNA, 16 nt, Chlamydophila pneumoniae CWL029
accauauucucaggaa

SEQ ID NO: 490993 - RNA, 22 nt, Chlamydophila pneumoniae CWL029
acauaacgggguugucucuaca

SEQ ID NO: 490994 - RNA, 15 nt, Chlamydophila pneumoniae CWL029
cucacaagcauccua

SEQ ID NO: 490995 - RNA, 13 nt, Chlamydophila pneumoniae CWL029
cuccaaauaaagc

SEQ ID NO: 490996 - RNA, 14 nt, Chlamydophila pneumoniae CWL029
cuauagaaggcauc

SEQ ID NO: 490997 - RNA, 14 nt, Chlamydophila pneumoniae CWL029
cuauagaaaaggau

SEQ ID NO: 490998 - RNA, 13 nt, Chlamydophila pneumoniae CWL029
cuauagcaacagg

SEQ ID NO: 490999 - RNA, 14 nt, Chlamydophila pneumoniae CWL029
cuauaguagaagaa

SEQ ID NO: 491000 - RNA, 15 nt, Chlamydophila pneumoniae CWL029
cuauaucauuaagaa

SEQ ID NO: 491001 - RNA, 17 nt, Chlamydophila pneumoniae CWL029
cucaaacccucuccaga

SEQ ID NO: 491002 - RNA, 19 nt, Chlamydophila pneumoniae CWL029
cuauuuuccucuauauuuu

SEQ ID NO: 491003 - RNA, 14 nt, Chlamydophila pneumoniae CWL029
cucaagagcaugcu

SEQ ID NO: 491004 - RNA, 18 nt, Chlamydophila pneumoniae CWL029
cuaugggaggaauuccuc

SEQ ID NO: 491005 - RNA, 14 nt, Chlamydophila pneumoniae CWL029
cuauuaucugcaga

SEQ ID NO: 491006 - RNA, 12 nt, Chlamydophila pneumoniae CWL029
cuauuccccucc

SEQ ID NO: 491007 - RNA, 18 nt, Chlamydophila pneumoniae CWL029
cuaugagauaggaacuca

SEQ ID NO: 491008 - RNA, 14 nt, Chlamydophila pneumoniae CWL029
cuaucuaaucaauu

SEQ ID NO: 491009 - RNA, 16 nt, Chlamydophila pneumoniae CWL029
cuauccgcacucauag

SEQ ID NO: 491010 - RNA, 18 nt, Chlamydophila pneumoniae CWL029
cuccuccaaugagcucua

SEQ ID NO: 491011 - RNA, 18 nt, Chlamydophila pneumoniae CWL029
cuccauuuagacaagaca

SEQ ID NO: 491012 - RNA, 23 nt, Chlamydophila pneumoniae CWL029
cucgaggggacggaaaaucacac

SEQ ID NO: 491013 - RNA, 18 nt, Chlamydophila pneumoniae CWL029
cugcauauugcucuugua

SEQ ID NO: 491014 - RNA, 18 nt, Chlamydophila pneumoniae CWL029
cugcauaaucucaccaga

SEQ ID NO: 491015 - RNA, 19 nt, Chlamydophila pneumoniae CWL029
cugcagcguuucuagggac

SEQ ID NO: 491016 - RNA, 22 nt, Chlamydophila pneumoniae CWL029
cugacguuguguagcugaaauc

SEQ ID NO: 491017 - RNA, 19 nt, Chlamydophila pneumoniae CWL029
cugacucuuuuaagacaau

SEQ ID NO: 491018 - RNA, 20 nt, Chlamydophila pneumoniae CWL029
cugagagauagguuuuugua

SEQ ID NO: 491019 - RNA, 18 nt, Chlamydophila pneumoniae CWL029
cugauacaucaucagaag

SEQ ID NO: 491020 - RNA, 15 nt, Chlamydophila pneumoniae CWL029
cugaacaucuccagc

SEQ ID NO: 491021 - RNA, 18 nt, Chlamydophila pneumoniae CWL029
cucuugcgaacuauccua

SEQ ID NO: 491022 - RNA, 16 nt, Chlamydophila pneumoniae CWL029
cucuaagaaucuauag

SEQ ID NO: 491023 - RNA, 20 nt, Chlamydophila pneumoniae CWL029
cugaaucagcuuaucuauag

SEQ ID NO: 491024 - RNA, 17 nt, Chlamydophila pneumoniae CWL029
cugacaaauagaaagga

SEQ ID NO: 491025 - RNA, 15 nt, Chlamydophila pneumoniae CWL029
cugacacagagcuuc

SEQ ID NO: 491026 - RNA, 16 nt, Chlamydophila pneumoniae CWL029
cguucuuucaauaaca

SEQ ID NO: 491027 - RNA, 14 nt, Chlamydophila pneumoniae CWL029
cgugaacaaaaucg

SEQ ID NO: 491028 - RNA, 13 nt, Chlamydophila pneumoniae CWL029
aacccuauuuaag

SEQ ID NO: 491029 - RNA, 18 nt, Chlamydophila pneumoniae CWL029
aacccgauacauccucac

SEQ ID NO: 491030 - RNA, 20 nt, Chlamydophila pneumoniae CWL029
gaauucucagaaagccuuug

SEQ ID NO: 491031 - RNA, 14 nt, Chlamydophila pneumoniae CWL029
gaauucugaugacc

SEQ ID NO: 491032 - RNA, 17 nt, Chlamydophila pneumoniae CWL029
gaauucuuuaaaaucuu

SEQ ID NO: 491033 - RNA, 15 nt, Chlamydophila pneumoniae CWL029
gaauugucaucucau

SEQ ID NO: 491034 - RNA, 15 nt, Chlamydophila pneumoniae CWL029
gaauccuguucuaca

SEQ ID NO: 491035 - RNA, 23 nt, Chlamydophila pneumoniae CWL029
gaaguuuuuuaagugcuuuuaga

SEQ ID NO: 491036 - RNA, 14 nt, Chlamydophila pneumoniae CWL029
gaaguuuuuucucu

SEQ ID NO: 491037 - RNA, 16 nt, Chlamydophila pneumoniae CWL029
gacauacaucaaaaug

SEQ ID NO: 491038 - RNA, 14 nt, Chlamydophila pneumoniae CWL029
aacgauuucuucuu

SEQ ID NO: 491039 - RNA, 14 nt, Chlamydophila pneumoniae CWL029
gaccuguuuucuuu

SEQ ID NO: 491040 - RNA, 12 nt, Chlamydophila pneumoniae CWL029
gaccuucucuuc

SEQ ID NO: 491041 - RNA, 20 nt, Chlamydophila pneumoniae CWL029
gacgcucuaaacucucuucc

SEQ ID NO: 491042 - RNA, 17 nt, Chlamydophila pneumoniae CWL029
gaacguacucuucuuuu

SEQ ID NO: 491043 - RNA, 13 nt, Chlamydophila pneumoniae CWL029
gaacuaacuguaa

SEQ ID NO: 491044 - RNA, 21 nt, Chlamydophila pneumoniae CWL029
gaacaacgcugcuucucuacu

SEQ ID NO: 491045 - RNA, 20 nt, Chlamydophila pneumoniae CWL029
gaaauuaaguaggccuccuu

SEQ ID NO: 491046 - RNA, 14 nt, Chlamydophila pneumoniae CWL029
gaaauccacagaua

SEQ ID NO: 491047 - RNA, 18 nt, Chlamydophila pneumoniae CWL029
aaccugugaaaauuuucu

SEQ ID NO: 491048 - RNA, 14 nt, Chlamydophila pneumoniae CWL029
gaaaacuucaaaag

SEQ ID NO: 491049 - RNA, 20 nt, Chlamydophila pneumoniae CWL029
gaaaaagccuaugggaggaa

SEQ ID NO: 491050 - RNA, 13 nt, Chlamydophila pneumoniae CWL029
gaaaacgcccucu

SEQ ID NO: 491051 - RNA, 13 nt, Chlamydophila pneumoniae CWL029
gaaaaaauaucuc

SEQ ID NO: 491052 - RNA, 14 nt, Chlamydophila pneumoniae CWL029
cuuuucguauagag

SEQ ID NO: 491053 - RNA, 23 nt, Chlamydophila pneumoniae CWL029
cuuuugcugcagcaaaacuagga

SEQ ID NO: 491054 - RNA, 19 nt, Chlamydophila pneumoniae CWL029
cuuuuguuugucuuccaua

SEQ ID NO: 491055 - RNA, 21 nt, Chlamydophila pneumoniae CWL029
cuuuuuaguauacuaagacug

SEQ ID NO: 491056 - RNA, 17 nt, Chlamydophila pneumoniae CWL029
cuuugucuaugauugcu

SEQ ID NO: 491057 - RNA, 15 nt, Chlamydophila pneumoniae CWL029
cuuucuuauuacaga

SEQ ID NO: 491058 - RNA, 22 nt, Chlamydophila pneumoniae CWL029
cuuucuuuaaagaauagcauga

SEQ ID NO: 491059 - RNA, 14 nt, Chlamydophila pneumoniae CWL029
cuuugacuuucaua

SEQ ID NO: 491060 - RNA, 18 nt, Chlamydophila pneumoniae CWL029
cuuucguuuucuagcaua

SEQ ID NO: 491061 - RNA, 23 nt, Chlamydophila pneumoniae CWL029
cuuuccauaaagccccacccacu

SEQ ID NO: 491062 - RNA, 21 nt, Chlamydophila pneumoniae CWL029
cuuucauucccuuuuuccaua

SEQ ID NO: 491063 - RNA, 14 nt, Chlamydophila pneumoniae CWL029
cuuuaccagaaaug

SEQ ID NO: 491064 - RNA, 21 nt, Chlamydophila pneumoniae CWL029
cuuuaagguugcuuuucuagg

SEQ ID NO: 491065 - RNA, 14 nt, Chlamydophila pneumoniae CWL029
cuuuacuaacaaaa

SEQ ID NO: 491066 - RNA, 16 nt, Chlamydophila pneumoniae CWL029
cuuuagaauccugacc

SEQ ID NO: 491067 - RNA, 11 nt, Chlamydophila pneumoniae CWL029
cuuuagggaag

SEQ ID NO: 491068 - RNA, 15 nt, Chlamydophila pneumoniae CWL029
cuuuaacaaaguuua

SEQ ID NO: 491069 - RNA, 22 nt, Chlamydophila pneumoniae CWL029
cuucguuucuuugaguuaagca

SEQ ID NO: 491070 - RNA, 18 nt, Chlamydophila pneumoniae CWL029
cuugcuuuuuugaaagcu

SEQ ID NO: 491071 - RNA, 14 nt, Chlamydophila pneumoniae CWL029
cuugcucugaagcu

SEQ ID NO: 491072 - RNA, 18 nt, Chlamydophila pneumoniae CWL029
cuugcucaggagauacaa

SEQ ID NO: 491073 - RNA, 20 nt, Chlamydophila pneumoniae CWL029
cuucgcaaucuuugaucgcu

SEQ ID NO: 491074 - RNA, 20 nt, Chlamydophila pneumoniae CWL029
cuuccuuaaccuccucaaga

SEQ ID NO: 491075 - RNA, 13 nt, Chlamydophila pneumoniae CWL029
cuucaugcugcuu

SEQ ID NO: 491076 - RNA, 18 nt, Chlamydophila pneumoniae CWL029
cuucauugcaaaaaugaa

SEQ ID NO: 491077 - RNA, 23 nt, Chlamydophila pneumoniae CWL029
cuucaaugaagaaaaaucuacau

SEQ ID NO: 491078 - RNA, 16 nt, Chlamydophila pneumoniae CWL029
cuuaucuaaagaaaug

SEQ ID NO: 491079 - RNA, 21 nt, Chlamydophila pneumoniae CWL029
cuuaucuaggucgauauccca

SEQ ID NO: 491080 - RNA, 12 nt, Chlamydophila pneumoniae CWL029
cuuaucucuuuc

SEQ ID NO: 491081 - RNA, 23 nt, Chlamydophila pneumoniae CWL029
cuuaaagcuugagaaaagguaac

SEQ ID NO: 491082 - RNA, 13 nt, Chlamydophila pneumoniae CWL029
cuuaaccuccuca

SEQ ID NO: 491083 - RNA, 17 nt, Chlamydophila pneumoniae CWL029
cuuaagaguuuuacauc

SEQ ID NO: 491084 - RNA, 23 nt, Chlamydophila pneumoniae CWL029
cugugagcucucgacgaacaugc

SEQ ID NO: 491085 - RNA, 22 nt, Chlamydophila pneumoniae CWL029
cuguagccccggucgucuuaga

SEQ ID NO: 491086 - RNA, 21 nt, Chlamydophila pneumoniae CWL029
cuggcuaaaggaucauuaaag

SEQ ID NO: 491087 - RNA, 20 nt, Chlamydophila pneumoniae CWL029
aagcaaggcugccagagauu

SEQ ID NO: 491088 - RNA, 13 nt, Chlamydophila pneumoniae CWL029
aagauuuuuucuu

SEQ ID NO: 491089 - RNA, 13 nt, Chlamydophila pneumoniae CWL029
aagauauucaaga

SEQ ID NO: 491090 - RNA, 16 nt, Chlamydophila pneumoniae CWL029
gccaauuuuuguagac

SEQ ID NO: 491091 - RNA, 15 nt, Chlamydophila pneumoniae CWL029
aagaauuucauaaga

SEQ ID NO: 491092 - RNA, 20 nt, Chlamydophila pneumoniae CWL029
gccauuccauggauauggaa

SEQ ID NO: 491093 - RNA, 21 nt, Chlamydophila pneumoniae CWL029
aagacgacacucaaaucuuuc

SEQ ID NO: 491094 - RNA, 16 nt, Chlamydophila pneumoniae CWL029
aagaaagcuugucaua

SEQ ID NO: 491095 - RNA, 15 nt, Chlamydophila pneumoniae CWL029
aagaaaucaguccua

SEQ ID NO: 491096 - RNA, 19 nt, Chlamydophila pneumoniae CWL029
aagaaaugcccugucacua

SEQ ID NO: 491097 - RNA, 21 nt, Chlamydophila pneumoniae CWL029
aagaagaucaaagauuccuaa

SEQ ID NO: 491098 - RNA, 20 nt, Chlamydophila pneumoniae CWL029
gcaggugugugguaaaaaua

SEQ ID NO: 491099 - RNA, 14 nt, Chlamydophila pneumoniae CWL029
aacuuuugaauuaa

SEQ ID NO: 491100 - RNA, 12 nt, Chlamydophila pneumoniae CWL029
aacuuucuucuc

SEQ ID NO: 491101 - RNA, 20 nt, Chlamydophila pneumoniae CWL029
aacuuucuuuuugagauaau

SEQ ID NO: 491102 - RNA, 16 nt, Chlamydophila pneumoniae CWL029
gcaacagguaagacga

SEQ ID NO: 491103 - RNA, 14 nt, Chlamydophila pneumoniae CWL029
gauuuuucaagacc

SEQ ID NO: 491104 - RNA, 16 nt, Chlamydophila pneumoniae CWL029
gauuuauuuugucuuu

SEQ ID NO: 491105 - RNA, 12 nt, Chlamydophila pneumoniae CWL029
gcaaagaaaauu

SEQ ID NO: 491106 - RNA, 23 nt, Chlamydophila pneumoniae CWL029
gcaaagaacucaacuuuuuuacu

SEQ ID NO: 491107 - RNA, 18 nt, Chlamydophila pneumoniae CWL029
gauucggggagagaacuu

SEQ ID NO: 491108 - RNA, 16 nt, Chlamydophila pneumoniae CWL029
gauugauccacagauc

SEQ ID NO: 491109 - RNA, 20 nt, Chlamydophila pneumoniae CWL029
aacuucaacuucuccaacua

SEQ ID NO: 491110 - RNA, 17 nt, Chlamydophila pneumoniae CWL029
gaugauccgcauuuccu

SEQ ID NO: 491111 - RNA, 19 nt, Chlamydophila pneumoniae CWL029
gaugauccacugcuuuagg

SEQ ID NO: 491112 - RNA, 20 nt, Chlamydophila pneumoniae CWL029
gaucuuuauuuuuaaaaaua

SEQ ID NO: 491113 - RNA, 18 nt, Chlamydophila pneumoniae CWL029
gaucuucagagagaacag

SEQ ID NO: 491114 - RNA, 19 nt, Chlamydophila pneumoniae CWL029
gaucuugagaaaagaacag

SEQ ID NO: 491115 - RNA, 17 nt, Chlamydophila pneumoniae CWL029
gaucucuaguucuagaa

SEQ ID NO: 491116 - RNA, 17 nt, Chlamydophila pneumoniae CWL029
gaucucaguaggagcag

SEQ ID NO: 491117 - RNA, 17 nt, Chlamydophila pneumoniae CWL029
gaucaggauucuaaaaa

SEQ ID NO: 491118 - RNA, 14 nt, Chlamydophila pneumoniae CWL029
gauaucaucaaaag

SEQ ID NO: 491119 - RNA, 16 nt, Chlamydophila pneumoniae CWL029
gauaucaaagcauugc

SEQ ID NO: 491120 - RNA, 20 nt, Chlamydophila pneumoniae CWL029
gauacguuuuucccuuuaaa

SEQ ID NO: 491121 - RNA, 23 nt, Chlamydophila pneumoniae CWL029
gaguaccgaccgaaucucuccag

SEQ ID NO: 491122 - RNA, 15 nt, Chlamydophila pneumoniae CWL029
gauaaauggaggaua

SEQ ID NO: 491123 - RNA, 20 nt, Chlamydophila pneumoniae CWL029
gaggucuuuucuuuuuagaa

SEQ ID NO: 491124 - RNA, 19 nt, Chlamydophila pneumoniae CWL029
gaggguggaacuauccugu

SEQ ID NO: 491125 - RNA, 19 nt, Chlamydophila pneumoniae CWL029
gagcuucacaucuuucucu

SEQ ID NO: 491126 - RNA, 22 nt, Chlamydophila pneumoniae CWL029
gagcuuccauuggaauccuuug

SEQ ID NO: 491127 - RNA, 20 nt, Chlamydophila pneumoniae CWL029
gagcuuuuagguagagaauc

SEQ ID NO: 491128 - RNA, 23 nt, Chlamydophila pneumoniae CWL029
gaggaccgaaaaaccuucuccaa

SEQ ID NO: 491129 - RNA, 16 nt, Chlamydophila pneumoniae CWL029
gaggagccuccauaau

SEQ ID NO: 491130 - RNA, 16 nt, Chlamydophila pneumoniae CWL029
gagcucgcaaaagcug

SEQ ID NO: 491131 - RNA, 11 nt, Chlamydophila pneumoniae CWL029
gagcuaagucu

SEQ ID NO: 491132 - RNA, 12 nt, Chlamydophila pneumoniae CWL029
gagcucuaaaaa

SEQ ID NO: 491133 - RNA, 17 nt, Chlamydophila pneumoniae CWL029
gagcucgcaaaagcugu

SEQ ID NO: 491134 - RNA, 14 nt, Chlamydophila pneumoniae CWL029
aacugauuaguuug

SEQ ID NO: 491135 - RNA, 20 nt, Chlamydophila pneumoniae CWL029
gacguaauuacgcucuccau

SEQ ID NO: 491136 - RNA, 16 nt, Chlamydophila pneumoniae CWL029
gcuuuucugcuccuga

SEQ ID NO: 491137 - RNA, 18 nt, Chlamydophila pneumoniae CWL029
ggaaaaacaaaccuccua

SEQ ID NO: 491138 - RNA, 18 nt, Chlamydophila pneumoniae CWL029
ggaaaaagccuuucuuau

SEQ ID NO: 491139 - RNA, 17 nt, Chlamydophila pneumoniae CWL029
gcuucgggaucuaaaag

SEQ ID NO: 491140 - RNA, 15 nt, Chlamydophila pneumoniae CWL029
gcuguggaauuuucc

SEQ ID NO: 491141 - RNA, 22 nt, Chlamydophila pneumoniae CWL029
gcugaaagaaugccauucuuau

SEQ ID NO: 491142 - RNA, 14 nt, Chlamydophila pneumoniae CWL029
gcucuccaaaggga

SEQ ID NO: 491143 - RNA, 19 nt, Chlamydophila pneumoniae CWL029
gcugauccagcuccauaag

SEQ ID NO: 491144 - RNA, 14 nt, Chlamydophila pneumoniae CWL029
gcuccaaaauaauc

SEQ ID NO: 491145 - RNA, 17 nt, Chlamydophila pneumoniae CWL029
gcuccacggaaauauuc

SEQ ID NO: 491146 - RNA, 18 nt, Chlamydophila pneumoniae CWL029
aaggaccacaauuccuaa

SEQ ID NO: 491147 - RNA, 13 nt, Chlamydophila pneumoniae CWL029
gccuuuagggaaa

SEQ ID NO: 491148 - RNA, 20 nt, Chlamydophila pneumoniae CWL029
gugaauaucaucacuaagau

SEQ ID NO: 491149 - RNA, 18 nt, Chlamydophila pneumoniae CWL029
gugacgacaaaucacgac

SEQ ID NO: 491150 - RNA, 19 nt, Chlamydophila pneumoniae CWL029
gucuucaauagaacgaauu

SEQ ID NO: 491151 - RNA, 13 nt, Chlamydophila pneumoniae CWL029
gucgucuuuuaaa

SEQ ID NO: 491152 - RNA, 23 nt, Chlamydophila pneumoniae CWL029
gucauaaagaucgugaucaaaga

SEQ ID NO: 491153 - RNA, 14 nt, Chlamydophila pneumoniae CWL029
guaggccuccuuca

SEQ ID NO: 491154 - RNA, 14 nt, Chlamydophila pneumoniae CWL029
guagagagaaucga

SEQ ID NO: 491155 - RNA, 16 nt, Chlamydophila pneumoniae CWL029
guaaagagcuucuucu

SEQ ID NO: 491156 - RNA, 13 nt, Chlamydophila pneumoniae CWL029
guacguuuucucu

SEQ ID NO: 491157 - RNA, 17 nt, Chlamydophila pneumoniae CWL029
guaccacauacucuuca

SEQ ID NO: 491158 - RNA, 19 nt, Chlamydophila pneumoniae CWL029
ggucuuuguucgcuccuaa

SEQ ID NO: 491159 - RNA, 15 nt, Chlamydophila pneumoniae CWL029
aaguaggaauuuuca

SEQ ID NO: 491160 - RNA, 17 nt, Chlamydophila pneumoniae CWL029
gggaaaguaccuuuaac

SEQ ID NO: 491161 - RNA, 14 nt, Chlamydophila pneumoniae CWL029
ggcucaaagaaagu

SEQ ID NO: 491162 - RNA, 23 nt, Chlamydophila pneumoniae CWL029
ggcuccucguuaauaagaaccuc

SEQ ID NO: 491163 - RNA, 19 nt, Chlamydophila pneumoniae CWL029
ggauugcuucgggaucuaa

SEQ ID NO: 491164 - RNA, 22 nt, Chlamydophila pneumoniae CWL029
ggcacccaaacugaugccaaga

SEQ ID NO: 491165 - RNA, 21 nt, Chlamydophila pneumoniae CWL029
ggaaaucuaaacaguaggcga

SEQ ID NO: 491166 - RNA, 14 nt, Chlamydophila pneumoniae CWL029
ggaacaaagcucuc

SEQ ID NO: 491167 - RNA, 20 nt, Chlamydophila pneumoniae CWL029
aaccauagagagccuuuccu

SEQ ID NO: 491168 - RNA, 15 nt, Chlamydophila pneumoniae CWL029
aaccaauugagcucu

SEQ ID NO: 491169 - RNA, 20 nt, Chlamydophila pneumoniae CWL029
aaccacggauuuucucuaca

SEQ ID NO: 491170 - RNA, 23 nt, Chlamydophila pneumoniae CWL029
aaccacuguccaugcacgagauu

SEQ ID NO: 491171 - RNA, 16 nt, Chlamydophila pneumoniae CWL029
aacauaucgauaggau

SEQ ID NO: 491172 - RNA, 15 nt, Chlamydophila pneumoniae CWL029
aacaucacucaggau

SEQ ID NO: 491173 - RNA, 16 nt, Chlamydophila pneumoniae CWL029
cggaaauugaauaucg

SEQ ID NO: 491174 - RNA, 20 nt, Chlamydophila pneumoniae CWL029
cgcuuucgggaauaauagga

SEQ ID NO: 491175 - RNA, 13 nt, Chlamydophila pneumoniae CWL029
cgaguuucgauau

SEQ ID NO: 491176 - RNA, 17 nt, Chlamydophila pneumoniae CWL029
aacacccggcuuuucca

SEQ ID NO: 491177 - RNA, 22 nt, Chlamydophila pneumoniae CWL029
aacaacaugcgcguauaaggau

SEQ ID NO: 491178 - RNA, 22 nt, Chlamydophila pneumoniae CWL029
cgacaagacaaugacuguagga

SEQ ID NO: 491179 - RNA, 24 nt, Chlamydophila pneumoniae CWL029
cgauuauuucuuguugcaauagca

SEQ ID NO: 491180 - RNA, 15 nt, Chlamydophila pneumoniae CWL029
ccugaguauccgaau

SEQ ID NO: 491181 - RNA, 20 nt, Chlamydophila pneumoniae CWL029
ccugacucuuuuaagacaau

SEQ ID NO: 491182 - RNA, 12 nt, Chlamydophila pneumoniae CWL029
ccuccaaaauca

SEQ ID NO: 491183 - RNA, 12 nt, Chlamydophila pneumoniae CWL029
ccuccauuuaga

SEQ ID NO: 491184 - RNA, 22 nt, Chlamydophila pneumoniae CWL029
ccucgcaauccaggaauagaaa

SEQ ID NO: 491185 - RNA, 20 nt, Chlamydophila pneumoniae CWL029
aaauuuccgcuguauuuuca

SEQ ID NO: 491186 - RNA, 19 nt, Chlamydophila pneumoniae CWL029
ccggagcuucuaagaucuu

SEQ ID NO: 491187 - RNA, 15 nt, Chlamydophila pneumoniae CWL029
ccgaaucucuccagc

SEQ ID NO: 491188 - RNA, 19 nt, Chlamydophila pneumoniae CWL029
aaaucucgagaagacccua

SEQ ID NO: 491189 - RNA, 22 nt, Chlamydophila pneumoniae CWL029
aaaucucagugaacucuucaag

SEQ ID NO: 491190 - RNA, 22 nt, Chlamydophila pneumoniae CWL029
aaaucuggggcuuccagaaaca

SEQ ID NO: 491191 - RNA, 11 nt, Chlamydophila pneumoniae CWL029
cccauuccugc

SEQ ID NO: 491192 - RNA, 12 nt, Chlamydophila pneumoniae CWL029
cccaaagcagau

SEQ ID NO: 491193 - RNA, 22 nt, Chlamydophila pneumoniae CWL029
ccccaaacauggacaauauaga

SEQ ID NO: 491194 - RNA, 20 nt, Chlamydophila pneumoniae CWL029
aaaucccgagauaugaagag

SEQ ID NO: 491195 - RNA, 13 nt, Chlamydophila pneumoniae CWL029
aaaguaucuucag

SEQ ID NO: 491196 - RNA, 20 nt, Chlamydophila pneumoniae CWL029
aaaguuugagcuaagcugaa

SEQ ID NO: 491197 - RNA, 15 nt, Chlamydophila pneumoniae CWL029
aaaggaucauuaaag

SEQ ID NO: 491198 - RNA, 16 nt, Chlamydophila pneumoniae CWL029
aaagcucuuucauaag

SEQ ID NO: 491199 - RNA, 20 nt, Chlamydophila pneumoniae CWL029
aaagcguuucgauaauuuuc

SEQ ID NO: 491200 - RNA, 20 nt, Chlamydophila pneumoniae CWL029
aaagcuacggaugggcacuc

SEQ ID NO: 491201 - RNA, 11 nt, Chlamydophila pneumoniae CWL029
ccacagagaau

SEQ ID NO: 491202 - RNA, 17 nt, Chlamydophila pneumoniae CWL029
ccacagacugcaggaaa

SEQ ID NO: 491203 - RNA, 17 nt, Chlamydophila pneumoniae CWL029
aaagccucgaaauuuuc

SEQ ID NO: 491204 - RNA, 16 nt, Chlamydophila pneumoniae CWL029
aaagccuaugauaaag

SEQ ID NO: 491205 - RNA, 20 nt, Chlamydophila pneumoniae CWL029
caugaaguccuguauauucu

SEQ ID NO: 491206 - RNA, 19 nt, Chlamydophila pneumoniae CWL029
caucuucuuggcuuucccc

SEQ ID NO: 491207 - RNA, 15 nt, Chlamydophila pneumoniae CWL029
cagugugcugauuuu

SEQ ID NO: 491208 - RNA, 18 nt, Chlamydophila pneumoniae CWL029
cauaacauuuagauaaag

SEQ ID NO: 491209 - RNA, 17 nt, Chlamydophila pneumoniae CWL029
cauaaccuccucuucuu

SEQ ID NO: 491210 - RNA, 21 nt, Chlamydophila pneumoniae CWL029
caucaaucacucuaugaucua

SEQ ID NO: 491211 - RNA, 15 nt, Chlamydophila pneumoniae CWL029
caucacaaucgugau

SEQ ID NO: 491212 - RNA, 18 nt, Chlamydophila pneumoniae CWL029
caucaggcggaugaccuu

SEQ ID NO: 491213 - RNA, 17 nt, Chlamydophila pneumoniae CWL029
aaagauuauucuagagu

SEQ ID NO: 491214 - RNA, 13 nt, Chlamydophila pneumoniae CWL029
cagcaaauacucc

SEQ ID NO: 491215 - RNA, 22 nt, Chlamydophila pneumoniae CWL029
cagaucguaaucuguauaugcu

SEQ ID NO: 491216 - RNA, 22 nt, Chlamydophila pneumoniae CWL029
cagaucauaucggcagcagcau

SEQ ID NO: 491217 - RNA, 15 nt, Chlamydophila pneumoniae CWL029
cagaggaaucuaaga

SEQ ID NO: 491218 - RNA, 22 nt, Chlamydophila pneumoniae CWL029
aaagacaucucuuuaacuucua

SEQ ID NO: 491219 - RNA, 12 nt, Chlamydophila pneumoniae CWL029
aaagaucugaau

SEQ ID NO: 491220 - RNA, 18 nt, Chlamydophila pneumoniae CWL029
aaagaguuuguucacauu

SEQ ID NO: 491221 - RNA, 23 nt, Chlamydophila pneumoniae CWL029
cagacacaaaaagcuuuuuucuc

SEQ ID NO: 491222 - RNA, 21 nt, Chlamydophila pneumoniae CWL029
cacuauguguuuccuuuucuc

SEQ ID NO: 491223 - RNA, 23 nt, Chlamydophila pneumoniae CWL029
caccuuaauggcuccuacuccua

SEQ ID NO: 491224 - RNA, 19 nt, Chlamydophila pneumoniae CWL029
cacaucuuucucuaaaaua

SEQ ID NO: 491225 - RNA, 10 nt, Chlamydophila pneumoniae CWL029
cacagagaac

SEQ ID NO: 491226 - RNA, 15 nt, Chlamydophila pneumoniae CWL029
cacagagaacaauaa

SEQ ID NO: 491227 - RNA, 16 nt, Chlamydophila pneumoniae CWL029
cacagagaccuucucu

SEQ ID NO: 491228 - RNA, 23 nt, Chlamydophila pneumoniae CWL029
caccagaagcaacuaaacucucc

SEQ ID NO: 491229 - RNA, 18 nt, Chlamydophila pneumoniae CWL029
caauguuaaucuaauuuu

SEQ ID NO: 491230 - RNA, 17 nt, Chlamydophila pneumoniae CWL029
caauuggaggauaaaug

SEQ ID NO: 491231 - RNA, 15 nt, Chlamydophila pneumoniae CWL029
cacaacucuuuaauu

SEQ ID NO: 491232 - RNA, 14 nt, Chlamydophila pneumoniae CWL029
caaugaagaaaaau

SEQ ID NO: 491233 - RNA, 15 nt, Chlamydophila pneumoniae CWL029
caauaccagauaaag

SEQ ID NO: 491234 - RNA, 17 nt, Chlamydophila pneumoniae CWL029
caagcacuuucgcaaaa

SEQ ID NO: 491235 - RNA, 19 nt, Chlamydophila pneumoniae CWL029
caauaaacaacgaucguca

SEQ ID NO: 491236 - RNA, 23 nt, Chlamydophila pneumoniae CWL029
caauaaacgagacugcaaaggaa

SEQ ID NO: 491237 - RNA, 19 nt, Chlamydophila pneumoniae CWL029
caauaagcuugccagcaga

SEQ ID NO: 491238 - RNA, 21 nt, Chlamydophila pneumoniae CWL029
caauaaucacuguuugauuau

SEQ ID NO: 491239 - RNA, 18 nt, Chlamydophila pneumoniae CWL029
caagugcauuaucuaaga

SEQ ID NO: 491240 - RNA, 21 nt, Chlamydophila pneumoniae CWL029
caaguguucgaguucuuuagc

SEQ ID NO: 491241 - RNA, 19 nt, Chlamydophila pneumoniae CWL029
caaguucuaccuauauuuc

SEQ ID NO: 491242 - RNA, 13 nt, Chlamydophila pneumoniae CWL029
caauaaaaaagag

SEQ ID NO: 491243 - RNA, 18 nt, Chlamydophila pneumoniae CWL029
caaaucauuuaaagcuga

SEQ ID NO: 491244 - RNA, 17 nt, Chlamydophila pneumoniae CWL029
caaagaauucagagaaa

SEQ ID NO: 491245 - RNA, 19 nt, Chlamydophila pneumoniae CWL029
caaagaacugcauaaucuc

SEQ ID NO: 491246 - RNA, 22 nt, Chlamydophila pneumoniae CWL029
caaagaugacgagcccuagaua

SEQ ID NO: 491247 - RNA, 14 nt, Chlamydophila pneumoniae CWL029
caaagauaaagaag

SEQ ID NO: 491248 - RNA, 23 nt, Chlamydophila pneumoniae CWL029
caaaaugucuuuuucaauugcuc

SEQ ID NO: 491249 - RNA, 17 nt, Chlamydophila pneumoniae CWL029
auuuuucaagaacuccu

SEQ ID NO: 491250 - RNA, 22 nt, Chlamydophila pneumoniae CWL029
auuuuugcuuuaaaauccagga

SEQ ID NO: 491251 - RNA, 17 nt, Chlamydophila pneumoniae CWL029
auuuugacuugucccaa

SEQ ID NO: 491252 - RNA, 22 nt, Chlamydophila pneumoniae CWL029
caaaaauaaacauauucuccuu

SEQ ID NO: 491253 - RNA, 20 nt, Chlamydophila pneumoniae CWL029
auuugaaccuccgcccccuu

SEQ ID NO: 491254 - RNA, 16 nt, Chlamydophila pneumoniae CWL029
auuuguagcucccaua

SEQ ID NO: 491255 - RNA, 14 nt, Chlamydophila pneumoniae CWL029
auuuuacgaaucuu

SEQ ID NO: 491256 - RNA, 22 nt, Chlamydophila pneumoniae CWL029
auuuauaguggcgaauccuaga

SEQ ID NO: 491257 - RNA, 15 nt, Chlamydophila pneumoniae CWL029
auuucuaguuguccu

SEQ ID NO: 491258 - RNA, 22 nt, Chlamydophila pneumoniae CWL029
auuucuccaguaucuucucuua

SEQ ID NO: 491259 - RNA, 21 nt, Chlamydophila pneumoniae CWL029
auuucggaguuggaucaagga

SEQ ID NO: 491260 - RNA, 13 nt, Chlamydophila pneumoniae CWL029
auuuccuucucca

SEQ ID NO: 491261 - RNA, 16 nt, Chlamydophila pneumoniae CWL029
auuucauguaagaaug

SEQ ID NO: 491262 - RNA, 22 nt, Chlamydophila pneumoniae CWL029
auucuaacgcuuuuucaaacug

SEQ ID NO: 491263 - RNA, 13 nt, Chlamydophila pneumoniae CWL029
auucccuccuucc

SEQ ID NO: 491264 - RNA, 16 nt, Chlamydophila pneumoniae CWL029
auucccugacacagag

SEQ ID NO: 491265 - RNA, 12 nt, Chlamydophila pneumoniae CWL029
auuccauccugu

SEQ ID NO: 491266 - RNA, 18 nt, Chlamydophila pneumoniae CWL029
auuccagcugagcuaucu

SEQ ID NO: 491267 - RNA, 19 nt, Chlamydophila pneumoniae CWL029
auuccagcaucuucucgaa

SEQ ID NO: 491268 - RNA, 22 nt, Chlamydophila pneumoniae CWL029
auuccaagauugaauucaucca

SEQ ID NO: 491269 - RNA, 23 nt, Chlamydophila pneumoniae CWL029
auuacggcgugccuuuuuuucua

SEQ ID NO: 491270 - RNA, 16 nt, Chlamydophila pneumoniae CWL029
auguaagaaggcagag

SEQ ID NO: 491271 - RNA, 15 nt, Chlamydophila pneumoniae CWL029
augcuacaaacucuu

SEQ ID NO: 491272 - RNA, 20 nt, Chlamydophila pneumoniae CWL029
augcacgcuuucgucuaaaa

SEQ ID NO: 491273 - RNA, 14 nt, Chlamydophila pneumoniae CWL029
augcaaauuccaga

SEQ ID NO: 491274 - RNA, 13 nt, Chlamydophila pneumoniae CWL029
augacaaacucua

SEQ ID NO: 491275 - RNA, 16 nt, Chlamydophila pneumoniae CWL029
aucuugcucaggagau

SEQ ID NO: 491276 - RNA, 16 nt, Chlamydophila pneumoniae CWL029
aucuggggcuuccaga

SEQ ID NO: 491277 - RNA, 16 nt, Chlamydophila pneumoniae CWL029
aucucuuaaaauauua

SEQ ID NO: 491278 - RNA, 19 nt, Chlamydophila pneumoniae CWL029
aucucuuaaaauauuaaau

SEQ ID NO: 491279 - RNA, 20 nt, Chlamydophila pneumoniae CWL029
aucuggaaaagccucgaaau

SEQ ID NO: 491280 - RNA, 18 nt, Chlamydophila pneumoniae CWL029
aucugcuuuuaucucaau

SEQ ID NO: 491281 - RNA, 23 nt, Chlamydophila pneumoniae CWL029
aucgugcuuagagccuucucauu

SEQ ID NO: 491282 - RNA, 21 nt, Chlamydophila pneumoniae CWL029
aucuccauuuagaaugaccgc

SEQ ID NO: 491283 - RNA, 16 nt, Chlamydophila pneumoniae CWL029
aucucgcuauuccaua

SEQ ID NO: 491284 - RNA, 14 nt, Chlamydophila pneumoniae CWL029
auccuguagagcaa

SEQ ID NO: 491285 - RNA, 12 nt, Chlamydophila pneumoniae CWL029
auccgaagacuc

SEQ ID NO: 491286 - RNA, 19 nt, Chlamydophila pneumoniae CWL029
auccggaaggaguucuuuu

SEQ ID NO: 491287 - RNA, 17 nt, Chlamydophila pneumoniae CWL029
aucccuggauuucuucu

SEQ ID NO: 491288 - RNA, 21 nt, Chlamydophila pneumoniae CWL029
auccaguagaucuucugaaau

SEQ ID NO: 491289 - RNA, 21 nt, Chlamydophila pneumoniae CWL029
aucccaucaaaggcaauagca

SEQ ID NO: 491290 - RNA, 16 nt, Chlamydophila pneumoniae CWL029
auccaacaaagaugac

SEQ ID NO: 491291 - RNA, 14 nt, Chlamydophila pneumoniae CWL029
aucauuaagaagau

SEQ ID NO: 491292 - RNA, 15 nt, Chlamydophila pneumoniae CWL029
aucaugauaaaaauu

SEQ ID NO: 491293 - RNA, 17 nt, Chlamydophila pneumoniae CWL029
aucaucgcaaucaaaga

SEQ ID NO: 491294 - RNA, 13 nt, Chlamydophila pneumoniae CWL029
aucaucagaaauc

SEQ ID NO: 491295 - RNA, 15 nt, Chlamydophila pneumoniae CWL029
aucauaggcuauaau

SEQ ID NO: 491296 - RNA, 12 nt, Chlamydophila pneumoniae CWL029
aucauaaacagc

SEQ ID NO: 491297 - RNA, 15 nt, Chlamydophila pneumoniae CWL029
aucaguucaucuaga

SEQ ID NO: 491298 - RNA, 20 nt, Chlamydophila pneumoniae CWL029
aucaauaaguagauuaaagg

SEQ ID NO: 491299 - RNA, 22 nt, Chlamydophila pneumoniae CWL029
aucaauaaucggccgaguuucu

SEQ ID NO: 491300 - RNA, 20 nt, Chlamydophila pneumoniae CWL029
auauucaagaggaccgagau

SEQ ID NO: 491301 - RNA, 15 nt, Chlamydophila pneumoniae CWL029
aucaacauucuucug

SEQ ID NO: 491302 - RNA, 16 nt, Chlamydophila pneumoniae CWL029
auaccacuacugagcu

SEQ ID NO: 491303 - RNA, 19 nt, Chlamydophila pneumoniae CWL029
auaccacgcaucuuaagag
